United States Patent 9,675,668 (MODIFIED POLYNUCLEOTIDES ENCODING HEPATITIS A VIRUS CELLULAR RECEPTOR 2) - sequence listing, part 13

SEQ ID NO: 25489 - DNA, 3612 bp, Artificial Sequence
  Description of Artificial Sequence: Synthetic coding sequence
atggagcaggcgcctaacatggctgagcctcgaggaccagtggatcatggcgtccagattcgatttattactgagccggtctccggcgcggagatggggaccctgcggaggggaggtcgcagaccagccaaagatgcaagggcttcgacctatggtgtggctgtgagggtgcagggcatcgctggccagcccttcgtggtattaaacagtggcgaaaagggaggcgattctttcggcgtccagatcaagggagcaaacgaccaaggcgctagtggtgccttatcctccgacctggagttaccagagaacccttactcacaagtcaaaggtttccccgccccgtctcaatcctcaaccagcgacgaggagcccggtgcctactggaatgggaagttattacgatcacactcccaggctagcttagccgggcctggccccgtggatccgtccaaccgatctaatagcatgttagaacttgcaccgaaggtggcatctcctggttccacaatcgatacagccccactgtctagtgttgattcactcatcaataagttcgattcccagctgggcggtcaggcaagaggacgcaccgggcggcgaacccgaatgctgcctcctgaacagcggaaaagatccaaaagtctggattctaggctgccccgcgacactttcgaagagagagaacggcagagcactaatcactggacttcctccaccaagtacgataatcatgtgggcacaagcaaacagcctgcacagtctcagaatctttcccccctctcggggttctctcgctcaagacagacccaggactgggtcttgcagagcttcgaagaaccaagacgttctgctcaggatccgacaatgctgcagtttaagagtacccccgacttgttacgcgaccagcaagaggccgccccacccgggtctgttgaccatatgaaagcaacgatctacggaatcctgcgagagggttcatcagagagtgaaacaagtgtgcgtaggaaggtgtctttagtcctggagaagatgcagcctctcgtgatggtctcgagcggcagtactaaagcagtggccggacagggggaactcactaggaaggtggaggaacttcaaaggaagctcgatgaagaggtgaaaaagcggcagaagctggagccaagccaggtgggtctcgagagacagctggaggagaaaactgaagagtgttctaggctgcaggagttgttggagaggagaaagggcgaagcccagcagtctaataaggagctacagaatatgaaaagactcttggatcagggcgaagatctgcggcacggcctggagacccaggttatggaactgcagaacaagctgaaacacgtacagggtccggagcccgcaaaggaggtgctccttaaagacctcctggagactcgcgagcttctggaggaagttctggagggaaagcaacgggttgaagaacaattgaggctaagggagagagaattgactgcgctcaagggagccttgaaggaggaggtcgcctccagggaccaagaagtggaacacgtccgacagcagtatcaaagggataccgaacagctcagacgaagcatgcaagatgccacacaggatcatgcagtgctagaggctgaacgccagaaaatgtctgcactggtcaggggattacagcgggagttggaagaaacctcagaggagaccggccattggcagtccatgttccagaagaataaggaagacttgagagccacaaaacaagaactcctgcagctacgcatggaaaaagaggaaatggaagaggagctgggtgagaaaatagaggttcttcagagagaactggaacaagcccgcgcatccgccggggacacacgacaggtcgaggtactgaagaaggagctgttgaggacacaggaagaattgaaggaattgcaggcggaacgccagagtcaggaagtcgcagggcgacaccgtgaccgggagctcgaaaaacagttggcggtgctgagggttgaggccgatagaggcagagaactggaagagcagaatcttcagctccagaaaacgctgcagcaactgcgccaagactgtgaagaagcatcgaaggccaaaatggttgccgaggctgaggcaacggtacttgggcagcggcgggcagcggtggagaccacgttgcgggaaacacaggaggagaatgacgaatttaggaggcggatcttagggttggagcagcagttgaaagagacccgcggcctcgtagacggcggcgaagccgttgaagctcgactgcgggacaaactgcagcgactcgaggctgagaagcagcagctcgaggaggccttaaatgcgagccaggaagaggagggctcacttgccgcagccaaaagggccctggaagccaggcttgaggaagcgcaacggggcctggccagactgggacaagagcagcagaccctgaatcgcgccctcgaagaagaggggaagcaacgcgaagtgcttagaagagggaaggccgagctagaggaacagaagcgactcctcgataggacggtagatagactcaacaaggagctggaaaagatcggggaagactcaaagcaggccttgcagcagctccaggctcagttagaagattacaaagagaaggcccggagggaggtcgcggacgcacagcgacaagccaaggattgggcctcagaggccgagaagacgtccggagggctctccaggctccaagacgaaattcaacgattacgtcaagcgctgcaagcatcacaggctgagagggacactgctagacttgataaggagctattagcccagcgtctacaggggttggagcaagaagcagaaaacaaaaaacgaagccaggatgatcgcgccaggcagctgaagggccttgaggagaaggtgtccaggcttgagactgaacttgacgaggagaagaacacagtggagctgctaaccgaccgcgtgaatcgcggcagggatcaggtggaccagctcagaactgaacttatgcaagagcgcagcgctcgtcaagacctggagtgtgacaaaatctccctggagagacagaacaaggacctcaagactcggttggcttcgtccgagggtttccagaaacccagtgcctctctcagccagctagagtcccagaaccagctgctgcaggagcggttgcaggccgaggagcgagagaaaaccgtgcttcagtctacaaacagaaagctggagcggaaggtcaaggagctgagcatccaaatagaagatgaacgtcagcacgtgaacgatcaaaaggaccagctgtcactacgggtaaaggccttgaaacgacaggtggatgaagcggaggaggagatcgagcgtctggacggcctccgcaagaaagcccagcgggaggtcgaagaacagcacgaggtgaacgaacaactgcaagcgcgcatcaaatccctcgaaaaggatagctggcgtaaagcaagccggtcggccgccgagtccgcattgaaaaacgagggcctgtctagtgacgaagagttcgattccgtttatgacccgagctccattgccagcttgcttacagaatccaatcttcagaccagctcctgctag

SEQ ID NO: 25490 - DNA, 876 bp, Artificial Sequence
  Description of Artificial Sequence: Synthetic coding sequence
atggaacaagcacctaatatggccgaaccaagaggcccggtcgaccatggggtacagattagattcattacggaaccagtttctggggctgaaatgggtacattgcggagaggaggccgtagacctgcaaaggatgcccgtgctagcacatatggagtggcagtccgtgttcaaggcatcgccggtcagccttttgtggttttgaatagtggagagaagggcggtgactccttcggagtccagattaaaggagccaatgaccagggtgcttccggggcactgtcctctgatctcgagctccctgagaacccatatagtcaggtgaaggggtttcctgctccctcccaatcttcaactagcgacgaggagccaggggcttattggaacggtaaactgctgcgcagtcacagccaggcctcactcgccggcccgggccctgtggacccttctaaccgctcaaactccatgctagaattagcccctaaagttgccagccccgggtctacaatagatactgcccccctgtcttccgtcgactctttaattaataaatttgactcccagctgggtgggcaggcccgcgggagaactggacgtcggacccgaatgctgccccctgagcagcgcaagcgtagtaagagtttggacagccgccttcctagagacacattcgaggagcgggagcggcagtctacaaatcattggacatctagtactaaatacgacaatcacgtgggcacctctaagcagccagcgcagtcccagaatctgtctccactcagcggtttctcgcgatctcgtcaaactcaggattgggttttacagtcttttgaagagcctaggaggtctgcacaggatccgacaatgctgcagtag

SEQ ID NO: 25491 - DNA, 513 bp, Artificial Sequence
  Description of Artificial Sequence: Synthetic coding sequence
atggagcaggcgccgaatatggccgagccccggggacccgttgaccatggggtccaaatacggtttataaccgaacctgtctctggagctgaaatgggtacgctgcgccgtggcggcagacgccccgccaaagacgcgagggcaagtacatatggcgtggccgttcgggttcagggcatagccgggcaaccatttgtggtcttgaatagcggagaaaagggcggagatagctttggagtccagataaagggcgcaaacgaccaaggggctagcggtgccttgagctctgatctagagctgccagaaaatccatactctcaggtcaaaggattcccggccccgtctcagagcagcacaagcgatgaagaaccaggcgcgtactggaacggaaaacttctgagaagccatagccaggcctccctggcagggccaggcccagtggacccgtctaataggagcaactctatgcttgaactggctccaaaagtggcttccccaggttcaacaatctag

SEQ ID NO: 25492 - DNA, 513 bp, Artificial Sequence
  Description of Artificial Sequence: Synthetic coding sequence
atggagcaggctccgaatatggccgaaccaaggggacccgtggatcacggcgtgcaaattaggtttataacggagcccgtgtcgggggctgaaatggggacgctgaggcgcggcgggcggcggcccgccaaagacgcccgcgcctccacctacggagtggccgtccgagtccagggaatcgcagggcagcccttcgtcgttcttaattcaggtgagaaaggcggagattctttcggagttcaaattaagggcgccaatgaccagggcgccagcggcgccctctcaagcgacctggaacttccagagaacccttattcccaggtgaaggggtttcccgctccttcgcagtccagcacatccgatgaggagccaggcgcatattggaacgggaagctcctcagatctcattctcaggcttccctcgctgggcccggtcccgtggacccaagcaaccgtagtaattcaatgttagagctggcgcccaaagtggcatcccccggttcaacgatatag

SEQ ID NO: 25493 - DNA, 699 bp, Artificial Sequence
  Description of Artificial Sequence: Synthetic coding sequence
atgccaggctggtttaaaaaagcctggtatggtctggcttctctgctgtcgttctcttcctttatcctgatcatagtcgccctggtggtcccgcactggctaagcggcaaaattctttgtcagaccggcgtcgatctcgtgaatgccaccgatcgtgaactcgtaaagtttatcggcgacatctactatgggctcttccgcgggtgcaaagtacgacagtgcggtttggggggccggcaatcacagttcacaatattcccacatctggtgaaagagctgaatgccggcctacacgtgatgatccttctgttgctgttcctggcacttgccttagccctggtctccatgggcttcgctattttgaatatgattcaggtaccatatcgtgcggtgtcaggtccaggaggaatctgcttatggaatgttttggcgggaggggtggtggcacttgcaatagcctcattcgtggctgccgttaaatttcatgacctcacggagagaattgccaacttccaagagaagttattccaattcgtcgtagtcgaagaacagtacgaggagtcgttctggatttgtgttgccagcgcttccgcacacgctgctaaccttgtcgtcgtcgctatctcccagatcccgctgcctgagattaaaaccaagatcgaagaggctacagtcacagcagaggatattctctactag

SEQ ID NO: 25494 - DNA, 681 bp, Artificial Sequence
  Description of Artificial Sequence: Synthetic coding sequence
atgccaactaccaagaaaactctgatgtttctgagctcattctttactagtctgggttcgttcatcgttatatgcagcatcctggggacacaggcatggatcacaagtacaatcgcagttcgcgattctgcctctaatggaagtatcttcatcacctacgggctatttagaggagaatcatccgaggagctcagccatggtctggccgagcccaagaagaagttcgcagttctggagatcttgaacaacagcagccaaaaaacccttcacagtgtcactattctgtttctggtgttaagcctgatcacatctctgctgagcagcggcttcactttctacaactctatcagtaatccttaccagacgttccttggacctaccggtgtgtacacatggaatgggttgggagcttcatttgtcttcgttactatgatcctgttcgtcgccaacacccagagcaaccagctctctgaagaactgtttcaaatgctctaccctgccacaacaagcaaaggtactacacattcctacggatacagtttctggctgatcttgctggttattctgcttaatatcgtcaccgtaacaatcatcattttctatcagaaagccaggtaccagcggaagcaggagcagcggaagcctatggagtatgccccccgtgatggtatcctgttctag

SEQ ID NO: 25495 - DNA, 687 bp, Artificial Sequence
  Description of Artificial Sequence: Synthetic coding sequence
atggccagtacggcctccgaaattattgcattcatggtgagcatttcaggctgggttctggtctcctccactctgccgaccgattattggaaggtgagtacaatcgatggcaccgtcattacaacagctacctattgggccaacttatggaaggcatgtgtcaccgactccaccggagtttccaactgtaaagattttcccagtatgctggccctggatggttacatccaggcatgtcgtggattgatgattgctgcagtgagtttaggattttttggctccatctttgcgctctttggcatgaaatgcaccaaagtgggggggtcggataaggcaaaggccaagattgcgtgccttgccggtatcgtctttatactaagcggactttgctctatgaccggctgcagtctctacgccaataaaattactaccgaattttttgatccactgtttgtcgagcagaagtacgagttgggggccgccctatttattggctgggctggagccagcttgtgtatcatcgggggcgtcatcttctgtttcagcatatccgacaacaacaagacccctcgttatacctataatggagccacctccgtcatgtcctctcggacaaagtatcatggaggagaagattttaaaacgaccaacccaagcaaacagtttgacaagaacgcgtacgtctag

SEQ ID NO: 25496 - DNA, 222 bp, Artificial Sequence
  Description of Artificial Sequence: Synthetic coding sequence
atgatagccgccgtgtctctgggcttttttggatcaatatttgccctgttcggaatgaagtgtacaaaagtgggtggctctgacaaagctaaagccaaaatcgcctgcctcgccggtatcgtctttatcctgtccggcctctgtagcatgacggggtgctcactgtatgcaaacaaaatcacaaccgaattctttgatccactgttcgtcgagcagaaatag

SEQ ID NO: 25497 - DNA, 681 bp, Artificial Sequence
  Description of Artificial Sequence: Synthetic coding sequence
atgtctagagctcagatttgggcattggtgtcaggggtaggcggatttggcgctttggtggccgctaccactagcaatgaatggaaagtcactacacgtgcttcctctgttattacagctacctgggtgtaccaaggactatggatgaattgtgctggcaatgcactcggatctttccactgtaggccacacttcacaatcttcaaggtggctggatacatccaggcctgccgcggactcatgatcgctgcagtttccttgggctttttcgggtccatatttgccctgtttgggatgaagtgcactaaagtgggcggctccgataaggccaaggccaaaatcgcctgcttagccggcattgtcttcatcttgagtggcttgtgttccatgaccgggtgctccttgtatgctaacaagatcacgactgaatttttcgaccccttgttcgtggaacagaagtatgagctgggcgcagcactgttcataggttgggccggagcatctctttgcatcatcggcggtgtaatattttgtttttccatcagtgataacaacaagacaccccgctatacttataatggtgcaacatctgtcatgagcagtagaaccaaataccacggaggggaagattttaaaaccaccaatccctctaagcaatttgataaaaacgcttacgtgtag

SEQ ID NO: 25498 - DNA, 735 bp, Artificial Sequence
  Description of Artificial Sequence: Synthetic coding sequence
atgggctgcagagacgtccatgctgcgactgtgctttcattcctttgtggaatcgcttccgtagcagggctctttgccggaaccctcctgcccaactggcgaaagttgaggctcattaccttcaatagaaacgagaagaatctgaccgtttacaccggcttatgggtaaagtgcgctagatacgacggcagcagtgactgccttatgtacgacacaacatggtattccagtgttgatcagctcgacctgcgcgtactgcagttcgccttgcctcttagcatgttgattgccatgggtgcgctcctgctgtgtcttatcggaatgtgtaacacagcctttcgctcctcagtaccgaatatcaagctggccaagtgtctcgtcaattctgcaggctgtcacctggtggctggcctacttttctttctcgctgggactgtgagtctctctccctctatctgggtcatcttttacaatatccatctgaataaaaagttcgagcccgtttttagtttcgactacgccgtctacgtgaccatcgcctctgccggtggcttgtttatgacttctctgatcctgttcatctggtattgcacctgtaaatctctgccatcccccttctggcagcccctatacagtcatcccccctccatgcacacatactctcagccatactccgcacggagccggctgtcagctattgaaatagatattcccgtagtgtcccacaccacttag

SEQ ID NO: 25499 - DNA, 564 bp, Artificial Sequence
  Description of Artificial Sequence: Synthetic coding sequence
atggggtgtcgggatgttcacgccgcaactgtcctgtcgtttctttgtggtatcgcgagtgtggcaggtctgtttgccgggactcttttgcccaattggagaaagctaaggctgatcacttttaatcgtaacgagaaaaaccttaccgtttacacaggactttgggtgaaatgcgctcgctacgatggctcatccgattgccttatgtacgatactacttggtactcatccgtcgaccaactggatctgagagtgctgcagtttgccctccccttgtcaatgctgatcgcaatgggcgcccttctcctatgcctgattggcatgtgcaacactgcattccgcagctccgtaccaaacatcaaactggctaagtgcctcgtgaactcggccggatgccacctggtggctggtctgctcttctttctggctgggacagtgtccctcagtccaagcatatgggttatattctacaacatccatctgaataagaagtttgagcctgtgttctcctttgattatgccgtttacgtgaccatagcctccgcaggcgggctgtttatgtag

SEQ ID NO: 25500 - DNA, 735 bp, Artificial Sequence
  Description of Artificial Sequence: Synthetic coding sequence
atgggctgcagagatgtccacgccgcaactgtgttaagcttcctctgcggaatcgcctcagtagcaggtttattcgccgggaccttattaccgaattggcgaaaattaagactgattaccttcaatcgcaatgaaaaaaacctcaccgtgtacacaggcctctgggtcaaatgtgctcgctacgacggctcctccgattgtctgatgtacgatactacctggtattcctctgtcgatcagctcgatctgagagtcctccaattcgcactccctctgtctatgctcatcgctatgggcgcacttctgctctgtctgattggtatgtgtaatactgctttccgctccagcgtgcccaatattaaacttgcaaaatgtctcgtgaacagcgctgggtgtcacctagtggcaggactactattttttctggccggaactgtgagccttagccctagcatttgggtgattttttacaatattcatcttaacaagaaattcgaacctgtgttcagctttgactatgcggtttacgttacaatagcaagtgctggtggactatttatgacaagcctaattctatttatttggtattgcacctgtaaaagcctcccatctccattctggcagcccttgtactctcaccctcctagcatgcacacttactcacagccttattcagcaaggtcacggctgtcggctattgaaatcgatattcctgtggtttcccacacaacatag

SEQ ID NO: 25501 - DNA, 528 bp, Artificial Sequence
  Description of Artificial Sequence: Synthetic coding sequence
atgggttgcagagatgtgcacgcagcaacagtgttaagttttctctgcggtatcgcctccgtcgctggcctgtttgcggggactctcctccccaattggaggaaactccgactaatcacctttaataggaatgagaaaaacctgacagtgtacaccggcctgtgggtgaaatgcgcccgctacgatgggtctagtgattgtcttatgtacgacaccacatggtactcatccgtggatcaactggacctgcgcgtcttacagtttgcgctgccacttagcatgttgatagctatgggggctctgttgttatgcttaattggtatgtgtaacaccgcctttcgcagctcggtacctaatattaaactcgccaaatgcctggtcaatagcgccgggtgtcatctggtggcgggtctgctgttttttctggccgggactgtgtccttgagccctagcatatgggttatcttttacaacatacacctcaataagaagtttgagcccgtgtttagcttcgattacgccgtgtag

SEQ ID NO: 25502 - DNA, 528 bp, Artificial Sequence
  Description of Artificial Sequence: Synthetic coding sequence
atgggctgtagagatgtgcatgctgctacagtcctttctttcctgtgcgggatcgcgtctgtcgcagggctcttcgccggaaccctcctgccaaattggagaaagctcaggctgattacattcaatcgaaatgaaaagaacctgaccgtgtacaccggtctgtgggtgaagtgtgcacggtacgatggaagctccgactgcctgatgtacgacaccacctggtactcttccgtggaccagctggacttacgcgtattacaatttgcactaccattaagtatgttaatagctatgggtgctctgctcctgtgcctgataggcatgtgtaacactgcatttagatccagtgtcccaaacattaagctggcaaagtgcctggtaaacagcgctgggtgccatttggtggcaggcctgctgttcttcctcgcgggaactgttagcctcagcccgtctatatgggtgatcttttataatattcacttgaataagaagttcgagcctgtatttagcttcgactatgccgtgtag

SEQ ID NO: 25503 - DNA, 381 bp, Artificial Sequence
  Description of Artificial Sequence: Synthetic coding sequence
atgggttgccgggatgtgcacgccgctacagttctgtcctttctgtgcggaattgcatctgttgcggggttgttcgctggcactcttttaccgaattggcggaaactgagactgatcactttcaatcgcaacgaaaaaaacctgaccgtctatacaggcctatgggttaaatgtgcccggtatgacgggtcgtccgactgtctgatgtacgacaccacctggtattcttctgtggaccagttggatctgagggtgctccaattcgcccttccgttatctatgttgatcgctatgggagcactgctgttatgcctcattggaatgtgcaatacggcatttaggagctctgtcccgaatatcaaactggccaaatgcctgtag

SEQ ID NO: 25504 - DNA, 735 bp, Artificial Sequence
  Description of Artificial Sequence: Synthetic coding sequence
atgggatgcagagacgtgcatgcggcaactgtgctctccttcctttgcggcattgcatccgttgcgggcctctttgctggcactttgctgccgaactggaggaagctccggctcatcacttttaatcgcaatgagaagaatctgacagtgtacacaggtctatgggtcaagtgcgcaagatacgacggctcaagtgattgtctgatgtatgacaccacatggtactctagcgtggatcagctcgatctgagagtcttgcagttcgccttgcccctaagcatgctgatagccatgggggcactgctattatgtctgattggaatgtgcaacaccgcctttcgctcatccgtgccaaacatcaagctcgctaagtgcttggtgaactcggcaggctgccacttggttgccggcttattatttttcctggccgggactgttagcttaagcccgtcaatttgggtgattttttacaacatccatctgaacaaaaagtttgagcccgtgttctcgttcgactacgcggtctacgttacaatcgcatccgccggtggattgtttatgacatccctgatcctctttatctggtactgcacttgtaaaagcctgccaagccctttctggcagcctctttattcacatccccccagcatgcatacctattctcagccttacagcgcacggtctagactgagtgccatcgagatcgacatccctgtcgtgagtcacactacttag

SEQ ID NO: 25505 - DNA, 735 bp, Artificial Sequence
  Description of Artificial Sequence: Synthetic coding sequence
atggggtgtcgtgacgtgcacgccgcgacggtgctgtctttcctatgtggaatcgcatccgttgccggactgtttgctggtaccctcctgcctaactggaggaagctgcgcctgatcacatttaacaggaatgaaaaaaacctgacagtctataccggcctatgggtaaagtgcgccaggtatgatggaagctcggattgcctgatgtatgataccacttggtacagcagcgttgatcaactggatctgcgagtgttacagtttgccctccccctgtccatgcttattgccatgggggcgctgttactgtgcttaattggtatgtgtaacacagctttccggtcatcggtccctaacattaagttggccaagtgcctcgtgaactcggccggctgccacctggtagctgggcttctgtttttcttggccggcacggtgtcactcagtcccagtatttgggtgatcttttacaacatccatttgaataagaaattcgagcctgtgttctcatttgattacgcggtctacgttacaatagcttccgccggtgggctgtttatgacctccctgattctttttatttggtactgtacctgcaagtccctcccaagcccattttggcagcccctgtacagccatcccccatccatgcatacatattcccagccatactccgcccggtcccgcctgtctgcaattgagattgatatccctgtggtctctcatacaacgtag

SEQ ID NO: 25506 - DNA, 687 bp, Artificial Sequence
  Description of Artificial Sequence: Synthetic coding sequence
atgagcatggccgttgagacatttggttttttcatggcaactgtgggacttctaatgttaggcgtcacactgcccaacagttactggcgcgtgtctacggtccacggaaatgtgattactactaatacaatattcgagaacctgtggttcagctgcgccacggacagcctcggcgtgtataactgctgggagtttccgtccatgttagcgcttagcggctatatacaggcatgcagggcgttgatgataaccgcaattttgttgggctttctcgggctgctccttggcatcgctggactccgttgcaccaacatcggaggattggagctgtctaggaaggctaagctagccgcgaccgccggcgctttgcacatactggccggaatttgcggaatggtagctatatcgtggtacgcctttaatatcacccgggattttttcgatccactttacccagggaccaaatatgagctagggcctgccctgtatctgggttggtcagcatccctcatctccatcttaggaggcctctgtctgtgtagtgcatgttgctgcggttcggacgaggaccctgcagcctcagcgagacggccgtatcaggcaccagtgagcgtcatgcctgttgcaacctcagaccaggagggggactccagcttcggcaaatatggcagaaatgcctatgtctag

SEQ ID NO: 25507 - DNA, 687 bp, Artificial Sequence
  Description of Artificial Sequence: Synthetic coding sequence
atgtcgatggcggtggaaacttttggatttttcatggccaccgttgggctcttaatgctcggggttacactgccaaactcctactggcgggtgtctacagtgcacggcaacgttatcaccacgaacaccatcttcgaaaatttatggtttagttgcgcaaccgacagcttgggtgtgtataattgctgggagttcccgagcatgttggcactttccggttatattcaggcctgtcgcgcactgatgattacagccatcctgttgggcttcctggggctgctgctggggatcgctgggctgcggtgtacaaacataggcggactggaactcagccgcaaggcaaagctcgcggccacggcaggggctctccatatcctggctggcatttgcggcatggttgcaatttcttggtatgccttcaacatcactcgggactttttcgaccccctttatccaggcaccaagtacgagctgggccccgcactgtacttgggctggagcgctagcctgatctccatcttgggcgggctgtgcttgtgctccgcatgctgctgcgggtcggatgaagacccagctgccagcgcccgacggccgtatcaagccccagtaagcgtcatgccggtggccacttctgaccaggaaggagacagctccttcggcaaatacggaagaaacgcttacgtgtag

SEQ ID NO: 25508 - DNA, 675 bp, Artificial Sequence
  Description of Artificial Sequence: Synthetic coding sequence
atggccttttatcccctgcagattgcaggcttggttctcggctttttgggaatggtggggacactggcaaccacgctgctcccacagtggcgagtgtcggcttttgtggggagcaacattatcgtttttgagcggctgtgggaagggctttggatgaactgcatcagacaggcacgggtccgcctgcagtgcaagttctactcgtccttactcgccctccctcctgcgctcgaaacagccagagctttgatgtgcgtcgctgttgccttgagccttattgcccttctgataggcatttgcggcatgaaacaggttcagtgcaccggcagtaacgagcgtgctaaggcctatcttctgggcacctccggggtgcttttcatcctgacaggcatttttgtgctgatacctgtctcttggactgcaaacattatcattcgtgatttctacaatccggccattcatatcggccaaaaaagggaattgggcgcagccctttttctcggatgggccagtgcagcagttctatttattggggggggcctgctgtgtggattttgctgttgcaatagaaaaaaacagggctaccgttaccccgtccccggttatagagtaccacacaccgacaagcggcgtaatactaccatgctaagtaaaacttcgaccagctacgtgtag

SEQ ID NO: 25509 - DNA, 693 bp, Artificial Sequence
  Description of Artificial Sequence: Synthetic coding sequence
atggcctccttagggctacagctggtcggctacatcctgggcttgctgggtctattgggtacccttgtagctatgctgctgccgagctggaagacaagctcttatgtcggcgcctccatcgtgactgccgtgggcttcagcaaagggctgtggatggagtgcgctacccacagcacaggaatcactcagtgtgatatatacagtaccctcttgggactgccagccgacatccaggccgctcaagctatgatggtgacctcttccgcaatttcgtcgcttgcgtgcattatcagtgtggtcggaatgagatgtaccgttttttgtcaggaaagcagagcaaaagaccgggtggctgtggctggaggggttttttttatactggggggattattggggttcataccagtggcctggaacttgcacggcattttgagggatttttactcacctttagtgcccgacagtatgaaatttgagatcggcgaggccctgtacttggggatcatttctagcttattctctctcatcgctggcataattctctgctttagctgcagcagccagcggaatcggagcaactattacgatgcgtaccaggctcagcccctggccacccggagctcaccgcgccctggccagccaccaaaggtgaagtcagagtttaactcttatagcctgaccggctatgtatag

SEQ ID NO: 25510 - DNA, 693 bp, Artificial Sequence
  Description of Artificial Sequence: Synthetic coding sequence
atggcaagcctcggcctgcaactcgtagggtacatactgggtctgctcgggttactggggactttggtggctatgctcctaccttcctggaagacatcttcctatgtcggagcttccattgtgaccgctgtaggttttagtaaaggcctttggatggaatgcgccactcactcaacaggtatcactcaatgtgacatctattccactctcttaggattgcccgccgatattcaggccgctcaagccatgatggtcacatcatcagccatatccagcttagcatgtatcatctcggtcgtcggaatgagatgcacggtgttttgtcaggagtccagggccaaagaccgtgtggctgtggccggcggagtgttctttatccttggtggcctacttggattcattcctgtggcttggaacctgcacggcatcctacgggacttctactcacctctcgtgcctgattccatgaagttcgaaattggtgaggccttatatttgggcataatcagcagcctgttctcattaatagccgggatcattttatgtttctcatgcagcagccaacgcaacaggtccaactactacgatgcctatcaggcccagccactggcaactcgcagttcgccacgtcctggccagccccccaaggtgaaaagcgagttcaatagctatagtctgactggatacgtgtag

SEQ ID NO: 25511 - DNA, 693 bp, Artificial Sequence
  Description of Artificial Sequence: Synthetic coding sequence
atggctagcctgggcctgcaactcgtggggtatatcctagggctgctgggtttgctggggacacttgtggcaatgctgctgccctcttggaagaccagctcctatgtgggtgccagcattgtgacagccgtgggattttctaaggggctctggatggaatgcgccacccactccaccgggattacacagtgcgacatatactccactttactgggattacccgccgatattcaggccgcacaagcgatgatggtcacctcctcagcaatctcaagcctggcctgtattattagtgtcgtgggtatgcggtgcaccgttttttgccaagaaagccgggccaaagatcgagtggccgtcgcaggaggagttttcttcatacttggcggactacttggcttcatccccgtagcctggaacttgcatggcattttacgggatttttacagccccctggtacctgatagtatgaaatttgaaattggcgaggccctgtatctcgggataattagtagcctcttctcactaatcgcaggaattattctgtgtttctcctgcagctcacagcgtaatcgcagtaattattatgatgcataccaggcccagcccctggcaacccgttcaagccctcggcctggacagccgccgaaggtgaagagcgagtttaacagctacagtctcacaggatacgtttag

SEQ ID NO: 25512 - DNA, 660 bp, Artificial Sequence
  Description of Artificial Sequence: Synthetic coding sequence
atggcttccgccggactccagctattggcattcatcctggctctgtcgggtgtgagcggagtcctgaccgctaccttactgccaaactggaaggtcaacgtggacgtggacagtaatattatcactgctatcgtgcagctgcacggcctttggatggattgcacatggtattcaacggggatgttcagctgcgctttaaaacattctatcctgtccctccccatacatgtccaagcagccagggccaccatggtgctcgcttgtgtcctgagcgccctgggtatttgcacctcgaccgtcggaatgaagtgcacccgcctcggaggcgaccgcgagaccaagagccatgcttcatttgccggcggcgtttgcttcatgagcgccgggatttcttcccttatctctacggtatggtacacgaaagaaataatcgctaacttccttgacctgacagttcccgaatctaacaagcacgaacccggtggcgccatctacatcggtttcatctcagcgatgcttctcttcatctccggcatgatcttttgtacatcttgtatcaaaagaaatcctgaggccagacttgatccaccgactcagcagcccatttccaacactcagctggaaaacaattctacacacaacttgaaagattacgtttag

SEQ ID NO: 25513 - DNA, 663 bp, Artificial Sequence
  Description of Artificial Sequence: Synthetic coding sequence
atggcactcgtgttccgaaccgtggcacagttagcaggagtgagtctgtcgctcctcggctgggtcctgtcttgcctgaccaactatttgccgcattggaaaaacttgaatttggacctcaatgagatggaaaactggaccatgggattatggcagacctgcgtgatccaggaagaagtgggcatgcaatgtaaggattttgattcctttctggctttgcctgctgaactgcgcgtttcacggattctgatgttcctgtctaatggactcggatttctgggtcttctggtgtctgggtttgggctggactgcctcaggatcggcgagtctcagcgagacttgaagcgccgactgctcatactggggggaatcctgtcatgggccagcggagtaacagcactcgtacccgtcagctgggtagcacacaagaccgtccaagagttttgggacgagaacgtgccagactttgtgccacgctgggaatttggggaggcgctgttcctgggctggttcgccggactgagcctgctgttagggggctgtctgttacactgtgctgcatgctcctcacacgccccactggcaagtggtcactacgcagtcgctcaaacccaggaccatcaccaggaactcgagacacgtaacacaaatttgaaacactag

SEQ ID NO: 25514 - DNA, 879 bp, Artificial Sequence
  Description of Artificial Sequence: Synthetic coding sequence
atgcggaccccggtggtaatgactctagggatggtgctagccccttgcgggcttctcctgaatctcaccggaacccttgcccctgggtggagactggttaaaggctttttgaaccaacccgttgacgtcgaactttaccagggcctgtgggatatgtgtcgggagcagtcctcccgagaacgggaatgcggacagaccgaccaatggggctactttgaggctcagccggtgctggtggcacgggctctgatggtgacctccctcgccgccaccgtgctcggcctcctcctggccagcttgggggtgcgctgttggcaggacgagccaaacttcgtgcttgccgggctaagcggcgtggtgctttttgtagctggactcctcgggctcattcctgtgtcctggtacaaccacttcctgggggatcgggatgtacttccagctcctgcctctcccgttaccgtgcaagtatcctactctctggtgctcggctacctgggatcttgcctgctgcttctgggcggcttcagcctggctcttagctttgccccatggtgtgacgagcgatgccgccgcagaaggaagggcccatcggctggcccacgtcggtcgtcagtgtccacaattcaggtggaatggcctgagccagatttggctcctgctattaagtattacagcgatggtcagcaccgcccaccacccgcccagcacaggaagcccaaacctaagccgaaagttgggttccctatgccacgtccccggccaaaggcctataccaattccgtggacgtcctcgatggcgagggttgggaaagccaggacgccccctcgtgttctacccacccctgtgactctagcctgccttgtgattcggatctgtag

SEQ ID NO: 25515 - DNA, 690 bp, Artificial Sequence
  Description of Artificial Sequence: Synthetic coding sequence
atggcctggtccttccgggccaaagtacagttggggggactgcttctgagtctcttggggtgggtatgcagttgcgtcacaaccattttgcctcaatggaagacccttaatctcgagcttaatgagatggagacctggattatgggtatctgggaggtgtgtgtggatagagaagaggtggccaccgtgtgtaaagcattcgagtcgtttttgagcctccctcaggagcttcaggttgctcggatactgatggttgcatcacacggtctaggcctgctaggtctcctgctctgttcttttggcagcgagtgctttcaattccacaggattcggtgggtgttcaaaagacgcttgggtttactgggtagaaccctagaggctagcgccagtgccaccactctgttgcctgttagttgggtggctcacgcaacaatccaggacttttgggacgattccatccctgacatcatccctcgctgggaattcggcggagccctgtacctgggctgggccgctggtattttcctggcactgggagggctgcttctcatattctctgcgtgtctagggaaggaggacgttcctttccccttgatggcaggccctactgtgcccctatcatgtgccccagttgaggaatctgacgggtccttccacctgatgctgcgtccaaggaatcttgtcatttag

SEQ ID NO: 25516 - DNA, 663 bp, Artificial Sequence
  Description of Artificial Sequence: Synthetic coding sequence
atggcttccgccggcatgcagatcctgggagtagtgttaacactgcttggctgggtgaatggattagtaagttgcgccctccccatgtggaaagtaaccgcgtttattggcaacagcatcgtggtggcacaggtggtgtgggagggcttgtggatgagctgtgtggtccagtccactggccagatgcagtgcaaagtgtatgacagtttgctggcactgccacaggacctgcaggctgcgagagctctttgtgtgatcgctctacttgtggccctgtttggtctgctggtctacctagctggagccaagtgtacgacatgcgtggaggaaaaggattcaaaggccagacttgtcctgaccagcgggattgtgttcgtgattagcggtgtgttgaccttaattcctgtgtgttggaccgcacatgccattatcagagatttttataatcctctcgtggctgaggcccagaagcgagagttaggcgctagcctatacctgggatgggccgcctctgggctgctgcttctcggcggcggtctcctctgttgtacttgcccttcaggcgggtcgcagggcccctcccactacatggccaggtactccaccagcgctcccgctatcagcaggggccctagcgagtaccccactaagaattacgtttag

SEQ ID NO: 25517 - DNA, 663 bp, Artificial Sequence
  Description of Artificial Sequence: Synthetic coding sequence
atggcatctgctggaatgcaaatcctaggagtagtgctgacccttctcggttgggtcaatggactggtgtcctgcgccctgcctatgtggaaggtcacagccttcattggcaactcaattgtagttgcacaggtggtttgggaggggctgtggatgtcttgcgtagtccaaagtacgggccagatgcaatgtaaggtgtacgatagcctgcttgctctgcctcaggatttgcaggcagctagagctctgtgcgtcatagctttactggtcgctctgtttggactcttagtttatctggcaggcgccaagtgtaccacctgcgtggaagagaaggactctaaggctcggttggtgcttaccagtggcattgtcttcgtgatctccggcgtgctgaccctcattccagtgtgctggactgcgcatgctatcattagagacttctacaaccctctagtggctgaggcgcagaagagagaacttggggcctccctttacctggggtgggctgcaagcggcctactgctccttggcgggggtctcttatgctgcacttgcccatcaggtggttcacagggaccctctcactacatggctagatactccacaagcgccccggccatttctagaggaccttctgagtaccccaccaagaattatgtatag

SEQ ID NO: 25518 - DNA, 636 bp, Artificial Sequence
  Description of Artificial Sequence: Synthetic coding sequence
atggctaattctggtctgcaactgctcggttttagcatggctctcctgggctgggtcggcttggttgcctgcacagcgattccacaatggcagatgtcttcctacgcaggcgacaacataatcactgctcaggctatgtataagggactgtggatggattgcgtcactcagagcactggcatgatgtcctgcaagatgtacgattccgtgcttgcgctttccgcagcactccaagccacaagggctcttatggttgtctcactggtcctgggatttctggcaatgttcgtggccaccatggggatgaaatgtactagatgtggcggggacgacaaggttaaaaaagcccgtattgcaatggggggcggaatcatatttatcgtcgcgggattggctgcccttgtggcgtgttcatggtatggacaccagattgtcactgacttctacaacccgctgattcccacgaatatcaaatatgagtttggccccgcaatcttcatcggctgggcggggagtgcgttggtgatcttaggcggtgcccttctgagctgttcctgtcccggcaatgaaagtaaagccgggtaccgcgtgccccgatcttatccaaaatccaactcttccaaagaatatgtgtag

SEQ ID NO: 25519 - DNA, 636 bp, Artificial Sequence
  Description of Artificial Sequence: Synthetic coding sequence
atggcaaactccggccttcagctactgggattcagtatggccctgctgggatgggtaggcctggtggcatgcactgccatcccgcagtggcagatgtccagctacgccggggacaacataattaccgcacaggctatgtacaaaggcctgtggatggattgtgtcactcaatccaccggtatgatgtcatgcaaaatgtacgactcagtgcttgccctgtccgccgccctgcaagccactagagcactaatggtcgtgagtcttgtcctgggatttttggccatgtttgttgctaccatgggtatgaagtgcacaaggtgtggcggggacgacaaggttaagaaggcccgtatcgcaatggggggtggaattatctttatcgtggctggcttagctgccctggttgcctgcagttggtacggccaccagatagtcacagacttttacaatcccctaattcctaccaatataaaatatgagtttggccccgcaatattcattgggtgggctgggtcggcactcgtgatcctggggggcgccctcctgtcctgctcctgcccaggtaacgaatcaaaagcaggatatagggtgccaagatcatatccaaaatccaactcatccaaagagtatgtctag

SEQ ID NO: 25520 - DNA, 438 bp, Artificial Sequence
  Description of Artificial Sequence: Synthetic coding sequence
atggccaacagcggtttgcagctgctggggttttctatggccctcctggggtgggtggggctggtggcctgcactgcaatacctcagtggcagatgtcttcgtacgccggcgacaacattattacagcccaagccatgtacaaaggtctgtggatggattgtgtgacccagagtacagggatgatgtcctgcaagatgtatgactccgttttggctctctccgccgccttgcaggccacacgggccctgatggtggtgagcctggtgttgggtttcctggccatgtttgtggcaaccatgggaatgaaatgtaccaggtgcggcggagacgacaaggtgaagaaagccaggatcgccatggggggcggaattatcttcattgttgctggcatgtccctcgccctcccgtccctcctggcgggacaggggctgccctag

SEQ ID NO: 25521 - DNA, 678 bp, Artificial Sequence
  Description of Artificial Sequence: Synthetic coding sequence
atggccacacacgcactggaaatcgctgggctctttttggggggtgtgggaatggtgggcaccgtggctgtgaccgtcatgccccagtggagggtgagtgctttcatagagaacaacatagtagtgttcgagaatttctgggagggtctgtggatgaattgtgtgcgccaagcaaatatccggatgcagtgtaaaatctacgatagcctgctcgccctgagtcctgacctacaggcggccagaggcctgatgtgcgccgccagcgtcatgagcttcctggcattcatgatggcgattttgggcatgaagtgtactagatgcacaggcgataacgagaaagtcaaggcgcatattttattaacagctggaatcatctttattattactggtatggtcgtcctcataccagtttcttgggtcgccaacgccattattcgggatttttacaattcaatcgtgaatgttgcccaaaagcgggagctcggggaagcactttatctgggctggactaccgctttagtcctcatcgtggggggagccctgttctgctgcgtgttctgctgtaatgaaaagtcatcttcatatcgatacagtatacccagtcaccgaaccacccaaaagagctaccacacgggaaaaaagtccccctctgtctactcacggagccagtacgtatag

SEQ ID NO: 25522 - DNA, 678 bp, Artificial Sequence
  Description of Artificial Sequence: Synthetic coding sequence
atggcaactcacgctctcgagatcgcagggcttttcttaggtggggtcggcatggtcgggactgtggccgtgaccgtcatgcctcagtggcgcgtttcagctttcattgaaaacaatattgtggtatttgaaaacttctgggagggtttatggatgaactgtgtaagacaggccaacatccgcatgcagtgcaaaatctatgactcactactcgccttgtcaccagatctgcaggcagcccgcgggctgatgtgtgcagcttccgtcatgtcgtttctggcttttatgatggcaatccttggaatgaaatgcacacggtgtactggggacaatgagaaggtcaaagcccacatccttctcactgcagggatcatctttatcatcaccgggatggtcgtactgatccctgtatcgtgggtcgccaacgctattattagggatttctataacagcatagtaaacgtggcgcagaaacgagagctgggcgaggctctttatctaggctggaccaccgcgttggtattaatcgtgggcggcgccttgttctgctgcgtcttttgctgcaatgagaaatcctcctcataccgctactccatcccgtctcaccgcacaacccagaagagctatcatactgggaagaagtctccctcggtgtactctcgatctcaatatgtctag

SEQ ID NO: 25523 - DNA, 702 bp, Artificial Sequence
  Description of Artificial Sequence: Synthetic coding sequence
atggctacccatgcactggagattgccggactgtttctggggggtgtgggaatggtgggaacagtggctgtaaccgtgatgcctcagtggcgagtgtctgcctttattgagaacaacattgtcgtcttcgaaaatttctgggaaggactctggatgaactgtgtccgccaggccaacatcagaatgcagtgtaaaatctacgattccctgctagcgttgtctcccgaccttcaagccgcccgtggactcatgtgtgccgcaagcgtaatgtctttcctggcgttcatgatggccattctgggaatgaaatgcacacgatgcacaggagataatgagaaagtcaaggcccacatcctgttgacggcaggaatcattttcattatcacagggatggtagttcttattcctgtgagctgggttgctaacgctataatccgggatttttataactcaattgttaacgtagctcagaagcgcgagctcggagaggctctgtatctgggttggactacagccttagtccttatcgtgggtggggctcttttttgttgtgtgttctgttgtaacgagaaatcttcttcttataggtacagtataccaagccaccggacaactcaaaagtcttaccacactggaaagaaaagtagacttcttcagaagagcgtttgtgtggtggtttatgtgtttcttacacttctgtag

SEQ ID NO: 25524 - DNA, 654 bp, Artificial Sequence
  Description of Artificial Sequence: Synthetic coding sequence
atggcttcgactggtctggagctgttgggtatgactttggccgtgctcggatggctcggcacattagtgtcatgtgcactgcctttatggaaagtgactgctttcattggtaactccatcgttgtggcacaggttgtttgggaaggtctgtggatgtcctgcgttgtgcagtctactgggcagatgcaatgcaaagtttacgacagtctgttggctctccctcaggacctgcaagccgcacgtgcattatgtgttattgcactgttactcgccctgctgggattgctagtggctatcaccggagcacaatgtactacctgtgtggaggatgagggggctaaggcgcgcattgttctcacggctggggtcattttattgctggctggaatactggtgcttatccccgtgtgttggaccgctcatgccatcatacaggatttctacaacccgctcgtcgctgaggcgttaaagagggagctgggagccagcttgtacctcgggtgggccgccgccgcactgctcatgctcggtggggggctactgtgttgcacctgtccaccaccccaagtcgaacgacctcgcggaccaagactcggttatagcattccaagcaggtccggggcctcaggtctcgacaagcgggactacgtatag

SEQ ID NO: 25525 - DNA, 762 bp, Artificial Sequence
  Description of Artificial Sequence: Synthetic coding sequence
atggataacaggttcgccactgctttcgtgattgcctgtgttttatctctgatctcaactatctacatggctgcctctattggaaccgatttttggtacgagtatagatcacccgtgcaggagaactcatccgacctcaacaaatccatttgggacgaattcatctccgacgaagcggacgagaagacatacaatgatgcgctgttccgctacaacggaacagtgggcctgtggcgacgctgcattaccattcctaagaatatgcactggtactcgcctccggagaggacggagtcattcgatgttgtgactaagtgtgtatcttttaccctgactgagcagttcatggagaagttcgttgatcctggaaaccacaacagtggcattgatctgcttcgaacctatctgtggcgttgtcagttcctactgccttttgtttctttggggctgatgtgcttcggagctttaatcggcctctgtgcctgtatctgccggtcactctatcccaccatcgccaccggaattctgcatctactagcagggttatgtacattgggcagtgtcagttgctacgtggccggaatagagctgctccaccaaaagttggagctgcccgacaatgtgagtggcgagttcgggtggtcattttgtcttgcctgtgtgtctgcccctttgcagttcatggcatctgccctcttcatctgggcagctcacaccaatcggaaagagtataccctaatgaaggcatacagagtggcctag

SEQ ID NO: 25526 - DNA, 762 bp, Artificial Sequence
  Description of Artificial Sequence: Synthetic coding sequence
atggacaaccgattcgcaacagccttcgtgattgcgtgcgtcctcagtctcatcagtactatctacatggctgcctccatcggtacagacttctggtacgaatatcggtcccctgttcaggagaatagcagcgatctgaacaagagcatctgggacgagtttatatcagacgaagctgacgagaaaacctacaatgacgcccttttcagatacaacgggacagtgggcctctggcgccgatgcatcacaattcccaagaatatgcattggtatagcccacctgagaggacagagtcctttgatgtggtgaccaagtgtgtgtcctttacgctcactgagcagttcatggagaagtttgttgacccaggaaatcataactctggcatagacctgctgaggacctacttgtggagatgccaattcctgctccccttcgtatccctaggcttgatgtgcttcggcgccctgatcggcctctgcgcttgcatttgtagatcgctttacccaactattgccaccggaattttgcacttgctggccggactatgcaccctggggtcggtctcgtgctacgttgctggaattgaactgctgcaccagaagctcgagctgcctgacaacgtgtccggagagtttggatggagcttctgtttggcctgcgtgagtgctcccctgcagtttatggcttctgctctgtttatttgggccgcacatacaaacagaaaagaatataccttaatgaaggcctatagggtggcctag

SEQ ID NO: 25527 - DNA, 762 bp, Artificial Sequence
  Description of Artificial Sequence: Synthetic coding sequence
atggacaataggtttgctacggcctttgtcatcgcctgcgtgttaagcctcatcagcacaatatatatggctgcctccatcggtactgatttctggtacgagtacaggtctcctgttcaagagaactcgagcgatctcaataagtcaatatgggatgaatttattagcgacgaagcagacgagaagacatataacgacgccttatttcggtataacggtactgtgggcctctggaggcgctgcattaccataccaaagaacatgcattggtattcccctccagagcgtacagaatcttttgacgttgttactaagtgtgtctcttttactctaacagagcaatttatggaaaagttcgtcgatcccggcaaccacaattcaggcatcgatctgcttagaacgtatctttggaggtgtcaattcctgcttcccttcgtgtccttgggcttgatgtgctttggtgccctgatcgggctatgcgcctgcatttgtcggagcttgtatcctaccatcgctacaggtattttacacctgctcgctggtctctgtactctggggagcgtgagctgttacgttgcaggaatcgaactcttgcaccagaagctggaattaccagataatgtgagtggcgaattcgggtggagcttttgtttggcctgcgtgagtgcacctctgcagtttatggcaagcgccctgttcatatgggccgcacacactaacaggaaggaatataccctgatgaaggcgtatagagtcgcttag

SEQ ID NO: 25528 - DNA, 762 bp, Artificial Sequence
  Description of Artificial Sequence: Synthetic coding sequence
atggataatcggtttgcgactgccttcgtcatagcttgtgttctctctttgattagtacgatttatatggcggcctccattggcacagacttttggtatgagtacagatctcccgtgcaagaaaacagtagtgacttgaacaagtccatatgggatgagttcatctcggacgaggcagacgagaagacttacaatgatgcactgttcaggtataatggaaccgtgggcttgtggcgacgatgcatcactatccctaagaacatgcactggtactccccccctgagagaacagagtcttttgatgtggttacaaagtgtgtcagcttcacccttaccgaacagttcatggaaaaatttgttgatcccgggaatcacaatagcggtatcgatctcctccgcacatatctgtggaggtgtcagtttctactgcccttcgtctccttgggcctgatgtgtttcggtgcgctgatagggctgtgtgcttgcatatgccggtcactctaccctacgatagcaactggaatccttcacctgctcgccggtctgtgcacactcggctcagtgagctgttacgttgcagggatcgagctcctgcatcagaaactggagttgccggacaacgtctccggcgagtttggatggtcattctgcttagcgtgcgtgtcggcgccactgcagtttatggcatcagctctcttcatctgggctgcccacacaaatagaaaggagtacacgctgatgaaggcttacagagtagcatag

SEQ ID NO: 25529 - DNA, 831 bp, Artificial Sequence
  Description of Artificial Sequence: Synthetic coding sequence
atgggaggtgatcgccttgagaataagacctccgtttccgtggcgtcctggtcaagcctgaacgctcgtatggataatcgtttcgcaacagcctttgtcattgcctgcgtgctgtccttaatcagcacaatttacatggctgcctccataggcaccgatttttggtacgagtatagaagcccagtccaggaaaattcttctgacctgaacaaaagcatttgggatgaatttatctcggatgaggccgacgagaaaacctacaatgacgctctgttcagatataatggcaccgtgggcctatggcgtcgatgcatcacaatcccgaaaaatatgcattggtattctcctccggagcgaaccgagagcttcgatgttgtgacaaaatgtgtaagcttcacgctaaccgagcagttcatggagaaatttgtggaccccggtaaccacaattccggcatcgatctcctgagaacctatctttggcgatgccagtttctcctcccttttgtgagcctcggcctgatgtgctttggggcccttatcggtctatgtgcctgcatttgcaggtccctctatcccaccatcgctactggtattctgcacctactggccggcctctgtaccctcggttccgtgagctgttatgtagcaggaatcgagctcctgcatcaaaagctggaacttcccgacaacgttagcggcgagttcgggtggagcttctgtctggcatgtgtatcagccccgcttcagtttatggcctccgccctgttcatctgggcagcgcacacaaacaggaaagagtacaccctgatgaaggcctaccgggttgcttag

SEQ ID NO: 25530 - DNA, 720 bp, Artificial Sequence
  Description of Artificial Sequence: Synthetic coding sequence
atggacaacaggttcgctaccgcattcgtgatcgcatgtgttctgagcctcatttccaccatttacatggcagcctctataggcactgatttctggtatgaataccgaagccccgtgcaagagaatagctcagatcttaacaagtctatctgggacgagttcatctctgacgaagctgatgaaaagacttataacgacgcactcttcagatataatggcacagtgggcctgtggcgccgctgcattaccatccctaaaaacatgcactggtacagccctccggaaaggacagagtctttcgatgtggttaccaagtgcgtgagttttaccctcaccgagcagttcatggaaaaatttgtggaccccggaaaccataatagtggtattgatttgcttcgcacctatctgtggcgatgccaatttctgctgccatttgtctctctgggccttatgtgcttcggggcacttattggtctgtgcgcctgtatttgtagatccctttacccaacgattgcaacagggatactgcacctcctggccggcctgtgtacccttgggtcagtttcctgctatgtcgccggcattgagctgctgcatcagaagttggaattgccagacaatgtcagtggcgaattcgggtggagcttctgccttgcatgtgtgtccgcgccactacagttcatggcaagcgccctcttcatatgggccgcccacacctag

SEQ ID NO: 25531 - DNA, 762 bp, Artificial Sequence
  Description of Artificial Sequence: Synthetic coding sequence
atggacaaccggttcgcgaccgcctttgtgatcgcttgcgttctctctctgatctctactatctacatggctgcaagtattggcacagatttctggtatgagtatcggtcaccagtccaggaaaatagcagcgacttaaacaagagtatttgggacgaattcatttcagacgaggcagatgagaagacctacaacgacgccctgttcaggtataacggcacagtgggcctgtggcgtcggtgtattactattcccaaaaacatgcattggtactctccacccgagcgaaccgagagcttcgatgttgtgacaaaatgcgtgagtttcaccctgaccgaacaatttatggaaaaattcgtggatccaggcaaccacaacagcggaattgacctgctacgtacctatctgtggcgttgtcagtttcttctgccttttgtctcactgggactgatgtgttttggcgctctaataggtctgtgtgcctgcatttgccggtctctgtatcctaccattgcaaccggaatcctgcatctcctggcgggactttgtacgttgggctcggtgtcatgctacgtagccgggatcgagctcctgcaccagaagcttgagttgccagacaacgtgagcggcgagttcgggtggagcttttgtttagcatgcgtgtcagctccactccagtttatggctagcgcgctgtttatttgggctgcccacacaaataggaaggaatataccttgatgaaggcataccgggtggcctag

SEQ ID NO: 25532 - DNA, 270 bp, Artificial Sequence
  Description of Artificial Sequence: Synthetic coding sequence
atggataaccgttttgctacagctttcgtgattgcctgtgtgctcagcttaatttccaccatctatatggctgcatccatcgggaccgatttctggtacgagtatagatctcccgtgcaggaaaattcctcagatcttaacaagtccatttgggatgagttcatttccgatgaggccgacgagaagacatataatgatgctctgtttagatataatggaaccgtggggttgtggcgcaggtgtattacaatccctaaaaacatgcactag

SEQ ID NO: 25533 - DNA, 534 bp, Artificial Sequence
  Description of Artificial Sequence: Synthetic coding sequence
atggataaccgcttcgcaactgccttcgttatcgcctgcgtgctgtccctcatttccaccatctatatggctgccagcatcggcacagatttctggtacgagtaccgctctcctgttcaggagaacagcagtgacctcaataaaagcatttgggacgaatttattagcgacgaggcagacgaaaaaacttacaacgacgcgctatttaggtacaatggaaccgtcggcctgtggagacgctgcatcactatacctaagaacatgcactggtattccccacctgaacggacggaaagctttgacgtggtgacaaagtgtgtgtcttttactctgacagagcagttcatggagaaattcgtagatcccgggaatcataactccgggatagacctgctgaggacctacttgtggagatgccaattcttattgccctttgtttccctgggactcatgtgtttcggggccctcattggactgtgtgcatgtatttgtcgcagtctgtaccctaccatagctacgggcattttgcactag

SEQ ID NO: 25534 - DNA, 438 bp, Artificial Sequence
  Description of Artificial Sequence: Synthetic coding sequence
atggacaacagattcgcaactgcatttgttatcgcctgtgtcctatctctgatctctaccatatacatggccgcgagcattggtacggacttttggtacgagtacaggtcccctgtgcaggagaatagcagcgacttgaataaatccatctgggacgagtttatctccgacgaagctgacgagaaaacctataatgatgcgctgtttcgctacaacggcactgtaggtctctggcgacgatgtatcactatccctaagaacatgcactggtactcgccgcccgaacgcactgagtcttttgatgtcgtaaccaaatgcgtaagttttaccctgacagaacaatttatggaaaaattcgtagaccctggtaatcacaattccggtatcgatctgctccgaacctacttgtggagatgtcagtttcttttgcccttttag

SEQ ID NO: 25535 - DNA, 519 bp, Artificial Sequence
  Description of Artificial Sequence: Synthetic coding sequence
atggacaaccggtttgcaacagcattcgtcatcgcctgtgttcttagtttgatcagtaccatttacatggcggcgagtatcggcacggatttctggtacgaatataggtctcccgtacaggaaaactcttccgatctaaataagagcatttgggacgagttcatcagcgatgaggccgacgaaaagacttataacgacgccttattccgttacaacggcactgtaggcttgtggcgacgttgcattaccatacccaaaaatatgcactggtacagccccccagaaaggaccgagtcctttgacgtggttacgaagtgtgtttcattcacacttacagaacagtttatggagaaatttgtggacccgggcaaccacaattctgggattgaccttctccgtacgtacctgtggcgctgtcagttcctgctgcctttcgtgtctctgggattgatgtgtttcggggccctcattgggctgtgcgcatgcatctgccgaagcttgtaccccactattgcatag

SEQ ID NO: 25536 - DNA, 714 bp, Artificial Sequence
  Description of Artificial Sequence: Synthetic coding sequence
atggacaatcggtttgcgacagcatttgtgatagcctgcgtccttagcctgatttctaccatttacatggccgcttcaatcggtacagatttttggtacgagtataggtcccctgtgcaggagaacagctctgacctgaacaagagtatttgggacgagttcattagcgatgaggctgacgagaagacttacaacgatgcactgttccggtacaatgggacagtcggcctctggaggcggtgtattacgattccgaagaatatgcactggtattcccctccagagcggacagaatccttcgatgttgtgacaaagtgcgtgtccttcaccctgactgagcaattcatggagaagttcgtcgatcccgggaatcataattccggcatcgatctgctccgaacgtatctgtggcggtgtcagttcctcttaccatttgtatcattaggactcatgtgctttggagctctgataggtctctgcgcctgcatttgtaggtcattataccctacgatagctacaggcattctccatctccttgccggcctgtgtaccctgggatcggtctcttgctacgttgccggaatagaacttctccatcagaaacttgagttgcctgataatgtttccggcgagttcggctggagtttctgtctagcctgtgtgagtgcccctcttcagtttatggcaagcgccctattcatatgggccgcttag

SEQ ID NO: 25537 - DNA, 762 bp, Artificial Sequence
  Description of Artificial Sequence: Synthetic coding sequence
atggataaccgatttgccactgccttcgtcattgcctgtgttctatccctaatttcaactatctacatggctgcctccatcggcacagacttttggtacgaatatcgaagccccgtccaagagaacagtagcgacttgaacaagagtatctgggacgagttcattagcgacgaggctgacgaaaaaacttacaacgatgctctgttcaggtacaatgggactgttggactgtggcgccgatgtatcacaataccaaagaatatgcactggtactctccccccgagcgcacagagtctttcgacgttgtgacaaaatgcgtatcgtttaccctgaccgagcagtttatggagaagtttgtggaccccggaaatcacaattcaggcatcgatctcttgagaacctacctgtggcgctgtcagtttctgctgccttttgtctccctggggctgatgtgcttcggagcactgattggcctatgcgcgtgtatctgcagaagtttatacccgactattgcgacggggatcctgcatttgctggccgggctgtgtaccctggggtctgtttcctgctacgtcgctggtatcgaactgctccatcaaaaactggagctgccggataacgtgtctggggaattcggttggtccttctgcttggcttgcgtatccgcacctctgcagttcatggcgagcgccctttttatctgggctgcacacaccaaccgaaaggaatatactcttatgaaggcctatagagtggcatag

SEQ ID NO: 25538 - DNA, 477 bp, Artificial Sequence
  Description of Artificial Sequence: Synthetic coding sequence
atgggagagagtttcgatgtggtcacaaagtgcgtgtcattcacattaacagagcagttcatggaaaaattcgtggaccctggcaatcataactctggcatcgatctccttcgtacatatctctggcgatgtcaatttctgctgccttttgtgtctttgggtctgatgtgctttggcgctctaatagggttgtgtgcatgcatttgcaggtcattatacccaaccatcgccactggtatccttcacctactagcgggcttatgtacactcggctctgtgagttgctacgttgctggcattgagctcctccaccaaaaactggaactgcctgataacgtgagcggagaattcggttggtctttctgtctcgcttgcgtgtccgccccgctccagttcatggcttccgctctgttcatttgggctgctcacaccaatcggaaggagtacactttgatgaaagcatatcgggtggcttag

SEQ ID NO: 25539 - DNA, 294 bp, Artificial Sequence
  Description of Artificial Sequence: Synthetic coding sequence
atggataataggtttgcaaccgcgttcgtgatagcttgtgttctgagcttgataagcacaatttatatggctgcttccatcggcactgatttttggtacgagtacaggagtcctgtgcaggagaactcatccgatttgaataagtctatttgggatgaatttatctccgatgaggcagacgaaaagacttacaacgacgcccttttcagatacaacggaaccgtcgggctgtggagaagatgcatcaccatccccaagaatatgcactggtacagccccccagagagaacttag

SEQ ID NO: 25540 - DNA, 762 bp, Artificial Sequence
  Description of Artificial Sequence: Synthetic coding sequence
atggacaaccgcttcgcaactgcttttgtgatcgcatgtgtcttatctctcatcagtaccatctacatggctgcctccattggtacagatttctggtacgagtatcgctcccctgtacaggaaaattccagcgatctgaacaaatctatctgggacgaatttatcagtgatgaagccgacgagaagacgtacaatgatgcactcttccggtataacggaacagtggggctttggagacggtgtatcacaatcccaaagaacatgcattggtacagtcccccagagcggacggagtccttcgacgtagtgaccaagtgtgtgtctttcaccctaactgaacaattcatggaaaagttcgtggatcccggtaaccacaacagcggaatcgacctcctacgaacttacctttggagatgccagttcctacttccctttgtgagcctggggctgatgtgctttggggctctgattgggctgtgtgcatgcatttgcagaagcctgtatcctaccatcgctaccggtatcctacatctcctcgccggcctgtgcactttgggcagtgtctcgtgttacgtggccggtatcgaactgctccaccagaaactggaactccccgacaatgtttctggggaattcggatggtcattttgtctggcttgcgtttcagcaccgctgcagttcatggcctcagccctctttatctgggccgcacatactaatcggaaggaatacaccctgatgaaggcctaccgagtggcatag

SEQ ID NO: 25541 - DNA, 738 bp, Artificial Sequence
  Description of Artificial Sequence: Synthetic coding sequence
atggataataggtttgccactgcgtttgtgattgcgtgtgtcctctccttgatcagcactatctacatggctgccagcatcgggactgacttttggtatgagtacaggtctccagtccaggagaattcctctgatctaaataaaagcatctgggacgaatttatctctgacgaggcagacgaaaaaacctataacgatgcactgttcagatataacggcacagtggggctctggaggagatgtattactattcccaagaacatgcactggtacagtccgcccgagagaaccgaatccttcgatgttgtcaccaagtgcgttagctttaccttgactgagcagtttatggaaaaattcgtggacccgggcaaccacaattccggcatcgacctgctgcgaacttacctgtggaggtgtcagtttcttttaccctttgtaagcctaggcctgatgtgcttcggtgcattgattgggctctgcgcctgtatctgccgctcgctgtaccctaccatcgccaccgggatcctgcatctgttagctggcttgtgtaccttggggtccgtttcctgttacgtggcaggcattgaactgctccaccagaagctggagcttcccgataacgttagtggggaattcgggtggtccttttgtttagcatgcgtgtccgcgcccttgcagttcatggcctccgcgctcttcatctgggccgcccataccaaccgcaaggaatatacctag

SEQ ID NO: 25542 - DNA, 642 bp, Artificial Sequence
  Description of Artificial Sequence: Synthetic coding sequence
atggacaacaggttcgctacggctttcgtgattgcttgcgtactgagccttatttccactatttacatggcagccagcatcggaaccgacttctggtatgaataccggtccccagtacaggaaaacagctccgaccttaacaagtccatctgggacgaatttatctcagatgaggcggacgagaagacatacaatgacgccctgtttagatacaatggcactgtaggcttatggaggaggtgcataactatccccaaaaatatgcattggtacagtccccccgaaagaacagagtctttcgatgtcgtgaccaagtgtgtctcctttaccctcacagagcagtttatggagaagtttgtggaccctggaaatcacaattcagggatcgacttgctgaggacgtacctgtggagatgccagtttttactaccttttgtatccctgggcctcatgtgcttcggggccctgattggactttgcgcttgcatctgtcggtctttataccctacaattgccacaggtattctgcacctgctggctgggctctgcacactgggctcagtctcctgctacgtggcaggcatcgaactgttgcaccagaagctggagttgccagacaacgtgtctggcgagtttggttag

SEQ ID NO: 25543 - DNA, 543 bp, Artificial Sequence
  Description of Artificial Sequence: Synthetic coding sequence
atggataatagatttgcaaccgccttcgtcatcgcctgtgtgctctccctcatatccacaatctatatggctgccagcattggcactgatttttggtacgagtaccgatctccagtacaagagaattcctccgatctgaacaaaagcatctgggatgaattcatctcagatgaggcggacgaaaaaacctacaatgacgccctgttccggtacaatggtaccgtaggcctctggcgcaggtgcattacaatccctaagaatatgcactggtatagtccccccgagcgcacagagagcttcgacgtagtcacaaaatgtgtgagctttaccctgacggagcagttcatggagaaattcgtggacccgggcaatcacaactcagggatcgacctgttgcggacctacctttggcgctgccagttcctgcttccattcgtttccttggggctcatgtgttttggggccctgattggactgtgcgcctgcatttgccggtctctataccccacaattgctaccgggattctacatctgctcgcttag

SEQ ID NO: 25544 - DNA, 504 bp, Artificial Sequence
  Description of Artificial Sequence: Synthetic coding sequence
atgggtgtcaaacggagcctgcagtctggagggattctcctatcccttgtcgctaatgtgcttatggtgctgtcaacggctactaattactggacgcggcagcaggaagggcacagcggactttggcaggagtgcaaccatggcatctgctcctcaatcccctgtcagaccacgctggccgtgacagtggcctgcatggtccttgcggtgggtgtcggcgtggttggaatggtaatggggttgcgcatcagatgtgacgaaggtgagagcctcagagggcagacaacaagtgcctttctttttctcggaggccttctgttactaacagctctgataggctatacggtcaaaaatgcttggaagaataatgtgttcttcagctggtcctatttttctggatggctagccctgccattcagtatcctcgctggcttctgcttcctcctggccgacatgatcatgcaaagcactgatgcaatcagcggttttcccgtttgcctgtag

SEQ ID NO: 25545 - DNA, 1065 bp, Artificial Sequence
  Description of Artificial Sequence: Synthetic coding sequence
atggggcctgtgtccctcctgcccaagtatcaaaagctgaacacttggaacggagaccttgccaaaatgacacacctgcaggccggactctccccggaaaccattgagaaagcaaggcttgaactgaatgagaaccctgacgtcctccaccaagacatccagcaggtccgagacatgattatcactcgccctgacattggttttctgaggacggatgacgccttcatactaagatttctcagggcaagaaaattccaccaagcagacgcttttcggctcctggcccaatattttcagtaccgccagctcaatctcgacatgtttaaaaatttcaaggctgacgatccaggcattaaaagagccctgatcgacggattccctggagtgctggaaaacagagaccactacgggcggaagattctcctgctgtttgccgccaactgggatcagtccaggaactcctttaccgacattctaagagcaattctgttgtcattggaggtgctcattgaggatcccgagctgcagatcaatggctttatactcatcatcgactggtctaattttagtttcaagcaggcctccaagttaaccccgagcattcttaagttggctatcgagggcctgcaggatagcttcccggctcgcttcgggggggtacattttgtgaaccagccctggtatatccacgccctgtataccttaatcaaacccttcttaaaggacaagacacggaagagaatcttcttgcacggcaacaatctcaactccctgcatcagctcatacatccagagtttttgcctagcgagttcggaggtacactacccccttacgatatgggaacttgggcgaggacactgctcgggcctgattactcggacgagaatgactatactcacaccagctacaatgctatgcacgtcaaacacaccagttcaaatctggagcgagagtgttctccaaaattgatgaagcggtcccagtccgtcgtggaagcaggaaccctgaagcacgaggaaaaaggcgagaacgagaacacacagcctctgctcgctctggactag

SEQ ID NO: 25546 - DNA, 1065 bp, Artificial Sequence
  Description of Artificial Sequence: Synthetic coding sequence
atgggtccagtttctctgctgcctaagtaccagaagctgaatacatggaacggggatctagccaaaatgacccaccttcaggcagggttgtcccctgagactattgaaaaggcgcgcttagagctcaatgaaaatcccgatgtcttacatcaagacattcagcaggtccgagatatgataatcacacggcctgatatcggatttcttaggaccgacgatgcctttatcctcaggtttctgcgcgccaggaagttccaccaggccgacgccttccggctgctcgcccagtacttccagtatcggcagttaaacctggatatgtttaagaatttcaaggctgatgaccctggcatcaaacgagctttgatcgatggcttccccggcgtactagaaaacagagaccactacggcagaaagatcttgctgctattcgccgccaactgggaccagtctcgtaactctttcacggacattctgagggcaatcctgctgagcctggaagtgctgattgaggatccagagctgcaaatcaacggcttcatactgattatcgactggtccaacttcagctttaaacaagcgtccaagttgacaccatctatcctgaaacttgcaatcgaggggttacaagattcatttccggctagattcggaggtgttcactttgtcaaccagccctggtatatccacgcgctttacaccctgatcaagccttttctgaaagataaaactaggaaacgaatttttctccacggcaataatctgaatagcctgcaccaactcattcatcctgagttcctcccgtccgaatttgggggcaccctcccgccatacgatatgggtacgtgggctcgaaccctgctcgggcccgactattctgatgagaatgactacacacatacctcgtataatgcgatgcatgtgaagcatacctcttccaatctggaacgcgaatgctccccaaaactgatgaagagatcacagagcgtggtggaggctgggacactcaaacacgaagagaaaggggaaaatgaaaacacccaaccccttctggctttggactag

SEQ ID NO: 25547 - DNA, 240 bp, Artificial Sequence
  Description of Artificial Sequence: Synthetic coding sequence
atgggtcccgtgagcctacttccgaaataccagaaacttaacacttggaatggagacctggctaaaatgacccacctccaagccggcctgtctccagagactatcgagaaggcacgattagaactgaacgagaatccagatgtgctgcatcaggatatccaacaggttagggatatgataattactcgtccagacatcggcttccttcgcaccgacgacgcatttatactaagattttag

SEQ ID NO: 25548 - DNA, 984 bp, Artificial Sequence
  Description of Artificial Sequence: Synthetic coding sequence
atgacacacctccaggctgggcttagcccagagaccctggagaaggcacggctagaacttaacgagaatccagataccttacaccaagatattcaggaggtacgggacatggtcatcactagacctgacatagggtttctgagaacagacgatgcattcattctccggttcttaagggctcgcaaattccaccattttgaagctttcagattactggcccagtatttcgagtatcggcaacagaatctcgacatgttcaagtcatttaaagccacggaccccggcatcaaacaagcgctgaaggatggctttcctggagggctcgctaatctcgaccattacgggcggaaaattctcgttctgttcgccgcaaattgggaccagtctcgctacaccctcgtggacatactgagggctattctgcttagcctggaagcgatgatcgaagaccctgagctgcaggtaaacggtttcgtgctcatcattgactggtctaatttcacattcaagcaggcctcgaaactcactccttctatgctgcgcctcgcgattgaaggcctacaggattcattcccagcgaggttcggcggaatccatttcgtcaatcaaccatggtacattcatgccctttacaccgtgatccggcctttcctaaaagagaagaccagaaaacgcattttcttgcatggtaacaatctgaactctctgcaccagctgatacaccccgagattctgccctccgaattcggcggcatgctgcccccttatgacatgggtacatgggcccgtactttgctagatcatgagtacgatgacgatagtgagtacaacgtcgacagttattctatgcctgtgaaagaggtggagaaggaattgagcccaaaatccatgaagcgcagtcagtccgtcgtggatccgaccgtgctcaagcgcatggacaagaacgaagaagaaaacatgcagccgctgttgtctctagattag

SEQ ID NO: 25549 - DNA, 546 bp, Artificial Sequence
  Description of Artificial Sequence: Synthetic coding sequence
atgatcgaggatcccgagcttcaggtgaacgggtttgtgctgattatagattggagtaactttacctttaaacaagcaagtaagctgaccccttccatgctgcggctcgctattgaaggtttacaagacagctttcctgcccggttcggaggaattcatttcgttaatcagccctggtacattcacgccttatacacggtgattaggccttttctaaaggaaaaaactcgaaagaggatcttcctgcacggcaacaatcttaactcccttcaccagctgatccatcccgaaatcttaccctcggagtttggcggcatgctccctccgtacgacatgggcacctgggcacggactctgcttgatcatgagtacgacgatgactccgagtacaatgttgattcatattccatgccagttaaagaggttgagaaggagctgagcccaaagagcatgaaaaggtcccagagtgtcgtggatccgacagtattaaagaggatggataaaaacgaggaggaaaatatgcagcccctgctttcactcgactag

SEQ ID NO: 25550 - DNA, 2010 bp, Artificial Sequence
  Description of Artificial Sequence: Synthetic coding sequence
atggccgcagcccaggaggcagacggggcccggagcgctgtagtggctgccgggggcgggagttccggacaggtgacgtccaatggctcaatcggaagagatcctcccgcagaaacccagccccagaatcccccggcccaacccgcacccaacgcctggcaggtcatcaagggtgtcctgttccgcatcttcattatctgggctattagtagctggtttaggaggggccccgccccacaggaccaagccggccccggcggagcaccaagagttgcctcacgcaatctcttccctaaagatacattgatgaacctccacgtatacattagcgagcacgagcactttaccgacttcaacgctacaagcgctctgttttgggagcagcatgacctcgtgtacggcgattggacctctggggaaaatagcgatggctgttacgaacactttgccgagctcgacattccccagtccgtgcaacagaacgggtccatctacattcacgtgtacttcactaaatcaggtttccaccctgacccgcggcaaaaggccttgtatcgcagactggccactgttcacatgtcacgcatgattaacaaatacaagaggagacgcttccagaagactaagaatctcttaacaggcgaaactgaggccgacccagaaatgatcaagagagccgaagattacgggccggtcgaagtaatttcccattggcatcccaacatcaccattaacatcgtagacgatcacactccctgggtgaaggggtctgtgcctccccctctcgaccagtacgtgaaatttgatgccgtatccggcgattactatccaataatatatttcaacgattactggaacttgcagaaagactactatcctattaacgagtctctggccagtctcccactgcgagttagtttttgccccttaagcttgtggcgctggcagctctatgcagcccaatcaaccaagtcaccatggaactttctgggagatgagctttacgaacagtctgatgaagagcaggactccgtgaaagtggctctcctggaaactaatccctatctgctggccctgactattattgtctccattgtccactccgtgtttgagttcctagcttttaaaaatgacatccagttttggaactcccgtcagagtttggaaggactgagtgttaggagtgtattcttcggtgtgttccagtcttttgttgttctgttatacattctcgacaacgaaacaaattttgtagtgcaggtttccgtcttcattggggtcctgatcgacctctggaagataacaaaagtgatggacgtgcgtctggaccgagaacatagggtcgctggcattttcccacgtctgagcttcaaggacaagtctacatacattgaatcatcaaccaaagtgtacgacgacatggcgtttagatacctaagttggattttgtttccactgcttggctgctacgctgtgtactctctgctttacctggaacataaaggctggtacagctgggtactttcgatgctctatggttttctgctcactttcgggtttatcaccatgacaccacagcttttcatcaactataaactgaaaagcgtcgcacatttgccctggcggatgttaacttacaaggccctcaacacatttatcgatgacctgtttgctttcgtcatcaagatgcccgtgatgtaccgaatcggttgcttgcgcgatgatgtcgtcttctttatatatctctatcagcgctggatctaccgcgtggatcccactcgggttaatgagtttggcatgtcaggggaggatcccaccgctgctgcacctgtcgctgaggtccccaccgccgcgggtgcgttgactcccacccctgcccccactaccaccactgccacacgggaagaagctagcacctcactccctaccaaacccacccagggcgcgagttcggccagtgaaccacaggaggcacctcctaagcctgccgaagacaaaaaaaaggactag

SEQ ID NO: 25551 - DNA, 2061 bp, Artificial Sequence
  Description of Artificial Sequence: Synthetic coding sequence
atggctgccgcacaggaggcagacggcgcccgctccgccgttgtcgccgctggaggggggtcgagcgggcaggtaacgtccaacggtagtattggaagagatcctcccgccgagacacagcctcagaaccctcccgcccagcctgcaccaaatgcgtggcaagtgatcaagggggtactatttaggatctttatcatctgggcaatcagctcttggtttagacgcggccccgcgccacaggatcaggccggcccaggaggggcgccacgggtggcgtcacgcaacctctttcccaaagacactcttatgaacctccacgtttacatatccgaacatgaacactttacagactttaatgcaacctccgccttattttgggaacaacacgatctcgtgtacggagactggacaagtggcgagaattccgacggctgctatgagcactttgccgagttagatatacctcagtcagtgcagcaaaacgggagcatctacattcatgtctactttacaaagtctggcttccatccagatccacgccagaaggcattgtatcgccgtctagcaaccgtacatatgagcaggatgattaacaagtacaagcgacggcgattccaaaagactaaaaatctcttgacaggcgagacggaagccgacccggaaatgatcaagagagccgaagattacggcccagtggaggtgattagccactggcatccaaatatcaccatcaacatcgtggatgaccataccccctgggttaaaggttccgtgcctcctcctctcgaccagtatgtgaaatttgacgccgttagcggcgattattatccaatcatctattttaacgactactggaacctccagaaggattattatccaatcaacgagagtttggcctctctgcctctgcgagttagcttctgtcctctgtccctctggcggtggcaactctatgcagcacagtctaccaaatccccctggaatttcctgggcgatgaactgtacgagcaatcagatgaggagcaggacagtgttaaggtggccctgttggagacaaacccctacctcctggcgctgactattatcgtgtcaattgtccactctgtctttgagtttctggcatttaagaacgatatacagttttggaatagtcggcagagtctggaaggcctttccgtgagatcagtgtttttcggagtgttccaaagctttgttgtcctcctgtacattctggataatgaaaccaacttcgtggttcaagtgagtgtattcatcggagtcctcattgacttgtggaaaatcaccaaagttatggatgtgaggttggacagagagcacagagtggcaggaatctttccgaggttgtccttcaaggacaagtcaacctacattgagtcctcaactaaggtctatgacgatatggccttcagatacctcagctggattctctttccattgctgggctgttacgcagtttactcactgctgtatctcgaacacaaagggtggtattcatgggtattgtccatgttgtacggatttctgctgacattcggtttcattaccatgaccccacaactattcattaattacaagctcaagagcgtcgcccatcttccgtggcgcatgttaacctataaagcactgaatacgtttatcgatgacctgttcgcctttgtcatcaagatgcccgtgatgtacagaatagggtgcctgcgggacgatgtggtgttcttcatttacctgtatcaacgctggatctatagggtggatcccacccgcgtaaacgaattcggaatgtccggtgaggaccctacggctgccgctcccgtggctgaggtgcctactgctgccggggcgctgactcccaccccagcgccgactaccactaccgccacaagagaggaagcatcaacctcattgcctactaaacccacacaaggagcatcctctgcttccgaaccacaggggctgttcgtcgaagcactatcagtgcccctgtcactctgtgtcagttcccatctggccttaccagcccagcaccattgggaaagttggtag

SEQ ID NO: 25552 - DNA, 1968 bp, Artificial Sequence
  Description of Artificial Sequence: Synthetic coding sequence
atgtcaaggaaagcgcacatcacagagaaagtcacctcaaatggtagtataggacgagatcctcctgcagagacgcagcctcaaaatccccccgcccagcctgcaccaaacgcttggcaggttatcaaaggagtgctgtttagaatcttcatcatctgggccatttctagttggtttagacggggacccgcacctcaagatcaggccgggcccggcggggctcctcgtgtggctagccgcaaccttttcccaaaagatactctgatgaacttgcatgtctatatctctgagcatgaacatttcaccgacttcaacgccacaagcgctctgttctgggagcagcatgatctggtatatggcgactggacctcgggtgaaaactctgatggctgctacgaacacttcgctgagctggacatcccccaaagtgtccagcagaacgggagcatctacatccatgtttactttaccaagtcagggttccatcctgatcccaggcagaaggccttataccgcagattggcaaccgtacacatgagcagaatgatcaacaaatacaaaaggcggaggtttcagaaaacaaaaaacttacttactggagaaaccgaagcggacccagaaatgatcaaacgagcggaggattacggccccgtagaggtcatttcccactggcatccaaacatcaccataaacatcgtggacgatcacactccgtgggtcaaggggtccgtgccaccacccctcgaccagtacgtcaagttcgatgctgtctctggcgactactacccaattatttacttcaacgactactggaacctgcagaaggactactatcccatcaatgagtcgctggcctcactgcctctgagggtgtccttctgccctctgagtctctggagatggcagctgtacgcggctcaaagcactaaaagcccatggaacttcttaggcgatgagctgtatgagcagtcggatgaggagcaggacagcgtcaaggtggccctcttggaaacgaacccttatctgcttgccttaacaatcatcgtttctatcgttcacagcgtgtttgagttccttgcattcaagaacgacatacaattttggaactccaggcagagtctcgagggcctgagtgtcagaagtgtctttttcggtgtttttcagtccttcgtggtgctcttgtatatccttgataacgaaaccaacttcgtagtgcaggtttccgtgtttataggcgtccttatcgatctgtggaagatcacaaaggtcatggatgttagactcgacagggagcaccgggttgcaggcatatttccccggcttagtttcaaagataaatccacctacattgaatcgagtacaaaagtctatgatgatatggccttcaggtatctgtcttggatcctctttcccttgctgggctgctatgccgtctactcactgctctatttagagcacaaggggtggtacagctgggttctgagcatgctctacggctttctgctcacctttgggtttattaccatgacaccccagctgtttatcaactacaagctgaaatcagtagcgcatctgccatggcgtatgttgacttataaagcactcaatacttttattgacgatctgtttgcattcgtgatcaaaatgccagtcatgtacaggatcggctgcttacgggacgacgttgtattcttcatctacctgtaccagagatggatttatcgagtcgatcctacacgggtaaatgaattcggcatgagcggcgaagacccaacggccgccgctcccgtggccgaagtgccaacagcagcgggggccttgacccccacacccgcccctactaccactactgctacccgcgaagaggcgagtacaagccttcctactaagcctacgcagggcgcaagctccgcctcagaaccacaagaagcacctcccaagccggcggaggataaaaaaaaggactag

SEQ ID NO: 25553 - DNA, 1704 bp, Artificial Sequence
  Description of Artificial Sequence: Synthetic coding sequence
atgaatctgcacgtgtatatttccgaacatgaacacttcaccgacttcaacgcaacatcggcgcttttctgggagcagcacgatttagtctatggcgattggacctctggcgaaaactcagacggatgttatgaacacttcgctgagcttgacattccccagtctgtgcagcagaatggctctatctacatccatgtctactttactaagtcagggtttcacccagatcccagacagaaggctctgtatcgacgcttagctacagtgcacatgtccagaatgattaacaagtataagaggcgtcggtttcaaaaaaccaagaaccttctgacaggcgaaactgaagcagaccccgagatgattaaaagagccgaggattacggccccgtagaagtaatatctcactggcatccgaatatcacaatcaatatagtggacgatcataccccctgggtgaaagggagtgtccctcctccattagaccagtacgtcaagtttgatgccgtgtccggtgactattaccccattatctattttaacgactactggaatctgcagaaagattactacccaatcaatgagagtctggcttcgttgccactgcgcgtcagcttttgcccactgtccctttggcggtggcagctatacgcggcacaaagcaccaagtccccatggaacttcttgggagacgagttatatgagcagtctgatgaggaacaggactccgtgaaggtcgctctgctcgagactaacccttatttgctggccttgaccataatagtatctatcgttcacagcgtttttgagttcctggccttcaaaaatgacattcaattttggaacagccgccagtcactggaaggcctctccgttagaagtgtgttttttggagtgttccagagtttcgtcgtactgctatacattcttgataatgaaacgaacttcgttgtacaggtgtccgtgttcattggtgttctgattgatctgtggaagatcacaaaggtgatggacgtccgactggacagagaacatcgggtcgccgggatctttcccagactttctttcaaggataagtcaacatacatcgagtccagcacaaaggtctatgacgacatggccttccgctatctgtcctggattctgtttcctctcctcggctgctatgcggtttactctcttctgtacttggaacataaaggatggtacagttgggttctgtcaatgttgtacgggttcctacttacgttcgggtttattactatgaccccgcagctgtttatcaactacaagttgaaaagtgtggcgcatctaccatggcgtatgcttacctacaaagctctgaatacatttatcgatgatctgtttgcattcgtgatcaagatgcccgtcatgtatcggatcggttgccttcgggatgatgttgtgttcttcatctacctttatcaaaggtggatttaccgagttgatcccacaagggtaaacgaattcggcatgtctggcgaagaccctactgccgccgctcccgttgctgaggtgcctaccgctgctggtgccctgacaccaactcctgcccctaccactaccacagccacccgtgaggaggcctccacctctctgccaactaaacctactcagggcgcttcttcagcaagcgagccccaggaggccccccccaagccagctgaagacaaaaagaaggactag

SEQ ID NO: 25554 - DNA, 2124 bp, Artificial Sequence
  Description of Artificial Sequence: Synthetic coding sequence
atgctgggtagcctggtgctcaggagaaaggccctggcccccagactccttctgagactgctgcgctctcctaccctgagaggacacggaggagcctcgggcaggaacgtgaccaccggttctctcggggagccgcagtggttacgtgtggccactggagggcgtcctggcacctcgcccgcgctattctccggccgtggtgcagcaaccggcggtcgacaggggggcagattcgatacaaagtgcctggccgctgccacgtggggccgtctgcccggcccggaggagaccctgcctggacaggattcatggaacggagtcccatcgagggctggactaggtatgtgtgcccttgctgccgcgcttgttgttcactgttattctaagtctccgagcaacaaggatgctgcactcctagaagccgcccgggcaaataatatgcaagaagtgtcacgtcttctgagcgaaggcgccgacgtgaatgccaaacaccggctcggctggacagcattaatggttgccgccattaacaggaataacagcgtggtgcaggtgctcctggccgctggtgctgatccaaacctaggcgatgattttagttctgtttacaagacagcaaaagagcaaggaatacactctttggaagatggcggacaggacggcgcatcacgccatattactaatcagtggactagtgccctcgagttcagaagatggttgggccttcccgcgggagtgctcattacccgcgaggacgatttcaacaatcgtctgaataaccgcgcatcttttaaagggtgcacagcgcttcactacgccgtgcttgcggacgactatagaacagtcaaggaactgctggacgggggcgctaacccattgcaacgcaacgaaatgggtcatacacctctggactacgcccgagaaggcgaggtgatgaaattactgaggactagtgaagccaaataccaggagaaacagcggaagcgagaggccgaagaaagaagacgattccccctggaacagaggctcaaggagcatatcattggccaagagtcagcaattgcaaccgtcggggcagctatcaggaggaaggaaaacggatggtacgatgaagaacaccccttagtgtttctgtttctcggttcctccgggatcggaaaaacagagctggccaaacagacggcgaaatacatgcataaagatgcaaaaaaaggcttcattaggcttgatatgtcagagttccaggaacgacacgaggtggcaaagtttataggtagcccccccggctatgtaggacacgaagaaggtggtcagctcaccaagaaacttaagcagtgccccaatgccgtggtgctgttcgacgaagtggataaggcacatcctgatgtcctgaccattatgctgcaactgttcgacgaaggccgtctaacagacggcaaagggaagacgatcgactgtaaagacgccatcttcataatgaccagtaacgtcgcttctgacgagatcgcccagcacgccctgcagttaaggcaggaagcccttgagatgagcaggaatagaatcgccgaaaacctcggagacgttcagatctctgacaaaattacaattagtaagaattttaaggaaaatgttattcggccaattctcaaagcccattttcgccgagatgagtttctgggtaggattaacgagattgtgtacttcctgcctttctgccatagcgagctgatacagcttgtaaacaaggagctgaatttctgggctaaacgggcaaagcagagacacaatatcactttgctatgggatagggaagttgcagacgttctggtggatggctataacgtgcattacggcgctagatcaattaaacacgaagttgagcgcagggtggtgaatcagctcgctgcagcttatgaacaagacttactgccagggggctgtaccctgcgaatcaccgtcgaggatagcgataaacagctgttgaagtcccccgaactgccgtctccccaagctgagaagagattacccaagctgcggctggagattattgataaggatagcaagaccagacgcctggatattcgggctcctctccacccggaaaaagtgtgcaacaccatatag

SEQ ID NO: 25555 - DNA, 1989 bp, Artificial Sequence
  Description of Artificial Sequence: Synthetic coding sequence
atgcctcgcggctgtcatcttggcacgccgtcctggagccgccgcaatacccctagaaccggacagctcgaacgcgggccccagcagggacggacaggtcacgtcagaccaggccgatcggccggcgggtccctcctacagcaggaatctgtccagcagggctgttctcctgtcggcagctgcccctgccaacagtatgctcggtctcaacagccgcaggaaactgcgaagaacgacgctcagtcccgcagttgggccggccttaatgcaggagttagtctgaagaacaccaaaatttcatcgagcgaatggccccttcgattactaagtgagggtgcagacgtgaatgccaaacatagactaggctggaccgcgctgatggtggcagctattaaccggaacaatagtgtagtccaggtgctgctcgccgcaggagcggaccctaaccttggggacgatttttcttctgtctacaagactgctaaagagcaagggatacacagcctggaggacggcgggcaggacggtgcatcacgacacatcacaaaccagtggacatcagccctggaatttcgtcggtggctcggtctaccggccggggtgctgattactagagaggacgatttcaacaaccgccttaataaccgggcctcttttaaaggttgtacagcactgcattatgccgtgttggctgatgactatagaaccgttaaagagctattggatggaggagcaaatcctctgcagagaaatgaaatgggacatactccactcgactacgcccgcgagggtgaggtcatgaaactgttacggacttcagaagcaaagtaccaggaaaagcagcggaagcgagaagccgaagaaaggaggcgattcccactcgagcagcgtctgaaagagcacattattggacaggagagcgcaatcgccactgtgggcgccgcaatccggcgcaaagaaaatgggtggtatgatgaggagcacccactggtgttcctgttcttgggatcttccggaatcggaaagactgagctggcaaaacaaaccgccaagtatatgcacaaggatgctaagaagggatttattcggttggatatgtcagagttccaagaaaggcacgaagtggcaaagttcatcggctctcctcctggatacgtgggccatgaggagggtgggcagcttacgaagaaacttaagcagtgccctaacgccgtagtgttgtttgacgaggtcgataaggcacacccggacgtgctgaccatcatgttacagctgtttgacgagggcaggttaactgacggcaaagggaagaccatagattgcaaggacgcgatttttattatgacttcgaacgtggcctccgatgaaatcgcacagcatgctttgcagctgagacaggaggctctggagatgagccggaatcgaattgcagagaatctcggcgacgtgcaaatctcagataagatcactatctccaagaatttcaaagagaacgtcattagaccgatcctgaaagcgcactttcgcagagacgaatttctgggcagaatcaatgaaatcgtgtactttttgcctttctgtcatagtgaattgatccagttggtgaataaggaattgaacttttgggccaagcgcgcaaagcagcggcacaacatcacgttactgtgggaccgcgaggttgctgatgtactagtcgatggctacaacgtccattatggtgcccggtcaataaagcatgaagtggaacgccgagttgtaaaccagctcgccgccgcgtacgaacaggacctgttgccgggtggctgtactcttcggatcacagtcgaagacagtgataaacagcttttgaaaagtccagaactgccatctccccaggccgaaaagcggctcccaaaactgcggttggagatcatagacaaagactcaaaaactcgccgtttggacattcgtgcaccattacaccctgagaaggtgtgcaataccatctag

SEQ ID NO: 25556 - DNA, 2034 bp, Artificial Sequence
  Description of Artificial Sequence: Synthetic coding sequence
atgctcggatccctggttctacgacgcaaggccctggctccgcggctgttgctgaggctgcttcgctcacctacgttgagaggacatggcggcgcctccgggcggaacgttaccaccggatctctgggagagcctcagtggctgcgcgtggccactggcggccgtcccggcacatcccctgcattattcagcggaaggggagccgccacagggggccgtcaaggaggacgtttcgacaccaagtgcctggcagcagccacctggggtcggctgcctgggcccgaagagactttacctggacaagacagctggaacggagttccatctagggcaggtttaggcatgtgcgcattggccgccgctctcgtcgtccactgttattctaagagcccgtccaacaaggacgcggccttgctagaggctgcgagggccaataatatgcaagaggtgtctcggctgctgagcgagggggccgacgtgaacgcgaaacaccgattaggatggacggctcttatggtggcagccattaataggaataattctgttgtccaggtcctccttgctgccggagccgatcctaatctgggggacgatttttcttccgtctataaaactgccaaagaacagggtattcactcccttgaagtcttaattacgcgcgaggacgacttcaataaccggttaaacaaccgagccagcttcaaaggctgtacagctctccattacgctgtcttggcggatgactatcggaccgtgaaggagcttctagacggaggcgctaaccccctgcagaggaatgaaatgggccacacacctcttgattatgcccgagagggcgaagtgatgaagctgctgagaaccagcgaggcaaaataccaggagaaacagagaaaaagggaggctgaggagcgtagacggtttcccctcgaacagcggttaaaggagcacatcatcggccaggagtccgcaatcgctacagtaggtgccgcaattaggcgcaaggagaatggctggtacgatgaggagcaccctttggtgttcttgtttctgggatcttctgggatcggaaaaactgaactcgctaagcagactgcgaaatatatgcacaaagacgccaaaaaaggctttattcgcctcgatatgagtgagttccaggagcgtcacgaggtggcaaaattcattgggtcacccccaggttatgtggggcatgaagagggcggtcaactgaccaagaaattaaaacagtgccccaacgctgtggtcctcttcgatgaagtggacaaggcccatccggatgtgttaaccatcatgcttcagctgttcgatgaaggtcgacttaccgatggaaaaggaaaaacaatagattgcaaggatgcaatcttcatcatgacgagcaatgtggcatctgatgagattgcacagcacgccttacaacttcggcaggaggccctggaaatgtctcggaatcggatcgctgagaatctgggtgacgtgcaaatttccgacaagattacaatatccaaaaactttaaagagaacgtgatcagaccaattctcaaggcccactttcgtcgagacgagtttctcggtcgcataaacgaaattgtctattttcttccgttttgccattctgaactcatccagttagtcaataaggaacttaatttctgggcaaagagggcaaaacaaagacataacataaccctgctgtgggatagggaggtggcggatgttctggtggatgggtacaacgtccattacggtgcacgttccatcaaacatgaggtcgaacggcgcgtggtgaatcagctggcagccgcttacgagcaggacttactgcccggcgggtgcacactcagaataacagtcgaggatagcgataaacaattgctgaagagcccagaactgccatccccacaggcggaaaagcgcttgcccaagctgcgtctggagatcattgacaaggattccaagacgaggagactcgacatcagggcccctctccaccccgagaaggtgtgtaacactatctag

SEQ ID NO: 25557 - DNA, 1521 bp, Artificial Sequence
  Description of Artificial Sequence: Synthetic coding sequence
atggtggctgctattaatcggaataactctgtcgtgcaagtgttattggctgccggtgcagatccgaacctcggcgatgatttcagcagcgtttataagactgccaaagaacagggtattcatagccttgaggtgttaattactcgcgaggatgacttcaataacaggttgaacaaccgcgcttccttcaagggctgcacagccctgcattatgccgtgctcgcagacgattatcgcacagtgaaggagctcttggatggtggagccaatccactgcagcggaacgagatggggcacactcccttggactatgccagggagggggaggttatgaaactgctgaggaccagcgaggctaaataccaggagaagcagagaaagcgggaagccgaggagcgtagacggttccctctagaacagcggctgaaagaacacattattggccaggaatccgcaattgctacggtaggagcggccatccgccgaaaggagaatgggtggtatgacgaggaacaccccctcgtgttcctctttctgggaagttccggcatcggcaagacggagctggctaagcagaccgctaagtatatgcacaaggacgctaaaaagggtttcataagattagatatgtctgagttccaggagcgtcacgaagtggctaagtttatagggagtccaccgggctatgtgggacatgaagagggtggtcaactgacaaaaaaactgaagcaatgtcccaacgccgtcgtgctctttgacgaggtggacaaggcccatcctgatgtgcttactataatgctgcaactcttcgacgaggggcggctcactgatggtaagggtaaaacaattgattgcaaagatgcgatcttcattatgacttcgaacgtggcctcagatgagatcgcccaacatgccctgcagctgaggcaggaggctctggagatgtctcggaacaggattgccgagaacctaggcgatgtccagatttccgacaagatcaccatctctaaaaattttaaggagaacgtgattaggccgatcctgaaggcccattttagaagggacgagtttttaggcagaattaatgagatagtgtatttcttacctttctgtcatagcgagctgatacaactcgtgaacaaagagctgaacttctgggctaaacgcgctaaacaacggcataacataacattactgtgggacagagaggtcgccgatgtccttgtggacggttataacgtgcactacggggctcgaagcatcaagcacgaggtggagagaagggtggttaaccagctggccgcagcgtacgagcaggacttactccccggcggatgcaccctgagaattactgtagaggactctgataagcaactgcttaaaagtcctgagctcccatctcctcaggccgagaaacgcttgccaaagcttcgcctcgagattattgataaggactctaaaacaaggcgtttagacatacgcgcccctttgcatccagagaaagtatgcaatacgatttag

SEQ ID NO: 25558 - DNA, 1902 bp, Artificial Sequence
  Description of Artificial Sequence: Synthetic coding sequence
atgccctcttgtggagcttgtacctgcggcgctgccgcagttcggctgataaccagtagcttagcctccgcacagagaggcatttccggaggtcggatccacatgagtgtgctgggccgccttggcacgtttgaaacacagatcttgcagcgagctcctctgcgctcatttaccgaaacacccgcctactttgcctctaaggacggtatatcaaaagatgggtctggggatggcaacaagaagtcagcctctgaagggtcctctaagaaaagtggctcaggcaacagtgggaaggggggaaatcagctccggtgccctaaatgcggcgacctatgtacacatgtggagacatttgtgtcctccacccgttttgttaaatgtgagaaatgtcatcacttcttcgtcgtgctgtcggaggcggatagtaaaaagtcaatcatcaaggagcctgaatccgcagctgaggccgtgaaacttgcctttcagcagaagccacccccaccacctaaaaaaatttataattatttagacaagtacgtggtaggtcaatctttcgccaagaaggttctgtctgttgctgtatataaccattataaacgcatttacaataacataccagcaaatctgcgccagcaggctgaagtagagaaacagacatctttgactccgcgagaactggagataagacgtcgcgaggatgagtacagatttaccaagctgttgcagattgctggtatttcgccccatggaaacgcattgggcgcaagcatgcaacaacaggtcaaccagcagatcccacaggaaaaacgaggtggggaggttctggacagcagccatgatgatataaaacttgaaaagagcaatatcttgttgctcggccctaccggaagcggcaaaacattgctggcccagacactggccaaatgcctggatgtccctttcgccatatgcgactgcactaccctgacccaggcagggtatgtgggagaggatattgagtcagtgatagcaaaattgctacaagacgccaactataacgttgagaaggctcagcagggcattgtcttcctagatgaggtggataaaatcgggtccgttcctggtatccaccagctcagggacgtcggcggggaaggcgtgcagcaaggattgttgaagctcctagaaggcacaattgttaacgtgcccgagaagaatagtcggaaacttcgtggagaaaccgtgcaagtcgacacaactaatatcttgtttgtagcatctggcgcattcaatggactcgataggatcatctcccgacgtaaaaatgaaaagtacctgggctttgggaccccatccaacctgggcaaggggaggcgagccgccgcagcggccgatttagcaaatcgcagcggcgaatctaatactcaccaggacattgaagagaaagatagactcctgagacacgtggaggcccgcgacctcattgagtttggaatgattcctgagtttgtgggtcgcctaccggtggtcgtccccctccactcactcgacgagaaaacgcttgtgcagattctcaccgagcctagaaatgcagtcatacctcaatatcaggccctgttctcaatggataagtgcgaactaaacgtcactgaagatgctctcaaagctattgctcgcctggcactggagcgcaagacaggagcccgcgggctccggagcataatggaaaaacttttattggaacccatgtttgaagtacccaactccgatatcgtctgtgttgaagtggataaggaagtggtagagggcaagaaggagcccggatatattagggccccaacaaaagaatccagtgaagaggaatacgacagcggggttgaggaggagggatggccacgtcaggcagatgctgctaatagttag

SEQ ID NO: 25559 - DNA, 1602 bp, Artificial Sequence
  Description of Artificial Sequence: Synthetic coding sequence
atgccgagctgcggggcctgcacttgcggcgctgccgccgtccggctgatcaccagcagcttggccagcgcccaacggggaataagcgggggacgcatacacatgtcagtgctaggacgtctcggcacattcgagactcagattctgcagcgggcgcccctgaggagcttcaccgagacacctgcctatttcgccagtaaagacggtataagcaaagatggctctggtgatggcaacaaaaagagcgcctcagaagggtctagcaaaaagtctggttcggggaatagtggaaaaggcggcaatcagctgcgttgccctaaatgcggcgacctatgcacacacgtcgagacgtttgtgagcagtacacgcttcgtgaaatgtgagaaatgccatcactttttcgtggtgctgtccgaagccgattctaaaaagtcaatcataaaagagcctgagtcggccgcagaagccgtcaaacttgccttccagcagaagccccctcctccaccaaaaaagatctataactatttggacaagtacgtggtcggccagagctttgccaagaaagtactatcggtggccgtttacaatcattacaagcggatttataataacattccagcaaatctgcgacagcaggcagaggtggagaaacagactagcctcacgcctcgtgaactggagatccgccggagggaggacgagtataggtttacaaagcttctccaaattgcggggatcagcccacacggtaatgccctcggcgcctctatgcagcagcaagtgaatcagcagataccccaggagaagcgtggcggagaggtgctcgattcctcgcatgacgatatcaagttggagaaaagtaacattctgctgcttggtcctaccggttcaggaaaaaccctgctggctcaaacattagcaaagtgtctggatgttcccttcgcaatctgtgactgtaccacactgactcaggccggctatgtcggcgaggatatagaatcagtgatcgcgaaactgcttcaggacgctaattataacgtggagaaagcgcagcagggaatcgtatttcttgacgaggtggacaaaataggctccgtgcctggcattcaccagctgagagacgtgggaggcgagggcgtgcaacaggggctcttgaagctgctcgaaggaactattgtgaacgtccccgagaagaatagcagaaaactgcgaggcgaaacagtgcaggtggatacaactaacattctcttcgtggcatcaggagcttttaatggtttggatagaattatctctaggaggaagaacgagaagtatctcgggttcggcaccccgagcaacctgggcaagggtcgaagggccgctgccgccgctgatttggccaacaggagcggagaatccaacactcaccaggatattgaagaaaaggataggctgcttaggcacgtggaggcaagggatctgatcgagttcggaatgattccagagttcgttgggaggcttccagtggttgttccactgcattctttggatgaaaagacattagtccagatactaactgagcccccgcacccggctctgttcacaatctttaatcccttctag

SEQ ID NO: 25560 - DNA, 2625 bp, Artificial Sequence
  Description of Artificial Sequence: Synthetic coding sequence
atgttaaagaagtttgacaagaaggacgaagaatccggtggaggtagtaatccatttcaacatttggaaaagagcgcagtcttgcaggaggctcgagttttcaacgagacacctatcaacccacggaaatgcgcacatattctgaccaagattctgtatctgattaatcagggagaacatttgggcaccaccgaagctaccgaagcttttttcgcaatgacaaagcttttccagtcaaacgaccctacactgcgccggatgtgttacctgacaatcaaagaaatgagctgtattgcagaagatgtcatcattgtcactagcagcctcaccaaagacatgaccgggaaggaggacaattatagagggccagccgtgcgggcactgtgccagattacggattccaccatgctccaggccattgaaaggtatatgaagcaggccattgtcgacaaggtgccaagcgtgtcgagtagtgcgctagtgagctcattgcacctcctaaagtgttcctttgacgtggtgaaacggtgggtcaatgaggcacaggaggcagcctcctccgataacattatggttcaataccacgccctagggctcctttatcatgtccgcaaaaacgataggttggccgtcaataaaatgatctctaaggtgacccgccacgggctgaagtctccgtttgcctactgtatgatgatccgggtcgcgtcaaaacagctggaagaagaagacggcagtcgagattccccactcttcgacttcattgaatcatgtttgaggaacaagcatgagatggtagtctacgaagctgcaagtgcaatcgtgaatcttcctgggtgctccgccaaagagctagctcccgccgtttcagtgctgcagctgttctgtagtagccccaaggcggccctgcggtacgcagcggtccgcacattaaataaggtcgcgatgaaacacccatctgctgttacagcgtgcaatttagatttagaaaatctggttaccgatagtaaccggagcatcgcgactctcgccataactactctgctaaagacagggtccgagtcatctatcgacagactgatgaagcaaatttcaagtttcatgtctgaaatcagcgacgagttcaaggttgtggtcgttcaagccatcagtgctctgtgtcagaagtaccccagaaaacatgccgtcctcatgaacttcctcttcaccatgctgcgagaggaaggtggctttgagtacaaaagggcaattgtggactgtatcatcagcatcattgaggagaactctgaaagtaaagagacgggcctcagtcatctatgtgagttcatcgaggattgtgaattcacggtactggcaacccgcatcctgcacctgctgggtcaggaagggccaaaaacaaccaacccgtccaaatacattcgatttatatacaatcgggtggtcctggaacatgaagaagtgcgagctggcgcggtctccgctcttgccaaatttggcgcgcagaatgaggagatgctaccttctatcctggtactcctgaagagatgtgtaatggacgatgataacgaagtccgcgatagagccacgttctacttgaatgtgctcgaacagaagcaaaaggcgctgaatgccggatatatcctgaatgggctgactgtgtcaatcccggggctggagcgcgccctccaacagtacacattggagccaagcgagaagccatttgaccttaaaagcgtccccctggccacagctccaatggcagagcaacgaaccgaaagtacgcccattactgcagttaagcagcctgagaaagtcgcggctaccaggcaagaaatttttcaggaacaattggctgcagtgccagagtttcgaggcctgggtccgctattcaaatcgtcccctgagccagtggcccttactgagtctgagacagaatatgtgatcagatgcacgaagcacaccttcacaaatcacatggtgttccagttcgattgtaccaatacacttaacgaccagaccctggaaaacgtgactgtccaaatggagccgaccgaggcctatgaagtcctgtgctacgttcccgcgcgctctctcccatataatcaaccagggacatgttacacactagttgctttgcccaaggaagatcctacagctgtggcctgtactttctcttgtatgatgaagttcacggtcaaagactgtgatcccactacaggcgaaaccgacgatgagggatatgaagacgaatatgttctcgaggaccttgaagtgaccgtggctgatcacatacagaaagttatgaagctgaacttcgaggccgcttgggatgaggtcggagatgagttcgagaaggaggaaacgtttacactgagtacgattaagactctggaagaggctgtcggaaacatcgttaaatttttgggaatgcacccatgcgaacgctcagataaggtccccgataataaaaatacccataccttgctgctcgccggagtgttcagggggggacacgacattctcgttcgcagccggctcctcctgcttgacaccgtcacaatgcaggtcacggccaggtccctcgaagaattaccggtcgatatcatcctggccagcgtgggatag

SEQ ID NO: 25561 - DNA, 534 bp, Artificial Sequence
  Description of Artificial Sequence: Synthetic coding sequence
atggaggccctcatcctcgagccttctctgtataccgtgaaggccatactgatcctcgataatgatggggatcgactgtttgccaagtactatgatgatacatatccatcagtcaaagaacagaaagcctttgagaagaacatcttcaacaagacccatagaaccgatagtgaaatcgctctgttggagggccttactgtggtctataaaagttcaatcgatctctacttttacgtgatcgggtcctcttatgaaaatgaactgatgctaatggcagtgctcaattgcctgttcgactctctatctcaaatgttgcgcaaaaatgtcgagaagcgggcactcctggaaaacatggaaggtttgtttctggccgttgatgagatcgtggatgggggtgtaattctggagtctgatccacaacaagttgtgcatcgggtggctctccgtggagaagatgtgcctctgacagagcaaacagtgtcccaggtgttacaaagtgctaaagagcaaatcaaatggagcctgcttagatag

SEQ ID NO: 25562 - DNA, 381 bp, Artificial Sequence
  Description of Artificial Sequence: Synthetic coding sequence
atgatggaaatagacttcctgcccagcactatgacaactcccacccccgtatccagaagtaagagacccctgagacgcaccttcagcacgcggccaataggacttacactgatgttaatggcagtgctgaattgcctctttgattccctgtctcagatgctccggaagaacgtagagaagcgcgccctgctggagaacatggaaggcctcttccttgccgtggatgagattgttgacgggggggtgatcctggaaagcgatcctcagcaggttgttcatagggtggcgctgcggggcgaagacgtgcctttgacggagcaaacagtcagtcaggttttgcagagcgccaaagagcagatcaaatggagcttactgagatag

SEQ ID NO: 25563 - DNA, 465 bp, Artificial Sequence
  Description of Artificial Sequence: Synthetic coding sequence
atggaagctttaatcctctactatgacgacacatatcccagtgttaaggagcaaaaagctttcgaaaagaatatattcaacaaaacgcacagaacagattccgaaattgcccttctggaaggtttaaccgttgtctacaaatcctccatagacctttacttctacgtcattggctcatcctacgaaaatgagctgatgctaatggccgtcctgaactgcttgtttgattccctttcacagatgcttcgcaaaaatgtggaaaaaagggccctcctggagaacatggaggggcttttcttagctgtcgatgagatcgttgatggaggagtaattctggaatccgacccccagcaggtggttcacagggtcgctctccgcggggaagacgtcccgcttacggagcagaccgtgagccaggtactccaatctgctaaagagcagatcaaatggagcctgctacggtag

SEQ ID NO: 25564 - DNA, 279 bp, Artificial Sequence
  Description of Artificial Sequence: Synthetic coding sequence
atggaggccctcattctggaaccttccttgtacaccgtcaaggccattttgatcctcgacaacgatggcgacagactgttcgcaaagtactacgatgacacctacccctcagtcaaagagcagaaagcttttgaaaaaaatattttcaataaaactcatcgaaccgattccgagatcgccctgcttgaaggtctcacagttgtgtataagagctctatagacctgtatttctacgtgattggcagctcatatgaaaatgaactgatgctgatggcttag

SEQ ID NO: 25565 - DNA, 744 bp, Artificial Sequence
  Description of Artificial Sequence: Synthetic coding sequence
atggcctgggccggctctcggcgtgtgccggctggaaccagagcagccgcagagaggtgctgtagactgtccctgagtccaggcgctcaaccagcccccccgcccggacctctccccccaccgcgccccatgcgtttcctgacctcgtgctctcttctgctgccaagagccgcccagatcctggcggcggaggctgggctgcccagctctcgatctttcatgggtttcgccgccccctttaccaacaagagaaaggcttatagcgagagaaggatcatgggctacagtatgcaggaaatgtatgaagtggtaagtaacgtgcaggagtaccgtgagttcgtcccctggtgcaagaagagtttggttgtatctagtcggaagggacatttaaaggcacaactggaggttggtttccctccggtaatggagaggtatacatccgcagttagcatggtgaagccgcacatggtgaaggcagtgtgcaccgacggtaaactgttcaatcatttggagaccatctggcgattctcccccgggattcccgcttaccctaggacttgcactgtcgattttagcatctcattcgagttccgcagtctgctgcactctcagttggctaccatgtttttcgacgaggtggtcaagcaaaacgttgccgcattcgaacgccgggccgcaaccaagttcggcccagagaccgccattcccagggaactaatgttccacgaggttcaccaaacctag

SEQ ID NO: 25566 - DNA, 648 bp, Artificial Sequence
  Description of Artificial Sequence: Synthetic coding sequence
atgctgctccaggtggtgcgcgaagggaaattcagtggattcttgacgtcttgtagtcttctcttgccacgagctgctcaaattttagcagcggaagcgggtcttccttcatctcgctccttcatgggctttgccgctccatttactaataagcgtaaggcctattctgaaagaaggataatggggtactccatgcaggaaatgtacgaagtggtgtcaaacgtccaggagtacagggagtttgtgccttggtgcaagaaaagtctggttgttagctctcgcaaaggccatcttaaggcacagcttgaagtcggctttccgcccgtgatggagagatatacatcagccgtgtccatggttaagcctcatatggtaaaggcggtgtgcactgacggtaagctcttcaatcatctggagactatctggcgcttctcccctggtattccagcttatcctagaacgtgcaccgtcgacttcagcatctcgtttgaatttagaagtctgcttcactcacagcttgccaccatgttctttgatgaggttgtcaaacagaatgttgcagcattcgagaggagggctgccactaagtttgggccagagaccgcaatccccagggaattgatgttccacgaggtccaccaaacctag

SEQ ID NO: 25567 - DNA, 693 bp, Artificial Sequence
  Description of Artificial Sequence: Synthetic coding sequence
atgcacagctcatcccctagccccaccaatgataggggactccgccgcaccatccgcctggctccccttagtttcggactgcgctttttgacaagctgctcactacttctcccgagagcggcccagatcctggccgctgaagcggggcttccgtcgtcccggtcatttatggggttcgccgccccgttcaccaataaacggaaagcttactctgaaagacgcatcatgggttatagcatgcaggagatgtacgaagtcgtgagcaatgttcaagagtaccgggagtttgtcccctggtgtaagaagtccctggtggtttctagccggaagggtcatctgaaggctcagctggaggtgggttttccacccgtcatggagcgatacacttctgcggtgtctatggttaagcctcatatggttaaggcggtttgtactgatggtaagctgttcaaccatcttgagacaatatggcggttcagtcctggcattcctgcttacccaaggacgtgcaccgtggacttttctatttcattcgaattcaggtcattgctgcactcccagctggcaactatgttctttgacgaagtggtaaaacagaacgtggcggccttcgaacggcgggcagccaccaagttcggtccagaaactgcaattccgcgggaactgatgtttcatgaggtgcatcaaacatag

SEQ ID NO: 25568 - DNA, 195 bp, Artificial Sequence
  Description of Artificial Sequence: Synthetic coding sequence
taacgcacctgcactgtggatttctccatatcgttcgaatttaggagtttgctgcactcacagctggccaccatgtttttcgacgaagtagtaaagcagaatgtggcagctttcgagcggagagccgctacaaagtttggacccgaaactgccattcctcgcgaactaatgtttcacgaagttcatcagacctag

SEQ ID NO: 25569 - DNA, 717 bp, Artificial Sequence
  Description of Artificial Sequence: Synthetic coding sequence
atggcagctagaaccggtcacaccgctctgcggagagtggtatcaggatgccggccaaagtccgcaacagcagccggggcacaggctccagttcgcaacggcaggtatctggcgtcgtgcggcatcctgatgtctcgcacgttaccgcttcacaccagcatactgcccaaagagatctgcgcccgcaccttcttcaagatcacagcccccctaatcaataagcggaaagaatactcagagagaaggatcctcggatactcaatgcaagagatgtacgacgtagtgagtggcgtggaggactacaagcacttcgttccttggtgcaagaagagcgatgtcatcagcaagcgaagtggctactgcaaaacgagacttgaaatagggttccctcccgtgctcgagagatacacatctgtggtcacgctggttaagcctcacctagtgaaagcatcatgtacagacgggagactgtttaatcatctcgaaaccatctggcggttttcgcctgggttgcctggctacccccgaacatgcacacttgacttttccatcagctttgaatttagatccctgctgcactcccagctcgcaacactttttttcgatgaagtcgtgaagcagatggtcgcagcattcgagcggagagcatgcaagttatatggacctgagaccaacattcccagggaactgatgcttcacgaagttcaccatacttag

SEQ ID NO: 25570 - DNA, 633 bp, Artificial Sequence
  Description of Artificial Sequence: Synthetic coding sequence
atgggcgtttgtgtatggcgttatcttgcctcttgtggaatactaatgagccgcactttacccctccataccagtattctgccaaaggagatatgtgcaaggacgtttttcaaaatcaccgcaccattgataaacaagcggaaagagtactcagagaggcggattctcgggtactccatgcaggagatgtatgatgtggtgagcggagtggaggattacaagcattttgtgccctggtgtaaaaaatctgacgttatatcaaagagaagtgggtactgcaaaacgcgcctcgaaataggattcccacccgtgctggagaggtataccagtgtggtgactttagtaaagccacatctggttaaagctagctgcacagacgggagactgttcaatcacttggagacaatttggaggtttagcccgggcctgcccgggtacccaaggacatgcacactcgacttttccatcagcttcgagtttcggagcctcctacactcacagttggctacacttttctttgatgaggttgttaaacagatggtggccgcgtttgaacgtagagcttgcaagctctacgggcctgagacgaacatccctcgtgaacttatgttacacgaggttcaccatacctag

SEQ ID NO: 25571 - DNA, 588 bp, Artificial Sequence
  Description of Artificial Sequence: Synthetic coding sequence
atgagtcgaaccctccccctgcacacatctatcctacctaaggaaatctgcgctcgaacgttcttcaaaattactgcccccctgataaacaagcgcaaggaatatagtgagagacggatcttagggtactctatgcaggagatgtacgacgtcgtttccggcgtcgaggactacaagcatttcgttccatggtgtaagaagtccgatgtaatctcaaagaggagtgggtactgtaagaccagactcgagatcggttttcctcctgtgcttgaaagatatactagcgttgtgacgctggtaaagccacatcttgtaaaggcaagctgcaccgacggccggctgtttaaccatttggagactatttggcggttttcacccggcctgcccggctacccgaggacctgcacattggatttcagtattagttttgagtttaggtccctgctgcacagtcaactggcaacactgttttttgatgaggtggtgaaacaaatggttgcggcatttgagcggagagcatgtaagctttacggccccgagacaaatatccctagagaactgatgctccacgaggtgcatcacacctag

SEQ ID NO: 25572 - DNA, 984 bp, Artificial Sequence
  Description of Artificial Sequence: Synthetic coding sequence
atggccgcacccggttcatgtgcactgtggtcctactgcggtaggggatggtccagagcaatgcgtggatgccaactcctggggctgagaagctcatggcctggtgaccttctctcagcccggctgttgagccaggagaagcgcgcggctgaaacacatttcggctttgaaacagtgtccgaagaggaaaaaggcggaaaggtttatcaggttttcgaaagtgttgccaaaaagtacgatgtcatgaacgacatgatgtctttgggaatccatcgcgtttggaaagatcttcttctttggaagatgcatccactccctggcactcagctgctggatgtagctggcggcaccggcgacattgcatttcgctttctgaactacgtgcagtctcagcaccagcggaagcaaaagaggcagctccgtgctcagcagaacctgtcatgggaggagatagctaaggagtaccaaaatgaggaggattctttgggcggttctcgcgttgtggtatgtgacattaacaaggagatgctaaaagtgggtaaacagaaagcgctggcccagggttatcgcgctggcttggcctgggtgctgggggacgccgaggagctgcccttcgacgatgacaagttcgacatctatacaatcgcctttggtatccgcaacgtgacgcacattgatcaggctctgcaagaagctcaccgggtgctgaagccagggggtcggttcttatgcctcgaattttctcaggtgaataaccctctgatcagtcgtctgtacgacctttatagctttcaggttatcccagtgctgggcgaagttatagctggagactggaagagctatcagtacctcgtggagtccatccggagatttcccagccaggaggaattcaaagatatgatcgaagatgcgggtttccataaagttacatacgaatccctgaccagtggtattgtggctatccattctggtttcaaattgtag

SEQ ID NO: 25573 - DNA, 741 bp, Artificial Sequence
  Description of Artificial Sequence: Synthetic coding sequence
atggccgcccccggctcgtgtgcactttggtcctactgcgggagaggctggagccgagcaatgagaggttgccagctactgggcttgcggagttcgtggcctggagacctgttaagtgcacggctgctgtcacaagagaagagggcagccgaaacccacttcgggttcgaaaccgtttcagaagaggagaaagggggaaaagtgtatcaggtctttgaatcagtcgccaaaaagtacgatgtgatgaacgacatgatgtccttgggcattcacagagtgtggaaggacctgctgctctggaaaatgcacccacttcctggtacacagctgctggacgtggctggaggtacaggggacatcaataaagaaatgctgaaagtgggcaaacaaaaggccttagctcaaggccatgatcgaaggtgccggttatcacagggcgacctgcgcaagtctaacattagacattgcggccacagtttttggttgcaaaccctgatccctttcctgtcctggtctatgaatcaaagttatccagttgagagcctggaacttaaggataacttggccaacgagacggctgccgaacacctgctgctgcgcattcgcgcgctggactcttgcctgaaccgtactgtcagcaagtggaaaaacaagtttcttagcttattttactcattcttatggagttgttttagtccctcacctcggggcatttggtctgtcagcctgcttaactgttag

SEQ ID NO: 25574 - DNA, 1182 bp, Artificial Sequence
  Description of Artificial Sequence: Synthetic coding sequence
atgatattcaccttcatgacccgcaagtcctgctgcagtaaacaggtgcagcggaagtattggcggaactgccaaaaactcacagcaacaggaagcgcgccatttcccctcgccctgcagcgattttctgttgtgtgggatgcgtgcagtgaggccctgatcatgttcgataaggacaacctggacgatatggggtacatcgtggagaacgatgtgatcatgcacgctcttacaaagcagctggaagctgtttctgatcgtgtaaccgtgctgtaccgatccaaggctattagatacacttggccttgcccatttcctatggctgactccagcccctgggtgcacatcactctcggcgatgggtcaacctttcaaactaaactactcatcggggccgatggtcacaactccggggtgaggcaggcggtgggaattcagaatgtgtcctggaactacgaccagtctgctgtagtggccaccctgcatttatcggaagctactgagaataacgtggcctggcagcggtttttaccctcgggcccaattgctctgctcccgctcagcgataccctatctagcctcgtctggtctacaagccatgagcacgccgcagagctggttagcatggacgaagagaaattcgtggatgccgttaattccgctttctggtcggacgccgatcatacagatttcattgatacagccggggccatgctccagtatgctgtgagcctgctgaagcccacaaaggtgtcagcaaggcagctccctcccagtgtagcacgggttgacgcaaagtcccgcgtcttattccccctgggtttagggcacgccgctgagtacgtgaggccgagggtcgccttgattggcgatgctgcccacagagtgcaccctctcgcaggacagggtgtgaatatggggtttggcgatatctccagcttagcccatcacctgagtacagcggctttcaatggcaaagatctcggctcagtatcacatcttactggttacgaaactgagcggcagagacacaatacagctctgctggctgctacagatctgttaaaacggctttacagtacctctgcctctccactcgtgctcctgcgaacctggggactgcaggctacgaatgccgtgtctcccctaaaagaacaaattatggcctttgcaagtaagtag

SEQ ID NO: 25575 - DNA, 1407 bp, Artificial Sequence
  Description of Artificial Sequence: Synthetic coding sequence
atggccgccagactcgtgtccagatgtggcgctgttagagccgcaccccactccgggccccttgtgtcatggcggagatggtctggcgcctcaactgataccgtttacgatgtggttgtgagcggaggcggcctggtgggagcagcaatggcctgcgctcttgggtatgacatccattttcacgacaagaaaattttgctcctcgaggcaggccccaagaaggtgttggaaaaacttagtgaaacctactctaatagagtctcatctataagccctggatctgctacacttctgagctcatttggcgcctgggaccacatttgtaacatgaggtaccgagcatttcgcaggatgcaggtgtgggacgcttgttccgaagctttgatcatgttcgataaagataacctggatgacatggggtatattgtggagaatgacgtaataatgcacgccctcaccaaacagcttgaggccgtgagcgaccgcgttaccgtcttgtacaggtctaaagccattcgctacacttggccttgccctttccccatggctgattcctccccatgggtgcacattactcttggagacggctcgactttccagacgaagctgctcattggagcagatggtcataactctggggtgcgtcaagcggtcggcatccagaatgtgagttggaactatgatcaatccgccgttgtcgctacactgcatctgtccgaggcaaccgagaataatgttgcttggcaacggttcctcccctcaggccctatagccctcctccctcttagtgacacactgtcctccttggtctggagcacatctcacgagcacgctgcagaactggtcagtatggatgaggaaaagtttgtggatgctgtgaacagtgctttttggtcggacgcagatcacacagatttcatcgacaccgcaggagccatgctccagtatgcagtgagccttttgaaaccaaccaaggtgagtgcacgccagctaccacctagtgtggccagagttgacgctaaatcgagagtgctcttccccttgggcctgggtcatgccgcagagtacgtgcggcccagagtggcccttatcggtgatgctgcacaccgggtccaccctctggcaggccagggagtgaacatggggtttggcgacatttcctctcttgctcaccacttatctacagctgctttcaacggcaaggacctgggctctgtgagtcatcttactggttatgaaactgagcgtcagagacacaatactgcccttctggcggctaccgacctcttgaaacgtctttattccacatccgctagcccccttgtcctcctacgcacatggggactgcaggcaactaacgcagtgtctccacttaaggaacagattatggcttttgcctctaagtag

SEQ ID NO: 25576 - DNA, 1332 bp, Artificial Sequence
  Description of Artificial Sequence: Synthetic coding sequence
atgcgcggccagggcccccccctgtccagttttggagtctggcttgcttctagggccgcttccgaccctagtagaccgaggaggcagggctacgatatccacttccatgataagaagattctgctgcttgaggcaggtcctaagaaagtgctggagaaactgtccgagacatattctaacagggtgtcttctatttcacccggcagcgccacactgttatcttcattcggtgcatgggaccacatatgcaacatgcgatacagagcttttaggcgtatgcaggtgtgggatgcctgttcagaggccctgatcatgtttgataaggacaacttagacgacatgggctacatcgtcgagaatgacgtgatcatgcacgcactgactaaacaattggaagccgtttcagatcgagtgactgtcctctaccgcagcaaagcgattcgttacacctggccatgcccctttcctatggcagactcttctccctgggtgcacatcacccttggagatggatctacatttcaaactaagctgctgatcggggccgacggccacaacagcggagtgcggcaggcagtgggcattcagaatgtatcttggaactatgatcaatccgccgtggtcgctacactgcatctctctgaggccacagagaataacgtcgcctggcagaggttcttgccctctggacccattgctttgctgccacttagcgacacccttagcagcctggtgtggagcacctcacatgagcacgctgcagagctggtgtccatggacgaagaaaagttcgtagatgccgtgaattccgctttctggtctgatgccgatcacacggatttcattgacaccgccggagcaatgctgcagtacgccgtgagcttgcttaagcccactaaggtgtctgctcggcaactcccaccctcggttgcacgggtggacgccaagtctcgcgttctgttcccgctgggattgggccatgcagccgaatacgtcagaccaagggtggccctgattggcgatgcagcccatagagtgcatcctctggcgggacagggtgttaacatggggtttggcgatatcagtagtcttgctcatcatttatctactgccgcattcaacggtaaagaccttggttccgtgagtcatctaacagggtatgaaacggaaagacagagacataacaccgccttgttggccgccaccgatctgctgaagagactttactccactagtgccagtcccctggtgttgctgcgcacctggggactgcaggccactaatgccgttagtccactcaaggagcaaattatggcttttgcgtccaaatag

SEQ ID NO: 25577 - DNA, 441 bp, Artificial Sequence
  Description of Artificial Sequence: Synthetic coding sequence
atggctgcaaggctggtctcacggtgtggtgctgtcagagcagctccccattcggggcctctggtgtcatggagacggtggtccggtgcttctacggacaccgtgtatgacgtagtcgtgagcggtggaggactggtaggtgctgccatggcctgcgccctgggctacgatatccacttccacgataaaaaaatcctgctgctggaggcaggacccaagaaagtgcttgagaagcttagtgagacctattctaacagagtgtcatcaatttccccagggtcggcgacacttttaagtagcttcggagcgtgggatcatatctgtaacatgcggtatcgcgcgttccgaagaatgcaggttccgctgtacctgttcaacttcgtcaaaatgtcctggtccgtattgagataccgctcccccctttccccctctgtgctctag

SEQ ID NO: 25578 - DNA, 417 bp, Artificial Sequence
  Description of Artificial Sequence: Synthetic coding sequence
atgacatggtggtgtagagttgaggcgtggtgggcccttccttggccggtcccatgggatatgatcttcacatttatgacgaggaagtcttgctgcagcaaacaagtccagagaaaatactggagaaactgccaaaagcttaccgccaccggaagtgctcccttccccctggcccttcagagatttagcgttgtgtgggacgcttgttctgaggccttgatcatgttcgacaaggacaatctcgatgatatggggtacatagtcgaaaatgacgtgattatgcatgctctcactaagcagcttgaggccgtttcagatcgagtgacggtactttaccgcagtaaggctattagatacacatggccctgtcctttccctatggctgattcctctccatgggtgcatatcactctctag

SEQ ID NO: 25579 - DNA, 789 bp, Artificial Sequence
  Description of Artificial Sequence: Synthetic coding sequence
atgatatttacttttatgacccggaagtcttgttgtagcaagcaggtacagaggaagtactggaggaattgtcaaaagctgaccgctacaggtagcgctccttttcccttggccctgcagcgcttctccgtggtatgggacgcctgcagcgaggcactgatcatgttcgataaggacaatctcgacgatatggggtacattgtcgagaatgacgttattatgcacgccctcaccaagcagctcgaggccgtgagcgacagggtgaccgtcttataccggagcaaggcaatccggtacacctggccttgccctttccccatggcagattcatccccttgggtccatattacattgggggacggctcaaccttccagactaagctgttaattggcgctgatggtcacaactccggcgtgaggcaagccgtcggtatacagaacgtgagctggaactatgatcagtccgccgtggtggctacgctgcacctgtccgaggccactgagaacaatgtcgcctggcagcgatttctcccctcaggtccaattgcactgttacccctctctgatacgctttcttccctagtgtggagcactagccatgaacacgcagctgagctggtttccatggatgaagaaaagtttgttgatgccgtcaacagcgccttttggagcgacgccgatcacaccgacttcatcgatacagccggtgctatgctgcagtacgctgtcagtttgcttaaaccaactaaagtgtccgcgagacagctgccgccttctgtggctcgttag

SEQ ID NO: 25580 - DNA, 1176 bp, Artificial Sequence
  Description of Artificial Sequence: Synthetic coding sequence
atgatctttacttttatgactcgtaagtcctgctgttctaaacaggtgcagagaaaatactggcgtaactgtcaaaaactgactgctacagggtccgcaccatttccactggctctgcagcgattcagcgttgtttgggatgcttgctcagaggctcttatcatgtttgataaggacaacctcgacgacatgggatatatcgtggagaacgacgtgatcatgcacgctctgacaaaacagctggaagccgtgagtgaccgagtgaccgtgctatatcgatccaaggcaattaggtacacgtggccatgccctttcccaatggcagatagtagtccctgggtccacattaccctcggagacggtagcaccttccaaaccaaactgctgatcggagcagacggtcataatagtggggtgcgacaggcagtcggtatacagaacgtgagctggaactacgatcaatctgcagtggtcgctaccctacacctgtccgaagccaccgagaataatgttgcatggcagcgattcctgccgagcgggccgatcgctttgttgcccttgtccgataccctgagctcactggtatggagcacttcacacgagcacgcagcagaactggtatctatggatgaagagaagttcgtggatgctgttaattcagccttttggagtgacgctgatcataccgattttattgatacagccggtgcaatgctccagtatgccgtgtctctgttgaagccgaccaaagtcagcgctcgacagctccctccctctgtcgcaagggtggacgctaagtcaagagtgctcttcccactgggcctcgggcatgcagcggagtacgtcaggccgagggttgcactaataggagacgctgcccaccgggttcacccactggccggccaaggcgtgaatatgggcttcggggacatctctagcctggcccaccacctgtccacagctgccttcaacggtaaggatctgggcagtgtcagccacctgacaggctacgagacagagagacaaaggcataacacagctctgctggccgccacggatcttcttaaacgcctgtattctactagtgcctcgcctctggtgttactccgaacatggggtctacaagccaccaatgctgtttcacctctcaagataatggccttcgcgtctaagtag

SEQ ID NO: 25581 - DNA, 468 bp, Artificial Sequence
  Description of Artificial Sequence: Synthetic coding sequence
atggctggcgcggtctctttactgggcgtcgtcggcctgttactagtttccgctctgagcggggtgctgggcgatcgggccaatcctgatctccgggcacaccccggcaatgctgcccaccctgggagtggtgccaccgagccgaggcgaaggcctcctctcaaggaccaaagagagcggactagggctggttcactccccctgggcgccttatacacagcagccgttgccgccttcgtactatataaatgcttacagggcaaagacgagaccgccgtacttcatgaggaggcttccaaacagcagcccctgcagtcagagcagcaactcgcccagctcacccagcagctcgcacagacagagcaacatctgaataatttaatggcccagctcgatcctctgttcgaaagaccagccggagcttcggagcacgaggcgatggatcatcctcgcgccgccgccaggtag

SEQ ID NO: 25582 - DNA, 414 bp, Artificial Sequence
  Description of Artificial Sequence: Synthetic coding sequence
atggcaggagcggttagtctgctgggcgtggtggggctgttgctggtgtctgccctctccggagtgctcggggatagagcaaaccccgacttacgggcccatcccggaaacgcagctcatcccggctctggcgctaccgagcccaggcgtcgtccccccctcaaagatcagcgcgagcgaaccagagcaggctctcttccactgggcgcgctttacacagcggctgtcgccgcctttgtgctgtataagtgtcttcagggaaaggatgagactgctgtcctgcatgaagaggcgtctaagcagcagcctcttcagtcagaacagcagctagcccagttgacccagcagctggcccagaccgaacagcacctgaacaatcttatggctcagctcgatcctctgtttgagcgctag

SEQ ID NO: 25583 - DNA, 420 bp, Artificial Sequence
  Description of Artificial Sequence: Synthetic coding sequence
atggcaggcgcagtctccctactcggcgtagtgggcctgctcctcgtgagcgccctgagcggtgtactgggggaccgtgccaacccggacctgcgagcgcatccgggaaatgctgctcacccaggaagcggggccactgagccaagacgacgcccaccactgaaggaccagagggagaggaccagagcgggcagtctcccgctgggtgcactttacactgccgcagtcgccgcgttcgtactgtacaagtgcctgcagggcaaggacgagactgccgtcctgcacgaagaggcatccaagcagcaaccattacagtcagagcagcagcttgctcagctgacacagcagctggctcagaccgagcagcatctgaataacctcatggctcagttggatcccctttttgaaagatccttctag

SEQ ID NO: 25584 - DNA, 771 bp, Artificial Sequence
  Description of Artificial Sequence: Synthetic coding sequence
atggccggtgctgtgtccctgctgggagttgtgggtctactgctcgtgtccgccctgtccggcgtcctgggggatcgcgcaaaccctgatttaagagctcaccccgggaacgcagcgcatccaggatcgggggccacggaaccgcgccggcgtccaccactgaaagatcaacgggagaggaccagagccggatccctccccctgggagcgctctataccgctgccgtagctgcatttgtgctctataagtgtctgcaaggtaaagatgagacggcagtcctgcatgaggaagcaagcaaacagcaacctctacaaagtgagcagcaactagcccagctgacccagcagcttgcgcagactgagcagcacctgaacaatctgatggcacagctcgacccactgttcgaacgagtgaccacactggctggagcccagcaggagctgctgaacatgaagctttggactatccatgaactgctgcaagattcaaagcctgacaaggatatggaggcatcggagcctgaagcctctagacctttgcctgaagacttctgtctgaaagaagacgaggaagaaatcggcgactctcaggcttgggaagaaccaacaaattggtcaaccgagacttggaacctggccacttcctgggaggtgggccgcggcctgaggcgtagatgtagccaagctgtagcaaaaggcccaagccatagcctggggtgggaaggcggcaccaccgctgaaggccggctcaagcagagcctctttagttag

SEQ ID NO: 25585 - DNA, 360 bp, Artificial Sequence
  Description of Artificial Sequence: Synthetic coding sequence
atggcaggcgctgtcagcctgctgggtgtggtgggcctgctgctcgtctctgccctgtccggagtcctaggagatagggcgaatccagacctccgagctcatcccgggaatgccgctcatcctggctccggcgcgacggagccacgtagacggccccctttaaaggatcaaagagagaggacacgagcaggctccctgccgctaggagctctgtatactgctgccgtcgccgcattcgtcctttacaaatgtttgcagggcaaagacgagacagccgttctccatgaagaagccagcaagcagcagcctctgcagtccggtggtttttccaggtctctctgttgggttgggggggtgtag

SEQ ID NO: 25586 - DNA, 852 bp, Artificial Sequence
  Description of Artificial Sequence: Synthetic coding sequence
atggccggtgccgtgagcctcctgggcgtagtgggccttctgttagtttccgccttgtctggtgtgcttggagatcgggctaatccagacctgagggcccaccccgggaatgctgcccaccccggctcgggcgccaccgagccacggcgacgtccccctctgaaggatcagagggagcgaacacgggctggaagtctgcctttaggcgctctgtatactgcagcggtggccgcattcgtcctctacaaatgtcttcagggcaaggacgagaccgctgttctgcacgaggaagcgtcgaagcagcaaccactacaaagtgagcaacaattggcccagctgacacagcagctcgcacagactgaacagcacttgaacaatctgatggctcaacttgatcctttattcgagagagtcacaaccctggccggtgcccaacaggagctgctaaatatgaaattgtggacaattcatgagctgctgcaggattcaaagcctgataaagatatggaagctagcgaacctggggaggggtctgggggagagagtgccggaggtggtgacaaagtgagtgaaacaggtacttttttgatcagccctcacaccgaagcctctcggccacttccggaagatttctgccttaaggaagacgaagaggaaatcggcgatagccaggcatgggaggagcctactaattggagcacagagacatggaatctcgccacatcttgggaggttggtcgaggactgagacgccgttgtagccaagccgtcgctaaggggccatcgcactccctggggtgggaaggcggcactacagcagagggccgtctgaagcaaagcttgttttcctag

SEQ ID NO: 25587 - DNA, 1011 bp, Artificial Sequence
  Description of Artificial Sequence: Synthetic coding sequence
atgctccaacggggcctgtggccttggagaacacggctgctgcctacacccgggacatggcgtcctgccaggccctggccgctccctccccccccacaagtactgagagtgaaactgtgcggcaatgtgaaatattaccagtctcaccactattcgacagtggtcccacctgacgaaatcaccgtcatctatagacacgggctgcccctcgtaactctgactctgccgagccggaaagagagatgccaattcgtggtaaaacctatgttgagcacggtcggcagcttcttgcaagacctacagaacgaggataagggaataaagaccgccgcaatattcacagccgacgggaatatgatctcagccagtacactgatggatattctgcttatgaatgatttcaaacttgttattaataagatagcatatgacgtgcagtgtccgaagagggagaagccttctaatgagcataccgcagagatggagcacatgaaatctctggtgcaccgcttgttcacaattctgcaccttgaagagagccagaaaaagagagaacaccatcttctggaaaagatcgatcacttgaaggaacaactgcaacccttggaacaggtgaaagcagggattgaagcacacagcgaggccaagacatctggattgctgtgggccgggctagcattgctctccatacagggtggtgccctcgcctggctaacctggtgggtctactcctgggacattatggaacctgtcacctacttcatcacgtttgccaattctatggtgtttttcgcctattttattgtgaccaggcaggattatacctactccgctgtgaagagccgtcagtttctgcagttcttccataaaaaaagcaaacagcaacacttcgatgtccagcagtataataagctcaaggaggatttggcaaaggcgaaagagtctctgaagcaggcgcgccattctctatgtctgcagatgcaggtggaagaactgaatgagaagaactag

SEQ ID NO: 25588 - DNA, 1689 bp, Artificial Sequence
  Description of Artificial Sequence: Synthetic coding sequence
atggaccttcctgagggtccagtggggggtcctaccgccgagatgtacctgagggagagaccagaggaagcccggctgggcatgcctgtgagtttagaggaacagatcctgaattccacttttgaggcatgtgatccccagagaacgggcaccgtcgccgtggcacaggtcctcgcatatctcgaagccgtgacaggccagggacctcaggacgccaggcttcagacactggcgaattcgcttgatcctaatggagaggggccaaaagcaaccgttgatctagatactttcctggttgtaatgcgggattggattgccgcgtgccagcttcatggtgggctggaactcgaggaggagaccgccttccagggagcgctaaccagtcgccagcttcccagcggttgccctgaggcagaggaaccagcgaatcttgaaagtttcgggggggaggacccaaggccggaactgcaagccactgccgacctcctgagctctttggaggacctcgagctctcaaaccgacggcttgtgggagaaaacgccaaactgcagcgaagcatggaaaccgccgaggaagggagcgctcgcttgggcgaggagatcttggcgttgcgcaaacagctacactccactcaacaggcactgcagtttgccaaggcgatggacgaggaacttgaggacctgaagactttggcaaggagcttagaagaacagaatagatctctgctcgcccaagctagacaggcagaaaaagaacagcagcacctggtggcagagatggaaactctgcaggaggagaacggcaagcttctggccgagcgggatggtgttaaaaaacggagtcaggaattggcaatggagaaggacaccctaaagaggcagctgtttgaatgcgagcatcttatatgccagcgggacacaatactgagtgaaaggacaagggatgtagaaagcctcgctcagacactggaggagtatcgagttacgacacaggagctcaggctcgagatatctagactcgaggagcagctgtcccaaacatatgaaggacccgacgaactgccggaaggagcccaactgcggagagtaggatggactgagctactccctcctagcctgggattggaaatcgaggctattagacaaaaacaagaagtagccacagccgatctgagcaatcccctgtgcggagtgtggcagtgggaagaggtgattcacgaaacatccgaagagacagagtttccttccgaggcgcccgcagggggacagcgcaatttccagggagaacccgcccatccagaggagggacgaaaggagccatccatgtggctcacaagacgcgaggaagaggaagacgcggagtctcaagtgactgccgatctacctgtgccactcggggctccccgtcccggcgacataccagagaatccacccgagcgcccagccaggagagagcttcagcaagccttagttcccgtcatgaaaaagctggtccccgtgcgaaggcgcgcatggggccagctgtgcttgcctcctcaacgcctgcgagtcacccgacacccactgatcccggcgcccgttcttggcctgttgttgctcctgctgctttctgtgctccttctgggaccatctccacccccaacctggcctcatctgcagttatgttatctgcagccaccacccgtttag

SEQ ID NO: 25589 - DNA, 357 bp, Artificial Sequence
  Description of Artificial Sequence: Synthetic coding sequence
atgacgaagaagaagcgggaaaatctcggagtggcattagagatcgatgggctcgaagagaagctgtctcagtgcaggagggatctagaggctgtgaattctcggctccattctcgcgaactgtcacctgaggcacgggaagggaccgaggtttcatcagcccgagaaccggaggagcacgctgccctgtgtggccatctttatccgcccgatgcacggctttgccttctggatcatgtctctctcgcccttccccacaaccaacaccgtctcccacttggacctctcatccgtataaagcaggccctccaggcttccataggtcctcggtgctggggcgtgccactgcccacatag

SEQ ID NO: 25590 - DNA, 294 bp, Artificial Sequence
  Description of Artificial Sequence: Synthetic coding sequence
atgaccaagaaaaaaagagaaaacttgggtgttgcactggaaatcgatggactcgaagaaaagttgtcccaatgtcgtagggacctggaagctgtgaactcccgcctgcatagccgcgaactatccccggaagcacggcggtctcttgagaaggagaaaaactcattaatgaacaaggcttcgaattacgagaaggagttgaaatttttgcgacaagaaaaccgcaaaaacatgctgctctccgtcgcaattttcatactgcttaccctcgtgtacgcgtattggacaatgtag

SEQ ID NO: 25591 - DNA, 345 bp, Artificial Sequence
  Description of Artificial Sequence: Synthetic coding sequence
atgactaaaaagaaaagagagaatctgggagtggcactggagatagacgggctcgaggagaaactctcgcaatgccgccgtgacttggaggccgttaatagccgactccactcccgggagctaagcccggaggccagggaaggcaccgaggtgagcagtgccagggagcctgaagagcacgctgcattgtgcgggcatctgtatcctcctgacgcccggttgtgcttgctcgatcatgtttctttggcactcccccacaaccagcatcggctcccgttggggcctctcattcggattaagcaggccctgcaggcctccattggccccaggtgctggggtgtgtag

SEQ ID NO: 25592 - DNA, 753 bp, Artificial Sequence
  Description of Artificial Sequence: Synthetic coding sequence
atggcggccggcacaagttcatactgggaagatttaaggaaacaagctcgccagctggaaaacgaactggatcttaagctcgtatcatttagtaaattgtgcacttcctattcacactctagtactagggacgggcgaagagaccgttatagctctgatactaccccgcttctcaacggttcttctcaggatcggatgtttgagacaatggctatcgagattgaacaactgctggcgcgcttaactggggtaaacgataagatggccgaatacacgaacagtgctggcgtgccctcgttgaacgccgcgctgatgcacactctgcagcggcatagagacatcctacaggattatacgcacgagtttcataagaccaaagcgaactttatggctattagagagagagagaatttaatggggagcgtcaggaaggacatcgagtcatataagtcggggtcaggggtaaataaccggcgcacagagctgtttctgaaggaacacgaccacctgaggaattctgacagactgatcgaggagaccatttccatcgccatggcaactaaggaaaatatgacttctcagcggggcatgcttaaaagtatccatagcaagatgaataccctcgcaaacaggttccccgctgtgaatagtctgattcagcgaattaatttgagaaagcgcagggatagcctgatactaggcggcgtgataggaatttgcacaattcttcttcttctttatgcctttcactag

SEQ ID NO: 25593 - DNA, 1452 bp, Artificial Sequence
  Description of Artificial Sequence: Synthetic coding sequence
atgaaggcctttcatacattttgcgtggttctcctcgtgttcggctctgtgtctgaagcaaagttcgacgatttcgaggatgaagaggacatcgtggagtacgacgataacgacttcgctgaattcgaggacgtgatggaagactccgtgaccgaatcgccccagagagtcatcatcacagaggatgatgaggatgaaacaactgtggagcttgaaggacaggacgagaaccaagagggcgattttgaagacgcagatactcaggagggagatacagaaagcgagccctatgacgacgaggagtttgagggctacgaggacaagccggacacaagcagtagcaagaacaaagaccccattaccatcgtggatgtacccgcccacctgcagaattcctgggaatcctattatctggaaatcctgatggtgaccggtcttcttgcatacatcatgaattacattatcggtaagaacaaaaattcccgacttgctcaagcttggtttaatacgcacagagagctgctcgagagtaactttaccttggtgggggatgatggtactaataaggaagctactagcacgggcaagctgaaccaggaaaatgagcacatttacaatctttggtgtagcgggcgcgtatgctgcgagggaatgttgatccaattgcgatttcttaagcgccaggacttgctgaacgtcctggcccgtatgatgcgccctgtttcggatcaggtccagattaaagtaacaatgaacgatgaggatatggacacttacgttttcgctgtcggaactcggaaagcgctcgttcggttgcaaaaagaaatgcaggacctctccgaattctgttcggacaaacctaaatctggggcaaagtatggtttgcctgactcactcgctatccttagcgagatgggggaagttaccgatggcatgatggatactaagatggtgcatttcctgacgcactatgccgataaaattgaaagcgtgcatttttctgaccagttctccggccctaagatcatgcaggaagaggggcagcctttaaagcttccagacacaaagagaacgctcttgttcactttcaatgtgcctggcagtggaaacacataccctaaagatatggaagcgttacttccactgatgaacatggtgatctactccatcgacaaggcaaaaaagttccgcctaaacagagaaggcaagcagaaagcggataagaatagagccagggtggaagaaaacttcctgaaactcacccatgtgcagcggcaggaggctgcacagagtcgacgcgaggagaaaaagcgggcagagaaagaaaggataatgaacgaggaagacccagaaaagcagagaagactggaggaagcagctttgcgaagggaacagaagaaattggaaaagaaacaaatgaaaatgaaacaaatcaaggtgaaggcaatgtag

SEQ ID NO: 25594 - DNA, 1236 bp, Artificial Sequence
  Description of Artificial Sequence: Synthetic coding sequence
atgatgggtaggtcaccaggttttgcgatgcagcatatcgtaggtgtgcctcacgtccttgtgagaaggggcctgttgggacgagaccttttcatgaccaggactctgtgtagcccagggcctagccaacctggggagaagagaccagaggaggtcgcactcggtcttcaccatcgtttaccagctctaggacgagctctgggacactcaatccaacaaagggctacatccacggccaaaacctggtgggacagatacgaggagtttgtggggcttaatgaggttcgggaagctcaggggaaggtgactgaggccgaaaaggttttcatggtggctaggggcctcgtacgggaggctcgggaggacctcgaagtccaccaggctaagctcaaagaagtgcgtgaccggctcgatcgggtgtcacgcgaggacagccagtatctggagttggcaactctcgaacaccgcatgctgcaggaagagaagcgcctgcgaactgcttatctgagagccgaggactcggagcgtgagaagttcagcctgttcagtgcagccgtacgggaatctcatgagaaggagcggacccgagcagagcggacaaaaaactggagcctgatcggctctgtgcttggggccttaattggtgtagcaggttccacttacgtcaatagagtgcggctgcaggaactgaaggctcttcttctcgaggcccagaagggtcccgtttccttgcaggaggcgatccgggagcaagcgtcttcgtacagtaggcagcagagagatctgcataaccttatggtggatttgcgcggattggtccacgctgccggacctggccaggactctggctcccaggctggctctcctcccaccagggaccgagatgtcgatgttctcagcgcagccctgaaggagcagttgagtcactcacgacaggtgcactcttgtctcgaggggctacgcgagcaactagacggtctcgaaaagacgtgctcccagatggcgggtgtggtgcagctggtgaaatctgctgcacacccaggtcttgtggagcccgcggatggtgccatgcctagtttcctgctggagcagggctctatgatcctagccctgtccgataccgaacaacggctcgaggcacaggtcaaccgaaatactatttactctacactggtgacatgtgtgacgttcgtggccacactgcccgtgttatacatgctcttcaaggcctcctag

SEQ ID NO: 25595 - DNA, 1236 bp, Artificial Sequence
  Description of Artificial Sequence: Synthetic coding sequence
atgatgggacgaagccccggcttcgccatgcaacacatcgtaggggttccccacgtgctggtgcgtcgcggacttctgggcagagatctctttatgactaggacactgtgtagccccggacccagtcagcccggcgaaaaaagacctgaggaagtggcattgggattgcatcatcgattgcccgcacttggtagagccctgggccactctattcagcagcgagctactagtaccgccaaaacttggtgggaccggtatgaggagttcgtgggactgaatgaagtgcgcgaggctcagggaaaagtcaccgaggccgagaaggtctttatggtggcgaggggcctggtccgcgaggcccgtgaagacctggaggttcaccaggctaagctgaaggaagtccgcgacaggctggatcgggtcagccgagaagattctcaatacctggagctggcaacgctggaacacaggatgctacaagaggaaaagaggctgcgcacggcttatctccgtgccgaggacagcgagagagagaaattctctctgttttccgctgcagtgcgggagtctcacgagaaagaaaggaccagagccgaacggactaaaaactggagtctgatcgggtccgtgctaggagcactcattggggtggctggaagcacctacgtaaacagggtgcgcctacaagagcttaaagcgcttctgctagaggctcaaaaagggcccgtgagcttgcaggaggcgataagggagcaggcttcatcctattcccgccaacagagagacctccataatctcatggttgatctgcggggcctcgtgcacgccgcaggccctggtcaggacagtggatcccaggccggaagtccccctacacgtgatcgcgacgttgacgttctttccgcggctctgaaagagcagctgtcgcatagtcggcaggtccacagctgcttggaaggcctgcgggaacagctggacggactggagaaaacctgctctcagatggctggcgtcgttcaactggtcaaaagcgccgctcaccccggcctggtcgagcccgcagacggtgcgatgccctcttttcttctcgagcagggaagcatgattctcgctttgtccgataccgagcagcggttggaggctcaggtaaaccgcaacacaatttattccacgttagtgacatgcgtcacctttgtggccacgcttccagtcctgtacatgctcttcaaggctagttag

SEQ ID NO: 25596 - DNA, 909 bp, Artificial Sequence
  Description of Artificial Sequence: Synthetic coding sequence
atggtggctcgcggattggtccgtgaagccagggaggacctagaggtacaccaggcaaaactcaaggaagttagagacaggctggatagagtaagtagagaagactcacagtatctggaactggctaccctcgagcatcgaatgttgcaagaggagaagcggctgcgaacagcctaccttcgggcggaagactctgagcgcgagaagttttcactgttctcggccgccgtccgtgaatcccatgagaaggaacgcacccgggcagagcgcactaagaattggtccttgattggcagtgtcctgggagcccttattggagtcgcagggtcaacttatgtgaatagggtgaggctgcaggaactcaaggccttactcctcgaggcccagaaaggaccagtttccctgcaagaggcaattcgggaacaggcctcttcttatagtagacagcagcgggatctgcacaacctgatggttgatctgcggggtctggtccatgctgctgggcctggccaagactcaggctcccaggctggctctcccccaactcgggaccgagacgtggatgtgctaagcgccgcactgaaggaacaacttagccattcacgacaggttcacagctgccttgaagggctgagggaacaacttgatggtctcgaaaaaacatgtagccaaatggccggtgtggtacagcttgtaaagagcgcagctcaccctggcctggtcgaacccgccgacggtgccatgccttctttcctgctcgaacaggggtcaatgatcctggccctttccgataccgaacagcgactggaagctcaggttaataggaacaccatctatagcacactcgtaacttgtgtaacgttcgtcgctaccctgccggtgctatacatgttgttcaaagcctcctag

SEQ ID NO: 25597 - DNA, 189 bp, Artificial Sequence
  Description of Artificial Sequence: Synthetic coding sequence
atgatgggtaggagccccggttttgccatgcagcatatcgtgggcgtgccacacgtgttagtgagacgcgggcttcttggccgggatttgttcatgaccagaacactgtgcagcccggggccttcacagcccggcgagaagcggccggaagaggtcgctctcggccttcaccaccgcctcccagcctag

SEQ ID NO: 25598 - DNA, 909 bp, Artificial Sequence
  Description of Artificial Sequence: Synthetic coding sequence
atggttgccagaggcttggttcgggaggcccgggaggatctggaagtccatcaggcaaaattgaaggaggtgcgagaccgactcgaccgggtcagtagggaggatagccagtacttggaactggctaccctcgagcacaggatgctgcaggaggagaaacgcttgaggactgcctaccttcgggccgaagactccgaaagggaaaagttctccttgttcagcgcagctgtacgtgaaagccatgaaaaggagcggaccagagcagagaggacaaagaactggagtctgatcggttccgtacttggcgccctgattggtgtcgcgggaagcacatacgtcaacagggtgcgacttcaggaactgaaagccctactgctggaggcccaaaaaggccccgtgagcctgcaagaggccatcagggagcaggcaagtagttactctagacagcaacgagatcttcacaatctgatggtagatctgcgtggcctggtgcatgccgccgggccgggccaagacagcggttcgcaggccggttcaccacctacgcgcgatagggatgtggatgtcctatctgcagccctaaaagagcagctgtcccactcaagacaagttcattcatgcctcgagggattgcgagaacagctggatggactcgagaagacctgtagccagatggccggcgtagtccaacttgtaaagagtgcagcacaccccgggttggtggaacctgctgacggcgccatgccctcatttctactggagcaggggagcatgatattggccctgtccgacaccgagcagcgcctcgaagcgcaagttaacagaaacacaatctacagcaccctggttacctgtgtgacttttgtggctacccttcccgtgctgtatatgctctttaaagcctcttag

SEQ ID NO: 25599 - DNA, 480 bp, Artificial Sequence
  Description of Artificial Sequence: Synthetic coding sequence
atgatgggaaggagccctggttttgcaatgcagcatattgtgggagtgccacatgtcctagtgcggagagggctgctggggcgtgatctgtttatgacgcgaacgctatgtagtccaggaccaagtcagccgggcgaaaaaagaccggaagaagttgccctgggtctgcatcacaggctcccagctctgggcagggctctcggacattctatccagcagcgtgccacttcaacagctaagacgtggtgggatcgttatgaggagtttgtggggttgaatgaggttagggaggcgcagggaaaggtgacggaggcagagaaggtgttcatggtggctagaggccttgtgagggaggcgcgggaggatctggaggtgcaccaggctaaacttaaggaggtgagagaccgcttagaccgcgtgtccagagaagattcccagtatctggaactggccactcttgagcatcgcatgctccagtag

SEQ ID NO: 25600 - DNA, 909 bp, Artificial Sequence
  Description of Artificial Sequence: Synthetic coding sequence
atggtagctcggggcttggtgcgggaggcgagagaagacttggaggtgcaccaggctaaactgaaggaggttagggatagactcgacagagtaagcagagaagactctcagtacctggagctcgctacactcgagcacaggatgctccaggaggagaagcgactgcgcacagcctatctgcgagcagaggattccgaaagggaaaagtttagcttgttctctgcagcagtgcgagaatcccatgagaaagagcggaccagagccgaacggaccaagaactggtctctgattggttctgtcctgggggccctgattggcgtggccggtagcacgtacgtaaaccgcgtgcggctacaggagcttaaggcgttgctattggaagcacaaaagggccccgtgagcttacaggaagccatccgcgagcaggcttcgagttatagccgacaacagagggacctgcataacttgatggtagacctgcgcggtctcgtccacgctgccggaccaggacaagattcaggttcgcaggccgggtcacctccaacccgagatagagacgtggacgtgctatctgccgctctgaaagagcaactgagccacagccggcaggtacatagttgcctcgaaggattgagggagcagttggatggcctggagaagacttgtagccagatggccggagtggtgcagctcgtcaaaagtgccgcccatcccggcctcgtggaaccagccgatggagctatgccctcttttctgctcgagcagggatctatgatactggctctttctgacactgagcagaggctggaagctcaggttaaccgaaatactatttactccacactggttacctgcgtcacttttgtcgcaacgctgcccgtcctgtatatgctctttaaggcttcttag

SEQ ID NO: 25601 - DNA, 321 bp, Artificial Sequence
  Description of Artificial Sequence: Synthetic coding sequence
atggccagttctggcgcgggtgatcctctcgactctaaacgtggagaggctcccttcgctcagcggatcgatccgacccgcgagaaactgacacctgagcagctgcattccatgcgccaggctgaattggctcagtggcaaaaagtcctccctcggcggcgcacacgaaatattgtgaccgggctgggcatcggagcactagtgctcgcaatctacggctataccttctatagtatctcccaggaaaggttcctcgatgagttagaggacgaggctaaggccgctcgcgctcgggcactagctagggcaagtggctcatag

SEQ ID NO: 25602 - DNA, 435 bp, Artificial Sequence
  Description of Artificial Sequence: Synthetic coding sequence
atggccgcgccttcgggcggagtgaactgcgaggaattcgcagaatttcaggaactgctcaaagtgatgcgaaccattgatgacaggattgttcatgaactgaacacaaccgtccccaccgcctcttttgcaggcaagatcgatgccagtcaaacttgcaaacaactgtatgaatctctgatggccgcccacgcttccagggatcgggtcatcaaaaattgcatcgcccagacaagcgccgttgtgaagaacctgagggaggagcgcgagaaaaacctggatgatttaaccctgctgaagcagttgaggaaggagcaaaccaaactgaaatggatgcagtctgagctcaacgttgaagaagtcgtgaatgatcgaagctggaaagttttcaacgaacgctgccgcattcacttcaaaccccctaagaatgaatag

SEQ ID NO: 25603 - DNA, 774 bp, Artificial Sequence
  Description of Artificial Sequence: Synthetic coding sequence
atggactgcggctctgtcggtggacagaggacgcagaggctgcccggcagacaaaggcttctatttcttccagtggggctatccggacgccccgggggaagcgagacctcagcgcggcgctgcttgagtgccctgtcggacggactgggtgccttgcggcctagggccccggccgccagaggcggcgtgtctagggcgtcacccttactgctcttactcttagttcccagccctcgtttggcagcggccgcgcctagaagacagctcggtgattgggaaagaagtagattaggctatgccgcacctcccgcagggcgcagctcagcctggcggtgctctcccggcgtggctgcggccgcaggcgcactcccacagtaccatggccccgccccggctcttgtaagctgccggagagagctttcactgtcagctgggtctctgcagctggagaggaagagacgggatttcacgtcttctggttcccggaagctgtattttgatacccatgcgctggtatgtctcttagaggataacgaaagtcattccttcatccaagccggggtgcagtggcattccctggggctgttgcaacctccgcctccgggtttcaaaagatcatctcaccttatcctgttatccagctgggactatcgccacgccccccctcacctggacaatttctctgtctttctgctggaaaccggctttcaccatgtgggtcaggctggcctgaaacttctgacgtccagcgatcccccaacactagcatcatag

SEQ ID NO: 25604 - DNA, 1080 bp, Artificial Sequence
  Description of Artificial Sequence: Synthetic coding sequence
atggactgtggcagcgtgggaggacagcgaacacagcggttgccgggcagacagaggctgttattcctcccagtcggactaagcgggcggcctggtggctcagagacatctgccagacgttgcctgtcagctctgtctgacggcctgggtgccctgaggccgagggcgcccgccgcccggggaggggtgagccgagcctctccactgctccttctcctcttggttccttcaccacgcctcgctgccgctgcgcctcggcgccaattgggtgactgggaacgatcccgactgggctacgcagcacctccggccggccggtcgtccgcgtggcgctgtagccccggggtggccgcagcagccggtgcacttccccagtatcatggccccgctcctgcccttgtgtcctgcagacgggagctttccctcagtgctggatctctacaactcgaacgcaaacgccgcgactttacctcatccggctctaggaagttatattttgacacgcatgctctggtctgcctgctggaagacaatggatttgcaacacagcaagctgagatcatcgtgtccgcgctggttaagatcctcgaagcgaacatggacattgtgtataaggatatggtgacgaaaatgcaacaggagataaccttccagcaggtgatgtcccagatcgcaaatgtcaaaaaagacatgatcatcctagagaaatctgagttcagcgcactgcgagccgagaacgaaaaaattaagctcgagctgcaccaactcaagcagcaggtgatggacgaggtcattaaggtgcgaactgacaccaaacttgattttaacttagaaaaatcacgtgttaaggaactgtattctttgaacgaaaagaagctcttggagctccgaactgagatcgttgctttgcatgctcagcaggacagggctttgacccagacagaccggaaaatcgaaacggaggtggcaggactaaaaaccatgctggagtctcacaaactggataatattaaatatctggccggatctatatttacttgcctgaccgtcgccctcgggttctacaggctatggatctag

SEQ ID NO: 25605 - DNA, 738 bp, Artificial Sequence
  Description of Artificial Sequence: Synthetic coding sequence
atgctggcaaattgtgggagcgtatgtgaggaaacgcagttccggggaacaacagtggcccccgctctgggcgagttttttactacaactactaaggaaggatatgatagaagacctgtcgacattactccactggaacagcgcaagctcacatttgacacccatgctctggtgcaggacctcgagacccacgggttcgataagactcaggctgagactatcgtatcagcactgaccgctctttccaacgtttccctcgataccatctacaaggagatggtgacccaagctcaacaagaaatcaccgtgcagcagctcatggcccatttggatgccatccgtaaagatatggtgatactcgagaagtccgagttcgctaatctgcgggctgaaaacgagaaaatgaagattgaactggaccaggtgaagcagcagttgatgcacgagactagtaggatcagagccgataataaactggatattaacctggaacgttctagagttactgatatgtttaccgaccaggagaaacaattgatggaaacaactacagaatttacgaaaaaggatacgcagacgaaatcaattataagcgagacgagtaataagattgatgccgagatcgcgtcccttaagacactgatggaaagcaacaagttagaaactattcggtacttggcagcgtcagtgtttacctgtctagccattgccttgggattctaccgattttggaaatag

SEQ ID NO: 25606 - DNA, 462 bp, Artificial Sequence
  Description of Artificial Sequence: Synthetic coding sequence
atggtgactcaggcgcagcaggaaatcacagtccagcagttgatggcacacttagatgccattcgaaaagacatggttattctagagaaatctgagtttgcaaatctgagggcagaaaacgaaaagatgaaaattgagctcgaccaggttaaacaacagctgatgcatgaaaccagtagaatcagggcagacaataaactcgacataaacttagaacgctcaagggtcacggatatgttcacagatcaagagaagcagttgatggagaccactacggaatttaccaaaaaagatacacagacgaagagtattattagcgaaacctcaaacaaaatcgacgctgaaatagctagcctgaaaaccttgatggagagcaacaagcttgagactatcagatacctcgccgcatcagtcttcacctgccttgccatcgccctgggtttctacaggttttggaagtag

SEQ ID NO: 25607 - DNA, 462 bp, Artificial Sequence
  Description of Artificial Sequence: Synthetic coding sequence
atggttacacaggcccagcaagaaattacagttcagcaactgatggctcacctggacgcaatcagaaaagacatggtcatactggagaaaagcgagttcgctaatctgcgcgctgagaacgagaagatgaaaatcgagctggaccaagtaaagcagcagttgatgcacgaaactagcaggatccgcgctgataataagttggacatcaatctcgaacggagtcgagttaccgacatgttcacggatcaagagaagcagctaatggagacaactaccgaattcaccaagaaggacacccagacaaagtccatcattagtgagacatctaataagatcgacgccgaaattgcatcgctgaagactctgatggagagcaataaactggaaactatcaggtatctggcagcctccgtattcacatgcttggccatcgccttggggttctaccgcttttggaaatag

SEQ ID NO: 25608 - DNA, 765 bp, Artificial Sequence
  Description of Artificial Sequence: Synthetic coding sequence
atgaacagtaggcaggcgtggcggctttttttgtcgcagggcaggggtgacagatgggtgtcaagaccaaggggtcacttttcccctgctttacgaagggagtttttcacaacaacaacaaaagaggggtatgaccgcagacctgtggatattacacccttggagcagcggaagctcacgttcgacactcatgccctcgtgcaggatctggaaactcacgggtttgacaagacacaggccgagaccatagttagcgcgttgactgccctctccaacgtttctttggataccatctataaggagatggtcacccaggctcagcaggagatcactgtccagcagctaatggcacacctagatgctatcaggaaggacatggttatccttgagaagtctgagttcgctaatttaagggctgagaacgagaagatgaagatagagttagatcaggtgaagcaacaactgatgcacgagacctcccggataagagctgacaacaagctggatatcaacctggagcgatctagggttaccgatatgtttactgaccaggagaaacaactgatggaaaccacaacagagttcaccaagaaggatacccaaaccaagagcataatctccgaaacatctaataagatcgacgcagaaattgcctcactcaaaaccctgatggagtccaacaagcttgagactattcggtatctggccgcctctgtctttacctgcttagcaatagctcttgggttctaccgtttctggaagtag

SEQ ID NO: 25609 - DNA, 1236 bp, Artificial Sequence
  Description of Artificial Sequence: Synthetic coding sequence
atgcccatgtggaacaaggtgtccggagttcatctgtctccctccagtcccgagatcgtcttagatagggaccactccagtagtattggctgtctgtcttcagacgccattatcagcagccctgagaacacccacgccgcaaacagcatcgtgagtcagacaattcccaaagcccagattcaacaatccacccatacacaccttgatatttcgctgtttcccctcggcctgactgacgagaaatcaaacggcaccattgcattggtggacgactctgaagacccaggcgctaatgtttcgaatattcaactacagcagaaaatatcatcactggagattaagttaaaggtatcagaggaggaaaagcaaaggattaaacaggatgtggagtccctgatggagaagcacaatgtcctcgagaagggttttctcaaggaaaaagagcaagaagcaatctccttccaagataggtataaagaactacaggaaaaacacaaacaggaactcgaagacatgcggaaagctgggcatgaagccctatctattattgtggacgagtacaaagccctccttcaatcttctgtgaagcagcaggtagaggcaatagagaagcagtacataagcgcaattgagaaacaggcccataagtgcgaggagctcctcaacgcacagcaccagcggctgctggaaatgttggacactgagaaggaattgttaaaggagaagataaaagaggcactcattcaacagtcacaggaacagaaagaaatactggagaagtgtctggaggaagaaagacagaggaataaagaagctctggtgtccgcagcaaagctggagaaagaggccgtgaaagacgcggtgctcaaggtcgtggaggaggaacgaaagaatctcgaaaaagcccacgcagaagaacgcgaactatggaaaaccgagcatgcaaaggaccaagaaaaggtttcacaggaaattcagaaggcaattcaggagcagagaaagataagccaggagactgttaaagctgcaatcatcgaggagcagaaacgctctgaaaaggctgtggaggaggctgtaaaacggacccgagacgaactgattgaatacataaaggaacagaaacgtttggatcaggttatacgacagaggtctctgagcagcttagagctgtttctgagttgcgcccagaaacagctgtccgccctgattgccactgagcccgtggacattgagtag

SEQ ID NO: 25610 - DNA, 1218 bp, Artificial Sequence
  Description of Artificial Sequence: Synthetic coding sequence
atggacgacgatgatttcggtggcttcgaagctgcagagacgttcgacggtggcagcggcgagactcagacgacaagccccgccattccttgggcagcctttcccgctgtgtctggtgtccatctgagccctagtagccccgaaatagtgctcgatagagatcactcctccagtataggttgtttgtctagtgacgccattatctcttctcccgaaaacacccatgcagccaatagcattgtctcacagacaattccgaaggcccaaatccagcagtctacacatacccatcttgacatcagcctctttccgcttggactgaccgacgaaaagtccaatgggaccatcgcactggtggacgatagcgaagaccccggagcaaacgtgagtaatatacagctgcagcaaaagatttcttccctggagataaaactcaaagtgtccgaggaagagaaacaacgcatcaagcaggacgtcgaaagtctgatggagaaacacaatgtgctggaaaaaggattcctgaaagagaaagaacaggaggccatctcctttcaggacagatacaaagagttgcaggagaaacacaaacaggagctcgaagatatgcgcaaggccgggcacgaggcgctgagtataatcgtcgacgaatacaaacatcaaagactgttggaaatgcttgataccgaaaaagagctactgaaggagaagatcaaagaagctcttattcagcagtcccaggagcagaaagagatcttggaaaagtgtctggaagaagagaggcagcgtaacaaggaagccctggtctccgcagcaaaacttgagaaggaagcggttaaagacgctgtcctgaaggtggtggaagaggagcgtaagaatttggagaaggctcatgcggaagaacgcgaactctggaaaacggagcacgcaaaagaccaggagaaagtcagtcaggagatccagaaagctattcaggaacaaaggaaaatttcacaggagactgttaaggccgctatcatcgaggagcaaaagcgctcagagaaggccgtggaagaggccgtgaagcgaactagggacgaactaatcgaatacatcaaggagcaaaaaagattggaccaggtaattcggcagcgctccctgagcagccttgaactgttcctgtcgtgtgcacagaaacaattgtctgctttaattgcaacggagccagtcgacatagaatag

SEQ ID NO: 25611 - DNA, 1326 bp, Artificial Sequence
  Description of Artificial Sequence: Synthetic coding sequence
atggacgatgatgactttgggggattcgaggcagcggagactttcgatggcggatcgggggagacccagactacgtcccccgctattccctgggctgcctttccggctgtctctggtgtgcacttgtcaccctcctcaccggagattgttcttgatcgcgaccacagttcctctattggatgcctaagcagcgatgccattatctccagtccagaaaatacgcacgccgcaaactcgatcgtgagtcagactatcccaaaggcacagatccagcagtccacgcatacacacctcgatatcagcctgttcccactcggcctcacagacgagaagtccaatgggacgatcgctcttgttgacgattctgaagatcctggggccaacgtttctaatatccaactccaacaaaagatctcgtctctggagatcaaattgaaagtctccgaggaagagaagcagcggatcaaacaagatgttgaatccttaatggaaaaacacaacgtgctggagaagggcttcctgaaggagaaagagcaggaggcaatttcttttcaggaccggtacaaagagctacaggagaaacacaaacaggaattggaggatatgcgcaaagccggtcatgaggcactatccatcattgtcgacgaatataaagccctgctgcaaagctccgtaaagcagcaggtggaggcaatcgaaaagcaatatatttccgctattgagaaacaggcccacaagtgcgaggaactgctcaacgcacagcatcagagacttctagaaatgcttgataccgagaaagaactgctcaaagaaaagataaaagaggctctgatccagcagtctcaggagcagaaggagatccttgaaaaatgccttgaggaggagaggcaaagaaacaaggaagcccttgtgtccgctgccaaattagaaaaagaggccgtgaaagatgccgtgttgaaagtcgttgaggaggagcgcaagaaccttgaaaaagctcacgcggaagaaagagaactctggaagactgaacacgccaaagaccaagagaaagtgtcccaagagatccaaaaggcgattcaagaacagcgcaaaatcagccaggagactgtgaaggcagccatcatagaggaacaaaaaagatctgagaaagctgtggaagaggcggtcaagcgcacccgggatgagcttatcgaatacatcaaagaacagaagcggctggaccaggtgattaggcagaggtctttgtctagtctggagctctttctgtcttgcgcacaaaaacagttgtcagcacttatcgctaccgagccagttgacatagagtag

SEQ ID NO: 25612 - DNA, 1086 bp, Artificial Sequence
  Description of Artificial Sequence: Synthetic coding sequence
atggacgacgacgacttcgggggctttgaagcagcggaaacatttgatggcggctcgggtgagactcaaacaacatcacctgccataccgtgggcggcttttcccgcagtcagtggtgtgcatctctcaccctcctctcccgaaatcgtgttggatagagaccactccagttcaattggctgcctatctagtgatgccattatcagctcaccagagaatacccacgctgccaactctattgtctcacagaccatccctaaggctcaaattcaacagtcgacacacactcacctggatatttcactgttcccactaggactgacagacgaaaaaagtaacgggaccatagcactggtggacgatagcgaggatcccggggcaaatgtctctaacattcagctccagcaaaagatcagctcactagaaatcaagttgaaagttagcgaggaggaaaagcaaagaatcaagcaggacgtcgaatccctgatggaaaaacacaacgttctggagaaaggcttcttgaaggagaaagaacaggaggctatctccttccaggataggtacaaagagttacaggaaaagcataagcaggagctcgaggatatgcgaaaggctgggcacgaagcgttgagcatcattgttgacgagtacaaagcgctgttgcagtcctcagtgaagcagcaggtcgaagccattgagaaacagtatatctcagcaatagaaaagcaggctcataaatgcgaagagctcctgaatgcacagcaccagagactgttggagatgttggataccgagaaagagctgttaaaagaaaagatcaaagaagctttaatacaacagtctcaggaacagaaagaaattctggagaagtgcctggaagaagaaagacagcggaacaaggaggctctggtttccgccgctaagcttgagaaggaggcagtaaaagacgcagtattaaaggtggtcgaggaggagcggaaaaatctggaaaaggcacatgcagaagagagagaactgtggaagactgaacacgcaaaggatcaggagaaagtctcacaggagatccagaaggcgattcaggaatag

SEQ ID NO: 25613 - DNA, 258 bp, Artificial Sequence
  Description of Artificial Sequence: Synthetic coding sequence
atggacgatgacgattttggcgggtttgaagcagctgaaacctttgacgggggaagcggggaaacacagacaacttctcctgccattccgtgggccgcctttcccgccgtcagcggggtacacctgtctccaagttcccccgagatcgttttagatcgcgaccatagcagttcaattggttgtctgagttcggatgccattatttcttcccccgagaacacccatgccgcgaactccatcgtcagtcagaccatctag

SEQ ID NO: 25614 - DNA, 1218 bp, Artificial Sequence
  Description of Artificial Sequence: Synthetic coding sequence
atggacgacgatgacttcggcggtttcgaagctgcggagactttcgatggaggatccggggagactcaaacaacgtcaccggctattccatgggcggcatttcctgccgtctcaggcgtgcacctgagcccctcaagcccagaaatcgtgttggaccgggatcactctagtagtatagggtgtctcagctcggacgccataataagctctccagagaatacccacgccgccaactccatcgtctcacagacgatccccaaggctcagatccagcagtccactcacacacatctcgacattagtctcttccctctcggactgaccgacgaaaagtccaacggcacaattgcactcgtagacgattccgaggacccgggggcgaatgtctctaatattcagctgcagcaaaagatttcaagcctcgaaataaaattgaaggtcagcgaggaagagaagcaaaggattaagcaggacgtggaaagccttatggagaagcacaatgtgctggaaaaagggttcttgaaagagaaagagcaagaggccatcagcttccaggatagatacaaggagctgcaggagaagcacaaacaagaactggaagatatgcgaaaggccggtcacgaagccttgagcatcatcgtcgacgaatataagcaccaacgcttgctggagatgctcgacacagagaaagagctgctgaaggaaaagattaaagaggccctgatccagcagagccaggaacagaaagagatcttggaaaagtgtctggaagaggagcgacagcgcaacaaggaggcactggtaagtgctgccaagctggaaaaggaggcagtaaaggacgccgttttgaaggtggtcgaggaggaaaggaaaaacctggagaaagcacatgcagaggagagagagctttggaagactgaacacgctaaagatcaagagaaggtgagccaggagatccagaaagccatacaggaacagcgaaaaatatcacaagagactgtgaaagctgcaattatcgaggagcagaaaaggagtgaaaaggcagtggaggaagccgtgaagcggacgcgagatgaattgattgaatacataaaagaacagaagagactagaccaggtaattcgacagagaagtctgtcctccctggagctttttctgtcatgcgcacagaagcaactttctgcgctgatcgccacagagcctgttgatatcgagtag

SEQ ID NO: 25615 - DNA, 276 bp, Artificial Sequence
  Description of Artificial Sequence: Synthetic coding sequence
atggacgacgatgactttggggggtttgaggcggcagagactttcgacgggggatctggggagacgcagaccacgagcccagcaataccgtgggccgcatttcctgccgtatctggggtacacctgtcgcccagcagccccgagatcgtgttggatcgtgatcactcatcgtctattggatgcctcagttcagacgcgattatcagcagccccgagaatacccacgcagccaacagcatcgtaagccagacgatccccaaggcccaaattcagtag

SEQ ID NO: 25616 - DNA, 1326 bp, Artificial Sequence
  Description of Artificial Sequence: Synthetic coding sequence
atggacgacgacgactttggcggcttcgaggccgccgagacctttgacggaggcagtggagaaacccagactaccagtcctgcgattccctgggccgcttttcctgcagtcagtggcgtgcacctatcccccagttctccggagatagtccttgatcgcgaccatagcagctctattggatgtttatcttccgacgccatcatttcatcccctgagaatacccatgctgcaaatagtattgtgagccaaacaatccccaaggctcagatccagcagtcaacccatacgcatcttgacatctccctctttccacttggactgacagatgagaagagtaatggtacaatcgccctggtggatgactcggaggatcccggagcaaatgtgagcaacatccagctccaacagaagatctcttccctggagatcaaactaaaggtgtccgaggaggaaaaacagcggataaagcaggatgtggagtctctgatggagaagcataacgttctggagaaaggctttctgaaggaaaaagagcaagaggcaatttctttccaggaccgttataaagaactacaggagaaacacaagcaagaacttgaagacatgcggaaagccgggcacgaggccctcagcatcattgttgacgaatacaaggcactgttgcagtcttctgtcaagcaacaggtcgaggcaattgagaagcaatatatttcagccattgaaaaacaggcccacaagtgcgaagaattgctaaacgcgcaacaccagagactcctagagatgcttgacacagaaaaggagctcttaaaggagaagattaaagaggcactcattcagcagtcccaggagcagaaagagattctggaaaaatgtctggaagaggagcgtcagaggaacaaggaagccttggtgtcagctgctaagctcgagaaagaagccgtgaaggacgccgtgctgaaagtggtagaggaagagcgtaaaaacctggagaaggcacatgcggaggagcgagagctctggaagactgaacacgcaaaggaccaggaaaaagtttcccaggaaatacagaaagccatccaagagcagaggaagatttcacaggagacagtgaaggccgctatcatcgaggagcagaaacgctcagaaaaggctgtcgaggaggcggtgaaacgcacacgggacgagttaattgaatatatcaaggaacagaaaaggctcgaccaggtgatccgccagcgctctctgagcagcttagagctgttcctgtcttgcgcgcaaaaacagctgagtgctttgatagctactgaaccagtggacatcgagtag

SEQ ID NO: 25617 - DNA, 357 bp, Artificial Sequence
  Description of Artificial Sequence: Synthetic coding sequence
atggccaccccctccttgaggggacgactggcccgatttggcaatccccgaaaacccgtgctgaagcccaacaagccgctgatattggcgaacagagtgggcgaacgtcgacgggagaagggagaagccacatgcataactgaaatgtcagtgatgatggcctgctggaagcagaatgagttcagagatgatgcgtgtcggaaggagatacagggctttctggactgcgcagcccgtgctcaggaggcccggaaaatgcggtccatccaggagacattgggagagtccggttccttgctgcccaacaaattgaacaagcttctacagcggtttcccaacaaaccatatctgagttag

SEQ ID NO: 25618 - DNA, 294 bp, Artificial Sequence
  Description of Artificial Sequence: Synthetic coding sequence
atggctacaccttctctgagaggtagattggctagatttggaaaccctcggaagcctgtgctcaaaccaaataagcccttaatattagcaaatcgtgttggggagcggcgccgggaaaaaggtgaggcaacatgtattaccgagatgtcagtgatgatggcctgttggaagcagaatgagttccgcgatgacgcctgtagaaaagaaattcaaggtttcctggactgtgctgctagggctcaggtgaccgacggatcgtggggcgccttcagcggaaaagagtggggcaggtag

SEQ ID NO: 25619 - DNA, 429 bp, Artificial Sequence
  Description of Artificial Sequence: Synthetic coding sequence
atgccaagaggaagtaggtcagcagcttccagacccgcttctcgtcccgccgcaccatcggctcacccaccagcccacccccctccctctgccgccgctcctgctcccgctccaagtggtcagccaggcctgatggctcagatggctacaacagccgccggagttgccgttggaagtgcagtgggacatgtgatgggctccgcacttactggcgccttctcaggaggtagcagtgaaccgagccagcctgcagtgcagcaggcacctaccccagcggctccccagcccctgcaaatgggcccctgcgcttacgaaatacgccagtttctggattgctctactacccagtcagacctcagtttatgcgaaggattctctgaggctctaaaacagtgcaaatattaccacggcctgagtagcctgccctag

SEQ ID NO: 25620 - DNA, 456 bp, Artificial Sequence
  Description of Artificial Sequence: Synthetic coding sequence
atgcctcgaggctcaagatcccgaacatccaggatggccccccccgcgagccgcgcaccccagatgcgcgccgctcctcgcccagcccctgttgctcagcccccagcggccgcacccccaagtgctgtggggagtagcgctgcggccccacggcagccgggattaatggcccagatggcaaccactgctgccggcgtggccgtggggagtgcagtcgggcacaccctaggacatgccattacgggaggcttttcaggcgggtccaatgcggagccagctcgcccggacattacatatcaggagccccagggaacgcagcccgctcagcagcaacagccatgcctttacgagataaagcagtttctcgaatgtgcacagaatcagggtgacatcaaactgtgcgagggcttcaacgaagttcttaagcagtgtcggctggccaacgggctcgcctag

SEQ ID NO: 25621 - DNA, 468 bp, Artificial Sequence
  Description of Artificial Sequence: Synthetic coding sequence
atgcccgtgtcttactcaagtgtcaccactaggtattatcatcgcgccggcgctgaggaaggtaaggaccggatcatatttgttactaaggaggaccacgagaccccatcttccgctgagttagtggccgacgaccctaatgacccatatgaggagcacggtcttatcctgcctaatggaaacattaattggaactgcccatgcctgggcggaatggcaagtgggccatgcggcgagcagttcaagagcgctttttcgtgcttccactattcgacagaggaaatcaaaggatccgactgcgtggatcagtttagagccatgcaggagtgcatgcaaaagtatcccgatctgtacccccaggaggatgaagacgaggaggaggagcgcgagaagaagcctgccgagcaagccgaagaaactgcccccattgaagccacggccacaaaggaggaggaaggaagctcgtag

SEQ ID NO: 25622 - DNA, 429 bp, Artificial Sequence
  Description of Artificial Sequence: Synthetic coding sequence
atgtcatactgcaggcaggagggtaaggaccgcataatatttgtcacgaaagaagatcatgagacgcccagttcagcggaactagtggccgacgatccgaacgacccctacgaggaacacggactcatcttgcccaatgggaacatcaactggaattgtccctgtctgggcggtatggcatccggcccatgtggggaacaattcaagagcgccttctcttgtttccattacagtaccgaggaaattaaagggagcgattgtgtcgatcaattccgagctatgcaggagtgcatgcaaaaatacccagatttgtatcctcaggaagacgaggatgaagaagaagagcgcgagaaaaagcccgccgagcaggctgaggaaaccgcgcccattgaagccacagccaccaaggaagaggaggggtccagttag

SEQ ID NO: 25623 - DNA, 1449 bp, Artificial Sequence
  Description of Artificial Sequence: Synthetic coding sequence
atggctagcttcagcgcggagactaattctacagacctcttgtctcagccttggaacgagcctcctgtgatcctttcaatggtgatcctgtctctgaccttcctcttaggcttgcccgggaatgggctggtgttatgggtcgctggcctgaagatgcaacggacggtaaacacaatttggtttctgcacttgactctggctgatctgttgtgctgcctgagccttccctttagtctagcccatctggccctccaaggccagtggccttacggaagattcctttgtaaattgatcccttcaattatcgtgctgaatatgtttgcgtcagtgttcttgctgacggcgatctctctcgaccggtgcctcgtggtttttaaacccatctggtgccagaatcacagaaatgttggcatggcgtgctcaatatgtggttgcatatgggtggtcgcctttgtgatgtgcattccggtgttcgtataccgcgaaatttttacaaccgataaccataaccgatgcgggtataagttcgggctgagctcttctctggattatcctgacttctacggggatcctttggaaaacagatccctcgagaacatagtgcaacctcctggggagatgaatgataggttggatccttcaagctttcagaccaacgatcacccctggacagtgccaaccgtgttccagccccagacatttcagaggccttcagctgactccctgcctcggggctctgctaggcttaccagtcagaatctgtactctaacgtttttaagccagctgacgtggtctcacctaagattccttcgggcttcccaatcgaagatcatgaaaccagccctttggacaactcagacgccttcctctcaacccatctcaagctattcccctctgccagtagtaacagcttctatgaatcagaactgcctcagggttttcaggactactataacctcggccagttcactgatgacgaccaggtccctacccctttagtggctatcaccatcacaaggttagtcgtcggcttcctgcttcccagcgtgatcatgatcgcttgttactctttcattgtgtttagaatgcagaggggaaggtttgcgaaatctcagtctaagacctttagggtggccgtggtcgttgtcgccgtattccttgtgtgctggactccctatcatatctttggtgtgctgagtctgcttactgaccccgagactccgcttggtaagacgctgatgtcttgggaccacgtttgtattgcactagcatcggcaaattcatgctttaatcctttcctttatgccctgctgggcaaagactttcgcaagaaagctcgtcagagtatccaaggcatcctcgaagccgcctttagcgaggagctgaccaggtctacacattgcccctcaaataacgtcatcagcgaaagaaacagcaccaccgtttag

SEQ ID NO: 25624 - DNA, 441 bp, Artificial Sequence
  Description of Artificial Sequence: Synthetic coding sequence
atggctagcttctctgccgaaactaactcgactgatctactcagccagccttggaatgaacctcccgtgatcctctccatggttatcttatctttaaccttcctgcttggcctccccggcaatgggctcgtactctgggtcgccggtttgaagatgcaacgcacggtgaacacgatttggtttctgcacctcaccttggccgatctgctgtgctgcctgtcattgcccttctccctggctcacctcgcattacagggacagtggccttacggacggttcctgtgcaaactgatccccagcatcattgttctgaacatgtttgcaagtgtatttctgttgacagccatttccctggatcggtgcttggtcgtttttaaaccaatttggtgccaaaaccaccgtaacgtcgggatggcatgcagcatctgtggctgtatctag

SEQ ID NO: 25625 - DNA, 1053 bp, Artificial Sequence
  Description of Artificial Sequence: Synthetic coding sequence
atggattccttcaactatacgactcccgattacggacattatgacgataaagacactctggacctgaacacaccggtggataagacatctaacaccttgcgcgtacctgatatactggcccttgtaattttcgccgttgtcttcttagtaggcgtcctgggaaatgctctcgtcgtatgggtcactgcgtttgaagctaagcggactatcaatgctatttggtttctgaacttggccgtggccgacttcctgtcatgcttggctcttcctattctgttcaccagtatcgtccagcatcaccattggccctttgggggcgctgcgtgctcgatcctaccgtctctgattttactgaatatgtacgcctccattctgctgctggccactatcagcgcagatcggttcctcctggtgtttaaacctatatggtgtcagaactttcgaggagctggcctagcttggatcgcttgcgcagtcgcctggggcttggcactgctgctgaccatccccagctttctgtaccgggtcgtgcgcgaagaatatttcccacccaaggtgctttgcggagtagactattcgcacgataagaggcgcgagcgagccgtggctatcgtccgactggtcctgggcttcctctggcctttactcaccctgacaatatgctatacctttatacttctgaggacatggagccgacgagcgaccaggtccaccaaaacactgaaagtggtcgtcgcggtcgtggcttcattcttcatcttctggctgccttatcaggtgaccggtattatgatgagctttctggagccctctagccccacctttctcttgctcaagaaacttgattcattgtgcgtgtcttttgcctacataaactgctgcatcaaccccataatctatgttgtagccggtcagggattccagggtcggctgaggaaatctctgcctagcctgctgcgaaacgtactaaccgaggagtctgtggtgagggaaagcaaatcttttacaaggtctacagttgacaccatggcccagaaaacacaggcagtgtag

SEQ ID NO: 25626 - DNA, 477 bp, Artificial Sequence
  Description of Artificial Sequence: Synthetic coding sequence
atggcctttatggttaagactatggtggggggccaattgaagaatctcacgggcagcctgggtggcggagaagacaagggagatggcgacaaatcagcggcagaagctcagggcatgagccgagaagaatatgaagagtaccaaaaacagctggtggaggagaagatggaacgcgatgcccagtttacccagcgcaaagctgaacgggctaccttgagatcacatttccgggataaataccgcctacctaagaacgaaactgatgaatcccaaatacagatggccgggggcgatgttgagctccccagagaactagctaagatgatcgaggaagataccgaggaagaagaggagaaggcatccgtgctcggccaactggcctccctgcctggcctcaatctgggctcccttaaggacaaggcacaggcaacgctaggagatctgaagcagagcgctgaaaagtgtcacgtgatgtag

SEQ ID NO: 25627 - DNA, 2142 bp, Artificial Sequence
  Description of Artificial Sequence: Synthetic coding sequence
atggagccggttgaaacctggacgcccggcaaggtcgctacgtggctgagggggttggacgacagcttgcaagattacccattcgaagactggcagcttcccggcaagaatcttctccagctgtgcccccagtcattggaggccctagctgtcaggagcctgggtcatcaggagttaatcctgggcggggtcgaacagctgcaggctctgtcttcccgactgcagaccgaaaaccttcagagtctgactgaaggcttgctgggggcaacacacgacttccaaagcatcgtccaagggtgcctgggcgattgcgccaagactccgattgacgtgctgtgcgcagctgtggagcttctgcatgaggccgatgcgttattattctggttgtcaaggtacctgttttctcatctcaacgactttagcgcctgccaggaaattagggacttacttgaggagctcagccaggtactccatgaagatggtcctgccgccgagaaggaaggaacagtgctgagaatttgcagtcacgtggccggaatctgccacaacatactagtctgttgtcccaaggaattactagagcagaaggcagtgctcgaacaagtgcagcttgactctccactgggcctggagatccacacgacctcaaactgtcagcatttcgttagccaggtggatacacaggtgccaactgatagtaggctccagatacagcctggtgacgaggtggtccagatcaatgagcaagtagtcgtaggctggccccggaaaaatatggtacgcgaactgctgcgggaacccgccggtctgtcattagtgctcaagaagattccgataccggagacccccccacaaacaccacctcaagtgttggactccccccatcaacgcagcccctcactgagtctggccccactgagcccccgggctccgagcgaggacgtgttcgcctttgacttgtcgagcaatccttcccccggtccttcacctgcttggaccgactccgcctctctgggccccgaaccattaccaatcccacctgagccacccgcgatcctgcctgcaggcgtggcaggcacccctgggctgccagaatctcctgacaagagtcctgttggccggaagaaaagcaaagggctcgcaacacgcctgtcccgccggagagtgtcctgtcgagaactggggcgccctgattgtgacggctggctgctcctgcgaaaggccccaggaggctttatgggtcccaggtggcggagacgctggtttgttctcaaaggtcacacactctactggtacaggcagccacaggacgaaaaagctgaaggactgatcaatgtgtctaactattccctggagtcgggtcatgaccagaaaaaaaaatacgtctttcaactaacgcacgacgtttacaaacctttcatttttgccgccgatacactcaccgatctcagcatgtgggtacggcacctgattacctgcatctccaaataccagtcacctggacgcgctcctcctcctcgcgaagaggattgttacagcgagacggaagccgaggatcctgacgacgaagcaggatcgcactccgcaagcccatctcctgcccaagcgggaagtcctctgcatggcgacacatcgcctgccgccaccccgacccagcgctctccacgaacaagttttgggagccttacagactccagcgaggaagctcttgaaggcatggtgcgaggcctaaggcaaggaggagtgtcactactcggacagcctcagccgctgacacaagaacaatggcgcagcagttttatgcgaaggaacagggacccacagctgaacgagagggtgcacagggtcagagccttacagtccacgctgaaggctaaattgcaggaactgcaggttcttgaggaagtactgggggatcctgaactgaccggggaaaagtttcgtcaatggaaggagcagaatcgagagctctactccgagggtctgggtgcctggggagtggcccaggcagaggggagctcccacatcctcactagtgacagcacggaacagagcccccattcactccccagtgacccagaggaacacagccacctgtgtcccttgacctccgaaagctcattaaggccacccgatttgtag

SEQ ID NO: 25628 - DNA, 2163 bp, Artificial Sequence
  Description of Artificial Sequence: Synthetic coding sequence
atggagccagttgagacctggaccccggggaaagtcgcgacgtggctccgcggcctcgatgatagcctccaggattacccttttgaggattggcagttgccgggaaaaaatttgcttcagctgtgtcctcagtctcttgaggccctcgccgttcggtcactgggccaccaggagttgatcctgggcggagtcgagcagctccaggctctctcatctcgtctacagacagaaaacctgcaaagtctcactgagggcctcctgggtgctacacacgatttccagagcatcgttcaaggatgcctgggtgattgtgccaagaccccaatagacgtgctgtgtgctgccgtggagctgcttcacgaagctgacgccctgctgttctggcttagcaggtatctgttttcgcatcttaacgacttttcagcttgtcaggagatacgggatttattagaggaactgagccaagttctccatgaggacggccctgcagctgagaaggaaggaaccgtcctgcgcatctgctcccacgttgccggaatctgtcacaacattctggtgtgctgtccgaaagaattgctggaacagaaagccgtcctggaacaggtgcagctggacagccctctgggcttagagattcacacgacatcaaactgccagcacttcgtctcccaagttgacacacaggttcctaccgactccagattacagatccagccaggagacgaggttgtgcagataaatgagcaggtggtggttcgtgaggagagagacatggttggttggcccagaaagaatatggtgcgggagctgctgagggagcctgctggcttatctctggtccttaaaaagattcccatccctgaaacccccccccagacccccccccaggtcctggattcacctcaccagcgtagtccttcgctgagcctggcacctctcagtccccgagcaccatcagaggacgtgttcgcattcgacctgagttccaacccaagccccggcccgtctcccgcctggacagattccgcctctctgggacccgaaccacttccaatccctcccgaaccccccgccatattaccagcaggcgtcgccggaactcctgggctgcccgaatctcctgataagtctcctgtcggcaggaaaaaatcaaaaggacttgccacccggttatctcgaagacgtgtgtcttgccgcgagctggggcggcctgactgcgatgggtggctcctcctgcggaaggcacccggcggattcatgggaccccggtggcggcgccgctggttcgtgctcaaagggcatacactctactggtaccgccagcctcaggacgagaaagctgagggcctgatcaatgtgtccaactacagtttggaatcaggccatgaccagaaaaaaaaatacgtcttccagctgactcacgatgtgtacaaaccattcattttcgccgctgataccctaacagacctgtcgatgtgggtgaggcatctgattacctgtatttctaagtaccaaagtcctgggcgtgccccacctcccagggaggaggattgttacagcgaaaccgaggcagaagatcctgatgatgaggcaggatcacatagcgcctcaccctcccctgcccaggcgggcagccctttacacggggacacaagcccagcagccacccccacccaacgatctccacggactagtttcggttctctgaccgattcctccgaggaagctttggagggaatggtcagaggcctgaggcaaggcggagtgtcccttctgggccaaccacagccactcacacaggaacagtggagaagttcgtttatgcggagaaaccgggaccctcagctgaacgaacgcgtgcacagagtgcgggctttgcagagtactctgaaagcaaaattacaggagctccaagtgctggaggaggttctcggagaccctgagcttactggtgagaagtttcgccagtggaaagaacagaaccgggagctgtatagtgagggcctaggcgcctggggggtggcccaggctgagggtagttcgcacatcctgacaagcgactcaacggaacaaagcccacacagcctgccatccgatccggaggagcactctcacctttgccccctgaccagcgaaagtagcctgagaccccccgacctgtag

SEQ ID NO: 25629 - DNA, 936 bp, Artificial Sequence
  Description of Artificial Sequence: Synthetic coding sequence
atggaacccgtggagacatggactcctgggaaggtcgccacttggctaagagggctcgacgattcactccaggattatccgttcgaggattggcagctcccagggaagaatctgctccagctttgtccacaaagcttggaagccctggcagtgaggtcattaggccaccaggaactgatcctggggggcgtagaacaactccaggccctgtctagcaggcttcagaccgagaacctgcagagccttacagagggtctcctgggggcaacacacgacttccaatccatcgtccaaggctgcctgggggattgcgcaaagacacccatagatgtcctatgtgccgcagtggaattgctccacgaggccgatgccctcttgttctggctcagccggtacctgttctcccatctgaacgacttcagcgcttgccaggagatccgtgacctgctcgaggaattaagtcaggtacttcacgaggacttacagcctcggggatgggatttgcctcagcaccctggattactgccgcagggtgccgccggaacagaagggagagcgcgggccggggctgccggtcaaagcatcggacctaggaattcgcatcaccacccgcatacttgcctgcagacacctccaaaccggcacctcccacttctgagaccgccctcatcactgcagactcctccacaagtgcccgctccagcagctcctctgcccctactgccaccaaacctgctgtccgatccatgtctccactgcttcgtgcctggctgcagtcctgatgccccctccggccccgggcttccagctcccgaagagcccattacggtctccggccccaccgtttcgcaggtgaccggttctgtccaggtgtgtttgggaggtgagaccgtgggtagctcccaccctccctgcccgcctcagggtcccatatag

SEQ ID NO: 25630 - DNA, 4155 bp, Artificial Sequence
  Description of Artificial Sequence: Synthetic coding sequence
atgatgcacctgcgcttattttgcattctcctcgctgcggtgtccggggctgaaggctggggatattacggatgtgatgaggaactggtcggacccctttatgccagaagtctcggcgccagcagctactactccttactgactgcgcccaggtttgctcggcttcatggtatttcgggatggagccctaggattggtgaccccaatccttggctgcaaatcgatttgatgaagaagcacaggatccgagccgtggccactcagggatctttcaattcttgggactgggtaacacgatatatgctgttgtacggtgacagagtagatagttggaccccattctatcaacgcgggcacaatagcaccttttttgggaacgtgaacgagagtgccgtggtgcgccatgatctgcactttcactttaccgctaggtatatacggatcgttccactggcatggaacccccggggcaagatcggtctgagactaggtctgtatggatgcccttacaaagccgatatattatatttcgatggagatgacgccattagctatcgattccccaggggagtttctagatcgctctgggacgtgttcgctttctctttcaagacagaggagaaggacggcctcttgctacatgcggagggggcacaaggtgactatgtgacgctcgaattagagggcgcccatcttttgcttcacatgtcgctggggtcaagccctattcaaccaaggcctggtcacacaactgtgtcagccggtggcgtactcaacgaccagcattggcactacgtgcgagtcgatcgtttcggaagagatgtgaacttcacactggacggctacgtgcagcgcttcatcctgaatggagatttcgaaagactcaatcttgatactgaaatgtttatcggcggactcgtcggggccgcccggaagaacctcgcctaccggcacaatttcagaggatgcattgaaaacgtgatatttaacagggtgaatatcgccgacctggccgttcgccgccacagcagaattacgtttgaagggaaagtggcgttccggtgcctggaccccgttccccatccaattaactttggcggccctcataattttgtgcaggtcccgggatttccgcggaggggacggctggccgtgtcatttcgtttcaggacgtgggaccttacagggctgttgctgttttcccgactgggtgacggcttagggcacgtggagcttaccctctcagagggtcaggtaaatgtgtctatcgcccaaagcggtaggaagaaactgcaattcgccgctggataccgcctaaacgatggcttctggcatgaagtgaactttgtcgcccaggagaaccatgccgtgatttcaattgatgacgttgagggcgcggaggtccgagttagctatcctctgctcatcaggaccgggacaagctacttctttggaggctgcccaaagcccgcaagccgttgggactgtcacagcaatcagactgccttccacgggtgcatggagcttctgaaagtcgatggccagctggtcaacttgacactagtggagggtcggagacttggtttttacgcagaggtcctgttcgatacatgcggtattactgataggtgtagtcctaatatgtgcgagcacgatgggaggtgctaccaaagttgggatgactttatctgctactgtgagctgaccggttataaaggcgagacatgccacacgccgctgtacaaagaaagctgtgaagcctatcgcctctcgggtaaaacttcaggcaacttcactatcgatccggacgggtcagggccactgaaacccttcgtggtttactgcgacattagggagaatagggcatggaccgtcgtgcggcacgacaggctgtggactacacgcgtcactggttcctcaatggagcgcccatttctcggagcaatccagtattggaacgcatcctgggaggaagtctcggctcttgcaaatgcctcacagcattgtgaacagtggattgagttctcgtgctacaacagccgcctgctgaatacagccggcgggtatccatactcattctggattgggcgaaatgaggagcagcacttttattggggcggaagccagccaggcattcaaaggtgtgcatgcgggctggacagatcttgtgttgaccctgccctttattgtaactgcgatgcagatcaaccacagtggcgcacggacaaaggcctcctgacattcgttgaccatctgccagtgacccaagtggtgatcggggacacaaaccgctccacttccgaggcgcagttcttcctgagaccattaaggtgttatggggacaggaactcgtggaataccatctcttttcacacaggcgctgctcttcgtttcccgcctatcagggccaatcactccctcgatgtgagtttctacttcaggaccagtgcaccttctggagtctttttagagaacatgggagggccatactgtcagtggagaaggccttacgtgagagtcgagctgaatacctcccgggacgttgtgtttgcctttgacgttggcaatggagacgagaacctgacagtgcactctgacgatttcgagttcaacgatgacgagtggcatttggtgcgagccgagatcaacgtaaaacaggcacgcctcagagtcgatcatcgaccttgggtgctaagacccatgcctctacaaacatacatttggatggagtatgatcagccactgtatgttgggagcgcagagctgaaacggcggccattcgtgggttgtttgagagctatgaggctcaatggagttacactcaacttggaaggtagagccaatgcctcagaggggacatcaccaaactgcacagggcattgtgcccatcccagactcccttgttttcatgggggacggtgtgtggagaggtatagctactatacatgtgactgtgacctaacagcttttgacggcccgtattgtaatcacgatattggtggattctttgaacctggaacctggatgcgatacaatttgcagagtgccttaaggagtgctgcccgggagttcagtcacatgctcagtagacccgtgccgggttacgagcccgggtatattcctggttacgacactcccggctacgtgcccgggtaccatggcccagggtacagattgccggactatccccgccccggtcggcctgtgcctggttaccgtggccccgtgtataacgtgactggggaggaggtttcattttctttctctactagctcagcgcccgctgtgttattatatgtgagtagttttgtgagagattacatggccgtcttgattaaagacgacggcacacttcaactgagatatcagttaggcacctccccatacgtataccagctgaccactaggcctgttacggacggccagcctcattcaatcaatataaccagggtgtatcggaacctgtttattcaagtcgattactttcctctcaccgagcagaagttttcacttttggtcgattcccaattggatagtccaaaggccctgtacctcggcagagtcatggagacaggagtcatcgaccctgaaatccagcgatataatactccgggtttttctggatgcctaagcggagtgagatttaataatgtggcccctctgaagacacattttaggacccctcgccccatgactgctgagctggccgaggccctgcgcgtgcaaggcgaactctctgaaagcaactgcggggcgatgcctagactggtgtcggaggtaccgcctgagctggatccttggtacttgcctccggatttcccatactaccatgacgaaggttgggtcgcaattcttcttggttttctagtcgcctttctactgctgggcttggtgggtatgctggtgctgttttatctgcaaaaccatagatacaaaggctcgtatcacaccaacgagccaaaggccgcccatgagtatcatcccggcagtaaacctccccttccaacgagcgggccggcccaggtgccaacaccgacagccgcccctaaccaagcacccgcaagtgcaccagcgcccgctccaacaccagcaccagcacccgggccgagggaccaaaacctgccccaaatccttgaagaatctcggagcgaatag

SEQ ID NO: 25631 - DNA, 1143 bp, Artificial Sequence
  Description of Artificial Sequence: Synthetic coding sequence
atggcctcagtggcctgggccgtgctgaaggtactcctgctgcttcccacacagacctggagcccagtgggcgcaggaaatcctcccgactgtgactcgccattagctagtgcactgccaagatccagcttctctagcagcagcgagcttagtagctcacacggcccaggattttccagactcaatcgcagggacggggccggcggatggacccccttggtgagtaacaaataccagtggctacagattgacctgggcgaacgaatggaggtcaccgcggtcgcaacccaggggggatatggcagctcagattgggtgacaagctatcttctcatgttctccgatggtggtaggaactggaagcagtacaggagagaagaaagcatctggggattcccgggaaacaccaacgcagatagtgtggttcactaccggctacagccgccgttcgaggcccgttttctaagattcttaccattagcctggaaccctagagggaggatcggcatgaggattgaggtgtatggctgcgcgtataagagtgaggtggtgtactttgacgggcagagcgccctgctgtacaccctggataaaaagcctttaaagcctatccgggatgtgatttcactgaagttcaaggcaatgcagtctaacggcatattactgcacagggagggtcagcatggaaatcacatcacgctggagttaatcaaggggaagctggtgttcttcctcaatagtggaaacgctaaactaccaagcactatcgcgcctgtgacacttacactggggtctcttctcgacgaccagcactggcatagtgtactgatcgaacttcttgatacccaggtgaactttaccgtggacaagcatactcaccactttcaggcaaagggggattcctccaacctggacctcaatttcgagatttcgttcgggggtatcctgagtcccggtaggagcagagcttttacacgcaaatctttccacggctgcctggagaatctgtactataacggcgtggatgtgaccgagctcgccaagaaacacaaaccccagatactgatgatggagctggcacacggcctgcaggatcaaaacttaaagatctcactgactgtgtgtcaccagactacacagtag

SEQ ID NO: 25632 - DNA, 2241 bp, Artificial Sequence
  Description of Artificial Sequence: Synthetic coding sequence
atggcctctgtggcatgggctgtccttaaagttttgttgttacttcctacgcagacgtggtccccagttggggccggcaacccgcctgattgtgattcccctctcgcttccgccttgcctcgcagcagctttagctcaagcagcgaactcagctcatcccatggcccgggcttttccaggctcaatcggagagatggcgcaggcggctggaccccactggtcagtaacaagtaccaatggctgcaaatagatctaggcgaaaggatggaggttactgctgttgccacacaaggtgggtacggatcaagcgactgggtgacttcttaccttctcatgttctcagacggcggtcgaaactggaagcaataccgccgagaagaaagtatctggggctttccaggtaataccaatgcagacagcgtggtgcactatagactccagcccccgtttgaagcacgtttccttagattccttccattggcctggaatccacggggcaggatcggaatgaggatcgaggtgtatggatgcgcgtacaagtcagaggtggtgtattttgatggacaatctgcactgctgtataccctcgataaaaaacccttaaagcccatccgggatgtaatttcactgaagtttaaggctatgcaaagtaacggcatcctgcttcatagggaggggcagcacgggaatcatataactttggagttgatcaagggcaagctggtgtttttcctcaacagcggcaatgcaaagctccccagtaccatcgccccagtcactttaacgttggggagtttgctggacgatcagcattggcactcagtgttaattgagttgctggatactcaggtgaatttcactgtcgacaaacacacacaccatttccaagccaagggggactcatctaacctagatttgaactttgagatttcttttggcggcatcttgagccccggcagatctagagccttcactagaaaatccttccacgggtgcctggagaatctgtattataacggagtggacgtgactgagctcgcaaagaaacataagccacagatcctcatgatgggaaatgtgagcttctcatgcccgcagccccagactgtcccggtgacctttcttagcagccgctcttacctggcccttcctggcaactctggcgaggacaaggtgtctgtgacttttcagttcaggacctggaaccgcgccggccacctgctgtttggcgagcttcagagaggcagcggttcatttgtcctcttccttaaagacggcaaactgaagctgagtctttttcaggctgggcagtctccaaggaatgtgaccgccggggctggcctgaacgatggacagtggcacagcgtgtctttcagtgccaagtggtctcacatgaacgttgtggttgatgacgacaccgccgtgcagcctctggtggcagtgttgattgactcgggcgatacctactacttcggaggctgtctgggaaattcctctggttctggttgcaagtctccgctggggggctttcaagggtgtctcagattgatcaccattggggacaaggccgtcgaccccatacttgtgcaacagggggcactgggcagtttcagggatcttcagatcgatagctgcggaattacggataggtgcttaccctcgtattgtgagcacgggggtgagtgctctcagagttgggacacattttcatgtgactgcttaggaacgggctacacaggcgaaacgtgccattcgagcttatacgagcagtcctgcgaggcgcacaagcaccgggggaatccatctgggttgtattatatcgacgcagatggttccggaccactgggcccctttctggtctattgcaatatgaccgctgactctgcatggaccgtggtgaggcacggtggacctgatgctgttactttgaggggggcaccatctgggcacccactgtctgccgtgtccttcgcttatgctgccggggcaggtcagctgagggccgccgtaaatctggcagaaaggtgcgaacagcgccttgcattgcggtgtggcaccgcccgacgccctgattctcgggacgggacaccgctgagttggtgggtcggaagaaccaacgaaacacacacaagttggggcgggtccctgccagacgcccaaaaatgcacctgcgggctcgagggaaactgcatagattcacaatactattgtaactgcgatgcagggcagaacgaatggtag

SEQ ID NO: 25633 - DNA, 609 bp, Artificial Sequence
  Description of Artificial Sequence: Synthetic coding sequence
atgacttaccatttccaggagcactacactttgtccgagaactccagttcacttgtctcatctctataccgggatgtgacgcttaccagggagatgattactcttagtttcaggaccacccggagcccaagtctattgctctacgtgagctccttttacgaggagtacctctccgtcatcctcgctaacaatggctctttgcagattaggtacaagctcgacaggcaccagaacccagacgcgttcactttcgattttaagaacatggctgacggacagctccaccaggttaagatcaacagggaggaagccgtcgtaatggtggaagtcaaccaatcagctaaaaaacaagtgattctctcctctgggactgaattcaacgcggtgaagagcctgattctgggtaaagtgctggggcggtcagggcccgtggacgagggtgaaccccttgtgaatgcggatcgtcgcgattcagctgtgatgggaggcgtcattgccgttgtaatattcattcttctttgcattaccgcaatcgccattcggatataccagcagaggaagcttcggaaagaaaatgaatctaaggtgtcgaagaaagaggaatgttag

SEQ ID NO: 25634 - DNA, 3531 bp, Artificial Sequence
  Description of Artificial Sequence: Synthetic coding sequence
tgaggacgcgagctggagactggacagggccgccagagctctgtgggtgccgcccagggaacaggcgtgcgagcaggggtcagggccggaactacacagtccggcagaagacgagcccgtgtgtccggtcgcctggccgaagtctcgatggcttcagtcgcctgggctgtgctcaaggttctgctcctactcccgacccagacctggtctcccgtgggcgccggcaatccacccgattgcgatagtcccctggcctctgcactgcctcggtcaagtttttccagctcaagtgagttaagctccagtcatgggcccggcttctcaagattgaacagacgcgatggggctggcggatggacccctctcgtgtcgaataaatatcagtggctgcaaatcgacctcggcgagcgcatggaagtaacagccgtcgccacgcagggtggctacggcagctccgactgggttaccagctatctgttgatgttctcagatggaggccgcaactggaagcaatacaggcgggaagaatccatttgggggttccctggtaacacaaatgccgacagtgtcgtgcattatcggctgcagccacccttcgaagctcgcttcctacgattcttacctctggcctggaaccccagagggcgcattggcatgcggattgaggtgtatggatgtgcatacaagtcagaggtggtgtattttgacggtcagagcgccctgctctataccctcgataagaagcctctgaaacccatacgcgatgtcatatcgctgaagtttaaggccatgcagtcaaatggcattctcctccatcgggaaggacagcacggcaaccacattactctggagcttattaagggcaagctggtatttttcttaaattctggtaacgctaagcttccctcaaccattgctccagtcacactaactctgggcagtttactggacgaccagcattggcattcggtcctcatcgagttacttgatactcaagtgaactttactgtcgataaacacacgcaccattttcaggcaaaaggggactcctctaatctggatttaaactttgaaatctcctttggagggattctttcaccgggtcggagccgtgcctttacacgcaagtccttccatggctgtctcgagaatttgtattataatggtgtggatgtaaccgagctggcgaaaaagcacaagccgcaaatcctcatgatggggaacgtgagcttctcttgcccacagccacagaccgttcccgtcacttttcttagttcacgatcttacttagctcttcctggaaattccggggaggataaggtgtctgtgacttttcagttccggacctggaacagagccggccacctactgttcggcgaactccaacgcggatcaggatcgttcgtgctgtttctaaaagatggtaagttgaagctttctctgttccaggccggccaaagcccacgcaatgtcactgcaggcgccgggctcaacgacggacagtggcattcggtgagcttctctgcaaagtggagccatatgaatgtggtggttgatgacgatactgcggtgcagcctttagtggccgtactgatcgacagcggggatacatattattttggtggatgcctgggaaattcatctggctcaggatgtaagagccctttaggcggcttccagggttgcctgcgcctcataacaattggcgataaagcggtggaccctatcttggtgcagcaaggagctcttggttcattccgagaccttcaaatcgatagctgcggcattactgatagatgcttgcccagctactgcgagcatggcggagagtgtagccagagctgggacacattttcttgtgattgtcttggaacgggatacacaggcgagacgtgccattcctctttatacgagcagtcctgcgaggcccataaacacaggggcaacccaagtgggctctactatattgacgcagacgggtccggccccttgggacccttcctggtgtactgcaacatgaccgcggatagtgcatggactgttgtcagacacgggggtcctgacgctgtaaccctgaggggggccccctccggccaccctctttcggccgtatcctttgcgtacgctgctggagccggacagctccgcgcagccgtgaatctggctgaacggtgtgagcaacggctggccctccggtgtggcacggctaggcgccccgattcaagagacggaacacctctctcttggtgggtggggcgtactaacgaaacccacaccagctggggtggatctctgcctgatgctcagaagtgcacctgcgggttggaggggaactgcatcgacagccagtattattgcaattgtgacgctggccagaacgagtggacttctgacaccatcgtcctgtcccaaaaagagcatctgcccgtcactcaaattgtaatgaccgatacaggccagccccactcggaggccgactacactttgggcccccttctctgccgcggggacaagtctttttggaactccgcaagctttaataccgaaaccagctacttgcacttcccagccttccatggcgagctgactgcggatgtatgtttttttttcaagactaccgtgtcctcaggggtcttcatggaaaatcttggcattaccgactttattaggatagagctgcgcgctccaactgaagtcacatttagcttcgatgttggcaacggaccctgcgaagtcacagtgcaaagtcccacccctttcaacgacaatcagtggcaccacgtgagggctgagcgcaacgttaaaggagcctccctgcaggtggatcaattgccccagaaaatgcagcctgctccagcggatggccacgtgcgactgcaactgaattctcagctgtttattgggggtactgcaacccggcagaggggattcttgggctgcatcaggtccctccagctgaatggagttgcactagacttagaggagcgggccaccgtcacccctggtgttgaaccagggtgcgctggacactgtagcacctatgggcatctttgccgtaacggcggtcgttgtcgggagaaacgtcggggggtcacctgtgactgcgccttttcggcgtatgatggacccttttgtagcaatgagattagcgcatacttcgcaactggatcttctatgacgtaccactttcaggagcactacactctcagcgagaacagcagcagcctggtgagcagcctttatagggatgtcacgctgacaagagagatgatcacattgagctttcggactacacgaagtccttctctccttctgtacgtgagttccttctacgaggaatacctctcagtaattctggcaaacaatggcagcctgcaaatccgttataagcttgaccgccaccagaatcccgatgcttttaccttcgacttcaagaacatggccgacgggcagctacatcaggtgaagattaaccgagaggaggctgttgtgatggtggaggtgataccacaaatgcaaaagtcaaactag

SEQ ID NO: 25635 - DNA, 3867 bp, Artificial Sequence
  Description of Artificial Sequence: Synthetic coding sequence
atggcatccgtggcatgggcggtgctgaaagtgcttctgctgctgcctacacaaacctggagtccggttggagccgggaacccacctgattgtgattctcctctggcttctgcgctgccacgatctagctttagcagttcatcagaactctccagtagccacgggccaggcttcagtcggctgaaccggcgtgacggagcaggaggctggacaccactggtgagcaacaagtatcagtggcttcaaatcgatctgggcgaaaggatggaagtaaccgccgttgccacacagggcggttacgggagcagcgactgggtcacctcatacctactgatgtttagtgatggcggccggaactggaagcagtaccgccgagaggagagcatatgggggttccctggaaacactaacgccgatagtgtcgttcattacaggctgcaacctccgtttgaagcccggtttttacgattcctccccctcgcctggaatccaaggggccgtatcggaatgaggattgaggtttacggttgtgcttataagagcgaagtggtgtactttgatgggcagtcggctttattgtacacgttggataagaaacccttaaaacccatcagggacgtaattagcttgaaatttaaagccatgcagtccaacggaattctgttacaccgagaggggcaacatggaaaccatatcactttagaactgatcaaggggaagcttgtgttctttcttaactcggggaatgctaagctccccagtacgattgcccctgttacgctgacgttgggaagtctccttgacgaccagcactggcattcagtgctgattgagctacttgatacacaggtcaatttcacagttgataagcatactcaccactttcaagccaaaggagactcatccaacctcgacctcaattttgagataagctttggaggcatcctctccccaggtcgaagccgggcgttcaccaggaagagttttcacggatgcctggaaaacctctactacaacggagttgacgtaactgagctggccaagaaacataagcctcagattctcatgatgggaaacgtcagcttttcatgcccccaaccccagactgttcccgtgacctttctttcatcccgttcttatctggcactgcccggaaactccggggaagataaagtttccgtgacttttcagttcagaacatggaaccgggccggacaccttttgttcggagaactgcagagaggaagcggcagcttcgtactcttccttaaagatggcaagctgaaactgtcattatttcaggccgggcaatcacctcgaaatgtaacagccggtgcgggcttaaatgatggtcagtggcattctgtgtcattctcggcaaaatggagccacatgaatgttgtcgttgatgatgatacagcagtacagcccttggtggcagtattaattgactctggtgacacttactactttgggggatgccttggcaatagcagcggcagcggctgcaaaagccctctcggcggctttcaagggtgtctgagactgatcactattggcgacaaggcagtggaccccatcctggtgcagcaaggagcgctggggagcttccgggaccttcagatcgactcttgcggcatcaccgaccggtgtctgccgtcatactgcgaacacggtggcgaatgcagtcagtcttgggacaccttcagctgtgactgtctgggcacaggttacaccggagagacgtgccactcctctctgtacgagcaatcctgcgaggcccataagcatcgcgggaacccctcgggactgtattacatagatgcggacggctctggcccattaggcccctttttggtgtattgcaacatgacggccgacagtgcgtggacagtggttaggcatgggggacccgatgccgttacactccgaggggctcccagcggccaccctctgagtgcggtatcgtttgcctatgcggccggggctgggcagctgcgtgccgccgtcaatcttgccgagcggtgcgagcagagactggctctgcgctgcgggacagcaagacggcccgatagcagagatggcacacctttgagctggtgggtaggtaggacaaacgaaacgcatacatcatgggggggaagtttgccagacgcccagaaatgcacctgtggacttgagggtaattgtatcgactctcagtactattgtaattgcgacgcaggacagaacgaatggacatctgacactattgtgcttagtcaaaaggaacatctccccgttacgcaaattgttatgacagatactggccagccgcactccgaagcagactatacgctcggacccctgctgtgcaggggggataaatccttctggaacagcgcctctttcaacactgaaacttcatacttacattttccagctttccatggggagttgaccgctgatgtgtgctttttctttaaaaccaccgtttctagcggggtgtttatggagaacctgggtatcacggatttcatcagaatcgaactccgggctcctaccgaagtgacattttcttttgatgtcgggaatggtccatgcgaagtgacagtacaatctcccacccctttcaatgacaatcagtggcatcacgtgcgggctgagagaaacgtcaagggggcctctttgcaagtcgaccaactgccacaaaagatgcagcctgcacccgccgatggtcatgtaagattacagctaaattctcagttattcattggcgggactgccactcggcagcgcggcttcctggggtgcatccgatcactacaactgaacggcgtcgctctagatcttgaagaacgtgcgactgtaacacccggcgttgaacccgggtgcgcagggcattgcagcacatatggtcacctatgccgtaatggcggccggtgccgtgagaaacgaagaggagtgacgtgcgattgtgccttttccgcttacgacgggccattctgctccaacgaaattagcgcatacttcgcgaccggcagttctatgacctaccacttccaggagcactacaccctgtccgagaacagctcaagcctggtgagttccctgtaccgtgatgtgaccctgacccgagagatgattacactttcttttcgcaccactcgtagcccttccttgctgctctacgtgtcatctttttatgaggagtacctgtccgtcatcctcgccaataacgggagcctgcaaattcgctacaagctcgaccggcaccaaaaccctgacgcctttacttttgattttaagaatatggctgatggccagctccatcaggttaaaattaatcgggaggaggccgtggttatggtggaggtgaatcaatctgccaagaagcaagtgatcctttcctctggcacagagttcaatgcagtgaaatccttgatcctggggaaggttctggaggcagcaggcgctgacccagacactcgtagagcagccacatctggttttacaggctgtctctccgctgttcgcttcgggcgagccgcaccgttgaaagcagccctgcgtcccagcggaccctcacgcgtcaccgtgaggggccatgtagcccctatggccagatgtgccgcgggagctgcttccggttcccccgccagggagctcgctcctaggctcgccggcggggcaggacgctccggaccagtcgacgagggagagcctctagtaaacgccgacagacgggatagcgctgttatggggggagtgatcgccgtagttatcttcatcttgctctgtataaccgcaatagccatccggatttatcagcagcgaaaacttcggaaagaaaatgagtctaaagtcagcaagaaggaggagtgctag

SEQ ID NO: 25636 - DNA, 1803 bp, Artificial Sequence
  Description of Artificial Sequence: Synthetic coding sequence
atggcatctgttgcctgggccgtcctgaaggtattactcttgctcccaacacagacatggagtcccgtaggtgccggcaaccctccagattgtgactcaccacttgccagtgcccttccaagatctagctttagctcatctagcgagctctcctcatcgcatggacctggattttctaggctcaatagacgtgatggggcaggtggttggaccccattggtgtccaataagtaccaatggctgcagatagaccttggggagcgcatggaggtgaccgcagtagctacccagggcggctatggatccagcgactgggtgacaagctacttgctgatgttctccgatggggggcgcaattggaaacagtaccgacgggaggagagcatctgggggtttcctggcaataccaacgctgatagcgtcgtgcactatagattgcagcctccattcgaagccagattcctccggttcctcccgcttgcctggaacccccgcggacggatcggcatgcggatcgaagtgtatgggtgcgcctacaagagcgaggtggtttacttcgatgggcagtctgcgctgctgtacactctcgacaaaaagccactgaaacccatccgggatgtgatttcccttaaattcaaggccatgcagagcaatggtatcctgctgcatagggaagggcagcacggtaaccacatcactcttgagctcatcaaagggaagctggtatttttcttaaattcaggtaatgccaaactcccgagtaccattgctcccgtgactctgacactgggaagtctgctggatgaccaacactggcacagcgtgttaatcgagctcctcgacacacaagtcaacttcaccgtagataaacatactcaccacttccaagctaagggagactcttcgaacctggacctcaactttgagattagcttcggcggtatccttagcccgggtcgtagcagggcttttacaaggaagagttttcatgggtgtctggaaaacctttactataatggggtcgatgtgacagagctggccaagaagcacaagccccaaattttaatgatgggcaacgtcagtttctcttgcccacagccgcagacagtgcccgtcactttcctgtccagtcggtcatacctagcgctgccaggcaacagtggggaggataaggtgtccgtcacttttcagttcaggacttggaatcgggccggccatctactgttcggcgagttgcagcggggatccggctctttcgtgctgttcctgaaagacgggaaactgaagcttagtctgttccaagccggtcaatcgcccaggaatgtgacagccggcgccggtctcaatgatggccagtggcactcagtctccttttccgcaaaatggagccatatgaacgtggtagtagatgatgataccgctgtgcagcctttggtggctgtattaattgactcaggtgatacctattactttggagccttgtatgaacaatcatgtgaagctcacaagcacaggggcaatccttctgggctgtactatatcgacgccgacgggtcagggccactcggaccatttctcgtttactgtaatatgacagattccgcctggacagtggtgcgacatggggggcccgatgcagtcaccctcagaggagccccaagtggccacccgctgagtgccgtgagctttgcatatgccgctggggctggccagttgagggcggcagtcaatctggctgaaagatgtgagcagcggttggcactgaggtgcgggaccgcccgtcgcccggactctcggggttag

SEQ ID NO: 25637 - DNA, 3921 bp, Artificial Sequence
  Description of Artificial Sequence: Synthetic coding sequence
atggattctctgcccagactgacctcagtattgactctattattcagtggcctctggcacctgggtcttactgccaccaactataactgtgatgaccctctggcctctctcctgtcacctatggcctttagcagctccagcgacctgacgggcacacactcaccagcccaactgaattggcgcgtcggtaccggcggctggtctcccgccgatagcaacgcccagcagtggctgcagatggacctgggcaaccgagtggagattacagctgtggctacccaaggacgctacggctcaagcgactgggtgaccagttacagtctaatgtttagtgacaccgggaggaattggaaacagtataagcaggaagactccatatggaccttcgcagggaatatgaatgccgatagtgtagtacatcacaaattgcttcattcagtccgggccagattcgtgcggttcgtcccgctggagtggaatccatccggaaagattggaatgcgcgtcgaggtttacggatgcagctataagagcgatgtggccgacttcgatggacgatccagtctcctgtacagatttaatcagaaattaatgagtaccttaaaggacgtcatcagtctgaagtttaagtcaatgcagggtgacggggttctgttccacggcgagggacagcggggagatcacatcactctggagctgcagaaaggccgcctggcgctccacttgaaccttggcgacagcaaagctaggttgagctcaagtctgccgtccgcaaccttggggtcccttctcgacgaccagcactggcacagcgtactcattgaaagggtgggcaaacaggtgaatttcactgtggataaacatacgcagcacttccggactaagggcgagactgacgctttggacattgattatgaactttcatttgggggtatccctgtgcctgggaaacctgggacctttttgaagaaaaactttcacggctgtatcgaaaacttgtattacaatggcgtaaatataattgacctagcaaagcgtcgtaagcaccagatctacactggcaacgtaaccttttcatgcagcgagcctcagatagtccccatcacatttgttaattcgtctgggagttacctgctgctgcccggtactccccagattgacggactgtccgtcagcttccagttcaggacatggaataaagatgggctgttactctcaacagagctcagtgagggcagcggcactctgctcctgagtctggaaggaggtattctgagactggtaatacagaagatgactgaacgcgtggccgaaattcttacaggctccaacctaaatgatggattgtggcattccgtgtcgattaacgccaggcggaaccgtatcactctcacgctggacgacgaagctgcgccccctgcgccagacagtacctgggtacagatatactccgggaattcctactattttggcgggtgcccggacaatctgactgatagtcagtgcctcaatccaattaaagctttccaaggctgcatgcgactgatatttattgataatcagcctaaagatctcatcagcgttcagcagggaagtttggggaatttctccgacttacacatcgacctttgctcaatcaaggatcggtgcctccccaactactgcgaacacggcggctcctgttctcagagctggactaccttttactgcaattgctctgacacgtcctacaccggtgccacctgccacaacagcatttacgaacaatcctgcgaggtttacagacaccaggggaacactgccggcttcttttatattgatagcgacgggtctggaccattgggcccgttgcaggtatactgcaacatcacggaagacaagatctggacctcagtgcagcataacaataccgaactcacaagggtgagaggcgcaaaccctgagaaaccatatgcaatggcactggactacggcggctccatggaacaactcgaggctgtgattgatggtagtgagcactgcgagcaagaagttgcatatcattgtagacggtcgaggcttcttaatacgccagatggcaccccgttcacttggtggatcggcagaagcaatgagcggcacccttattgggggggcagccccccgggggttcagcagtgcgaatgcggactcgatgaatcttgcctcgatattcagcatttttgtaattgcgatgccgataaagatgagtggacgaacgataccggatttctttcattcaaagatcacctgccagtgactcagattgtcattaccgacacagatagatccaatagtgaggctgcttggcgcattggtccccttagatgctatggagaccgacggttttggaacgcggtgagcttctatacagaagcctcttacctccacttccccacattccacgccgagttcagcgcagatatttcattcttcttcaaaaccacggcactgagcggcgtcttcctggaaaatctcggcattaaagactttattcgactggagatatcaagtccgtcggaaattacatttgccatcgatgtgggcaacggccccgtagaactagtggtgcaaagtcctagtttactgaacgataatcagtggcactacgtgcgtgctgaacgtaacctcaaggagacaagccttcaggtggataaccttcctcgctcaacaagggaaacttctgaggaggggcacttccgtctccagcttaattcccaactgttcgttggtgggacgagcagccgacagaagggattcttgggatgtattcgatcacttcatctgaacgggcaaaaaatggacctggaggagagagccaaggtcacaagtggggtgcggcctggatgtcctggtcactgcagttcttacgggagcatttgtcacaatggcgggaaatgtgttgaaaaacacaacggatacttgtgtgactgtaccaacagcccgtacgaagggcccttttgcaagaaggaagtttcagctgtttttgaggcaggtacttccgtaacgtacatgtttcaggagccgtaccccgtgacaaaaaacatctccctttcttcttccgctatttatactgacagcgcacccagcaaggagaacatagcgctatcttttgtcactacacaggccccgtctctcttgttatttatcaactcaagcagtcaagacttcgtggtggtgttgctgtgtaagaatgggtcattgcaagttcgatatcacctgaataaggaggaaacccatgttttcaccattgacgccgacaatttcgctaacaggcgaatgcaccatttgaaaatcaatcgtgaagggcgcgagctgaccatccagatggatcagcagctccggctttcctacaacttctcgccagaagttgaattccgagtcatccgatcactgactctgggcaaggtgactgagaacctcggcctagactcagaagtggctaaggccaatgccatgggcttcgccggctgcatgtcctccgttcagtataatcacatagcgccactcaaagcagctctgagacatgccaccgtcgccccagtcacagtgcacggtaccctgacagaaagttcatgcgggttcatggtggacagtgacgtgaatgcagtcacaaccgttcattcctcttctgacccttttgggaagactgacgagagggagcccctcacaaacgcagtgaggtcggactcggcagtgatcgggggcgtaatagcagtcgttatatttatcatattttgcatcattggcatcatgaccaggtttctatatcagcacaaacagtctcacagaacatcccagatgaaggaaaaagagtatcccgaaaacttagacagctcttttagaaacgaaattgatttacagaacaccgtatcggaatgcaaacgtgagtatttcatttag

SEQ ID NO: 25638 - DNA, 3129 bp, Artificial Sequence
  Description of Artificial Sequence: Synthetic coding sequence
atgaagcaatctcccgcactcgcccctgaagagaggtgtaggagagctgggtcaccaaagccagtcctcagagcagatgacaacaacatgggcaatggctgcagccagaagctggccacagctaatctgctcaggtttcttctactcgtgcttataccgtgcatatgtgctttagtcctactattagtcatattactgtcatatgttggaaccctccaaaaagtgtatttcaagtctaatggcagcgagcctttggtgaccgacggcgaaatccagggctctgatgtcattctgaccaacacaatctataatcaaagcaccgttgtgtctaccgctcaccccgaccagcatgtccccgcgtggacaaccgacgcttctcttccgggcgatcagtcccacaggaacacctccgcctgcatgaatattacccactcacaatgtcagatgcttccttaccacgcaacccttactccgctgctgagcgtggtgaggaatatggaaatggagaagtttctgaagttttttacctacctgcatcgcctttcttgctatcagcatattatgttgttcgggtgtaccttagccttcccagagtgcatcatcgacggagatgatagtcacgggttactgccgtgtcggagtttttgcgaggctgctaaggagggttgcgagagcgttctgggcatggtgaactactcctggccagatttccttcgatgtagccagtttcgaaaccaaacagaatctagtaacgtgtcaaggatctgtttctccccccaacaggagaacgggaagcaactactctgtggacgtggcgagaacttcttgtgtgcctctgggatttgtatccccggcaaacttcagtgtaatggttacaacgattgtgatgactggagcgacgaggctcactgtaactgttctgagaatctattccactgtcatactggtaagtgcctgaattactcacttgtgtgcgacggatatgacgattgcggagatctttccgacgaacagaactgtgattgcaaccccacaaccgagcacaggtgtggcgacggcaggtgtattgcaatggagtgggtgtgtgacggcgatcatgattgcgtcgataaatcagatgaagtgaattgttcctgtcatagtcaggggctggtggagtgccgcaacgggcaatgtatccctagcacgttccagtgtgatggggacgaggactgcaaagatggcagcgatgaggagaactgtagtgtgatacagaccagttgccaggagggtgatcagaggtgcctctacaacccctgtctggatagttgtggcggctcctctctatgcgacccaaataattccctcaacaactgtagccagtgcgagccaatcacccttgaactgtgtatgaatctaccttataattctaccagttacccaaattacttcgggcaccgcactcagaaggaggcaagtatcagttgggaaagctctctgtttccagcactggtccagactaattgttataagtacctcatgttctttagctgtacaattttagtaccaaagtgcgacgtcaatactggagagcacattcccccatgccgggcactttgtgagcatagcaaagagcggtgtgaaagcgtgctgggtatagtgggcctgcagtggccagaagacacagactgtagtcagttccccgaagaaaactccgacaatcaaacctgtttaatgcctgatgagtacgtcgaagagtgcagtccctctcactttaaatgcaggtctgggcagtgcgtgcttgcctccagacgttgcgacgggcaagcagattgtgacgatgatagcgacgaagaaaactgcggatgtaaggagagagatctctgggagtgccccagtaacaagcagtgccttaagcacacagttatatgcgacggcttccctgattgccccgactacatggacgaaaaaaattgttccttctgtcaggacgatgagctcgagtgtgcaaatcatgcctgtgtgtcgcgcgacctgtggtgtgacggggaggcagactgctctgactcctctgatgaatgggactgtgtcactctatccatcaatgtaaatagtagctctttcctgatggtccatagggcagctacggaacatcacgtatgtgctgacggatggcaggaaatactttctcagcttgcttgtaaacagatgggactcggggaaccatccgttaccaaactcattcaggagcaagagaaagaaccccgctggctaacgcttcattctaactgggagtctctgaacggaacaaccctgcatgaattgctggtgaatggtcagagttgtgagtctagatctaagatttcacttctctgcacaaaacaagactgtggtcgcagacctgctgcgaggatgaataaaagaatactcggtggcagaacatctagacccggacggtggccctggcagtgcagcctgcagagtgagccatccggacatatctgtgggtgcgtcttgatcgctaagaagtgggtacttactgtggcacactgcttcgagggtcgagagaacgctgcggtctggaaggtcgtcctcggtataaacaatttggaccacccctccgtgtttatgcagacccgcttcgttaagactattattttgcacccacgatatagcagagcagtagtggattatgacatctccatagtggaactgtcagaagacatttcagaaacgggttatgtgcggcccgtctgtcttcccaatcctgagcagtggctggaacctgatacctattgctacattaccgggtggggtcacatgggcaataagatgccgttcaagttacaggaaggtgaagtccggatcatatccttagagcactgccaaagttacttcgacatgaagaccatcaccactcggatgatctgcgcgggttacgaaagtgggacagtcgactcttgcatgggagattctggcggtccacttgtgtgcgagaaacctggaggtcggtggacccttttcggcctcactagctgggggtctgtgtgtttctctaaagtgctcggacctggcgtttatagtaatgtcagttacttcgttgagtggattaagcgccagatctatattcagaccttcctgctaaactag

SEQ ID NO: 25639 - DNA, 2928 bp, Artificial Sequence
  Description of Artificial Sequence: Synthetic coding sequence
atgaaacagtctcctgcattggcacccgaggagcggtgtagacgagccggatcaccaaaacccgtcttacgagctgacgataacaatatggggaacggatgcagtcagaaactggccaccgctaatttgctgaggtttctcctactcgtactgatcccctgcatctgtgcccttgtgcttctactcgtgatcttgctgtcgtacgtgggagcctgtatgaacatcacccactcccaatgtcagatgcttccttatcacgctacactgacccccctgcttagcgtcgtacgtaatatggaaatggaaaaattccttaaattctttacttacctgcacaggctatcttgttatcaacacatcatgttattcggttgcacactggcctttccagagtgcattattgacggcgatgatagccacggtcttctgccctgtcgatctttttgcgaggccgcgaaagaaggttgtgagagcgtgctaggcatggtgaactactcatggccagactttttgcggtgcagtcagtttcggaaccagaccgagtcatctaacgtctcccgcatctgctttagcccacagcaggagaacggaaagcagcttctgtgtggcaggggagaaaactttctgtgtgcaagcggcatttgtattcccggcaagctgcagtgtaatgggtataatgactgtgacgactggtctgacgaagcccattgtaactgcagcgagaatttatttcattgccacacaggcaagtgtctaaactattccctggtttgcgacggttacgacgactgcggggatttgtcagacgagcagaactgcgactgcaaccccaccaccgagcatcggtgtggtgatgggcgctgtatcgcaatggagtgggtttgcgatggcgaccatgactgtgttgacaagagcgacgaggttaactgctcttgtcactcccagggcctggtggaatgtagaaacgggcagtgcattccaagtacattccaatgtgatggagacgaagactgtaaagacggcagtgacgaggaaaattgctcagtgatacagacctcgtgtcaagagggtgaccagcgatgcctgtataacccttgcttggatagttgtggcggttcatccttgtgcgacccaaacaattctttgaataattgcagtcagtgcgaacccattaccctggagttatgcatgaacttaccatataactctacctcctacccaaactatttcggacaccgaacacagaaagaggcctccattagctgggaatctagcctgttcccggccctggtccagacaaactgctacaaatacctcatgttttttagctgcaccattctggtgcctaaatgcgacgttaacaccggagagcacatcccaccttgcagggcactttgtgagcactcgaaagaaaggtgcgagtctgtgctgggcattgtcggactccagtggcccgaggatactgactgttcacagtttcccgaggagaattctgacaaccagacctgcctcatgcctgacgagtacgtggaagagtgctcgccatcccacttcaagtgcaggtccgggcagtgtgtattagcttcaagaaggtgcgacggccaggcggactgtgatgatgattccgatgaagagaactgcggttgcaaggaacgtgacctctgggagtgcccatctaataagcaatgtcttaagcacacagtcatctgcgatggatttccagactgccccgattatatggacgaaaaaaactgcagcttctgtcaggacgacgagctggagtgcgccaaccacgcttgtgttagtagagatctgtggtgcgacggggaggccgactgctctgacagcagcgacgaatgggactgcgttaccttgagcatcaatgtgaatagttcctcttttctgatggtgcatcgagctgccactgaacaccatgtatgcgccgacgggtggcaagagatcctgtctcagctggcttgtaagcagatgggcttgggggagccatcggtaacgaaactaatccaggaacaagaaaaagagcctcggtggctcactctgcactccaactgggaatccctgaacggcacaaccctgcatgagctactcgtcaatggccagagctgcgagtccaggtctaagatcagtctcctttgtactaaacaggattgtggacggagacccgctgccagaatgaacaaacgcatcctcggaggacgaacctcacggcccggcagatggccatggcagtgctccctgcagtccgagccatcaggtcacatctgcgggtgcgtgttgattgctaaaaaatgggtgctgaccgttgctcactgtttcgagggccgggaaaatgcagccgtgtggaaagtcgtgcttggcatcaacaacctcgatcatcctagcgtcttcatgcaaacccgcttcgtgaagactataatcctgcacccaagatactccagagctgtggtggattacgacattagcattgtggagcttagtgaggatatctcggaaaccggctacgtgcggcccgtgtgcctccctaaccctgagcagtggctcgagcccgacacttactgttacattactgggtggggacatatgggtaataagatgcctttcaagctgcaggagggagaagtgcgtataatttctctggagcactgccagagttatttcgacatgaagaccatcaccaccaggatgatttgtgctggatatgagagcggcaccgtagatagttgtatgggggacagcggtggccccctcgtgtgcgagaagccgggaggccggtggactctctttgggctgacctcttggggttccgtgtgtttcagtaaggtgctgggtcccggagtttactctaacgtcagttatttcgtcgaatggataaagcgccaaatttatatccagaccttcttgctcaattag

SEQ ID NO: 25640 - DNA, 3018 bp, Artificial Sequence
  Description of Artificial Sequence: Synthetic coding sequence
atgaagcagagccccgcactggccccagaggaacgttgtagaagagccgggagcccaaaaccggtccttcgggcagacgacaataacatggggaacggttgcagccagaagctcgcgactgctaatcttctaaggtttctccttctcgtgttaataccatgtatctgcgcactggtgttgctcttagtgattctactgtcttatgttggaacactccaaaaggtgtactttaaatcgaatgggagcgagcccctggtgaccgacggcgaaattcagggttctgacgtgatcctgacaaatactatctacaatcagtcaaccgtggtgagtactgcccatccagatcagcatgttccagcatggactaccgacgcgagtcttcccggagaccaatctcaccgtaatacctctgcttgcatgaatattacccacagccagtgccagatgttgccttaccacgctaccctgacacccttactcagcgtcgtgcggaacatggagatggagaagtttctcaagttctttacctacctgcaccgcctatcctgctatcagcatattatgttattcggctgtaccctggcatttcccgaatgtatcattgacggcgacgacagtcacggactactcccctgtcgctccttctgcgaagccgccaaggaaggctgtgaaagcgtgctgggtatggtgaactactcctggccagatttccttcgatgtagccagtttaggaatcaaacagaatcctcgaacgtcagccggatttgtttttccccacagcaggagaatggtaaacagttactatgtgggaggggagagaacttcctgtgtgcttctggcatctgcattcccgggaaactgcagtgcaacggttacaatgattgtgatgactggagcgacgaggctcactgcaattgttccgagaacctattccattgccataccgggaaatgtttaaattatagcctcgtgtgtgatggatacgatgattgcggcgatctcagtgacgaacagaactgcgcttgtcactctcagggtctggtggagtgcagaaatggtcagtgtattccctctaccttccagtgtgatggagacgaagactgcaaggatggctctgacgaggaaaattgttccgtcatacagacttcctgtcaggaaggcgaccaacgatgtctgtacaacccttgcttagactcctgtgggggctccagcttatgtgatcccaacaattcactgaacaactgttcccagtgcgagcccatcaccctggagctgtgtatgaatttaccttataacagcaccagttaccctaactatttcggccatcgaacccagaaagaagctagcatctcttgggagtcctccttatttccagcgttagtgcaaactaactgttacaaatacctcatgttcttctcgtgcactatcctcgttcctaagtgtgacgttaacaccggagaacacatccctccttgccgggccctttgcgagcattcaaaagaacgctgtgagtcagttttgggaatagtcggactccaatggcccgaagatacagattgttcacagttccctgaggagaactctgacaatcagacctgcttaatgcccgacgagtatgtcgaagaatgtagtcccagtcattttaagtgccggtcagggcagtgcgtgcttgcctcccgccgatgtgacggtcaggcagactgtgatgacgactctgatgaggagaattgcggatgtaaagaaagggacctgtgggagtgcccgtctaacaaacaatgcctaaaacatactgttatctgcgacggttttcccgattgtcctgactacatggatgaaaagaactgttcgttctgccaggatgacgagctcgagtgtgccaaccacgcctgtgtttcgagggatctgtggtgtgacggagaggcagattgctcggatagttccgatgagtgggactgtgttaccctcagcataaacgtgaacagcagctccttcttgatggttcaccgtgcggctaccgagcatcacgtgtgcgcagatggctggcaggagatactcagccagctggcgtgcaagcagatggggctcggcgagccctccgtaaccaaactcatacaggaacaagagaaggagccacgctggcttacattgcacagcaactgggagtctctcaatggcaccacgctacacgaactgctggtcaatgggcagtcttgtgaatcaagaagcaagatttccctcctgtgtaccaagcaagactgtggaaggcgacccgctgctcggatgaataagaggatactcggaggccgcacttcccggcctgggcgctggccctggcagtgtagcctccagtcggaaccaagtggccacatctgcgggtgcgtgctaatcgcaaagaagtgggtgcttaccgttgcccactgtttcgaaggtcgggaaaacgccgcggtatggaaagtggtgctcggcatcaacaatctagatcaccccagtgtgtttatgcagaccagatttgttaagacaatcatcctgcaccctagatacagtcgtgccgtggtggattacgacatctctatcgttgagctgtcagaggatatcagcgagacaggctacgtgaggcccgtttgtctccctaaccctgaacagtggctggagcctgatacttattgttatattaccggttgggggcatatggggaacaaaatgccctttaaactgcaggagggcgaggtgcgaattatctctctggagcattgccaatcgtacttcgatatgaaaaccataactacccggatgatctgcgccggctacgagtccggtaccgtcgactcgtgtatgggtgattctgggggcccacttgtgtgtgagaagccagggggacgctggacactgttcggcctgactagctgggggtctgtgtgcttctcaaaggtactgggtccgggggtgtatagcaatgtctcttacttcgttgaatggattaagcgacagatttatatccaaacattcctgctcaattag

SEQ ID NO: 25641 - DNA, 555 bp, Artificial Sequence
  Description of Artificial Sequence: Synthetic coding sequence
atgaaacccgatgagactccaatgtttgatccatccctgctgaaggaagtcgattggagtcaaaacactgccactttttcccctgctatcagccctacccatccaggagagggtcttgtcctgcggcctttgtgcaccgccgaccttaaccgtggattctttaaggtcttagggcagctgacagaaaccggggttgtgagtccagagcaattcatgaagtcatttgagcatatgaagaaatccggcgattactatgtaaccgtcgtggaggacgtaacactgggccagattgttgcaactgccacactgataatcgagcataaattcatccattcttgcgcaaagcggggccgcgtagaagacgtcgtggtgtccgatgagtgcaggggcaaacagctcgggaaactgctgctttcgactctcaccttactatcaaaaaagcttaactgctacaagattacgctagaatgtctgcctcaaaatgtgggattctataagaaattcggatacacagtttccgaagaaaattacatgtgtagaagattcctcaaatag

SEQ ID NO: 25642 - DNA, 291 bp, Artificial Sequence
  Description of Artificial Sequence: Synthetic coding sequence
atggcttttacttttgccgccttttgttatatgcttgctctgctgctgaccgctgctctgatcttcttcgctatctggcacatcattgctttcgatgagctgaagaccgactataagaatcccatcgaccagtgtaatactcttaaccccctggtcctgccggagtacctcattcacgcgtttttctgtgtgatgtttctctgcgcagctgaatggctgacgctcggtctaaatatgcctttactggcataccacatatggtccatgatctacgtcctggtgtcttcttag

SEQ ID NO: 25643 - DNA, 483 bp, Artificial Sequence
  Description of Artificial Sequence: Synthetic coding sequence
atggcgtttacattcgccgccttctgttacatgctgactcttgtgctgtgcgctagcctcattttttttgttatctggcacataatagcttttgatgaactccgtactgacttcaagaatcctatagatcaagggaaccccgcccgcgcccgcgagaggctcaaaaacatcgaacgtatctgctgccttttacgcaaactcgtggtgcccgagtactcgatccatggcctgttctgcctgatgttcctctgcgccgctgagtgggttaccctggggctcaacattcccctcctgttttatcatctgtggcgctactttcatcggccagccgatggaagtgaggtgatgtacgacgctgtgtcaatcatgaatgctgatatactgaattactgtcagaaagaaagctggtgtaagctggccttctacctgctctcatttttttattatctctacagtatggtgtatactctggtttctttctag

SEQ ID NO: 25644 - DNA, 483 bp, Artificial Sequence
  Description of Artificial Sequence: Synthetic coding sequence
atggcattcacctttgccgctttctgttatatgctttctctggtactctgtgcagccttgatcttcttcgctatatggcacattatcgcatttgacgaactgcggaccgattttaaatccccaatcgaccagtgcaatccggtacacgccagggagcgcctcagaaatatcgagaggatttgcttccttctgaggaagctcgtcctgcctgagtatagtatccacagtctattctgcatcatgttcctgtgtgctcaggagtggctcactcttggcttgaacgtccctttgcttttttaccacttttggaggtattttcactgccctgcagacagcagtgaactcgcttacgacccacctgtagtgatgaatgcggacaccctgtcttattgtcaaaaggaagcatggtgtaagttggcattttatctccttagcttcttttattacctatattgcatgatttatacactcgtgtcaagttag

SEQ ID NO: 25645 - DNA, 414 bp, Artificial Sequence
  Description of Artificial Sequence: Synthetic coding sequence
atggaagcggtagtgttcgtcttctctttgttggattgctgcgcgttaatcttccttagcgtgtacttcataataactctctcagacctggagtgcgactacatcaacgcacggtcatgttgcagcaaactgaataagtgggtgatccctgaactgattgggcataccatagtgactgtcctgctacttatgtcgctgcactggttcattttcttgttgaacctccccgtcgctacatggaatatctaccgctatatcatggtaccttcgggtaacatgggtgtgttcgaccctacagaaattcacaatcgtggacaattgaagtctcatatgaaggaggccatgataaagttaggcttccaccttctgtgcttttttatgtacctgtatagcgggtcaaattgtccctgttag

SEQ ID NO: 25646 - DNA, 279 bp, Artificial Sequence
  Description of Artificial Sequence: Synthetic coding sequence
atggaggctgtggtgtttgtgttctccctgttagactgctgcgctcttattttcctgtctgtttattttattatcaccctgtcggacctggagtgcgactacattaatgcaagaagttgctgctctaagctgaacaaatgggtgatccctgagctaattggccacacaattgtgacagtgctccttcttatgtccttacattggttcatttttctgctcaatctgccggtggctacatggaacatttaccgcatgatcctggccctaatcaacgattag

SEQ ID NO: 25647 - DNA, 273 bp, Artificial Sequence
  Description of Artificial Sequence: Synthetic coding sequence
atggaggcagtggttttcgtgttctcgcttttggattgctgtgccctaatcttcctgtctgtgtactttataataacactatccgatctggagtgtgactacatcaatgcaaggagctgctgcagtaagcttaacaaatgggtgatccctgaactcattggacatactatcgttactgtgttgctcctcatgtcactgcactggttcatattcctcctgaacctgcccgttgccacctggaacatctaccgggggagtaactgtccctgctag

SEQ ID NO: 25648 - DNA, 420 bp, Artificial Sequence
  Description of Artificial Sequence: Synthetic coding sequence
atggaggcagtcgtttttgtgtttagcctactcgattgctgtgctctgatctttctaagcgtgtacttcattataactttgtccgacctggaatgtgattatatcaatgcaaggtcatgctgtagcaagttaaacaagtgggttattcccgagctcatcggacacaccatcgtgacagtgctcttattgatgtcactacattggttcatctttttgctaaatcttcctgtggccacctggaatatctaccgatacatcatggtgccatcaggaaatatgggcgtttttgatcccaccgagattcacaaccgcggtcagttgaaatctcacatgaaagaagccatgatcaagctcggatttcacctgctgtgtttcttcatgtatctgtattctatgatcctcgccttaatcaatgactag

SEQ ID NO: 25649 - DNA, 246 bp, Artificial Sequence
  Description of Artificial Sequence: Synthetic coding sequence
atggacggcggccaacctattccaagctcactcgtaccactgggcaacgagtcagccgactctagcatgagtctggaacagaaaatgacattcgtctttgtgatccttctgttcatctttctcggcatcttaattgtacgctgctttcggattttactggacccgtatcgctcaatgcccaccagtacttgggccgatggtctagagggtctggagaaaggccagttcgaccacgctctcgcgtag

SEQ ID NO: 25650 - DNA, 246 bp, Artificial Sequence
  Description of Artificial Sequence: Synthetic coding sequence
atggatggaggccaacctattcccagttcactggtaccccttggcaacgagtccgcagatagttccatgagcctggagcagaagatgacgtttgtatttgtcatcttgctgttcatcttcctcggtatcctaatcgtgaggtgcttccggattctcttggacccataccggagcatgcccactagcacctgggccgacgggctcgaggggttggagaaagggcagtttgaccatgccctggcctag

SEQ ID NO: 25651 - DNA, 114 bp, Artificial Sequence
  Description of Artificial Sequence: Synthetic coding sequence
gtgtatacagactacatctatttcaattcttttttggaatcattccaggggttcttcgtgagcgtgttctactgcttccttaacagcgaggtgagatcggccatcagaaagtag

SEQ ID NO: 25652 - DNA, 723 bp, Artificial Sequence
  Description of Artificial Sequence: Synthetic coding sequence
atgtctcccgaagtgcatcaaagtaatgtggggtggtgccgattggtcacggccgcatataattattttcacgtgaccaatttcttttggatgttcggtgagggttgttacttgcacactgccattgtcctcacctactctaccgaccgtctgcgaaagtggatgtttatctgcataggctggggtgtaccatttccaatcatcgtggcatgggctattggaaagctgtactacgacaacgaaaagtgttggttcggaaagcggcccggcgtctataccgactacatctatcagggcccgatgattctggtgctgctgatcaatttcattttcctgttcaatattgtccggatccttatgaccaagctcagagctagcactacctcagaaacaatacagtatcggaaagctgttaaggccaccctcgttttgttgccgctcctgggtattacatatatgttattcttcgtgaaccccggggaggacgaagtctcccgagtggtgtttatatactttaattcctttctggagagcttccagggcttttttgtatccgtgttctactgcttcttaaatagcgaggtacgatccgccatcagaaaacggtggcacagatggcaggataaacactctatccgcgcccgggtcgccagagctatgagtattcccaccagcccaacaagggtgtctttccattcaatcaaacagtccacagcggtgtag

SEQ ID NO: 25653 - DNA, 1206 bp, Artificial Sequence
  Description of Artificial Sequence: Synthetic coding sequence
atggggggtcaccctcagctgcgcctggtgaaggcacttctactgcttggcctgaacccggtttccgcttctttacaagaccagcactgcgagtccctgtccctggcctcaaacataagtggtttacaatgcaacgcttcggttgatctgattggcacctgctggcctaggagtcccgctgggcaattggttgtgaggccttgccccgccttcttttacggcgtgaggtacaatacaacgaataacggctatcgagagtgtttggctaacgggagctgggcagctcgcgttaattactctgagtgtcaggaaattctcaacgaggaaaagaagagtaaggtgcactaccatgtggcagtcattattaactatctgggacattgcatcagcctggtggcgctgttggtggctttcgtcctgtttcttcgcttaagaagcattcggtgcttacgcaacataatccactggaatctcatttccgccttcatccttcgcaacgccacttggttcgtggttcagctaacaatgtcccctgaagtgcaccagtccaacgtcgggtggtgccgtttagtgacagccgcttacaattattttcacgtaaccaactttttttggatgttcggcgagggctgttatctacacacagcgatcgtgcttacatatagcactgaccgcctgcgtaagtggatgttcatttgtatcggctggggcgttccgttccccatcattgtggcttgggccatcggcaagttgtactacgataacgaaaagtgttggttcggcaagagaccaggcgtgtatactgactatatttatcaggggcctatgatcttagtccttttaatcaattttattttcctgttcaacatagtgcgcattctcatgacgaaactccgagcttctaccacatcagagactattcagtatcgcaaggccgtgaaagcgaccctggtattgcttcctttgctcgggattacttatatgctcttcttcgtcaaccccggcgaagacgaagtatctcgtgttgtctttatctactttaacagctttctcgaaagtttccaggtgcggtccgctatcagaaaacggtggcacagatggcaggacaagcacagtattcgggcaagagtcgcaagagccatgtcaatccctacctcaccaacacgcgtgtcttttcatagcattaaacaatcaacagccgtgtag

SEQ ID NO: 25654 - DNA, 1128 bp, Artificial Sequence
  Description of Artificial Sequence: Synthetic coding sequence
atgggaggacatccgcagctcagactggtgaaggctctgctgctcctcggactcaaccccgtgtcagcctccctgcaggatcagcattgcgaaagcctttccctggcttccaatatctccgataacggctatagggagtgtctagccaacgggtcctgggccgcacgggtgaattatagcgaatgccaagaaatattaaatgaggaaaaaaaaagtaaggtacactaccacgtggccgtcatcatcaactatctgggccattgtatctcccttgtggcgctactcgtggcctttgtcctgtttctccggttgaggtcaataaggtgcttgcgcaacatcattcactggaacttaataagcgcgttcatcttgcgcaacgcaacatggttcgtagtgcagctgaccatgagtccggaggtgcatcaatcaaacgtgggatggtgccgcctggtgactgccgcttataactactttcacgtgactaatttcttttggatgttcggcgaagggtgttaccttcacaccgcaatcgtgcttacctactccacggatcgacttaggaaatggatgttcatttgcatagggtggggtgtgccatttccaattattgtggcatgggctattggaaaactctactatgataatgaaaagtgctggttcggcaagcgccccggtgtgtacaccgactacatctaccaggggccaatgatcctcgtcttactaattaactttattttcctgttcaacatcgtgaggatcttaatgacaaagctgcgcgcctctacaacatccgaaacaattcagtatcgcaaagctgtaaaagcgaccctggtactcctccccctgttgggtatcacatatatgcttttctttgtgaacccaggggaagatgaggtgtccagagtagtgttcatctactttaactcctttctagaatctttccaagggttctttgtctcagtcttctattgcttcctgaatagcgaggtgcggtctgccatccggaagagatggcacaggtggcaggataaacatagcattagggcgcgggttgcgagggctatgtcaatcccaacgtccccaaccagagttagctttcacagcatcaaacagtccaccgcggtgtag

SEQ ID NO: 25655 - DNA, 378 bp, Artificial Sequence
  Description of Artificial Sequence: Synthetic coding sequence
atgggcggtcaccctcagctgcggctagtcaaggccctgttgctcctcgggttaaatcccgtgtccgcctccttacaggaccagcactgcgagtcactctccctcgcatccaatatatcagggctacagtgcaacgcaagtgtggatctgatcgggacttgttggccacgatctcccgcaggccagctcgtggtgcggccatgtcccgccttcttttacggagtacggtataatacaaccaataacgggtatcgagagtgcctggccaatgggtcttgggccgcgagagtgaattactcagaatgccaagaaatccttaacgaagaggagcctgggacccaggcacagcctggacgagcccacaggggggggacctag

SEQ ID NO: 25656 - DNA, 1248 bp, Artificial Sequence
  Description of Artificial Sequence: Synthetic coding sequence
atgggagggcacccacaattaagactggtgaaggcgctgcttttgttgggccttaacccagtgagcgccagcctgcaagatcagcattgtgagtctttgtccctggcctccaatatatcaggcttacaatgtaacgcatccgtggacttgattgggacttgctggccgaggtctcccgcaggccagcttgtcgttcgtccctgtccagcctttttctacggcgtccgttataacaccacaaataacggctatcgcgagtgcctggcaaacggctcttgggccgcgcgcgttaattatagcgaatgtcaggagatactgaacgaagaaaaaaaaagcaaggtacactatcacgtggccgtgatcatcaactatctgggccattgcattagcctggtagcactgctggttgcttttgtactatttctgcggctccgtagcatccgttgcctcagaaacataatccactggaaccttattagcgcctttatcttacgtaatgcaacatggttcgtagtgcagctgaccatgtcaccagaggtgcaccaatccaatgtcggctggtgtcggctcgtcacggctgcgtataactactttcacgttaccaacttcttttggatgttcggagagggttgttatctgcacactgccatcgtactgacgtactctaccgatcgccttagaaagtggatgttcatctgtattggctggggagtcccattccccatcatcgtcgcctgggctataggcaaactgtattatgataatgagaagtgttggtttgggaagaggccgggtgtttataccgactacatctaccaggggcccatgatcctcgtcctcctaattaacttcatatttctttttaatattgtgcgtatcctaatgacaaaactgcgggccagtacgacgtccgagactatccaatacaggaaagcagtgaaggccactctggtgctgctcccactgctggggataacctatatgctcttcttcgtgaaccctggagaagacgaagtgtcccgggtggtcttcatctactttaattcgtttcttgagagcttccagggatttttcgtgtccgtgttctactgcttcctgaactctgaagttcggtcagcaatccggaaaagatggcataggtggcaggacaagcacagcatcagggccagagtggctcgggctatgagtatacccacaagccccaccagggtctcctttcactccattaagcaatctacggctgtatag

SEQ ID NO: 25657 - DNA, 858 bp, Artificial Sequence
  Description of Artificial Sequence: Synthetic coding sequence
atggtgagcgcaaccattcctcagaagaaaagcaaggtgcattaccacgttgctgtgattataaattatctcggacactgcatcagtctagtcgccctattagttgcatttgtgctattcctgcggctaaggagcattagatgcctgagaaacattatacattggaatcttatttccgcgttcatacttcgcaatgctacctggtttgtggtgcaacttaccatgagccctgaagtccaccagtctaatgtaggatggtgcaggctcgtgactgcagcctacaactattttcatgtgacgaatttcttttggatgttcggagagggatgttatctacatactgctatcgttctgacctatagtacagatcgcctacgtaaatggatgttcatctgcattgggtggggcgtccccttcccaattatcgtggcttgggccatcgggaaactctactacgacaatgagaagtgttggttcgggaagaggcccggcgtgtacactgattacatttaccaaggacctatgatcctggttctgctaattaattttatatttcttttcaatattgttcgtatcctaatgacgaaactccgcgccagtacgacatcagagactatccagtaccgggctagtctctgtctctgctctaccgttagcagcatagtgaggtcagttctgcctagcggccgcgggggcaccggaggaagaactagcacgcgatccgtccccgagtggcctgtaccttgcccttcccctcccccacagcctgttagtgcttttacagcgagttcaagccctcagcagtctgagcttgcagggcatggggcagcccccaaacagctatggctgggtggatag

SEQ ID NO: 25658 - DNA, 1335 bp, Artificial Sequence
  Description of Artificial Sequence: Synthetic coding sequence
atggggggccaccctcagctgaggctggtgaaagctttactgctgctcggcttgaatcccgtaagcgctagtctgcaggatcagcattgcgaaagcctcagccttgcctcgaatatttccgggctgcaatgcaacgcatccgtcgatctgatcggcacatgttggccccgcagccctgcgggtcaactagtggtgaggccctgtcccgcttttttctatggtgtacggtacaacaccactaataacggctatcgcgaatgtcttgccaatggctcctgggctgcccgcgtcaattattctgagtgtcaggagatcctcaatgaggagaaaaagtctaaagtccattaccatgttgcggtgatcatcaactatctggggcattgcatcagtttagtggcacttctcgtggcattcgttctcttcctgcggctgaggcccggctgtacgcattggggagatcaggctgacggggcactggaggtgggcgctccctggagcggagctccattccaagtccggaggtcaatacggtgtttgaggaacatcatacactggaatctcatctccgccttcatattgaggaatgcgacatggtttgtggtgcagttgacaatgtcaccagaggttcaccagtctaacgtaggttggtgccggctggtgaccgccgcttacaattattttcatgtgactaattttttctggatgtttggggagggctgctacctgcacactgcgatcgtactcacttactccaccgacagattacgcaagtggatgtttatatgcatcgggtggggcgttccttttcccattattgtcgcgtgggccattggcaagttgtattacgataacgagaaatgttggttcgggaaacgcccgggcgtttacaccgattacatctatcagggacctatgatcttagttttactaatcaactttatattccttttcaatattgtgagaatcttgatgaccaagctaagagctagtactacaagcgaaaccattcagtataggaaggccgtgaaagcaaccctcgttctgctgcccttgttgggcataacctatatgctgttctttgtgaaccctggggaggatgaagtctcccgcgtggtgtttatctattttaatagtttcctggagagctttcaaggattctttgtctccgtgttttactgtttcctgaacagcgaagttcgttctgccatccgcaagcggtggcacaggtggcaagacaaacacagcattagggctcgcgttgctagggcaatgtccatccccactagtcccacacgggttagctttcattctataaagcagtccacagccgtatag

SEQ ID NO: 25659 - DNA, 321 bp, Artificial Sequence
  Description of Artificial Sequence: Synthetic coding sequence
atggccctggatcctgctgaccagcacctgcgtcatgtggagaaggacgtgctgatccccaaaatcatgagagaaaaggcaaaagaaagatgttcggaacaagtgcaggacttcactaagtgctgtaaaaattctggcgtgctgatggtggtcaaatgcaggaaggaaaactcagcactaaaagaatgcctgacagcttactataatgatcccgctttttatgaggagtgtaagatggagtatctcaaggagagggaggaattccggaagacagggatccccacgaaaaagagattgcaaaaacttcctacctctatgtag

SEQ ID NO: 25660 - DNA, 321 bp, Artificial Sequence
  Description of Artificial Sequence: Synthetic coding sequence
atgtttgcccctgccgtgatgagagcattccgtaagaataaaacccttggctatggggttccaatgttacttctgattgtggggggcagcttcggtcttcgggaattctcccagatcaggtacgatgccgtgaagtcaaagatggaccctgagctggaaaagaagctcaaggagaacaagattagtctggaaagcgaatacgagaagataaaggactccaaattcgatgattggaagaacatcagagggccgagaccatgggaggatccggatttgctccagggccgtaatcctgaaagccttaaaaccaaaacgacatag

SEQ ID NO: 25661 - DNA, 1002 bp, Artificial Sequence
  Description of Artificial Sequence: Synthetic coding sequence
atgctttgccgcttaggtggcagatggttaagaccgctgccagcccttcagctgtgggctagggaccttccccttgcacctgtgcccaccagtggggctaagaggccaacactgcccgtatgggccgtggccccagtgtccgccgttcacgctaatggttggtacgaagccctagccgcatccagccctgtgcgcgttgccgaggaggtgctgttgggtgtacacgcagccactggtctgccttggtggggatccatcctcctgagcactgttgccctgcggggcgcagtgaccctgcctctcgccgcctaccagcactacattctggccaaggttgagaatctgcagcctgagatcaaaacaatagcacgccacctcaatcaggaggttgctgtcagagccaatcaactgggttggtctaagcgagatgcccgactcacttaccttaaaaatatgagaaggcttatctcggaactctatgtgagagataattgccacccatttaaggccaccgtgctagtgtggatccaacttccaatgtggatcttcatgagcttcgccctgaggaacctgtctaccggagccgcccactcggagggcttttccgtccaggaacaactggccaccgggggaattctgtggttcccggacctgactgctccagattctacctggatcctgcctatcagcgtaggcgtaattaatctgctaatagtggagatctgtgctcttcaaaagattggaatgagtagattccagacttacatcacctattttgtacgtgcaatgtcagtgctcatgataccaatcgcagctaccgtgccgtcctccatcgttctctattggctgtgtagttcttttgtgggactgtctcagaatctcctgctgcgctccccaggctttcgacagctctgtcgtattccaagcaccaaaagcgattcggagaccccgtacaaagatatcttcgccgcgtttaacaccaagttcatttccaggaagtag

SEQ ID NO: 25662 - DNA, 1005 bp, Artificial Sequence
  Description of Artificial Sequence: Synthetic coding sequence
atgctgtgtcggctgggaggccgctggctgcgcccacttccggcactccagctgtgggcccgagacctaccactggccccagtccccacgtcgggcgctaagagacctacactgccagtgtgggcagtggcaccggtgtcggcagtccacgccaacggatggtatgaagccctcgccgcctcctctcccgtgagggtggccgaggaggtccttttaggcgtacacgctgcgacagggctcccctggtggggcagtatcctcctgtccactgttgcactgaggggagcagttaccctcccactcgccgcttaccagcactatatcctggcgaaggttgagaaccttcaacccgagatcaagacaatcgcgcgtcaccttaatcaggaggttgcagtccgcgccaaccagttaggatggtctaagcgagatgcgcgccttacctatttaaaaaacatgagacgactgatcagcgagctctacgtcagagataactgccatccttttaaagcaactgtactggtgtggatccagcttccgatgtggattttcatgagtttcgctttgcggaatctgagcaccggagcggcacactcagaggctggattttccgtccaggagcagctggctactggtgggatcctctggtttcccgaccttactgcacctgatagcacgtggattttaccaatttctgtgggggtgattaacctgctaattgtggagatttgcgctttgcaaaagatcggtatgagcaggtttcagacttatatcacttacttcgtgagggccatgtccgtgttgatgattccgatcgcagcgacagttcctagtagcatcgtgctgtactggctgtgctccagctttgtgggcctgagccaaaacctgttattacgctctcctgggttccggcagttatgcaggatccccagcaccaaaagcgacagcgaaactccgtataaagatatcttcgccgcgtttaacacaaagttcataagccgcaaatag

SEQ ID NO: 25663 - DNA, 2334 bp, Artificial Sequence
  Description of Artificial Sequence: Synthetic coding sequence
atggaggagccaggcgcaacccctcagccatacctcggcctggtgctggaggagcttcgaagagtggttgcagccctgcctgagtcgatgcgaccagatgaaaatccctacggattcccctccgaattggtcgtgtgtgcagctgttatcggatttttcgtggtcctgttatttttgtggcgctccttccggtcagtccgcagcaggctgtacgttgggcgcgagcagaaactgggagcgacattgtccggtcttatagaagaaaagtgtaaactactggaaaaatttagcctgatccagaaagagtacgagggctacgaggtggaaagttcacttgaggatgcttcgttcgagaaggcagctgctgaagaggcaagatcgctcgaggcgacttgcgaaaagcttaaccgtagtaatagcgagctagaggacgaaattctatgtttagagaaggacttgaaggaggaaaaatctaagcactcacagcaggatgaactcatggccgacatttccaaatctattcagtcgctggaagacgagagtaagtccctgaagagccaaattgccgaagcaaagataatctgcaagacgttcaagatgtcggaggaaagaagagccattgccatcaaggacgcactgaacgaaaatagtcagctccagacctcacataaacagctgtttcagcaagaggccgaagtgtggaagggcgaggtgagcgagctaaacaaacagaaaattacgttcgaggacagcaaagtacatgcagaacaggttctcaacgacaaggagaaccatataaaaaccctgacagggcaccttcctatgatgaaggatcaggccgccgtactggaagaggatacaacagacgacgacaatctggagctggaggttaattcacaatgggagaatggggctaaccttgacgatcctctgaagggggccttaaagaagctgatacacgctgctaagctgaatgtgtccttaaaaagtttagagggcgaacgcaaccatatcattatccagctgtcagaagtggataagactaaggaggaactcacagaacacattaagaacctgcagacacagcaggccagcttgcagtctgaaaatatctacttcgaatctgaaaaccagaaactccagcaaaagttaaagattatgactgagttttaccaggaaaatgaaatgaagttgtataggaagctgactgtggaggagaattatcgaatagaggaagaggagaaattgagtagggttgaagaaaagatttctcgcgcaaccgagggcttggagacataccgaaagctcgccaaagatctggaggaagagctggaacgtacagtccatttctaccaaaagcaggtgatctcttacgagaagagaggccatgacaactggctggctgccagaacagctgagcggaacctgagtgatctacggaaggaaaatgcccataataaacagaagcttacggagacggagctgaaattcgaactgctggaaaaagatcccaacgcactggatgtgagtaatactgcatttggaagagaacattctccatgtagcccgtcaccgctggggcggcccagcagcgaaactagggccttccctagtccccagacgttgctggaggatcccctcagattgtctcccgtgctccccggcggaggaggacgcgggccctcgtctcctggtaaccctttggaccatcagattactaacgaaagaggggaaccttcatatgaccgtctgatcgacccacatagagcccccagcgatactggctcactcagctcccccgttgagcaggaccggcgaatgatgtttccacccccagggcagagctaccccgacagcactcttccaccccaacgtgaggacaggttctattctaacagtgaacgcctgtccgggccagctgaacctcgctccttcaagatgacctctctcgataagatggatcggtccatgccctccgagatggaatcctctcggaacgacgcgaaagacgatctgggcaatcttaacgtccccgactcatcactccccgcagagaacgaggcaacgggacccggcctcatcccgccccctttagctcccatttctggcccactgttccctgtggacacgcgggggcccttcatgcgtcggggcccacctttcccacctccacccccaggaacaatgttcggggctagcaggggctactttcccccgagagatttcccgggccccccacacgctcctttcgccatgcgcaatatttaccccccacgcggtttgcccccatacctgcatcctaggcccggattctatcctaacccgactttctag

SEQ ID NO: 25664 - DNA, 2334 bp, Artificial Sequence
  Description of Artificial Sequence: Synthetic coding sequence
atggaggagccgggcgcaactccacagccatatctggggcttgtcctagaggagctccggcgtgtggtggctgccctgcctgagtctatgagaccagacgagaatccttacggctttcccagcgagctggtcgtgtgtgcagctgttatcggattttttgttgtgctgctcttcctgtggcgaagcttccgtagcgtacgctcccgcctgtatgtgggcagagagcagaagctcggggccacactgtccggcctgatcgaagagaagtgcaagttgctggaaaaattctccctcattcaaaaggaatacgaaggttacgaggtagaaagctctttagaggacgcctctttcgaaaaagcagctgccgaggaagctagatctctggaagccacctgtgagaagctcaaccgaagtaactccgaactggaagacgaaattctttgcttggaaaaggacctgaaggaggaaaagtcaaaacattctcagcaggacgaattgatggccgacatctccaaaagcatccagtctctcgaggatgagtcaaagagtctgaaatcccaaatcgccgaagccaagatcatctgtaagacgttcaaaatgtccgaggaaaggcgagcgatcgctatcaaggacgctctgaacgagaattcccaactacagacatcccacaaacaactatttcaacaggaagctgaggtttggaagggccaggtttcagaactgaacaaacagaagatcacatttgaagactctaaggttcatgccgaacaggtgctgaacgacaaggaaaaccatatcaagaccctcacgggacacctcccaatgatgaaagaccaagcagcagtactcgaggaggacaccaccgacgacgacaacctcgagttggaggtgaattcgcagtgggaaaacggcgcaaaccttgatgacccactgaagggagccctcaaaaagcttatacatgccgctaagttgaatgtgtcccttaagagcctagagggcgaaagaaatcatattataatacaactttccgaggtagacaaaacaaaggaggaactgacagagcatatcaagaatctacagacacaacaggcttcgctgcagagcgaaaatatctactttgaatccgagaatcagaaactccagcagaaacttaaaatcatgaccgagttttaccaggaaaacgagatgaaactgtacagaaaactgacagtggaagaaaattatagaatcgaagaagaggagaaactgtctcgcgttgaagagaagatctccagagccacagaagggctggagacttaccgaaaattagctaaggatctggaagaagaactggaacgaacagtgcatttttaccagaagcaggtgataagctatgaaaagagaggccatgataactggctcgccgctaggacagccgagagaaatctgtcggatctcagaaaggagaatgcacataataaacagaagctgacagaaacagagctgaaattcgagcttttagaaaaggaccccaatgcactagacgtgagcaatacagcctttggtcgcgaacattccccctgcagtccaagccccctcgggaggcccagcagcgaaaccagggcatttcctagccctcagacactgctggaggatcccctccggctttctcccgtgctccctgggggggggggccgaggaccaagctcccctggcaatcctttagatcatcagatcactaatgaaagaggagagccatcctatgatcggctcattgatccccatcgcgcgcccagtgatactggctccctttcgagccccgtggagcaggaccgacggatgatgttcccaccgcctggacagtcttacccagactctaccctcccccctcaacgtgaggacagattctatagtaactctgaacggttgagtggccccgccgagccgcggtcttttaaaatgacgagcctcgataaaatggataggagtatgccatctgaaatggaaagcagtcgaaatgatgccaaggacgatcttggcaatttaaacgtgcccgacagctctctgcctgcagagaatgaagctacaggaccaggcttcatcccacctcctcttgcgcctgtccgcggacctctcttccctgtggacacacgcggtcctttcatgagacggggcccccccttcccacccccacctcccggcaccatgtttggagcatcccgtggatatttccctccccgcgacttcccgggtcccccccatgcccccttcgcaatgcgtaacatttacccacccagaggactccctccataccttcaccccaggcccgggttctatccaaacccaacattctag

SEQ ID NO: 25665 - DNA, 2334 bp, Artificial Sequence
  Description of Artificial Sequence: Synthetic coding sequence
atggaagaaccaggggctacacctcagccatacctgggcctggtgcttgaagaactgggacgcgtggttgccgccctccctgaaagcatgagacccgacgagaacccctacggtttcccatccgaattggtagtttgcgctgctgtgatcggcttttttgtggtgctacttttcctctggagaagttttagaagtgttagatcaaggctgtacgttggaagggagcagaaactgggggcaactctgagtggcttgatagaagagaaatgtaagctgctcgaaaagttctctctcatccaaaaagagtacgaaggatatgaggttgaaagctcactggaagacgccagtttcgagaaagccgctgctgaagaggcccgatccctcgaggccacctgcgagaagctgtccagatcaaactccgagttggaggacgagattctgtgtttggagaaggacctgaaagaggaaaaatctaaacacagtcagcaagacgaattaatggcagatatatccaaaagcatccagtctttggaggacgagagcaagtccctcaagtcgcagattgccgaggccaagatcatctgcaagacgttcaaaatgtccgaggagcggagggcgattgcaatcaaggatgccctcaatgaaaattcccagcttcagacctcccacaaacagctgtttcagcaggaagccgaggtatggaaaggacaggtgtctgagctgaacaagcagaaaatcaccttcgaggactcaaaagttcatgcagaacaagtgcttaacgacaaagaaaatcacattaaaactctgaccgggcacttgcctatgatgaaagaccaggctgcagtcctggaagaggacaccactgacgacgataatctcgagctcaaagtcaactcacagtgggaaaatggcgccaacctggacgaccctccgaagggggccctgaaaaagcttatccatgccgctaagctaaatgtaagcctaaagagtctcgagggtgagcgcaaccacatcataattcaactatcggaggttgataaaactaaggaggaattaaccgagcacatcaaaaatctccaaactcagcaagctagcctgcagtccgaaaacatttattttgaatccgagaaccagaagctgcaacagaagctcaaaataatgaccgagttttatcaggagaacgaaatgaaactctatcgaaagctaaccgtcgaggaaaattatcgcattgaggaagaggagaaattatctagagttgaagaaaaaatttctcacgcaaccgaggaacttgagacgtacaggaaactcgccaaggatctcgaggaggagttggagcgtacagtacacttttatcagaaacaagtgatttcctacgaaaagcgaggccacgacaactggctggcagcccggacggcggagaggaatttaagcgacctgcggaaggagaatgcccacaacaagcagaagctgacggagcgggagctcaaattcgagctacttgagaaagacccaaacgctctggacgtgtccaacacagctttcggccgagaacattctccatgtagcccttccccccttgggaggcctagttctgaaaccagggcgttcccatccccacagaccctgcttgaagatccattgcggctgtcccccgtgcttcccggtggcggaggtcgcggacccagttcccccggcaaccctctcgaccaccaaatcactaacgagcggggagaaccgtcctatgataggctgatagatccacaccgggccccttccgacacgggcagtcttagtagcccagtcgaacaagacagaaggatgatgttcccccccccaggccaatcttatccggattccacattgcctcctcagagggaagatcggttttattcgaacagtgagcgcctttctggtcctgctgagcctcgctcattcaagatgactagcctcgataagatggacagatccatgccatcagagatggaaagcagccggaacgacgctaaagatgacttggggaacttaaatgtacctgactcatccttgccagctgagaatgaagccaccggtcctggcctcattccaccaccactggccccaatctcaggtcctctgttccctgttgacactagaggtccattcatgaggaggggcccaccttttcctccgcccccaccagggaccatgtttggagcatctcggggatacttcccacctcgtgactttccggggccgcctcacgcaccattcgccatgcggaatatctatcctccccgaggcctgcccccctacctccaccccaggccgggcttctaccctaatcctactttctag

SEQ ID NO: 25666 - DNA, 735 bp, Artificial Sequence
  Description of Artificial Sequence: Synthetic coding sequence
atgatgcggactcagtgcttacttggtcttcggacattcgttgccttcgcagcaaagctctggtctttcttcatttacctgttaagaagacagatcaggacagtgattcaataccagactgtgcggtacgacatcctgcctctctcaccagtctctcggaatcgccttgcacaggtcaagagaaagatcctggtactcgaccttgatgagacgctgattcactctcaccatgacggggtccttcggcccaccgtgcgccctggaacaccacctgatttcatacttaaggtcgttatcgacaagcaccccgtaaggttcttcgtgcataagcgccctcacgtcgactttttcctggaggttgtgagtcagtggtatgaacttgtggtgttcactgctagcatggagatatacggttctgcagtggccgataaactggacaatagcagaagcatactgaaacggaggtattaccgacagcactgtactctggagctaggcagctacataaaggatctgagcgtggtccactcagatctgtcctcaattgtcatactcgataatagcccaggggcttatagaagccatccagacaatgctattcccattaaatcctggttctcagacccgtctgacacggccctgcttaacctccttcccatgctggacgccctccggtttacagccgacgtacggagcgttctgtcgagaaatctgcaccagcaccggctgtggtag

SEQ ID NO: 25667 - DNA, 735 bp, Artificial Sequence
  Description of Artificial Sequence: Synthetic coding sequence
atgatgcggacacagtgtttgttaggccttcggaccttcgtagccttcgctgccaaactgtggtctttttttatctatttgctccggcggcagattagaacagtgatccagtatcagaccgtgagatacgacatcttacccctctcacccgttagtagaaacagactggcccaggttaagaggaagatcttagtgctggatttagatgagactctgattcattcccatcatgatggagtgctcagacccaccgtgcggccggggacaccaccagacttcatcctcaaagtggtgatcgataaacaccccgtgcgttttttcgtccacaaacggccccacgtggacttcttccttgaagtcgtgtcccagtggtacgagttggttgttttcaccgcaagcatggaaatttacgggagcgccgtggcagataaactggataacagccggagtattctcaaacggagatactaccgacagcactgcacactggagttgggtagctacattaaagaccttagtgtggttcatagtgacctgagctccatagtgattctggacaattccccaggagcataccgctcccaccccgataacgctatacctattaaatcttggttctcggacccttccgacaccgccctgctgaacctcttacctatgctcgacgctctccgtttcaccgcggatgtaaggtcggttctaagcaggaatctccatcaacatcgcctctggtag

SEQ ID NO: 25668 - DNA, 690 bp, Artificial Sequence
  Description of Artificial Sequence: Synthetic coding sequence
atgcaggacgaggatgggtacattaccctcaatattaaaaccagaaaaccagccctgatttcagtgggtagtgcctcctcaagctggtggagagttatggccctgattctattaattttatgtgtcggtatggtggttggcttggtcgcattggggatctggtcggtaatgcagaggaattacctacaaggcgagaacgagaacagaaccggtacactgcagcagcttgccaagcggttctgtcagtatgtcgtaaagcaatccgaactgaaaggtaccttcaagggacacaaatgctcgccttgcgacacaaattggagatactacggtgatagctgctacgggttcttccggcacaacctcacatgggaggagtccaaacaatactgtacggatatgaacgctacattgctgaagattgataatagaaacatcgtggaatatatcaaggccaggacccatttgatacgatgggtcggcctgtccagacaaaaatcgaacgaggtctggaagtgggaggacggttccgtaattagcgaaaacatgtttgagttcctggaagacggaaaagggaacatgaattgtgcctactttcacaacggcaaaatgcacccaaccttttgcgaaaataagcattacctgatgtgcgagaggaaagcaggaatgacaaaggttgatcagttaccctag

SEQ ID NO: 25669 - DNA, 591 bp, Artificial Sequence
  Description of Artificial Sequence: Synthetic coding sequence
atgcaggacgaggatggctacattacacttaatattaagactcggaaacccgccctcatcagcgctgtcatgcagaggaattacctccaaggggagaacgagaaccgcaccgggactctgcagcagctcgccaagaggttttgtcagtacgtggttaagcagtcagaacttaagggcactttcaagggccataagtgttccccttgcgatacgaactggagatattatggagacagctgctacggcttcttccgtcacaatctgacttgggaagaatccaagcagtactgtaccgatatgaatgccactttactcaagatagataacaggaacatcgttgagtacatcaaggccaggacacatctgatacggtgggtgggcctgagtcgccagaagagcaatgaggtttggaagtgggaagatgggtctgttatctcggaaaacatgtttgagttcctggaggatggcaagggcaacatgaattgcgcttactttcacaatggaaagatgcacccaacattctgcgaaaacaaacactatctaatgtgcgagcgtaaggccggcatgactaaggttgaccagctgccatag

SEQ ID NO: 25670 - DNA, 417 bp, Artificial Sequence
  Description of Artificial Sequence: Synthetic coding sequence
cacaaatgtagcccatgtgacactaattggagatactacggtgattcatgttatgggttttttcggcacaatctgacatgggaagagtcgaagcagtattgtacggacatgaacgccactttgctcaaaattgactccaaagaagaaaagctgttccttacttcttttcggattctgacgattgtgtttatctgggtgggacttagccgccaaaagtcgaacgaggtctggaagtgggaggacgggagcgtaatctcagatagtctcttcagccagagcaatttccagaatggcaagggtaacatgaactgcgcgtacttccacaatggcaagatgcaccccactttttgtgagaataagcactatttaatgtgtgagcgaaaggcaggcatgaccaaggttgaccagttgccctag

SEQ ID NO: 25671 - DNA, 591 bp, Artificial Sequence
  Description of Artificial Sequence: Synthetic coding sequence
atgcaggatgaggatggctatatcacactcaacatcaagacccgtaagccagccttaatctccgccgtaatgcaacgtaattatctgcagggtgaaaatgagaaccgaaccggaaccctgcagcagctggctaagaggttttgtcagtacgtggtaaaacagtccgagctgaaagggaccttcaaggggcataaatgttcgccctgtgatacgaattggcgctactacggcgattcctgttacggatttttccgccacaaccttacgtgggaggaatcaaagcagtactgtactgacatgaatgctactctgcttaagatcgataaccggaacattgtggaatatatcaaggccagaactcacttgattcgttgggttgggctgtcccggcagaagtccaatgaggtctggaagtgggaagatgggagcgtgatctccgaaaatatgttcgagtttctggaggacgggaaagggaacatgaactgtgcatacttccataacggcaagatgcatccaacgttctgtgaaaacaagcattatttgatgtgtgagaggaaggccggtatgactaaggtcgaccagttgccctag

SEQ ID NO: 25672 - DNA, 831 bp, Artificial Sequence
  Description of Artificial Sequence: Synthetic coding sequence
atgagtgaagaggtgacttacgctactctgacattccaggacagcgctggtgccaggaataaccgagatggcaacaacctcagaaagcggggtcacccggctcccagcccaatatggagacatgctgcactaggactcgtgactctgtgcctgatgctgctgatcggcctggtcacgttggggatgatgtttctgcagatttcaaacgacatcaatagcgactcagagaagctgtcgcaactacagaaaaccatccagcagcagcaggataacctcagtcaacagctcggcaacagcaataacctgagtatggaagaagagttccttaagtctcaaatctcctctgtcctcaaacgccaagagcaaatggccataaaactgtgccaggagctgataattcacacttccgaccatcgttgtaatccttgccctaaaatgtggcaatggtatcagaactcttgctattactttaccacaaacgaagagaagacatgggccaacagcagaaaagattgtattgataagaacagcactctggtcaaaatcgacagtctggaagagaaagattttcttatgtctcagcctctattaatgttttcatttttctggctcgggttgagctgggacagctcaggacggagttggttttgggaagacggtagcgttccatcgccttcgctctttagcactaaagagctggaccagattaatggttctaagggctgtgcctatttccaaaaaggtaatatttacataagtagatgctcagcagaaatattctggatttgtgaaaaaaccgcagctcccgtgaaaaccgaggaccttgactag

SEQ ID NO: 25673 - DNA, 699 bp, Artificial Sequence
  Description of Artificial Sequence: Synthetic coding sequence
atgtctgaggaagttacctatgccaccctgacattccaggatagcgccggcgcccggaataatcgcgacgggaataatctgcggaagcgaggccatccagctcccagcccaatttggaggcacgcggccctcggcctggtcacactgtgtctcatgctgctaatcggcttagtgacccttggaatgatgttcctgcagatctcaaacgatatcaatagcgatagcgagaagttgagccagctccagaagactatccaacagcagcaagataacttaagccagcaactcgggaattccaacaacctgtcaatggaggaggaatttctcaagtcccagatctcttctgtcctaaagcggcaggaacagatggccatcaaactgtgccaggagctcattatccatacgtcagaccatagatgtaatccatgcccgaaaatgtggcagtggtaccagaattcttgttattattttacaactaatgaggagaaaacttgggccaatagccgcaaagattgtattgataagaactctacactggttaaaattgactcattggaagaaaaagacttcctgatgtcgcaacctctgctgatgttttcattcttttggctcggactttcttgggattcttcgggccggtcatggttctgggaggacggtagcgtccccagtccatctctctacgtcagtaattactag

SEQ ID NO: 25674 - DNA, 1473 bp, Artificial Sequence
  Description of Artificial Sequence: Synthetic coding sequence
atgagacctgcattcgctctgtgtttgctgtggcaagcactgtggcccggtcctggtgggggcgaacaccccactgcagaccgagctggttgtagtgcatccggagcttgttacagcctgcaccatgccaccatgaagaggcaagctgctgaggaggcctgcatcctgagaggtggagctctcagcacagtaagagccggggctgaactgcgggccgttctcgccctgctgagggctggcccgggcccaggcgggggctcgaaagacctgctgttttgggtggctctagagcggaggcgcagtcactgcactctggaaaatgagccattgagggggttttcctggttaagcagtgatcccggaggcctcgaaagtgatacactccagtgggtcgaggagcctcagcggtcctgcactgcccgccgatgcgccgtactgcaagcaacaggcggggtggagccagctgggtggaaggaaatgaggtgccacctccgagcaaacggttatctttgcaaataccagttcgaggttctatgccctgccccccggcccggcgctgcatcaaatctcagctacagggcaccttttcagctgcactcagcagccctggacttctccccccccggcaccgaagtgtcagccctctgtcgaggccagctgccaattagtgtaacctgcattgctgacgagattggggcaaggtgggataagctgagcggcgacgtgctgtgtccatgccctggccgttacctgcgggctgggaagtgtgctgagctgccaaactgtctggacgacctgggcgggtttgcatgcgagtgcgccaccggcttcgagctgggaaaagatggccgttcttgtgtaacaagtggagaaggtcagccgactctggggggcaccggggtgcctacaaggagaccccccgcgaccgcgacaagtcccgtcccgcaacgtacctggcccatcagagtcgatgagaagctgggggagacacctctggtccctgagcaggacaatagcgtgacgtccatcccagagatcccgcgatggggctctcagtctaccatgtcaacccttcagatgagcttacaggctgagtccaaggccacaatcacccctagtggttctgtgatcagcaaattcaactccacaaccagctctgctaccccacaggcattcgactcctcgagtgcagtcgtgtttatatttgtatcaacggccgtggtcgtcctagtgattttgaccatgactgtcttgggcctggtgaaattgtgtttccacgaatcgccgagtagccagcccaggaaagagagtatgggcccacccggtctagaatccgacccagagcccgccgctctgggcagctctagtgctcactgtaccaataacggagtgaaggtgggagactgtgatcttagagacagggccgagggggctctactggcagaatctccactcggctctagcgatgcctag

SEQ ID NO: 25675 - DNA, 633 bp, Artificial Sequence
  Description of Artificial Sequence: Synthetic coding sequence
ggcaccaattcaagggcaatgtgctgcgtcccgcccggcagatatcttcgcgccgggaaatgtgcagaacttccgaactgtctggatgatctgggtggctttgcatgcgaatgtgccaccggctttgagctcgggaaagatggccgatcctgtgtgactagtggtgaggggcagcctactctgggtggcaccggcgtgcccactcgaagacccccagcaactgccacctcccctgttccacagaggacgtggcctattagagtcgacgagaagctgggggagacaccgttagtgcccgaacaggacaatagtgttactagtattcctgaaattcctaggtggggctcccagtccaccatgagtacgcttcagatgtctctacaggctgaaagtaaggccacgattaccccctctggaagtgtgatctcaaagttcaactcaaccacctcgagcgcaactccacaagccttcgattctagttcagcagttgtattcatattcgtctcaactgcggtggtcgtcctggtaattctgacaatgaccgtgttgggcctagtgaaactttgtttccatgaatctccttccagccagcctcgcaaggagagcatggggccaccaggactcgagagctag

SEQ ID NO: 25676 - DNA, 870 bp, Artificial Sequence
  Description of Artificial Sequence: Synthetic coding sequence
atgcacaatttatacagcataacagggtacccagaccctcctgggactatggaagaggaggaggaggacgatgattacgagaattctacacccccatacaaggacctgccgcccaaaccagggacgatggaggaagaggaagaggacgatgactatgaaaatagcactcccccctataaggacttgcctcccaaaccagcacttactctgagtttctcatccccaggtagttcagccccaccaagacccccccgtgccgccaaggagactgagaagcctccacttccctgcaaaccccggaatatgacgggacttgaccttgcagctgtcacctgccctccgccacagcttgcagtaaacctggagcctagcccgctgcagccttccctcgcggcgacacccgtcccttggctgaatcagaggtctggcggcccgggctgctgccaaaaacggtggatggtgtacctctgtttattggtagtgacatccttgttcttaggctgcttagggcttactgtgaccctgatcaagtatcaggagttaatggaagagctccggatgctgtctttccagcagatgacttggcgaaccaatatgactggcatggccggattggctggactcaaacatgatatagcccgggtgagggccgacacaaaccagtctctggtcgagctctggggactgctggactgcaggcggattacttgtcctgaagggtggcttcccttcgagggcaagtgttattacttttctccttctactaaaagctgggatgaggccaggatgttctgtcaggagaattattctcacctagtgattattaatagcttcgctgagcacttattgggcgcccgcggaacccaatag

SEQ ID NO: 25677 - DNA, 1137 bp, Artificial Sequence
  Description of Artificial Sequence: Synthetic coding sequence
atgcataacttatacagtatcacgggctatcccgatccacctggcactatggaagaagaggaggaggatgacgactatgaaaactctaccccgccgtacaaggatctccctccgaagcccggtactatggaagaggaagaagaggacgacgattatgagaattctacccccccctataaggacctacccccaaagcctggaacaatggaggaggaagaggaggatgacgattatgagaactccaccccaccttataaagacctgccgccgaaaccgggctcaagcgcaccccctcgccctccacgcgcggcaaaagagacagagaaaccacctctgccttgcaagcctcggaacatgacagggctcgatctggctgcagtgacctgccctcctccccaactagccgtcaatctcgaaccaagtcctctccagcccagtcttgccgccactcctgtgccgtggttgaatcagcgctctggcggacccggttgctgccagaagcgatggatggtctatctctgcctgttggttgttacatcattgtttttgggctgcctcggtctgaccgttaccctgatcaaatatcaggagctcatggaggagctgagaatgctgagttttcaacagatgacctggaggactaatatgacggggatggcaggcctggccggtctgaagcacgacatcgctcgcgtcagggcggataccaatcaatctcttgtggaactctgggggctgttggattgccgccggataacatgtcccgagggttggctgcccttcgaaggaaagtgctattatttctctccgtcaacaaagtcctgggatgaagcccggatgttttgccaggaaaactactcccacctggtgataattaactccttcgctgaacataatttcgttgctaaggcccatggaagcccccgggtgtattggttaggcctgaacgacagggcccaagagggtgactggaggtggctggacgggagtccagttacgctttccttctgggagcccgaggaacctaataatattcacgatgaagactgcgctactatgaacaagggcggaacctggaacgatctctcttgttacaagactacttactggatttgcgaaaggaagtgctcttgctag

SEQ ID NO: 25678 - DNA, 921 bp, Artificial Sequence
  Description of Artificial Sequence: Synthetic coding sequence
atgcataacctatactccattacaggataccccgaccctcccggcaccatggaagaagaagaagaagacgatgactatgaaaattccactccaccttacaaggatctcccaccgaagcctggaactatggaggaggaagaagaagacgatgactacgaaaattctacacccccgtacaaagaccttccccccaagcctggcacaatggaggaggaggaggaggatgatgactacgaaaacagtactcccccctacaaggatctcccaccgaaacctgggagttccgcacctcctcgccctcccagggcagctaaggagactgaaaaaccgcctctcccttgtaagccgaggaacatgactggcctcgatttagctgctgttacatgcccacctcctcaattggcagttaatctggagccctctcctcttcaacccagtctggctgctaccccggtcccttggctgaaccaacgcagtggcggtccgggttgttgccaaaagcggtggatggtatacctgtgcctgcttgtggtgaccagcctgtttctgggatgcctggggctcacggtgaccctcattaaataccaggaattaatggaagaactgagaatgctgagcttccagcagatgacttggagaacaaatatgacggggatggcaggcttagctggccttaagcacgacattgctcgtgtgcgggctgacacgaaccagtctctggttgaactttggggactcctcgattgccgacgtattacttgtcctgagggatggctacctttcgaggggaagtgctattatttttctccttccacaaaatcgtgggatgaagcgcggatgttctgtcaggaaaattattctcatttagtgatcattaatagctttgcggaacacctattaggtgcgcgagggactcaatag

SEQ ID NO: 25679 - DNA, 1770 bp, Artificial Sequence
  Description of Artificial Sequence: Synthetic coding sequence
atggacggcgaggcagtccggttctgcacagataaccaatgtgtgtcactgcacccccaagaggtggacagcgttgccatggctcccgccgcccccaaaattcctcgattggtgcaggcaacccctgccttcatggcagttacacttgtgtttagtttggtcacactgtttgtcgtggtgcagcaacaaaccaggcctgtgccaaaacctgtgcaagctgtcatcctgggggacaatattacaggacacctccccttcgaaccgaacaatcatcaccatttcggcagggaagccgagatgagagagctcatacaaaccttcaagggacacatggagaactccagcgcatgggtggttgaaattcagatgctcaagtgtcgcgtagataatgtcaactcccagctacaagtgctgggtgatcatctaggaaacacaaacgccgatatccagatggtcaagggtgtcttgaaggacgcaaccacactttctctgcagacccagatgctcaggagcagtcttgagggcaccaacgccgagatacaaaggctcaaggaggatttggagaaagccgacgcgctgacattccagacactgaattttctgaagtcgagcctcgaaaataccagcattgagttgcacgtattaagcaggggattggagaatgccaattctgagattcagatgctgaatgcctcgctagagactgccaacactcaggcccagctcgctaactcatcacttaaaaatgccaacgctgaaatttatgttctccgaggtcacctagactctgttaacgacttgcgtacgcagaaccaggtgctccggaattctttggaaggtgctaacgcggaaatccaaggtttgaaagaaaacctgcagaacacaaacgcactgaacagccaaacgcaggctttcatcaagagcagttttgataacacatccgcagagatccagttccttcgtgggcatttggaacgcgcaggagatgaaatccacgtcttaaaacgcgatctgaaaatggttacagcccagactcagaaagctaatggaaggctagaccaaaccgacacgcaaattcaggttttcaaatctgagatggaaaacgtaaacactctgaacgctcagatccaggtgctcaacggccacatgaaaaatgcctcgcgagaaattcagactttaaagcaggggatgaagaacgcatccgccctaacctctcaaactcagatgctcgattccaatctacagaaagccagcgcagagatacagcgcctccggggggatctggaaaatacaaaggcgcttactatggagatacagcaggaacagagtcgcctgaaaactttgcacgtcgtcatcacaagtcaggagcagctgcagcggacccagtctcagctcctgcagatggtgctccagggctggaagttcaatggtggttcattatactactttagcagcgtgaagaaatcttggcacgaggcagaacagttttgcgttagccagggggctcacctggcgtccgtcgcctccaaggaagagcaggccttcctggtcgagttcaccagcaaggtctactattggatcggacttacagatcggggcacggaaggaagctggagatggacagacggtaccccttttaatgcagctcagaacaaggcccccggatctaagggcagctgtcctctgcgcaaatatattatcgtgaacagtggaatgggagcctgtagctttattgacacaccaccctgtccttggattctgtccaactag

SEQ ID NO: 25680 - DNA, 882 bp, Artificial Sequence
  Description of Artificial Sequence: Synthetic coding sequence
atggatactacacggtactctaagtggggtggttcaagtgaggaggttccgggcggtccttggggacgttgggtacactggagtcgccgccccctttttctggccttggcagtcttagtgaccacagtgctttgggctgtcatcttgtcgatccttttatcaaaagctagcactgagcgagccgcgttactggatggtcatgacttactccgaaccaacgccagtaagcagactgccgcccttggcgccctgaaggaggaggtaggtgactgccattcttgctgctcaggaacacaggcacaattgcagacaacccgcgctgaactgggggaggcacaagccaagcttatggagcaggagagcgctctgagggagctgcgggaaagggtgactcaagggctcgccgaggccggcagaggtagggaggacgtcagaactgaactcttccgcgcacttgaggcagtgagattgcagaacaactcgtgtgagccttgtccaacttcctggctgtccttcgaagggagctgttatttctttagtgttccaaaaaccacatgggccgccgcacaggaccattgtgccgacgctagcgcccatttggtgattgttggaggactagatgagcagggatttctgaccagaaataccagaggtagaggatattggctggggctccgagccgtccggcacctgggaaaggtgcaaggatatcagtgggttgacggcgttagtcttagcttctctcattggaatcagggcgagccaaatgacgcctggggcagggagaactgtgtgatgatgttgcacactggactttggaacgatgcgccctgtgacagtgaaaaggacgggtggatttgcgagaagcgacacaactgctag

SEQ ID NO: 25681 - DNA, 759 bp, Artificial Sequence
  Description of Artificial Sequence: Synthetic coding sequence
atggagcaggagtcagctctgcgggagctacgcgagcgtgttacccaaggtcttgcagaggctggtcgaggccgcgaggacgtccgcacagagctctttcgcgccttggaggccgtgaggctacagaacaactcctgtgagccatgtccaacctcctggctttcatttgaagggagctgctacttcttttcagtccccaaaacaacctgggcagctgcccaggatcactgcgccgatgctagcgcacacttggtgattgtgggcgggctcgacgagcagggcttcctcacccggaacacgcggggacgcggctattggctgggactgcgcgctgtgaggcacctgggtaaggtccaggggtaccagtgggtggacggagtcagcctgtcattctcccattggaatcagggcgaacccaatgacgcctggggccgggagaactgtgtgatgatgttgcataccggcctttggaatgatgcaccatgcgatagcgagaaggacggttggatctgcgagaaggctcaactgctgacccctccttcggctcttgaaccacgtcccctgcagcacgtcgtatcgtggggcctcctaacatctcttgcacctggagccgactgccaacgggtgttctctagcagttctactgccgccgaaagccagaagcacttggcacaacactcccctgtgcagcctagtgcttgggccctgggtccgccatgtagaccgcatccaaacagtactcacgctgatccgacatag

SEQ ID NO: 25682 - DNA, 726 bp, Artificial Sequence
  Description of Artificial Sequence: Synthetic coding sequence
atgcatgaggaagagatttacaccagcctccaatgggacagccccgctcctgacacttatcagaagtgtctatccagcaacaaatgctccggggcttgctgtctcgtgatggttatctcgtgtgttttctgcatgggattgctgacggcgtcgatattcctgggcgtcaaactgctgcaggtcagcacaatcgccatgcagcagcaggagaagcttattcagcaggaacgtgctttgttgaactttactgagtggaaacggagctgtgcccttcagatgaaatattgccaagcttttatgcagaactctctgtcatctgctcataactcttccccgtgccctaataattggatccaaaatagggaaagctgttattacgtgagcgagatatggtccatatggcatactagccaggaaaattgcttgaaggaaggctctactttattacaaatcgagagtaaggaggagatggactttataactgggtctttgcgaaagatcaagggctcctatgattactgggtcgggctgtcccaggatggacactcaggacgctggctttggcaggatggatcatcgccttccccaggactcctgccagctgagaggtctcaatccgccaaccaggtgtgcggatacgtcaaaagtaacagcctgctcagtagcaactgctctacctggaaatacttcatttgcgaaaaatatgcattaagatcatccgtatag

SEQ ID NO: 25683 - DNA, 504 bp, Artificial Sequence
  Description of Artificial Sequence: Synthetic coding sequence
atggtgagcaatttctttcatgtgatccaggtctttgagaaatctgctacactaatttccaaaacagagcatatcgggtttgttatttactcatggcggaagtctacaacccacctgggcagtcgaagaaaattcgccattagcatttacttgagtgaagtgtctcttcagaagtacgattgcccattcagtggcacctcttttgtagttttctcactgttcctgatctgtgcaatggcaggagacgtggtttacgctgacataaaaaccgtgcggactagtccacttgaactcgcttttcccctacaacgaagtgtcagttttaatttctctactgtccataaatcctgcccagcaaaggattggaaggtgcacaagggcaagtgctattggatcgccgaaacaaaaaagagctggaataaatcccagaacgattgcgcaattaataacagttatctgatggtgatccaggacatcacagctatggtacgctttaacatttag

SEQ ID NO: 25684 - DNA, 108 bp, Artificial Sequence
  Description of Artificial Sequence: Synthetic coding sequence
caagatattaccgccatgcttattaccttcctgctgtatttacaaatggccttccttcagtgcgtttacatatcagatgtgagtgtttatccaaatttttttctgtag

SEQ ID NO: 25685 - DNA, 726 bp, Artificial Sequence
  Description of Artificial Sequence: Synthetic coding sequence
atggggcacaactccactgtggaaatcatttacattaccgaagacgatgtgatacagtcccagaacgcattaggcaaatacaacacaagtatggccctttttgagtctaatagtttcgaaaaaacgatactggagagcccctactacgtcgatctgaaccaaacacttttcgtccaagtatcgttacacacgtcggatccaaatctcgtggtatttcttgacacctgcagggcttctccaacatcagactttgcctcaccaacctatgacctaatcaaaagcgggtgttcgcgggatgaaacctgtaaggtctaccctctgttcggacattacggtcgatttcagttcaacgccttcaaatttctgaggtcaatgtcctccgtatatttgcagtgtaaggtactgatctgtgacagctccgaccaccagagtaggtgtaatcagggatgcgttagccgaagcaagagggatatcagcagctacaaatggaagacagatagcatcatcgggccaattaggcttaaacgcgacaggagtgctagcggcaattcaggctttcaacacgaaacacatgctgaagagacgccaaatcaaccatttaattccgtgcacttgttctcatttatggtgctggctctcaatgtggtcactgtcgccactattaccgtccgacactttgtgaatcagcgggcagactataaataccagaagcttcagaattattag

SEQ ID NO: 25686 - DNA, 981 bp, Artificial Sequence
  Description of Artificial Sequence: Synthetic coding sequence
atgcgcgtcatcatttcaaagagctatctggaggcattcaattcgaacggtaataaccttcagcttaaggatcccacttgtaggcccaagctttcaaacgtagtggagttctccgttccgcttaatggatgtggcactattagaaaggtagaggaccaatctatcacctatacgaacattatcacattttctgcctcttccacgagcgaggtcatcacacgccagaaacagttacaaattatagtgaaatgtgaaatggggcacaatagtactgtcgaaatcatctacatcactgaggacgatgtcatccagtcccagaatgccttgggcaagtataatacctcaatggcactcttcgaatccaattctttcgagaagacgattcttgaatcaccatactatgtggatttgaatcagacacttttcgttcaagtgagcctacatacatcggaccctaacctggttgtttttttagatacctgcagagcctcccccacatctgacttcgcttctcctacctacgatttaattaagtcagggtgctctcgagatgagacctgcaaggtgtacccactctttggacactatggacggtttcagttcaacgccttcaagttccttcggtcgatgagcagcgtgtacctgcaatgcaaggtgttaatctgcgactcctcagaccaccagagtcggtgtaaccagggctgtgtctcaagatcaaaacgagacatcagcagctataagtggaagactgacagtataatcggccctattaggcttaagagggacagatcagcatctggaaacagcgggttccagcatgagacccacgcagaggaaacccccaatcagcctttcaactcagtgcacttgttctctttcatggtcctggccctgaatgtcgttacggtggccactataacagtgagacattttgttaatcagcgcgcagactataaatatcagaagctgcagaactactag

SEQ ID NO: 25687 - DNA, 981 bp, Artificial Sequence
  Description of Artificial Sequence: Synthetic coding sequence
atgagggttattatctcaaagagctacttagaggccttcaactcaaatgggaataacctgcagcttaaggaccccacatgccgcccaaaattgtccaatgtggttgaattttctgtccctttaaacggttgtggaacaatacgaaaggtggaagaccagtctattacatatacaaatatcattactttcagcgcctcaagcacctccgaggttattaccaggcaaaaacagctgcagattatcgtgaagtgtgagatggggcacaacagcacagtcgaaattatttacataacagaagacgatgtgatccaaagccagaatgctctgggcaagtacaatacttctatggcactctttgaatcaaacagctttgagaaaaccattctggaatctccatattacgtcgatcttaaccagacactgttcgtccaggttagcctacatacctctgacccaaatttggtggtgttcctggatacctgtcgggcctcccccacgtctgatttcgcttccccaacctatgatttgatcaagtctggctgcagcagagacgagacctgtaaggtgtaccccttatttggtcactacggtaggttccaatttaacgcttttaagttcctgaggtcaatgtctagcgtgtacctgcaatgcaaggtcctcatctgtgatagttcagatcatcagtctaggtgtaaccagggatgtgtttcccgaagcaaacgcgatatcagtagctataagtggaagacagactccattattgggcctatacgcctgaaacgcgatcgttcagcctctggaaactccgggttccagcatgaaacccacgctgaggaaacccctaaccaaccctttaatagtgtccacctgttcagtttcatggtgctggctttgaacgtggtcacagtggcaaccataacggtacgccacttcgtaaatcagcgcgctgactataaatatcagaagctgcagaattactag

SEQ ID NO: 25688 - DNA, 981 bp, Artificial Sequence
  Description of Artificial Sequence: Synthetic coding sequence
atgagggtgattatctcaaaaagctacttagaagcttttaacagcaatgggaacaaccttcagttgaaggatccaacgtgtagacccaaattgagcaatgtcgtggaattctcagtacccctgaatggatgcggcacaatccggaaggttgaagaccaatccatcacctacacgaatattataacgttctcagcatcctcaacatcagaggtgattacaaggcagaagcagctgcagattattgtgaagtgtgaaatggggcacaactctaccgtagagatcatttatattaccgaggatgatgtcatccaatcacagaacgccctgggtaaatacaatacctccatggctctattcgagtccaactctttcgagaaaacaatcctggaatctccatattatgtggatctgaatcaaacactcttcgtccaggtgtccctgcacacaagcgacccaaacctggttgtattcctggacacttgccgagcttcacctacctccgattttgcttcaccgacttatgacctgatcaagagcggatgctcaagggatgagacctgcaaggtgtaccctctgtttggtcactacgggcgatttcagtttaatgcattcaagttccttcgatccatgagcagcgtatacttgcagtgcaaagtgctgatatgcgattctagcgatcatcagtcgcggtgtaaccagggatgtgttagccgcagcaagcgcgatatttcttcttataagtggaaaacagattccataatcggccccatacggttgaagagggatcggtccgcatcagggaattccggattccagcacgagacccatgccgaagaaacacctaatcagcctttcaactccgtccaccttttcagttttatggtactcgctctcaacgtcgttacagtggctactattacagtgaggcactttgttaaccagagagctgactacaaataccagaaactgcagaactactag

SEQ ID NO: 25689 - DNA, 1824 bp, Artificial Sequence
  Description of Artificial Sequence: Synthetic coding sequence
atggaactagtgcgacgtttaatgccacttacgctcctaatcctgagttgcctggcagagcttacaatggccgaagcagaaggcaacgcaagttgtaccgtctccctggggggggccaatatggccgagacccacaaggcaatgatcctccagttgaaccctagcgagaactgtacctggacaattgaaaggccagagaacaaatccatcaggatcatcttcagttatgtacagctggatccggacggtagttgtgaatcggagaacatcaaggtatttgacgggacgtcctccaatggacctctgctgggacaggtttgctcaaagaatgattacgtaccagtatttgagtcttctagcagcactctgacatttcagattgtgaccgactccgcacggattcagaggacagtgtttgtattttactactttttctcaccaaatatatctatcccgaactgcggcggctatctggacacactcgaggggtcgttcacgtctcccaactaccccaagccccacccggagcttgcgtattgtgtgtggcacattcaagtggaaaaagactacaaaatcaaactgaacttcaaggaaatatttctggaaatcgacaagcagtgcaaatttgattttctggcaatttacgatggacctagtaccaactcgggtttgatcggtcaggtgtgcggacgcgtgacccccacctttgaaagctcctctaactctttaacggtcgtactgagcacggattatgccaactcctaccgaggattcagtgcaagctacacttcaatttatgccgaaaatatcaataccaccagcctgacatgttcaagcgaccgcatgcgggttataatcagcaaaagttacttagaggcctttaatagcaatgggaacaatctgcaactcaaggatccaacatgtaggcctaagctttccaacgtagtagagttctctgtgcccttaaatggctgcggtacaatcaggaaggtcgaagaccagtccatcacctatactaacatcatcaccttctccgcgtctagtacgtcagaagtgataacccgacagaaacagttacagataatcgtgaaatgtgagatgggccacaattccacagtggagatcatttatatcaccgaagatgacgtcattcaatctcaaaacgcgctggggaagtacaatacatcaatggccttattcgaatccaactccttcgaaaagacaatactggagagcccatactacgtggacctgaatcagacactgtttgttcaggtgtctctccatacaagcgaccccaatctcgttgtgttcctggatacttgtcgcgcgagtcctacctcggacttcgctagtcctacgtacgatttaatcaaaagcgggtgctccagggacgaaacctgcaaggtctacccactgttcgggcactacggtaggttccaattcaacgccttcaagttcttgaggtcaatgtcctccgtttacctccagtgtaaagtcctgatctgtgatagttctgatcaccaatctcggtgcaaccaggggtgtgtctcccgatcgaagcgggatatctcgtcatataaatggaagactgattccattatcggccccattcgcttgaagcgggaccggtccgcctcaggaaattcaggttttcagcacgaaacacatgcggaagagaccccaaatcaacccttcaattctgtgcacctcttcagtttcatggtgctggccttgaacgtggtcactgtagcgaccatcaccgtgaggcacttcgtcaaccaaagagctgattacaagtatcagaagttgcagaattactag

SEQ ID NO: 25690 - DNA, 2238 bp, Artificial Sequence
  Description of Artificial Sequence: Synthetic coding sequence
atgcggcctgattcacatccatacgggttcccctgggaactggtgattcgggcagcggtcgccgggttttttgcagtacttttcctgtggcggagttttcgatctgtgacctcaagactctacgtgaggcgcgaaaaaaaattcgctgttgcactttccggcttgattgaggaaaagtgtaaactgcttgagaaattcagtctggtccagaaagagtatgaaggctatgaggtggagagtagtctaaaaaatgcgagtttcgagaaggaggctaccgaggctcagtccttggaggccacctgcgaaaagctcaaccgcttcaactccgaacttgtgcacgaaatactgtgcctcgagaaagagctgaaagaagagaagagtaaacacagcgaacagaatgagctaatggccgatatttctaagcgtattcagtcccttgaagacgagagcaagtctctgaagtcgcaggtggctgaagctaagatgacatttaagagattccaggcaaacgaggagagactggagatcgagattcaggacgcttggaaggaaaatagcgaacttcaggagtcacagaaacagctgttgcaggaagcagaggtgtggaaagagcaggtgagcgaacttatcaaacagaagagaacctttgaggatagtaaagttcatgccgaacaggtgctgaacgacaaagagaatcacatcaagacgttgacagaacggctgctcaaaatgaaggatggggttgccatgttggaagaagacgtgaccgatgatgataatcttgagttggagatgaacagcgaaagcgaagatggggcatacctggacaaccctcccaagggagcactgaaaaaattgatacatgccgcgaaattgaacgcttcgctgaaaaccttggagggtgaaaggaatcagatctatattcagctctctgaggtcgacaagaccaaagaagagctcaccgagcacatcaagaatttgcagactgagcaggcctcgctacagtcagaaaatacacattttgaatcagaaaaccagaagctacagcaaaagttaaaggtgatgacagagttgtaccaggaaaatgaaatgaagctgtaccgaaaattgattgtagaagaaaagtgcagactggagaaggaggagaaattaagcaaggttgatgagatgatcagtcacgcaacagaagagctggagacttatcggaaaagagcaaaagatcttaaagagttcgagaagaccatccatttttaccagaaaaaaataatcctacatgagaagaaggcgcatgacaactggagtgctgcttggaccgcagagcggaacctgaacgatctcaggaaggagaatgcgcataatcgccagaagttaaccgaaatcgaatttaaaatcaagctcttagagaaagacccatatggcctggatgtgccaaataccgcatttggacgtcagcattctccctatggcccctcacctcttggctggccctcaagcgaaactagggcgagtttgtatcctccaacactcttggagggccccctgcgcctctcccccctccttccgcgaggggggggcaggggatctagaggcccagggaatcccccagaccatcagataactaaagagcgaggggagtcaagttgcgatcgtctgaccgacccccatcgagcgccttccgacgccggaccgttggctccaccatgggagcaggactaccggatgatgttcccaccgcccgggcaatcgtacccagattcagccttgcctccacaaagacaggatagattttatagcaattgtgctcgtctgagcgggcctgccgagttacgcagttttaacatgccttcactggacaaaatggacgggtccatgccctccgagatggagtccagtcgtaatgacacaaaagataacttgggaaacctgaaggttccagatagcagtctgccagcagaaaacgaagcgactggacccggcttcgtgcccccccctcttgcgcccatccggggcctgcttttccccgttgatactcggggtccctttattcgccgtggcccccccttcccgcccccacctcccggaaccgttttcggggcgtcacctgactatttctctccgagagacgtgcctgggccaccgcgagccccgttcgcaatgcggaatgtttatctcccacgcgggtttctgccgtaccggcctcctcggcctgctttcttcccaccagcccctacattttag

SEQ ID NO: 25691 - DNA, 225 bp, Artificial Sequence
  Description of Artificial Sequence: Synthetic coding sequence
atgtttgtgatcatatctctccacaactgtgttgtgatcagctttgtgctgtttctgtttggtgggaataacttcatacaaaacttctatttgccacagaactatattgaccagtttttgctgactagcttccctacctttacaagcgtaggggtgctcattgttctggtgctctgcagcgcgtttctactcctttggcagggcgaaggagtgaacctcagatag

SEQ ID NO: 25692 - DNA, 4518 bp, Artificial Sequence
  Description of Artificial Sequence: Synthetic coding sequence
atgctctgtgtggccggggcaagactgaagcgcgagctcgatgcaacggccacagtactggccaataggcaggacgagtcagaacagagtcgcaagcgcctgatcgaacaatctagagagtttaagaagaatacgccagaggatctgcgcaagcaggtggctcctctgctcaagagcttccagggggagatagatgccctctccaagcggagtaaagaggccgaggctgccttcctgaatgtatacaaacgtcttatagatgtgcctgaccctgtgcctgcattagacctcggtcagcaattgcagttaaaagtccagaggctgcatgatatagaaaccgagaatcaaaagctccgggaaacactggaagagtataataaggaatttgcagaggtgaagaatcaggaggtcactatcaaagctctgaaagagaagattagagagtacgaacaaacactcaaaaaccaggctgaaacaatcgccctggagaaagagcaaaagctccagaatgattttgcagagaaagaacgtaagcttcaagagactcagatgtctacaacaagtaaactggaagaggccgagcataaagtccaatcacttcagaccgccctggaaaaaacaagaaccgagctgttcgacttgaagacaaagtacgatgaagaaaccacagctaaagcagatgagattgagatgattatgactgatctcgaacgggctaatcagcgggctgaagtggcccagcgagaggctgagactctccgcgagcagctctcaagtgccaatcactccctgcagcttgcctcacaaattcagaaggcccctgacgtcgagcaggccatcgaagtgctcactaggtctagtctcgaggttgagctcgcggccaaggagcgagagatcgcccagctggtcgaggacgtgcaaagacttcaggcgagcttgacaaaactgagggaaaactccgcaagtcagatttcccagcttgagcagcagttatccgctaagaactccacccttaagcagttagaggaaaagctcaagggtcaggccgactacgaggaagtcaaaaaggaactcaacatcctcaagtccatggaatttgcgccgagtgaaggggccggaacccaagatgctgctaagcccctggaggtgctactcttggagaagaatcgatcattacagtcagaaaacgctgcgcttcggatctctaacagtgatttgtccggtagtgccagaaggaaagggaaggatcagcctgagtcgcgccgaccagggagtctaccagcgccccctccctcccaactgcctcggaatcccggagaacaagcttctaataccaatgggacccatcaattctcacctgccggattatcacaggactttttctcttcttctcttgcaagtccttctttaccgctcgccagcacaggtaagttcgctctgaactctctccttcagcggcagctcatgcagtctttctatagtaaggctatgcaggaggccggcagcacctctatgatcttctccaccgggccctactcaacaaattcaatttcgagtcagtcacctctgcagcaatcccccgacgtaaacggtatggcacccagcccgagtcaaagcgagtctgcagggagtgtcagtgagggtgaggaaatggatactgccgagattgctaggcaggtgaaagagcagcttatcaagcacaatatcggccagagaatattcggacactacgttctcggcctcagccaaggtagtgttagcgaaatcttggcccggcctaagccctggaacaagttaacagttagagggaaggagccttttcataaaatgaaacaattcctgtccgatgagcagaacatcttggctcttagatccattcagggacgccagcgagaaaaccctggtcagagtctcaaccggctttttcaggaggtccccaagagaaggaacggatcagaaggcaacatcaccaccagaatccgcgcatccgaaaccggatctgatgaggccatcaagagtatcttggagcaggcaaagagagagctgcaagtgcaaaaaacagcggagccagcccagccaagctctgcatctggtagtgggaacagcgacgacgcaattagaagtatcctgcagcaggcacgccgtgagatggaggcgcagcaggctgccttggatccagccctcaaacaggcccctctctcacaatcagacatcactattttgacccctaagctgctctccactagtcccatgcccactgtcagttcatatccccccctggctatctcgcttaagaagccaagtgcggccccagaggcaggagcctctgccttgcccaacccacccgcactgaaaaaagaagcacaagacgcccctggcctggaccctcagggcgctgcagactgcgctcaaggcgtcctaagacaggtgaaaaacgaagtggggaggtctggggcttggaaggatcattggtggtctgcagttcaacctgagaggagaaatgccgcttcaagtgaggaggctaaggcagaagaaaccggaggggggaaagagaagggcagtggcggatcaggcggggggagtcaaccccgcgcagaaagaagtcagctgcaaggaccctcttcttctgaatattggaaggaatggccatccgccgaatcaccgtattctcagtcttctgagctgagcctcaccggcgcgtcacggagcgagacacctcagaacagcccccttccatccagccccatagtgccaatgtctaagcctacgaagccttcagtcccgccattaactcctgagcagtatgaggtctatatgtaccaggaggttgataccatagaacttactagacaggtgaaagagaaactggccaagaacggaatctgtcagcgtatcttcggcgaaaaggtacttggtctgagccaggggagtgtgtccgatatgctaagcagaccgaagccatggtccaaactcacccagaaaggtcgggaaccattcatccggatgcagttatggctgaacggtgagctcggtcagggggtgctccctgtccagggacagcaacaaggccctgttttacatagtgtgacttccctccaggatcccctccagcagggttgcgtgtcctctgaatctactcctaaaacaagtgcgagttgttcacccgcccctgagtcccctatgagctcgtcggagtctgtcaagtctctcactgagctagtgcaacagccttgcccacccatcgaggcgtcaaaggattctaaacctcccgagcccagtgatcctcccgcatccgactcacagccaaccactcctttacccctcagcggccacagcgcgctgtcgatccaggagcttgtggccatgtctcccgagctggatacttatggcattacaaagcgtgtgaaggaggtcctcaccgacaataacctgggtcagagactgtttggcgagacaatcctgggcctgacacagggttctgtcagtgacctcttggcacgccctaagccttggcataagctgtcactgaaggggcgtgagccattcgtgagaatgcagctctggcttaatgacccaaataatgtcgaaaaactgatggatatgaagaggatggaaaagaaggcgtacatgaagcggcgtcattccagcgtaagcgacagccagccttgcgaacccccatccgtgggcacagagtacagccagggggcatcaccccagccccagcaccagttgaagaagccacgggtggtactagctccagaggaaaaggaagccttaaagagggcatatcagcagaaaccttacccaagtcccaaaactattgaagatctcgcgacacagctgaacttaaagacaagcaccgtgattaactggtttcataattacaggtcgaggatcaggcgtgagctatttattgaagagattcaagcggggtctcaggggcaggccggggcgtcggactcaccaagtgctagatctgggagagccgctccctcctcagaaggagacagctgcgacggcgttgaagcaacagagggccccggctctgcagacaccgaagagcccaagagtcagggagaggcagaaagggaagaggttccgcggccggccgaacaaaccgaacctcctccgtctggcacccccggacccgatgatgcaagggacgacgaccacgaagggggccctgtggaaggccctgggccactaccaagtcctgcgagcgccacagctacagcagcccctgcagcccctgaagacgcagccaccagtgcggctgcggctccgggcgagggccccgctgctccctccagtgctccaccacccagcaactcctccagcagctctgctccacgacggccctcatcacttcagagcctgttcggacttccagaggctgctggcgcccgcgatagcagagacaacccactccgaaagaagaaagcagctaacctcaactccatcattcaccggcttgaaaaggccgcttcgcgcgaggagcctatagagtgggaattttag

SEQ ID NO: 25693 - DNA, 2037 bp, Artificial Sequence
  Description of Artificial Sequence: Synthetic coding sequence
atggctgcaaacgtcggatctatgttccagtattggaagcgcttcgatctgcagcaactgcagagggaactggatgccacagctacagtgctagccaatcgacaggacgagtcagaacagtcaagaaagagactgatagaacagtcaagggaatttaagaaaaacacccccgaagatttgaggaagcaagtcgcccccctgctgaaatctttccaaggcgaaatcgacgcccttagcaaacggtcaaaagaggccgaggctgcttttctgaacgtgtacaaacgcctgatcgacgttcccgacccagtgcctgcattagatttggggcagcagttgcaactgaaagtccagcgtcttcacgatattgaaaccgagaaccagaagcttcgagaaactctcgaggagtacaataaagagtttgcagaggtgaaaaatcaggaggtgactattaaagcactgaaagaaaagatacgagaatacgaacagactctgaaaaaccaggccgagactatcgcactggagaaagaacaaaaactccagaatgattttgctgagaaagaacggaagttacaggagacacagatgtcaactaccagtaagctggaggaggcggaacacaaagtgcagagcctccagacggctctcgaaaagactagaactgaactgtttgacctgaaaactaaatatgacgaggaaacaacagcaaaggccgacgagattgagatgataatgacggacctcgagagagctaaccagcgagccgaagtggcacaacgcgaggcggagactctgcgggaacagttgtcttcagctaaccatagccttcagctggcctcacaaatccagaaagcacctgatgtcgagcaagcaatcgaggtcttaacccgctcaagtctcgaggtggaattggccgcaaaggaaagggaaatcgctcagctggttgaggacgtgcagcgtctccaagcgtcactcactaaactccgggaaaacagcgccagtcagatctctcagctcgagcaacaattatcagcgaagaatagcacacttaaacagttagaggaaaagttgaaaggacaggccgactatgaggaggtaaagaaagaattgaacatcctgaagagcatggagttcgcaccgtctgaaggggcagggacccaggatgccgcaaagccattggaagtcctgttactagaaaagaacaggagtctccaaagtgaaaacgctgccctacggattagtaattctgacctgtccggacgctgcgccgagctccaggttcggatcacggaggctgtggcgactgcaactgaacaaagggagctgattgcgaggctggaacaggacctgagcatcattcaatcaatccagaggccagatgcagagggtgcagcagaacaccgtctagagaagatccccgaacctatcaaggaagccacagctctgttctacggcccagccgctccggcatcaggagccttgccggagggtcaggtggactctctgctctcaatcatatcctcccagcgagagaggttccgggcaaggaatcaagagctggaagccgaaaatagacttgcacagcacacccttcaggcactgcagtctgaattggatagcctccgcgcagataatataaaactctttgagaagatcaaatttctacagtcataccctggcagaggatctgggtccgatgataccgagctgcgctattcatcccaatatgaggagcggctggatcctttctcttcattttccaagcgggaaagacagaggaagtatctgtcattgtcgccatgggataaggctactttaagtatgggccgccttgtgttgagtaacaaaatggccagaaccatcggtttcttttacacactcttcctccactgcctggtatttttggtgctctataagttagcctggtccgagtcaatggagagagactgcgccactttttgtgccaagaagttcgccgaccatctgcataaattccatgaaaacgacaacggcgccgcagcaggagatctgtggcagtag

SEQ ID NO: 25694 - DNA, 4551 bp, Artificial Sequence
  Description of Artificial Sequence: Synthetic coding sequence
atggctgccaatgtaggaagtatgttccaatactggaaaaggtttgacctccagcaacttcagcgggagttggacgcaactgctaccgtgctggcaaaccgccaggatgagagcgagcagagccgcaagcgattgatcgaacaatcacgggagtttaagaagaatacgccggaggacctgcggaagcaggtggcccctctgctgaagagctttcagggcgagatcgacgcactgagcaagagatctaaagaagcggaagccgcttttctgaacgtctacaagagactcatagacgtccccgaccctgttccggctttggaccttggtcaacagctgcagctgaaggtgcagcgcctgcacgatattgagacggagaatcaaaaactccgtgaaacactagaggagtacaacaaagaattcgcagaggtgaagaaccaggaggtgactattaaagctcttaaggaaaagattagagaatacgagcaaacattgaaaaatcaagctgagaccatcgctctggagaaggaacagaagctccaaaatgattttgccgagaaggagcggaagctgcaggaaactcagatgagcactacgagtaagctggaagaggccgagcataaagtgcagtccctgcaaacagctctggagaaaaccaggacagagctgttcgatctgaaaacaaagtatgatgaagaaaccaccgccaaagctgacgagattgagatgatcatgacagacctggagcgcgccaatcagcgggcagaggtcgcccagcgggaagccgaaactcttagggaacagctttccagcgcaaatcatagtctccaactggcatctcagatccagaaggctcctgacgtcgagcaagcaattgaggtgctgacaagatccagtctggaggtagagctggctgccaaagagcgggaaatcgcccaactagtggaggacgttcagagactgcaggctagtttgaccaagcttcgcgaaaactctgctagccaaatctcgcagctggagcagcagctatccgccaaaaattcaaccctgaagcagctcgaagagaagctcaagggacaagccgattacgaagaggtgaaaaaagagctgaacatcctgaagtcaatggaatttgcccctagcgaaggggccggaacccaggacgcagctaagcccttggaagtgctgctgttggaaaagaatcgaagcctgcagtcagaaaacgcggcactccggatatcaaactccgatctgagtgggtccgcccgtcgtaagggaaaggatcaacccgagtcccgcaggcctggatctctgcctgcacccccaccgagccaactacccagaaatccgggtgaacaggcttcaaatactaacggcactcatcagttctcacccgctggcctgagccaggatttcttctcctctagccttgcttcccctagcctcccactggcttcaacagggaagtttgctctgaacagcctgctccagcggcaactgatgcagtccttctatagcaaagcgatgcaggaggccggctctactagtatgattttctccacagggccttatagtaccaacagcattagcagccaatcacccctgcaacagtcacctgacgttaatgggatggccccctctccgagccaatccgagagcgctgggagtgtgagcgaaggagaggagatggatactgcagaaatagcgcgacaggtgaaggaacaactcatcaaacacaacatcggacagcgcattttcggccattatgtgctagggctcagccaaggatctgtgagtgagatcctggcccgcccaaagccatggaataaactcaccgtgcgtgggaaagaacccttccacaagatgaaacagttcttgagcgatgagcagaatatcctcgctctaagatctatccaaggcagacagagagaaaaccccggtcaatctttgaataggttgtttcaggaagtgcctaaacgcagaaacggcagcgaggggaacattacaacccgcatcagagcttctgagacgggctcagatgaggccataaaatctatcttggaacaggccaaacgggagctccaagtgcagaaaactgctgaaccagctcagccttcaagtgcttccggtagcgggaattcagacgacgctattagatctatcttgcagcaggctaggagagagatggaagcccaacaggcggcactcgacccggcattgaagcaggcaccactgtcacagtctgatattactatcctcactcctaaactgctgagcacttcccccatgcccactgtgtcgtcctatccgcctttagcaataagcctgaaaaagccatctgctgctcccgaagccggtgcctcagccttgccgaacccacccgcgcttaagaaggaggcgcaggacgctcccggacttgacccacagggcgcagccgactgcgcacagggcgtgctccgccaagtgaaaaacgaggtcggcaggagtggtgcctggaaggatcactggtggtctgctgtgcagccggaacggaggaatgctgccagcagcgaagaggctaaggcggaggagaccgggggtggtaaggaaaaaggatctggcggttcgggcggcggatctcagccccgcgcggaacgcagtcagcttcagggaccatcttcgagtgagtactggaaggagtggccttctgctgaatccccctactctcaatcctctgagttaagcctcaccggtgcctccaggtcggagacccctcagaattcacccttgccttcaagccctattgtgcccatgagcaaacctactaaaccttccgtaccaccgctgacgcctgagcagtatgaagtttatatgtaccaggaggtggatactattgagctcactagacaggtgaaagagaagctcgccaagaatgggatatgtcaaagaattttcggcgaaaaagttctcgggctcagccaggggtcggttagcgacatgctctctcggccaaagccgtggtctaaacttactcagaagggacgagaaccattcatccgaatgcagctttggctgaatggcgagctggggcagggggttctgcctgtccagggacagcagcagggcccagtcctccattctgtgacatctctgcaggacccactgcagcaaggttgtgtgagctcagagtctacacctaagacttcggcctcatgtagtcccgcacctgaatcccccatgtccagttctgagagtgtgaagagcctgaccgaactggtacaacagccgtgcccgccgattgaggcctccaaggacagcaagccaccagagccttctgatccaccagcgtcagacagccagccaacaacaccgctgcctctcagtggccatagcgcactatcaatccaagaactcgtggccatgagccctgaattagacacttatggcatcactaagcgagtgaaagaggtcctaacagacaataatctcgggcagaggttgtttggcgaaactatattgggccttactcagggatccgtttctgatctattggccaggccaaaaccctggcacaaactttccctgaaaggacgcgagcctttcgttaggatgcagctctggttgaacgacccgaataacgtagagaaactaatggacatgaagaggatggagaagaaggcctatatgaagcgaagacacagctcggtgagtgacagtcagccctgcgagccaccttcagttgggaccgagtactctcagggagccagcccacagccacagcaccaactgaaaaagcctcgggtggtgctcgcaccagaagaaaaagaagccctaaagcgcgcataccaacagaagccctatccgtccccaaagacgattgaagatcttgctacccagctcaacctaaaaacatccacagtaattaactggttccataattatcgctctagaataagacgggaactcttcattgaagagatacaggccggatcccagggccaagccggtgcgtcagattcacccagcgcccgtagcggtcgtgctgccccttcctctgaaggagacagctgtgacggagtcgaagccacagaagggccagggtcagctgacaccgaagagccaaaatcgcagggtgaggccgaacgagaggaagtgccacggccggctgaacagactgagcctcctccctctggaacccctgggcccgatgatgccagggatgatgatcacgagggaggacctgtggagggaccaggaccactcccatcccccgcctccgccaccgccaccgccgcccccgcagcccctgaagatgccgctacgtctgctgctgctgcaccgggcgagggaccagccgcgccatcatctgcacccccacccagtaactcgtcaagcagcagtgcaccacggcggccaagctcactgcaaagcctgtttggtctacccgaagccgccggcgcccgcgactcccgcgataatcccctgcgtaaaaaaaaggccgcaaacctgaacagcatcattcatcgcctggaaaaggcagcctctagagaggagccgattgagtgggaattctag

SEQ ID NO: 25695 - DNA, 1920 bp, Artificial Sequence
  Description of Artificial Sequence: Synthetic coding sequence
atggccgccaatgtcggatctatgtttcaatattggaagcggtttgatctccagcagcttcaggatttacggaagcaggtagcccctcttctcaagtccttccagggggagattgacgccctcagcaagcggtcaaaggaagctgaggccgcatttctcaacgtgtacaaacgtttgatagacgtcccagatcctgtccctgccctggatctaggccagcagctgcagctgaaggttcaaaggctccacgacatcgaaaccgagaatcagaagctgagggaaactctggaggagtataacaaagagtttgccgaagtaaagaaccaggaagtcacaattaaagcactcaaggaaaaaatccgagagtatgaacaaactcttaagaatcaggctgaaaccattgcactggaaaaggaacagaaactacagaacgatttcgcagagaaagagaggaaattacaagagactcagatgagcacaacctcaaagctggaggaagccgagcataaggtgcagtccctgcagaccgcccttgaaaaaactcgcacagagcttttcgaccttaagactaaatatgatgaagaaacgacagcaaaggcggatgagatcgaaatgataatgaccgatctggagcgcgccaatcaaagagcggaagttgcccaaagagaagccgaaaccctgcgtgaacagctctcatcagccaaccactcactgcagctggcatcacagatccagaaagctcccgatgtggccattgaagtcctaacacgctcttcactggaggtcgaacttgcagccaaagagcgggaaattgctcagcttgtggaggatgtgcagcgactgcaggcctctctgaccaagctgagggaaaacagtgctagtcagatttcccagctggaacagcagctctctgcaaagaatagcacacttaagcaactggaggagaagctgaagggtcaggctgactatgaggaagtcaagaaggagcttaatatcctgaaatccatggaattcgcaccgtcagagggagcaggcactcaagatgccgctaagcccctggaggtgttgctgctcgagaaaaatagatctctccagtcagaaaatgccgcattgcgaataagtaactcagatctctccggcagatgcgccgaattgcaggtgcgaatcacagaggcagtggctactgccacagaacagcgcgagctgattgcccgtcttgaacaagacctgtcgattatccaatctatacagagaccagatgccgagggtgctgccgaacataggctggagaaaatcccggaacccatcaaagaagccaccgcactgttttatgggccggccgccccagctagcggggctttgcccgagggacaagtggatagcctgctgtcgattattagctcccagcgtgaacgatttcgcgcacggaaccaggagcttgaggcagagaaccgcctcgcccaacatactctgcaggccctgcaaagcgaactagactctctcagggcggataacattaagttattcgaaaagattaagttcctgcagagctatcctggacgcggtagcgggtctgacgatacagagctgagatactcttcccagtatgaagagcgcctggaccctttctcctctttctccaagcgagagcgccagcgaaagtacctgtccctgagcccctgggacaaggcaaccttgtctatgggcaggctggtgctctcgaataaaatggctaggaccatcgggtttttctacacattatttctccattgtctggttttcctggtgctgtataagctggcttggagcgagtctatggagagggattgcgcgacattttgtgccaagaaatttgccgaccacttgcacaagttccacgagaatgataatggcgctgcggcaggggacctatggcagtag

SEQ ID NO: 25696 - DNA, 1899 bp, Artificial Sequence
  Description of Artificial Sequence: Synthetic coding sequence
atggctgccaacgtcggctctatgtttcaatattggaagcgttttgatttacagcagctacagcgggagttggacgccaccgccactgtcctggccaaccgacaagatgaatccgagcagagccgcaagaggctgatcgagcagtccagggagttcaaaaagaacaccccagaggacctgaggaaacaagtggctccactcttgaagagcttccaaggggagatagatgcattgagcaagcgctccaaggaggctgaagctgccttcctcaatgtctataaacgactgattgatgtgccagaagtgacaattaaggcactgaaggagaagatcagagaatacgagcagaccctgaagaatcaagcagaaacgatcgcattagaaaaggaacagaagttacagaatgactttgcggagaaggagcggaagctccaagagacccagatgtctactacctctaaactggaggaagccgagcacaaagtgcagtcccttcagacagccctcgagaaaacaagaaccgaattattcgacctgaagactaaatatgatgaggagactactgccaaagcagacgagatcgaaatgattatgactgatcttgaaagggccaatcaaagagccgaagttgcccagcgagaagcggagactcttagagaacagctatcttcagccaaccactctctccagctggccagccagatacagaaggccccagatgtggagcaggccattgaagtgctgactcggagcagcctggaggttgaattggcagctaaggagagggaaattgcccagctggtcgaggacgtacagagactgcaggcctctctgacgaaattgcgggaaaattccgcctcccagatcagccagcttgagcagcaactgagtgctaaaaactctacccttaaacagttggaagaaaaacttaagggtcaggctgattatgaggaagtgaagaaggagctcaatatactcaagagtatggaattcgccccatcagagggggcgggcacgcaggatgccgcaaagcctctggaggtcttgcttctggagaagaacagatcactgcagagcgagaatgctgccctgagaattagcaattctgacctgagcggcaggtgtgctgagctgcaggtgcggattaccgaggctgtggcaacagcgaccgaacagcgcgaactgattgctagactggagcaggacttatcaatcattcagtccattcagcgtccagatgcagagggggcagcagaacatcgtcttgagaaaattcccgagccaattaaggaggctactgcattgttttacggcccagccgcccctgccagtggagcactccccgaggggcaggtggattctctcctgtctattatctccagtcagcgcgagcgtttccgtgctcggaaccaagagctggaggcagaaaaccgcctagcccaacacacactgcaggcgctacagtcagaactcgacagcctgagagcggacaacattaagctatttgagaagatcaagtttctccaaagctacccaggtcgaggttccggaagcgatgataccgagttgcgatatagcagtcagtatgaagagcgactggatcccttcagttcattttctaagagagaaagacagagaaagtatctgtccctgtcaccttgggataaggcgaccttatctatgggaagattggtactgtcaaataaaatggcccggactatcggatttttctacacgctgtttctgcattgcctggtgtttctggtgttgtataagctagcatggtcggaatcaatggaaagggactgcgcaaccttctgcgccaaaaaattcgccgaccaccttcataaattccacgagaacgataacggcgccgcagccggtgatctttggcagtag

SEQ ID NO: 25697 - DNA, 2031 bp, Artificial Sequence
  Description of Artificial Sequence: Synthetic coding sequence
atggcagccaacgtaggaagtatgttccagtactggaagcgttttgatctgcaacagctccagagagagcttgacgcaacagcgaccgtgctcgcaaatcggcaggacgaaagtgagcagtccagaaaacgactcattgagcagagcagagagttcaagaagaacacacctgaggatctgcgaaaacaggtagctcccctgctgaaaagttttcagggggagatcgatgcactctcaaagagaagcaaagaggcagaagctgcttttctcaacgtctataagagacttatcgacgtcccagatcccgtgcccgcactagatctgggccaacaactgcagttgaaagtgcagaggctccatgacatcgagaccgaaaaccagaaacttcgggagaccttagaggagtataacaaggaattcgcagaggtaaaaaatcaggaggtcaccatcaaggccttaaaagaaaaaattcgcgagtacgagcagacactaaagaaccaggcagagacgattgccttagagaaggagcaaaagctccagaatgactttgctgaaaaggagcgtaaattgcaggagacccagatgagcacaactagtaagctggaggaggctgagcataaggtgcaatccttgcagacggcgctggagaaaaccagaacggagctattcgacctcaagacaaaatatgacgaggagacaacggctaaagccgatgagattgagatgatcatgaccgatctcgagagggccaaccagcgggctgaagtcgcccagcgcgaagctgagaccctgcgcgaacagctaagtagcgctaaccactcgcttcagctggcgagccagatccagaaagcccctgatgttgccatagaggttctgacacgctccagcctcgaggtggagctcgccgcaaaagagcgtgaaatcgcgcagctggtagaggacgtccaacgccttcaagcttcccttacaaagcttcgcgaaaacagcgcctcccagatctcccaactcgaacagcagctctcagctaaaaactcaactctaaaacagctcgaggaaaaacttaagggccaggccgactacgaagaagtgaagaaagagctgaacatcctgaagtccatggagttcgctccctccgagggagcgggcacccaagacgccgctaaaccactggaagtccttctccttgaaaaaaatagatctttacagtccgaaaatgccgctttacgcatttcgaattccgacctaagcggccggtgtgccgagctgcaagtccgaatcaccgaggccgtggcaaccgctaccgagcagcgcgagctgattgcacggctggaacaggatctcagcattattcagagtatacaaagacctgacgcagaaggcgctgccgaacacaggctggagaaaattcccgaacctattaaggaggccacggctctgttttatggccccgccgccccagcaagcggcgccctcccagagggacaggtggattctttgctgagcataattagctcacaacgggaacgatttcgcgctaggaatcaggagctggaggcagagaacagactggcacaacacacactccaggctttgcagtcagaattggattctctcagagctgataatatcaagctgttcgaaaaaataaagttcctccagtcctatccgggtagaggaagcggatccgatgatacggaacttagatatagcagtcagtatgaggagcgactggatccattcagcagttttagcaaacgggaacgacagcggaagtacctgagtctgagcccatgggacaaggcaacactgtcgatgggccggctcgtgctgtcaaataagatggctaggaccattggtttcttttatacattgtttctgcactgtcttgtgttccttgtgctgtataaattagcttggagtgaaagtatggagcgcgactgcgccacattctgcgcaaagaaattcgccgaccaccttcacaaatttcatgagaacgacaatggggccgcagctggcgacctctggcagtag

SEQ ID NO: 25698 - DNA, 4212 bp, Artificial Sequence
  Description of Artificial Sequence: Synthetic coding sequence
atgctttgcgtggctggggcgagattgaagcgtgaactcgatgccactgccactgttctggccaaccgtcaggatgagagcgaacagagccggaaacggttgatcgagcagagtcgtgaatttaaaaaaaatacccccgaagacctgcgaaaacaggtggcccctctcttaaaatccttccagggggaaattgacgccctgagtaagcgatcgaaagaggccgaggccgcattcctgaatgtctacaaacgtctgatagacgtccccgaccccgttccggccttggacctcgggcaacagcttcagttgaaagtgcaaagacttcatgacatagaaaccgaaaatcagaagttacgtgagactctggaagagtacaacaaggagttcgccgaagtgaagaaccaagaagtaacaatcaaagcccttaaggagaagatacgcgaatatgagcagactctgaaaaatcaggccgagaccattgccctggagaaagagcagaagttgcaaaatgatttcgcggaaaaggagcgtaagttgcaggaaacccagatgtcgaccacctccaagctggaggaggccgaacacaaggttcagtctctgcagacagctctcgagaaaactagaacagaactgtttgatctaaaaacgaagtacgacgaggagaccacggcaaaagcagatgagatcgagatgattatgaccgacttagagagggcaaatcagcgggccgaagtggcgcagcgcgaggccgagacgttacgcgagcagttgagcagcgccaatcactcccttcaactggctagccaaatccaaaaagccccagacgtcgaacaagcaattgaggttctgacaaggagcagcctcgaagtagagctcgcagcgaaagaacgcgaaatcgcacagctggtggaggacgtgcaacggctccaggccagcctgacgaagctccgagagaatagcgcatctcaaattagccaactggaacaacagctgtcggccaagaatagcacactgaagcagcttgaagagaagttgaaaggccaggcggattacgaagaagtgaagaaagaattaaacattctgaaatctatggagtttgctccttctgagggagctggaacacaggacgctgccaagccactggaagtcctactgctcgaaaagaatcgcagtttgcagtctgagaacgctgccttgagaattagcaactcagacctctccgggccatactcaaccaattccattagcagtcagtcacccctccaacagtcccccgacgtgaatggcatggcgccatccccaagccaatccgagagtgctggatcggtctctgagggggaagaaatggacaccgccgaaatcgcgcgacaagttaaggaacagctaatcaagcacaatatcgggcaaagaatctttggccactacgtgctgggcttgtcccaggggtccgtgtccgagatcctggctcgccccaaaccttggaataaactgacagtgaggggcaaagagccgtttcataaaatgaaacaattcctgtccgatgaacagaacattctggctctaaggagcattcaggggaggcagcgcgaaaatcctggtcaatcactgaacaggctattccaggaggtcccaaaaaggcgaaacggctctgaagggaacattacgacccgcatacgtgccagtgaaacaggatcggacgaagccattaaaagtattctggagcaggccaaacgagaactacaggtgcagaagaccgccgaacccgcgcaaccaagtagcgcctctggttctggaaactctgacgatgccatccgcagtatactacagcaggccagaagggagatggaagctcagcaggctgccttggaccccgcactcaaacaagctccacttagccaatccgacataacaatcttgactcctaagctactcagcacttcccctatgccaaccgtatcttcttacccacccctggccatatcattaaaaaaaccatctgccgctcccgaggccggtgcttccgcactgcccaatccaccagctctcaaaaaggaagcgcaggatgctcctggactggacccccagggcgccgctgattgcgctcagggggtgctgagacaggtgaagaatgaggtgggcaggtctggtgcctggaaggaccactggtggtcagccgtgcaaccagagcgaagaaatgcagccagttcagaggaagccaaggccgaggaaaccgggggaggcaaagaaaaaggcagtggtggttctggaggcgggagccagccgagggccgagcgctcccagctgcagggccccagctcatctgagtactggaaggagtggccatccgcagaatcgccttattctcagtccagtgaattgtccctgacgggcgcatcccgttctgaaacacctcagaatagtccgcttccaagcagtcctattgtgcccatgtctaagccgactaaaccttctgtgccacctctaaccccagaacagtacgaggtctatatgtaccaagaggtggacaccattgaacttacacggcaggtgaaggaaaagcttgcaaaaaacgggatctgccaaagaatcttcggagagaaagtgctcggcctttcacaggggtcagtgagcgatatgctttctaggcccaaaccctggagtaaactgacacagaaaggacgcgagcccttcataagaatgcaactgtggctcaatggagagctcggacaaggagtgctcccggtccaaggacaacaacaagggcccgtgttacactccgttacctccctacaggaccccctccagcaggggtgtgtctcctcagagagcactccaaagacctctgcttcctgttcgcccgctccagaatcccctatgagcagtagcgaatctgtgaagtctctcaccgaactagtgcagcagccatgtccacccattgaggcatctaaagatagcaaaccccctgaacctagtgacccccccgcgtccgactctcaacctacgactccactgccattgagcggccacagcgctcttagcatccaggaactcgtcgccatgtcgccagaactcgatacctacggaatcaccaaacgcgtcaaagaagtgctgacagataacaatctcgggcagcgccttttcggcgagacaattctaggactcactcaggggtctgtgagcgatctgctggcccgccccaaaccatggcacaaactcagccttaaaggacgagagccctttgttagaatgcagctatggctcaacgacccgaacaacgtggagaagctgatggatatgaaaaggatggaaaagaaagcctacatgaagaggcgtcacagctctgtcagtgacagccagccatgtgagcccccctccgtaggaacggaatattcccagggagcctcccctcagccccagcaccagcttaagaaaccccgggtcgtgcttgctccagaagaaaaagaagccctgaagcgcgcatatcagcagaagccatatccttccccaaagacgatcgaggacctggccactcagcttaatcttaagactagcacagtgattaattggtttcataattaccggagcaggatccggcgggagttatttatcgaggaaatacaggcgggctctcagggccaggctggagcttccgactccccttctgctagatccggcagggcagcaccaagtagtgagggcgactcatgcgacggcgtagaagctaccgagggccctggaagcgccgataccgaagaacccaagtcacagggagaggcagagagggaggaggtacccagaccggcagaacagacggagccccccccctccggaactccggggcccgatgatgctagagacgacgatcacgaaggagggcctgtagaaggacccggccctttaccttctcctgcctcggccactgccaccgcggccccagccgcacccgaggacgcagctactagtgccgcggcagcgcccggcgaaggtccggctgcccccagctccgctcctcccccatcaaattctagctccagctctgctccccgaagaccttcttcgttgcaaagtctgttcggtttaccagaagcggctggtgccagagactcccgtgacaacccactcagaaaaaaaaaggcggcaaatcttaatagtattatccacagactggagaaggccgcatccagggaggagcccatcgaatgggaattctag

SEQ ID NO: 25699 - DNA, 1989 bp, Artificial Sequence
  Description of Artificial Sequence: Synthetic coding sequence
atggcagccaacgtgggatcaatgtttcagtactggaaaaggtttgatttgcaacagttgcagagagagcttgacgctacagccaccgtgctggcaaatcggcaggacgagagtgagcaatcacgcaagcgactcattgagcagtctagggaatttaagaagaacacaccagagattgatgcgcttagcaagaggtctaaggaggccgaggccgcattcctgaacgtgtataagagactcatcgacgtccccgaccccgttccagccctggacttgggccagcagctccagttgaaggtgcagcgtctgcacgacattgagaccgaaaatcagaaactgcgagaaacactggaggagtataacaaggaattcgctgaggtgaaaaaccaggaggtgacaataaaagctctcaaagaaaagattagggagtatgagcagaccttgaaaaatcaagccgaaaccatcgcgcttgaaaaagaacagaagctgcagaacgattttgccgagaaagagcgcaagctccaggagactcagatgtccaccacctccaaactggaggaggcagaacataaggtacagagccttcagacagccctggaaaagacaaggacagagttgtttgacttgaagacgaagtacgacgaagaaaccactgccaaagcagatgagattgaaatgataatgactgacctggagcgggcaaaccagagggccgaggtggcacagcgagaggctgaaacgctgcgcgagcaactgtccagtgccaaccatagtctgcagctggcgtcccaaattcagaaggcccctgacgtggagcaggccattgaagtgctaactcgctcgagcctcgaggtcgagcttgctgccaaagagcgcgagattgcccagctagtagaggacgtacaacgtttgcaggcgagcttgaccaaactgcgagagaactccgctagccagatatcacagctcgagcagcagctgtccgcaaagaacagtaccttaaaacaattggaggaaaagttgaaagggcaggcggattatgaggaagtgaagaaggagctcaacattctgaagtcaatggagttcgcgccttctgaaggcgcaggcacgcaagacgctgcgaaaccattagaggttctgctacttgagaagaatcgctctctccagtctgaaaacgccgcacttcggatatctaacagtgatctctctggccgctgtgctgaactgcaggtgcgcatcacagaggccgttgccacggctaccgaacagagggagctgattgccaggcttgagcaggatctgtcgattatccaatctattcaacggccagacgccgagggggctgccgagcaccggctggagaaaatcccggagcctattaaagaggcaactgccctcttttacgggcctgctgccccggcatccggtgcactgcctgaaggacaggtggatagtctgctgtcaatcatatcttctcagagggagcggttccgggcccggaatcaggaattagaggccgagaatcgtttggcccagcacaccctacaggctctgcagtccgaacttgattccctgcgagccgacaacattaaattatttgagaaaatcaagtttttgcaatcttacccaggccgaggatcaggaagtgatgatactgaactgaggtattcatctcagtacgaagaacgcctggaccccttctcttccttcagcaaacgtgagcggcaacgaaaatacctatcactgtcaccctgggacaaagccactctaagcatgggtagactggtgttgagcaataagatggctagaacaattggcttcttttacacactgtttctgcattgcctggtcttcctggttttgtacaaactggcatggagtgagtctatggaacgagactgcgccactttctgcgcgaaaaagtttgccgaccacctacataagttccacgaaaatgacaacggtgctgctgctggggacttgtggcagtag

SEQ ID NO: 25700 - DNA, 4452 bp, Artificial Sequence
  Description of Artificial Sequence: Synthetic coding sequence
atgctttgcgtcgcgggggccaggttgaagcgcgagctggacgccaccgccacagtgctggcaaatcgccaggatgagagtgaacaatcccgaaaacggctcatagagcagagtcgggaattcaaaaaaaataccccagaggacctgcggaaacaagtagcaccactgctgaagtctttccagggggaaatcgacgccctgagcaagcgcagcaaggaggctgaagcagccttcctgaacgtctataaacggctgatcgacgtcccagacccggtgccggctcttgacctgggccagcagttgcagcttaaggtgcagaggctgcatgatatcgagacagagaaccaaaagttgcgagagactttagaggaatacaataaggagttcgccgaagtgaagaatcaggaggttacaataaaagccctaaaagaaaagatcagggagtatgaacagaccctcaagaatcaagccgaaactatcgcgctggaaaaagaacagaagctgcagaatgattttgcagagaaggagcgcaagcttcaggagacccagatgtccaccacctctaaactagaggaagccgagcataaggttcagtctcttcagaccgctctggagaagacccgaacggagctgttcgacctcaaaaccaaatatgacgaggaaactactgcgaaagcagacgaaatcgagatgataatgactgacctggaacgagcgaatcagcgcgctgaagtggcgcagcgcgaagctgaaacacttcgggaacagttgagcagtgccaatcattccctgcagcttgcctcccagattcagaaggcgccagacgtggagcaggcgatagaagtgctcactaggagctcactggaggttgaattagcagcgaaagaaagagaaattgctcaactcgtagaggacgttcagaggttacaggcctccctcacgaaattgcgggaaaacagcgcctcacagatctctcagctggagcagcagctctccgccaaaaattcaaccctcaaacagttggaggaaaaactgaaggggcaggctgactatgaggaggtgaagaaggagttgaatatcctgaagagtatggaattcgctccatcggagggagctggaactcaggatgccgcaaagcccctggaagtgcttcttctggagaaaaatagaagtctacaaagtgaaaatgccgcattgaggatatccaacagcgacttgagtggctccgctagaaggaaaggtaaggaccagccggaatccaggcgcccaggctccctcccagcccctccgcccagccaactgccaagaaatccaggcgagcaggcgtctaacaccaacggaacccaccagttttcacctgctggcttgagtcaagacttctttagttcatcgttggcctctccctcattgcctctggcctcaacgggcaagttcgcgcttaacagtctcctccaaaggcagctgatgcaatctttctatagtaaggctatgcaagaggccggaagcactagtatgatcttcagcacaggaccctattcaactaactctatcagtagtcagtcccccctgcagcaatctccagacgttaacggaatggccccgagcccaagtcagtcagaaagcgcaggctctgtttcggagggggaggaaatggacactgcggaaatcgcgaggcaggttaaagaacaattaatcaaacacaatattggacagaggatctttggccattatgttttgggcctgtctcagggctctgtgtctgagatcctcgctagacccaagccctggaacaaacttacagtgagagggaaggagccttttcataagatgaagcagttcctgagcgacgaacagaacatcttagctttaagaagtattcagggaaggcagagaggcaatattacaacaaggatccgagccagcgagacgggatctgatgaagccatcaaatccatccttgaacaggccaaacgggaacttcaggttcagaagactgctgaaccagcccaacctagctctgccagcggttccggcaattccgatgatgccatccggtccatactgcaacaagctagaagggagatggaggcccagcaagccgcactggaccctgctttaaaacaggcaccacttagtcagtctgacatcaccattctgacgcccaagctcctgtccacgagtcctatgcccactgtttcctcgtacccacccctcgcaatctctcttaagaagccaagtgccgccccggaagccggcgcctcagccctgcccaatcctccagctctcaaaaaggaagcacaagacgctcccggtctggatcctcagggcgccgccgattgtgcccagggcgtgctccgccaggtgaagaatgaagtgggtcgctccggggcatggaaagatcactggtggtctgcagtccaacctgagcggcggaacgccgcgtcttctgaggaggcaaaggccgaggagacgggtggcggtaaggaaaaaggatcaggaggcagcggaggcgggtcccagccccgggccgaacgcagtcagctacagggaccgtcctcaagcgaatactggaaagaatggccttctgccgagtccccttactctcagtccagcgagctgagtctgactggcgcttcaagatcggagactccccagaactcacctttacctagttccccaatcgtaccaatgagcaagcccaccaagcccagcgtccctcccctgacaccagagcagtatgaagtgtacatgtaccaggaggtcgacaccatagaactgacgcgccaagtgaaggagaagctggcaaaaaatgggatctgccagcgcatcttcggcgaaaaggtgctgggtctttcccagggcagtgtaagcgacatgctttctcggcctaagccctggtctaagctcactcagaaggggagagagcctttcattcgcatgcaactctggctgaatggtgagctgggccaaggggtcctgcccgttcaagggcaacaacagggacccgtgttgcatagtgtgactagtctccaagatcctctccagcagggttgcgtaagctccgagtcaacacccaaaacttcagccagttgctcccccgcccctgaatcccccatgtcatcctctgaaagcgtgaaatccctgacagagttagtgcagcagccttgtcctccaattgaagcgagcaaggacagcaagcctcccgaaccctcagacccacccgcctccgacagtcagcccaccacccctcttcccctgtccggccactctgccctcagtatccaggagttggtggcaatgtcacccgaactggatacttacggaataacgaagagagtgaaggaagttttgacagacaataatctagggcagcgcctttttggcgaaacgatcctgggcctgacccaaggcagcgtttctgatttgctcgcacgtccaaaaccgtggcataaactctctctgaaggggcgcgagccgttcgtcaggatgcagctatggcttaatgaccctaataatgtcgaaaagcttatggacatgaagcggatggagaagaaggcttatatgaagagacgacacagcagcgtatcagattcacagccatgtgagcctccaagcgtcgggacagagtactcccagggcgcctcacctcagcctcaacaccagcttaagaaacctagggttgttctggcaccagaggagaaggaggcgctgaaacgcgcttatcagcaaaagccatacccgtcaccaaagactatagaggatttggcaactcagctgaatctcaagacttccacagtgatcaattggttccataattaccggagcagaatccggagagagctgttcatagaagaaatacaggctggatctcaaggccaggccggcgcatcggattcaccaagcgcaagaagcgggcgggcagcaccatcctctgaaggtgatagctgtgacggcgtggaagctaccgaaggacccgggagtgccgacacagaggaacctaagagccagggtgaagcagagcgtgaagaagtgccaagacctgccgaacagacagagccccctccaagcgggactcctggcccggatgacgctagagatgacgatcacgaaggcggcccggtcgaaggtcccggcccgctgccctcccctgcctccgccaccgctaccgcagcccccgcggcccccgaagatgccgcaacttccgcggccgctgctccaggggaaggacctgcagctccctcatctgcacctcctccttctaatagtagctcgagtagcgccccgcgacgcccgagctcgttgcagagtctgttcggcttaccagaggcagcgggggctcgggattcacgagacaaccccttacgcaagaaaaaggcagcaaaccttaactcaattatccacagattggaaaaagccgcctcgagagaggaaccaatcgagtgggaattttag

SEQ ID NO: 25701 - DNA, 4350 bp, Artificial Sequence
  Description of Artificial Sequence: Synthetic coding sequence
atgctctgtgtagctggggccagattgaaaagagagctggacgctactgctaccgttctggctaacagacaggacgaatcagagcagtcacgaaaaaggctgatcgaacagtccagggaatttaagaagaatacacccgaggatctccgtaagcaggtggcacccctcttgaaaagttttcaaggggaaattgatgctctaagtaagagatcaaaagaagctgaggccgcatttttgaacgtctataagcgcctgatcgatgtccctgaccccgtgcctgcactggatcttgggcagcagctccagctaaaagtgcaacgcctgcatgacattgaaacagaaaatcagaagctgagggagaccctcgaggagtataacaaggaattcgcagaggtgaaaaaccaggaggtgaccatcaaagctttgaaggaaaagattagggagtatgaacagacactcaagaatcaagccgagaccattgccctggagaaggagcagaaactccaaaatgactttgcggaaaaagaaagaaaactgcaggaaacgcagatgtcgacgacgagcaagctagaagaggccgaacataaagtgcagtcacttcaaaccgcactggaaaaaacccgaactgagttattcgacttgaagaccaagtatgacgaagagactacagccaaagccgatgaaatcgagatgattatgaccgatctagaaagagccaatcaaagagccgaggtagcgcagcgcgaagccgaaacgttaagagagcagctgtcgtcagccaaccattcactgcagctggcttcccaaatacaaaaggcccccgacgtcgagcaggcaatagaggtgcttactaggtcttctttagaagtggaactggcagccaaggaacgtgagatcgcgcagttagtcgaagatgtgcagcgtctacaagccagtctgactaagctgagggaaaactcagctagtcagatctctcagctggaacagcaactgagcgcaaagaactcaaccttaaagcagctcgaggaaaaattgaaggggcaggcagattatgaagaagtgaagaaggagttgaatattctcaaatctatggaatttgcgccctccgaaggcgccggaacccaagacgctgcgaagcccttggaagtcctgctcttggagaaaaaccgctctctgcagagtgaaaacgcagccctccggatcagtaacagtgatctctccggcagtgcaaggagaaaggggaaggatcagccggaatctagaaggcctgggagcctgcctgctcctcccccaagtcaactgccccggaaccccggagaacaggcctcgaacacaaacggaacccatcagttttccccggccggactgtctcaggatttttttagctcttcacttgccagtccaagtctgcccttggcttcaactgggaagttcgctctgaattccttgttacagagacagcttatgcagtctttctacagtaaagccatgcaggaggccgggagtactagtatgatcttcagcacaggaccctactcgacaaacagcatctcctcacaaagccctttgcagcaaagtccagatgtcaacgggatggccccttcgcccagccagtcagaatcagccggtagcgtgtcagaaggcgaggagatggatactgcagagatcgcaagacaggtcaaggagcagctcataaagcacaacattggacaaagaatcttcggtcactacgtgctaggactgtctcaaggaagtgtgtctgagattctggcacgccccaagccttggaacaaactgactgtgagaggaaaagagcccttccataagatgaaacagtttctgtccgatgagcagaacattctcgcactgaggagcattcaaggacgccagagggctgaacctgcccagccgtctagtgcttccggatccggcaacagtgacgatgccattaggtccattttgcaacaggcaaggcgagaaatggaggcacagcaggccgcgctggaccccgcactgaagcaggctcccttgtctcagagtgatattactatcctcacccccaagctgctctccacctctcccatgcccactgtctccagttatccccccctagctatctctctcaagaagcccagcgccgcccctgaggctggggcgtcggccctgcctaacccaccggctttaaagaaggaggctcaggatgcaccgggcttggatccacagggcgccgctgattgcgcccagggggtacttcggcaggtgaaaaatgaggtggggaggtcaggagcttggaaagatcactggtggagtgcagtgcagcccgaacgcagaaatgcagcctcttcggaggaggccaaggctgaggaaacgggtggcgggaaggaaaagggtagcggaggctctggaggaggttcacagccaagggcagagaggagccagctacagggcccctctagctcggagtattggaaggaatggccctcagctgaaagcccatacagccaatcctctgaactgagtctgactggggcctcacggtccgagactcctcaaaatagtccacttccgagttcaccgatagtccccatgtccaaacctaccaagccaagtgtcccaccactgactcccgaacagtatgaggtgtatatgtaccaggaggtagacaccatcgagctcactagacaggttaaagaaaagctggcaaaaaatggcatttgtcagcgcatctttggagaaaaagtcctggggctgagtcagggttctgtttcagatatgctcagccgtccaaaaccatggagcaaactcactcaaaagggccgagaaccctttattagaatgcaactatggctcaacggtgaactgggacagggcgtgcttcctgtgcagggacaacagcaagggcccgtcctgcatagcgtaacctccctccaggaccccctgcagcaaggctgcgtgtcctctgaatcaacacccaagacatccgccagctgttcccccgcacccgagtctcctatgagttccagtgaatccgtgaaatctctcaccgagctggtgcaacagccctgtccacccatagaggctagcaaagactcaaaaccccctgaacctagcgatccacccgcaagcgattcccaacctacaactcccttgccattatccggccattctgccctgtcaattcaagaactggtcgccatgagccctgaactcgatacatacggaatcacaaagagagtgaaagaagtcttgaccgacaataacctggggcaaagactgttcggtgaaaccattctggggctcacccaaggcagtgtgagtgacctgttagcgcgacctaaaccctggcacaaactgagcttgaaagggagagagccttttgtccgcatgcaactgtggctgaatgatccaaacaatgttgagaagttgatggacatgaagcgcatggagaagaaggcctacatgaagagaagacactcatcggtgagtgatagccagccctgtgaacctcccagtgtcgggacagagtacagccagggtgcatctccacagccccagcaccaattaaaaaaacctcgggtggtgcttgctcccgaggaaaaggaggccttgaagagagcgtatcagcaaaaaccttaccccagccctaaaaccatcgaggacctggccacacaactgaacctcaaaacgtctaccgtcattaattggtttcacaactaccgcagtagaataagacgggaactttttatcgaggagatccaagcagggtcccaaggtcaagccggtgcttcagattctccgagcgccaggagcggacgcgccgctccatcatccgagggggattcatgcgacggagtggaggcaacagaaggcccaggcagtgcagacactgaggagccaaagagccaaggtgaagccgaacgagaagaagtgccacggcctgctgagcagacggagccaccccccagcgggacacccggcccagatgacgcaagggacgatgatcatgaaggagggcctgtcgaagggccaggaccactcccaagccccgcttcagcaacagcaactgccgctccagccgcacctgaagatgctgccactagtgctgcagcagctccgggcgaaggacctgccgcccccagttcagctccacctccctccaacagcagctcaagctccgcaccacgtcgcccatcctccctgcaatcccttttcggccttccagaggccgctggggcaagagattcccgggacaaccctctgcgcaagaagaaagctgcgaatcttaactctattatccatcggttggagaaagccgccagtcgcgaggagcccatcgagtgggagttctag

SEQ ID NO: 25702 - DNA, 4044 bp, Artificial Sequence
  Description of Artificial Sequence: Synthetic coding sequence
atgttatgcgtcgccggggcccgccttaagagggaactcgatgccacagcgacggtgctggcaaacaggcaggacgaaagcgagcaatcccggaaaagactcatcgagcagtccagggagttcaaaaagaacacaccagaggacctcaggaaacaggtggcaccactcttgaaatcttttcaaggggagattgacgccctctcgaagcggtcaaaagaagccgaagctgcgtttcttaacgtgtataaaaggttaatagacgtgcctgatccagttcccgccctggacctgggacagcagctacaactcaaggtccagcgccttcatgatatcgagacggagaaccaaaagctacgggagacactcgaagagtacaataaagagttcgctgaggttaagaatcaggaggtgacaataaaagcccttaaggaaaaaattcgtgaatacgagcagaccctcaagaatcaggccgagactatagcactggaaaaagagcaaaagttgcaaaacgatttcgcagagaaggaaagaaagttacaggaaacgcaaatgagcaccacttccaagctagaagaggctgagcataaagtgcagtcccttcaaaccgcactggagaaaacccgcaccgagctgttcgacctcaaaaccaagtacgacgaggagaccactgcaaaggccgatgagatcgagatgatcatgacagacctggaaagagcaaatcaaagggccgaagtcgctcagcgggaagcagaaactctgcgggagcagttgtctagcgctaaccattccttacagttagcctctcagatccaaaaggctcccgacgtggaacaggcgatcgaggtgctgactcggagctcactggaagtggagctggcagccaaagagagagaaatagcacagctcgttgaagatgtccagcggctgcaagccagcctgacaaagctccgcgaaaatagtgcttcccagatctcgcagcttgagcaacagctttcagcaaagaattctactttgaagcagctggaagaaaagctcaaaggccaggcagactatgaggaggtgaagaaagaactgaatattttgaaatctatggagtttgccccttccgagggggccggcactcaggatgccgcgaagccattagaggtactgttgctcgagaagaatcgatcacttcagtctgaaaatgccgcccttcggatcagtaactccgacctgagcggtccatacagcacgaattccatcagtagccagagcccactgcagcagtcacccgacgtgaacgggatggccccttcacctagccaaagtgagtctgccggctccgtatcagagggagaagaaatggacacagctgaaatagcccgtcaggttaaggagcagcttattaagcataacatcggacaaaggatttttgggcactacgtgcttggcctgagccaaggaagtgtgtcggagattctggctcgtcctaaaccatggaacaagttaactgtgcgaggtaaagaaccttttcacaagatgaagcagtttttatcagacgaacagaatatccttgcactgaggtctatccaggggagacagcgagctgagccggctcagccaagctcagcaagcggaagcgggaattctgacgatgcaatccgttctatattgcaacaggcgaggcgtgagatggaagcccaacaggcagccctggacccagctctcaaacaagccccgctgtctcaaagcgacatcacaatcctgaccccaaaactgctcagtacttcaccgatgccgaccgtcagcagctacccacccctggctatctctctcaagaagccaagcgccgcccccgaagcgggggcctcagccctgcctaatcccccagccttgaagaaagaggcacaagacgcaccgggattggacccacagggagcggccgattgtgcacagggggttctgaggcaggtgaaaaacgaagtggggagaagcggtgcctggaaagatcactggtggtcagcggttcaaccagagaggcgcaacgccgcatcatccgaagaggcaaaagcagaggagaccgggggcggcaaagaaaaagggagtggcggctccgggggcggatcccagccacgggcggagcggagccagctccagggaccatctagttcagagtactggaaagagtggccaagtgccgaaagtccttactcacagtccagcgaactcagtttaactggggctagcagaagcgaaaccccccagaacagccctctgccttccagccctattgtaccaatgtccaagcctaccaagccctcagtcccgcctttgaccccagaacaatacgaagtgtatatgtatcaggaggtcgacactatcgagttaacaaggcaggtcaaggaaaaactggccaagaacgggatctgccagagaattttcggagaaaaggtcttgggactcagtcagggcagtgtgagcgatatgttgtcccgtccaaagccctggtctaaactgacccagaaggggcgggaacccttcatcaggatgcagctgtggctaaacggagagctagggcagggcgtgctgcctgtgcaggggcagcagcaaggcccagtcctccactcagtgacgtccttgcaggatcctctgcagcagggttgtgtctcctctgaatcaacacctaaaacttcagcctcttgttcaccagctcccgaatctccaatgtcttcatccgagagcgtcaagtctctgaccgagttagtccagcagccttgtccgcctattgaggcttccaaggatagtaagcctcccgagcccagcgatcctcccgcatcagactcgcagcctacaacaccacttcccctgagtggacattccgctctcagtattcaagagctcgttgcaatgtctcccgagctagacacctatgggattacaaaacgagtcaaagaggttctcacggataacaatttgggtcagcgtttatttggtgaaaccatcctgggattaactcaaggatctgtctccgatctcttggcacggcctaaaccttggcacaagctctcactcaaagggagggaaccatttgtgaggatgcagctctggctcaatgaccccaataacgtggaaaagcttatggacatgaagaggatggaaaaaaaagcctacatgaagcggcggcatagttccgtgagcgactctcaaccatgcgagccccctagcgtggggactgaatactcccagggagcttccccacagccccagcaccagctgaaaaaacctagggtggtactcgcccctgaagagaaagaggccctgaaacgagcctaccaacaaaaaccataccctagtcccaagacaattgaggacctagctacccagctgaacttgaaaacatccacggtaattaattggttccataactatcgcagccggattcgaagagaactatttattgaggagatacaggcaggttcccagggccaggctggggcctccgactctcctagcgcccggtctgggcgggctgctcctagctccgagggtgactcatgcgacggtgtggaggccaccgagggcccagggagcgctgatacagaggaaccaaagagccagggcgaggctgaacgcgaagaggtacctaggcccgcggaacaaactgagccaccaccctccgggacccctggccccgacgacgccagggatgatgaccatgaaggcgggcccgtggaaggccctggtcccttgccgagtcccgcatcagctacggctactgcggctccagctgcacccgaggacgccgcaacgtctgccgcagccgctcctggggagggtcccgcggctccaagcagtgctccaccaccctcaaattcgtcctcttcctctgcgccccggcggccctcctccttgcagtccctgtttggattacccgaagcggctggggcccgggactcaagagacaacccactccggaaaaagaaggccgcgaatttgaacagtatcatccacaggctggagaaggcagccagcagagaagagcccatcgagtgggagttctag

SEQ ID NO: 25703 - DNA, 1902 bp, Artificial Sequence
  Description of Artificial Sequence: Synthetic coding sequence
atgaagatatcagcatggctgatgtgcgctagaggcaaggacctgcggaagcaggtggcccctctgctgaaaagcttccagggtgaaattgacgcgctaagcaagcgatcaaaggaagccgaggccgcgtttctgaatgtctataaacgccttattgacgtccctgacccagttccggcactggacctggggcaacagttgcagcttaaagtacagcgcctgcatgatatcgagactgaaaaccaaaagctcagggagacattggaagaatataacaaagagttcgctgaggtgaagaatcaggaagtgacaattaaagctctcaaggaaaaaatcagagaatacgaacaaacgttgaagaaccaggctgagaccatcgcgcttgaaaaggaacagaagttgcagaacgacttcgccgaaaaggagcggaaactccaggagactcagatgtcgacgaccagcaaattggaggaagccgagcacaaggtgcagtcattgcagacagctctggagaaaacacgcactgaattgtttgacctgaagacgaagtatgacgaggagacaacagcgaaggccgacgaaatcgaaatgatcatgacagatttagagagagccaaccaaagagctgaggtggcccagcgggaggctgaaacactgcgggaacagctgagtagcgctaaccactcactgcagttggcctcacaaattcaaaaagcaccggatgtcgagcaagccatcgaagttctcacccggtctagcctggaagtagagttagctgccaaggaaagggagatcgcacagctcgtggaggacgtacaacggcttcaggctagcctaacgaaactgagggaaaacagcgcgtcccaaatctcacaattagagcagcagctatcagcgaagaactccactctgaaacaacttgaagagaagctaaaaggccaagcggactacgaagaggtcaaaaaggaactgaatatcctgaagtctatggagtttgccccttctgagggcgcgggaacacaggatgcggcaaaacctctggaagtactcttgcttgagaagaatagatccttacaatctgagaacgctgcactgcgcatttcaaactccgatttgtccggcaggtgcgcagagcttcaggtaaggataaccgaagctgtagcaaccgcaaccgaacagagggaactaattgcgcgcctggagcaggaccttagtattatccagagtatccagagaccggacgccgagggcgcagccgaacatcgactcgaaaagattccggagcctattaaggaggccacagccctgttttatggccccgccgcgccagctagtggggcattacccgaggggcaggtggactctctgctgagtatcattagttcccagagggagaggttccgggcaaggaaccaggaactggaggccgaaaatcgcctggcccaacatacgctgcaggcacttcagtcagagcttgactcacttcgcgcggacaacattaagctctttgagaagattaaatttctccagagctatcccggacgcggatccggtagtgacgatacagagctcagatactcctcccagtacgaggagcggctcgatccattctccagcttcagcaagcgcgaacgccaaaggaagtacttgtctctgtccccatgggacaaagctacactgtccatggggaggctggtactaagcaacaagatggcccgtacgattggcttcttttacaccttgtttctgcactgtcttgtgtttctcgtgctgtacaaactggcatggtcagagtccatggaaagggattgcgcgaccttttgtgccaagaaattcgctgatcatctgcacaagttccatgaaaatgataatggcgctgcagctggcgacctgtggcagtag

SEQ ID NO: 25704 - DNA, 2079 bp, Artificial Sequence
  Description of Artificial Sequence: Synthetic coding sequence
atgagcgccggaaccggaaagggtgggccccagacacctgtcgagtccccaaccgcaagctccaaacttcctcaggcgcactggctgtgctcccctggtattaaaagagagctcgacgctactgcaacagtgcttgctaacaggcaggatgagtctgagcagagcaggaagcgcctcatcgaacaatctcgggagttcaaaaagaatacgccggaggaccttagaaaacaagtggcgcctctgctcaagtctttccaaggggagatcgacgccttatcaaaacgctccaaggaggctgaggccgcgtttttaaatgtctataaaagactaattgacgtcccagacccagttcctgccctggacctggggcagcagctacagcttaaggttcaacggttacacgatattgaaaccgagaaccagaagctgcgcgaaaccctggaggagtacaacaaagaatttgcagaggtcaaaaaccaggaggtaaccattaaggcacttaaggaaaaaatccgcgagtacgagcaaacgctgaagaatcaagctgaaaccatagcacttgagaaggagcagaaattgcagaatgactttgccgaaaaagagaggaaactgcaggaaacccaaatgtccacaacctctaaactggaagaagccgagcacaaggtgcagagtctgcagacagccctagaaaagacccgcactgaattgttcgatctgaagacaaagtacgacgaagaaaccaccgccaaagcagacgagatagagatgattatgacagatctggaacgggctaatcaacgagcagaagttgctcagcgcgaggccgagactctacgcgagcagcttagctcagcaaaccacagccttcagctcgcgtcacagatccagaaagctcctgacgtggagcaggccatcgaagtgttgacaaggagctccctggaggttgagctggccgccaaagagcgtgagattgcccagctggtggaggatgtgcagcgtttgcaggctagtttgacgaagctgcgagaaaattccgccagtcagatctcgcagctagaacagcagctgtcggcgaaaaatagtacattaaagcagctagaggagaaacttaaaggacaggcagattacgaagaagtgaaaaaagaactcaatatcctcaaaagcatggagtttgctcctagcgaaggggccgggacccaagatgccgcgaaacccctggaggtgctgctcttggaaaaaaatcgaagtctgcagtcagagaacgccgcacttcgaataagcaattctgacctgagcgggcggtgcgccgagctccaggttcgcatcaccgaggcggttgcaactgcaactgaacaaagggagttgattgctcgcctggaacaggacctgtctattattcagtctattcagagacccgatgcagaaggcgctgctgaacacaggctcgagaagatccctgagcccatcaaggaggcaacagcgctgttttacgggcccgctgctcccgcaagcggcgcacttcctgagggccaagtcgacagcctactgagtatcatctcctcccagagggaaaggtttagggccagaaatcaagaactcgaagccgaaaatcgcttggctcagcacaccctgcaggccctgcaatcagagttggactctctcagagctgacaatatcaagctgtttgaaaaaatcaaattccttcagtcctaccccggacggggctccggctctgacgataccgagctccgatacagctctcaatacgaagagaggctggatccattctcatcgttctcaaagcgcgaaaggcaacgcaagtatttgtctctaagtccctgggataaggcaacactgtctatgggtcgattggttctgtccaataaaatggctcgcaccattggctttttttacaccctgttcctgcattgcttagtcttcctggtcctctataagctggcttggtccgagtcgatggaaagggactgcgcaacattctgcgctaaaaagttcgcagatcacctacataaatttcatgaaaatgataacggagcagctgcaggggacctgtggcaatag

SEQ ID NO: 25705 - DNA, 1719 bp, Artificial Sequence
  Description of Artificial Sequence: Synthetic coding sequence
atggatcgtgcaggagcagatatgtgggctagtacttttacactggctatggccgaacgtaagccacaagacgtttgggtgctgttgcctgaacattctttggtgcccggatgtctggacgggggcggagtccagtacttgctcgtcgggctgtctagactccaatgcgggcattgccccgggacttgggattcagctcacgtgcacgttctgtttcatctttggtgggaccgagccagccacagaggccttgtgaaaatgagaatctggggtcagcgatgtagactctgtcctgctcctggcgactgccaagttcgcccccctggtgaacagccattcctgagtaggctagtgctgcacattttgcaggactgttacggtgatggacctggtcctgcacgtcatccccgggaggcttacgagggatgctgcgaggcttgcgagttaggggtttgcttccttcaaaaggctcctgatcccgcttggtctgccaacgctactaagggtaattttccagcgaccgcctggggtggcacaggaacagtgagccgaggcaaacccctgagtacgcccggcgatgatctgggtaaaggaggagtcgttatcgccatccctttctctctcgtgggcacctctaacgatcaggtgcctattgccgaggggccggctccgccggctggggcaagcctgccagtgactggatcatgcgaggccctggtaattgggcagggttcaatatttctgtctggtgacagtgtcgccatgccaggcgggaagggctttcctgttgctattggcgacccgctttttcatggacctggcctgcttggcagttccatacagacttttgaattgaagggcttcttgttcaaaggaagggggtccctatgttctcccgtgggtgtcgcgcagggatggggacccattagcctaaacaacggtctcgttcctgttgggaagcatacccccactgtcttctactgtgtggggctgagcgccagtggcgagggctctttaactttcccttcctcactgactagtattttcaccaataccctgagcgagcctactgacggacccgtcgctaccaaggaggcctctatcacttttccgttcatcttcacagacgtgaaggatgctgtcgctgaagtcgccgaaggcaacggaaaagagggtggagggcaaggcctcgtgcctgtcggccacgacgccctcccagagactaatgcgggagggttgcctagccaagtaaagggatctctggccttacctttccctgccgacgttcagggcaaggatgcatttacagatattaccgaaggtaaagaaaaggaagggggactagtgactgctggccacgatgccccgctcgaggcaaatgctgaaggtccaatcactgtgtccgagggatgtatcactatccccttcgctgtttttgatgttatcaaacgcaagggggggggtcacgtggcttacgggccacaaggaaatggctgcttttcccaaggatactatcagaaaagacagctgcgaagtcgctttcataaggcgaggtgcggctgccgacgggaggaggatgagcgacctgggcgggcatgtcgaaggccccacgctgagccctatgaagacttttggatttgggtttcaatgacagtctgcgtgttttggctgatgtgtatgtgtaggctcaaccccggcatatatccccagcaggtttag

SEQ ID NO: 25706 - DNA, 1728 bp, Artificial Sequence
  Description of Artificial Sequence: Synthetic coding sequence
atgagccaagacacaaaagtaaagacaacggaaagtagcccacccgctcccagtaaagcacgcaagctgctccctgttctggatccatctggcgattactactactggtggctgaacaccatggtcttcccggtaatgtataacctcatcatccttgtgtgccgagcctgtttccctgacctgcagcacggctacctggttgcttggctggtgctggactataccagcgatctcttatacctgctggacatggtcgtgcgctttcacaccgggtttctcgagcagggcattctcgtcgtcgataagggaagaatatccagcagatacgtgcggacttggagttttttcctcgacctcgctagcctcatgcccaccgatgttgtctatgttcggctcgggccccacacccccacacttcgcctgaatagattccttcgtgctcctcggttgttcgaggctttcgatcggaccgagactagaaccgcctatcctaacgcgttccgtattgccaaactaatgctgtacatttttgtggtgatccactggaactcctgcctgtatttcgccctcagcagatacctgggtttcggacgagacgcctgggtttaccccgaccccgctcagcccggtttcgagcggctgcggcgccagtatttatattctttctacttttcaactttgattctgacaacggtgggagatacaccaccgcctgccagagaggaggagtaccttttcatggtgggagatttccttctggccgtaatgggctttgctacaattatggggagcatgtcatcagtgatctataacatgaacacagcagatgcagcattctatcctgatcatgccctagtaaagaaatacatgaaactacagcacgttaacagaaagttggagcgccgggtcattgactggtatcagcacctccagattaacaaaaagatgaccaatgaagtggccatcctgcagcacctaccagaaaggctccgtgcagaggtcgctgtgtcagtacacctttccacgctgtcccgggttcaaatctttcagaactgtgaggctagcctgctagaagaactcgttttgaagctgcagccacagacatactcccctggagagtacgtttgcaggaaaggtgacatcgggcaggagatgtatatcatcagagaaggccagctggcagtggtcgcggacgatggtatcacacagtacgccgttctcggcgccgggttgtactttggcgaaatctccatcatcaatatcaagggaaacatgtccggcaatcggcgaacggctaacataaagtcactggggtactccgacttgttctgcctatcaaaagaagatctgagggaagtgttgagtgaataccctcaggcacaaacaatcatggaggagaaaggcagggagatactgctaaagatgaataagttggacgtgaacgctgaggccgcagagatcgccttacaggaagccaccgagtcccgactgcgtggactcgatcagcaactcgacgacctgcagaccaagttcgcccgcttactggcggagttggaatcctccgccctaaagattgcctatagaatagaacgtctggagtggcagactcgtgagtggcctatgccagaagatctggcagaagccgacgacgagggagagccagaagagggtactagtaaagatgaggagggtagggcctcgcaggagggcccgcctggtcctgagtag

SEQ ID NO: 25707 - DNA, 1164 bp, Artificial Sequence
  Description of Artificial Sequence: Synthetic coding sequence
atgatggacgagccatggtgggagggtcgcgtggcttccgacgtccactgcaccctgagggagaaggaattgaaactacctactttccgtgctcactcccccctccttaagtcgcgcagattctttgtagatatactgacgctgcttagcagccattgccagttatgcccagcggcgcgacatctcgctgtctatctgctggaccacttcatggacaggtacaatgttactaccagtaaacagttgtatacagtggctgtcagttgtctactgctggcatcgaagttcgaggatcgggaagaccacgtgccgaaactcgagcagatcaactccacccgcatcctctctagccagaattttactctcaccaaaaaggaactcctgtctactgagttacttctgctcgaggccttttcctggaacctttgtttgcccacccctgctcacttcttggattattatctactagcctcagtgtcgcagaaggatcatcactgccacacatggcccacaacctgtcctcggaagacaaaagaatgcctcaaggagtatgcccattactttttagaggtcacactacaagatcacatcttttataaattccagccgagtgtggtcgccgcggcctgcgtgggggcatcaaggatttgtttgcaactgtctccctactggacacgtgacctgcagcgcatatcatcctactcacttgagcacctgtctacatgtatcgaaattctgctggttgtctatgataacgtgctgaaagatgccgtggctgtgaagtcgcaggccctggctatggtcccaggcacccccccaacaccaacccaggtcctgttccagccaccagcctacccagccctaggtcagcccgctaccactctagcgcagttccaaacccccgtgcaggatctgtgcctggcctaccgtgattctttgcaggcccacagaagcggctccctacttagcggtagcactggctcttctctgcatactccataccaacctctacagccactggacatgtgccccgtgcccgttcctgcttccctctcgatgcatatggccattgcggccgaacctcgtcattgcctggccacgacctatgggtcgtcttacttcagtgggagccacatgttccccaccggttgtttcgaccggtag

SEQ ID NO: 25708 - DNA, 1308 bp, Artificial Sequence
  Description of Artificial Sequence: Synthetic coding sequence
atgatggatgagccatggtgggaggggcgcgttgcatccgacgttcactgtacccttcgggaaaaagagctgaaattgccaacattccgcgcccattcccccttgttgaaatctcgtaggtttttcgtggatatcctaactctcctgtcctctcattgccagctgtgtcccgcagcaagacacctcgccgtttacctactagaccatttcatggatcggtacaacgttaccacttccaaacagctgtacactgtcgctgtctcctgcctattattggccaatggagtaagtctgctgtctcctcgcctgaaatgcagcgggatgatctccgctcattgcaacctgcatctcccaggcagttctaactcaccggcgtctgccccacacccaccgccgactccaccccaagttgccgagacgaccggcaaattcgaagatcgcgaagatcacgttcctaaactcgagcagatcaacagcacccgcatccttagcagtcaaaactttacccttaccaagaaagaactgctgtcgactgaactgctactgttagaagcatttagctggaatttgtgcttgcccacccctgcacactttttggactattaccttctggcctccgtctcacagaaggatcatcactgccatacctggccaacgacctgccctagaaagaccaaagagtgcctcaaagaatacgctcattattttctcgaagtgactttgcaggaccatattttctataaattccagccctcggtcgtagctgccgcctgtgtcggcgcaagccggatctgtttgcagttgagtccttactggacacgtgatttgcagaggattagcagctactccctcgagcacctgagtacttgcatagagatcctgctggtggtctacgataatgtactgaaggatgccgtggcagtgaaaagccaggctctggccatggttcctggaacacctcctacaccaacacaggtgctattccaacctccagcatatcctgctctgggtcagcctgccaccaccctggctcagttccagacccctgtgcaggatctttgcctggcctatcgcgactctctgcaggctcatcggtcaggaagtttactgagcgggtcaactgggtcatcattgcacacaccatatcagccactccagcctctcgacatgtgcccggtcccagtgcccgcgtctctctctatgcacatggccatcgccgcagagcccagacactgcctggccaccacgtacggctctagttacttctccggctcacatatgtttccaaccgggtgcttcgaccgctag

SEQ ID NO: 25709 - DNA, 501 bp, Artificial Sequence
  Description of Artificial Sequence: Synthetic coding sequence
atgaggcatacctcaaagcgcaagccccagtattacgaggctgagatggtgctgaagtattacaagcatctggaagaaggttctgtgagcctctgctgtcctggatggagcgccgtggcccaaagcagactaactgcagcttcaaccttcggcgcccaggttatactgttatttcagctgtcggaacagctcaggcttcaggagctgaagttgcccacgtttagagctcacagtccactcctcaagtccaggcggttctttgtggatattcttactcttctttccagccactgccagttgtgcccagccgcacggcaccttgccgtctatttgcttgaccactttatggataggtacaacgtcactacctcaaagcagctttatacagtagctgtatcatgtctgttgcttgcctcacgcaataagggaagtggaagtcctgtccccacgcgctcagctcaacagtgtaggcagacctgggccaggggttctccctggtag

SEQ ID NO: 25710 - DNA, 759 bp, Artificial Sequence
  Description of Artificial Sequence: Synthetic coding sequence
atgatggatgaaccatggtgggaggggcgagttgctagtgacgttcattgcactcttcgcgaaaaagagctcaagctccctacctttcgtgcacacagtccactactcaagtctcgccggttttttgtagacatcctgaccttactatcctcgcattgtcaactgtgcccagccgcaagacacctggccgtgtacctgcttgatcacttcatggaccgctacaacgtaactaccagtaagcagctatatactgttgccgtgtcttgtctgcttctggcttcaaaatttgaagatcgggaagaccatgtgccaaagctggaacaaattaactctacacgcattctctctagccagaatttcactttgaccaaaaaggagctgctgtctaccgagctcctgctgctcgaggcctttagctggaatctctgcctcccaacacctgcccatttcctggattactatttactcgcgtcggtctcccagaaggaccatcactgccatacctggccaactacctgtccccgcaagactaaagaatgtctgaaggagtacgcccattatttcctagaagtgacgcttcaggatcacatcttctacaaatttcagccaagcgtggtggccgcagcctgtgttggggcatcccgtatttgcctgcagctgtcaccatattggactagggatctacaaaggatttcgagctattcactcgagcatctgagcacgtgtattgagatcctgctggtcccgttatttaggtag

SEQ ID NO: 25711 - DNA, 756 bp, Artificial Sequence
  Description of Artificial Sequence: Synthetic coding sequence
atggatgagccttggtgggaggggagagtcgcatctgacgtgcattgtacccttagagaaaaggagctcaagctgcccaccttccgggctcacagtccactgcttaagagccgccgattttttgttgacattctgaccctgttgagcagccactgccaactctgtccagctgctaggcatctagctgtgtatctcctggatcatttcatggaccgatacaacgtgaccacttccaagcagctttacactgtcgcagtgtcttgccttctcttggcctctaaattcgaggaccgagaagaccacgtgcctaaattggaacagataaatagcactagaatcctaagctcccaaaacttcacacttacaaagaaggagttgctgtctacggagctgctcctcctcgaggcctttagctggaatttgtgtctgcctactcccgctcacttcttggactattacctgctggcttccgtatcccagaaggaccaccactgccacacatggcctaccacatgtccccggaagaccaaggagtgtttgaaggagtatgcccactatttcctcgaagtgaccctacaagatcacatattttataaattccaaccctcagtcgtggcggccgcgtgcgtaggtgcctctcggatttgcctgcagctgagcccctattggacccgcgacttgcagcgcatttcttcatattccctcgagcacctttctacatgtattgagatcctcctggtgcccctgttcagatag

SEQ ID NO: 25712 - DNA, 1233 bp, Artificial Sequence
  Description of Artificial Sequence: Synthetic coding sequence
atggacctcactgggctgcttctggacgaagaaggcacattttcactggcggggttccaggactttaccttcttaccgggtcaccaaaaactctctgcaagaattagacggcggctgtactatgggtgggattgggaagctgactgtagcctggaggagctgtcctcacctgtggccgacatcgccgtagagctgctgcagaaggccgccccttccccgatccgccgactacaaaagaagtacgtggctcatgtgtctagggaggcctgcattagtccgtgtgcaatgatgctcgctctcgtctacatagaaagattacgccaccggaacccggactacctccagcacgtgagctcctcagacctctttctgatctctatgatggtggcatcaaagtacctttatgatgagggcgaggaggaagaggtatttaacgacgaatggggggctgctgggggcgtggcggtaccaacactcaacgctttggaaaggggtttcctctccgccatggactggcatctgtacacagatcctcgcgagattttcgaagtccttagctggcttgagtcatgtgttgcagaacagcaagggaggtggcgtggctggtatacttatacagacctatgcgtcctactggaacaacctacatggcagctggcgctggggtcattatgtcaacgacttgttaaactttcgtgcttgctggcagtggcctacgtgtcgtctgtcgccctcgcggtagcatccgtcgcggtgattcatcaaagcctagggctttcatgcattcctacccccgggcctcccgatctggggctgacttctagatgcctgctggagccttgcatacctagcgtcccacaatgtctgcctagtttagcgaacgtgtcgtcctgtcttgaggggagtatgggacttcggagcctgtggggttctctcctggctagccttactcctccccccctgcctccccccgaccctcctgccccccccactttactacataactgccacctctgccaaaaacttcagcgcgacagccctacatgtcacgcctgtctccaccctaatcggacagtcccaactgctttatcttccccatggtaccatacttacggtctggcgcccccttggccatggagtccggtcctgctttcactgccgcagccccagcagtgctcccttttttcggtgatggaattagcacggctaaaatcattcgtctttcccggctag

SEQ ID NO: 25713 - DNA, 1233 bp, Artificial Sequence
  Description of Artificial Sequence: Synthetic coding sequence
atggacctcacaggcctcttgctcgacgaggaaggtaccttttcgctggctggctttcaggattttacctttctgcctggccaccaaaaattgagcgccagaatccgtcgcaggctgtactatggctgggactgggaagccgattgctcgttggaagaactctcaagccccgtggcagacatcgctgtggaactgctgcaaaaagcggcaccatcaccgattcgcaggcttcagaaaaagtacgtggctcatgtgtccagggaagcctgcatctccccgtgcgcaatgatgctggcactggtgtacattgagagattgcgtcaccgcaatccagactatctgcagcatgtttcatccagcgatcttttcttgatcagcatgatggtggcttctaagtacctttatgatgagggagaggaggaagaggtttttaatgatgagtggggagccgccggcggcgtggccgtcccaactctaaatgccctcgagcgagggtttttatctgctatggactggcatctgtatactgatccacgggaaatttttgaggtgctgtcttggctggagtcgtgcgtggctgaacagcaggggagatggagaggctggtacacctacacagacctgtgtgtgctcttggaacaaccaacatggcagctggccctgggctccctatgccagcgcctcgttaaactttcatgtctcctcgcggtggcatacgtgagcagtgtggctttggcagtcgcgagcgtggccgtgatccatcagagcttgggcctgtcatgtatccctaccccagggccaccggaccttggccttacatcgcgctgcctgcttgaaccctgtatccctagcgtccctcaatgccttccttctttagccaacgtctcaagttgtctggaggggtccatgggactccgcagtctctggggctctctgcttgcatcactgacacctccccctctgccaccgcctgacccccccgcaccccccactctcctccataattgccacctgtgccagaagcttcagagagattcacccacgtgccacgcctgtcttcaccctaatcgaacagtgcctacagccctatctagtccttggtatcacacatatggattggcgcctccatggccttggagcccagtcctcctgtcgcttccccagcctcagcagtgcagtctatttagcgtaatggaactggctagactgaagtccttcgtcttcccgggatag

SEQ ID NO: 25714 - DNA, 927 bp, Artificial Sequence
  Description of Artificial Sequence: Synthetic coding sequence
atggatcttactggattgctgctagatgaagagggaactttttcgcttgcagggtttcaggatttcacctttctcccgggacaccagaagctctcagcccgcatccgacgccggctttattacgggtgggactgggaggcagactgctccctggaagaactttcctcacccgtggccgacatagcagtcgaactattgcagaaggctgcccccagccccattaggcgccttcagaagaaatatgtggcccatgttagcagggaggcttgcatctcaccttgcgctatgatgctggcactggtttacatcgaacggctgaggcatcggaatcccgactacctgcagcacgtgtcctcatccgacctgttcctaatttccatgatggtggcctccaagtacttgtacgacgaaggagaggaggaggaggtctttaacgatgagtggggggccgccgggggggtggcggttcctacacttaatgctctcgagaggggctttcttagcgcaatggactggcacctgtacactgacccccgggagatttttgaagtgctgagctggctagagagctgcgtggcagaacagcagggacggtggcgcgggtggtacacatacacagatctctgtgtgctgctcgagcagcctacatggcagctggccctgggaagcttatgccagagactggtcaagcttagctgcctgctggccgtggcatatgtttcctcagtcgctttagcagtcgcttccgtggcagtcatacatcagagtttaggtctaagttgcattcctaccccaggaccccccgatctggggttgacatctaggtgtctgctagaaccttgcataccgagcgtgccgcagtgcctgccgagcctcgcgaacgtgagtagctgtctggaagggtcaatgggcctacgctccctttag

SEQ ID NO: 25715 - DNA, 1356 bp, Artificial Sequence
  Description of Artificial Sequence: Synthetic coding sequence
atgcacggatacttcgggtgtaatgccgctgccgaacccgggtacagtgcattcgtagggactccacagatatgcgtgaccaaaatgtccacaaggaactgccaaggaatggacagtgtgattaagcctcttgataccattccagaagacaaaaaagtccgagtgcagagaacacaatctactttcgatccctttgaaaagcctgccaatcaggtcaaacgggtgcactctgagaacaacgcttgcataaacttcaagacatcctctaccgggaaagaatcccctaaggtgcggaggcattctagcccttcttcccccacatctcccaagttcggcaaggccgatagttacgagaaactggagaagttgggagagggttcatatgccaccgtgtataagggtaagtccaaggtgaacggaaaattagtcgctcttaaggttatcagactgcaggaggaagagggtactccgttcacagcgatcagggaggcatctctccttaaaggtctgaagcatgcaaatatcgtcctgttgcatgatattatccatacaaaggagaccttgactctcgtgtttgagtacgtccatactgacctgtgtcagtatatggacaagcaccctggtggcctccaccccgataatgtgaagttgttcttgtttcagctgctgcgaggtctcagttacatccatcaacgatatattcttcaccgggacctgaagccgcagaacctgctgatctcagacactggggaactcaagcttgccgactttggcctcgccagggccaagagtgtgccctctcatacatactcgaacgaggtggtgaccctgtggtaccgtccgcccgatgtgcttcttggctccaccgagtattctacgtgcctggacatgtggggagtgggctgtatcttcgttgaaatgattcagggggtggcggccttcccgggtatgaaggacattcaggatcagcttgagcggatctttctagtgctgggtaccccaaatgaagacacctggccaggggtgcatagtctcccccacttcaaaccagagaggttcaccctgtattctagcaaaaacttaaggcaagcctggaacaaactgagctatgtgaatcatgccgaggacctggcgtcaaagctgctgcagtgttcccccaaaaatcggcttagcgcacaggccgctttatcccacgagtattttagcgacctgccaccccgcctgtgggaattgaccgatatgtcttccatctttactgttcctaatgtaaggctgcaaccagaagccggcgaatccatgagagcttttgggaagaacaattcatatgggaaatctctcagcaattcgaaacactag

SEQ ID NO: 25716 - DNA, 1410 bp, Artificial Sequence
  Description of Artificial Sequence: Synthetic coding sequence
atgtgcgatttgatcgagcctcagcccgcggagaagattgggaagatgaaaaagctgcgtagaacactgtctgaatcctttagcaggatcgctttaaaaaaagacgataccacattcgacgagatatgcgtgactaagatgtccactaggaactgccaggggatggactcagttatcaagcccctcgacacaatcccggaggacaagaaagtcagggtacaacggacccagagtaccttcgacccttttgagaaacctgcgaatcaggtcaagagagtccacagtgagaataatgcctgtatcaatttcaaaacctcctcaaccggcaaggagtcgcccaaggttaggcgccactcctcccccagctcacccacctcgcctaagttcgggaaggcggactcatacgaaaaactagagaagctcggcgaaggatcttatgcaacagtgtataagggtaagtcaaaagtcaatggaaaactggtcgcattgaaggttatcaggctgcaggaagaggaagggacaccctttaccgctatcagggaggcctctctcctgaaagggcttaaacacgcaaatattgtgctcctccacgatattatccatactaaggagaccctgaccctcgtgtttgagtacgtgcataccgatttgtgccagtacatggataagcaccctggcggcctccatcccgacaacgtaaagttatttctctttcagttgctacgggggcttagctatatccatcagagatacatcttgcatagagatttgaaaccccaaaatttattgataagcgacacgggggagttgaagctcgcagacttcggattagcacgggccaaaagtgtgccttctcacacgtacagtaacgaggtggttacactgtggtaccgacctccggacgttctcttagggtctacggagtattctacctgcttggatatgtggggggtggggtgcatctttgtcgaaatgattcagggagtggccgcctttccgggaatgaaggatatccaggaccagttggaaagaatctttttggttctcggtaccccaaacgaggacacatggcccggagtgcactctctgccacacttcaagcctgagcgattcaccctttactcttctaaaaatctaaggcaagcgtggaacaaattgtcctacgtaaatcatgcagaggacctggcttccaaattgctccagtgttcacctaagaatagactgtctgcacaggccgctctgtcccacgagtacttttccgaccttcccccgcggttgtgggagctgaccgatatgtcaagtatatttacagtgcccaacgtcaggttacagcccgaggcgggcgaatcaatgcgagcttttggaaagaataactcttacggaaaatctctctctaattccaaacactag

SEQ ID NO: 25717 - DNA, 1023 bp, Artificial Sequence
  Description of Artificial Sequence: Synthetic coding sequence
atgctggccctgaccttaaggcctccccccctcgctaagtcacatctgaagcttggggggacccctgctcctgcacgcgtgaacgggaagctcgttgccctgaaggtgatcaggctgcaggaagaagagggaactccattcactgctatccgcgaggcttccctgcttaagggtctgaagcacgctaatatcgtacttctgcatgatatcatccacaccaaagagacgctaacacttgtctttgaatatgtgcacacagacctatgccaatacatggacaagcacccgggaggactccaccctgataatgtgaagctgttcttgttccagctgctgcggggcttgagctatattcatcagagatacatccttcatcgggacttaaagccccagaacctactgatttctgatacaggagagttgaaactcgcagacttcgggctagctcgtgctaagtcggtgccctctcatacatattctaatgaggtggtcacattgtggtaccgacctccggacgttctgctggggtctaccgagtactccacctgcctggacatgtggggcgtcggctgcatttttgtggagatgatccagggagtagccgcattcccgggcatgaaggatattcaggaccaattagaacgaatcttcctggttctcggtacgcccaacgaggatacgtggcccggagtgcattccctgccccatttcaaacccgagcggttcactctgtacagttctaaaaatcttcgccaggcttggaataagctgagctacgtcaatcacgccgaagacctcgcctctaagttgctacaatgtagcccaaaaaatcggctgtccgcccaggcagccctctcacacgagtacttctctgacctcccaccacggctctgggaattgacagacatgtcctccatctttaccgtgcccaatgtgcggctccagcccgaagctggagagtccatgcgcgcgtttggaaaaaataatagctacggtaaaagcttgagtaattctaaacattag

SEQ ID NO: 25718 - DNA, 1353 bp, Artificial Sequence
  Description of Artificial Sequence: Synthetic coding sequence
atggaccagtattgtatattaggaagaatcggcgagggtgcccacgggattgttttcaaggctaaacacgtcgagactggggagattgttgcattgaagaaagttgccttgcggaggctggaggatggtttcccgaatcaggcacttcgggagattaaggcgctgcaggagatggaggacaaccagtacgtcgtgcagttgaaagctgtgtttcctcacgggggtggctttgtcttggcttttgagttcatgctgtctgatttggcagaagtagtgcgtcacgcccaacgacctttggctcaggctcaagtgaagagctatctccagatgctcttgaagggggtcgccttttgccacgctaacaacatcgtacatcgagatcttaagcctgctaatttactgattagcgcatctggtcagcttaagatcgctgatttcgggttggcaagagtgtttagccccgatgggtctaggttgtacacccaccaggtggctacaaggtctgtgggctgcatcatgggcgagctactcaatggcagccccttgtttccgggaaaaaatgatattgagcagctctgctatgtccttaggattcttggaacgccgaacccgcaggtgtggccagagctgaccgaacttcctgactataacaaaatcagcttcaaggagcaggtgcctatgccactcgaggaagtcctacccgacgtgtctccacaggcactggatcttctgggccagttcctactctatccacctcaccagcgcattgctgcctccaaagccctcctgcaccagtacttcttcacagcacctctgcccgctcaccccagcgagctcccaatcccccagcgtctcggtggacctgcccccaaggcacaccctgggcccccccacatccacgacttccatgtagataggcccttggaggtcgccgtggaacctcgggcagactctgcacttcaccctggcggcgtgcgatcctggccctggagtagactgcctgcaccacaagatcatagtgtgcatctatttctttgccatctccctggctttacactgcagggccttcccatggcaacagttgggccacatcataccctacccctgagtccctgcgaggggtggtcccggggccgcggacacgttccgtctcaggagtacgaaaatattcaatcatcaagaggcgattcctggcctgtgctgggagaaccctacctgctgtgtgccacagatgtgccgataaggaccgtgagcagcgcagcctctcaagggctccatatgcagaacgatgacgcctgcctcggcgccgcccctgagtgttgcctcctggtgaaggagaaatgcagagaatag

SEQ ID NO: 25719 - DNA, 1041 bp, Artificial Sequence
  Description of Artificial Sequence: Synthetic coding sequence
atggaccagtactgtattctggggcggatcggggagggcgctcatgggatcgtattcaaggccaaacatgtcgaaacaggcgaaattgttgccttgaagaaagttgcactccgccgcttggaggacggtttccctaaccaagccctgcgtgagattaaagccctccaggaaatggaggataaccagtatgtggtgcaattgaaggcagtgttcccgcacggcggcgggtttgtgttggccttcgagtttatgctctcggacctcgctgaggtggtgagacatgcgcagagacctcttgcccaggcgcaggttaaaagctacctacagatgcttttgaagggggtggcattttgtcacgcaaataatatcgtccatagagatctgaagcccgcgaacctgttaatctcagccagtgggcagctcaaaatcgccgacttcgggcttgcacgagtgttctctccagacgggtcccgactgtatacacaccaggtggccacaaggtggtatcgggctcctgagctcctgtacggcgcaagacagtatgatcagggagttgatttatggtctgttggctgtattatgggagagctgctcaatggttcgcccctgttcccaggcaagaatgatatagagcagttatgttatgttttgcgaattttgggaactcctaatcctcaggtttggcccgagctcacagaactccctgactacaacaagatatcctttaaggagcaagttcccatgcctttagaggaagtgttgcctgatgtgagtccccaagcactggacctgctcggccagtttcttctctacccgccgcatcagcgaatagcagcgtctaaggctctactacaccaatacttctttaccgccccactgcccgctcaccccagtgaactgcctatccctcagcgactgggaggacccgctcctaaggcacaccccggcccccctcacatccacgacttccacgttgatcgtcccctggaggagtccctgctgaatcctgaattgatcaggccctttatactggaggggtag

SEQ ID NO: 25720 - DNA, 1017 bp, Artificial Sequence
  Description of Artificial Sequence: Synthetic coding sequence
atggatcagtactgcatactcggacgaattggcgagggagcccacggtatagtcttcaaagctaaacacgttgagccccgggtcgggtggcagtgtctgccttcaattctgcagacgggcgagattgtcgcgcttaagaaggtggctctgcggcgcctggaggatggctttccaaaccaagccctgagggaaattaaagcactacaggaaatggaagataaccaatacgtagtgcagctgaaggcggtctttccccacggcggtggctttgttctggccttcgagttcatgctctctgaccttgccgaagtagtgagacacgcccagcgccctctcgcccaagcccaggttaagtcataccttcagatgctgttgaaaggtgtcgcgttttgtcacgccaacaacattgtgcatagagatttgaaaccggcaaacctcctaatctcagccagcggccagctgaaaatcgcagactttgggctggcacgcgtgtttagccctgacggcagcagactgtacacgcatcaggtggcaactcgatccgtgggatgcattatgggtgaactcctgaacggatctcccctattcccaggaaaaaacgacatcgaacagctgtgctatgtactccggatcctcggcaccccaaatcctcaggtctggccagagctgactgaactgcctgattacaacaagatttcctttaaagaacaggtaccgatgccactggaagaggtcctgccagacgtgagcccgcaggccctagatctgctcgggcagttcctcctatatcctccacatcaacggatcgctgcctcgaaggcactactccaccagtatttcttcacagcgccactgcccgcccatccctctgaactgcctattccccaaagacttggcggacccgctccaaaggctcatccaggccctccacacattcacgacttccatgtggatcggcctttggaggagtcattacttaatccggaactcatccgtccttttatccttgagggctag

SEQ ID NO: 25721 - DNA, 732 bp, Artificial Sequence
  Description of Artificial Sequence: Synthetic coding sequence
atggatcagtactgcattcttgggagaattggcgagggtgctcacggtatcgtgttcaaagctaagcacgtcgaaacgggggaaatagtcgcacttaaaaaggtcgccctccgccgattagaagacggattcccaaatcaggctcttcgcgaaatcaaagccctgcaggagatggaggataatcagtacgtcgtgcagctgaaagcggtgttcccccatggggggggatttgtccttgctttcgagtttatgcttagcgatctggccgaggttgtccggcatgctcagcgacctttggcccaggcacaagtaaagtcttatcttcagatgttgctgaagggtgtggctttttgtcacgccaacaacatagttcacagggacttgaagccagcaaaccttcttataagtgcgtcaggacagctcaaaattgcagatttcggacttgcgcgagttttcagccccgacgggagtcggttgtatacccaccaagtcgccacccgctcgtctctctcttgtcggacgaccacacgcagtcctctccgaagccgatgtccttgtccttggcggcggtgttgcctgacttcactcccacggcactggatatgttgggtgaactcattcagcaccctcctcactagcgcgtctcaacttcctcggctgagctcgatcagtacaagctctcagctaccctgtctgccaatacacctctcttgtcgctttctctccgtttag

SEQ ID NO: 25722 - DNA, 978 bp, Artificial Sequence
  Description of Artificial Sequence: Synthetic coding sequence
atggatcagtattgcatcctaggaaggatcggtgaaggagcgcatgggatcgtgtttaaggccaaacacgtggaaacaggagaaattgtggctctaaaaaaagtcgctttacggagattggaggacggtttcccgaaccaagccctgcgagaaatcaaagctctgcaggaaatggaagacaaccaatacgtcgtgcagcttaaagcagtcttcccacacggggggggatttgtgcttgcctttgaattcatgctgagcgatctcgccgaggtcgtccgccatgcccagagaccattggcacaggcccaggtgaagtcatatctccagatgctgttgaagggcgtagccttttgccatgcaaataatatcgtgcatcgggatttgaagcctgcaaacttgctgatcagcgcatctgggcaacttaagattgctgattttggccttgcccgagtgttttcacccgacgggtccagactgtatacacatcaggtcgcaacgcgaagcgttgggtgcattatgggcgaactgctgaacggctccccactctttcccgggaagaatgatattgaacaactgtgctatgtgctgcgaattctgggaactcctaacccccaggtctggccggaactgacagaactgccagactataataaaatctcatttaaggagcaggtgcctatgccccttgaagaagtgctgcctgacgtgtcaccacaggcactggacctcctgggtcaatttctgttatatccacctcaccaacggatagccgccagcaaggctctgctgcaccagtacttctttacggcccctctcccagcacacccctctgaactccccatcccccagagacttggcggacccgcgcctaaagctcaccctgggcccccacacattcacgatttccatgtggaccggcctttggaggagtcacttcttaacccagaattgattaggccatttatcctcgagggatag

SEQ ID NO: 25723 - DNA, 465 bp, Artificial Sequence
  Description of Artificial Sequence: Synthetic coding sequence
atggatgccccacgtctgcctgtgcggcccggtgtgctgctgcctaaattggtcctgctctttgtttatgccgatgactgtctggctcagtgtggtaaagattgcaagtcctactgctgcgatggcacaactccttattgctgttcttactatgcatacatcgggaatatcctcagcgggaccgccattgccggaatcgtgtttggtatagttttcatcatgggggtcatcgccgggatcgccatctgcatttgcatgtgcatgaagaatcatagagccacgagagtggggattctgcggactacccacataaatactgtgagttcttatccaggcccgccaccgtacgggcacgatcacgagatggaatactgcgccgacctaccacccccatactccccaacccctcaagggcccgcccagcgctccccgccccctccgtatccagggaatgcgcgtaagtag

SEQ ID NO: 25724 - DNA, 519 bp, Artificial Sequence
  Description of Artificial Sequence: Synthetic coding sequence
atgaaatgcgagccaggctggccccgtaccccagagtggccgccttctccaaggctgtctgccgtgggcagagataaggaaacctgggcgcctagtgccgcacgacttgggccacgggcgccgcagctgcgaggagtgcctcagagtctcgccagagatgcaccaggccccggaagcctgggaaggttacctcggcagtggccagggctatgctctacgagactaagtggagcgctcttgtctccaagcgatcggccccctagctctcccttcccccccgtgccgggatctcccttcgcgccctctctccgtccaccagcgtggatggacgcgcctagactgcctgtgaggccaggcgtgttactgcccaagctagttttgctatttgtgtatgccgacgactgtttggcccaatgtggtaaggactgcaagtcttattgctgcgacggcaccacaccatattgctgttcatactatgcatacatcggtaatattctgtcttgttgctgtccaaggtag

SEQ ID NO: 25725 - DNA, 675 bp, Artificial Sequence
  Description of Artificial Sequence: Synthetic coding sequence
atgtcaattctgctgcctaatatggccgaattcgatactatctcggagctggaagaagaagaggaggaggaagctgccacatcctcctcctcgcccagcagctccagctctgtcagcggacctgacgatgatgaagaggatgaagaggaagaggaagaggaggaagaagaagaagaggaagaggaggaagaggaggaagaggaagcccctccaccaccgcgggtcgtgtcagaagagcatctgagacggtacgctccagacccggtgctggtcagaggggccggtcacatcaccgtgttcggcctgtctaacaagttcgatacggagttcccatctgtcctcactgggaaggtggccccggaggagtttaaaacgagcattggccgggtcaacgcgtgtctgaaaaaggccctgccagtaaacgtcaaatggcttttgtgcggctgcctgtgttgctgctgcacattaggttgcagtctctggcccgtgatatgcctgaataagcgcacacgtcggtccatacagaagctgatagaatgggaaaacaacaggttataccacaagctggctctgcactggaagttgaccaagagaaagtgtgagacgagtaatatgatggaatatgtgatactaattgagtttcttcctaagtatcccatctttagaccggactag

SEQ ID NO: 25726 - DNA, 615 bp, Artificial Sequence
  Description of Artificial Sequence: Synthetic coding sequence
atgagcatcttactgcctaacatggctgaattcgataccataagcgagctggaagaagaagaggaggaggaagcagctacctcatcctcttcacccagcagcagttcttctgtgtctggtcctgacgatgacgaggaggacgaggaggaggaggaggaggaggaggaagaggaggaagaggaggaagaagaggaggaagaggaggcgccccccccgcctcgcgtcgtgtctgaggaacatctgagacggtatgcaccagatcccgtgttagtacggggcgccgggcacattaccgtgtttgggctctccaataagtttgacactgaattcccttccgtgttaaccgggaaagtggcacctgaagagttcaaaacctcaataggcagggtcaacgcctgccttaaaaaagcgctacccgtgaacgtgaaatggctactttgtggctgcctttgttgttgttgtacactgggatgctcactctggccagttatttgccttaacaaacgcactagaaggagcattcagaagctcatcgagtgggaaaacaatcggctgtatcataaagtgatcctaatagagtttctgcctaagtaccctatttttcggccagactag

SEQ ID NO: 25727 - DNA, 1341 bp, Artificial Sequence
  Description of Artificial Sequence: Synthetic coding sequence
atgcatgaaccctcgctgtgtgcgaacgtggagtgcccacccgcccatacttgtccttgcggggtgcctgcctgctcctgcgcgcacgtggagtgtcccccggcccatacgtgtcggtgtggtgtgcctgcctgtagtcacatgcccatgtggtctgccaggcttctaacaagagcacacgtagagtgcccgcctgcgcacacaagagtgcacgtcgagtgtcctcccgctcatgtgccaatgtggtccgcacatctgctcacctgcgcagacgtggaatgccacctccttacacacgtgcctatgtggtccgccagactgttgacctgcccctgtggggtgccagcctgcagtcacgtgcccatgaggtctgcaagactgttgactagagctcatgccgagtgtcctcctgcgcacacctgcccctgcggcgtccctgcatgttcacacgtccctatgcgaagtgccaggctccttactagagctgacgtcgagtgtccccctgcccatacgtgtccgtgtggagtacccgcctgttcccatgtgccaacctggagcgcacggctgatcacaagagctcacgttgagtgctcccccgcccacacatgtcgttgtggagtgcctgcttgtagccacgtccctatgtggagtgtgcgccttttgacccgtgctgacgccgaatgccccccagctcatacctgtaggtgcggagttcccgcctgcagtcatgtgcccatgtggtctgcacgactgctcacctgtagatgtggcgtgccggcttgttcacatgttcctatgtggagtgctcgcctcttgacctgcagatgtggtgtgcccgcctgctcccacgtcccgatgtggagtgcccgcctccttacaagggcccacgtggagtgtcccccggcccacacctgccggcgcggtgtgcctgcttgcagccgagcacatatggagtgccctcctgcacacacttgtcattgtggcgtgcccgcttgcagtcacacatgtcgctgtggtgtcccggcatgcagtcacgtgcctatgtggtccgcacgattgctaacccgggcccacgtggagtgtccccctgcacatactagggctcatgtcgagtgccccccggcacatacctgcccttgtggggttcctgcctgcagtcatacctgtccctgcggggtcccagcctgtagtcacaaggcactggcgtggtggttttgtcggtttcctgtgttgccagctgaatccgacgcagtaacagttcatagcactcacggtggctttttgatcaggttttacgtgaaggatcctttctatatttctctccatctggaaatcacgtag

SEQ ID NO: 25728 - DNA, 1167 bp, Artificial Sequence
  Description of Artificial Sequence: Synthetic coding sequence
gccaacgtcgaatgccccccagcacatacctgcccctgcggcgtgcctgcttgtagctgcgctcacgtggagtgtccccctgcccatacatgccggtgcggtgtcccagcctgctcccacatgccgatgtggtcggctcgactgctaacgcgcgcacacgtcgagtgccctcccgcccacactagggtgcacgtagaatgcccacccgcacacgttcctatgtggagtgcccacctcttgacatgtgccgatgtagagtgccatctgctgacccacgtcccaatgtggtctgcccggctgctgacgcgcgcagacgccgaatgtcctccagcacatacctgtccatgcggggtgcccgcctgttcccacgttcccatgaggtcagctcgactgttgacacgagcgcatgctgaatgcccgccggcacacacttgccgtaggggggtacctgcatgctcccacgtgccaatgtggagcgctcgtctgctgacgcgggccgacgctgagtgcccgccagcacatacctgtaggtgcggggtaccagcatgtagtcatgtgcctatgtggagcgctaggttgctgacatgtcggtgcggagtccctgcctgttcccacgtacccatgtggtccgctagattattgacatgccgctgtggggtgcccgcctgttctcacgtgcccatgtggagcgcaagattgctgaccagggctcatgtggagtgtcctcctgcacacacgtgtagacgaggtgttccagcctgctcaagggcccacatggaatgcccgcctgcccatacttgccattgcggggtaccggcctgcagtcatacatgtaggtgtggcgtgcctgcctgctcccatgtccctatgtggtctgcccgcctgctgactagagcccacgtggaatgccccccagcgcatacacgggctcatgtggaatgcccccccgcgcatacctgcccttgtggcgtgccagcctgtagccatacatgcccatgcggagtgccagcatgctcacacaaggccctggcttggtggttctgtcgtttcccggtgttaccagcagagagtgatgcggtgactgtccattccacacatggaggctttctcatccgattctatgtgaaagatcccttctatataagcctgcacctcgaaattacctag

SEQ ID NO: 25729 - DNA, 861 bp, Artificial Sequence
  Description of Artificial Sequence: Synthetic coding sequence
atggcgatggaaggctattggaggtttttagccctgctggggagtgccttgctagttggctttctctcagtgatctttgcgctagtatgggtgcttcattatagggaaggattagggtgggatggcagcgccctcgaatttaattggcaccctgtgttgatggtcacaggttttgttttcattcagggtattgctatcatcgtctataggctgccctggacctggaaatgtagcaagttgttgatgaaatctatccatgccggtctgaatgctgtcgccgccatcctggcgattattagcgtcgtagcagttttcgaaaatcacaatgtaaataacatcgctaatatgtatagcttacactcctgggtgggactgattgccgtgatctgttacctgctccagctgcttagcggattctccgtgttcctcttgccatgggcacccttatccctgcgagcattcctaatgccgatccacgtgtatagcggaattgtgatcttcgggaccgtcatcgcgaccgcgctgatgggcctcaccgagaagttaattttcagtcttagggatcccgcctactctacatttccccctgagggtgtcttcgtgaacacacttggcctgctgatattggtattcggggccctcatattttggattgtcactcggccgcagtggaaaagaccgaaagagcctaattcgaccatcctgcatccaaacggtggtaccgaacagggggctaggggctcaatgccagcctacagtggaaataatatggataagtcggactcagagctgaactccgaagtagccgctaggaagcgcaacttggcgttggatgaagctggccagcgctcaacaatgtag

SEQ ID NO: 25730 - DNA, 474 bp, Artificial Sequence
  Description of Artificial Sequence: Synthetic coding sequence
atggcaatggaaggatactggcgattcctggctttacttggaagcgctctgctggtcggatttctgagtgttatctttgctctggtttgggtactacactatcgggagggcttaggctgggatggctcagcactggagttcaattggcacccagtcctgatggtgacgggattcgtcttcatccaaggcatcgcctcctttaggttcttttccctttctgcctctatgggcagcgctttctcgcccagcattagccacgcgcacacctgtctgttttggaattgtcacctgtggaactccgactgcaactccacttatggcatcgacagggaaaccgacttttttcccgaacgcagttgcatccagtacattcccgcacgccgatgttttagaaaatacgcctggccatctgaccctggtgtgaggggcccccattttctggattctcatcaaaccgcgatggagacttcctag

SEQ ID NO: 25731 - DNA, 687 bp, Artificial Sequence
  Description of Artificial Sequence: Synthetic coding sequence
atgctggatgagggagaggctataatcgtgtatagactgccttggacttggaaatgcagtaagctcttgatgaaaagcattcatgcgggactcaatgctgtggccgcaatccttgccatcattagtgtcgtggctgtctttgagaaccacaacgtgaacaacatcgccaatatgtactcactgcacagctgggtgggccttattgcggttatatgttacctcctccagttgctgtccgggttttcggtgtttctcctcccgtgggctcccctgagcttgcgggcgttcttgatgcccatccacgtctatagcggcatagtcatttttggaaccgtgatcgcgactgctcttatgggtttgacggagaagctcattttttcactgcgggacccagcctactcaactttccctcccgaaggtgtgtttgtgaatactctcggtctcctcatcctggtgtttggtgcattaatcttttggatagtcacccgcccccagtggaagagacctaaggagcctaatagcacaatcctgcaccccaacggggggaccgagcagggggctcgcggcagtatgcccgcctacagtggcaataacatggataaatcagatagtgagctcaactctgaagtcgccgccaggaaacgcaacctcgccttggatgaagcaggacagcgaagcaccatgtag

SEQ ID NO: 25732 - DNA, 729 bp, Artificial Sequence
  Description of Artificial Sequence: Synthetic coding sequence
atggtgagcggtaggttctacctgagctgcctactattagggtcgctcgggagcatgtgtatcctctttaccatatactggatgcaatactggaggggaggattcgcctggaacggatctatttatatgtttaattggcaccccgttctcatggttgccggtatggtcgtcttctacggtggggcatcgttggtttacaggttgccacaatcttgggtaggcccaaagctgccatggaaactgctgcacgctgctctgcatctcatggctttcgtgcttaccgtagtcggattagtggccgtctttacgtttcacaatcatggtcgcaccgccaatttatattctctgcattcatggctcggaataacgaccgtttttctcttcgcatgtcagtggttcttaggattcgcagtctttttgctgccatgggcatccatgtggctcagaagcctgttgaagccaattcatgtgttctttggtgccgccatcttgtctttgagcattgcgagcgttattagtgggatcaatgaaaagttattcttttctctcaaaaataccacacggccctaccactccttgccaagtgaggccgtcttcgccaatagcaccgggatgctggttgtggcttttgggctgcttgtcttgtatattctgctcgcgtcctcatggaagcgaccggaacccggaattctgaccgatcggcagcccctgctgcacgatggcgaatag

SEQ ID NO: 25733 - DNA, 780 bp, Artificial Sequence
  Description of Artificial Sequence: Synthetic coding sequence
atgggcaaaaactttagtgatagctttctgagtcgggaatgcgtcatccgcatggtctctgggaggttttacctctcctgtctccttctaggtagcctcggctcaatgtgtatacttttcactatctactggatgcaatactggcgcgggggcttcgcttggaatggctctatctatatgtttaactggcaccctgtgcttatggtggccggcatggttgtgttctatggtggcgctagcttagtgtatagactaccccaatcatgggtcggtcctaaactcccatggaagttactgcacgctgcacttcacctgatggcctttgtcctcaccgtcgtcggactggtcgctgtattcactttccacaaccacgggagaacagcaaacttatactccctgcactcttggttgggcatcacaacggtcttcctgtttgcttgtcagtggttcctcggctttgcagttttcttgctgccttgggcctccatgtggttgagatctctgctgaagcctatccacgtattctttggagctgccattttgtccctgtctattgcttcagtcatttcaggtatcaacgagaaacttttttttagcctaaagaatactacccggccttaccactcgctgccatccgaagccgttttcgccaactctactgggatgctggtggtggcctttggtctcctggtgttgtacatattacttgcaagctcttggaagagaccggagccagggatcttgacggatagacagccgctcctccatgatggcgagtag

SEQ ID NO: 25734 - DNA, 729 bp, Artificial Sequence
  Description of Artificial Sequence: Synthetic coding sequence
atggtgtctggtcgtttttatctgtcgtgtcttttgctaggttcactcgggtcgatgtgcattttatttacgatctactggatgcaatactggagaggaggctttgcctggaacgggtccatatatatgttcaactggcacccagtcctcatggtagccggtatggtggtgttctatggcggggcctcccttgtttataggcttccccaatcctgggtaggcccaaagttgccctggaagcttctacacgcagccttgcatctgatggcttttgtcctaaccgtagtcggtctggtggctgtatttacttttcataatcatggaaggactgccaatctctactctttgcactcctggcttggaatcaccactgtgtttctgttcgcgtgccagtggttcctcggctttgcagtctttttactgccctgggctagtatgtggctgcgctctctactgaagcccatccacgtcttttttggcgcggccattctaagcctctcaatcgcgtcagttataagtggaattaacgagaagctcttctttagcttaaaaaacacaacgcgcccctatcattccctccccagcgaagcggtgttcgctaactccaccggtatgttagtggtggcatttggactgctggtgttgtacatcctgctggccagctcctggaaaagaccggagcccggcatcttgacagacaggcagcctctcttacatgacggcgagtag

SEQ ID NO: 25735 - DNA, 549 bp, Artificial Sequence
  Description of Artificial Sequence: Synthetic coding sequence
atggtgtcagggcggttttacctaagctgccttctcctggggagcctgggttcaatgtgcatcttgttcacgatttattggatgcagtactggagggggggctttgcatggaacggctcaatatatatgtttaactggcatcctgtgttgatggtcgccggcatggtggtgttctatggtggagcgtcgttggtctatcgcttaccccaaagttgggtgggccccaaacttccttggaaactgttacacgccgcattacatctgatggcattcgttttgaccgtggtgggtctcgtcgctgtatttacattccataatcacggtaggaccgcaaatctgtattctctgcatagctggctgggtatcaccactgtcttcttgtttgcgtgccagtggtttctgggattcgccgtttttctgctcccctgggccagtatgtggcttcgttccctgctgaagccaattcatgtcttttttggagcggcaattctgtccctgagcatcgcatccgttatatcgggaataaatgaaaaactgttcttttcatag

SEQ ID NO: 25736 - DNA, 87 bp, Artificial Sequence
  Description of Artificial Sequence: Synthetic coding sequence
atggtctctggacgcttttatctctcctgtctgttacttggaagtctgggcagcatgtgtatattgtttaccatatactggatgtag

SEQ ID NO: 25737 - DNA, 348 bp, Artificial Sequence
  Description of Artificial Sequence: Synthetic coding sequence
atggttagtggcaggttctacctgagctgcctccttctcgggagtcttgggtccatgtgtatcctgtttacaatctactggatgcagtactggagaggaggatttgcctggaatggttccatttacatgttcaattggcacccagtgctaatggtcgcggggatggtggtcttttacggcggggcctccttggtttacaggctaccccagagctgggtggggcccaaactgccttggaagctgctacatgctgctctgcaccttatggctttcgtgctgactgtggtggggctggtcgctgtgtttacattccataatcatgggagaacggccaatctgtacagctag

SEQ ID NO: 25738 - DNA, 603 bp, Artificial Sequence
  Description of Artificial Sequence: Synthetic coding sequence
atggtctccggacgattttaccttagttgtttgttacttgggtccctgggatccatgtgtatcctcttcacaatctactggatgcaatattggcgtggaggatttgcttggaatgggtccatctacatgttcaactggcatccggtactgatggtcgccggaatggttgtgttttacgggggcgcctcactggtgtacagattaccccagtcatgggtgggaccaaaactcccatggaagttgctgcacgccgccttgcacctcatggcctttgtcctgaccgtcgtcggccttgtcgcggtcttcaccttccacaaccatggccgaaccgcaaacctttactccctgcactcctggttaggaattacaactgtgttcctgtttgcatgtcagtggttcttgggctttgcagtgttcctgctgccctgggcgtcaatgtggttgcgcagcctgctcaagcccattcacgtgtttttcggcgcagctatcctctccctcagtatcgcttccgtaataagtggtattaacgagaagctcttctttagcctaaagaataccacacggccataccactccttgccatcagaagccgtcttcgcttag

SEQ ID NO: 25739 - DNA, 168 bp, Artificial Sequence
  Description of Artificial Sequence: Synthetic coding sequence
atggtgtccggtagattttatctgtcctgcctgctgctaggctctttaggtagtatgtgcattctcttcacaatctattggatgcagtactggagagggggattcgcctggaacgggtctatctacatgtttaactggcatcccgttctcatggtggctgggatgtag

SEQ ID NO: 25740 - DNA, 918 bp, Artificial Sequence
  Description of Artificial Sequence: Synthetic coding sequence
atgggcatccagactagtcccgttttgttagcttcactgggagttgggctcgtcacattattgggacttgctgtgggatcttacctggtgcggcgcagccggcgaccccaggtcacactgttagatccaaacgagaagtacctcctccggctgctggataagaccaccgttagccacaataccaagagatttcggtttgctctgccaactgcccatcataccctcggactgcctgtaggcaaacatatctaccttagcactagaattgacggatccctcgtcataaggccctacacgccggttacatccgacgaggaccaggggtatgtcgatcttgtcattaaggtatacctcaagggcgtccaccctaagttccctgaaggtggtaagatgagccagtacctcgacagcctgaaagtgggtgatgtggtggaattcagaggtccctcagggttactgacttacactgggaagggacacttcaatatccagcctaataaaaaatcgcccccagagccccgggtagccaagaaactaggaatgattgccggagggacaggtatcaccccgatgctccagctgatacgggccattctcaaggtccctgaggatcctactcagtgcttcctgctgttcgccaaccagactgaaaaagacataattctacgcgaggatcttgaggagctgcaggctaggtacccaaatagatttaagttgtggttcactctggaccatccccctaaagactgggcctactctaaaggatttgtcaccgccgacatgatccgtgaacatcttccagctcccggggacgatgtgttggtgctgctgtgcggcccgccccccatggttcaactcgcctgccaccctaatttggataaactcggatactcccagaaaatgagattcacttattag

SEQ ID NO: 25741 - DNA, 681 bp, Artificial Sequence
  Description of Artificial Sequence: Synthetic coding sequence
tagacagcccatcatactctggggctgcctgtaggaaaacatatctatttgtccaccagaatcgacggcagcctggtcattcgcccttatacacccgtcaccagtgacgaggaccagggatatgtggacttggtgattaaggtgtatctgaagggggtgcaccctaagtttcctgagggcgggaaaatgtcacagtacctggatagcctcaaagtgggtgatgttgtagagtttcggggtcccagcggcctcttgacctataccggcaaggggcacttcaatatacaaccaaacaaaaaatccccgcccgagcctcgagtagccaagaagctggggatgatcgccggaggaaccggcattacacccatgctgcaactcattcgcgctatcctgaaggtacctgaggaccccacccagtgcttcttactgttcgccaaccaaaccgagaaggatattatcctgcgggaagacttagaggagctgcaggcgcgttacccaaaccgtttcaaactctggttcaccctggatcatccacctaaggggatcctccctatctctgggcaccctactattcctagcagctcaaagtctaaaccatgtccgttcgtcaatagtggattcattgagatcaacctggctagccattgccaactggggagcctgtccgcgcagacacagtag

SEQ ID NO: 25742 - DNA, 402 bp, Artificial Sequence
  Description of Artificial Sequence: Synthetic coding sequence
atgcaacccctcgaagttggtctggtaccagcacctgcgggggagccaagactgacacggtggctgagacgtggatcaggaatcctggcccacttggtagccttaggatttaccatttttctgactgccctgagccgtcctggcaccaagactgggcccctaatggaagacaggagcgaaggtggtagggctcgctgggttatgcccgagattcctgcactatgggaagctgatgccgggggatccttagaagtgttttcgcccggaaccctgtactcttggccctggcgctctgcctctgcctggctcaaaccgtcctacagcagccaccttaacaccccttgctctagttcagcccctgaaaagcatggctccggcagtactggccaggggcgcccatag

SEQ ID NO: 25743 - DNA, 756 bp, Artificial Sequence
  Description of Artificial Sequence: Synthetic coding sequence
atgcagcctctggaagtaggtctcgttcccgcccccgcaggtgaacctcggcttacccgttggctgcgacgggggagtggcatacttgcccacctggtggcactgggtttcactatatttctgactgcgttgtccaggccaggcacgaaaacaggacctctgatggaagatcgaagcgaaggtggccgcgctaggtgggtaatgccagagatcccagccctgtgggaagccgacgcgggcgggagtctagagttctgtctatgcatggcagaggccattctccttttctcacctgaacattctctcttttttttttgttcgcgaaaggcacgtatcaggctccactgggctggccaaactcttgcaatattatgcgccgcgctgggcctcggctttattatttctagccgcactcgatccgagcttccccatttggtctcttggcactcctgggtgggtgctttgacgctgctggcaaccgcggtacaggcactgtgcggcctctgcctgctgtgtcctcgcgccgctagagtctcgcgggtcgcccgtctgaaactttatcacctgacttgcggactcgttgtctatctgatggccacggtgaccgtcctcctcggaatgtattctgtgtggtttcaggcccagataaaaggagccgcctggtatctgtgccttgctcttcccgtgtatcccgcacttgtcatcatgcaccagatttctcgaagctacctgccgagaaaaaaaatggaaatgtag

SEQ ID NO: 25744 - DNA, 519 bp, Artificial Sequence
  Description of Artificial Sequence: Synthetic coding sequence
atgcaaccactcgagttttgtttgtgtatggctgaagcaatactcctgtttagccctgaacactccctctttttcttttgctcccgtaaggctcggatccgactgcattgggctggtcagactctggctattctttgcgcagccctgggcctgggttttatcatcagctccaggacaagatccgaactgccacacctggttagctggcactcttgggtgggagccctgactctcctggcaaccgctgtccaggccctgtgcgggttatgtctactttgccctcgggctgctcgagtcagccgggttgcaaggctcaaactgtaccacctcacatgcgggctggtggtttacttgatggcgaccgtaaccgtgctactgggcatgtatagcgtgtggtttcaggctcagatcaaaggcgccgcctggtacctgtgcctagcattaccagtctaccccgctctggtcatcatgcatcagattagcagatcatacctgccacggaaaaaaatggagatgtag

SEQ ID NO: 25745 - DNA, 690 bp, Artificial Sequence
  Description of Artificial Sequence: Synthetic coding sequence
atgcagcctctggaagtcggcctggtccctgcaccagccggcgaaccccgcctgactcggtggctcagaagaggaagtggaattctggctcacttggtcgcacttggctttactatcttcctgactgctctgagtagaccaggtacttctcttttttcctggcatccagtgttcatggccctggcattttgtctctgtatggctgaggccatccttcttttctcccccgagcactcactcttcttcttctgctcaaggaaagcacgaataagactacactgggccggccagaccctcgcaatcctgtgcgctgctttgggcctcggctttatcatatctagcagaactaggagcgagctgccccatctagtgtcttggcattcctgggtcggagctttgactctgttagccacagcagttcaggcgttgtgcggtctgtgtctgctctgccctcgcgccgctcgggttagccgcgttgcccgcttgaagctgtaccacctgacatgcggcctggttgtttacctaatggccacagtgaccgtactgctgggaatgtacagcgtgtggttccaggcccaaataaagggagccgcctggtatctgtgcctggcactccccgtttatcccgctctggtcatcatgcatcagatcagccggagctacctgccccgtaaaaagatggaaatgtag

SEQ ID NO: 25746 - DNA, 387 bp, Artificial Sequence
  Description of Artificial Sequence: Synthetic coding sequence
atgcagcctttggaggtgggtctggtgccagcccccgccggcgaaccacgccttactcgttggctgcgtcgggggagcggcatactcgcccatttagtcgccctaggatttactatattcttgacagcactgagtcgtcccggtacaaagacaggccccctgatggaagataggagcgaagggggcagggcacgatgggtgatgccggagatacctgccctgtgggaagccgatgctggggggagcctcgaggtgtttagcccaggaaccttatatagctggccttggagaatgtacgagtcgacttccttttttagcggactacaggcccgacacgaggcttattggttgagccctatgttcacagtgctgccattgcatgggtag

SEQ ID NO: 25747 - DNA, 225 bp, Artificial Sequence
  Description of Artificial Sequence: Synthetic coding sequence
atgccaaaatactatgaggacaagccccaggggggggcatgcgccggcttgaaagaagatcttggggcctgtttgctgcagagcgactgcgtggtgcaggagggcaagtccccccgccagtgcttgaaagaggggtactgtaattcactgaagtacgcattctttgagtgcaagaggtctgtgctggataaccgagctagattccgggggcgaaaaggctactag

SEQ ID NO: 25748 - DNA, 330 bp, Artificial Sequence
  Description of Artificial Sequence: Synthetic coding sequence
atggccgcggtgggagtcttcagcgtatcacggctgctgggacgcagtcggccacagctcggcaggcctatgtcttccggagcgcacggcgaggaaggtagcgcaagaatgtggaaaactttgactttctttgttgcgcttcccggagtggccgtgagcatgctgaatgtctacctcaagtctcaccacggcgagcatgaacgacccgagtttatagcatacccacatctgaggatacgcactaagccgtttccttggggggacgggaaccacaccctattccataacccacacgtaaaccctctgcccacaggatatgaggatgaatag

SEQ ID NO: 25749 - DNA, 294 bp, Artificial Sequence
  Description of Artificial Sequence: Synthetic coding sequence
atggccttgcctttaaggcccctgacacgtggattagcttctgctgccaagggcggccacggtggagcaggcgctagaacttggcgacttctcaccttcgtgctcgcgctaccatcagtggctttgtgcacgttcaattcctatctccactccggacaccgtccgagaccagagttccgcccctaccaacatctgcggatcagaaccaaaccctacccttggggcgatggcaaccatacactcttccacaacagccacgttaacccactgcctacaggttacgaacacccatag

SEQ ID NO: 25750 - DNA, 267 bp, Artificial Sequence
  Description of Artificial Sequence: Synthetic coding sequence
atgttagatgtggaggcccaggaacctccaaaggggaagtggtcaacccccccattcgatccccgcttccctagccagaaccagatcagaaattgttaccagaacttcctggattaccaccgctgcctgaagacccgcactcggaggggtaagagtacccagccctgcgagtattacttccgggtataccactcactttgtcctatctcctgggtagagagctggaatgaacagattaagaacggcatcttcgctgggaagatttag

SEQ ID NO: 25751 - DNA, 243 bp, Artificial Sequence
  Description of Artificial Sequence: Synthetic coding sequence
atgtttccccttgtcaaatctgcccttaatcgcctgcaggtaagaagcatccagcagacgatggccaggcaatctcaccagaagagaacccctgatttccatgataagtacgggaatgctgtgctcgcctcaggcgccaccttctgcattgtcacatggacctacgtggcgactcaggtggggattgaatggaaccttagccccgtgggaagggttacgcccaaagaatggcgcaatcaatag

SEQ ID NO: 25752 - DNA, 210 bp, Artificial Sequence
  Description of Artificial Sequence: Synthetic coding sequence
atgagtgtgctgacccctctgcttctccggggccttacaggttccgcccgtagactgcccgtgccccgcgctaaaatacactccctgccgccggagggcaaactggggattatggagctggctgtgggacttacctcctgctttgttacctttcttctccccgcagggtggatcttatctcatctcgaaacatatcgccgtccggaatag

SEQ ID NO: 25753 - DNA, 219 bp, Artificial Sequence
  Description of Artificial Sequence: Synthetic coding sequence
atgcctctgctgcgcgggcgctgccctgctaggcggcactaccgccgcctcgcactgctgggactccagcctgcacctcgatttgctcactcgggtccaccacgccagcgaccactgtcagcagccgagatggccgtcgggttagtggtgttttttacaacattcttgacacctgcagcctacgtgcttgggaacctgaagcagtttcgccggaactag

SEQ ID NO: 25754 - DNA, 1092 bp, Artificial Sequence
  Description of Artificial Sequence: Synthetic coding sequence
atggcccctgaagccacaaagaattttctgccacttctagacgcagttagcagagattttgtctccgtactccacagacgcatcaagaaggcgggaagcggaaactactccggagacatctctgatgatttgtttcgattcgcatttgaatctatcaccaacgtgatcttcggggaaaggcaggggatgctcgaggaagtggttaatcccgaagcccagcgattcatcgacgctatctaccagatgttccatacctccgtgcctatgctaaacctacctcccgatctattcagactgttccggaccaaaacttggaaggaccacgtcgcggcttgggacgtcatatttagcaaggccgacatttacacccagaatttctattgggagttaagacagaagggctccgtgcaccacgattatagaggaattctgtatcgcctcctaggcgacagtaagatgagctttgaagatattaaggccaatgtaacagagatgctggccggcggagttgacacaacgagcatgacattgcaatggcatttgtatgagatggctcggaatctcaaagtgcaggatatgctgcgtgccgaagtgctagcagctcgccaccaggcacaaggtgacatggctacaatgttgcaattggtgccactcctgaaagcatctatcaaagaaactctcaggctccatcccataagcgttactctgcagaggtacttggtgaacgacctcgtgctgagggactatatgattcctgctaagacactggttcaggttgccatctacgccctgggtagagaaccaacattcttctttgatccggagaacttcgatcccacccgctggctgagtaaggataaaaacattacatacttcagaaacctgggcttcgggtggggcgtacggcaatgtctgggccggcgcattgctgagctagaaatgacaatctttctcattaacatgctggagaacttccgcgtggaaatccagcacttatcggacgtcggcactaccttcaatttaatcctcatgccagaaaaacccatcagctttactttttggcccttcaaccaggaagccacacagcagtag

SEQ ID NO: 25755 - DNA, 1566 bp, Artificial Sequence
  Description of Artificial Sequence: Synthetic coding sequence
atgctcgccaaaggcctcccaccccggtccgtgctggtgaaaggatgccagacatttttgagcgccccgcgggagggactgggtcggctaagggtccccacgggggagggggccggtattagtacccgttccccgcggccttttaacgaaattccgagcccaggcgacaacgggtggctcaacctctaccatttttggagagaaaccggcacacacaaggtccacttacatcacgtgcaaaattttcagaaatatgggcccatctatcgcgaaaaattggggaacgtcgaaagcgtttacgtgatagaccctgaggacgtggctcttctgtttaaaagcgaagggcccaatccagaacggttcctcatcccgccctgggttgcgtatcaccagtactaccaacgccctatcggagtgcttctcaaaaagagtgcagcctggaaaaaggatagagtagctctgaatcaagaggttatggccccagaggcaaccaaaaattttctaccgctgctcgacgccgtctcacgggacttcgttagtgtactgcacagacgcatcaaaaaagctggttctggcaattactcaggagacattagtgatgatctttttcgttttgcgttcgagtcaatcacaaacgttatcttcggcgagagacagggcatgcttgaagaggtggtcaatcctgaagcacagcggttcatcgatgcaatctatcagatgttccacaccagcgtgccaatgcttaacctgcccccggatctgtttcggctgtttagaacaaaaacttggaaggatcacgtcgctgcttgggacgtcatcttttctaaggctgatatttacacccagaatttttactgggagttaagacagaaaggcagcgtccaccatgactataggggcatcctgtaccgcttgttgggagattctaaaatgtcgtttgaagacattaaggccaatgttacggagatgcttgcaggaggagtagacaccaccagcatgacgcttcagtggcacctctacgaaatggccaggaatcttaaggtgcaggacatgctgcgggcagaggtactggcagcccgacaccaggctcagggtgatatggccactatgctgcagctggttcctttgctgaaggccagcattaaggaaacacttaggctgcatcccatcagcgtgacccttcagagatatctcgtgaacgatttagtactccgtgactacatgatcccagcgaagacattggtgcaagtggccatctacgccttaggaagagaacctacattcttcttcgatcccgagaactttgaccccacacggtggctgtcaaaagataaaaatatcacatattttagaaatctggggttcgggtggggggtcaggcaatgcctgggcagacgcattgcagaattggagatgacaatcttcttgatcaacatgctggaaaacttccgggtggaaatacaacatctgagcgacgttggcacgacatttaaccttatcctgatgcctgagaaacccatctcctttaccttttggccattcaatcaggaagctacccagcagtag

SEQ ID NO: 25756 - DNA, 1092 bp, Artificial Sequence
  Description of Artificial Sequence: Synthetic coding sequence
atggccccagaggcaactaaaaacttcctgcccctgctggacgccgtgtctcgagatttcgtaagcgtgctccacagacgcatcaagaaggcgggatctggcaactacagcggcgacatttccgatgacctctttaggttcgcctttgagagtatcaccaacgtgattttcggggaacgacagggtatgctcgaggaggtcgtaaaccctgaagcacaaaggttcatcgatgccatctaccaaatgtttcacacttctgtgcctatgttgaacctccccccagatctgttcagactttttcggaccaaaacgtggaaagaccacgtggccgcctgggacgtaattttttcaaaagcggatatctacacgcagaacttctattgggaactgcgacagaaagggtccgtgcaccacgactatagaggcatcttgtacaggctgctgggggatagcaagatgtcttttgaagatattaaggccaacgtaacggaaatgctcgctggtggcgtggataccacgtctatgacactccagtggcatctatatgaaatggctcggaacctgaaggtgcaagacatgctgagagctgaggtattagcagcccgccaccaggcacagggcgacatggctacaatgttgcagctggtccctctgctgaaagcttcaattaaggaaacactcagattacaccccatatcagtgacattacagaggtatctggttaatgatctggtgctccgggattatatgataccagccaagacattagtgcaggtggccatttatgcactggggagagagcccacatttttttttgaccctgagaattttgaccccaccagatggctctccaaggacaagaatatcacctacttccgcaacctgggattcgggtggggggttagacagtgtttgggtaggcggattgccgaattggagatgacaattttccttataaacatgctggaaaattttcgggtggagatccagcacttaagtgacgtcggtaccacgttcaatctgatcctgatgcctgagaagccgatttcctttaccttttggccatttaatcaggaggcaacgcaacagtag

SEQ ID NO: 25757 - DNA, 1245 bp, Artificial Sequence
  Description of Artificial Sequence: Synthetic coding sequence
atgttggccaaaggattgccacctcggagcgtcctggttaagggctgccagacatttctaagtgcccctcgagaagggctcgggcggttacgggttcctacaggagaaggtgccggcatctcgactcggtctccccggccatttaatgaaatcccttctcccggggataacggctggttaaatctgtaccacttttggagagaaacaggcacacacaaagtacatttacaccatgtccagaactttcaaaagtatggaccaatttacagagagaagctggggaatgtcgagtcagtgtatgtgattgatcctgaagacgtcgccttgctgtttaagtctgagggaccgaaccccgaaagattcctgatacctccttgggttgcctaccatcagtattatcagagacccatcggagtcctgctcaaaaaaagtgcagcgtggaaaaaagacagggttgccctcaaccaggaggtcatggctcccgaggccacgaaaaattttctccctctgctggatgccgtgtctcgggattttgtatcagtgctgcaccggcgtattaagaaggctgggtccggaaactattctggggacatatctgatgacctttttagattcgcgttcgaaagtatcactaatgtaatcttcggcgaaagacaggggatgctagaagaggtggtgaacccagaggcccaacgattcatcgacgccatctatcaaatgttccatactagcgttccaatgcttaatctcccccccgacttgtttaggctttttcggaccaaaacttggaaggaccacgtggccgcttgggacgtaatttttagcaaggccgatatctacacacagaacttttactgggaactgcgacagaaaggtagcgtgcatcacgactaccgcgggattctgtaccgtctactgggggattccaagatgtccttcgaggacatcaaggccaatgtgacagagatgctggctggcggagtagacaccacatccatgaccctgcaatggcatctttacgagatggcgcggaatctgaaggtacaagatatgctaagagcagaggtcctagccgctcgtcaccaggcccagggagacatggctactatgctgcaacttgtcccactcttgaaggccagtattaaggagactctaaggcactggtgcaaatggccttccatgctgtgggccgagtctcccccttcttcatccacacgtaagatcctgacacagccagacggctag

SEQ ID NO: 25758 - DNA, 861 bp, Artificial Sequence
  Description of Artificial Sequence: Synthetic coding sequence
atgccatcaacccgctgctctacacctgcgagtccatgtagtaccttcccgcagacttgtagcgtatgctccgggcctagacccaaggaccacgttgccgcctgggacgttattttttccaaagctgacatctacacccagaacttttattgggaactccggcagaagggctccgtccatcatgattataggggaatcctttataggcttctgggcgactctaaaatgtcattcgaagacatcaaggccaatgtgaccgagatgcttgctggaggggttgacacaacctctatgaccctgcagtggcatctgtacgagatggcccggaacctgaaagtgcaggatatgttgagggccgaagttttggccgcgcgtcaccaggcccaaggcgatatggccaccatgcttcagctggtgcccttgctcaaagccagtattaaggagaccctgcggctacatcccatcagcgtgactctccagaggtacctagtgaatgacctggtcctccgcgactatatgatcccagccaagactctcgtgcaggtggcaatctatgccttgggtagggaaccaacattcttctttgatccggaaaacttcgaccccactcgctggctgtccaaggacaagaacatcacttatttccggaatctcggtttcggttggggtgtgcggcagtgtctcgggagacgaatcgcagaattagagatgacaatctttttgataaatatgttagagaatttccgcgtagagattcagcacctcagcgacgtcggaactacctttaatctgattttgatgccagaaaagcccattagctttaccttttggcctttcaatcaggaggccacacagcaatag

SEQ ID NO: 25759 - DNA, 435 bp, Artificial Sequence
  Description of Artificial Sequence: Synthetic coding sequence
atgcttgccaagggcttgcctccaaggtcagttctggttaaagggtgtcagacatttctctccgcaccccgggaaggtctaggcagacttcgggtacccaccggtgaaggcgccggcatctcaaccaggtcccctcgcccatttaacgagatcccatctcctggagataacggttggctcaacctttatcacttctggcgcgaaactggtacccacaaagtgcatcttcatcatgtacagaatttccaaaaatacgggcctatataccgcgagaaactcggcaatgtggagtctgtgtacgtcatcgacccagaagacgttgctcttttatttaaaagtgaaggtccaaatcctgaaaggttcctcatccccccatgggtggcttaccatcagtactatcagcgacccatcggcgtactgctgaatcatcactag

SEQ ID NO: 25760 - DNA, 1473 bp, Artificial Sequence
  Description of Artificial Sequence: Synthetic coding sequence
atggacccagccgtagcgttagtactttgcctgtcctgcctgttcttactgtctttgtggaggcagagctctggccgtggccgcctcccctctggccccactcccttacccattattggtaatattctgcagctggacgtgaaggacatgtcaaaatccctgactaacttttccaaagtttatggcccggtcttcaccgtatacttcgggcttaaacccatcgtcgtactgcatgggtatgaagcagtgaaggaagcactgattgaccatggtgaggagttttcgggccgaggtagctttccagtggctgaaaaggttaataagggccttggtattttatttagcaacggcaagaggtggaaggagatacgaagattctgccttatgaccctccgcaatttcggtatgggcaagagatctatagaagatcgcgttcaagaagaggccagatgtctggtggaggagcttcgcaagaccaatgcgtccccttgcgatccaacttttatcctaggatgtgcgccatgcaacgtcatctgcagtgtgatcttccatgataggttcgactacaaggaccagcgttttcttaacttaatggaaaaattcaacgagaacttgcgaatcctgtctagcccatggatccaagtatgcaataactttcccgcactgatcgactacctccccggctctcataacaaaattgcagagaattttgcatacattaagagctacgtattggagagaattaaggagcatcaggagtcacttgacatgaactccgctagagattttattgattgttttcttatcaaaatggaacaggagaaacacaatcaacagtctgaattcaccgtggaatccctaattgcgactgtgaccgatatgttcggcgctggtactgaaaccacgagcaccaccctaagatatggactgctcctgttattgaagtatcccgaagtgacggccaaggtacaggaagagatagaatgcgtggtcgggcggaatcggagcccatgtatgcaggataggagccatatgccctacactgatgcagtcgttcacgaaatacagaggtatatcgacctgctcccaaccaaccttccccacgctgtgacctgcgacgtgaagttcaagaattatctcattcccaagggcacaactattattacatccttaacttccgtgctccacaatgacaaggaatttccgaatccagagatgttcgacccaggtcattttcttgacaagtctggtaactttaagaaaagcgactacttcatgccattttccgctggaaagaggatgtgcatgggagagggcctcgcccggatggagctcttcctatttctgacaactatacttcagaatttcaatctgaagagtcaggtggaccccaaggatatcgacatcactcctatagctaatgcttttggccgggtgcctcccctttaccaactatgtttcatcccggtttag

SEQ ID NO: 25761 - DNA, 1296 bp, Artificial Sequence
  Description of Artificial Sequence: Synthetic coding sequence
atggaccccgcggtggcactcgtgctgtgcttaagctgcctgttcctgctgtcactgtggcggcaaagctccggcagggggagactccctagcggacctacccctctcccaatcatcgggaatattctgcagctcgacgtgaaggatatgagtaagagcctcacaaacttctctaaggtctatgggcccgttttcactgtgtatttcggcctgaaacccattgtggtcctccacggttatgaagctgtgaaggaagcattgatcgatcatggcgaagagttcagtggacggggctcatttcccgtggccgagaaggtcaacaagggccttggaatcttgttctcgaatggtaaaaggtggaaagagatccggaggttctgtctgatgactctccgcaattttggaatgggaaaacgaagtattgaagatagagtccaagaggaagcccggtgccttgtggaggagctgcgcaaaacaaacgccagtccatgtgatccaactttcatcctcgggtgcgccccctgtaacgtgatctgctcagttatttttcatgacaggttcgactataaagaccagcggttccttaatctcatggagaagtttaacgaaaatctccgcatcctatctagtccctggatccaagaaaaacacaatcagcaatccgaatttacagtcgagtcacttatcgcgaccgtcacggatatgtttggtgccggcaccgaaacgacctcaactacactcaggtacgggctattacttcttctcaagtatcccgaagtgacggcaaaagtacaggaggagattgaatgcgtggtcgggcggaaccgcagcccatgtatgcaggatcgtagccacatgccttacacagatgcggtagttcacgagattcagagatacatcgacctcctgccaacaaatttgccccacgcagtgacatgtgacgtgaaattcaagaattaccttatcccaaaagggactaccatcatcacgagcctgaccagcgtgcttcataatgacaaggaatttcccaatcctgagatgtttgacccagggcacttcctggataagtccgggaatttcaaaaaatcagactacttcatgcctttcagcgcgggtaagcgcatgtgtatgggagaagggctggcccgcatggagctgttccttttcctcaccaccatccttcagaattttaatctcaagtcccaggtggacccaaaggacatcgatatcacaccgatcgcaaatgctttcggcagggtgcccccgctttatcagctctgtttcatcccagtgtag

SEQ ID NO: 25762 - DNA, 1473 bp, Artificial Sequence
  Description of Artificial Sequence: Synthetic coding sequence
atggccctgctcctgctcttatttctaggcctactcggcctatggggcttgctttgcgcctgcgctcaggatcccagccccgccgctagatggcctcccggaccgaggccgctgcccctagtgggcaaccttcacttgctgcggctctcgcaacaggatcgctccttgatggagcttagtgagaggtatggacctgtgttcacagttcacctggggcggcagaagacagtagtcctgacaggctttgaagcagtcaaagaagctctggcgggcccaggacaggaactcgccgacaggccgcctatagcgattttccagctgatccagaggggggggggcatcttcttcagctcaggagcccgatggcgcgccgcccgccagtttactgtccgcgccctgcacagtctgggcgtcggccgagagcctgtggcggataagatcttgcaggagctcaagtgccttagcggccaactggacggttatcgtgggcggccgtttccactggccctgctgggatgggcacccagcaatattacgttcgccctgctatttggccggagatttgactatcgcgatccggtgttcgttagcctactaggcttaattgatgaagtcatggtgctgctggggtccccaggcctgcaactgtttaacgtgtacccgtggctgggggccctgctgcaattgcatcgacctgtgttgaggaagatcgaagaagtacgtgccatcctacggactctgttggaagcccggagaccgcatgtatgtccgggcgaccctgtttgtagctatgttgacgctctcatacagcaggggcagggggatgatccagaaggcttattcgccgaggcaaacgccgttgcctgcacattggatatggtgatggccggcaccgaaaccaccagtgcaaccctgcagtgggccgcactgctaatgggtaggcatccagatgtgcagggtcgagttcaggaggagctcgaccgggtgctggggcctggcagaacccctagactggaggaccagcaggctctcccctatacatctgccgtacttcatgaggtgcagcggtttattacattgttgccccatgtgccccgttgtaccgccgccgacacacagctcggagggtttctgctccccaaaggcacaccggtgattcccctgctgacatctgtactcttggacgagacgcaatggcaaaccccgggtcagtttaaccctggccacttcctggatgcgaatggacatttcgtcaagagggaagcctttctgccattctccgccgggcgacgggtgtgtgtcggagagcggctggctcggacagagctctttttgctgttcgccggtctgctgcaacgctacagacttctgccaccccctggagtcagtccagcttcgttagatactacgccagcacgtgctttcaccatgagacctagggcacaggcgctttgcgctgtgccccgcccatag

SEQ ID NO: 25763 - DNA, 1389 bp, Artificial Sequence
  Description of Artificial Sequence: Synthetic coding sequence
atgttagatttcgcgatctttgcggtcacttttctcttagctctggtgggcgcggttctctacctgtacccagccagcaggcaggctgcaggcatccccggcataacccccaccgaggagaaggacggcaatttacctgatatagtgaactcgggctccctgcacgagttcctggtcaacctccatgaacgttacggccccgtggttagtttctggtttggaaggagacttgtagtatccttaggtaccgttgatgtgttaaagcagcatatcaatcccaacaagacatctgacccatttgaaaccatgcttaaaagcctactacgctaccagtctggcggaggctccgtctccgaaaaccacatgagaaaaaagctttatgagaacggagtcacagatagcctcaagtccaatttcgccctcttgctgaaactctctgaagagcttttggataagtggctttcataccctgaaactcagcatgtcccactctctcaacacatgctagggttcgctatgaaaagcgtgacacagatggtgatggggagtacattcgaagacgatcaggaggtcattcgctttcaaaagaatcatggaactgtgtggagcgagattgggaagggctttttagacgggtctctcgacaaaaacatgacgcggaagaaacagtacgaggatgccctgatgcagctagagagcgtcctgaggaacattattaaggagcgcaaaggtcggaatttttcccaacatatctttattgactccctggtgcaaggaaatctgaacgaccagcaaatacttgaggactctatgatcttttctctggcctcctgcataatcaccgccaagctgtgcacgtgggcaatatgcttcctgaccacaagtgaagaggtgcaaaaaaaactgtacgaggagattaatcaggtctttggaaacggtcccgtgacccccgaaaaaatcgagcaacttcgctactgtcagcacgtcttgtgtgagaccgtgcgcacagccaagctgactccagtgtcagctcagttgcaagatattgaaggcaaaatagatagatttatcattccacgggagactttagtgctatacgccctaggggttgtcctgcaggaccccaatacatggccctctcctcataagtttgatcctgacaggtttgatgatgagctcgtcatgaaaacctttagctcccttggatttagcggaacgcaggagtgccccgagctgaggtttgcatatatggttaccaccgtattactgagtgtcctagttaagcgtttgcacctgctgagtgtggagggccaggtcatcgagaccaagtacgagctagtgacgtcgtccagagaggaagcttggattacagtgagtaagcgctactag

SEQ ID NO: 25764 - DNA, 1308 bp, Artificial Sequence
  Description of Artificial Sequence: Synthetic coding sequence
atgctggatttcgccatatttgcggttaccttcctgttggctctggtaggggccgtcctgtatctttaccctgcctcaaggcaggctgcaggcatccctgggatcacacctaccgaagaaaaggatgggaacctgccagatatagtgaacagcggtagcctccacgagtttctggtaaatctgcacgagcgatatgggcccgtggttagcttttggtttggccgacgcctggtcgtgtccctcggcaccgtggatgttttaaaacagcatattaacccaaacaagacctcagacccctttgaaacgatgctgaagtcacttcttcgataccagagcggaggcggttcagtgagtgaaaatcacatgagaaagaaactttacgagaacggggtgacggactcccttaagagtaatttcgcgctgctactcaagctcagtgaagaactcctggataagtggctgtcataccccgaaacccaacacgttccgttatcccagcacatgctcggattcgcaatgaagtccgtcacccagatggtcatgggctcaacctttgaggacgaccaagaagtgatccggtttcaaaagaaccacggtactccatcatgcaactggagcctgttcaaggagcaccacaaaagaacgaagcgtaaagagctgcaaagcacttatttcatcgactccctggtgcaggggaacctcaatgatcagcaaattcttgaggattctatgatcttctccctggcatcctgcatcataacagccaagctgtgcacctgggccatctgttttctgacaacaagcgaggaggtgcagaagaagctatatgaagaaattaatcaggttttcggcaatgggccagttacccccgaaaagattgaacaattaagatattgccagcacgtactctgtgaaactgtccgcacggccaagttgacgcccgtatcagcccagctgcaggacatcgaagggaaaattgaccgattcataatcccccgggaaactctggttctgtatgctcttggagtcgtgctgcaggaccccaatacttggcctagtccacacaaatttgaccccgatagattcgacgacgagctagttatgaagacattctcaagtctggggttcagcggtacccaagaatgcccagaactgcgattcgcctatatggtcacaactgtcctgctctctgtgctcgtgaagcggctgcaccttctaagcgtagagggacaggtgattgagacaaaatacgagttggtgactagttctcgggaggaggcctggattaccgtgagtaagcgctactag

SEQ ID NO: 25765 - DNA, 1539 bp, Artificial Sequence
  Description of Artificial Sequence: Synthetic coding sequence
atgttgtttgaaggcctagatctagtgtctgcccttgccacccttgccgcgtgtctcgtgtctgtcacactgctcctcgccgtatcacagcagctgtggcagctgcgctgggccgctacacgcgataagtcgtgcaaactgcccattccaaaagggtccatggggttccccctcataggagagaccggccactggttgctccagggttccgggttccagagctcgaggcgggagaagtacggaaacgtgttcaagacccacctgctggggcgcccacttattcgggtcaccggtgcagaaaatgtccgtaagattctcatgggcgaacaccacctcgtctcaaccgagtggccccggagcacacggatgctgcttggacccaatactgtgagcaattcaattggcgatatccatcggaacaaaagaaaagtattctccaagatcttttcccatgaggccctggagtcatacctgcccaagattcagcttgtgatccaagatacattgagagcctggtcctcccatcccgaggcaatcaatgtataccaagaggcccagaaattaaccttccggatggcaattcgggtgcttttgggattttctattccggaggaggatctgggccatctgtttgaagtttaccagcagtttgtggataacgttttttctctccctgtagatctgcctttcagtggctacaggaggggcatccaggcccgccagattcttcagaagggtttggaaaaggccataagggaaaaactgcagtgcactcagggaaaagattatctggatgcattagatcttttgattgaatcttccaaagaacatgggaaagaaatgaccatgcaggagctgaaggacggaacgcttgagcttatatttgctgcctatgccacaacggccagcgcctccacctcactcattatgcagctcctcaagcatccaacagtcctcgagaaactgagagacgagctgagagcccatggcatcctccacagtggtggatgtccatgcgaaggaactctccgtctggataccctcagcggactgaggtaccttgactgcgtaattaaggaggtcatgcgtctgttcacacctattagcggagggtacagaaccgtgctgcagacctttgaacttgatgggttccagattccaaagggatggtcagtgatgtactccataagagacacacatgacaccgcaccagttttcaaagatgttaacgtctttgacccagacagattctcacaggctcggtctgaagacaaggatgggagatttcactatcttccgtttggtgggggggttaggacttgtctgggcaagcacctcgcaaaactttttcttaaggtactcgccgtggaactggcctccacctcccgctttgagctggccacccgcacatttccacggataacattagtaccagtactgcaccccgtggatggcctgtctgttaaattcttcggtcttgattccaatcaaaatgaaatcttgccggaaacagaagctatgctgagtgcgactgtttag

SEQ ID NO: 25766 - DNA, 1314 bp, Artificial Sequence
  Description of Artificial Sequence: Synthetic coding sequence
atgttgttcgagggactcgacctggtgagcgccctggccacactcgctgcgtgcctcgtgtctgtcacccttctcctggccgtgtcgcagcagttgtggcaactccggtgggccgctacacgcgacaaaagctgcaagctccccatccctaaaggaagcatggggtttccgcttataggtgagaccgggcattggctgctccaggtgttttcaaagatattttcccatgaggcactggagtcttacctgccaaaaattcagctggtgattcaggacacgctgcgggcttggtcctcacacccagaagctataaacgtgtaccaggaggcacaaaaacttactttccgcatggccattagggtcctgttgggcttctcaattccagaggaggaccttggccacctgtttgaggtttatcagcagtttgttgacaacgtcttctccctaccagtggatctgcccttttccggttacagacgggggatccaggctcggcagattctgcagaagggtctagagaaagccatcagagaaaaactgcagtgcactcaaggaaaggactacttggatgccctagatttgttgattgagagctccaaggagcacggtaaagagatgaccatgcaggagctgaaggatgggactctcgaactcatatttgccgcatatgcaacaaccgcctccgccagcacatccctcatcatgcagcttttaaaacacccgacagtgctcgagaagctacgagacgagctgcgagcccacgggatacttcattccggaggctgcccctgcgaagggacgctccgattggacaccctttctggcctcagataccttgactgtgtgatcaaagaggtgatgaggctttttactcccatctcgggcgggtacaggaccgtgttgcagacctttgaactggatggcttccagatacccaagggctggtctgttatgtacagcataagagatacccacgacacggctcccgtcttcaaggacgttaatgtctttgatcccgacagatttagccaggcgcgatcggaggataaagacggtcgttttcactatctccccttcggtggaggtgtaaggacttgtctaggcaaacacttagctaagttgttcttgaaagtacttgccgtggagttagccagtacttcccggttcgaactggctacccggacttttccacgtattacactcgtcccagtccttcacccagtcgatggcttatccgtgaagttctttggactcgattcaaatcagaatgagatcctgcctgaaacagaagcaatgctgagtgccaccgtgtag

SEQ ID NO: 25767 - DNA, 1368 bp, Artificial Sequence
  Description of Artificial Sequence: Synthetic coding sequence
atgtctgtctccgtcctgagcccttctcgtagactgggcggggtctcgggaattctgcaggtgacctctctgctgattttgttacttctcctgattaaagctgcgcaactctacttacacaggcagtggttgctgaaggcccttcagcagttcccttgtccgccctcacattggctctttggtcacatccaggagttccagcatgaccaagaactccaaagaatccaggagcgggtgaagacattcccttcggcttgcccctactggatttggggtggaaaagttcgcgttcagttatacgatcccgattacatgaaagtgattctggggcgatctgatccaaagagccacgggtcttacaaatttttggctccaaggatcggttacggcttgctgcttctcaatggacagacctggttccagcataggaggatgctgactccagcttttcataacgatattctcaagccttacgtcggccttatggcggatagcgtgagggtgatgctagacaaatgggaggagctgctcgggcaagactcccctctggaggtgtttcagcacgtatctttgatgaccctggatactatcatgaagtccgccttcagccaccaaggttcgatccaggtggataggaatagtcagtcttacatccaggcaatcagcgacctaaactcactggttttttgctgcatgcggaacgccttccacgagaacgatactatctactccttgaccagcgcaggacgctggacccaccgtgcttgtcagctggcccaccagcacacggaccaggttattcagctgaggaaagctcaattacaaaaagagggggaactggagaaaatcaagaggaagagacacctcgacttcctggacatactgttgctcgcaaagatggagaatggctcaatactgtccgataaagatctccgggccgaagtggacaccttcatgttcgaggggcacgatactacagccagtggcattagctggatcctctatgcactcgccacgcaccctaagcaccaggagaggtgtcgcgaggaaatccacggtctgctgggagatggcgcctctatcacctggaatcatctcgaccagatgccatacaccactatgtgcattaaggaagccctccggctatacccacctgtcccaggaattggacgtgagctaagtaccccagtgaccttccccgatggtcgctcattgccaaaggggatcatggtcctgctgtctatatatggcctacatcataatccaaaggtgtggccaaatttggaagtgtttgatccttcgagatttgcccctggtagtgctcagcattctcacgcgttcctccctttcagcggcgggagtcgctag

SEQ ID NO: 25768 - DNA, 1266 bp, Artificial Sequence
  Description of Artificial Sequence: Synthetic coding sequence
atgtccgtctctgttctatctccttcacggcgcctggggggtgtttctggcatcctccaagtcacctccctactcattcttctgctcctgctgattaaggctgctcagctctatctgcaccgccagtggttgctgaaggctctgcaacagttcccctgtcccccttcacattggctctttggccacatccaagagtttcagcatgatcaggagctccagaggatccaggagagagtgaaaacttttccttccgcatgtccctattggatctggggcggtaaagtgcgggtccaattgtatgaccctgactatatgaaggttattcttggaaggagtgatcccaagtcccatggcagctataaattccttgccccgagaattggatacggactgctgctgctcaacggccagacgtggtttcagcaccggcgcatgctaaccccagcttttcataacgacatactcaagccttatgtggggctaatggcggattcggttcgcgtgatgctggacaagtgggaagaactgctgggccaggacagcccattggaagtgttccagcacgtgagcttgatgactcttgacacaatcatgaagtctgccttctctcatcagggatccattcaggtcgacagaccgagcgaccccaccgaggaaggtagcacgacagagggaggtggggcaggcgaagaccaggaggaggaagctctcgggttcagtgggcaccccccactggggcagcgggcccccggactgcccaggccctgttggtgctccggatggaactgcttcaggaaccatttagatcagatgccctacactaccatgtgtatcaaggaggccctccgcctgtatcccccagtgccaggaatcggccgggaactttccacaccagtgactttcccagatgggagatcactgcccaagggtattatggtgctcctgagtatatacgggctgcaccataacccaaaagtgtggccgaatttagaggtgtttgaccccagccgctttgctcctggaagcgcacagcactcgcacgcctttttgccattctctggaggctcccgcaactgcatcggcaagcagttcgcaatgaatcagctcaaagtggcacgggcattgaccctactgcggtttgagttgctacctgatcccactagaattcctattccgatggcccggcttgtcctaaagtctaaaaatggaattcacttaagactgagacgtttaccaaacccatgcgaggacaaggaccagctgtag

SEQ ID NO: 25769 - DNA, 1560 bp, Artificial Sequence
  Description of Artificial Sequence: Synthetic coding sequence
atgagcgtcagcgtgctgagccctagccgtaggctcgggggcgtctccggcatattgcaggtgaccagcctgcttatcctactgttacttctcatcaaggctgcccagctctatctgcatcgtcagtggctcctcaaggcacttcaacagttcccatgccccccttcacattggctgttcggccacatccaggaatttcagcatgaccaggagcttcagcgcatccaagagcgtgtgaagacgttcccttctgcttgcccttattggatctggggagggaaggttagggtgcagctgtatgaccctgattacatgaaggtcatcctggggagaagcgatccgaagagccacggctcatataagtttctcgcacctaggataggatacgggctgctgctgctaaatggtcaaacatggtttcaacacagaagaatgctgacacccgcctttcataatgatatcttaaaaccatatgtgggcttaatggccgacagtgtgagggttatgctggataagtgggaagaactgctgggccaggattcacctctcgaagtgttccagcatgtgtccctcatgactcttgacaccatcatgaagtccgccttttcacaccagggctcaatacaagttgaccgcaattcccagtcttatattcaagcaattagcgacctgaacagcttggttttctgttgcatgagaaatgcctttcacgagaatgacacaatttattccctaactagcgccgggcgctggactcacagggcctgtcagctggcccatcaacacacagatcaggttattcagttaagaaaggcccagctgcagaaggaaggcgagcttgagaagatcaagcgcaaaagacaccttgacttcttggacatcctattgcttgctaaaatggaaaacggttccatactgagcgataaagatttgagagccgaggtagacaccttcatgtttgaggggcacgatactaccgcaagtggtatctcatggattctctacgcccttgctactcaccctaaacatcaggaaaggtgtagagaagagattcacggtctgcttggggacggcgcctctatcacatggaatcacttggatcagatgccatacaccacaatgtgtattaaagaagcccttcgtttgtacccccccgtgccgggcatcgggcgggaattgtccactcctgtgacatttccagatggcagaagtcttcccaagggaatcatggttctgctctctatttacggattacaccataacccaaaggtctggcccaacttagaagtcttcgatccatctcgcttcgcccccggctccgcccagcatagccacgctttcctcccattcagcggcgggagccggaactgtatcgggaagcaattcgccatgaatcaactcaaggtcgcccgtgccctgactttgctgagattcgaactcctgcccgaccctacgcggatacctattcctatggcccggttggtgctcaagtcaaagaacggcattcatctgagacttaggaggcttccaaatccctgcgaggacaaggatcagttatag

SEQ ID NO: 25770 - DNA, 1536 bp, Artificial Sequence
  Description of Artificial Sequence: Synthetic coding sequence
atggtcccctcttttctgtccttatccttttcaagccttgggctctgggcttctggacttatcctcgtactgggctttttgaagctgatccacttgctgctacgaaggcagactctggctaaggcaatggacaaatttccagggccccctactcattggttatttggccatgcgctggaaatccaagagaccggtagcctagacaaagtagtgtcttgggcgcaccagttcccttacgcgcatccgttgtggttcgggcaattcattggattcctaaacatctatgagcccgactatgcaaaagccgtgtacagtagaggagacccaaaagcacctgatgtttacgacttcttcctgcagtggatcgggaggggcctcctggtgcttgaaggcccgaaatggctgcagcatagaaaactgctgaccccaggcttccattacgacgtcctcaaaccctacgttgcggttttcaccgagagcacgcgcatcatgctcgataaatgggaagagaaagcgagggagggaaagagtttcgatatcttttgtgatgtgggccatatggctctcaatactctcatgaaatgcacttttgggaggggtgataccgggcttgggcatcgcgacagttcctactacctggctgtctccgatctgaccctgctcatgcagcagcggctggtctcgttccaataccataacgactttatttattggctaactccccatggccgccgtttcctgagggcctgtcaggtggcccacgatcacaccgaccaggtcatcagggaaaggaaggccgcactacaagatgagaaggtgcgaaagaaaatccagaacaggcggcatttggacttcttagatattctgctcggggctcgagatgaggatgacattaagctgtccgatgctgacttgagagctgaagtggatacttttatgttcgaaggtcacgatacaaccacgtcaggcatttcatggtttctgtactgtatggcgttgtaccccgaacatcagcacaggtgcagagaagaggtgcgcgaaatactgggagaccaagacttttttcagtgggacgatttaggcaagatgacttacctcacgatgtgtataaaagagtcattcaggctgtaccctcctgtaccccaagtctatcgccaactatccaagcccgtgacttttgtggatggccgcagtctccccgccggaagcctgatctcaatgcatatctatgccctgcatcggaattcagccgtctggccagaccccgaagttttcgactctttgagattttccaccgaaaatgctagcaagcgccatccttttgcgttcatgccatttagcgccggaccacggaactgcatcgggcaacaattcgcgatgtcagagatgaaagttgtgactgccatgtgcctcctccgatttgagttttccctcgacccatcccggcttcctattaaaatgccgcaactggtgcttcgatctaaaaacggcttccatttacatctaaagcccctaggacctgggagtggcaaatag

SEQ ID NO: 25771 - DNA, 1494 bp, Artificial Sequence
  Description of Artificial Sequence: Synthetic coding sequence
atggtgccctctttcttgagcctcagctttagcagcctgggcctgtgggcatcgggtctcatcttggttctgggttttctcaaactcatacatctactcctccggaggcagaccttggccaaagccatggacaagttcccaggaccccctacacactggctgttcggtcacgccttagagatccaggagactggatctctggacaaagtcgtgagctgggcccaccaattcccatacgctcacccactgtggtttggccagttcattgggttcctgaatatttacgagcctgactacgcaaaggcagtttattcaagaggcggccggggactgcttgttctcgaggggcccaagtggttacagcatagaaaactgttgacccctggttttcactatgatgtcctcaagccttatgtggccgtcttcacggaatcaacacgaataatgctcgacaagtgggaggagaaggcccgggagggtaagtccttcgacatcttctgtgatgtgggtcacatggcactgaacacactgatgaaatgcacatttggccgtggagataccggattaggtcattcaagggacagctcctattacctagccgtctcggacctgaccctactcatgcagcaaagactagtgagcttccagtaccataatgattttatctactggctcacacctcatggcagacgcttcttacgcgcctgtcaggttgctcacgaccatacagaccaggtcatccgtgagcgtaaagcggctttgcaagacgagaaggtgcgaaagaaaattcagaacaggagacacctcgattttctggatattctgcttggcgctagggatgaagacgatattaagctgtctgatgctgatctgcgcgctgaggtagataccttcatgtttgaggggcatgacacgaccacttcaggaattagttggtttctatactgcatggctttataccccgaacatcaacatagatgcagagaggaagtccgcgaaattttgggcgatcaagatttctttcagtgggacgacctaggaaaaatgacctatctcacaatgtgcatcaaagaaagctttaggctttaccctcccgtgcctcaagtttaccggcaactgtcaaaacccgtgacttttgtggatggtcggtccttacctgccggtagtctcatctctatgcacatatatgcactgcatcgcaacagcgccgtctggccagacccagaggtcttcgactcgctccgtttttcaacagagaacgcttccaagaggcaccctttcgcctttatgcctttttcagccggtcccagaaactgcataggccaacagttcgcgatgagtgaaatgaaggtcgtcacagccatgtgtctactgcgcttcgagttttccctcgacccttctcggctcccgattaagatgcctcagctggtgctgcgcagcaaaaacggctttcacttgcatcttaagcccttaggacctggaagtgggaagtag

SEQ ID NO: 25772 - DNA, 1539 bp, Artificial Sequence
  Description of Artificial Sequence: Synthetic coding sequence
atggtgccaagctttctttccctcagcttctcgtctctcgggttatgggcctctggactgattcttgtgctcggctttctgaagctaattcatctcctgctgcggaggcagacactagccaaggcaatggacaaatttcccggtcctccaacccattggctgtttgggcacgccctggagatccaagagacaggctccctcgataaagtggtatcttgggcccatcagttcccctatgcacacccattgtggtttggccagttcattggattcctgaatatttatgagcccgattatgcaaaggccgtgtattcaagaggcgatcccaaagccccagacgtgtacgattttttcctgcagtggattggaaggggcctgttggttttggagggacctaagtggctccagcaccggaaattgttaacacccggctttcactatgatgtactgaaaccgtacgtcgcggtctttactgagtctacccggattatgctggacaagtgggaggagaaagcgcgggagggcaaaagctttgatatattttgcgatgtgggacatatggccctcaatacactgatgaagtgtacttttgggaggggcgacacagggttaggccattcgcgggactcatcatactacctggccgtctccgacctcactctcctgatgcaacaaagattggtttctttccaataccacaacgactttatttactggctgaccccccatggccgaagatttctcagagcttgtcaggtggcccatgaccatactgatcaggtcatacgggaaagaaaggcggcactgcaggacgaaaaggtccggaaaaagatccaaaaccgacgacacttggattttctggacatattgctcggcgcccgcgacgaagacgatattaaacttagtgacgccgacttacgggctgaagtggatactttcatgtttgagggccacgataccactacctctggaatttcctggttcctttactgcatggctctgtatccagaacatcagcaccggtgccgggaggaggtgagagaaatccttggggaccaggacttctttcaatgggatgatctgggaaaaatgacatatctgacgatgtgcattaaggagtcttttcgactctacccaccggtgccccaggtgtaccgccagctgtccaaaccagttactttcgtagacggccgatccttgcccgccgggagcctaataagtatgcacatctacgctctccaccgtaatagcgcggtatggcctgaccctgaagtgttcgattctctgcggtttagtacagaaaatgcctccaagaggcatccattcgcgttcatgcccttttcagccggcccacggaactgcatagggcagcaattcgccatgagcgagatgaaagtcgttaccgccatgtgcctcttacgattcgaatttagccttgaccctagccggttgcctatcaagatgccccaactcgtcctacgatctaaaaacggcttccatcttcacttgaagccactgggcccgggaagcggcaagtag

SEQ ID NO: 25773 - DNA, 573 bp, Artificial Sequence
  Description of Artificial Sequence: Synthetic coding sequence
atgctgacgccagccttccactttaacatcctgaagccttacatgaaaatttttaacgagtccgtcaatatcatgcacgccaaatggcaactgttagcgtcagagggaagtgcctgcctggatatgttcgagcacatttcgctaatgactcttgatagcttgcagaagtgcgtgttcagcttcgattctcactgccaggagaagcctagcgaatacatcgccgccatcctggaattatctgctctggtctctaagaggcatcacgagatactgcttcacatcgactttttgtactatctgaccccagacggccagaggtttagacgggcatgtcggctcgtgcatgacttcaccgacgctgtgatccaggagagacgacgcaccttgccgagccagggagtcgatgactttttgcaggcgaaagccaagagtaagacattagacttcatagacgtgctgctcttgtccaaggctatgacaccccggccagtcgtcagcccaggatcatgcactactctgcaaagcacccaaaacactcgcagcgcggctgggcggcgatgcaagaacttctag

SEQ ID NO: 25774 - DNA, 1974 bp, Artificial Sequence
  Description of Artificial Sequence: Synthetic coding sequence
atggcctccgctcgtaaggccagccgccccatgcgggatgtgttcggagacttttccgacgtgtcgctggaagattctacaatggaagaaataagaaactttcagatcagccgcaatcttactaagatcgctccagggcactccaggtttctgaagagaaaccagaccctggatgagaaacatttgctgttaaaggaaaacccggtcctgggtagtggccctcggctagcctcctgtcggccgcctacaacggcatcccgaatccgcgccaatgccgcactgatgaagctcgcccagttggagactcgcatcatgaataggaagctccagcgcaatctcagcgatacagagagcgactcaatgaccgcagatgctggtctgcccaagcgcgccgaccggatactgtcaggcggagccctcgaactggcctcacagaacacggacaagacatcgcaaaatcaggcccgggagctccctgtgacagagaataatgcccagaatgccaaggtgagtaggtttctgaaaaagaaacaggcccccgttgaaaatatatcaccagaggcacccgccgggaaggagcggacactgcagactccaaaacaaaaggagcccgcacgcacattcgactcacccgacagtgatgaggaggagatgaaagtacttttggggagcttaatggatagttctagggaaaagaacaccaatcaaggatttagctcagccaatgtgagtgaggaggaagagagaaagctgttcagcgtgccgtcacagttgcgcgcttttaccgttccgtctgtcgagcttagctccgcaaaaccatcccagactagccatcttcctacgtctctcgcggctgatcgaacgctccatagcacacgttcccgggcagattatcctcaaagccacgtcagcagtgatacagcctctcacacaccttcagtctccataacgggagctttcagcaacagcgtgtccctcaagatgggacatgtcaagctggtatcctcacccggccgttccgaagccgagacagtcgatgagcctgtgagtgagggggcagatgactccctggacgaatttagaataaacatcctgtcactcgacggcctggcgccagcggtttcagagaattcagacctggagcaagaggaagagtccgcccagaggcagaaaacggcaggcaagattttccgcgccgaggctagtacaggacaggacgctcctcggcaagcccaggctcgcagttgggcctcacaggggaaagctgcctctgcagaaggggacgagagtgaggtgtctgagcatctgagcgcctcatcggcaagcgctatccagcaggacagcactagctcgatgcagccaccctctgaagcaccaatggtgaacaccgtttctagtgcttactctgaggatttcgagaattcacctagccttacggcctccgaaccgaccgctcacagcaaggagtctctggaccggactctcgacgccttatcggagagcagctcttccgtcaaaactgacttgccccagaccgcagagtcccggaagaagtctggacggcacgtaaccagagttcttgtgaaagacacggcagtacagacccccgaccctgcattcacttatgagtggaccaaagtagcaagcatggctgctatgggccctgcactgggaggtgcctacgtggaccctacccctatcgctaatcacgtgatttcagcagacgcaatcgaggccctcaccgcctacagccccgcagtactagctcttcatgatgtgttgaaacagcagctctcactgacccagcaatttatccaggcatctcgtcacctgcacgccagtctgctgcgcagcttagatgctgattccttccactatcacactttggaggaggcaaaggaatacataagatgtcacaggccggctcccctcaccatggaagatgcactggaggaggtcaacaaagagctttag

SEQ ID NO: 25775 - DNA, 1116 bp, Artificial Sequence
  Description of Artificial Sequence: Synthetic coding sequence
atgttgacccccgcgttccattttaacatcctcaagccatacatgaagattttcaacgagagtgttaacatcatgcacgccaagtggcaactgctcgcctcagagggttccgcttgtctggacatgtttgagcacatttccctgatgaccctcgattctctccaaaagtgtgtcttcagcttcgactcacactgtcaggagaaaccttctgaatatatagccgcgattctggagcttagtgcgctggttagcaagagacaccatgagattctgttacatatagattttttgtattatctcactccagacggacagcgattccggcgtgcttgtcggctggtccacgacttcactgacgccgttattcaggagaggcgccggaccctaccctctcagggcgtcgatgatttcctccaggctaaagcaaagtccaagacactggacttcatcgacgtgctccttctgagcaaggacgaggacggaaaaaagctgtctgacgaggatataagagccgaagccgatacgtttatgtttgagggacacgataccacagcgagtggcctcagttgggtgctctatcacctggcaaaacaccctgaatatcaagagcggtgtaggcaagaagttcaagaactcctgaaagacagagaaccaaaggagattgaatgggatgatctagcacaccttccattcctcacaatgtgtatgaaagaatcattgcggcttcaccctcctgtccctgtgatttcgcgccacgtgacacaagatatcgttcttcctgacggacgcgtgatcccaaaggggattatttgcctgatctcagtttttgggacccatcataaccccgccgtctggccagaccccgaggtgtatgatccattccgcttcgacccagaaaacataaaggagcggtctccactggcttttattcctttcagtgcggggccccgcaactgcataggacaaaccttcgccatggctgaaatgaaggttgtcctcgcactgacactgctgagattccgcgtgctgccagaccacaccgaacctaggcgtaagcccgaactggttcttcgggctgaaggtgggctgtggctgcgagttgaaccccttagctag

SEQ ID NO: 25776 - DNA, 1530 bp, Artificial Sequence
  Description of Artificial Sequence: Synthetic coding sequence
atggagttcagctggctggagacccggtgggcaaggccattctatctggcttttgttttctgcctggccctgggcctgcttcaggctatcaagctatacctgcgcaggcagcgcctcctccgagatctcaggccattccctgcccccccaactcactggttcttgggtcatcagaagtttattcaggacgataatatggagaagctggaggagatcatcgagaaatatcctagggcatttcccttctggatcggaccatttcaagcattcttttgtatatacgatcctgattacgcaaaaactctgctgtcaagaactgaccctaagtcacagtacttgcaaaaattcagccccccactcttgggaaaggggcttgccgccctggacgggccaaaatggtttcagcatcgccggttgctcactcccggatttcatttcaatatattgaaggcatacattgaagtgatggcccactctgtcaagatgatgctggataaatgggagaagatatgctctacacaagacaccagcgttgaggtctatgaacacatcaactcaatgagcctggacatcattatgaagtgtgctttcagtaaggagaccaattgtcagacaaactccactcacgacccttacgccaaagcgatcttcgagctttctaaaattattttccataggctgtactcgctgctttatcattcagacatcattttcaagttgtctccccaaggttatcgcttccagaagctgtcccgggtgctgaatcagtacaccgataccattatccaggagagaaagaagtccttacaggctggggtgaaacaggacaacaccccaaaaagaaaatatcaggacttcctggacattgtcctctctgcgaaagatgaatctggctcctccttttcagacattgacgtgcatagcgaagtgtctaccttccttcttgccggacatgataccctcgctgcgagcatttcgtggatactgtattgcctggccctgaatccggaacaccaggaacgctgccgggaggaagtgagagggattcttggggatgggtcgagtatcacctgggaccaactcggagagatgtcatatacaaccatgtgcatcaaggaaacttgccgcctaattcccgcggtgccaagcatcagccgagatttatccaaaccccttacttttccagacgggtgtactctccctgcaggtattacagtggtactgtctatctggggtctccaccacaatccagcagtctggaaaaatcctaaggtctttgatcctcttcgctttagccaggagaatagcgaccagagacatccatacgcttacctgcctttcagtgcgggtagcaggaattgtatcggacaggagtttgccatgatcgaattaaaagtaaccatcgccctgatccttctccacttccgggttacacctgaccctactagacctctcacctttccaaaccatttcatcttgaagccaaagaacggaatgtacctgcatcttaagaagctcagtgaatgttag

SEQ ID NO: 25777 - DNA, 1527 bp, Artificial Sequence
  Description of Artificial Sequence: Synthetic coding sequence
atgatgtggggcggcggactggatctttgtcccatgcctggccaactgaagttcccaccctgcctgtctcgttgtctgttgtgggaaccacctagcctgtaccttacccaacctacaagttccttggccgagcctcaggcactgatatgtatgacatccagttcctctgggctgttcatccaagacgataatatggaaaagcttgaggagataatcgagaagtacccgcgagcattccctttttggattgggcccttccaggcgtttttttgcatctacgatcctgactacgctaaaactctactgtcgcgcacagaccccaagagtcagtatctgcagaagttctcgccgcccctgctcgggaaaggattggccgccttggacggacccaagtggttccaacaccggcgtctcctgactcccggattccacttcaatattctgaaggcttacattgaggtgatggcacattctgtgaagatgatgctggacaagtgggagaaaatatgcagcacccaagacactagtgtcgaagtatacgagcacatcaatagcatgagtttggatattattatgaagtgtgcattctccaaagagactaattgtcagacgaacagcacgcacgatccgtacgccaaagctattttcgaactgagcaagatcatattccataggctgtactctttactatatcactccgacatcatcttcaagctatcgcctcaggggtaccggttccagaaacttagcagggtcctgaaccagtacaccgatacaatcatccaggagaggaaaaaatctctgcaagctggagtgaaacaggataatactccaaagagaaagtaccaggacttcttagacattgtcctcagcgcaaaggatgaatccgggtcctcattctccgacatagacgtgcacagcgaagtctccacattcttgctggctggccatgacactctcgctgctagtatcagctggatattgtattgcctcgccctgaatcccgaacaccaggagcgctgcagggaagaggttagaggcatactcggcgatggcagctctattacctgggaccagctaggagaaatgtcctacaccactatgtgcataaaggaaacttgtagactgatccccgctgtcccaagcatttccagggacctcagcaagcctctgactttccccgacggatgcacccttccggcagggatcactgtggttcttagtatatggggcctgcaccacaatcctgccgtgtggaagaatcccaaggtgttcgacccgctcagattttctcaggagaactcagatcagcgccatccatacgcctatcttccgttctctgcagggtccagaaactgcattggacaagagtttgccatgatcgaactgaaggtcactatcgcactgatcctcttacattttagagtcactcccgaccctacaagaccacttacattccctaaccacttcattttgaaacctaagaacggcatgtatttgcacctgaaaaagttaagtgaatgctag

SEQ ID NO: 25778 - DNA, 1518 bp, Artificial Sequence
  Description of Artificial Sequence: Synthetic coding sequence
atggagcccagctggctgcaggaactcatggcccacccctttctcctgttgatcctgctgtgcatgtctctgctcctgttccaggttatcagactgtatcaacgtcgaagatggatgatccgtgctcttcacctattccctgcaccaccagcacattggttctatggtcataaggaattttaccccgtcaaggaatttgaagtgtatcataaattgatggaaaaatatccatgcgctgtgccactttgggttgggcccttcacaatgtttttctccgttcatgatcccgattacgctaagatactcttgaagaggcaagatcctaagagcgccgtgtctcataagatcttggagagctgggtaggccgcggactcgtcacactcgacgggagtaagtggaagaagcatagacaaatcgtgaagccaggatttaacatatccatccttaaaatctttataaccatgatgagcgagagtgtcaggatgatgctgaataagtgggaagaacacattgctcagaattctcggctggaattatttcaacatgttagtctcatgaccttagatagtatcatgaagtgtgccttcagtcaccagggtagcatccaactggactctaccttggatagctacctgaaagccgtgtttaatctgtcgaaaatcagcaaccagcggatgaacaactttctacaccacaatgatctggtctttaagttctcttcacaggggcagatcttcagtaagttcaatcaggaactccaccaatttactgagaaggtgatccaagaccggaaggaatcacttaaagataagctaaagcaggatacaacacaaaaacgccgctgggactttcttgacatcctgttaagcgcgaagtccgaaaatacaaaggacttcagcgaagccgacctccaggcagaagtgaagacattcatgttcgccgggcatgatactacaagtagcgcaatctcctggattttgtattgtctcgctaagtaccccgagcatcagcagagatgtcgcgacgaaattagagaactgttaggggatgggtcctccataacatgggaacacctcagtcagatgccatacacaacaatgtgcatcaaagagtgcctgaggctgtacgctcctgtagttaatatctctagactcctagacaaacctattacctttcctgacggaaggagcttaccggccggcattaccgtttttattaatatctgggccctccaccataatccatatttctgggaggatccacaggtttttaaccccctaagattctcccgggagaattctgaaaagatccacccatacgcttttatcccctttagcgctggacttcggaattgtatcgggcagcatttcgccattatagagtgcaaagtggcagtggccttgacgctcctgcgattcaaattggcaccagatcactctcgacccccgcaacccgtcaggcaggtggtcctgaagtcaaagaatgggatccacgtgttcgctaagaaggtctgctag

SEQ ID NO: 25779 - DNA, 1809 bp, Artificial Sequence
  Description of Artificial Sequence: Synthetic coding sequence
atgccaagtgctaagcagcgcggaagtaaggggggtcatggggcagcttccccttccgagaagggggctcatccatctggaggagctgacgatgtcgcaaaaaagcctccccccgcaccacagcagcctcccccaccgcctgcgcctcaccctcaacagcatccccagcagcaccctcagaaccaggcccacgggaaaggaggacatcgtggaggcggcggggggggcggcaagtcttcatcctcttcatctgcctcggcagctgccgccgccgccgccgcgtctagttccgcttcctgctcccgccggctgggccgagcactaaactttctcttttatctggcccttgtcgccgcagccgcattttctggctggtgcgtgcaccacgttcttgaagaagtgcaacaggtccgacgatctcatcaggacttcagtaggcagagagaggagctgggacagggtcttcagggggtagaacagaaagtgcagagtctccaggccacctttgggacctttgagagcatcctgcgctccagccagcacaagcaggacctcactgaaaaggccgttaagcaaggcgagagtgaagtcagcagaatcagcgaagttctgcaaaagcttcagaacgagatactcaaggacctttcagatgggatccacgtggtgaaagatgcaagagagagggactttacctctctcgagaataccgtggaagaaagactaaccgaactgactaaatccattaatgataacatagccatctttacagaagtgcagaaaaggtcccagaaggagatcaacgatatgaaggcgaaggtcgcatctttagaggaatctgagggcaacaagcaagacctcaaggccctcaaggaggcggtcaaggaaatccaaacctctgctaagtctcgggaatgggacatggaggccctccgttccactttgcaaactatggaatccgatatttataccgaagtgagagagctagtcagcctcaaacaggaacagcaggcgtttaaggaggcggccgacacagaaaggctcgcattacaagccctgactgagaaattgctgagatcagaagaatcggtcagtcgcttgccagaagaaattcggaggctggaggaagaattgcggcagttaaaaagcgactcacatggccctaaagaggacggcggatttcgacattctgaggcatttgaggcccttcaacaaaagtcacagggcctggactcgaggctgcagcacgtagaggacggcgtcctctctatgcaggtagctagcgctcgccagaccgaatctctggaatccctattgagcaaaagccaggagcatgagcagagacttgcggcgctgcaaggtaggctggaaggcctgggaagtagcgaggcggatcaggacggcttagcctcaacagtgcggtccctgggcgaaacacaactggtgttgtatggcgacgtggaagaactgaagcgctcggtcggcgagctgccatctactgtggagtccctccagaaggtgcaggagcaagtccacactctgctgagccaggatcaggcccaggcggcgcggttgcctccccaggatttcctagaccgcctcagtagtttggataatctcaaagctagcgtttcccaggtggaagctgacttgaaaatgctgagaacagccgtggatagcctcgtagcctacagtgtcaaaattgaaaccaatgagaataacctggaaagtgcgaagggattgcttgacgatctcagaaacgacctcgataggctgtttgttaaggtggagaagatccatgaaaaggtgtag

SEQ ID NO: 25780 - DNA, 9897 bp, Artificial Sequence
  Description of Artificial Sequence: Synthetic coding sequence
atgcaaaaagagctgggcattgtgcctagctgcccaggcatgaagtctcctagacctcatcttttactccccctcctccttctgttgctcctgctgttaggagctggcgtgccgggtgcgtggggccaggccggcagcctggatctgcagattgatgaggaacagccagctggcacactgatcggagatatctccgcaggcctgccagctggcaccgcagctcctctgatgtattttattagtgctcaggagggttccggggtggggaccgacctcgccattgacgaacattcaggggtggttcgaacagcgagggtcctggatcgggagcagagagacaggtatcgcttcacggccgtgactcccgacggcgcaacagtggaagtcacagtccgcgttgctgatataaatgatcatgctccagcttttccacaagccagggcagctctccaggtcccagagcacacagcattcggcacacgctacccactggaacctgcccgcgacgcagacgcaggacggttgggcacacaagggtacgcgctgtccggcgacggcgctggtgagacattccgtctcgagacacgccctggccccgatggaacgcctgtccccgaactggtggtgacgggcgagcttgaccgagagaaccggagccactacatgctgcaattggaggcttatgacgggggaagccccccacgtcgcgctcaggctctgctcgatgtcacgctgctggacatcaacgatcatgcgccggctttcaatcagtcacgataccacgctgtggtgtcagagtccctggctcccggctcccctgtgcttcaggtttttgcctcagatgccgacgcgggggttaatggcgccgtaacctacgaaattaacaggcgccaatccgaaggggatgggccttttagtatcgacgcacataccggattgctccagcttgagcgccccttagacttcgagcagagacgggtgcacgaactcgttgtgcaagcgcgcgatggcggcgcacaccccgaactcggaagcgccttcgttacagtccatgtcagggacgcaaatgacaaccaacccagtatgaccgttattttcctgagtgccgacgggagtccacaggtgtcggaggccgcccctcccggacaactcgtggctcggatatccgtcagtgatcctgatgatggagactttgcccacgtgaatgtgtcactcgagggcggtgaaggccattttgccctgtccacacaggactcagttatttatctcgtgtgtgtggcccgacgactcgatcgagaggagagagatgcatacaatctgcgtgtcaccgcaactgatagcggatcacccccgctgagggccgaagctgctttcgtcttacatgtgacagacgtgaacgacaacgcacccgcgttcgatcgccaactctatagaccagagccgctacccgaggtagcactccccggctccttcgtggtgagagtaaccgctagggatccagaccagggtacaaatgggcaggttacttatagtctggctcctggggctcatacccattggttttcgatcgaccctacctccggtatcataacgacagccgcgtctttggattacgaactggagccccagccacagctgatagtggtcgctacagatggggggctgccgccgctggccagctcagccaccgtgtccgtcgctctgcaggacgtaaacgataacgaaccccagttccaacggaccttctataacgcgtctctgcctgaaggaacgcagccgggcacctgttttctgcaagtcaccgctacggatgccgactcgggtcctttcggcctgctgtcttattcactgggagccggtctaggttcatctggcagccctcctttcaggattgacgcacatagcggcgacgtttgtacaacccgcacactagatcgcgaccaaggtccctcctccttcgactttacagtgactgctgtggacggcgggggcctcaagtctatggtgtacgtaaaggtattcttatccgatgagaacgacaacccgcctcagttctatcctagagaatacgctgcgtctatttcagcccaatctccacctggcacagccgtgttgcgcctgcgcgcacatgatcctgaccaaggttcccatgggcggctctcctatcatatcctggcgggtaacagcccacctcttttcaccttggacgagcagagtgggctgctaaccgtggcctggcctctcgcccgccgggccaactctgtagtacagctcgagatcggagccgaggacggcggaggcttgcaggccgagccatccgcgagggtcgacatctcaatcgtaccgggcacccctacaccccccatcttcgaacagctccaatacgtcttctctgtccccgaggacgtggctcccggtacatcagtcggaatcgttcaagctcataacccccccggacgtctggcccctgtgactctaagcctgagtggcggggatcctagggggctgttcagtcttgatgctgtctccggtctgttacagactctaaggcccctagaccgagagttgctaggtccggtgctagagctcgaggttcgagccggttcgggcgtcccccctgccttcgctgtggccagggtccgagttctgttagacgatgtgaatgacaattctcccgcgtttcctgccccagaggacactgtgttgttacccccaaataccgcacctggcacccctatctatactctccgagctctggatcccgacagcggtgtcaactcaagagtgacgttcactctgttggcaggcgggggaggtgccttcaccgtagacccgactaccggtcatgtgcggctcatgcgccctttaggcccaagcggcggccctgcacatgaattggagttggaagctagagacggtggatctcccccacgtacatcgcacttccggttgcgggtggtcgtgcaggacgtgggaacacggggcctcgccccacgctttaacagcccaacctaccgcgtggatctccctagcggaactactgcaggtacccaggttctgcaggtccaggcccaagcccctgacggcgggcccataacttaccacttagcagcagaaggggcgtcttcacctttcggcctggagcctcagagcggctggctgtgggtgcgagctgccctggatagggaagcccaggagctgtacatcctcaaagtgatggcagtgagcggttccaaggctgaactagggcagcagactggtacagccaccgtccgggtcagcatcttgaaccagaacgagcactcaccccggctgtcagaagatcctactttcctggccgtggccgaaaatcagccccctggtacatccgtgggtcgggtctttgctactgatcgggatagcggacccaacggaagattgacttatagtctccaacaactgtccgaagatagtaaggcgtttagaatccacccacagacgggtgaggtgacaacattacagaccctggatcgtgagcaacagtcttcctatcagctgctagttcaagttcaagacggagggagcccgcctcggagcacaaccggaacagtgcatgtggccgtgctcgacctcaatgataactcccctacatttttacaagccagcggcgcggccggcggcgggcttccaattcaggtacctgatcgagtgccgcccggcactctggttacgaccttgcaggccaaagaccccgatgaaggagagaacggtaccattctgtataccttgacaggaccaggctccgaactgtttagtttgcacccccacagcggcgagctgctgaccgcagcccccttgatcagggctgaacgcccccattatgttctgacattgtccgcgcatgaccagggatcaccaccacgctccgcgtctctccagcttctagttcaggttctgcccagtgcccgtctcgctgagcctccacctgacttggcagagcgtgatccagcagctcccgttccagtggtactcacagtaacggccgcagagggcttgagacccggaagcctgctgggctcagtcgccgcacccgaaccagctggcgttggggcactgacttacacccttgttggcggcgcagaccccgaaggtacttttgcactggacgctgcctccgggcgtttgtatttagcccgcccactggactttgaagccggaccaccatggagagccctgactgtccgcgccgaaggacctggcggagccggagcgagactcctacgggttcaggtccaggtgcaggacgaaaacgaacacgccccggccttcgctagagatccactggctttagcactgcctgagaatcccgagcctggcgccgccctatacacgttccgcgcgtcggacgctgacgggcctggtcccaattctgatgtcagatatagattgttacgtcaggaaccacccgtacctgctctccggctggacgcaaggacgggggccctgagtgcgcctaggggtttggacagagagactacaccagctctgctgctgcttgtggaggcgacagataggccagcgaatgctagtcggcgcagagcagctcgagtcagcgcccgcgtcttcgtcacggacgagaatgacaacgcacccgtgttcgcttcaccatcaagggtacggctcccagaggaccagccaccaggaccagccgccctgcacgtcgtcgccagagacccagacttgggagaagccgcccgcgttagctatcgactggcctcaggaggcgacgggcacttccgactccacagcagtacaggagccctcagcgtagtgaggccactggacagagaacagcgcgccgaacacgtcttgacagtggtggcctccgatcatggttcccctccaagatctgccacacaagtgctgactgtgtccgtggcggacgtgaacgacgaggcaccaacatttcagcagcaggaatactctgtcctgctgcgcgaaaacaacccaccgggcacttctctgctgacgcttagagctacagacccggacgtgggggctaacggacaggtcacatatggcggggtcagctctgaaagtttctcgctggatccagacactggtgttctgaccacactgagggcccttgatcgcgaggagcaggaggagataaacctaaccgtgtacgctcaggacaggggctccccaccacaattgacccacgtcactgtgcgtgtggcggtggaggacgaaaatgatcacgctcccactttcggatctgcacatctgagcctggaagtacctgagggccaagaccctcagacgctcacgatgttaagggccagtgatcctgacgtcggggcgaatgggcagctgcagtacagaatcctggatggcgaccccagtggcgctttcgtgctggacttagcctctggggaattcggcaccatgcggcccttggatcgggaagttgagcctgcatttcagttgcgcatcgaggctcgcgacgggggacaaccggctctgagcgcaaccctgctactcaccgtcacagtcctggacgcaaatgaccatgcccccgcttttcccgtgccggcatacagcgtcgaggtgcctgaagatgtccccgcagggaccctgctgctgcagcttcaggcgcatgatccagacgcgggtgcgaacgggcatgtgacgtattacctgggagccggaactgctggcgccttcctgttagaaccaagttccggggaattacgaacggcagccgccctcgaccgcgagcagtgccccagctacaccttctccgtgtccgccgtcgacggagccgctgccggcccactatccaccacagtgagcgtgaccattaccgtgagggacgtcaatgatcacgccccaacattccccactagcccgcttcgcttgcgactaccccgcccaggaccgagtttttccacacccactctcgctctcgcgactttacgcgccgaggatcgcgacgcaggcgcgaatgcttccatcctgtatagacttgccggtactccgcccccgggaaccaccgtagatagctacaccggagagattagagtagctcgaagtcctgttgcactggggcctagggatcgggtgcttttcatagtcgcaaccgacctggggagaccagcacgctccgccactggcgtcatcatcgttgggttgcaaggagaagctgaacgaggcccacgattccctagggcctccagtgaggccacaatccgagagaatgcccctccaggaaccccaattgtcagtccaagagccgttcatgctgggggcacgaatggcccaatcacctacagcatcctctccggaaatgagaaggggacgttctctatccagccttctacaggggcaatcaccgtaagatccgccgaggggctggatttcgaagttagccccaggctgcgcctggtgctccaggctgagtcaggcggggcattcgcctttacagtcctgacccttactcttcaagacgccaatgacaacgcacctcggttcctgcgcccgcactacgtagccttcctgccagaaagccgccctctggaggggcctctgctacaggtggaggccgatgatctggaccagggttccggaggacagatctcttatagccttgccgctagtcaaccagccagggggctgttccacgtggacccgaccacagggacgattacgacaaccgctatcttagaccgggaaatttgggcagagacacggctggtccttatggccacagatagggggtcaccagcactcgttgggagcgccacattgacagttatggtgattgacacaaatgataatcgaccaacaatccctcaaccttgggaacttcgggtttctgaagacgccttgcttgggagtgagatcgcccaggtcacagggaacgatgtagactctggccctgttctgtggtacgtcttgagtccgtcaggccctcaggacccattcagcgtcgggcgctacgggggacgggtgtctttaactggacccctcgattttgagcaatgcgacaggtatcagctccagttgctcgcccacgatggaccgcatgaagggagggccaacttgaccgtgctggttgaagacgtgaacgacaatgctcctgcatttagccagtccctctatcaagttatgctcctcgaacatacacctccagggtcggcaatcctttcagtgagcgcaaccgacagggacagcggagcaaacggccacatttcgtaccaccttgcatctccggccgacggattctctgtggatccaaacaacgggacattgtttactattgtgggcacagtggcgctggggcacgacgggagcggcgctgtggacgtggtgctcgaagcacgcgaccatggcgcacccggtcgagccgcgcgggccacggtccacgtgcagctgcaggatcagaacgaccacgcccccagtttcactctgagtcactacagggtggccgtgacagaggacttgcctccgggctctaccctgctcacactggaggctacggatgcagatggatcacggtctcatgccgcagtcgactactctattatctctggcaattggggccgagtgttccagctggaaccaagactcgctgaggcaggcgaaagcgccggacctggccccagagctctgggctgcctggttttgctggaacccctggattttgaaagcttgacgcagtataacctgacggtggctgcagcggaccgcggtcagcctcctcagagcagtgtagtccccgtcacagtgacagtcctggatgttaatgataaccctccagtcttcacgagagctagttacagggtgacagtgcccgaggacacaccagtcggcgctgaactcttacacgtggaagcgagcgacgcagatccaggcccccacggcttagtccgatttactgtgagctcaggagatcccagcggactgttcgagttggatgagtcttccgggacactccggctggcgcacgctctcgattgtgagacccaggctagacaccagctggttgtccaggccgctgaccccgcgggtgcccacttcgccctggcccccgtcaccattgaggtgcaagatgtgaacgatcatggacccgcattccctctgaacctcttatcaaccagcgtggccgagaatcaaccacctggaacactggtgaccaccctgcatgcgatcgatggggacgcgggtgccttcggccgcctgagatactcccttcttgaggccggccccggccccgaaggacgagaagctttcgcactgaactcctctaccggcgaactcagagccagggtcccttttgactatgagcacaccgagagtttccgactgctggtcggagcagccgacgccggaaatttatccgcctcagtcactgtatcagttctcgttacaggcgaggacgagtatgaccctgtgtttctcgcaccggcctttcattttcaagtccccgaaggcgctagacgggggcacagtctcggtcacgttcaagctactgacgaagacggcggcgctgatgggctagtcctgtacagtctggccacgtcctccccatattttggcattaatcagaccacaggcgcactctacttgagggtagactcgagggcccccgggagtgggacggctacctccggcgggggtggcaggacaaggagggaagccccccgggagctgcgcttagaggtgattgccagaggacctttgcccggctcccgaagcgccacagttcctgtcaccgtggacattacacacacagccttagggcttgcccccgatctgaatctgctcctggttggcgccgtggcagcctctctgggggttgttgttgtcctggcattggccgcgcttgtgcttggcctcgtgcgagccagatcccgcaaggccgaagctgcccccggaccaatgtcgcaggccgctccgctggctagcgacagtcttcaaaaactcgggcgggagcccccttctccccccccatctgagcacctctaccatcaaacccttcccagctatggaggcccaggagcaggcggtccttaccctcgtgggggctcgttggacccatcccattcaagtgggagaggtagtgccgaggccgccgaggatgacgaaattaggatgatcaatgaatttcctagggtagccagtgtggcctcctcccttgccgcaagggggcccgattctggtattcaacaggacgcagacgggctaagtgataccagttgtgagccacctgcccctgacacttggtacaaagggcgcaaagccggcctcttattaccaggggctggggcgacactttacagagaggagggtcctccggccacagccaccgccttcctcggcggctgcggtctgtctccagcccctactggcgactacggcttcccagcggacgggaagccttgtgtagcgggcgccttgaccgccattgtcgctggtgaggaggaattacgcgggagttataattgggattatctgctctcttggtgccctcagttccagccattggcatctgtgtttactgaaatagctaggctgaaggacgaggcccggccatgtcctcccgcgcctcggattgatcccccccctttgatcaccgcagtggcccaccctggcgctaagtctgtgcccccaaaaccagcaaacaccgccgctgctagggctatattcccgcccgcctctcatcggtcccctatctctcacgaggggtcactgagctccgcagccatgtctccctcctttagtccatccttatcccctttagctgcccgcagccccgtcgtgtccccatttggcgtcgcccagggaccctccgcttctgccctttccgccgaatccgggttggaaccccccgatgacactgagttgcacatctag

SEQ ID NO: 25781 - DNA, 462 bp, Artificial Sequence
  Description of Artificial Sequence: Synthetic coding sequence
atgaaggcaccctgtccacaactgccttgtccccctgcctcccacccactgtgcttgctttggctcctggcgcaccctctctcgcaccacctgggatggcccagagttccccagccacagcacagcgcacaatcgctcgcttggtcccatctgatgacccgctcctgcacttctagctgcgggcccggctgggcgcctacatgggacgcccactcggtgccgaatgcagggcctacactatctctgccctgggccgcaagcgactacgattggttgagaggcggccaccaccaagctcctgccttgcaccccgagctccctagtcctctcagagtgctggggcctcaaaagccgtgttgctcactaacttgcgaccaggttcaatgcggagagaaatacgagggcggttcatcccctggatttagtagcgtgagagatccatgtccagccccggccccttag

SEQ ID NO: 25782 - DNA, 2121 bp, Artificial Sequence
  Description of Artificial Sequence: Synthetic coding sequence
atggacattaagcatcatcaaaacggaaccagagggcagcggcggaagcagcctcacaccactgtccagaggttgcttacctggggtcttccagtgtcttgcagctggttcctgtggcggcagccaggcgagttccctgtcaccgccctcttgctgggggccggcgcaggtggcctgcttgcaattgggcttttccagctgctggtgaatcccatgaacatctatgaggagcagaagatcatgtttctgtacagtcttgtcggactcggcgcgatggggtggggtacaagccctcatatccgttgcgccagcctcttgttggtccccaaaatgctggggaaagaggggagattgtttgtgctgggttacgccctcgcggctatctacgtgggcccggtcgcaaacctgagacacaacctgaacaacgtgatcgcaagcctgggctgtactgtggaactccagataaataacacaagggcagcatggcgcatttccacagccccgctgagggcgatgttcaaggacttgctttcaagtaaggaactgctgcgggcagagacccgcaacattagtgctacgttcgaggacctcgacgcccaagtgaattctgaaactgggtatactcccgaagataccatggacagcggggaaactgcccaaggaagagaagcacgccaggcacctgcatcaagactgcacctgagcacccagaagatgtatgagcttaaaacaaagctcaggtgttcgtacgtagtaaaccaagcaattctgagttgccgacggtggtttgacaggaaacacgagcagtgcatgaagcatatctgggtgccccttctgacacatctactgtgtctccccatgaaatttaagttcttctgcggaatcgccaaagtcatggaggtgtggtgtcggaacaggatccctgtggagggcaactttggccagacatatgattccctcaatcaatctatacgggggctggacggcgagttcagcgcgaatatagacttcaaggaggaaaagcaggccggggttctcgggctgaatacgagttgggaaagagtcagcactgaggtaagagattatgtgtatagacaagaagcacgcctggaatgggctctgggattactgcacgtgcttctgagctgtacgttcctactggtgctacacgctagcttttcatacatggattcctataaccatgatatacggtttgataatatctacatctctacatatttttgtcaaatcgacgaccggcgtaagaaactgggaaagcgaactctgctgcccctgcgaaaagcggaagaaaagacggtgatctttccatgtaaaccaacaattcaagcctcagagatgagcaacgttgtgcgcgagctgttggagacgctgccaattctgctcttgctggtcgtgctatgcggcctcgactgggccctgtatagcatatttgatactatccgccaccactcatttcttcagtatagcttcaggagctctcataaactggaggtgaaagtgggaggggatagtatgctggccagactacttcggaaaactatcggggcccttaacactagctccgagacggtcatggagtcaaacaacatgccctgtctgccccaacctgtgggactagacgcaagggcgtattggagggctgcggtccccataggcctgctggtgtgtttgtgccttctgcaagcgttcggttacaggctgcgcagagtcatcgctgccttttatttccctaagcgagaaaaaaaaaggatcttatttctgtacaacgaccttctgaaaaaacgtgccgcattcacaaaattgaggagggcagccatattgcgacgggaaagacagcaaaaggcacctcgccacccactggctgacattctgcaccgaggatgccccctgctgagaagatggctctgcagacgatgtgtcgtgtgccaagctcccgagaccccagagtcctatgtgtgtcgaacactggactgcgaagcagtgtactgctggtcttgttgggacgatatgcgacaaaggtgccctgtatgtacaccccgtgaggaactatctagcagcgcatttagtgatagcaacgacgataccgcttatgctggatag

SEQ ID NO: 25783 - DNA, 1995 bp, Artificial Sequence
  Description of Artificial Sequence: Synthetic coding sequence
atggacataaagcaccaccagaacggcactagaggccaacgacgcaaacaacctcacacaacagtgcagcggttactcacctggggtctgccagtctcctgttcctggtttctgtggagacaacccggcgaattcccagtgaccgctctgcttttaggagccggggcaggcggcctgttagctattggtctgttccagttgttagtgaaccccatgaatatttacgaagaacagaagataatgttcctctattccctggtgggcctaggggccatgggctggggcacatcaccccacatccgctgtgccagccttttactggtgcctaagatgctggggaaagagggacgtctgtttgtgctgggttacgccctggccgcaatctatgtcggacccgtcgccaacctacgccacaatctgaacaatgtaattgcgtcactcggctgtactgtcgagctgcagattaataacacacgtgcagcgtggcgtatctccaccgctccactcagagcaatgtttaaggacctcctatccagcaaagagctgctcagagctgagacacggaatattagcgctacatttgaagatctcgacgcacaggtgaattcagagactggttacacccctgaggatactatggactctggcgaaactgcacagggtcgggaagcaagacaggcccccgcctctagattacatctgagcacacagaaaatgtacgaactgaagactaagctcagatgctcttatgtagttaatcaagcaatcctctcatgtagaagatggttcgatcggaagcatgaacagtgtatgaaacatatctgggttccacttttgactcacctactatgcctccccatgaagtttaaattcttctgcggaatagcgaaggtcatggaggtgtggtgccgcaacagaatccctgtggaaggcaatttcgggcagacctacgattccttgaaccagtcgatcaggggcctggatggagaatttagtgcaaatattgacttcaaagaggagaagcaggccggggttctaggccttaacacatcctgggagcgcgtctctacagaggtccgagactacgtttaccgccaagaagctcgactcgagtgggcattgggcctgcttcacgtcctgttgtcttgcacttttctgctggtgttgcatgcctccttcagctatatggactcttacaatcatgacattcgattcgacaacatttatatcagtacatatttttgtcaaattgacgaccgcagaaaaaagttagggaaaaggacgctgttaccactaagaaaagcagaagagaagacagttatttttccgtgtaagcccacaatccaggcatccgaaatgtccaatgtggtgcgtgaactgttggaaaccctccctattctgcttttgcttgttgtgctttgcggcctcgactgggctctctattccatttttgacacgattagacaccacagttttctacagtattcttttagatcctcgcacaaacttgaagtgaaggtgggcggcgactccatgcttgctcgcttgttaagaaagacaattggcgccctcaatacaagctctgagaccgtgatggaaagcaacaatatgccttgcttgccacagcctgttggcctcgacgccagggcatactggcgagcggcagtgccgattggactgcttgtatgtctttgtctcttgcaggcctttggttatagactcaggcgagtgattgccgctttttactttcccaagcgggagaaaaagcgtatcctgtttctatataacgatctgcttaagaagcgcgctgcctttactaagctgcgcagagcagcaattttgcgacgggagcggcagcagaaagcaccagtgtttactgagccccagtttcttccacttaagaacggcaaaactggcgaaatctgcaaagcttgctcactagaaatttctctcgagtggtggtctggcgtgggcttgagatgccagcgcgcctag

SEQ ID NO: 25784 - DNA, 1995 bp, Artificial Sequence
  Description of Artificial Sequence: Synthetic coding sequence
atggacatcaagcaccaccagaacggcacaaggggtcaaagaaggaaacaacctcataccaccgtccagagactcctgacctggggcctacccgtttcctgtagttggtttctttggcgacagccaggagagtttccggtgacagccctcttactcggagcgggagcaggaggtctcctcgcaatagggctgtttcaactcctagtgaatcccatgaatatctacgaggagcagaaaatcatgttcttgtattctttagtggggttgggagcgatgggttggggcacttcacctcacatccgttgcgcatccttactgctggtgcctaagatgcttggcaaagagggcagactctttgtactgggatacgctctcgcggccatctacgtggggcctgttgcaaatctccgccacaacctcaataatgtgatcgcctctctaggctgtaccgtggagctacagattaacaataccagggctgcatggagaatcagcaccgcacccttacgcgcgatgttcaaggatctgttatcgtccaaggagttgctgcgcgcagagacccgtaacatctcagccacatttgaggacctggacgcccaagtcaatagcgaaactggttatactcccgaggatactatggactcaggagaaacagcacagggccgggaggctagacaggctccagcctctaggctccacctgtccacccaaaagatgtatgaactgaaaaccaagctgaggtgctcatacgttgtgaatcaagccatcctgtcttgccgtaggtggtttgaccgaaaacacgaacaatgcatgaagcacatctgggtcccgctcctcacccacctgctctgcttacccatgaagttcaaatttttttgtggtatcgctaaggtcatggaggtgtggtgcaggaaccgcatccccgtggagggtaactttggtcagacatatgacagtctcaatcagagcattaggggattggatggagaattcagcgccaatatcgacttcaaagaagaaaaacaggctggtgtgctggggctgaacacgtcatgggaaagggtcagtacagaagtcagagattatgtgtacagacaggaagctagactggaatgggctctgggcctgctccacgtgcttctgtcctgcacttttttattggtgctacatgcgtcttttagttacatggactcatataaccacgacattaggttcgacaatatctacatttcaacctatttttgccagattgacgacaggcgcaagaagctgggcaagagaaccctactaccgctcaggaaagccgaagaaaaaacggtgattttcccctgtaagcctaccatccaggctagcgaaatgtccaacgtggtgagagaactgctggagacactccccatccttcttctgctcgtcgtgctttgcgggctcgactgggccctttattcaatcttcgacaccattaggcatcacagcttcctgcaatattctttccggagctcccacaagcttgaagtcaaagtcggtggagatagtatgcttgcccggctcctgcgtaagacaattggcgcccttaataccagttccgagactgtgatggaatccaacaatatgccctgtttaccccaacctgtgggtttggacgcaagagcatattggcgtgcagccgtacccatcggacttcttgtctgcctctgcttgctccaagccttcggctacaggctcaggcgcgtgatcgccgccttctatttcccaaagcgcgaaaaaaagaggatactttttctctacaacgacctcctcaagaagcgcgccgccttcacgaaacttcgtcgcgccgctatattaaggagagaacgacagcagaaagctcccgtgttcacagaacctcagtttctccccctgaagaacgggaaaaccggtgagatttgcaaggcatgttcccttgaaatttctctagaatggtggagcggtgtgggcctgagatgtcagcgggcttag

SEQ ID NO: 25785 - DNA, 2046 bp, Artificial Sequence
  Description of Artificial Sequence: Synthetic coding sequence
atggacataaagcaccaccagaacggaacaagaggccaacgtcgaaagcagcctcatacgactgtgcagcgactgctgacatggggattacccgtatcttgctcatggttcttgtggcgccagcccggagagtttccagttacagccctcctactcggcgctggggcaggcggcctgctggccatagggctaggcgccatggggtggggtacgtctccgcacattagatgcgcaagcctgctgttggttcccaaaatgcttggcaaggaaggtagactgttcgtccttgggtacgctctcgctgcgatctacgttggtccggttgccaacttgagacataacctgaataatgtgatcgcaagcttaggctgcaccgtggagctgcagattaacaataccagagcggcctggagaataagcacggccccactgcgcgctatgtttaaggatctcctgtcaagcaaggagctgctgagagcggaaaccaggaacatcagtgctactttcgaagaccttgacgcccaggtgaattcagaaaccggttacacccccgaagacacgatggacagtggggagactgctcaggggcgggaagctcgccaggcacccgctagtcgattgcacctgagtactcagaaaatgtacgagctaaagaccaagctcaggtgtagctatgttgtcaatcaagccattttgtcatgtagaaggtggtttgacaggaaacacgagcagtgcatgaagcacatttgggtcccgctgcttacacacctactgtgtttgccgatgaagttcaaattcttttgcggaatagccaaggttatggaggtgtggtgcagaaaccgcatccctgtggagggaaactttggccaaacttatgatagccttaaccagtccattagaggtctggatggtgaattcagtgccaacatcgacttcaaagaagagaagcaagcaggcgttctcgggctaaatacctcctgggaacgcgtcagtacagaggtacgcgattacgtctataggcaggaagcgcgcctggaatgggccctgggcctcctccatgtactgttaagctgtacattcctgttggtattgcatgcgtcattttcctatatggactcctacaatcatgatataagattcgacaatatctatatcagcacatatttttgtcaaatcgacgacaggcgcaagaagctgggcaagcgcacgctcttgcctctgcgcaaggcagaagagaagacagtgatttttccatgcaaacccactatccaggccagcgagatgtcgaacgtagtccgggagttactggagactctgcccatccttctgttgctagtcgtcttgtgcggactggattgggccctgtacagtatcttcgatacaattaggcaccattctttcctgcagtactccttccggagctctcacaaactggaagtgaaagtcggcggagactccatgctggccaggctgctgcgtaaaactattggagccctgaacacctcttctgagacagtgatggaatcaaacaatatgccatgtctgccccagccagtagggttagacgcccgcgcctactggagagccgctgtgccaatcgggctgctcgtctgtctgtgtctcctccaggccttcggctacaggctaagacgagtgatagcggcattttacttccctaagagggagaaaaagaggatcctgttcctgtacaatgatctgttgaaaaaacgggctgccttcaccaaattgcggagggcagccatcctgcggagagagagacaacagaaggcacctaggcacccactcgcagatatactgcaccgtgggtgtccactcctgagaagatggctgtgcagaagatgcgtggtttgtcaggcgcccgaaacccccgaaagttacgtttgtcgaaccctggattgcgaagctgtgtattgctggagttgctgggatgatatgaggcagcggtgtccagtgtgtaccccccgtgaggagcttagctcctctgccttctctgattctaacgacgacaccgcatacgccgggtag

SEQ ID NO: 25786 - DNA, 1920 bp, Artificial Sequence
  Description of Artificial Sequence: Synthetic coding sequence
atgcccaaagtcatgaaggacgtggttcaccccttgggtggcgaggagccgtcaatggccagagctgtggtacgcagcgtgggcgggttcactctgggacttagtctggctactgcttacggcttgttggagctgttggtagagggccactctccttgggggtgcctcgtcggcaccctgacattagccgccttcctgagtcttgggatggggttctcaaggcaggtccgcgccaccgtgctgctcctgttaccgcaagccttctcgcggcagggccgaacgctactactcgtagcagccttcggactggtccttcagggaccttgcgcgaacaccttacgcaattttacaagagccagcgaggcagtcgcctgcggcgctgaactcgcgctgaatcagaccgccgaagtgcttcaaagagcgaagcagcccctagtctcggctcttaataagattaaggccatcgcacgcaagactaaagaggtggccgatagagtccgaaaattcttcaggtctattatggatggggtgaagcacatcgcgcgcgctcttaggaatgtgtggcagtggctgctgcatattggagacgtgtgcaatagcgaactcgggaatccctatctcaaatgtgcacgagtgttcgatgacgctaaggacagttgtatgatggtaattccacaggcctatcacctctgctacgtactcatgcctttcaagcttgccctgtgtggtctggcctctctggtgcaggtgttctgcgtgattccaaagtacatccaaccgttcctgagacaaacaatcggaaccccagtcatacaactgctaaatagggtaagacaagagttcgagttcaatatgacagctactcaccacttttctgtagatctgaacgcgagcagatcgctctcccaggtggccatggatttgcacgaagccgtctcaatgaagcttcatcgtgtgagggaggcactggccctgatgggatttacaacacccctgctgctagtgttactctacctgcaggccctgttttataggtactgctacctcaactgggatcattacgacaacatctacatcacatccaggtttctgaggatggaggcagttcggagcaccgccgggctgccaacggtgttgcccttgagcgcccatgaagccagaaggtacattccacccgggagtatcttcctctctcagtgggagaagtttttctatatcctggagacgttcaatctcattcgacacctactgctcgtgctcttcctcgtattcctcgactacgcagtgttctgggtgctcgacctggccagacatcaactgcaaggagaaatcgtggcccgtagcccagtgctggtttcactgacagtggagggcaccgggtacgctggcaatatttatagagacctggtttctgctttcgatgtattgcaacaaggaaacattagtatactctcaaggagatgtttattgcgaccctcagaacctgacagtaccggttatatcgtgatcggcgttatgtacggtctgtgctttttcattaccttattcggttcctatgtatcacggcttaggagggttatctgtgcctcctattatccctcgagagaacaagagcggatttcatacttatacaatgtattattgtctaggcgcactaatctgcttgcggctctccaccggagcgtgcgacgccgtgccgccgatcagggacaccgatcagcctttttggtccttgcctccagatgtccttgtctgggaccatttgtcagtcacttctggctccatcaggcctactgcctcgggtgcggtcagccccaggatgagggggatatggagaacacagtttcatgcagcacgccaggctgccagggatttatctgcaaatggcattgtagctcgtccttggtgtgcacaccttag

SEQ ID NO: 25787 - DNA, 2322 bp, Artificial Sequence
  Description of Artificial Sequence: Synthetic coding sequence
atgccaaaagttatgaaagacgtcgtccatccgctgggcggtgaggagcccagtatggcgagagctgttgtcaggtccgtcggaggattcactctggggctctcactagccacagcctatggcctgctcgagttacttgtggagggccattctccctgggggtgtttagtaggaaccttaacgctcgcagccttcctgagtctggggatgggcttttcacggcaggtacgtgctacagtgcttctcttgctgccccaggctttctctcgacaggggcggaccttgctgctcgtggccgcttttggcttggtcctccagggaccatgtgccaatactctccgcaactttactcgtgcgtccgaggccgtggcatgcggcgctgagctggcattgaaccagaccgccgaagtactgcagagagccaagcagccacttgtttcagccctgaataaaataaaagcaatcgcacgtaaaacaaaggaagtggcagatcgggtcagaaagttttttagaagcattatggacggggttaagcacattgcccgcgccctcaggaatgtatggcaatggttgctgcacataggcgacgtttgtaacagcgagctcggaaacccttacctaaaatgcgcccgagtcttcgacgacgctaaggactcttgtatgatggttattccccaggcttaccatctatgctacgtgctcatgcccttcaaactggctctctgcggcctcgctagcctagtgcaagttttttgcgttatccccaagtacattcagccttttttaagacaaacaatcggaaccccagtaatacaattgctcaatcgggtgagacaggagtttgagtttaatatgactgcgacacaccactttagtgtggatctgaatgccagccggagcttatcccaggttgcaatggatctgcacgaggccgtcagtatgaagcttcaccgcgtacgagaagcgctggctctcatgggtttcaccaccccgctgcttttagtgcttctgtacctgcaggctctgttttataggtactgctacctgaattgggaccactacgacaatatatatatcacctctaggttcctccgcatggaagctgtgcgcagtaccgcgggacttcccactgtcttgccgttatctgctcatgaggcgcggcgctatattcctccgggatcaatctttttgagccagtgggagaaattcttctatatcctggagacattcaatctgattcggcatctgctgttagtgctgtttctggtattcctcgattatgctgtgttttgggttctcgacctggcccgtcatcagttacagggcgagattgtggctcgatctccagtgctggtgtccctgacggtggaagggaccgggtacgctggtaatatttatcgggatctcgtctctgcatttgacgttttgcagcagggcaatatttcaatcctaagccggagatgtctgctgcggccctccgaacccgattctacgggttacattgtgatcggagtcatgtacggtctttgcttctttataacactcttcgggtcttatgtgagtcgtctgcggcgcgtgatttgcgcaagctactatccatcccgggagcaagagaggatcagctatctgtataatgttctcctgagccggcggacaaacctgttagccgctctgcaccggtcagttagacggagggctgctgaccagggccaccggtccgcctttcttgtactggcatcgcggtgcccatgtctggggccctttgttagccacttttggttgcaccaggcatactgtcttggctgcggacaaccacaggatgaaggagacatggaaaacacagtgagctgttccactccaggttgtcaggggctgtactgtctcacttgctttaggctcctggacaacacgtgctctgtctgtgcctcaccactctcctaccagggagacttagatttggagctggattcctctgacgaggagggacctcagctttggctcgccgcggcgcaacggaaagacccagagcaagcctggcttttacagcagcagctgcaggaggtgttgggacgaagtctgtccatggaaagtacaagcgagtcatctgatctggacgaggagaaaggcccccaacaacgcaagcatggacagcaaccgctgccagaggcacaccagcccgttagcattcttacaagccccgagccccatcgcccacccgaaacctctagcgcaactaaaggagcccccacgcctgcatctgagccgagcgtccctctcagcccaccaagtttacccgatccatctcacccccctccaaaatag

SEQ ID NO: 25788 - DNA, 1563 bp, Artificial Sequence
  Description of Artificial Sequence: Synthetic coding sequence
atgggtcctaccagaaaacccaatgtctgctcgcgactttccaggagagctctgggctgtttttcgcgcgacgccggtgtcgtgcagcgaaccaacttgggtatcctgagagccctggtgtgtcaggaatcaaccaaatttaagaacgtgtggaccacccattcccgcagccctatcgcttatgagagaggccgaatttatttcgataattatcgccgttgtgtgagctccgtggcgtccgaaccacgcaagctgtatgagatgccaaaatgctcaaagtccgagaagatcgaagacgctcttctatgggaatgtcccgtcggagatatattgcccaattctagcgactacaaaagcagtttgattgcactgactgcccacaactggctcttgcgaatctctgccactaccggaaagattctggaaaagatatacctcgctccgtattgtaagttccgatacctcagttgggacacaccccaggaggtgattgcagtaaaaagcgctcagaaccggggctcggcagtcgcaagacaggcgggaatacaacagcacgtgctgctttacctcgcggtgttccgggttcttcccttctcgctggtgggaatactggaaatcaacaagaagatttttggaaacgtaacagacgctactctgtcccacggcatcctgatcgttatgtactcttccggtttagtccgactgtattctttccaaacaatagcggagcagttcatgcagcaaaagcttgatctcggctgtgcatgccgatggggcggcacaaccgggaccgtcggcgaagcacctttcggtatcccctgcaacatcaaaattactgatatgccccctttattgtttgaggtctcctccctcgaaaacgcgtttcaaattggcgggcacccctggcactatatcgttacgccaaacaagaaaaagcagaagggcgtcttccacatctgcgccctgaaagataattcactggctaaaaatggcatccaggagatggactgttgttctctggaaagcgattggatttacttccaccctgacgcatccggtcggattattcacgtgggccctaatcaggtgaaagtgctcaaacttacagaaatagagaacaattcatctcagcatcagattagtgaggatttcgtcattcttgcgaaccgggagaaccacaagaacgaaaatgtcttaaccgtcaccgcgtccggacgcgtggtaaagaagtcattcaacctgcttgacgacgatcccgagcaggagaccttcaaaatcgttgactatgaagatgagcttgacctactgtctgtagtcgctgttactcagatcgacgctgaaggtaaagcccacctggacttccactgtaatgaatacggaaccctcctgaagagcattcccttagtggagtcctgggatgtcacttacagtcacgaggtgtatttcgatagagacttagtgcttcatattgagcagaaacccaatagggttttttcctgctacgtctatcagatgatctgtgatacaggcgaggaggaagaaacaattaatagatcgtgctag

SEQ ID NO: 25789 - DNA, 813 bp, Artificial Sequence
  Description of Artificial Sequence: Synthetic coding sequence
cggcatagtacgacgtgttttgctgtgccttgtagcgttccctcctcgacgttttttacgtgccgggatagcagggaccaacaaaaagacatgcctccgctgttgtttgaagtctctagcctggagaatgcttttcagattggcggacacccttggcattacatcgttacccccaacaaaaaaaagcaaaagggggtgtttcatatatgtgctttgaaggacaattccctggcgaaaaatggaatccaggagatggactgctgcagcctcgagtcagattggatctatttccatcccgatgccagcggtagaataattcatgtgggtcccaatcaggtcaaagtgctcaagctgactgagattgaaaacaactcctcccagcatcagattagtgaagatttcgtgattttagctaatagggagaatcataagaacgagaacgtgctaactgtaaccgcgagcggccgcgtcgtgaagaaatcatttaacctgctggatgacgaccccgagcaggaaacatttaaaatcgtcgactacgaagacgaactggatttgttgtctgtggtggcagtgacacaaatcgacgccgagggtaaggcacatctggactttcactgcaatgagtacggaacgcttttgaaaagcatccctctggtggaaagttgggatgtgacttacagtcacgaagtgtacttcgaccgcgacctggtgctgcacattgaacaaaagccaaaccgggtcttttcttgctatgtgtatcagatgatctgcgacacaggcgaggaagaggaaactatcaatagaagctgttag

SEQ ID NO: 25790 - DNA, 1362 bp, Artificial Sequence
  Description of Artificial Sequence: Synthetic coding sequence
atgggccctaccaggaaacctaatgtgtgctcccgtctgtcccgcagggccctcggctgtttttcacgtgatgctggcgtggttcagcggacaaatctcgggatcctgagggctctagtttgtcaggagagtaccaagtttaaaaacgtgtggactacacattccaggtcacccattgcatacgaacgcggcagaatatatttcgacaactataggcgatgtgtcagctccgtcgcctcagagccaagaaagctctatgagatgcctaagtgctccaaatctgagaaaattgaagatgcccttttgtgggagtgccctgttggcgatatactacctaacagcagtgactataagtcctctcttatcgcattaaccgcacacaattggctgctgcggatctctgccacaactggaaaaattttggagaagatctatcttgcgccttactgtaagttcagatacctctcgtgggataccccacaggaagtaatcgcagtgaagagtgctcaaaaccgcggctccgccgtggcccgccaggccggcatccagcaacatgtcttgctttatttagccgtgtttagggtgctccctttcagtcttgtaggaatcctcgaaataaataagaagatattcggaaacgtgacagacgccaccctcagccacgggatcctcattgttatgtattcctctggccttgtgcgcctctactcttttcagacaattgccgaacagtttatgcagcaaaagctggatctggggtgtgcctgccgctggggggggacaactggaacggtgggggaggcaccctttgggataccctgcaatatcaaaatcactgatatgcccccccttttattcgaggtgagcagtcttgaaaacgctttccaaattggaggccatccctggcattacatcgtcactcccaacaagaagaaacaaaaaggggtcttccacatttgtgccctgaaggacaatagtctgaacgaaaacgtcctcaccgtgaccgctagcgggagggtcgtgaaaaaatcttttaacctcctggatgacgaccccgagcaggaaacctttaaaatcgtggactacgaagacgagctggatctgctgtcggtggtcgcagtcactcaaattgacgccgagggcaaggcccacctggacttccactgcaatgagtacggcactctgctcaagtccatcccactggtggaatcctgggacgtgacatattcacacgaggtgtacttcgatcgcgatctcgtactgcatatagagcagaagcccaacagagtctttagttgctacgtgtatcagatgatttgcgacacaggagaagaggaagaaaccatcaataggagctgctag

SEQ ID NO: 25791 - DNA, 945 bp, Artificial Sequence
  Description of Artificial Sequence: Synthetic coding sequence
atggtggctcccgtctggtacctcgttgctgcagccctgttagtgggtttcattctgttcttgacccgatcaagaggccgcgcggcttcagctggccaggagccattgcataatgaagaattggccggcgccgggcgcgtggctcaacctggtccactggaacccgaggagcccagggccggagggagaccgcggaggcgcagagacctcgggtctcggctccaggcccaacggcgggctcagcgggtggcctgggcggaggctgacgagaacgaagaggaagctgtcattctggcccaagaggaagagggtgtggagaagccagctgagacgcacctgagtgggaaaatcggagccaagaagctcaggaaactggaagagaaacaagctcgaaaagcacaacgcgaagctgaggaggctgagagagaagagaggaaaagattggaatcccagcgggaagctgaatggaagaaggaggaagaacgtttgagactggaggaagagcagaaggaggaagaggagaggaaggcgcgcgaggagcaagcccagagagaacacgaagaatacctcaaattgaaggaggctttcgttgtggaggaagagggagttggagagacaatgactgaggagcaaagccaatcttttcttaccgagtttattaactatatcaagcagtcaaaggtagtgctgcttgaggacctggctagccaagtggggttgaggacacaggacactataaatcgcatccaggatttactagccgaggggactatcacaggcgtgatcgacgataggggtaaatttatttacatcaccccggaggagctggctgctgtcgctaattttataagacagcgaggcagagtgtccatcgctgaactggcccaggcctccaatagtcttatcgcctggggaagagaatctcctgcccaggctcccgcctag

SEQ ID NO: 25792 - DNA, 897 bp, Artificial Sequence
  Description of Artificial Sequence: Synthetic coding sequence
atggtggcgcccgtctggtatcttgtggctgccgcactgctggtcggatttattctgttcctgacgaggtcacgaggccgggcggcttcagctggacaggagccactacacaatgaagagttagccggagctggaagggtcgcccaacctggtccactggaacccgaagaaccccgcgccggaggccgccctcggcgacgcagggatctgggctcccgtctccaggcccagaggcgggctcagcgagtggcttgggccgaagccgacgagaatgaggaagaggcagtgatcctggcccaggaggaggaaggggtcgagaagccggccgagacccatctgagcggtaaaatcggtgctaaaaagctgaggaagcttgaagagaaacaggctcgcaaggcccagcgggaggctgaagaggccgaaagagaggaacgcaagcgcctggaatcccagagggaagccgagtggaagaaagaggaggagcgactgaggcttgaggaggaacagaaagaagaagaggaacgcaaggccagggaagagcaggcccagagagagcacgaggagtatctcaaactgaaggaggcctttgtagtagaagaagagggtgttggagaaaccatgactgaggaacagtcacagagcttcctaaccgaattcataaattacatcaagcagtccaaagtggtcctgctagaggatctcgcttcacaagtgggtctgaggacccaggtgtcacctggaacttggccagcagtttgttccgtcgcaagaggcctgtggcttgcagagagaacatgccccaaggaccgggttctgatgcaccgattgccatgcccgcagccaagggtgagctcggctcaaaagtctccaggcactctggggattctccacttctag

SEQ ID NO: 25793 - DNA, 942 bp, Artificial Sequence
  Description of Artificial Sequence: Synthetic coding sequence
atggtggctcctgtctggtacctggttgccgccgccctcttagtgggatttatcttatttctgaccagaagcaggggcagagccgcctctgcaggtcaggagcccctccataacgaggagcttgctggagcgggccgagtggcccagcccggaccactggaacccgaggagcccagagctggagggagaccaaggagacggagagacctgggttccaggctacaagctcagcgtcgcgcccagcgcgtggcttgggcagaagccgacgagaatgaggaggaagctgtgatactggctcaggaggaagaaggtgtagagaaaccagcagaaacacacttgagcgggaagattggggccaaaaagcttcgaaagctggaggaaaaacaggcgagaaaagcccagcgggaggctgaggaagccgagagagaagagcggaaacggctcgaatcacagcgggaggcagagtggaagaaggaagaggagcgactacgcttggaggaggaacaaaaggaagaggaagagagaaaggctcgggaagaacaggctcagcgcgagcacgaagaatatctgaagctgaaggaagcctttgtggtagaagaggagggcgtgggtgagacaatgacggaagagcagagccaaagctttctcacagagtttatcaactacataaagcaaagcaaagtcgtattgctggaagacctggctagtcaggtgggcctacgcacacaagttagccctggcacatggcctgcagtgtgctcagtagctcggggcctttggctggccgagcgtacgtgtccaaaagatcgcgttctgatgcaccgtttaccttgccctcaacctcgagtgagtagcgcccagaaatcaccgggcaccctgggtatcctgcacttttcactgatcgcatgggggcgggaatcccctgcccaggcaccagcctag

SEQ ID NO: 25794 - DNA, 324 bp, Artificial Sequence
  Description of Artificial Sequence: Synthetic coding sequence
atggccaatgaagtgcaagacttgttgagtcctcgcaagggaggccatccaccagccgtgaaagctggagggatgaggattagtaaaaagcaggaaataggaacactcgagcgccacacgaaaaaaactgggtttgagaagacctccgccatagcaaacgtggctaagattcagactctcgatgctctcaacgacgcccttgaaaaactgaactacaaatttcctgctacggtccatatggcccatcaaaagccaacaccggccttagagaaagtggtcccactgaagcgaatctacattattcagcagccgcgcaagtgttag

SEQ ID NO: 25795 - DNA, 2760 bp, Artificial Sequence
  Description of Artificial Sequence: Synthetic coding sequence
atggctagcgcaacggccgcagctgcaaggcgcggcctgggccgggctcttccactgttctggcgcggttaccagaccgagaggggcgtttacggatatcgacccagaaagccggagtctcgggagccccaaggagccctcgaaaggccccccgttgaccacggattagcccggctggttaccgtatactgtgaacacgggcataaagccgcaaagattaatcccctttttactgggcaagccctactagagaacgtacctgaaatccaggcattggttcagacgttgcagggacccttccacaccgcggggttgctgaacatgggcaaagaagaggctagcctggaggaagttctggtatatcttaaccaaatctattgcggtcagatctcaattgaaacgtctcagctccagtctcaggacgagaaagactggttcgctaaaagatttgaagagttgcagaaggagaccttcacaaccgaggaaaggaaacacctttccaagctgatgttggagtcccaggaattcgatcacttcctcgcgactaaattttcaacggttaagcggtacgggggcgaaggggccgagagcatgatgggatttttccacgaattgctaaagatgtcggcatattctggcatcactgatgtcattatcggcatgccacaccgaggccggcttaatctgttaaccgggttgttgcagtttcctcctgagctcatgtttcgtaagatgcgggggctgagtgagtttccagaaaacttttctgcaaccggtgatgtcctttcgcatttaacctcttccgtggacttgtattttggtgcccaccatcctctgcacgtcaccatgttacctaacccttcccacctggaagcagttaaccctgtggcagttggtaagacgcggggaagacaacaaagtagacaagacggcgattactctcccgacaactctgcccagcctggagacagagtgatctgtctccaggttcacggagatgcatctttttgcgggcaaggaatagttcccgaaacattcaccctgtccaatctgcctcactttagaataggcggtagcgtgcatttgatcgttaataatcagctcggatacacgacacccgctgaacgggggaggagcagcctatactgcagtgatatcggcaagttggtgggttgtgccatcatacacgtgaatggcgatagtcccgaagaggtagtgagggctacacgactggcttttgagtatcagaggcaattccggaaagatgtgataatcgacctgctgtgctatagacagtggggacataatgagctcgatgagcctttttatactaacccaattatgtataagattatccgggcaagaaagtctatcccagacacatacgcagaacatctgattgcaggcggcctgatgactcaggaggaagtgtcagagattaagagctcttactacgctaaactgaatgatcatctgaataacatggcgcattatagacctcctgccttaaacctgcaggcccactggcaagggttggcgcaacccgaggcccagataaccacctggtctacaggcgtgccactggacctcttacgttttgtgggtatgaaatccgtggaagtgcctagggagctccagatgcactcccacttacttaagactcacgtccagtcccgcatggagaagatgatggatgggattaagttagactgggcaacagccgaagcactggctctgggatctcttctggcccagggatttaacgttcgtctatctggacaggacgtcggacgcggaacgttttcacagaggcacgccattgtcgtgtgtcaggagactgacgatacatatattccacttaatcacatggaccccaaccagaagggattcctcgaggtgtccaactctcccctgtcagaggaagctgttctgggatttgagtacggtatgtccatagagagtcccaaactgttgcccctctgggaggcgcagttcggggatttcttcaacggcgcacagatcatctttgacacgtttatatctggaggcgaggcaaaatggctcttgcagagcgggatcgtaattttgctgcctcatggatacgacggggctggacctgatcactcctcttgccgtattgagaggttcctccaaatgtgcgattcagccgaggagggcgtggacggtgacactgtaaacatgttcgtcgtgcacccaaccaccccagcccagtacttccacctgctacgaaggcaaatggtgcgaaatttccggaaaccactcattgttgctagccctaagatgctgctgcgcctcccggccgccgtgagcaccctccaggagatggccccaggtactacttttaatcccgtgataggagactcttcggtggacccaaaaaaggtgaagaccctagttttctgttccggaaaacacttttatagtctggtgaagcagcgagagtcactgggcgctaaaaagcatgactttgccatcattagggtggaggagctgtgtccctttcccctcgactcactacagcaagagatgtctaagtataagcacgtgaaggaccacatctggagccaggaggagccacagaatatgggcccatggagtttcgtctcaccgcgatttgagaagcaactcgcgtgtaagctccgattggttggacgtccacctctccctgtgcccgctgtcggcatcggaaccgtgcacctccaccagcacgaagacatcctagctaagacatttgcctag

SEQ ID NO: 25796 - DNA, 486 bp, Artificial Sequence
  Description of Artificial Sequence: Synthetic coding sequence
ggcaggcagcaatccaggcaggacggtgattactctccagacaactccgctcaacctggtgacagggtgatttgcttacaagtgcacggcgacgccagtttctgtggccaaggtattgttccggaaactttcacattgagcaatcttcctcacttcagaatagggggctctgtgcacctgattgtgaacaaccagctgggatacacaactccagctgagagaggtagatcatcgctttattgctcagacatcgggaaattggtcgggtgtgctataatacatgttaatggggacagtcccgaggaagttgtgagagccacgaggttggccttcgagtatcaacggcagtttcgtaaggatgtgataattgacttgctctgttataggcaatggggtcacaatgaactcgacgagcccttttataccaatcccattatgtacaagatcattcggtacaactacaaacctctttgcgatatgccttag

SEQ ID NO: 25797 - DNA, 927 bp, Artificial Sequence
  Description of Artificial Sequence: Synthetic coding sequence
atggccagcgccactgccgcagccgcaagacgggggcttggccgagccctgccactgttctggaggggctatcaaaccgagaggggggtttatgggtatcggccacgaaagccagagagtcgggaaccacagggagccctcgaacgacctccagtggaccacggcttagcaaggttagtgacagtgtactgtgaacatgggcacaaagctgccaaaatcaaccctctgttcactgggcaggccctgctagagaacgtccccgaaattcaagctctagtgcagaccctgcagggcccttttcataccgctggccttctcaacatgggtaaagaagaggctagcctggaggaggttctggtgtacctgaatcaaatctactgcgggcagatttcgatcgagacttcccaactccagtcacaggatgagaaagattggttcgccaagcgcttcgaggaactgcaaaaggagacgttcaccaccgaagagagaaaacatctgtctaagcttatgctggagtcccagctgatgttccgcaagatgagaggtctctcagagttccccgaaaatttttcagctactggtgatgttctgagccacctcacctctagcgtcgatctttactttggtgcacaccatccccttcacgtaacaatgttgcctaatccgtctcacctggaggcagtgaaccctgtcgctgtcgggaaaacgaggggaagacaacagagcagacaggacggagattactcgccagacaacagcgctcagcccggagacagagtcatatgcctccaggtgcacggggacgcctctttttgtggtcaggggatcgtgcctgagacctttactctgtccaacctgccccactttaggattgggggtagcgtccacctgatcgtaaacaatcagctcgggtatactacgccttag

SEQ ID NO: 25798 - DNA, 645 bp, Artificial Sequence
  Description of Artificial Sequence: Synthetic coding sequence
tagaagatcatccgcgcccgaaagtcaatacccgatacgtacgccgaacacctgattgccggcggtttaatgacacaggaagaagtgtccgaaattaagagctcgtattacgcaaagctgaacgatcacctgaacaacatggcacattatcgccccccagctctcaacctccaggctcactggcagggtcttgcccaacccgaggcccagatcacaacatggagtacaggagtgcccttggacttactccgatttgtcggcatgaaaagcgttgaggtcccacgggagctccagatgcatagccacttactgaagactcacgtccaatccaggatggagaagatgatggacggaatcaaactagactgggccactgctgaggccctagcgcttgggtccctgttagcacaaggttttaacgtgcgtctcagcggacaagatgtgggaagaggtactttttcccagaggcacgccatcgtagtctgccaagagaccgacgatacgtatattccactgaatcatatggatccaaaccagaagggattcctggaggaacggccatcaggcagttataaagccgcttcatcctcatcatttcacatggcgaccatggggctgggacagacaacccatcctgtagaatag

SEQ ID NO: 25799 - DNA, 942 bp, Artificial Sequence
  Description of Artificial Sequence: Synthetic coding sequence
atggccgctccgatgaacggccaagtgtgcgtagtgaccggcgcgtccaggggaattggtcgtgggatcgcgctgcagctgtgcaaagcaggagccacggtgtacattacaggacgtcacctggatacactcagggtggtggcccaggaggctcagtccctggggggccagtgtgtccctgtagtgtgcgattccagtcaggaaagtgaggtgaggagcctgttcgaacaagtagaccgcgaacagcagggccggctcgatgtgctcgttaacaacgcctatgcgggagtgcaaaccatcttgaatacaaggaataaggcgttttgggaaactccagcctcaatgtgggatgatatcaataatgtgggactgagagggcattatttttgttctgtgtacggcgcacggctgatggtaccggctggccagggactcatcgttgtaatttcatcgcccgggtcactgcagtacatgttcaacgttccatacggagttggaaaagccgcctgtgacaagctggccgcagattgcgcccacgagttacggaggcatggggtgagctgcgtctccctgtggcctgggatcgtgcaaactgagctcctcaaggaacacatggccaaagaggaagtacttcaggacccagtactcaaacagttcaagtctgctttttcttcggcggaaaccacagagttatctggcaaatgtgtggtggcattggccacggatccaaatattttaagcctcagcggtaaggtcctgccgagctgcgacttagcccgccgatacgggctgcgcgatgtggacggccggcctgtgcaggattacctgagcttgtcttccgtgttatcccacgtcagcggtcttggctggctggcatcttacctgccatcattcctgcgggttccaaaatggataattgcactctataccagcaagttctag

SEQ ID NO: 25800 - DNA, 942 bp, Artificial Sequence
  Description of Artificial Sequence: Synthetic coding sequence
atggccgcaccaatgaacgggcaggtgtgcgtggtcactggcgcatcacgaggcataggccgtgggattgccctccaactctgtaaggccggcgccaccgtgtacattacagggcggcatctcgacactctcagggttgttgctcaggaagcccagtctcttgggggacagtgcgtgccagttgtatgtgattcctcacaagagtcagaagtgaggtccttgttcgaacaggtggacagggaacaacaggggaggctggatgttcttgtgaataacgcttacgccggggtccagactatcttaaacaccagaaataaggccttttgggagactccggcctccatgtgggacgacatcaacaatgttggactgagggggcactacttctgctcggtatatggcgctaggctgatggtcccagctggacagggcctcattgtggtgatctcgtcaccgggcagcctgcaatacatgttcaacgtgccttacggtgtgggcaaagcggcatgcgacaaactggcggcggactgtgcacacgaactgcgcaggcatggggtgtcttgcgtgtcactctggcctgggatcgtccaaactgaactgctcaaggagcacatggctaaagaagaagtcctccaagaccctgtgctaaagcagttcaagtcagctttcagctctgctgaaacaacagagctgtccggcaagtgtgttgtggcactagccactgaccccaatatcttgagtttatctgggaaggtgctgccttcatgcgaccttgccagaagatacgggctgagagacgtggatggtcgtccagtacaggactacttgtccctgagtagcgtcctgagccacgtatctggtctgggatggctcgctagctacctgccttcttttctgcgggtccctaagtggattattgccttatacacaagcaagttctag

SEQ ID NO: 25801 - DNA, 978 bp, Artificial Sequence
  Description of Artificial Sequence: Synthetic coding sequence
ttcattagcgggtcttcacggaaatctttacctaaagtgaaagcgatggatttcattacctcaacagcaattctacctctgctgttcgggtgtctgggcgtcttcgggctattccgactcctgcagtgggtgaggggcaaggcgtatctgcggaacgcagtggtagtgattaccggcgccacaagcggcctagggaaggagtgcgcaaaagtgttttacgccgccggggcaaaactggttctttgcggtaggaacgggggagccctggaggaactgattagagagttgaccgcctcacacgcaacaaaggtgcagacacacaagccttatttggtcacttttgatctgacagactctggagcgattgtggctgccgcagcagaaattctccaatgctttgggtatgtcgacatactggtcaacaacgccggcatctcttacagaggaacaatcatggacacaactgtcgacgtcgacaagcgggtgatggaaaccaattacttcggcccagttgcactcactaaagctctgctaccaagcatgatcaaacgcaggcaaggccatattgtggccatctcatctattcaagggaagatgtccattccattccgttcggcttacgctgcctccaaacacgccacgcaagcgttctttgattgtctgcgagccgaaatggagcaatatgaaattgaagtcacagtcatatccccagggtacatccataccaacctgtcagtcaacgcaattacggccgacggttctagatacggggtgatggacacgactacagctcaggggcggagcccagtggaggtggctcaagacgttctggctgcggtgggaaaaaagaagaaggacgtgatcctcgctgatttactaccttcacttgccgtatacttgcggacgttggcccccggactgttctttagcctgatggcgagtcgtgcccggaaggagcgcaaatccaagaatagctag

SEQ ID NO: 25802 - DNA, 978 bp, Artificial Sequence
  Description of Artificial Sequence: Synthetic coding sequence
atggtgtctcctgctactaggaaaagcctgccaaaggtcaaagccatggacttcattacctcaactgctatcctcccactgctttttggctgcctcggcgtgtttggcctctttaggctgctgcagtgggtacgcggcaaggcctatctgagaaacgctgtggtggttataacaggtgctactagcggactcggcaaggagtgtgcgaaggtcttctatgctgcgggagcaaaactggtcctctgcgggcgcaacggcggagctctggaagaactgattcgggaactgaccgccagccacgcaactaaggtgcaaacccataagccctacctggtgaccttcgatctgacagacagcggtgcaatagtggctgcggctgctgagatcttgcaatgcttcggatatgtcgatatcctagtgaataatgccggtatctcatatagagggacaatcatggatacaacagttgatgtggacaaaagagtgatggagacaaattacttcggtccagtggccctgacaaaagcgctgctcccctccatgattaaaaggcgccagggacacattgttgctatttcatcaatccaaggcaagatgagtataccattccggagtgcttacgctgcatctaagcatgctacccaagcatttttcgactgcttacgtgcagagatggaacaatatgaaatcgaggttaccgttatttccccaggttacatacatacgaatctcagcgtcaacgcaatcactgccgatggcagtcgctacggcgtgatggacacaacgaccgcccaagggaggagccccgttgaggttgcccaggacgtcttggctgccgttggaaagaagaaaaaagacgtcatcctggcagacctcctgccatctctggcagtgtatctgcggaccttggctcctggcctgttcttcagcctaatggcatctcgggcccggaaagaacggaaaagtaagaacagctag

SEQ ID NO: 25803 - DNA, 4587 bp, Artificial Sequence
  Description of Artificial Sequence: Synthetic coding sequence
atgagcgttgccatcagaaaaaggtcttgggaggaacatgtgacacactggatgggtcagcccttcaactctgacgataggaataccgcatgccatcatggtctggtggcggatagcctgcaggccagtatggagaaggacgctacccttaacgtggatcgcaaggagaagtgcgtgtccctgcctgattgttgtcatggatcagaactgagggattttccaggccggcccatgggccacctgagcaaggatgtggatgagaacgacagccatgaaggggaagaccagttcctcagcctcgaagccagcacagaaaccctggtgcatgtttctgacgaggacaataatgcggatttgtgtctgactgacgataagcaggtgcttaatacacagggacaaaagacatcgggacagcacatgatccagggggctggctcgctcgagaaagccctgccgattatacagtcgaaccaggtgtcttccaacagttggggaatagccggcgaaactgaactggccctcgtcaaggagagcggggagcggaaagtcaccgactccatctcaaaaagccttgaactgtgtaacgagattagtctatccgagataaaagacgccccaaaggtgaatgcggtggacaccttaaacgtgaaggacattgccccggagaaacagctgctcaattccgcagtgatagcacagcagcgccggaagcccgatccccctaaggacgagaatgagcggtcaacgtgcaacgtggtgcaaaacgagttcctcgacactccttgcaccaatcggggcctgcccctcttaaagaccgacttcggatcatgtcttctgcagcctccttcttgtcctaatggaatgtctgcggaaaatggcctcgagaaatcaggtttttcccagcaccagaacaagtccccaccaaaggtgaaggccgaggacgggatgcagtgtctgcaactgaaggaaacactggctacgcaggaacctaccgacaaccaggtgagactgcgcaaacggaaggaaattagagaagatcgagacagggcaagattagactctatggttcttttgatcatgaaactggaccagcttgatcaggacatcgagaatgccctcagcaccagttcttcccccagcggcacaccaactaacctcagacgacacgtccctgacttagagtctggttcagagtccggcgctgacacgatctcggtgaatcaaacgcgcgtaaacctgtcaagcgacactgaatctacagatctaccctcctctactccagttgctaattctggaaccaagcccaagacgacggctatccaaggaatatccgaaaaggaaaaagccgagatagaagccaaagaggcatgcgactggctgagggccaccggctttccgcagtatgcacagctgtacgaagatttcctgttccccatcgatatctccctcgtcaaacgggaacacgactttctggatcgcgatgccatcgaagccctctgccgtcggctgaacaccctgaacaagtgtgcagtaatgaaactcgagattagcccccaccggaagcggtccgatgattcagacgaggatgagccttgcgccatatccggcaagtggaccttccagcgggactccaaacgttggtccaggctggaagagtttgacgtgtttagtcctaagcaggatctggttccaggttctcccgacgacagtcaccctaaggacggtccatcccccggaggcacgcttatggacctgtcagaacggcaagaggtctccagcgttcgttctctgagctctaccggctctctgccgtcacatgcccctccttccgaagatgcggctacacccagaacaaactcggttatttccgtttgcagttcatcaaacctcgccggaaacgacgacagcttcggtagcttacccagcccaaaggagttgagtagtttttccttcagtatgaaaggccatgagaaaactgccaagagcaagacacgatccctcctgaagagaatggaaagcctaaagctgaagtcgagccaccactccaaacataaagcgccgagcaagttaggcctcatcatctctggacccattctgcaggagggcatggacgaggagaaactgaagcaactcaactgtgtagaaatctccgcccttaatggcaatcggattaacgtcccaatggtccgaaaacgaagcgttagcaacagcacccaaaccagtagttcgtccagccaatcagagacttcctcagctgtctcaacaccctctccagtcactaggactaggtctctgagcgcttgcaacaagagggtgggtatgtatctagaaggattcgatcctttcaatcaatccactttcaacaatgtggttgagcaaaactttaaaaatcgcgaatcatatccggaggacacagttttctatattcctgaggatcacaagcctggcacgttcccaaaggccctcactaacggctctttcagcccctccggtaacaacggcagtgtgaactggagaaccggatctttccatgggcctggccatatcagtctccggcgcgaaaattcttctgattccccgaaagaactgaagcggcggaatagttcctccagcatgagcagccggctctccatctatgacaacgtgccgggcagcattctgtacagctcaagcggagacctcgcagacctggaaaacgaagacatttttcccgaactggatgatatcctgtatcatgtcaaaggtatgcagagaattgtgaatcagtggtctgagaaattcagcgatgaaggagattccgactcagctctcgattccgtcagtccctgtcccagttctccaaaacagatccacctggacgttgataatgatcgcaccacaccttccgatctggattctacgggcaatagcttgaacgagccagaagagcccagcgaaatcccagaacgccgtgacagcggggtgggtgcttcgctgacccgcagtaatcgccacaggttaagatggcacagttttcagagcagtcataggccctccttgaactctgtgtcactccagatcaattgccaatccgtcgctcagatgaatctgctgcaaaaatactccttactgaaactcacagccctcttagagaagtatacccccagtaacaaacatggtttcagctgggctgttccaaaattcatgaagagaattaaggtgccagattacaaagacagatccgtttttggggttcccctgaccgttaatgtgcaacgcaccgggcagcctctgccacaaagcattcaacaggccatgcgatatttacgcaaccactgtctcgatcaggtcggtttgtttaggaagagcggggtaaagtctagaattcaggccttgcgtcaaatgaatgagggcgcgattgactgcgtgaattacgaagggcagtccgcttacgacgtggccgatatgctcaagcagtacttccgggatctgccagagcctctgatgacaaataagctgtcggaaacattcctgcagatctaccagtacgtgcctaaggatcaacggttgcaggctattaaagcagccattatgctcttaccagacgagaaccgtgaggtgctgcagacgttgttatacttcctaagcgacgtgaccgccgccgtcaaagagaaccagatgactccgacaaatctcgccgtgtgcctagcgcctagtctcttccatctgaatacgctaaagcgtgagaattcatctcctagggttatgcagcggaagcaatcgctcggaaagcctgaccagaaggatctgaatgaaaacctggcggcaacgcaggggctggcacacatgatcgcagaatgtaaaaagctgtttcaggtgcccgaggaaatgagccggtgcaggaacagttacactgaacaagaactgaagcctcttaccctggaagccctgggccacctgggcaatgacgactctgcagactaccaacattttctgcaggactgtgtcgacgggttgttcaaagaagtcaaagaaaagtttaaaggctgggtctcgtacagcaccagtgaacaagctgagttatcttacaaaaaggtttcagagggcccccctctgaggctctggcggagcgttatagaggtgcccgcggtcccggaggaaattttgaaaagactgctgaaagaacaacacctgtgggacgtggatttgctagactctaaggtaatcgagatactggactcacaaacggagatatatcagtacgtgcagaattccatggctccccaccctgcccgcgactacgtcgtcttaaggacttggaggaccaacctgccaaaaggcgcgtgtgcactgcttctgaccagcgtcgaccatgacagggctccagtggtgggcgtccgggtgaatgttttactctctaggtatctgattgaaccatgcggacctggcaagtcaaaactgacttatatgtgccgcgtggatctcagggggcacatgccagagtggtataccaaatctttcgggcatttgtgtgctgcagaagtggttaaaattagggattcatttagtaatcaaaacacagaaacaaaggatacgaaaagtcgctag

SEQ ID NO: 25804 - DNA, 1497 bp, Artificial Sequence
  Description of Artificial Sequence: Synthetic coding sequence
atgtccgtggccattagaaaacgtagttgggaagagcacgtgacacactggatgggccagcctttcaacagcgatgaccgcaatactgcatgtcaccacggcctagttgccgactctcttcaggcatctatggagaaagacgctactttaaacgttgatcgtaaagagaagtgcgtctctctgcctgactgttgccatggatcggaactcagggactttccaggcagacctatgggtcacctctctaaagatgtcgacgaaaatgactcccatgagggggaagaccagttcctatcactggaggcttcgactgagactttggtacatgttagcgatgaagacaacaacgcggacttatgcctcacggacgacaaacaggtattaaacacccaaggacagaagacctccggacagcatatgattcaaggagcgggcagcctcgagaaggcactgccgattatccagtctaatcaggtctctagcaattcctggggtatcgccggtgaaacagaactcgctctcgtgaaagaatccggtgaaagaaaggtaacagatagtatttctaagtcgttggagctttgtaacgagatctccttgtccgagattaaagatgcacctaaagtaaacgcggtcgataccctaaacgtaaaggatatcgctcctgagaaacagcttctaaattccgctgtcatcgctcaacagcgacgtaagcctgaccctcccaaggacgaaaatgaacgcagcacctgcaacgtcgtgcagaacgagtttctggacaccccatgtacaaatagaggcctgccactgttgaagacagattttgggagctgcctgctacagcccccatcctgccccaatggaatgagcgctgagaacggcctagaaaaaagtgggttttcccagcaccagaacaagagccccccaaaagtgaaagccgaggacggaatgcagtgtcttcagctgaaggaaactctggcgacccaggagccaacagacaaccaggtgcggctgaggaagcggaaagagattagggaagaccgcgaccgggcacggctcgatagcatggtcctccttatcatgaaacttgaccagctggaccaagacattgaaaatgcgctctccacttcttctagcccttcagggacccctacgaacctgcgcagacacgtccctgacctggagtccggcagtgaatcgggtgccgacacaatctccgtgaatcagacccgcgtcaatctctcctctgatacggaaagtacagatctcccttcttccacacccgtggccaatagtggtacaaaacccaagacaacagctattcaaggaatttctgagaaagaaaaggctgctgtgaagtctgtaaagctggaagttgatgaggacaaatcaacgaagggatccaacttcagcaacagcgaagtcgccatcggcctgtctccatacacctttccccagaaacggctctttcacgtagctggggaagaaaatatcacatag

SEQ ID NO: 25805 - DNA, 3276 bp, Artificial Sequence
  Description of Artificial Sequence: Synthetic coding sequence
atgtgtcgcaaaaagcccgacaccatgatcctcacacaaattgaggcgaaggaggcctgcgattggctgcgggctacgggtttcccacaatatgcgcagctgtatgaggatttcctgttccccatcgacattagcctggtgaagagggaacatgattttctggacagggatgcaatcgaagccttgtgccggcgcttaaatacattgaataagtgtgccgtgatgaaactggagatcagcccccatcggaagcggtcggatgacagcgacgaagacgagccatgtgcaatttcagggaaatggactttccagagggattctaaacggtggagcaggttagaggagttcgacgtgttcagcccaaaacaggacctcgtccctggctctccagacgactcacatccaaaagatgggccgtcccctggggggacattaatggacctgtccgagcggcaggaagtatcctctgtgcgtagcctgtcatccacaggcagcttgccctcacacgctcctccatccgaggatgctgccacccctaggactaattccgtcatatcggtctgctctagctcaaacttggcggggaatgatgactcatttggcagcctcccctcgcccaaggagctgtcatcgttttctttcagtatgaaaggtcatgagaagaccgcgaagagcaaaacccgttccctgctcaaacgcatggagtctctcaaactgaagagttctcaccactcaaaacacaaggctccctccaaacttggcttgatcatcagcggaccaatcttgcaggaaggaatggacgaagagaagctcaagcagctgaactgcgttgagatttccgcactgaatggcaatcgaatcaatgtacccatggtgcgcaagaggagtgtttcaaacagcacccaaacatcaagcagttcctcccagtcggaaacttcatcagcagtcagtacccccagccctgtaacccgcactcggagtttgtccgcatgcaataagagggtgggaatgtatcttgaaggcttcgaccctttcaatcagagcacgtttaataatgtcgttgaacagaatttcaagaatcgggagtcttatcctgaggacactgtattctatatccccgaggaccacaagcctgggacattccctaaggctcttactaatgggtcgttcagccctagcggaaacaacggaagcgtgaactggcgaaccgggagcttccatggtccgggccacatttctcttaggagagaaaattcaagcgacagtccaaaagagctcaaaagacggaacagttcgtcttcaatgagcagtcgcctcagtatctacgataacgtgccaggatcaatcctatatagctcctctggagacctggctgatctggagaacgaggatattttccccgagctggacgacattctgtaccatgtaaagggcatgcaaaggattgtgaaccagtggtccgagaagttttctgacgaaggcgactcagattctgccctcgacagcgtcagcccttgtccctcatctccaaaacagatccacctggacgtagataatgatcggactacaccaagcgatctggactctactgggaattctttaaacgagcctgaggaaccaagtgaaatccccgagaggcgcgactctggagtaggcgcttccttgacacggtcaaataggcatagactgagatggcactctttccagtcatcacaccggcccagcctaaactcagtgagcctgcagattaactgtcaatcagttgcccaaatgaacctgctccaaaagtatagcttgctcaagctgacggccttgctcgaaaagtataccccctctaacaagcacgggttcagctgggctgttcccaagttcatgaagcgtataaaagtgccagactacaaagatcgaagcgtgtttggcgtccctctgactgtcaacgtgcagcgcaccggccaacccctgcctcaatcaattcagcaggccatgcggtatctgagaaaccactgtttggatcaggtgggtctctttaggaagagtggcgttaagagtcgaattcaagctctgcggcagatgaacgagggagccatcgattgtgttaattacgaagggcagtcagcatacgacgttgcagatatgctgaagcaatatttcagagatctgcccgaaccactcatgaccaataaactgtcagaaaccttcctgcagatctaccaatacgttccaaaggatcagaggctccaagccatcaaagcagcaatcatgctgctgcctgatgagaatcgtgaagtcctccagacactgttatactttttgtccgacgtgacggctgctgtgaaggaaaatcaaatgacccccactaatcttgccgtctgccttgctccgtcgctgttccatctgaacacactcaagcgtgaaaattccagcccaagggtgatgcagaggaagcagagtttgggcaagcctgatcagaaggatttaaacgaaaatctcgccgcaacccaaggtctcgcccacatgattgccgagtgtaagaaattatttcaggtgcctgaggaaatgtcccggtgcagaaacagctacaccgagcaagaactaaagccactgaccctggaggccctcggacacctcggcaatgacgattctgctgactaccagcattttctccaggactgtgttgacggactcttcaaggaggtgaaagagaaattcaaaggttgggtttcatactccacttccgagcaggccgagctgtcttacaagaaggtgtccgagggtccacctctgcgactctggcgttccgtgatcgaggttcccgcagtgcccgaagaaatccttaaacggctcctgaaagagcagcacctttgggacgtcgacctgctggattcaaaggtgattgagatccttgattctcagactgaaatctaccagtatgtacagaattccatggctccacatcctgccagggactacgtagtcctgagaacctggcggaccaacctgcccaaaggtgcctgcgctctgctgctgacctcagtcgatcatgacagagcgccggtggtgggagtccgtgtgaatgtgctgctgagccggtacctgattgagccgtgcggtcccggaaagtctaaactgacgtacatgtgccgcgtcgacctaaggggccacatgcccgaatggtacaccaagtccttcgggcacctctgtgctgctgaggtcgtgaaaattcgcgactctttcagcaatcaaaacacagagactaaggatacaaaatcacggtag

SEQ ID NO: 25806 - DNA, 972 bp, Artificial Sequence
  Description of Artificial Sequence: Synthetic coding sequence
atgggcagccgcgtctcgcgcgaagatttcgagtgggtctataccgaccagccacatgcagatcgaaggcgcgaaattctggccaaatacccagagataaagagcctaatgaagcccgacccaaatcttatctggataatcatcatgatggtgttgacccagctcggcgccttctatatcgttaaggacctggactggaagtgggtaattttcggggcttacgcgtttgggtcttgtattaaccactctatgacgctagctattcatgagattgctcataatgcagccttcggaaactgcaaggcaatgtggaaccggtggtttggaatgttcgccaatctgcctattgggattccctacagtatttcctttaagcgctatcacatggaccatcatcggtacttgggtgctgacggcgtcgatgtcgatatcccaacagatttcgagggctggttcttctgcacagcgtttcggaaattcatctgggtaatcttgcagccactcttttacgcatttaggcccctgtttatcaaccctaaacccattacatatctggaagtgattaacactgtagctcaggtgaccttcgacatcctgatctattacttcctggggatcaagagcctcgtttacatgttagcggcctcactgctgggcctgggattgcatccaattagcggacatttcattgccgagcattatatgtttctcaagggtcacgagacctattcatattatggacctctaaatctgttgacttttaatgtcggctaccacaacgaacatcacgattttccgaatattccagggaagtccctccctttggtgaggaagattgcagccgagtactatgacaatctgccacattataatagctggattaaagtactgtacgactttgttatggacgacactatctcaccttattcccgcatgaaacgtcaccagaaaggtgagatggtcctcgagtag

SEQ ID NO: 25807 - DNA, 972 bp, Artificial Sequence
  Description of Artificial Sequence: Synthetic coding sequence
atgggctccagagtctcacgagaggacttcgagtgggtctacaccgaccaaccccacgccgatcggagaagggaaatactggcaaaatatcctgaaataaagtccctaatgaaacccgatcctaacctgatctggattattattatgatggtgctgacacagctgggggccttctatattgtgaaggacttagactggaaatgggtgatcttcggcgcctatgcttttgggagctgtattaaccattctatgacgctggcaatccatgaaatcgcacataatgctgccttcgggaattgtaaggccatgtggaatcgttggttcggcatgttcgctaatcttcccattggaatcccttactctatctccttcaagcgctatcacatggatcaccatcgatatctaggcgccgatggtgtcgatgttgacatcccgaccgactttgagggttggtttttctgcaccgccttcaggaaattcatttgggtgattctccaacccctcttctatgcatttcgtcccctgttcatcaatcccaagcctattacctacctcgaggtcatcaatacagtggcccaggtgaccttcgacatcctgatctattatttccttgggattaagagcctggtttatatgctggctgcctcactgctcggactcgggctgcatcctatcagcgggcactttattgccgagcactatatgttcctgaaaggtcacgaaacttacagctactacggccccctaaacctcctgacttttaatgtgggatatcataacgaacaccatgacttccccaacataccgggcaaatccttgcctctggtgcgcaagatagctgctgaatactatgataatctgccacactataatagctggataaaagttctgtacgatttcgtcatggacgataccatatctccttactctagaatgaaacgccatcagaagggagagatggtgctggagtag

SEQ ID NO: 25808 - DNA, 786 bp, Artificial Sequence
  Description of Artificial Sequence: Synthetic coding sequence
atggtcagtccacaattagctaagtatccggagattaagtctttaatgaaacctgacccaaacctcatttggattattattatgatggtgttgacccagctgggcgctttttacatagtgaaggatctcgattggaaatgggtaatcttcggggcatacgcttttggcagttgtataaaccatagcatgacgctggccatccatgaaattgcgcacaacgccgcattcggcaactgcaaagcaatgtggaacagatggtttggtatgttcgccaacctgcccattggcattccttacagcatcagttttaaaaggtatcatatggatcaccacagatacttgggagccgacggagtggacgtcgatatacccactgatttcgaggggtggtttttctgcaccgcttttcgtaagtttatatgggtgatcctgcagcctctgttctacgcctttagacccttgttcattaatcctaaacctattacctacctggaggtgattaatacagtcgcccaggtgaccttcgatatcctgatctactatttcctcgggattaaatccttggtgtacatgctggctgcctccttgctgggtctcgggctacaccccatctcagggcacttcatcgccgaacactatatgtttctaaaggggcatgaaacttattcctactatgggcccctgaacctcctgacattcaatgttggatatcacaatgaacatcacgactttccaaacattcccggtaaaagtctcccgttggtcaggaagattgccgccgagtag

SEQ ID NO: 25809 - DNA, 1152 bp, Artificial Sequence
  Description of Artificial Sequence: Synthetic coding sequence
atgcctagcgggtgccgatgtttgcacctggtctgtttgctctgtattctcggggcccccggccagccagttagagcggacgactgttccagtcattgcgatctggctcatggatgctgtgctcccgatggctcctgtaggtgcgatcctggctgggaagggctgcactgtgaacggtgtgtaaggatgccaggatgtcagcatggcacatgtcaccagccatggcagtgcatctgccattccggctgggccgggaaattctgcgataaggatgagcatatctgtacgactcagtccccatgccagaacggcgggcagtgtatgtacgatggaggcggggaatatcattgtgtatgtctccctggttttcacggccgcgattgtgagcgaaaagccggcccctgtgagcaggctggctctccctgtagaaacggcggccagtgtcaagacgaccaggggttcgctctgaatttcacatgtcggtgcctggtggggttcgttggcgctagatgtgaggtgaacgtcgatgactgtctgatgagaccgtgtgctaatggggccacatgtctggatggcattaatagatttagctgtctgtgcccagagggcttcgctggccgcttctgtaccatcaacctcgatgactgtgcgagccgaccttgccagcgtggggcacgctgtagggacagggtccacgactttgattgcttgtgcccctcaggatatggtgggaaaacctgcgagctggtgctccctgtacctgatcccccaactacagtcgatactcctctgggtcccacctcggccgtcgtcgtgcctgccacaggtcccgctccccattccgccggggccggcctgttgcgtatcagcgtcaaggaggtggtccgcaggcaagaggctggcctaggcgagccctccctcgtggcattggtggtgttcggggcactgacggctgccttggtcttggctaccgtcctcctgacactgcgcgcctggaggaggggagtgtgtccaccaggaccatgctgttaccctgccccccactatgcccctgcatgtcaggaccaggagtgtcaggtgtcaatgctcccagccggccttccattacccagagacctgccacctgaacctggtaagaccaccgctctgtag

SEQ ID NO: 25810 - DNA, 1134 bp, Artificial Sequence
  Description of Artificial Sequence: Synthetic coding sequence
atgcccagtggttgcagatgtttgcacttggtctgcttgctgtgcattctaggcgcaccagggcaacctgtcagagctgatgactgtagttcacattgcgacctcgctcatggctgttgtgcaccagatggaagttgtcgctgtgatcccggatgggaagggctccactgcgagcgttgtgtgagaatgccagggtgccagcacgggacctgtcaccaaccttggcagtgtatttgccattccggatgggctgacgagcacatctgcacaacccaatctccttgccaaaacggcggccagtgcatgtacgacggaggcggcgaataccattgcgtttgtttgcccggatttcatggtcgggactgtgaacgtaaggccgggccctgtgagcaggctggatccccctgtaggaacggaggccaatgtcaggatgatcagggtttcgctctgaacttcacatgtcggtgcctcgttgggtttgtgggggctaggtgtgaagtgaatgtggacgactgtctaatgcgtccctgtgctaacggggccacctgcttggacggaattaataggttctcttgcctctgtcctgagggcttcgcagggcgattttgcacgattaacctagatgactgcgcctccaggccatgccagcgaggagcccgctgccgcgacagggtgcacgacttcgactgtctgtgtccttcaggctacggtgggaagacgtgcgagctggttttgcctgttcccgacccccccacaacagtggatacaccgctgggcccaaccagtgccgtggtcgtccctgccacgggacctgccccccattccgccggcgctggactgctccggatttccgttaaagaggtggttcggcgccaggaggccggattgggtgagccatctcttgtggctctcgtggtctttggggcactgaccgccgctctcgtgctcgcgaccgtgctccttactctgcgggcctggaggagaggggtgtgcccccctggaccatgctgctaccccgccccccattacgcaccagcttgtcaggatcaggagtgccaagtgagcatgctcccagcaggactacctctgccccgcgatctgcccccagaaccgggaaagacgaccgcactctag

SEQ ID NO: 25811 - DNA, 1152 bp, Artificial Sequence
  Description of Artificial Sequence: Synthetic coding sequence
atgcccagtggatgtaggtgtctgcatttggtgtgcctgttatgcatcctcggcgctccagggcagccagtacgcgccgacgactgctcaagccactgtgaccttgcacatgggtgttgtgctcctgacgggtcttgcagatgtgacccaggctgggagggcctccactgtgagcgctgcgtccgtatgcccggctgtcaacatgggacttgtcatcagccctggcaatgcatttgtcactctggatgggccggcaaattttgcgacaaagatgaacacatctgcacgacccagtccccgtgccagaacgggggacaatgtatgtatgacgggggtggagagtatcattgcgtgtgccttcccgggttccatggcagggactgcgaacgcaaagctggcccctgcgagcaggccggctccccctgcagaaatggtgggcagtgccaggatgaccagggttttgctctgaatttcacatgtagatgcctggtgggcttcgttggcgctcgttgcgaggtcaacgtggacgactgtttaatgcgcccctgtgctaatggcgcaacctgcctggatgggataaaccgattctcttgcctttgccctgaagggttcgccgggcggttctgcacgatcaatcttgacgactgcgctagccgtccatgtcagcggggagcccgatgtcgagacagggtgcacgattttgattgcctgtgcccctcaggttacggcggaaaaacatgtgagttggtcctgccagtgccagatcctcctacaaccgtcgacacgcctctgggacctacttctgccgtggttgtgcctgccaccggtcccgcaccccatagtgcaggcgccggcctgctgaggatctctgtcaaggaggtcgttaggcgccaagaagctggtcttggagaacctagtctggtggctctagtggttttcggagccttaacagccgcactagtcctggctaccgtcctgttgactcttcgcgcttggagacggggtgtgtgcccccctggaccctgttgctacccggctccccactacgctcctgcttgccaggaccaagaatgtcaagtcagcatgctgcccgctgggcttcccttgccaagagatctacctcccgaacccggaaaaacgaccgcactttag

SEQ ID NO: 25812 - DNA, 405 bp, Artificial Sequence
  Description of Artificial Sequence: Synthetic coding sequence
atgcctagcggctgccgctgtttacatctggtgtgcctcttgtgcattcttggggctcccggtcagcctgtgcgcgccgatgactgttcttcccactgtgacctagcccatggctgttgtgcacctgacgggtcctgcagatgcgaccctggttgggaaggcctgcactgcgagcggtgtgtcaggatgcctgggtgccagcacggaacttgccatcagccctggcagtgcatttgtcatagcggttgggcaggaaaattttgtgataaagatgagcacatctgtaccacccaatctccctgccaaaatggagggcagtgcatgtacgacggaggaggagaataccactgcgtttgtttgccaggcttccacggcagagattgcgagcggaaagccggaccctag

SEQ ID NO: 25813 - DNA, 1134 bp, Artificial Sequence
  Description of Artificial Sequence: Synthetic coding sequence
atgccctcaggatgccgatgtctgcacctggtgtgcctgctttgcatcttgggcgcgcccggccagcccgtaagagcagacgattgctctagccattgcgatctcgctcacgggtgctgcgcacccgacggctcatgcaggtgtgatcccgggtgggaaggactgcactgcgaacggtgcgtgcgcatgccaggttgtcagcacggcacttgccaccagccttggcaatgcatttgccatagcggctgggcagacgagcacatctgtaccactcagtcaccttgccagaatggcggacagtgtatgtacgacggaggtggcgaataccactgcgtatgcctgccgggatttcacggtcgggattgtgagaggaaagccgggccttgcgagcaggcaggaagcccatgtaggaacgggggccagtgtcaagacgatcaggggttcgcactcaacttcacgtgccggtgcttggtgggcttcgtgggggcacgttgcgaggtgaatgtggacgactgtctgatgagaccatgtgccaacggcgccacttgtctggatgggatcaaccggtttagttgcctgtgtcccgagggatttgcaggacgattctgtacgattaacttggatgactgcgcttcccggccttgccagagaggggcccggtgccgagaccgggttcacgattttgactgcctgtgcccttctggatatggagggaaaacatgcgaacttgtactgccagtccccgatcctcccaccaccgtggacacccccctaggcccaacttcagccgtagttgtgcctgccaccggccccgccccgcattccgccggcgccggcctcttgcgcatttcggttaaagaggtggtgcgcagacaagaagctggcctgggtgaaccatccctagttgccctggtggttttcggagcactcacagcagctcttgtgttagccaccgttctcctcacgctgcgagcttggcgcagaggcgtctgtcccccaggaccttgttgctatcctgcacctcattacgcacccgcatgccaagaccaggagtgtcaagtgtcaatgcttcctgctgggctccccctgcctcgagacctgcccccagagcctgggaaaactactgccctctag

SEQ ID NO: 25814 - DNA, 870 bp, Artificial Sequence
  Description of Artificial Sequence: Synthetic coding sequence
taaggttgccaacatggcacatgccaccagccatggcagtgtatttgccacagcggatgggcaggaaagttttgtgacaagggatttcatggcagagactgcgaaagaaaggcgggaccctgcgaacaagccgggtctccttgcaggaacggggggcagtgccaggacgatcaagggtttgccctgaactttacttgtcgctgcctggtgggatttgtcggagctcgctgtgaggtgaatgtggacgactgtctcatgcgaccatgcgctaacggtgccacgtgcctggatggaatcaaccgtttcagttgcctgtgccccgaggggtttgccggtaggttctgtacaattaatctcgatgactgtgcctcaaggccgtgtcagcggggggcccgctgtcgtgacagggttcacgactttgactgtttgtgcccatccggctatggcgggaaaacgtgtgaacttgtgcttcccgtcccagatccacccacgaccgtcgacactcctttgggacctactagcgcggttgtcgtcccggctaccgggccggccccccattctgcgggggctggactgctgcgcatatcagtcaaggaagtcgttagaaggcaagaagctgggctgggagagcctagcctggtggctctggtcgtcttcggagccctgaccgcagcactggtgctggcaacggtgcttctgacgctgcgagcctggagacgcggcgtctgcccccccgggccatgttgctacccagctcctcattacgccccagcatgccaagaccaggagtgtcaggtatctatgctgccagccggcctgccactccctagagatctacccccggagcctggcaagacaacggccctctag

SEQ ID NO: 25815 - DNA, 3441 bp, Artificial Sequence
  Description of Artificial Sequence: Synthetic coding sequence
atgagaaagacagacgtcgacccactggacgaggtctgttatagggtggttatgcagttatgcggcctatggggtcatccggtgttggccgttagagtgctgtttgaaatgaaaaccgcgcgaatcaagcccaatgctatcacttatggctattataacaaagtggtgttggaatcaccatggcccagcagtactcggtctggcatcttcctgtggactaaagtaagaaatgtagtaaggggactggcccagtttcggcaacctctcaagaagacagtccagaggagccaggtcagcagcatcagtgccctgcaaaacgtgaccggcgggtcagatggtgataccgtttcccacggcagcgtggactccagtaacgacgccaataacggagagcataccgtatttgtgagagacttgatacgtctcgaaagtattgacaaccacagctctactggaggacagagcgaccagggatatggctctaaggatgaactgatcaaagacgatgccgagatccacgtcccagaggagcaggctgcccgggagttgattaccaagacaaaaatgcaaactgaagaggtgtgtgacgcttcagccatcgtagcaaaacacagccagccttcaccagaaccccactcccccacagagcccccggcctggggcagcagcattgtcaaggtccctagtgggatttttgatgtgaacagccggaagtcttctatctccaatgttttatttagtacacaggatcccgtggaggatgccgtgttcggggaggccacaaacctcaaaaagaacggggaccggggagaaaaaagacagaaacactttcccgagcgaagctgcagcttttcttctgagagcagggccgggatgctgctcaaaaaatcatccctcgactctaattcaagtgagatggccattatgatgggagcagatgcgaaaatcctgactgctgctctgacgtgccccaaaacatctttgctccatatcgctaggacccatagctttgagaatgtcagctgtcacctacccgattcaagaacctgcatgagtgaatcaacctggaaccccgagcaccgctctagccctgttcctgaaatgctggaggaaagtcaggagctgctggagcccgttgtggatgacgtcccgaagacaaccgcgaccgtcgacacatatgagagtttactgtctgattccaactccaaccagtctcgggacctgaagacagtgagtaaggatcttagaaacaagaggagctctttgtatggtatcgccaaagtggtccagcgggaggacgtcgagacaggactggacccgttatcgttgttggcaaccgaatgtacaggcggtaaaacacccgactcagaggataagttgttcagtcctgtgatcgccaggaaccttgccgatgaaattgagagctatatgaatcttaagagtcccttgggcagtaaatcctcatccatggaactgcatcgggaagagaaccgggagagcggaatgaccaccgctttcattcatgccctggaaagacgaagttcactccctctggaccatggatcaccggctcaggaaaaccctgaaagcgagaagtcctcaccggccgtgtctcgctcgaaaacgttcacaggcagattcaagcagcaaactcccagccgcacacataaggaaaggtccacatcattgagcgctcttgtgcgctcatcgccccacggaagcctcggttccgtcgtcaactccctatctggtctgaagcttgacaatatcttgtcgggccccaagatcgatgtcctgaaatccgggatgaagcaagctgccactgtggcttctaaaatgtgggttgccgtggccagtgcctacagctactctgacgacgaagaagagactaaccgggactattccttcccggcgggactggaagaccatatactgggagagaacatcagcccgaatacatcaatctctggacttgtgccatccgaactcacgcaatccaacacatcactcggctcttcatcctccagcggtgacgtgggaaaactgcactaccccaccggagaggttccatttcccagggggatgaaagggcaagatttcgagaaaagcgaccatggctcatcacagaacacaagcatgtcaagcatttaccagaactgcgcaatggaggtcctcatgtccagttgtagtcagtgtcgagcgtgcggggcgttagtgtatgacgaggagatcatggccggctggaccgcggacgattcaaatttgaatactgcgtgtccattttgtaagtctaacttcctccctctccttaacattgaattcaaagatctgaggggttccgctagcttcttcctgaagccgagcacctccggcgacagcttacagagcgggagtataccactggccaacgaatcactggagcacaagcccgtttcgtcacttgcagagcctgacttgattaatttcatggacttcccgaaacacaatcaaattatcacagaggagaccggcagtgcagtcgagccctctgacgaaatcaagcgtgccagcggcgacgtgcagacgatgaaaatttcttcggtgcccaacagcctttccaagcgtaatgtcagtttaacacggagccactcagttggcggtcccctgcaaaatatagacttcacccagcgcccttttcacggaatcagcactgtgagccttcccaactccctccaggaggtcgtggatcctctggggaaaaggcctaaccctcccccggtgagcgttccctacctctcccccctggtgctacgcaaggagctcgaaagtctgctggaaaatgagggggaccaggtgatccacacctcttccttcatcaaccagcaccccataatcttctggaacctggtatggtactttaggcgactcgacctgcctagcaatctgccaggtcttatcctgacctccgagcactgcaacgagggcgtacagctgcctctatctagcctgtctcaggattctaagctcgtatacatccagctgctttgggacaacataaacctgcatcaggaacccagggaaccactgtatgtgtcctggcgtaattttaattctgagaaaaagtcctcacttctgtcagaggaacagcaggagactagcacgctggtggagacaatccgccagtcaatacagcataacaacgtgctgaagccgatcaatctcctcagccaacagatgaaacctggtatgaaacgacagcggagcctctaccgcgaaattttatttctgagtcttgtttccctgggcagagagaacattgacatagaggcgttcgacaacgaatatggcatagcatataactctctgtccagcgaaatcctggagcgtctccagaagattgatgctccaccctctgcttctgtggaatggtgcaggaagtgtttcggtgccccacttatctag

SEQ ID NO: 25816 - DNA, 2013 bp, Artificial Sequence
  Description of Artificial Sequence: Synthetic coding sequence
atgaatttaaaatctccactggggtcaaagtcctcatccatggaactgcatcgagaggagaatcgggagtcgggtatgacaactgcatttattcatgcattggagcgtcgatcttccctccctctcgaccacggaagtccggctcaagaaaatccagaatccgaaaagtcatcaccagcagtaagccgcagtaagacattcaccggtcgctttaagcagcagacgccaagccgcacacataaggagaggtccacatctctgtctgcactagttcgctctagccctcatgggagcctggggagcgtagtcaactctctttcagggctcaagcttgacaacatattatctggccctaaaatagatgtccttaagtctggtatgaagcaggcagccaccgtagcctctaagatgtgggtggccgtcgcctcagcttactcatacagcgacgacgaggaagagacaaaccgtgactacagctttccagctggactagaggatcatatcctcggggaaaacatctccccgaatacttcaatttcaggactggttccctctgaattgacacaaagcaacacatccctgggaagttctagtagttccggcgatgtcggtaaactgcactacccgacaggggaagtccccttcccccggggaatgaagggacaggactttgagaagtctgaccatggatcgagccagaacacaagcatgagctcgatctaccagaattgcgctatggaagttctgatgtcatcctgttcccaatgtagagcctgcggggcccttgtgtacgatgaggaaattatggccgggtggaccgccgacgattccaatctcaataccgcatgccccttctgcaaatctaactttttgccactcctcaacatcgagttcaaggacttgagagggagcgcttcatttttcctaaagccatctacgagtggcgatagtttacaaagcggaagcattcctctggccaatgagtcactcgagcacaaacctgtgagcagcttagcggagccagacctgattaatttcatggactttcctaagcataaccagattatcaccgaggagaccgggtccgctgtggaacccagcgatgagatcaaacgcgccagcggcgacgtccagacaatgaaaattagctctgtcccaaatagtctgtccaagaggaatgttagtcttaccaggagtcattccgtcggagggccccttcagaatatcgacttcacccagcggcccttccatgggatttccactgtgtccctccccaactcgcttcaggaggtagtcgatcccctgggaaagagacccaacccgccccctgtgtccgtgccttatttgtccccactagtattacggaaagaactggagtctctgctcgagaatgagggcgatcaggtgatccacacttctagcttcatcaatcagcacccaatcattttttggaacctcgtatggtatttccgccgcctcgatcttcccagcaatctgcctggccttatcctgacatctgaacactgcaacgaaggtgtccagcttcccttatccagtttgtctcaagactccaaactggtgtacatccaattgttgtgggacaatataaatttgcaccaggagcctcgtgagcctctgtatgtgagctggagaaactttaattcagaaaaaaaatcatctctgttgtccgaagagcagcaggaaaccagcaccctggtagagaccattcgacagagtatacagcacaacaatgtcctgaagccgatcaacctactcagccaacaaatgaaacctggcatgaagaggcagcgctcattgtatagggagatactttttcttagcttagtgagtctcgggcgggagaatattgatatcgaggccttcgataatgagtacggcatagcctacaattccctgtcatcggagatcctggaacgcctgcagaaaattgacgccccccccagcgcctccgtggagtggtgcaggaaatgttttggtgctccacttatttag

SEQ ID NO: 25817 - DNA, 777 bp, Artificial Sequence
  Description of Artificial Sequence: Synthetic coding sequence
atgaagcaggcggccaccgtggcctccaagatgtgggtggccgtcgcttcagcatactcctatagcgacgatgaggaagagactaatagggattactctttccccgcgggactcgaggatcacatactgggagagaacatcagtccaaacacctctataagcggcctggttccatccgaactaacccaaagcaacacctcactggggagtagttctagctctggcgacgtcggcaaactccattaccctactggcgaagtgccattcccccggggaatgaagggccaggacttcgaaaagtcagaccacggatcatcccagaatacctctatgagttccatataccagaattgcgccatggaagtacttatgagctcttgctcccagtgccgcgcctgtggagcccttgtgtacgacgaggagatcatggcgggctggacggctgacgacagcaatctcaacactgcctgtccattctgtaagtccaacttcctcccactcctgaacattgaatttaaagacctgaggggcagcgcctctttttttcttaaacccagcacttctggtgactctctccagagcggctccatcccactggcaaacgagtctctggagcacaagccagtctctagtctggccgaacctgatctgattaatttcatggattttcccaaacataatcagattattaccgaggagaccgggagtgccgtggaaccccggtatcaacgtgtgcagcgcccactgtatgtggtcataaatggagttcctctctag

SEQ ID NO: 25818 - DNA, 2376 bp, Artificial Sequence
  Description of Artificial Sequence: Synthetic coding sequence
atgctgttaaagaagtcatctcttgacagtaactcctccgagatggccattatgatgggcgcagacgcaaaaatcttaactgctgccctaacgtgcccaaagacctcccttctgcatattgctagaacacactccttcgagaatgtgtcttgtcacttgccagattcacggacgtgcatgtccgagagcacttggaaccctgagcatcgcagttctcctgtccctgagatgctggaggaatcgcaagaactccttgagcccgtggtcgacgacgtaccgaagacaacagccaccgtggacacctacgagagtctgctcagcgactcaaactcaaatcagtctcgggacctgaaaaccgtctccaaagatttgagaaataagcgatcctccctgtacgggattgccaaggtagttcagagagaggatgtcgaaactggcctggatcccttgagtcttttggccacagaatgcaccggaggaaaaacccccgactccgaggacaagttgttttctccagtgattgcccggaatctagccgacgaaatagaatcttacatgaatctcaagtcacctctcggttcaaagagtagctcaatggaacttcaccgggaggagaatagggaatccgggatgactaccgcttttatccatgcacttgaaagacgcagttctctgccccttgatcacgggtctccggctcaagagaaccccgagagtgagaagtcttctcctgccgtgagccgctcgaaaacctttaccggaagattcaagcaacagactccatcccgcactcacaaggaacgctctacctccctgtctgccttggtgcgctcaagccctcatgggtcactcgggagcgtggtaaatagtttatccgggctaaagctggacaatatcctgagcggaccgaagattgatgtactgaaatcgggcatgaagcaagccgcaactgtggcctccaagatgtgggtcgccgtggcttctgcctactcttactccgatgacgaggaggaaaccaaccgagactattcgttcccggcgggactagaggaccatattctgggcgagaacatcagtcccaacaccagtatttccggactggtcccatcagagctgacacaatctaataccagcctgggcagctctagtagctctggcgatgtgggcaaacttcactatccgaccggtgaggtccccttcccccgcggcatgaaggggcaagattttgaaaaatccgatcatggatcgtcccaaaatacaagtatgtccagcatataccagaattgcgccatggaagtgttgatgagctcatgtagtcagtgtagggcatgtggagcattagtgtacgatgaagagatcatggctggatggacagcagatgatagcaatttaaatacagcttgtcctttttgcaaatctaatttcctgcctctccttaacattgaattcaaagatctgagggggagcgcgtccttctttctgaaacccagcacatcgggagatagtcttcaatccggtagtatccccctggcaaatgagtcattggagcacaaacctgtgtctagcctcgctgagcctgacctgataaattttatggacttccctaagcacaatcagatcatcacagaggagaccggaagcgccgtggaaccttctgatgagatcaagagggcttccggggacgtgcagactatgaaaattagcagcgttccaaatagcctgtccaaacggaatgtttccctgacccgtagtcacagtgtcggtgggccactgcaaaacattgacttcactcagcgtccattccacggcatctccacagtcagcctgccaaactccctccaggaggttgtggacccactgggcaaaaggcccaacccccctcccgtgagcgtgccttacctttcaccattagtcctgagaaaggagctggaatctctcctcgagaatgaaggcgaccaagtaatccacacttcatctttcatcaaccagcaccctattatcttctggaatttggtgtggtacttcagacgcttagaccttccttccaacctgcccggtttgatcctcacctcagaacattgcaacgaaggtgtgcagctgccgctgtcaagtttgtctcaagattcaaagctggtttacatccagctcctctgggataacattaatttacatcaggagcctcgtgagccactctacgtaagctggaggaatttcaattctgaaaagaagtccagcctactttcggaggagcagcaagaaacatctactctggtagagaccatccgccaatccattcaacacaacaacgtgctaaagcctatcaacctgttgagccagcagatgaagcccggaatgaagaggcagcgcggaatatag

SEQ ID NO: 25819 - DNA, 3441 bp, Artificial Sequence
  Description of Artificial Sequence: Synthetic coding sequence
atgaggaagacagacgtggaccccctggatgaggtgtgctatcgtgtggtcatgcagctgtgcggtttgtggggacaccccgtgttggccgtgagagttctttttgagatgaaaaccgcccggatcaaacccaatgccataacctacgggtactataataaggtggtgttggagtccccttggccatccagtactagaagtggaatattcctctggaccaaggtccgaaacgtggtgcgggggttagcacagttcaggcagccactcaagaaaactgttcaaagatctcaggtttcaagcatcagtgcactgcagaatgtaaccgggggcagtgatggggacacggtcagtcatggcagtgtggattcctcaaacgacgcgaataatggcgaacacaccgtgtttgttcgggaccttataagactggagtcaatcgacaaccattcctctacaggaggtcagagcgatcaggggtacgggtcgaaagatgaactcatcaaggatgacgcagagattcacgttcctgaagagcaggccgcgagggagctcatcactaagacgaagatgcaaactgaagaagtatgtgacgcctccgctatcgtcgccaagcactctcagccatctcccgaaccacactcaccgacagagccaccagcttgggggagctctattgtaaaggtgccgtctggaatatttgatgtgaactcccggaagagcagcatcagcaacgttcttttctcgacgcaggaccctgttgaggacgccgttttcggagaggcgacgaacctcaaaaagaatggcgatcggggagaaaagcgccagaaacatttccccgaacggagttgcagcttttcttcggagtcccgcgccgggatgctgctaaaaaaatctagcctggacagcaattcctccgaaatggctattatgatgggagcagacgctaagatcctgaccgcggccctcacatgccccaaaacttctctgttacatatagcccgtactcactcgttcgagaatgtgtcttgtcatctccctgatagcaggacttgtatgtcagaatccacctggaacccagagcatcggtcatccccggtccctgagatgttggaggaatcgcaggagctgttagagcccgtggtggacgatgtccctaaaacaaccgccaccgtggatacctacgaatccctactgtccgatagcaactctaaccaaagcagagacttaaagaccgtttctaaagatctgcgaaataagagaagctcactttacggcattgcaaaggtagtgcagcgagaagacgtagagactggactcgatccattaagcttactggccactgagtgcactgggggaaagacaccagattcagaggataagttgttttctcctgtaattgcccgtaatcttgctgatgagattgagtcctacatgaatctgaagtcccccttgggctcaaagtcttcttcgatggagctacacagggaagagaaccgtgagtctggcatgaccacagcatttatacacgctctcgagagacggtctagcctgcccctggaccacggctctcccgcccaggagaatccagaatcggaaaaaagctctcccgccgtgtctcggtcaaagaccttcaccgggcgattcaaacagcaaacacccagccggactcacaaggagcgctcaacctctctgtctgctcttgttcgctcaagcccacacggcagtcttggctcagtggtgaattccttgtccggactcaagctcgataatatcctgtccggaccgaagattgacgtgctgaagtccgggatgaaacaggcggcgacggtggcctctaagatgtgggtagccgtcgctagcgcatattcttatagcgatgacgaagaggagaccaacagagactactccttccccgccggcctagaggatcacatcctaggggagaatatctccccaaacaccagtattagcggtttagtcccaagtgaattaacccagtccaacacctccctgggaagttcttccagtagtggcgacgtgggtaaactgcactacccaacaggtgaggtaccattccccagggggatgaaagggcaggatttcgaaaaatcagatcacgggtctagtcagaataccagtatgagttccatttaccagaattgtgcaatggaggtgctgatgtcctcttgttcccagtgcagggcgtgcggagcccttgtatatgacgaagaaattatggcagggtggacggccgatgacagcaacctgaacacagcctgtcccttttgcaagtctaatttcctgccgctcctgaatatcgagtttaaggatctcagagggtctgctagctttttcctgaaacctagtacctccggtgattccctgcagagcgggagcataccactagctaatgaatctttggagcacaagccggtgagtagcctagccgaacccgacctcataaatttcatggattttccaaaacataaccagattatcacagaagaaaccggcagcgctgtggagccctcagacgagataaaaagggcctcgggcgatgtacagacaatgaaaatctccagtgtcccaaactctttgagcaaaagaaacgtgtcactaacgagaagtcactccgtgggcgggcctctgcagaacatcgatttcacccagcgcccctttcatggaatttctaccgtaagcctgccaaatagtctgcaggaggttgttgacccattgggcaaaaggccgaatcctccacccgtctccgttccttacctgtcccccctggtgctgcggaaagagctggagagcctgttagagaacgagggtgaccaggtgattcatactagctccttcattaaccagcacccaattattttttggaatctggtgtggtattttcggagactagacctgccatcaaaccttccaggactgattcttacctccgaacattgcaacgagggcgtgcaattacctctgtcaagcctatcgcaagattcaaaactggtttacatccaactcctgtgggacaacattaatcttcaccaagaaccgcgggagcctctatacgtgagctggagaaacttcaacagtgaaaagaagagttccctgctttcagaggagcaacaggagacctccacactcgttgagaccatccgacagtcaatccaacataataacgtgctaaagccaatcaacctgctctctcaacagatgaagcccggaatgaaaagacagaggtccctgtatagagagatcctgtttttatccctggtgagcctcggacgagagaacattgatatagaggcctttgataacgaatacggtatcgcctacaactccctctcttctgaaatcttggagcggctccagaaaatcgatgcccccccatcagcctctgtcgaatggtgtcgcaagtgttttggggcccctttaatttag

SEQ ID NO: 25820 - DNA, 5022 bp, Artificial Sequence
  Description of Artificial Sequence: Synthetic coding sequence
atgggcgcaacaatcgagtgctgggacccggaaacaaagtaccccctccctgtgttttcaaccttcgttctgacaggctcaagtgctaaaaaagtgtacggagccgcaatacagttttatgagccttactccagggagctcttgagtgaaaagcagctgatgcatttaggtctgttaacaccggtggagcgaaagatggtgagcaagtctataaataccaacaaatgtatctgtctgctgagccactggcctttttttgaagccttcaggaaattcttgatgttcatctataaactgtcggtgtctgggccacacccacttcctattgaaaaacacatatcacattttatgcagaacataccctttccctcaccccagaggcctcgaattctggtccagctcagtgtccacgatgccttgattctgagccagccggtctcaacaccattaccattgtctggtgccaatttcagcactttgctgatgaaccttgggcccgaaaattgcgctacactgctactattcgtcctgcttgagtcaaaaatccttcttcactctttgagacctgccgtgctcactggtgtagccgaagccgtggtggccatgattttcccgtttcagtggcagtgtccctacattcccctttgtcctcttagtctggccgcagtgttgagcgcaccccttccttttatcgtaggcgttgactcgagatacttcgacttacacgacccccctcaggatgttgtgtgcatagacctggacaccaacatgctttatgtttcagatgagaaaaaaaatatgaactggaaacagctcccaaaaaagccctgcaagaaccttttgtcaacattgaagaaactgtatccacagttgtcttctgtgcaccagaagacccaggaaggatccgcaattgatatgacgcctatcgaagctgatttctcatggcagaaaaagatgacacagctcgaaatggaaatccaggaggccttcctacgatttatggcctcaatactgaaggggtaccgtacttatctgcgccccattacagaagcaccttctaataaggcaactgccgcggactcattattcgacaggcaggggtttttaaaatctcgagacagagcctacgccaagttctacaccttgctgtctaaaacgcaaatctttatccgatttatcgaggaatgttcttttgttagcgacaaggacacaggactcgcctttttcgacgattgcatcgaaaagctgttcccagacaaagggacagagaaaacagacaaagtagatttcgattccgcggaggacacaagacttattgaactagacgattcacagaaatcagagcatacggtgttcattatgccacctgaacctccacccgacgacggcaaagatttgagccctaaatacagctacaagtacttccctcgattagacctcaagctctttgatcggccccaggagctcaagctgtgtttctcacgccatcctacagggaactctatcacaaagtccccaccactcatggctaagcgaaccaaacaggaaattaaaacggctcataagctggccaagcgttgctacactaatccaccacaatgggcgaaatgtctgtttagtcattgctattccctctggttcatctgtcttcctgcatatgtgcgggttagccaccctaaagtcagagcccttcagcaggcctacgacgtgctcatcaagatgcgcaagaccgacgtggatccactggacgaagtgtgctatcgggtggtgatgcaattatgtggactctggggacatcctgtactcgctgtaagagtgctgtttgagatgaagacagcccgcattaagccaaatgctattacctatggctattataacaaggtagtgctggagtctccttggccatcatccacacggtcaggaatcttcctttggacaaaagtgagaaacgtcgtaagaggcttagctcagttccggcagccccttaagaaaactgtccagagatcacaggtgagttctatttcgggtggccaaagtgaccaaggctatggctctaaggacgagctgatcaaagacgacgccgagattcacgtccccgaggaacaggccgctcgtgaactgatcacaaagacaaagatgcagacagaggaggtgtgtgatgcctccgccatcgtcgcaaaacacagccagcctagtccagagccccacagccccaccgagccgcctgcttggggatcaagtatcgtgaaggtaccctccggcatttttgatgtcaattctcggaagagctcgacaggaagcattagtaacgtgctgttctctactcaggacccggtggaggatgctgtcttcggagaggccacaaacctgaagaaaaacggagatcggggagagaaacggcagaagcactttcctgaaaggtcatgctctttcagctctgaatctcgcgcaggtatgcttctgaagaaatcttctcttgactctaactcatcagagatggccatcatgatgggggcggacgccaaaatcttaactgcagctctgacatgccctaagacatctctgctgcacattgcacgaacgcattcctttgagaacgtttcatgccacctgcctgacagtcggacatgcatgtccgagtccacctggaaccctgaacaccggtcttctcctgtgcccgagatgctagaagagagtcaggagctgctggaacccgttgttgacgatgtgcccaaaactacggctaccgtagacacatacgaatctctcctgtcagacagtaatagcaatcaatcgcgggaccttaaaactgtttcaaaagacctcagaaataaaagatcgtccttgtacggaattgccaaagtcgtgcagcgcgaggatgtggagaccggcctggacccactgagcctcctggccaccgagtgtacgggcggcaaaacgcccgattcagaggacaagctcttctccccagtgatcgcccgcaacctggccgacgaaattgagtcctacatgaacctgaagagccctctggggagcaagagcagcagcatggaactccacagagaggagaatcgcgagagcgggatgaccacggcttttattcatgctctggaaaggcggagcagtctccccctcgatcatggctccccagctcaagaaaacccggagtccgagaagtccagccccgcagtgagcaggtccaagacattcactggtcgctttaaacagcagacaccatctagaacacacaaggagagaagcacctctctgtcggccctagttagaagcagcccccacggctcattgggttccgtggtgaactccctgtcaggactcaaattggacaacatattgtcgggccctaagattgacgtcttgaaatctggcatgaagcaagcagctaccgtcgccagcaagatgtgggtggccgtagcttcggcatactcttactcagatgatgaggaggagacgaatcgcgattattcgttccccgccggcttggaggaccatatcttgggtgaaaacatttctcctaatacaagcatctccggcctcgtcccctctgagctgacccaaagcaatacctctctcggaagctctagcagttctggagatgtcggcaaattgcattatcccacgggtgaggtgccttttccgagaggaatgaaggggcaagattttgagaaatccgatcatggaagctctcaaaatacaagtatgtcctctatctatcaaaactgtgcaatggaagtgctcatgagctcctgctcacagtgtcgggcttgcggcgcacttgtgtacgacgaagagatcatggccggctggaccgctgacgatagtaacctcaacaccgcatgtcctttttgtaagtcgaatttccttcctctgctgaacatcgaatttaaggacctgagaggcagcgcctcattttttttaaaaccctcgaccagtggcgactcactgcagagcggcagcattccgctggccaatgaatctctggagcacaagcccgtgagtagcctcgcggagcctgacctgatcaacttcatggattttccgaaacataaccagattattacggaggaaacaggcagcgcggtggagccaagtgacgagataaagcgggcttcaggcgatgtgcagaccatgaagatctcttccgtgcccaatagtctttcaaaaaggaacgtgtccctgactagatcccatagtgtgggagggcccctccagaatatagacttcacccagcgtccgtttcacgggattagtaccgtgtcattacccaattcactgcaggaagttgttgaccccctcggcaaacgtcccaacccaccaccagtgtccgttccatatctctccccattagtcctacggaaagaactggagagcctgctggagaatgagggcgatcaggtgatccatacgagttctttcatcaatcaacatccaatcatattctggaatctggtctggtattttcgccggctcgacctgccatctaacctcccaggcctgattctgacttccgagcactgcaacgaaggggtgcaactacctttatctagcttgtcacaggactccaaactggtgtatatccaattactctgggataacatcaaccttcaccaggaacctcgcgaaccgctctacgtttcttggaggaatttcaacagcgaaaagaaaagctctctgttatccgaagaacagcaggaaacatccacacttgtggaaaccattagacagagtattcagcataacaatgtgctgaaaccaattaacctgctctcccaacagatgaaacccggaatgaagcggcagagatccctctaccgtgagattctcttcctgagtctggttagcctggggcgagagaacattgacatcgaggcctttgacaacgaatacggaatcgcgtataacagcctcagcagcgagatcttggagcgcctgcagaaaattgacgccccaccctctgcctcagtggaatggtgtcggaaatgcttcggggctccactgatatag

SEQ ID NO: 25821 - DNA, 2376 bp, Artificial Sequence
  Description of Artificial Sequence: Synthetic coding sequence
atgcttctgaagaaatcttctttggacagcaactcttctgagatggccattatgatgggcgccgacgcaaagatactgacggcagccctcacatgtccgaaaaccagcctgcttcacatcgctcggacccatagctttgagaatgtgagttgccatctcccagactcaagaacttgtatgtcagaatctacatggaacccagaacaccgcagcagccccgtgcctgagatgcttgaagagagtcaggaactgctggaacccgtagtggatgacgtgccaaaaactacagccacagtggatacctacgaatctctgctttcagacagtaactccaatcaatcgagagacctaaagactgtgtccaaggacctgaggaacaaacgctcatcattgtatggtattgccaaggttgtgcagagagaagacgtggagaccggcttggaccccctgagtctgctggcaacggaatgtacgggaggcaaaacccctgacagtgaagacaaactgttcagtccagtcatagcacgtaacctggccgacgaaattgagtcttacatgaacctgaaaagccccttaggctccaaaagctcctctatggagttgcaccgtgaagagaatagggagagcggaatgactacagcattcattcacgccttagagagaaggtcgagtctgcccctagaccatggatcccctgcccaggagaacccggaatcggagaaatcttcccctgccgtgtctcgcagtaagaccttcactggccgcttcaaacagcagacccccagtcggactcacaaagagcgcagtacctcactgtctgctctggtaaggagctcacctcatggatcactgggatctgtggtgaactccctcagcggactcaaactcgacaatatcttatctgggcctaagatcgatgtccttaaatccggcatgaagcaggctgctacagtcgcctcgaagatgtgggtggctgtggcctcggcgtacagctactcagatgacgaggaagagacaaaccgggattacagctttccggcaggccttgaagaccatattttaggggagaacatatccccaaacacaagcatctcgggcctcgtgccctccgagttaacgcaatccaacactagtttgggctcctcctcatccagcggggatgttggaaagctgcactaccctaccggggaggttccatttccaagaggtatgaagggacaggatttcgaaaaatctgatcacggaagttcccagaacacctcaatgtcatcaatttaccaaaattgtgcaatggaggtattgatgtcatcctgtagccagtgtcgcgcctgtggagcgctcgtttacgatgaagaaatcatggctggatggacggcagacgattccaacctcaacaccgcctgccctttctgcaagagtaatttccttcctctgctgaatattgagttcaaggacctccggggtagcgcatcattttttttaaagccatcaacatccggggactcactgcaatctgggtctattcctctggctaacgaatcccttgaacacaagcccgtctcaagtctggctgagcctgacctgatcaattttatggactttccaaaacacaaccaaattattaccgaagagaccggatccgccgtggaaccctccgatgagatcaagcgggccagcggggatgtgcagactatgaagatttctagtgtacccaactcactttccaaacggaacgtcagcttgacaagaagccactcagtaggcggtcctttgcagaacattgactttactcagaggccatttcacggaattagtaccgtgtcactgcctaatagccttcaggaggttgtggacccactgggcaaacgacccaatcctcctccagtgtcagtgccgtacctgagccccctggtgcttcggaaggaactcgagtctttgctggagaatgaaggcgatcaggtcatccatacttcatcttttatcaaccagcatccaatcattttctggaacctggtctggtacttccgacgcctcgatttaccctctaacctgccgggcttgatactgacctcagaacattgtaacgagggcgtacaactcccccttagtagtctgtcacaggactcaaaacttgtgtacatccagctactctgggacaacattaacctccatcaagagccccgagagcccctgtacgtttcctggagaaacttcaactccgagaagaagtcctctctcttgagcgaggaacaacaggagacttccaccctcgtggagaccatccggcaaagcatccagcataataatgtacttaagcctattaacttgctttctcagcagatgaagcctgggatgaagcgacaacggaacatttag

SEQ ID NO: 25822 - DNA, 3012 bp, Artificial Sequence
  Description of Artificial Sequence: Synthetic coding sequence
atgctaactacatccggcggacagtccgatcaagggtatggatcgaaggatgagctgatcaaggatgacgccgagatccacgtcccagaggaacaggccgcaagggaactgatcacaaagacgaaaatgcagactgaagaggtgtgtgatgcctccgcaatcgtggcaaaacactcccagcctagccccgagccccatagccccaccgagcccccggcatggggttcctccatagtcaaagtgcccagcggtatctttgacgtgaatagccgtaaatcgagcacaggctctatcagcaacgtcctgttcagcactcaggacccagtggaagatgctgtgttcggggaggccaccaatctaaagaagaatggagaccgcggcgagaagcgacagaaacactttcctgagcgatcatgtagcttctccagtgagtctcgcgctggaatgctgctgaagaagtctagcctggactctaactcctccgaaatggccattatgatgggcgccgatgcaaaaatcttgactgccgcactcacctgccccaagactagcctgctccatattgcccgaacccattccttcgagaacgtgtcctgccatttgcccgactcacggacatgtatgagcgagtcaacttggaacccagagcacaggagcagtccagtgccagagatgctggaagagtcgcaggaactcttggagcccgtggtagacgacgtgcccaaaactacagcgacggtggacacctatgagagcctgctatccgactcaaacagtaaccaatctcgtgacttgaaaaccgtctcaaaagaccttcggaataagcggagttctctatacggcatagctaaggtagtgcagcgagaggatgttgagaccggcctggatccgctctcgctgctggccacagaatgcaccgggggtaagacaccagattccgaagacaaattgttctcacccgtcatagctcggaacctggctgacgagattgaatcatatatgaacttgaagtcccctctcggaagcaagtccagctccatggagcttcacagagaagaaaatcgggagagcggtatgactacagctttcattcacgctctggagaggcgtagctccttaccacttgaccatgggtcccctgcccaggaaaaccctgagtccgagaaaagttcccccgccgtgtccaggagtaagaccttcactgggaggtttaagcagcagaccccctcaagaacccacaaagagcgatccacttccctgagcgctctggtgaggtcctctcctcatgggagcttgggtagtgtggtgaacagcttgagcgggctgaaactggataacatattgtctggccccaagatagacgttctcaagagcggaatgaagcaggcagctacagttgctagcaagatgtgggtggcagttgcgtctgcatattcctattctgatgacgaagaagagacaaatagggactacagttttccagccggcctcgaggaccacattcttggggagaacattagtcccaacacatcaatttctggcctggtgccgtctgagctcacgcagagtaacacctctctgggctcatcatccagtagcggagatgtcggcaagctgcactatccgacgggcgaggtgccgtttccgcggggaatgaagggccaggatttcgaaaaaagcgatcacggatcgtcacaaaatacatccatgtcatcaatttatcagaactgcgctatggaagtattgatgtcttcctgttctcagtgtcgggcctgtggcgcgttagtgtatgacgaggaaatcatggccggctggactgccgacgattctaacctgaataccgcatgcccattttgtaagtccaactttctgccattactcaacattgagtttaaggacctgagaggtagcgctagcttcttcctgaagccatcaacttccggagattctttgcagtcgggatctatccccctcgccaacgagtctctggaacacaagccagtctcttctctggctgagccggatctgattaacttcatggattttccgaagcataatcaaataatcacagaagaaacaggctctgccgtggagccttcggatgagatcaaacgggccagtggcgatgttcagacgatgaagatcagcagcgtgcccaattctctgagtaagcggaacgtcagcctgactcgctcccatagcgtgggcggaccactgcaaaatatcgatttcactcagcgtccctttcacggcatatcgaccgttagcctgccaaattcccttcaggaggttgtggaccccctgggcaaacggcctaatccccctccagtatcagtaccttatctcagcccactagtgcttagaaaggagctggagtccctgctggaaaatgaaggggaccaggtcatacacacctcttcttttattaaccagcatccgataatcttttggaatctcgtatggtactttcgtagactggatttgccatccaatctacccggtctcatactgacgtccgaacattgcaatgagggtgtacaactgcccttgtctagtctctcccaggattccaagctggtttatattcaactcctgtgggacaacataaatcttcaccaagagcctagggaacctctgtacgtgagctggcggaattttaatagcgagaagaagtcaagcctcctttccgaagagcaacaggaaacctcaactttggtggaaactattagacagagtatccaacacaacaacgtgctgaaacctatcaatctgttgagtcagcagatgaagccaggcatgaaaagacagaggtctctgtatagagaaatactgtttctctccctggtgtccttgggtagagaaaacatcgatattgaggcatttgacaacgagtacggaatcgcctataatagcctgtctagcgaaatccttgagagactgcaaaaaatcgatgctcccccttccgcttccgttgaatggtgcaggaagtgcttcggcgcacctcttatttag

SEQ ID NO: 25823 - DNA, 3864 bp, Artificial Sequence
  Description of Artificial Sequence: Synthetic coding sequence
atgagcggagggggcggcggcgggggttcagcaccaagtcgctttgccgactactttgttatatgtggtctggacacggagaccggactagagcccgatgagctgagtgctctttgccagtatatccaggcctccaaggcccgagacggagcctcacccttcatctctagcacaactgagggggaaaattttgagcagactcctctgaggaggactttcaaatcaaaggtcctagctcgctaccccgaaaatgtggagtggaatccgttcgaccaggacgccgtgggcatgctgtgcatgccgaaaggcctcgcatttaagactcaagccgaccctcgggaacctcaattccatgccttcattatcactagggaagatgggtccaggacattcggttttgctctgaccttctatgaggaagtaacctccaagcagatctgtagtgcaatgcagacactgtatcacatgcataatgctgaatatgatgtacttcatgctcccccagctgatgatcgggaccagagctcaatggaagacggcgaggatacacccgtgactaaactccaaaggttcaatagttatgatatctctcgcgacaccttgtacgtgtctaagtgcatctgccttataacgcctatgtcctttatgaaggcctgcagaagtgttttagagcaactgcatcaagccgttacttcaccacagcctccacctctgcctctggaaagttacatctataacgtgctatacgaggtccctctgcccccaccaggccgcagcttaaagttcagcggagtttatggaccaattatctgccaaaggccctccacaaacgagctgcctctgtttgactttccagttaaagaggtgtttgaactcctgggagtcgaaaacgtatttcagctgttcacttgcgccttgctggagttccaaattcttctatacagccaacattaccaacgactgatgacggttgcagagaccatcacagccttaatgttccctttccagtggcagcatgtctacgtgccaatcctccccgcttctttgctccacttcctcgacgcccctgttccatatttgatgggcctgcactctaacgggctcgacgaccggtccaagctggaacttccgcaggaggctaacttgtgtttcgtggatatcgacaatcacttcatcgagttacctgaggatctaccacagttcccaaataaactggagtttgtgcaggaagtgagcgaaatccttatggcatttggaataccgccagagggaaacctccactgcagcgagtctgccagcaaactcaagaggctcagggcttccgagctggtatccgacaaaaggaacggtaacattgccggatcacccctgcactcctacgaactcttaaaggagaatgagaccattgcacggctgcaggccttggttaagaggactggcgtcagcctcgagaagctagaggtccgggaggacccgagtagtaacaaagacctcaaggtccaatgtgacgaggaagagctgcggatataccaattaaatatccaaatcagagaggtgtttgctaacaggttcacacagatgttcgccgattacgaagtgtttgtgatccagccatcccaagacaaagagagttggtttaccaatcgagagcaaatgcagaactttgacaaagcttcttttctgtccgatcagccagaaccgtatcttcccttcctgtcccggtttttggagacacagatgtttgcctcattcatcgacaataagatcatgtgtcatgacgatgacgataaggatccagttctgcgggtgttcgactcccgagtggataagattaggctgctaaatgtccgtacccccactcttagaaccagcatgtatcaaaaatgtaccacagtcgatgaagcggaaaaggcaatcgaactaagactcgctaaaatcgaccacacagctatccacccccacctgctggatatgaaaattggtcagggtaaatacgagccagggttcttcccaaaattgcagtctgacgtgttgagcaccggcccagctagcaataaatggactaaaagaaacgcgcccgctcagtggcggcgaaaggaccgtcaaaagcaacatactgaacatctgcgacttgataacgaccagcgggagaagtatatccaggaggcaagaaccatgggcagcacaattaggcaacccaagcttagtaacctcagcccttctgttatcgcacagactaactggaaattcgttgaaggtctgttgaaagagtgccgcaacaagactaagcgtatgctagtagagaaaatgggccgcgaggcagtcgaactgggacacggcgaggtcaacatcactggtgttgaggaaaacacactgatcgcatccctctgtgatctgctggagcggatctggtctcatggcctccaggtaaagcaggggaaaagcgcactttggtctcatctgctccactaccaggataatagacagcgtaagcttaccagtgggagcctgtcaacttcgggcatactgcttgactctgagcgccgtaagtccgatgccagttctctcatgcctccattgaggatcagcctgatccaggacatgaggcatattcaaaatattggcgagattaaaactgacgtgggaaaggctagggcttgggtgagactgagtatggaaaagaagttgctaagcaggcatttaaaacaactcctgtcagaccacgagctgactaagaaactctataagagatacgcttttctgagatgtgacgatgaaaaagaacagttcctgtaccacctactttcttttaacgccgtggactacttttgttttaccaacgtcttcacaacaatattaattccataccacatcctgatcgttccctctaagaagctgggcggcagcatgttcaccgccaacccatggatttgtatttctggagaactgggcgaaactcagatcatgcagatcccccggaacgtcctggagatgacttttgaatgtcagaatctgggcaagctgacaaccgtgcagattggccatgataactctgggctgtacgcaaaatggcttgtggagtatgtgatggtgcgtaacgagatcactggccacacctataaattcccgtgcggcaggtggcttggaaaaggaatggacgatggctctctagagagaattctggttggtgaattgctgacttcacagccagaagtggacgaacgtccttgtcgcacaccccctttgcagcagagtccttcagtgatcagacgcctcgtgacgatctctccaaataacaagcctaagctgaacacaggccagatacaggagagcattggcgaggccgtgaatggcattgtcaagcacttccataaaccagagaaagaaagaggtagcctgacactcctcttgtgtggcgaatgtgggcttgttagcgcactggagcaggctttccagcatggtttcaaatctccaaggctatttaaaaacgtatttatttgggactttctcgagaaggctcagacctattatgagacccttgaaaagaatgaggtcgtacccgaggagaactggcataccagagccaggaacttttgtaggttcgtaaccgccatcaacaataccccaaggaacattggtaaagatggcaagtttcagatgctggtatgcctgggggcacgggatcatcttctacaccactggatcgccctcttagcagattgccccattactgcccatatgtatgaagatgttgccctgatcaaagaccacactttggtgaacagcctaatccgcgtcctacagacactgcaggaatttaacatcacccttgagacaagtctggtcaaggggatagatatctag

SEQ ID NO: 25824 - DNA, 1893 bp, Artificial Sequence
  Description of Artificial Sequence: Synthetic coding sequence
atgaagattgggcaggggaagtacgaacccggtttctttccaaagttgcagtcagacgtgcttagcacaggacccgcatccaataaatggaccaagagaaatgccccagcccagtggaggcggaaagatcgccagaagcagcatactgaacacctccggctggataacgaccaaagggagaagtacattcaggaggcccggacaatgggaagtacaattcgccagccaaagctttcaaatctatctcctagcgtcatcgcccagactaattggaagttcgttgagggtctgcttaaggaatgtcggaataagaccaaacgcatgctcgtagagaagatggggagggaggcagtcgagctcggccatggcgaggtgaatattacaggtgtggaggaaaacacactcatcgccagtttgtgcgacctactggaacgcatctggtcccacgggctccaagtcaagcaggggaaatcggcgctttggagccatctgttgcattatcaggataaccgtcaacggaaactgacttcaggatcactcagcacatcagggattttgctggattcggaacgtagaaaaagcgacgccagctctctgatgccacctctgagaattagtctgattcaggatatgcgacatatccagaatataggcgagatcaagacagacgttgggaaggctagagcttgggtgcggttgagtatggagaagaagctgctctcccgacatctcaaacaacttcttagcgaccacgagcttaccaaaaaactctataaacgttacgcttttctgcgatgcgatgacgaaaaagagcagtttctgtaccacctgcttagctttaacgccgtcgattatttttgcttcaccaacgttttcactacgatcctgatcccataccacattttgatcgtaccctccaagaagcttggggggtcgatgttcactgccaacccgtggatctgtatatccggcgaactcggtgagacacaaatcatgcagataccccggaacgtcctcgagatgacctttgagtgccagaatctgggaaagctcacgaccgtgcaaatcggacacgacaacagtggactgtatgcaaagtggctcgtggagtatgttatggtcagaaacgaaatcaccgggcacacgtataagttcccctgcggccggtggttggggaaaggcatggatgacgggtctctggaaaggatcctcgtgggcgagctgttgaccagccagcccgaagtcgacgaacgtccctgccggaccccgccacttcagcagagcccttccgtgattaggcgcctggtaacaattagccccaataacaagccaaagctcaatacaggccagattcaagaatccatcggcgaggcggtgaacgggatagtgaagcatttccacaaacccgagaaagagaggggcagccttacccttctgctgtgcggggaatgcgggctggtctccgccttagagcaggcgttccagcacggcttcaagtcacctcgtctctttaagaacgttttcatctgggactttttggagaaggcccagacatactacgagaccctggagaagaatgaagtcgttccggaggaaaattggcacacccgggcccggaatttctgtagatttgtcacagccataaataacacccccagaaacatcggcaaagacgggaagtttcaaatgcttgtgtgccttggggccagggatcatctcctgcatcactggattgctttgctggcagactgccccattactgcgcatatgtacgaggacgtagccctgattaaggaccatactctggtgaactcacttattcgcgttttacagaccttgcaggagttcaacataacactggaaacaagtctcgtgaagggaattgacatctag

SEQ ID NO: 25825 - DNA, 3726 bp, Artificial Sequence
  Description of Artificial Sequence: Synthetic coding sequence
atgtccggcggtggcggtggaggggggtcggctcccagccgcttcgccgactatttcgttatttgtggtctcgatactgagaccggtctggagccggatgagttgtccgccctatgtcagtacattcaggcatctaaagctcgagacggtgcgtccccctttatatcttccaccacagaaggagagaattttgagcagacgccactgagacgcacctttaaaagcaaagtgcttgcacgatacccagagaatgtggaatggaacccattcgaccaggatgctgtgggcatgctctgtatgccaaaagggcttgcattcaagacccaggcagatccaagagaacctcagttccacgcctttatcatcacccgagaggacggcagtcggaccttcggctttgccctgaccttttatgaggaggtgactagtaaacagatatgtagtgctatgcagaccctgtaccacatgcacaatgccgagtatgacgtgttgcacgccccacctgccgacgaccgcgatcagagctccatggaggacggagaggacactcctgttactaagctacaacggtttaattcttatgacatttcccgggatactttgtacgtgtctaaatgcatttgcctcattacaccgatgtcctttatgaaagcctgcagatccgtgttggaacagttacatcaggccgtgaccagccctcagcctccacctctgcccctggaaagctacatctataatgtgctgtacgaggtgcccttgcccccgcctggtaggagtctgaaattttccggggtatatggcccaattatctgtcagagacccagcactaacgagcttcccctctttgatttccccgtgaaggaagtatttgaactccttggggttgagaacgtatttcaacttttcacatgcgcactgctcgaattccaaatactgctgtactcacaacattaccagcgcctcatgactgtcgccgagacaatcaccgccctgatgtttccttttcagtggcagcacgtgtatgtccctatcctacctgcgagtctgctccactttctcgacgccccagttccatatctgatgggcctgcactccaacgggcttgacgataggagcaagctagagttgccgcaggaagccaatctgtgcttcgttgatatagataatcattttattgaacttccagaagaccttccccagttcccgaacaagctagagttcgtccaggaggtgagcgagattcttatggctttcggaatcccaccggaagggaatttgcactgttctgaaagcgcctccaagctgaagcgcctgcgcgccagcgaactcgtctcagacaagcgcaacggaaacatcgcaggatcccccctacatagctacgagttactgaaggagaacgagacgattgctcggcttcaggcgctcgtaaagaggactggcgtaagcttagaaaagttggaggtccgcgaagatcccagttctaataaggacctcaaagtgcagtgtgacgaggaagaactacgcatctaccagttaaacattcagatccgggaagtttttgccaaccggttcacccagatgtttgccgattacgaagttttcgttatccagccatctcaagataaggaaagctggttcaccaacagggagcagatgcagaactttgataaggctagctttctcagcgaccagcctgagccatacctgcctttcttatctcggttcctggagacccagatgttcgcttccttcatcgataataagatcatgtgccatgacgacgacgacaaggacccggtacttagagtattcgactcaagagtggacaagatcagactactcaatgtgagaacccccaccctccgtacatcgatgtaccagaagtgcaccacggtcgacgaagcagagaaggctatagagctgaggctcgcaaaaatcgaccatacagcaattcacccacacttacttgatatgaagattggacaaggaaagtatgagcccggtttttttcctaaactacagagcgatgtcctgtctaccggacctgcctctaataagtggacgaagcgcaacgctccagcccagtggcgtcgcaaagacaggcagaagcagcacactgagcatctgagactcgacaatgatcagcgagagaaatacatccaagaagccaggaccatgggaagtactattaggcagccgaagctgagtaatctctctcccagtgtgattgcgcagacgaactggaagtttgtagagggactgctaaaggagtgtcggaataagactaaaagaatgctggttgaaaaaatgggcagagaggctgtcgaactgggccacggagaagttaatataacaggagttgaagaaaatacactgatcgcaagcctgtgcgacctactagaaagaatttggagccatgggcttcaagtgaagcagggaaaatccgcgctctggtcccacctgttgcactaccaggacaataggcagagaaagctcacttctggcagtctctcaactagcggcattttgctcgacagtgaacgaagaaaaagcgatgcctcctcgttgatgccgccattacgcatatccctcatccaagacatgcgacatattcagaatattggggagattaagactgacgtcggcaaggccagagcttgggtgcgcttgtccatggaaaagaaactcctctcaaggcacctgaagcagcttttgagtgaccacgagctgacaaaaaaattgtataagagatatgccttcttacgttgtgacgatgaaaaggagcagttcctataccatctcctatctttcaacgctgtggattacttttgcttcacaaacgtttttaccaccatattaatcccataccatatactgattgtgcctagcaagaagttggggggatccatgtttactgcaaacccatggatctgcatttccggcgagctgggcgagacgcagattatgcaaatcccgagaaacgtgttagagatgacgtttgaatgccagaatctcggaaagttgaccactgttcaaataggccacgacaactctggcttatacgctaaatggttagtggaatacgtgatggttcgcaatgaaatcaccgggcacacatacaaatttccgtgcggcaggtggttggggaagggaatggacgatggttccctggagagaatattagtgggagaactgctgacgtcccaacctgaggtggatgagaggccatgtagaacccctccactgcaacaatccccaagtgtgattcgcaggctcgtaacaattagccctaataataaacctaagctgaacacaggccaaatccaggagagtataggagaagccgtcaacgggatagtcaaacattttcacaagccagagaaggaaaggggatcactgaccctgttgctgtgcggtgaatgcggactcgttagtgccttagagcaggcttttcagcacggtttcaagtccccccgtctattcaagaatgtgtttatttgggactttttagagaaggctcagacttactatgagaccttggaaaagaacgaggtagtgccagaggagaactggcatacccgggcacgcaatttttgtcggtttgtgaccgccatcaataatacaccaagaaacatcggaaaagacgagattacctcttacaccactgggctaccctgctggctgacagcaccctctttacacacctgtatgcgtatgtggcactag

SEQ ID NO: 25826 - DNA, 3930 bp, Artificial Sequence
  Description of Artificial Sequence: Synthetic coding sequence
atggggacacaccaccacgctcagctaatctttgtgtttctcgtcgaaatgcgattccaccacgtggaccaggcgggcctcgaacttcttacctcctccaactcccccgcttccgcaagccggtccgctgaaattacggtcgtttcacaacatgcccagcccggattcttgtaccaatggctggaagctgataggcacgggaagtctcagggcgctgcaaacacaacttcaggcgagaattttgaccagtcacccctgaggcgaacctttaaatctaaggtactggcccattacccacagaacatagaatggaatcccttcgaccaggacgctgtgaacatgttatgcatgccaaaaggcctgtctttccggacgcagaccgacaacaaagacccacagttccattcattcatcatcactcgggaggatggcagcaggacctacggttttgttctgactttctacgaggaagtgacaagtaagcagatttgcactgccatgcaaaccctgtatcagatgcataatgctgagcactacagctctgtatacgccagctccagctgctccatggacagcctggcaagttctctggatgagggagatacaactagcctgctcaaactacagcggtataattcctatgatatcagtcgggataccctgtatgtgtccaaatccatttgtctgattaccccactcccattcatgcaggcctgtaaaaagttcctgatacagctttataaggccgtgaccagtcaacagcctcctcccctaccactggagtcatatatccacaacatactatacgaagtgcctctgcccccaccaggtagatccctgaagttttacggcgtatatgagccagtcatctgccagaggcccggaccatccgaattgcccctcagcgactaccccttaagagaagcgttcgaactgttggggctggaaaacttagtgcaggtgtttacttgcgttttactcgagatgcaaattctcctctacagccaggactatcagcgcctgatgactgtagcagaaggtatcaccacactcctgttccctttccagtggcagcacgtttatgtgcctattttgccagcttcgctgcttcacttcctggacgccccagtcccgtacctcatggggctgcagtccaaagagggaaccgatcgtagcaaactggaactaccccaggaagccaatctttgtttcgtcgatatcgacaaccacttcatcgagctgcccgaggagtttccccagtttccaaataaggtggattttatccaggaactctcagaagtattggtgcaatttggcattcctcccgagggctctctgcactgtagtgaaagcacatctaagctgaagaacatggtgcttaaagatctcgtgaacgacaagaagaacgggaatgtctgcaccaacaacatttctatgtacgagctactaaagggaaacgaaactatcgcgcgcttgcaagccctcgccaaaagaactggagtcgcagtggaaaaaatggatctaagcgcctcactgggtgagaaggacaaagacctgaagttacactgcgaggaggcagagctcagggactaccagctcaatgtacagttacgcgaggtcttcgcaaataggttcactcagatgtttgccgattatgaagcctttgtgattcagactgctcaagatatggagagctggctaacgaacagggagcagatgcaaaattttgacaaggcaagctttctgagcgaccagcctgaaccatatctgcctttcctttccagatttatcgagacacaaatgttcgccacttttatagataataaaattatgtcacagtgggaagaaaaagatcctctcctgcgtgtttttgacacacgcatcgataaaattcggctttacaacgtccgggctcccaccctgaggacatcaatctatcagaagtgttcaacgttgaaggaagccgctcagagcattgaacaacggcttatgaagatggaccacactgcaatccatccccacctcttagacatgaagattggccaggggaagtatgaacaaggtttttttcccaagcttcagtcagatgtgctggctactggacccacttctaataaccgctgggtaagcagatccgcgacagctcagaggagaaaggagcggctgcgtcaacactccgaacatgtcggtctggataatgatctgagagaaaagtacatgcaggaagcccgatcactcggtaagaacctccgtcaaccaaagttatccgatctatctcccgccgtaatagcccagacaaattgtaaatttgtcgaaggcctgctgaaagagtgcagaatgaaaactaagagaatgttggttgaaaaaatggggcatgaggcagtcgagctcggccacggggaggctaacattacaggcctcgaggagaataccctgattgcttccctgtgtgacctattagagaggatctggagccacggccttcaagtgaaacaaggaaagagcgccctgtggtcccatctcatacagttccaggatcgggaggagaagcaggagcatttggctgaaagccctgtagctctcggacccgagcgccggaaaagcgactctggtgtaatgctgcccactctgcgggtgagtctgatccaggatatgcgccatattcagaacatgtccgagataaagaccgacgtcggccgagcccgcgcttggataaggctgtccctcgaaaagaagctgctttcacagcacctcaaacagctcttatcaaatcaaccattaactaaaaagttgtacaagaggtatgcctttttacgttgtgaagaagaaagagaacagttcttatatcacttgctcagcctgaatgccgtggattacttctgcttcaccagcgtgtttaccactattatgatcccttacagatccgtgatcattcctatcaaaaaactgtctaatgctattattacttctaatccttggatttgcgtgagcggagagcttggtgacaccggtgtgatgcagattccaaagaaccttctcgagatgacttttgagtgccagaatcttgggaagctcaccaccgtccagatcggccacgataatagcggactcctagcgaaatggctggtggactgcgtaatggtccgaaatgaaattacaggccatacctacagattcccttgtgggcgttggctgggaaagggaattgacgatgggtcactggagcgcattctgattggagagcttatgacttccgcctctgacgaggacctggttaagcaatgccgaaccccaccccagcagaaaagtcccaccaccgcccgtaggctgtccatcacctccttgactggcaaaaacaacaaaccaaatgctggacagattcaggaggggataggtgaagctgtgaataacattgtcaagcacttccataaaccggagaaagagcggggatctctcacagttttgttatgcggagaaaatggcctggtagcggctcttgaacaggtctttcaccacggctttaaaagcgcaaggatttttcacaaaaatgtatttatctgggacttcatcgagaaagttgttgcctactttgagactacagaccaaatccttgataacgaggacgacgtgctgattcaaaagtcaagctgcaaaactttctgccattacgtgaacgctattaacaccgcccccagaaatatcgggaaagatgggaaattccagatcttagtctgtttgggtactcgcgaccgactgcttccccagtggatccccctgttggccgagtgccccgcaattacccgcatgtatgaggaatcagctctgctcagagatcgtatgactgtaaacagtctcatccggattcttcaaaccattcaggatttcacaatcgtgctcgaaggttcactcattaaaggcgtggacgtctag

SEQ ID NO: 25827 - DNA, 2217 bp, Artificial Sequence
  Description of Artificial Sequence: Synthetic coding sequence
atgagcggctcatgcgcagccccggggcctggttcaggctcatctcccgcggcatgcaggttcgctcattacttcgtactttgcggcattgacgccgattccgggctggagccagatgagctcgctgtgctataccagtggcttgaagccgataggcatggtaagagccagggagccgccaataccacctcaggagagaacttcgatcagtcacctctcagacggacctttaaaagtaaggtgctggcgcattatccccagaacattgagtggaacccgttcgaccaggatgccgtcaatatgctatgtatgcctaaaggactgagttttaggacccagacagataacaaagacccccagtttcactctttcatcataacccgagaggatgggtcacggacgtacggttttgtcctgacattctacgaggaggtgacttcaaaacagatctgcactgccatgcagacactgtaccagatgcacaacgctgaacattatagctcggtgtacgcaagctcctcctgcagcatggacagtcttgcttcatctctcgatgagggcgataccacctcactcctaaaacttcagcggtacaatagctatgatatctcgcgcgatactctgtatgtgagtaagtcgatttgcctgattacacccctcccctttatgcaggcatgtaaaaaatttcttatccaactctataaagcagtgacaagccagcagcctcctcctctcccccttgagtcatacattcacaatatattgtacgaggtgccactgcccccacccggtcgttctctgaagttttacggtgtgtacgaaccggtcatctgccagcgcccagggccctccgagctgcctctgtctgattatcctctgagggaggctttcgagctgctaggcctggagaacttagtccaggttttcacctgcgtgttacttgaaatgcagattctgctgtactcccaagattaccagcgtctgatgaccgtggctgagggtattacgaccttgctgttccccttccagtggcagcacgtctacgtgcctatcttgcctgctagcctgttacatttccttgacgccccggttccctacctcatgggcctccagtccaaggagggcacagatagatctaagctcgaactcccacaggaggccaacctgtgttttgtcgacatcgacaatcacttcatcgaactgccggaggagttcccacagtttcctaacaaggtggacttcatccaggaactctctgaggtgttggtgcagttcgggatcccgcccgaaggctccctgcattgctctgaaagtacctcgaaattgaagaatatggtactcaaggatttagtgaatgacaagaaaaatggcaatgtttgcactaacaacatatccatgtacgagctactgaagggcaacgaaaccatagctcgcctgcaagctctggctaaacggacgggcgtcgccgtcgagaagatggatttgtccgccagcctgggggagaaagacaaggaccttaagctgcactgtgaggaagctgagcttcgcgactatcaactgaatgttcaacttagggaggtatttgccaaccggttcacgcagatgtttgcggactacgaggcattcgtcatccagaccgcacaggatatggagtcttggctaaccaatagagagcaaatgcagaattttgataaggccagctttctgtctgaccaaccggagccatatcttccatttctgagtaggttcatcgaaacccagatgtttgccactttcattgataataaaatcatgtcacagtgggaggagaaggatcccctcttgcgcgtctttgatacacggattgacaaaattcgactgtataacgtgcgcgctcccactctgcgcacttcaatttaccagaagtgtagtacgctcaaggaagctgctcagtctatcgagcagcgtttaatgaagatggatcacacagctatccatccgcacctcctggacatgaaaatcggacagggaaagtatgaacagggattctttcctaagttgcagtccgacgtgctcgcaacaggtccaactagcaacaacaggtgggtgagcaggagtgcgacagcccaaagacgcaaggaacgactccgacaacacagcgagcacgtggggcttgataatgatctcagagaggtctgcgggctgcccagctggggcgcttcccagcaggcaccctag

SEQ ID NO: 25828 - DNA, 3825 bp, Artificial Sequence
  Description of Artificial Sequence: Synthetic coding sequence
atgtccggctcctgcgccgctcctggccccggctctggcagtagcccggccgcctgccgattcgctcattatttcgtgctgtgcggtatagacgctgacagcgggctggagcccgatgaactagccggcgaaaactttgatcagtctccattaaggaggacctttaagagtaaagtactggcgcattatccccagaacattgagtggaacccttttgatcaagacgccgtgaacatgttgtgcatgccaaagggtctgtcattccgcacacagaccgacaacaaagacccacaattccatagttttattattacccgcgaagacggttcacgcacatatggattcgtgctgactttctacgaagaagttacctcaaaacaaatctgtacagcgatgcaaaccctgtaccagatgcacaacgcagaacactattcttccgtttacgccagctcgagttgttctatggattccctggcctcaagtctcgacgagggagacactactagcttgctgaagctacaaagatataactcctatgatatcagcagggataccctatacgtgtccaaaagcatctgtctcattacccctctgccgttcatgcaggcttgcaaaaaattcctcattcagttgtataaagctgtcacctcccagcagcctccacccttaccactcgaatcttatatccataatattctctatgaagtgcctctgccgcccccagggcgctctctgaaattctatggggtttacgagccggtgatatgccagaggcctggacctagtgagctgcccttgagcgactaccctcttagagaagccttcgaactgctaggcttggagaatcttgttcaggtgtttacatgcgtgttacttgaaatgcaaatcttattatactcacaggattatcagcggctgatgactgtcgctgaggggattactacactacttttcccctttcaatggcagcacgtatatgtgcccattctgccagcttctctgctgcactttttagacgctcccgttccctatttgatgggtctccagtcaaaggagggaactgaccgaagcaaattggagttgccacaagaagcaaatctgtgcttcgtggatatcgataatcacttcatagaactccctgaagaatttcctcaatttcccaataaagtggattttatccaggaactgtctgaggtcctggtgcagttcggaatccctccggagggcagtcttcactgcagcgagagcacctctaaattgaagaacatggtgctgaaggacctcgtgaatgataagaaaaatggtaatgtttgcactaataacatctcgatgtacgagctcttaaaggggaacgaaacgattgccagacttcaagcacttgccaagaggaccggggtagctgtcgagaagatggatctgtctgcttcactgggggaaaaggacaaagatctgaaattgcattgcgaggaggccgagctgcgcgactatcagctgaatgtgcagttgagagaggtttttgccaatcggtttacacaaatgttcgccgattatgaagcctttgtaatccaaaccgctcaagacatggaaagttggctaactaaccgtgaacaaatgcagaactttgataaggcatcttttctgagcgaccaacctgagccttatctgccattcttgtctcgatttatcgaaactcagatgttcgccacttttatcgacaacaaaattatgtctcagtgggaagagaaggacccactacttagggtgtttgataccaggatcgataagatcagattatacaacgtgcgagctcccactttgcggactagcatctaccaaaaatgcagtaccctcaaagaagcagcgcagtccatcgagcagaggctaatgaagatggaccataccgccatccatccccacctgctggacatgaagattgggcaaggcaagtatgagcaaggcttctttcctaaattgcaatccgacgtcctggcaacaggaccaacctcaaacaatcggtgggtctctagatccgccaccgcacagagacgcaaagagcggctgagacagcatagcgagcatgtaggtctggacaatgacctgcgagaaaagtacatgcaggaagccaggagcttaggaaaaaatctgcggcagccaaagttatccgatctgtccccagcagttattgcacagacaaactgcaagttcgtggagggcctgctgaaggagtgcagaatgaagaccaaaaggatgctggtagagaagatgggccatgaggcggtggagctcgggcatggggaggcaaacattacaggcctggaggaaaacaccctcatagccagtttgtgtgatctgctggaaaggatctggtctcacggtctgcaggtgaaacagggaaagtcagccctgtggtcccatctgatccagttccaggatcgggaagagaaacaggagcacctcgctgaaagccctgttgccctgggccctgagcgccgaaagtccgatagtggcgtcatgttgccgactctacgggtctcccttatacaggatatgagacacattcaaaatatgtctgaaattaagacggacgtggggagagctcgcgcctggattcgtctctctctggagaaaaagctgctttcacagcatctgaaacagttgctttccaaccagccgttgaccaagaagctttacaagcgctacgcatttctgcggtgtgaggaggaaagggagcagttcttgtaccatttgctctccctcaatgccgttgattatttctgtttcacttctgtgttcaccaccatcatgatcccgtaccggtcagtcatcataccaataaagaagttatccaacgctattataacttccaacccttggatctgcgtgtcgggcgaactgggcgatacgggggtcatgcagatcccaaagaatcttctggagatgactttcgagtgtcagaatcttggcaaactgaccaccgtccagatcggacacgataactcgggtctattagctaagtggttagtggattgtgtaatggtacgcaatgaaattacaggtcatacatatcgtttcccatgtggtagatggttgggcaagggcatcgacgatggcagcctggagagaattctaatcggtgagctgatgacaagtgcaagcgatgaggacctggtgaaacagtgccggacccccccccagcagaaaagtccaacgactgctcgcagactgtccatcaccagtctaaccggaaagaataacaaaccaaatgcaggacagatacaggagggtatcggagaggccgtcaacaatatcgtgaaacacttccataagcctgaaaaggaaagagggtcactgacagttctactgtgcggggaaaacggcctggtcgcagcgctggagcaggtcttccaccatggatttaagagtgcccgcattttccataagaatgtctttatttgggacttcattgaaaaggtcgtggcctactttgaaactaccgaccagattcttgataacgaggatgatgtgctcatccagaagtcctcttgtaagaccttttgccattatgtgaacgcgattaatacagcaccccggaacattggtaaggacggcaaattccagatcttggtctgtttgggaacaagggaccgtttgctcccccagtggatccctctgctggccgaatgccctgctatcactagaatgtacgaagaaagtgcactcctgcgagataggatgactgttaactccctaatacgtatcctgcagaccatccaagattttactattgtgttagagggaagcctgataaaaggtgtagatgtttag

SEQ ID NO: 25829 - DNA, 3930 bp, Artificial Sequence
  Description of Artificial Sequence: Synthetic coding sequence
atgggaacgcaccaccacgctcaacttatattcgtctttttggtggaaatgcggtttcaccatgtggatcaggccggtttagagctgctgacatcaagtaactcccccgctagtgcgagccggagcgcggagatcacagtggtcagtcagcacgcccagcccggcttcctgtaccaatggctcgaggcagatcggcacgggaagtctcagggcgccgctaataccacgtccggagagaattttgaccagtctcctctcagaaggacatttaagtcaaaggtacttgcccactacccccagaacatagaatggaatccattcgaccaagacgcagtgaacatgctttgcatgccgaagggtctgtcatttcgcacccagactgacaataaggacccccagtttcatagcttcatcataaccagggaggatggatcacggacatacggcttcgttctgaccttttacgaagaggtgacctctaagcagatctgtacagctatgcaaaccttataccaaatgcacaatgcagagcattacagtagcgtgtacgcctcatcgtcatgttctatggattctctcgccagttcattggatgaaggcgacactacttctctgttaaagcttcagaggtacaattcttacgatatttctcgcgacaccctatatgtctcaaaatcaatttgcctcatcacccctctaccttttatgcaggcctgtaagaaatttctgattcagctttataaagcggtaacctctcagcagcctccccccctccccttagaatcctacattcacaatattctatacgaggtaccgcttcctcccccaggacgttcacttaagttttatggtgtctatgagcctgtgatctgccagcgccccgggcccagtgagctccccctttcagactaccctctgcgggaggcatttgaacttctggggctggaaaatctggtgcaggtatttacttgtgtgctgctggaaatgcagatactgctgtattcacaggactatcagaggctaatgacagtcgccgaggggattactacactgttgtttccctttcagtggcagcatgtgtacgtcccaattctccctgcctctctgctgcacttcctggacgccccagtgccgtatctcatggggctccaatccaaggaaggtacagaccggagcaaactcgaacttccacaggaagctaacctctgttttgtcgacattgacaaccattttatcgagctacctgaagagttccctcagtttcccaacaaagtcgattttatacaagagttatctgaggtcctagtgcagttcggtatccctcctgaagggtcattgcattgtagcgagagcacatcaaagctaaaaaacatggtgctcaaggacctggttaatgataagaagaacggtaacgtgtgtacaaataatatatccatgtacgaacttttgaaggggaatgagaccatcgcccgcctgcaggcccttgcaaagagaacgggcgtggccgttgagaagatggacctgagcgcctcactaggtgaaaaagacaaggaccttaaattgcactgcgaagaggcagagctccgggactatcagctaaatgtccaactgagagaggtgtttgccaacagattcacccaaatgttcgccgactacgaggccttcgtcatacagacagctcaagacatggaatcctggctgacgaaccgggagcagatgcaaaattttgataaggcgtcttttctgagcgatcagccagaaccttacctgccttttcttagccgatttatcgaaacacagatgttcgcgacctttatcgacaataagattatgtcacagtgggaggagaaggacccgctgctcagggtgtttgacactcgcatcgataagatccgcctctataatgttcgcgcccccactctccggacaagtatctaccaaaagtgttctaccctcaaagaagctgcacagtccatcgagcagagactaatgaaaatggaccacacggcgatccatcctcacctgctcgacatgaaaattggacaggggaaatatgagcaaggattttttccaaaacttcagagcgatgtcctagcaacagggccaacaagtaacaatcgatgggtgtcccgttctgcgacggcacagagacggaaggagcggttgaggcagcacagcgagcacgtgggccttgacaacgatctaagagagaaatacatgcaggaggcccggagtcttggaaagaacctgagacagccaaagttatctgacctctcccctgcagtgattgcccagaccaattgtaagttcgttgagggactactgaaggagtgtcgcatgaaaaccaagcggatgttggtggaaaagatgggccacgaggccgttgaactaggacatggcgaagcaaacataacaggcctggaggaaaacactctgatcgccagtctctgcgatctgttggagaggatatggtcccacggacttcaagttaagcagggcaaatcagccttatggtcacatctgattcaatttcaggaccgtgaggaaaagcaggagcacttggcagaatctccagttgcattgggacctgagagaaggaagtctgacagcggtgtgatgctaccaacacttagggtctctctcattcaggacatgcgccacatccagaacatgagcgaaattaagaccgacgtggggagggcaagggcttggattcggctgtccctggaaaaaaagctgctgtctcaacatctgaagcaactgctcagtaaccagccactgacaaaaaaactctataagaggtacgcattcctgaggtgtgaggaggaaagagagcagttcctgtaccacctcctgagcctgaacgcagtggactatttctgtttcacctctgtgttcactaccatcatgataccataccgctcagtgattatcccaatcaaaaagctcagcaacgccatcattacatcaaatccatggatctgcgtgagcggcgaactcggcgacaccggggtgatgcagattccaaaaaatctcctggaaatgactttcgagtgccagaatcttggcaagctgacaactgtccaaataggccacgataacagcggtctcctggctaagtggctggttgactgtgtgatggtccgaaatgagatcacagggcacacgtatcgctttccctgcggcaggtggctgggcaaaggcattgatgatgggtcactggagaggattcttattggggaactcatgacaagcgcctctgatgaagatttggttaaacaatgccgcacccctccccaacaaaagtctccgacaacagcccggcgactcagcattacgtccctcacgggcaaaaacaataaacctaatgccggccagatccaggaaggaattggagaggcagtcaataacattgttaagcattttcataaacctgagaaagaacgcggcagtctgacagtgctgctttgtggggagaatgggctggtggcagcgttagaacaggttttccaccacggctttaagtccgctaggatcttccataaaaatgtattcatttgggatttcatagagaaggtagtggcctattttgagaccaccgaccaaatcttggacaacgaggacgacgtgttaattcagaagtcatcctgcaagactttctgtcattacgtgaacgcaataaacactgccccaagaaacattggaaaagacggaaaattccagattctcgtgtgtctgggcaccagagatagattacttccccagtggatcccactgttggccgagtgccccgccattacaagaatgtatgaggaatctgctctgctgagggatagaatgacagttaattcattgatccgtatcctgcagaccatccaggactttaccatcgtgctggaaggcagcttgatcaagggcgtggacgtatag

SEQ ID NO: 25830 - DNA, 399 bp, Artificial Sequence
  Description of Artificial Sequence: Synthetic coding sequence
atgtttttggttggactcaccgggggcattgcaagcggcaagagtagcgtgatacaggtgtttcaacagctggggtgtgccgttatcgacgtcgacgtgatggctagacacgttgtgcagcccggataccctgcccatcggcgcatcgtggaagtgttcggcaccgaagtgctgctggaaaacggcgatattaataggaaggttctcggggacctgatcttcaaccagcctgatcgcagacagctgctgaatgctatcacccacccagaaatacgtaaagagatgatgaaggaaacctttaagtactttttgcgggaacccagaacatcgcctcgtggcaagaagcacgtgcccagtgctctcaaggaggctgattccctcatgcgccgagatacctag

SEQ ID NO: 25831 - DNA, 696 bp, Artificial Sequence
  Description of Artificial Sequence: Synthetic coding sequence
atgtttctggtggggttgactgggggaatcgcatccgggaaatcctcagtcatccaggtctttcagcaattgggctgcgctgtcatcgatgtcgatgtcatggcccgccatgttgttcagcctggttacccagcacacagacggatagtagaagtgtttgggaccgaagttctcttggagaacggcgacatcaatagaaaagtgctgggtgatctgatatttaatcaaccagatcggcggcaattgttgaacgcaatcactcatcccgaaattcgaaaggagatgatgaaggagacattcaagtacttcctgagaggttacaggtatgttattctcgacatcccactcctgttcgaaactaaaaaactgcttaaatatatgaagcacacggtggtagtatactgtgatagagacacgcagctggctaggctgatgcgtaggaattcgctaaatcggaaggatgcagaggcgcgaatcaatgcccagttgcccctgaccgacaaggccagaatggcgaggcatgtcttggataacagcggcgaatggtccgtaacaaagaggcaggtgattctgctgcatacggagctggagaggtcccttgagtacctccctttacgtttcggcgtgctcaccgggctggccgccatcgcaagcctgttgtatctcttgacgcactatttgctgccttacgcttag

SEQ ID NO: 25832 - DNA, 696 bp, Artificial Sequence
  Description of Artificial Sequence: Synthetic coding sequence
atgttcctggtaggcctcacaggaggtatcgcctccggcaagagttcagtgatccaggttttccagcaattaggctgcgccgtcatcgatgtcgacgtgatggcacgccatgtggtccaacccgggtatcccgctcacagacgcatcgtggaggtgttcggcaccgaagtactcctggagaacggagacattaatcggaaggtgctgggagatctcatttttaatcagccagatcgtcgtcaactactcaacgcaatcacacacccagagatccggaaagaaatgatgaaggagaccttcaaatacttcctgaggggttaccggtacgtgatcttggacattcccttgctttttgaaaccaaaaagcttctcaagtatatgaagcacactgttgtggtgtattgcgacagagatactcagctcgctcggcttatgcgcagaaacagcttgaacaggaaagacgcagaagcccgcattaacgcacaacttcccctaaccgacaaagccagaatggccaggcatgtgcttgataacagtggtgaatggtccgtcacaaagcgtcaggtcatcctgctgcacaccgaactggaacggtctttggagtacctccccctcaggtttggtgtgctgacaggtctggctgccatagcatcattactttatctcttaacgcactacctattgccctacgcatag

SEQ ID NO: 25833 - DNA, 756 bp, Artificial Sequence
  Description of Artificial Sequence: Synthetic coding sequence
atgagtgatattggcgattggttcagatcgatccctgccattaccaggtactggttcgctgcgaccgtggcagtccctctcgtaggaaagctggggctgatcagcccagcttacctctttctgtggcccgaggcgttcttatataggttccaaatctggcggcctatcacggctacgttttacttcccagtaggtccaggtactggattcctttatctggtgaacctatattttctgtatcagtactctactcggctggagacaggggccttcgacggccggccagctgattatctcttcatgcttctctttaattggatttgtattgtgattacaggcttggcgatggatatgcagcttctgatgatcccactgatcatgagcgtcctgtatgtgtgggctcagctgaatcgcgacatgatcgtctccttctggttcgggacaagattcaaggcttgctatctcccctgggtcattttaggcttcaattatataattggcggtagcgtcatcaacgaattgatcggaaatctcgtagggcatctctatttttttctgatgtttagatatccgatggatcttgggggtaggaattttctgtctacaccccagtttctatacaggtggcttccttctcgacggggaggggtgagtggctttggtgtgccgcccgcttcaatgcgcagagcggctgatcaaaacggcggaggtggccgccacaactggggacaagggttccggttgggagatcagtag

SEQ ID NO: 25834 - DNA, 696 bp, Artificial Sequence
  Description of Artificial Sequence: Synthetic coding sequence
atgtccgacatcggggactggtttagatccataccagccatcactcgctactggttcgccgctaccgttgccgtcccactggtcggtaagctgggtttaatttcaccggcatacctgttcctatggccagaggcctttctgtacagattccaaatttggaggccaataactgctacattctactttcccgtgggacctggcaccggcttcctttacttggtcaacctgtatttcctctaccagtactctacgaggctggagacaggggcatttgatggtcgacccgctgattatctcttcatgttattgttcaattggatatgcatagttatcactggcctcgccatggatatgcaattgctgatgatccccctgatcatgtctgtgttgtacgtgtgggcgcaattgaacagggacatgatcgtctccttttggttcggaacccgcttcaaagcctgttatctgccatgggtgatcctcggatttaactatatcattggaggaagctatcccatggatctcgggggcagaaacttcctctcaacccctcagttcctgtatcggtggctcccctctagacgcgggggggtttccggttttggagttccaccagcgtccatgcggcgggcagcagatcaaaatggaggtgggggccgccataactgggggcagggcttccgtctcggggaccagtag

SEQ ID NO: 25835 - DNA, 456 bp, Artificial Sequence
  Description of Artificial Sequence: Synthetic coding sequence
atgagcgacatcggagactggttccggtccatcccagctattacgcggtattggttcgcagctactgtcgcagtgccactggtagggaagctgggcctcatctctcctgcataccttttcctctggcccgaagcattcctctatcgcttccaggcatgttatttgccttgggttattctgggctttaattatattatcggtgggtctgtcatcaacgagttgattggcaatttagtgggtcacctgtatttcttcctgatgtttcggtacccaatggaccttggcggtcgcaacttcctcagtacgcctcagttcttgtacagatggcttccaagccgccgcggaggagtcagtggattcggggtgccacccgcgtccatgagacgcgccgcagatcagaatggggggggaggccggcataactggggtcagggcttcaggttgggggaccagtag

SEQ ID NO: 25836 - DNA, 720 bp, Artificial Sequence
  Description of Artificial Sequence: Synthetic coding sequence
atggcttatcagagtctgcgactggagtacctgcaaattccccctgtgtcacgcgcgtataccaccgcctgcgtcctaactaccgctgccgtgcagctggagctcattactccttttcaactgtactttaaccctgagcttatcttcaaacattttcagatatggcggctcattaccaacttcctattctttgggcccgtggggtttaactttctgtttaatatgatttttttgtaccggtactgtcgaatgctggaagaaggatccttccggggtaggacggccgactttgtgttcatgttcctgttcggggggttcctcatgacccttttcgggctgtttgtcagcctcgttttcctgggccaggcatttacaataatgctagtctacgtatggtcgcgtagaaatccttatgtgagaatgaatttcttcggcctccttaacttccaagctccttttctcccatgggtgctcatggggttctcactgctcttgggcaattctatcatcgtggatctgctcgggatagccgtgggacatatttacttctttctggaggacgtattccccaaccaaccgggaggcatcaggatcctaaagacgcccagcatccttaaggccatttttgataccccggatgaggaccccaattataaccccctgcctgaagagagacctggcggtttcgcatggggagaaggccaaaggttaggcgggtag

SEQ ID NO: 25837 - DNA, 708 bp, Artificial Sequence
  Description of Artificial Sequence: Synthetic coding sequence
atggcgtggcaggggcttgccgccgaattccttcaggttcctgcagtgactagggcatacactgccgcgtgcgttctgaccacagccgccgtacagttggagctgctgtcccctttccagttatattttaacccccaccttgtattcaggaagttccaggtctggagacttgtgaccaatttcttatttttcggccccctggggttcagtttctttttcaacatgctgttcgtcttcaggtattgcagaatgttggaggaggggagcttcagaggacgtactgctgattttgtatttatgtttcttttcggcggggtcctcatgacacttctcggcctactgggatccctgttcttcctcggacaggccctcatggctatgcttgtgtacgtctggtccaggcgatcacctagggtacgtgttaacttcttcgggctgttgactttccaggcccccttcctcccgtgggccctgatgggattctccctgctgctgggcaactccatactggttgatttgctcggaatcgccgttgggcatatatactatttcctggaagacgtctttccaaatcaaccggggggaaaacgactgctgcaaacccccggattcctcaaactgctgctggatgccccagccgaggatccaaattatctgcccctgcccgaagagcagcccggtccacatctgccacccccacaacaatag

SEQ ID NO: 25838 - DNA, 618 bp, Artificial Sequence
  Description of Artificial Sequence: Synthetic coding sequence
atggcatggcaaggactggctgcggagtttttacaagtacctgcggtaacgcgcgcatatactgctgcgtgcgtcctcacgaccgccgctgtccagctggaactgctgtcacctttccagctctacttcaacccccatctggtgttccggaagttccaagtttggcggctcgtaaccaacttcttattcttcgggccacttggcttctctttctttttcaacatgctgtttgtgtttaggtattgcagaatgctcgaagagggctctttccggggacgcaccgctgactttgtttttatgttcttatttggaggtgtgttgatgactttactcggcctactaggtagtctgttcttcctcggacaagccctcatggctatgcttgtgtacgtttggtcgagacgatctccaagggtgcgggtgaacttctttgggctactgacctttcaggcaccttttctgccatgggctcttatgggcttctcgctcctactcgggaactccatccttgtggatctccttgggattgcggtggggcacatctactatttcctcgaagatgttttccccaatcagccgggtggcaagcggcttttacagacacctggttttctctag

SEQ ID NO: 25839 - DNA, 720 bp, Artificial Sequence
  Description of Artificial Sequence: Synthetic coding sequence
atggcctggcagggcctggcggctgagttcctacaggttccagcagtcacacgtgcgtataccgcagcctgcgtcctgactacagccgccgtgcaactcgagcttttgtcaccttttcagctctattttaatccccacctggtttttaggaagttccaggtatggcgcctggtcacaaactttttgtttttcgggcctcttggattcagcttctttttcaatatgctttttgtatttagatactgccgcatgctggaagagggatcatttcgggggaggacagccgatttcgtgtttatgttcctattcggaggggttcttatgacactgctgggcctgctcggatcattattttttctgggccaagccctgatggcaatgctcgtttacgtttggtctagacgctctcccagggttagagtaaatttctttggcctccttaccttccaagctcccttcctcccctgggccctaatgggattttcattgctgctgggtaattcaatcttggttgacttgctgggaatcgccgtgggtcatatctactactttctggaggacgtgttcccgaaccagcccggcggaaagagactgctgcagacgcctggattcttgggtttgcagagcagcaaagcaccagctggtagttccttgacaatctggacccagcaaagccagggagggcctggcacagcgggtgagctggctgcgccctcttag

SEQ ID NO: 25840 - DNA, 2838 bp, Artificial Sequence
  Description of Artificial Sequence: Synthetic coding sequence
atggctgagggtcaaggtggtggaggtcagcggtgggattgggcaggggggggcagggcagccgaggaggaagtcgtcaggcggcggtgccgcagaggcgaagaagctcaggtggctcagccatggcctgaaggatcgagaggcaccgcggctggccccccggtggaggaacgcttccgtcagttacatttacgaaagcaggtgagctacagaaaagccattacaaagagcggacttcagcacttggctcccccgccacctacgccaggtgctccctgcagtgaatcagaaagacagatccggtctaccgtggattggtccgaatcagctacatacggcgaacacatatggttcgagaccaacgtctctggagacttctgctacgttggcgaacagtactgtgttgcccggatgctcaagtccgtcagcaggaggaaatgcgcagcttgcaagatagttgtccacacaccctgtatagaacagctcgaaaagattaacttcagatgtaagccctcgttccgagagtcggggagtagaaacgtcagagagcctactttcgtgcggcaccactgggtgcataggaggagacaagatggcaaatgcagacattgtgggaagggctttcagcagaagtttacattccactccaaagaaatcgttgccatttcatgttcctggtgcaagcaggcctaccactcgaaggtgtcctgtttcatgttgcagcagatcgaggagccttgcagcttaggagtgcatgctgccgttgtaatccctcccacctggatcctccgagcaaggagaccccagaacacgttgaaggcaagcaagaagaaaaaaagagcttcatttaagagaaaatcaagcaagaaaggccccgaagaaggaaggtggcggccctttatcataaggcccactcctagtcctctcatgaagcctttactggtcttcgtcaacccaaagtcgggaggaaatcagggtgctaagataatccaatcttttctttggtatctgaatccccggcaggtgtttgatctttcacagggcggtcctaaggaagccctggagatgtacagaaaggtccataacctcaggatcctagcgtgtggaggtgacgggaccgtgggctggatcctgtcgacgctggatcaactgagactcaaaccacccccaccggtggccatcctcccactcggaaccggtaacgatctcgcaagaactctcaactggggcggaggatacacggacgagcctgtgtcaaagattctttcccacgtagaggagggtaacgtggtgcagctcgaccgctgggacttgcacgccgaacccaaccctgaggctggtcctgaggacagggatgagggtgccacagatcggctgcctctggacgttttcaacaactacttcagtttgggttttgatgcgcatgtgacattggagtttcacgaatctcgggaagccaaccctgaaaagtttaactctagatttagaaacaagatgttttacgcggggactgcgttttcagactttctcatgggctcatccaaggacctggcaaagcacataagggttgtgtgcgacggcatggatctcacacccaagattcaggatcttaaaccccagtgtgtcgtgtttcttaacatccccaggtattgcgcggggaccatgccatgggggcatcccggcgaacatcacgatttcgaaccccagcgacacgacgacgggtatctggaagtgatcgggttcacgatgacctcacttgccgccctgcaagtcggaggacacggggagaggctcactcagtgtcgtgaagtggttcttaccacctcaaaggccatccccgtgcaggtagacggcgaaccctgcaagcttgcagcgagccgaatcagaattgcactacgcaaccaggctacgatggtgcaaaaggccaagcgccgaagcgcagcgccccttcattccgatcagcaaccagtacccgaacagctccggatccaggtgtcccgggtctccatgcacgactatgaggcgctgcactacgacaaggagcaacttaaagaagccagcgttccgctcggaactgtcgtagttcctggtgacagtgacctggagctttgccgggcgcacatagagcggctgcagcaggaaccagatggcgctggagcaaagagcccaacatgccagaagctgagcccaaagtggtgtttcctagatgctaccaccgcaagccgcttttaccggatcgacagagcacaggaacacctcaactatgttacagaaatcgcccaagacgagatttatattctcgatcctgagctgctgggggcctcggctcgccccgatctccctacacccaccagtcctctacccacaagtccatgcagccccaccccgcggtcactccagggggatgcggctccccctcaaggcgaagagctcatcgaggctgccaaacgaaacgacttctgtaaacttcaggagctgcacagggccggaggcgacctaatgcatagggacgaacaatcaagaaccttgctgcaccacgccgtcagcacaggttccaaagacgtcgtgcgttacttgcttgatcacgccccccccgagattttggatgccgtagaggaaaacggggagacatgcttgcatcaggccgcagcactggggcagcgaaccatatgtcactacattgtagaggcaggagcttcactgatgaagacagaccagcaaggggatacaccaagacagagggccgaaaaagcacaggacacagagcttgccgcttatctggaaaataggcaacactaccagatgatccaaagggaagaccaggagacagccgtctag

SEQ ID NO: 25841 - DNA, 2805 bp, Artificial Sequence
  Description of Artificial Sequence: Synthetic coding sequence
atggaaccccgcgatggttctccggaggctcgcagctcggactccgaatcagcctcagcttcctcaagcggctccgagagggatgccgggccggaacccgacaaggccccacgcagactgaataagagacgattcccagggctgcgcctttttggacacagaaaggccatcactaagtccggcttacagcacctagcacctccaccacccacacccggggcaccatgcagtgagtctgaacgacagatccggtcaacagtggactggtccgaatcggccacttatggagagcatatatggttcgagaccaatgtgtcaggggacttttgttacgttggcgaacagtactgcgttgctcggatgcttcagaaaagcgttagccggcgaaaatgcgccgcatgcaaaatcgttgtccacacaccctgcatcgagcagctggagaaaataaatttcaggtgcaagccaagctttcgcgaatctggtagccgtaatgtcagggagcccacattcgtgcggcaccattgggtccacaggcggagacaggatggaaaatgtaggcattgcgggaaagggtttcaacagaagtttactttccactcgaaagaaatagtcgccatctcgtgtagttggtgcaagcaggcctaccacagcaaagtgtcgtgtttcatgctgcagcagattgaagaaccttgttctctgggggtgcacgcggctgttgttatcccccctacctggattctccgggcgagaagacctcagaacacactgaaggccagtaaaaagaaaaaacgggcatcattcaaacggaaaagctcaaaaaaggggcctgaggagggacgctggcgaccttttataattcgaccaacaccaagcccgctgatgaaacccctcttagtgttcgtgaatccaaagtccggagggaaccagggggctaaaattatccaaagcttcctctggtatctgaacccccgacaggtgtttgatctgagccagggtggaccaaaggaagccctggagatgtacagaaaagtgcacaacctccggattctcgcatgcgggggggatggaaccgtgggttggattctgagcacgctggatcagttgagactgaagccaccccccccggtggctatcctgcccctggggaccggcaacgatctggccaggacactcaactggggcggaggttataccgacgagcctgtcagcaagatcttgtcccatgtagaggagggtaacgttgtgcagctcgatagatgggatctacatgctgaacccaaccctgaggctggtcccgaggacagagatgaaggggcgacagatcgattaccacttgatgtttttaacaactatttttctctggggtttgacgctcacgtaacactggaatttcacgaaagccgggaggctaacccagagaaattcaacagtagatttcgcaataaaatgttttacgcgggaacagcgttctcggattttcttatggggtcttccaaggatctggccaagcacatacgtgtagtctgcgatggaatggatctgacacccaagattcaggacctgaagccccagtgcgttgtgtttctcaacattccccgatattgtgctggcactatgccctggggtcaccctggggaacatcatgattttgagccccagagacatgacgatgggtaccttgaggtgatcgggtttactatgacatccttggcagctctgcaggttggaggacacggagaaaggctgacccagtgccgcgaagtcgtgctaaccacctcaaaggcgatccctgtccaagtggacggcgagccttgcaagctggcggcaagtagaatccgcatcgctttacgaaaccaggctaccatggtacagaaagcaaagcggaggtcagcagctcccctacatagcgatcagcagcccgtgcccgagcagcttaggatccaggtgtccagggtaagtatgcatgattatgaagcactacactatgacaaggaacagttgaaggaggcctccgtgcctttgggcaccgtggtggtccccggcgactcagatttggagctttgccgagctcatatcgagagactgcagcaggaaccagatggagccggcgctaaatctcccacatgtcagaaactgtcccccaagtggtgtttcctcgatgccactacagcttctcgtttttacagaattgatagggctcaggaacatttgaactacgtcacagagatcgcccaggacgaaatttatattcttgaccccgagcttctcggagcttcagccaggccagatctgcccacacccactagccccctgcccacttctccctgcagtcctaccccacgatctctgcaaggcgacgctgcccctccacaaggggaggaactcattgaggcagccaaacgcaacgatttttgtaaactgcaggaactccacagagccggcggggatcttatgcatagagatgagcagtccaggaccctgctccaccacgctgtgtccactgggtctaaggatgtggtgcggtatcttttggatcatgcaccccccgaaatcctggatgccgtggaagagaatccctgtagtccctcaggagaaacgtgccttcatcaggccgctgctttgggccagcgcacaatctgccactacattgtcgaggcaggagcatccctcatgaaaactgaccagcagggcgacaccccgcgccaacgggcagaaaaggcccaggacactgagctcgctgcctatctggagaaccggcagcattaccagatgatccagagagaggaccaggaaaccgccgtgtag

SEQ ID NO: 25842 - DNA, 3495 bp, Artificial Sequence
  Description of Artificial Sequence: Synthetic coding sequence
atggcaggcgctggcggacagcaccaccccccgggtgcagcgggaggcgccgccgcaggagcaggagccgccgtgacctcagccgcagcttccgcaggacccggcgaagattcttctgactcagaggcagagcaggaaggacctcagaagttgatcagaaaagtctccacatccgggcagatcagaaccaagaccagtatcaaggaagggcagctgttgaagcagacaagttctttccaacgctggaagaaacggtactttaaactcaggggaagaactttgtactacgccaaagattccaagtcgctcatctttgacgaggtggatctgagcgatgcaagcgtcgcggaggcctcaacaaaaaatgccaataattcttttactattattactccctttaggaggctgatgttatgcgcggagaaccgcaaggaaatggaggattggatatcttcactcaagtctgtgcaaactagggaaccatacgaggtggcccagtttaatgtggagcattttagcggaatgcacaactggtatgcctgtagtcatgctcggccaacattctgcaatgtgtgtagagaaagccttagtggagtgacatctcacggcctgagttgtgaagtgtgcaagttcaaagcccacaagcgatgtgctgtgcgtgccaccaacaactgcaagtggaccacactcgccagcattggaaaggacattatagaggacgaagacggcgtcgcgatgccccaccaatggcttgagggcaatttgcccgttagcgccaagtgtgccgtctgcgacaaaacatgtggctcggtactccggctccaggattggaaatgtctgtggtgtaaaaccatggtgcacacagcctgcaaggatttgtatcaccccatctgtcctctggggcagtgtaaagtcagcatcattcccccaatagccttaaattcgactgatagcgacggattctgcagggcaaccttttcattttgtgtgagcccactcctggtgttcgtgaactccaagtctggtgataaccagggggtcaaattcctcagaaggttcaaacaactcctgaatccggcacaggtttttgatctgatgaatgggggccctcatttgggcctgcggctcttccagaagtttgataacttccggatcttagtctgcggaggggatggaagtgtcggttgggtgctctcggagattgacaagctcaacttgaacaaacagtgccagctcggcgtcctgccattaggaactggcaatgatctggccagggttctgggttgggggggaagttacgacgatgacacgcagcttccccaaatccttgaaaagttggagagggcttccacaaaaatgctggaccgatggtcgatcatgacatatgagctgaaacttcctcccaaggctagtctgttacctggaccccccgaagcctcagaagaattttacatgacgatatacgaggactccgttgctactcatcttaccaaaatactgaatagcgacgaacacgcagtggtgatatcgagtgcaaagaccctgtgtgaaaccgtgaaagatttcgtagctaaagtggagaagacctacgataaaactctcgaaaacgcagtagtcgctgacgcagttgccagcaaatgctctgtcctgaatgaaaagttggagcagcttctgcaggccctacacacagactctcaggcagcccccgtgctgcctggcttgtctcctcttatcgtggaagaggacgccgtggaaagctctagcgaagaatccttgggcgaatcaaaggaacaacttggagacgacgtgactaaacccagttcgcagaaagctgtgaagcctagggagatcatgttacgggcaaactcactgaagaaggccgttagacaagttattgaagaagcgggaaaggtgatggatgatcctaccgtccatccatgcgaacccgccaaccagtcaagtgattacgattcaaccgaaaccgatgaatccaaggaggaagcaaaggatgacggcgctaaggagtctatcacagttaaaaccgcgccaagatccccggacgcccgcgcaagctatggtcactcacaaaccgattcagtgccaggccctgcagtagccgctagcaaagagaacctgcctgtccttaacactcgaattatatgcccaggtctcagggcgggcctcgctgcttccattgcaggctcttctattattaacaaaatgctcctggctaatattgaccctttcggcgccactccattcattgacccagacctcgatagtgtggacggctactccgaaaaatgtgtgatgaacaattatttcggcataggtcttgatgccaagatctcactggaattcaataacaagcgggaggagcaccccgaaaaatgtcgaagcaggactaaaaacctgatgtggtacggagtgctcgggaccagagaattacttcagagaagctacaaaaacctggagcagcgtgtgcagctggagtgtgatggccaatacattcctctgccaagcctgcagggcatagccgtactcaatattccctcatacgctggtggcacaaatttttgggggggtactaaagaagatgatattttcgcagcaccctctttcgacgacaaaattttagaggtggttgccatcttcgattcgatgcagatggccgtttctagggtaatcaaactacagcatcaccggatagcccaatgtcgtaccgtcaaaatcacaattttcggtgacgagggcgtcccagtgcaggtggatggcgaagcctgggtgcaacctcccggtattatcaaaatcgtccacaagaaccgagctcagatgttgacccgggatcgtgctttcgagtccacgctgaaaagttgggaagataaacagaagtgcgattctgggaagcccgtgctccgcacccacctttatatccaccacgccatagatttggccactgaggaggtgtcgcagatgcagctctgttcccaggcagctgaagaacttattactagaatatgcgatgcggcgacaattcactgcttgcttgagcaagaactggcccatgcagtgaacgcttgtagtcatgcactgaataaagctaatccaaggtgccccgagtctctgactagggatactgctacagaaattgccattaacgttaaagctctttataacgaaaccgaatccctgctagtagggagagtgcccctgcaactggagtccccccatgaagaacgggtgtcgaatgctctgcactctgtagaggtggaactacagaagctcacggaaatcccctggctgtattatatcttacatcccaacgaggatgaagaacctcctatggactgtactaagaggaacaaccggagcaccgtatttaggatcgtgccgaaattcaagaaggagaaagtgcagaagcagaagaccagcagccagcctggctccggcgacactgaaagtgggtcctgcgaggccaatagcccgggcaactag

SEQ ID NO: 25843 - DNA, 3663 bp, Artificial Sequence
  Description of Artificial Sequence: Synthetic coding sequence
atggccggcgcagggggacaacaccaccctccaggcgcggccggcggggcagctgcaggggccggggccgcagtgacttccgccgcggcgtctgcagggccaggagaggactcctctgatagcgaagcagaacaggagggcccgcaaaaactgatccgaaaggtcagtacttcaggccaaattaggaccaaaacatctattaaggagggccagttattaaagcagacatcctcttttcagcgctggaaaaaacgttatttcaaacttcgtggaagaacactgtactatgccaaggactctaagagtttgattttcgacgaggttgacctcagcgacgctagtgtcgccgaagctagtacgaagaatgccaacaactccttcactatcataaccccctttcggaggttgatgctatgcgcagagaataggaaagagatggaagattggatatccagcctcaagagtgtacagactcgcgagccgtacgaagtggcacagttcaacgtggagcattttagcggaatgcataactggtacgcttgcagtcatgccagaccaactttttgcaacgtgtgcagggagagcttgtcgggcgtaactagccacgggctgagctgcgaggtgtgcaagtttaaagcccacaaacgctgcgccgtacgggccaccaataattgcaagtggacaacactcgcaagcattgggaaagacatcatcgaagacgaagacggggtagctatgccacatcagtggttagaagggaacctcccagtctccgctaagtgcgcagtctgcgacaagacatgtggcagcgtgctgagacttcaggactggaaatgcctctggtgtaaaaccatggtgcatacggcttgtaaggatctctatcaccccatttgtcctctggggcaatgcaaagtgagcatcataccacccattgccctcaatagtacagattctgacgggttctgccgggctaccttctccttctgcgtctctcccctcctggtttttgtgaattccaaatccggcgacaaccagggcgtaaaattcctcaggcgcttcaaacagctcctcaacccagcccaggtgttcgacctcatgaacggaggcccgcacttagggttgcgcctgttccagaagtttgataatttcagaatattggtctgcggaggcgacggttcagtgggatgggtcttatccgagatagacaagctaaacctcaacaagcagtgtcaattaggggttcttcctctcggaacggggaacgacctagccagggttctcggctggggggggtcctacgacgatgacacgcagttacctcaaattctggagaaacttgaaagagcaagcacgaaaatgttagacaggtggtcgatcatgacttacgagctcaagctcccgccgaaagctagcctgctgccaggtccgcccgaggcttcagaggagttttatatgaccatttatgaggactctgtggccacacatctgactaaaattctgaactctgatgagcacgccgtggtgatcagttccgctaagaccctctgtgagactgttaaagattttgtcgctaaggtcgagaagacttatgacaagacactggagaatgcagttgttgctgatgctgtggcatcaaaatgcagcgtgctgaatgagaaactggaacagttactgcaggccctgcataccgactctcaggcggcgccagtgttgccaggactgtcgcctctcattgtcgaggaagacgccgttgagtcaagctctgaggagtccctaggcgagtccaaggaacagttgggtgacgatgtgacaaagcccagcagccagaaggcggtgaaaccgcgggagatcatgttaagagccaattccttgaagaaagctgtgaggcaggtgatcgaagaagcaggcaaagtgatggacgacccaaccgttcacccatgcgaacccgccaaccaatccagcgactacgactcaactgaaactgacgagtccaaagaagaagccaaagacgatggcgctaaagaatctattaccgtcaagacagcccctaggagtcccgacgcgagagcctcgtacggacactctcagaccgactcagttccagggcctgccgtggccgcctctaaagagaacctgcctgtactcaacactcgtattatctgccccggacttcgagcagggctggcagcgtctatcgccggatcttctataatcaataagatgttactggctaacatcgacccatttggggcaaccccatttatcgaccctgatctcgattctgtggatggctactctgagaaatgcgttatgaataactacttcgggattggactggatgccaaaatttccctcgagttcaacaataagcgtgaagaacatcccgaaaagtgtcgctcccgaaccaaaaatctgatgtggtacggcgtgcttggaacacgggagttgttacaaagaagttacaaaaatctggagcaaagagtgcagcttgagtgcgatggccagtatattcctttacccagtttacaaggcatcgcagtgctgaacatcccatcatatgctggaggcactaatttctggggcgggactaaggaagatgatatctttgctgcgcctagcttcgacgacaagatcctggaagttgtggcgatcttcgatagcatgcagatggctgtgagcagggttatcaagctgcagcatcaccggatcgctcagtgccggacagtgaagatcactattttcggagatgagggggtccctgtgcaagtagacggtgaagcgtgggtccagcccccaggaatcataaagatcgttcataagaatcgtgcccagatgttaactcgtgacagagcatttgaatccacactcaagtcttgggaagataagcaaaagtgcgacagcggcaagcccgtcctcagaactcatctctatatccaccatgccatagatctcgcaaccgaagaggtttcccagatgcagctctgttcccaagctgctgaagagctcatcaccagaatctgtgatgctgccacgatccactgtctcctggagcaggagctggcacacgctgtgaatgcgtgcagtcatgccctcaacaaggctaaccctcgctgtcctgaatccctcacaagggatacagccactgagatagcaatcaatgtgaaggctctgtataacgaaaccgagtccctgcttgtgggcagagtgcccctacagctggaaagcccccacgaggaacgggtgtcgaatgccttgcatagcgtggaagtggagctacagaagcttaccgaaataccctggctgtactatattctccaccccaatgaagatgaggagccacctatggattgtaccaagcgtaacaatcggagcaccgtgttccggatagtgcctaagttcaagaaagaaaaagtgcagaagcagaaaacctcttcacagcccgtgcaaaagtgggggacggaggaggtggccgcctggttggacctgctgaaccttggcgagtacaaggatatcttcatcagacacgatatccggggcgcagaactcctgcacctggagaggagggatttgaaggatcttggcatccccaaggtggggcacgtgaagcggatcctgcaggggattaaggagctcggacggtcaactccccagtcagaagtatag

SEQ ID NO: 25844 - DNA, 3303 bp, Artificial Sequence
  Description of Artificial Sequence: Synthetic coding sequence
atgttatgtgctgagaatcgtaaggagatggaggactggatctcctcgttaaagtcagtgcagacacgcgaaccgtacgaagtggcacagttcaatgtggagcatttctcagggatgcacaattggtatgcttgttcacacgcgaggccaaccttttgcaacgtgtgtcgggaaagcttaagcggggtgacctctcacggcctttcttgcgaggtttgtaaattcaaggcgcataagaggtgcgccgtgcgtgccactaacaactgcaagtggacaacccttgcctctattggcaaggatatcatagaagacgaggatggcgtagccatgccccaccagtggctggagggaaatttaccagtgagcgcaaaatgtgcagtttgcgataaaacttgcggaagtgtgctgagactgcaggactggaaatgcttgtggtgcaaaacgatggtacataccgcttgcaaggatttgtaccatcctatctgccccctgggacaatgcaaagtcagcatcattccaccaatagctctcaatagtaccgacagcgacggcttctgcagagcaactttctccttttgcgtgtctccactgctggtcttcgtcaacagtaagtcaggggacaatcagggagtgaagtttctgaggagatttaagcagctgctgaatccagctcaggtgtttgatttaatgaatgggggcccccatttgggactgcgcctgtttcagaaattcgataattttagaatcctcgtgtgcggtggcgacggctccgtcggctgggtgctaagtgagatcgataaactgaacctgaataaacagtgtcagttgggcgtgctgcccctaggaacaggcaacgatttggctagagtcctcggatggggcggaagctacgacgacgacacccaactcccgcagatcctcgagaaacttgaacgcgccagtacaaaaatgctggatcgctggtccataatgacatacgaattgaaactgccaccaaaggcgagccttcttccggggccccctgaggcttcagaagagttctatatgactatctacgaagactctgtggctactcatctaactaagattctgaattctgacgagcatgccgttgttattagtagtgcgaaaaccctttgtgaaaccgttaaggacttcgtggcgaaggtcgagaagacgtatgacaaaaccttggaaaacgccgtggttgccgatgctgtagcgtcaaagtgctctgtgctgaatgagaaactcgaacagctgctgcaggccctgcacacagacagccaggcggccccagtactacctggcctgtctcccctgatcgtggaggaagatgctgtggaaagtagctccgaggagtctctgggcgaaagtaaagagcagcttggggacgacgtgaccaaacccagtagtcagaaagcggtgaagccaagggaaataatgcttcgcgcaaacagtttgaaaaaggccgttagacaggtgatcgaggaggcgggcaaagtcatggatgatccaaccgtgcacccctgcgagccagcgaatcagagtagtgattatgattcaaccgaaacagacgagtctaaagaggaagccaaggacgacggagctaaagaatcaataaccgttaaaaccgctcccagaagccctgatgcaagagcttcctatggtcacagccaaacagatagtgtgcccgggcccgctgtggctgcaagtaaagaaaatcttcctgtgctgaacacccgtatcatttgtccagggctgcgggccgggcttgcagcttccattgcggggtcatccatcatcaacaagatgctacttgccaacatcgatccttttggtgctactccatttattgaccccgacctcgattctgttgatggctactctgagaagtgcgtcatgaacaactatttcgggatcggcctggacgccaagatcagccttgaatttaacaataagcgggaagaacaccctgagaaatgccgatctaggaccaaaaacctgatgtggtacggggttttaggcactcgagagctgctgcaacgtagttacaaaaatctggagcagcgggtgcaactggaatgtgacgggcagtatattccactgccatcccttcaaggcattgctgtgctcaacatcccgtcttacgcagggggaacaaatttttggggagggaccaaggaagatgatatttttgctgctcctagctttgacgataagattctggaggtggtggcaatttttgactcaatgcaaatggccgtgtctcgcgtaattaagctgcagcatcatcggatcgctcagtgccggactgtaaagatcactatcttcggcgatgaaggcgtgcctgtccaggtggacggtgaagcttgggtgcagccacctggcattatcaaaattgtgcataagaatagagctcaaatgctcaccagggatagagcttttgagagtaccttaaagtcgtgggaagacaaacagaagtgtgactccggcaagcccgtactccggacgcacctgtatatccatcatgccatagatcttgccaccgaggaggtttcgcaaatgcaactgtgctctcaggccgccgaggaactgattacacggatctgtgacgcggctacaatccactgtttgctggaacaagaacttgctcacgctgtgaatgcctgcagtcatgccctgaacaaggcaaaccctcgctgtccagaatctctcacacgggacacagcaacagagattgcaatcaatgtgaaagccttgtataatgaaacagagagcctgctggtaggaagggtaccgctgcagctagagtcccctcacgaagagcgagtgagcaatgcccttcactccgtggaagtggagctccagaagttgacagaaatcccctggctttattacattttacacccaaatgaagacgaggaacccccaatggactgcactaaacggaacaatcgcagtactgtgttccggattgtcccgaagttcaaaaaagagaaagtgcagaagcaaaaaacctcttctcagccagttcagaagtggggcactgaggaggttgccgcctggcttgatctacttaacctcggcgagtataaagacatcttcattcgccacgatatcaggggcgcagaactgctccatttggagcgaagagacctaaagaacaccgtaggcgaaaaaagagacacgaaggaaaatggcaaacacatggacctcggcatccctaaagtaggccacgttaaacgaatactgcagggaatcaaggagctcggacggagcaccccacaaagcgaagtatag

SEQ ID NO: 25845 - DNA, 3255 bp, Artificial Sequence
  Description of Artificial Sequence: Synthetic coding sequence
atgctgtgcgccgaaaatagaaaggaaatggaagactggataagctcgctaaaaagcgttcaaacccgcgagccgtacgaggtggcgcagttcaacgtggaacacttttcaggcatgcataactggtatgcctgtagccacgccagaccaaccttttgtaacgtgtgcagagagagcctgtcaggagtcacctctcacggactgagctgtgaagtgtgcaaattcaaggcccacaagcgttgtgccgtgagggccaccaacaattgtaagtggactaccctagccagcatcggtaaagacataatagaagacgaagatggcgtcgcgatgccgcaccagtggttggaaggcaacctcccggtgtccgcaaaatgcgctgtttgcgataaaacctgcggctcggttctgagactccaggattggaagtgcttatggtgtaagaccatggtgcacaccgcctgcaaagatctctatcaccccatttgtccactgggacaatgcaaagtgtccatcattcccccaattgccctgaactcaacagactctgatggcttctgtcgtgccaccttcagtttctgcgtgagccctctgctcgtgttcgtcaatagtaaatccggcgacaaccagggggtaaaatttcttcgccgtttcaagcagcttttaaaccctgcccaggtgtttgatctgatgaatggaggaccacacctcgggctgagactatttcagaagttcgataattttcggattctggtctgtggtggagatgggtccgtgggatgggtcttgagcgaaatcgacaagctaaatctgaacaaacagtgtcagctaggcgttctgcccctggggacagggaacgacctggcaagggtccttggttggggcggatcttacgatgatgatacacagctgccccaaatactcgaaaaactcgagcgcgccagtaccaagatgttagatcggtggagcattatgacatacgagctgaaactgcctccaaaggcttcgcttctgccaggcccacccgaggctagtgaagagttttatatgactatctatgaagactccgtggcgacccatctgacaaaaattctgaattcagatgaacatgccgtggtgatttccagcgcgaaaaccctgtgcgaaacagtaaaggacttcgtagccaaagtcgaaaaaacatatgataagactttagagaacgctgttgtggccgacgcagtcgcaagcaagtgtagcgtgctgaatgagaagttggagcagttgctgcaggccttacacacagactctcaggccgcgcctgtgctccccgggctcagtccacttatagttgaagaggatgccgttgagagctcaagcgaggagagtctgggggaatccaaagagcagttgggtgacgacgttaccaagccatctagtcagaaggcggttaagccacgcgaaatcatgttgcgcgcaaatagcctcaaaaaggccgtgcggcaggtaatagaggaggcggggaaggtgatggacgatcccacagtgcatccctgtgaaccggccaaccagagcagcgattatgattcgaccgaaacagatgaatccaaagaggaggcgaaggatgacggcgcaaaagaaagtataaccgtgaaaaccgccccaagatcacccgacgccagagcatcttatgggcactcccagacggacagcgttcccggccctgccgttgccgcatcaaaagaaaatttgcccgttctgaatacaagaatcatctgcccagggcttagagccggcctggcagcttctattgccgggtctagtatcataaacaagatgctcctggctaacatcgatcccttcggggctactcctttcatagatcctgacttagactctgtggacggatattccgagaagtgtgtgatgaataactattttggaatcgggttggatgcgaagatctcgcttgagttcaacaacaagcgcgaagagcacccagagaagtgtcgatcacgcaccaaaaatcttatgtggtacggcgtcctcggcacacgcgagcttctccaaagatcgtataaaaatttggaacagcgcgtccagctcgagtgtgacggccagtacattcctttacctagcctgcaaggaatcgccgtgctgaacataccaagttatgcgggaggcactaacttctggggcggcactaaggaggacgacatatttgccgctcccagttttgacgacaagatccttgaggttgtggctatctttgactcaatgcaaatggcagtgtcccgtgtgatcaagctgcagcaccaccggatcgcacagtgcaggacggtcaaaataacaattttcggagacgagggcgtcccagtccaggtcgacggcgaagcttgggtgcagcctccaggtattatcaagatcgtccacaagaatagagcacagatgctgacccgggaccgcgcgtttgaaagtacacttaagtcatgggaggacaagcagaaatgcgattcgggcaaaccggttctccgaacacacctttacatacaccatgcaatcgatctggccacagaggaagtgagccagatgcagttgtgctctcaggccgctgaggagctcattacaagaatttgcgatgctgccacaattcattgcttgctcgagcaagaactcgctcatgctgtgaacgcatgttcccatgctttgaataaggctaatcccagatgccccgaatctctgaccagagataccgccacggagatagctattaatgtaaaggcactttataacgagaccgagtcattgctggtcggtagggtgcctcttcaattggagtctccacatgaagaaagagtgagcaacgcattgcactcagttgaggtcgaattacagaagctgaccgaaatcccgtggttgtattatattctgcatcctaatgaggatgaggagcctccaatggactgcactaaaaggaacaacagatccaccgtgttcagaatcgtgccaaaatttaagaaagagaaagttcagaagcagaagacttcatctcagcccgtgcaaaaatggggcacagaggaagtcgcagcctggctcgatttgctcaacctcggggagtacaaagatattttcattagacacgacatcaggggagcggagttattacatcttgaacggcgcgacttaaaggatcttggtatcccgaaggttggccacgttaagcggatcctccagggcataaaagagctcggaagatccacaccccagtctgaagtctag

SEQ ID NO: 25846 - DNA, 2760 bp, Artificial Sequence
  Description of Artificial Sequence: Synthetic coding sequence
atgtggaacatttcgcaaggttgtacaaccggcacccccgcgccaacccctgaccctcctagcgtgacttgcgctgagcgagtcttcctggaatccccccccatggcctgtccagccaaagtacacaccgcctgcaaggacctgtaccatcctatttgcccgttggggcagtgtaaggtgtctataattcctcctattgctctcaatagcacagattcagacggcttctgcagggcaaccttttcattctgtgtcagcccactgctggtgttcgtaaacagcaagagcggagacaatcaaggcgtcaaattcctgcgaaggtttaagcaactcctaaatccagctcaggttttcgacttgatgaacggtgggcctcatctgggactacgcctctttcaaaagttcgacaacttccgcattctagtgtgtggaggcgacggcagtgttggatgggtgttgtccgagattgacaagctaaaccttaacaagcagtgtcagctgggggtgctacccctcggcacaggcaatgacctggcgagggtcttggggtggggggggagttacgacgatgacacccagctcccgcagatcctggagaaattggagagggcttccacaaagatgttggacagatggtcaattatgacctacgagctcaaacttccccccaaagcctcgctcttgccaggaccacctgaggcctctgaggagttctacatgacaatctacgaagacagcgtggcgactcacctgactaagattctcaattcggacgaacacgctgttgtgatctccagcgccaagaccctgtgcgaaaccgtgaaagattttgtggccaaagtcgaaaagacgtacgataagaccctggagaatgcagtcgtggctgacgccgtagcctccaagtgtagcgtcctcaacgagaagttggagcagctgttgcaggcattgcataccgattcccaagctgcaccagttctgccaggactgtctccgcttatagtggaagaagacgccgttgaaagttcttctgaggagagcctgggtgaaagcaaggagcagttgggagacgatgttactaaaccctctagccagaaagctgtgaaacctagggaaataatgctgagggcaaattcactaaaaaaagccgtccgacaagtaatcgaggaggcgggcaaggtaatggacgatccgactgtccatccatgtgaacccgccaatcagagctcggactacgattccacggaaactgacgaaagtaaagaagaagccaaggatgacggggcaaaggagagcattaccgttaagacggcacctcgttcccccgatgctagggcatcttatgggcattcacagacagactccgtaccgggtccagccgtggcagcctcaaaggagaatctaccagtgctcaataccaggatcatttgtccaggcttaagagccggcttagctgcttcgatagccggcagctcaattatcaacaaaatgctcctggccaatatagatcccttcggagctactccttttatcgatcccgacctcgacagtgtggatggttatagcgaaaaatgtgtgatgaacaactacttcggtattggactggatgccaaaatctccctggagtttaacaacaaacgagaagagcacccggagaaatgcagaagccgtactaaaaatctgatgtggtacggggtgctgggaacccgggaactgttacagaggagctacaagaatctggaacagcgcgtgcagctagagtgtgacggccagtatattcctcttccctccctgcaagggatagcggttttaaacatcccgtcttatgccggcggtacaaacttttggggggggacaaaagaagatgacatattcgctgccccatcctttgacgacaaaatcctggaggtggtcgcaattttcgacagtatgcagatggcggtgagtcgcgtcatcaagcttcagcatcacagaatcgcacagtgtagaaccgtcaaaatcaccatctttggtgatgagggcgtgccagtacaggtggatggcgaagcttgggttcagccaccgggaataattaagatcgttcataagaaccgtgcccagatgttaactcgggacagagccttcgaaagcaccttgaaatcttgggaggacaagcagaagtgcgattctgggaagcccgtgctaagaacacacctttatattcaccacgccatcgatcttgccacggaggaggtcagccagatgcagctgtgcagccaagcagccgaggaattgattacacgtatttgtgacgccgcaacgatacactgtctgcttgaacaggaactggcacatgccgtgaacgcctgtagccatgcgctgaacaaagccaatcccagatgccccgaatcactgacgcgggacaccgctacggaaattgccatcaacgtaaaagccctgtataacgagaccgaaagcctgctagtaggccgtgttccgctacagctcgaaagcccacatgaggaaagagtatccaatgccctgcattcagtggaggttgagctgcagaaactgacagagatcccatggctctattatatactgcaccccaatgaggacgaagaacccccgatggactgtaccaagaggaacaatcggagcactgtctttcggatcgtccccaagtttaagaaagagaaggtgcagaaacagaaaactagtagccaacctggatcaggggacaccgagtctggaagttgtgaggcaaactccccagggaattag

SEQ ID NO: 25847 - DNA, 3495 bp, Artificial Sequence
  Description of Artificial Sequence: Synthetic coding sequence
atggcaggggcggggggacaacatcacccaccaggggctgcgggcggagcagcagcaggcgcaggcgccgctgttacgtcggccgctgcctccgctggacctggcgaggattcatccgacagcgaagccgagcaggaaggcccccagaagttaattaggaaggtaagcacttctggccaaattagaacaaagacaagtatcaaagagggccagcttctgaaacagaccagctctttccagcggtggaaaaaacgctattttaaattaagaggtcgcactctgtactatgccaaagatagcaagtccctgatctttgatgaagtggacctcagcgacgcctctgttgccgaagcatctaccaagaatgctaacaactcattcactattataactccattccggagactgatgctttgtgctgaaaataggaaagaaatggaggattggattagcagtctcaaatcagtgcaaacacgagaaccctacgaggtcgcccagttcaatgttgagcacttctcaggaatgcacaattggtatgcatgttcccacgccagaccgacattctgcaacgtgtgcagagagtccctgagcggagtgacaagccacggactgtcgtgcgaagtctgtaaattcaaggcccataagaggtgcgccgtgagggccaccaacaattgcaagtggactacccttgcctccattgggaaagacatcatcgaggacgaagacggggtcgcaatgccccatcaatggctcgagggcaatctcccagtgtcagccaagtgtgctgtgtgtgacaagacctgtggctccgtcctgagactccaagactggaagtgcctgtggtgtaaaacaatggtgcatactgcctgcaaagatctttaccatccaatctgcccgctcgggcagtgcaaggtctcgataatcccccccatcgcgctaaatagcactgatagcgatggtttctgcagagctacctttagcttttgcgtgagtcccctcctggtgttcgtgaacagcaagtctggtgataatcagggcgttaagtttctgaggcggtttaagcagctgctcaacccggcccaggtcttcgatctcatgaacggcggaccccatctgggtctgcgcctgttccagaagttcgataactttaggattctagtctgcggcggagacgggagcgttgggtgggttctgtccgagatcgataagcttaacctaaacaaacagtgtcagctcggcgttttgcccctcggaactggcaatgacctcgcacgggtgctcggctggggcggcagttatgacgatgacacacagctaccacagatcttggaaaaactggagagggcctcgactaaaatgctcgacagatggtctattatgacttacgagctaaagttaccccccaaagcttccctgctgccagggccacccgaagccagcgaggagttttatatgacaatctacgaggacagcgtggccacgcatctgactaagattctcaattccgatgagcatgcggtcgtgataagttcagcaaagacactgtgcgaaaccgtcaaggactttgtcgcaaaggttgaaaagacatatgataagacgctggaaaatgcagtggttgctgacgctgtggcctcaaaatgctctgtgctaaacgaaaaacttgagcagcttcttcaggcgctccatacggactcccaggccgctccagtattacctgggctgagcccacttattgttgaggaagatgctgtcgaatcctcatccgaggagagcctgggcgaaagtaaggagcagttgggcgatgacgtcacaaagccctcaagccaaaaggctgtgaaaccacgcgaaataatgctacgcgctaactctctgaagaaggccgtccgtcaggtcatcgaagaagcgggcaaggtgatggacgacccgactgtgcacccttgcgagcccgcaaaccagtctagtgattacgacagcacagaaaccgatgagtcgaaggaagaagcaaaagacgacggagctaaggaatctatcacagtaaaaaccgcccctagatccccggatgctagagcttcgtacggccactcacagacagacagcgttccaggacccgccgttgctgccagcaaagaaaacctgccggtcctgaacacaaggataatctgtcctggcctgagagccgggctcgctgccagcatagccggaagcagcattataaataaaatgcttttggctaacatagaccccttcggagccacccctttcatcgaccccgatttggattcagtggacggctacagcgaaaagtgtgtgatgaacaactactttggaatcgggctcgacgctaagatctctcttgaattcaataataaacgtgaagagcatcccgaaaaatgcagatcacgaactaagaatctcatgtggtacggagttctgggcacacgggagttgctgcagcggagttataaaaacctggaacagagggtgcagctggaatgtgacggacaatacattcctctgccatctctccagggtattgccgtgttgaacattccaagctatgcaggcggcactaatttctggggcggaacgaaggaggacgatatttttgcagctcccagctttgatgataaaatcctagaggtggtggctatttttgactccatgcagatggcagtgagcagggtgatcaaactacagcatcatcggattgcccagtgcaggacagtgaagattacgatttttggagatgaaggcgtgccagttcaggtcgatggtgaggcttgggtgcagccccccggaataattaagattgtgcataaaaatagggctcagatgctgaccagggaccgggctttcgagagtactcttaaatcatgggaagacaagcaaaagtgcgactcaggcaaacctgtgctgaggacccacctttatatccatcacgccattgatctggccactgaagaagtctctcagatgcaactatgctcgcaggccgcagaagaactgattacccggatctgtgatgccgcgaccatacactgcctccttgagcaggagctggcacatgctgtgaatgcatgctcccacgctctcaataaagccaatcctcgatgtcccgaatccctgacccgggacactgctaccgaaatcgcaatcaacgtaaaggccttatacaatgagactgagagcctgttggttggaagagtcccactgcagctcgagagtccccatgaagaaagagtatctaacgccctccacagtgttgaggtggaactccagaaactcacagaaatcccttggctttactacattttgcatcctaacgaggacgaagaaccccccatggattgcactaaacggaacaaccgtagcacggtgttccggatcgtccctaagtttaaaaaggagaaggttcaaaagcagaaaacttcctcacagcccggaagcggggacaccgagagcgggagttgtgaggccaatagccccgggaactag

SEQ ID NO: 25848 - DNA, 2721 bp, Artificial Sequence
  Description of Artificial Sequence: Synthetic coding sequence
atggaaccccgtgatggatcaccagaggcgcggtcctcagacagtgagtctgcttctgcctcaagcagcggaagcgagcgcgatgcaggtcctgagcccgacaaagccccacggcggttaaacaagcgccggtttcccggcttacgtctattcggacacaggaaagccatcacgaaaagcggcctgcagcacctcgctcctcctccacctacccctggggcaccttgttcagagagcgagcggcagatcaggtctacagtggactggagcgaatcagctacatatggggagcatatctggttcgaaactaatgtgagcggagatttttgttacgtgggcgaacagtattgcgtggcaaggatgttgcagaagtccgtatctaggcggaaatgtgctgcctgtaaaattgtggtccatactccctgcattgagcagctggagaaaattaatttccgatgtaaaccctcatttcgcgagagtggcagccgcaacgtgagggaaggatttcagcaaaaattcactttccatagtaaagaaattgtggccatttcttgtagttggtgcaagcaggcataccacagtaaggtgtcttgctttatgctacagcagatcgaagagccctgttcactgggcgtccacgcagccgtggtgatcccgcccacttggatactacgcgcacgcagacctcagaacacactgaaggccagtaagaaaaaaaagcgcgcatcctttaagcgcaagtcatccaaaaagggccctgaggaaggcagatggcgaccatttattattaggcccacccctagcccactcatgaagccgctgctcgtattcgttaatccaaagtctggtggcaaccagggggcaaagatcattcagtccttcctgtggtatctcaatccccgccaggtcttcgatctctcacagggagggccaaaagaagcactggagatgtacagaaaggtccataacctgcggattttggcatgtggcggagacggcaccgttggttggatcctgtctacactggatcaattacgcctcaagccacccccgcctgtcgctatcttacccctcggaacaggcaatgacttggccagaaccctgaactggggaggagggtataccgacgagcctgtgtcgaagatcctttcgcatgtggaagagggaaacgtggtgcagctggatcgctgggatctccacgccgagcccaaccctgaagccggccctgaggaccgggacgaaggggcaacagaccgacttccactggacgtattcaacaattacttttctctgggtttcgacgcccacgtgactttagagttccatgaatcaagggaagctaatcctgaaaagttcaactcacggttcagaaacaagatgttttatgcagggaccgcctttagtgacttccttatggggtcctccaaggacttggccaagcatattcgggttgtgtgtgatggaatggacctgactccaaagattcaggacctcaaacctcaatgcgtcgtgttcttgaatattccacgctactgtgctgggacaatgccctgggggcaccctggcgaacaccacgatttcgagccgcaaagacatgacgacgggtaccttgaggtcattggattcactatgacaagtctagctgccctgcaagtcggtgggcatggggaacgactgacacaatgcagagaagttgtgctaactacctcgaaagccatccctgtgcaagtggatggagaaccatgcaagctggccgcttctcggattcgaatcgccttgcgaaaccaggccaccatggtgcaaaaagccaagcgaagaagtgccgctcccttgcacagcgaccagcagcctgtgccagagcagctgcgaatccaggtgtcaagagtttcgatgcatgattacgaggccctgcattatgataaggagcagctgaaagaggcatctgttccactgggtactgtggtagttccaggagactccgacttagagctctgccgggctcacatagaacggctccagcaggaacctgatggcgcaggggcaaaatcccctacttgccaaaagttatcccctaagtggtgctttctagacgcaactacggcctctagattttataggattgatagggctcaggaacacctcaattatgtcacggaaattgcacaggatgaaatctacattctggacccagaacttttgggagcttcagccagacccgatctgcccacaccgacctccccgctccccaccagcccctgctcacccacccctaggtctcttcaaggcgatgctgcccctccccaaggcgaagagctaatagaagccgccaagaggaacgacttttgcaagcttcaggagctgcatagagccgggggcgatctgatgcacagggatgaacagagcaggaccctattacaccacgcagtgtccacagggtcaaaagatgtggtcagatatctgctggaccacgcaccgccagagattctggatgctgtggaggagaatggtgagacatgcttacatcaggctgcagccttagggcagaggactatttgtcactatattgttgaggcaggcgcttctctcatgaagacagaccagcagggcgacactcctagacaacgggctgagaaggcgcaggatactgagctggccgcgtacctggaaaatcgacaacactatcagatgatccaaagggaagatcaggagactgctgtgtag

SEQ ID NO: 25849 - DNA, 2688 bp, Artificial Sequence
  Description of Artificial Sequence: Synthetic coding sequence
atgtggaggtaccggtcatgggacgtcccccagatcccttcggaggcccctcaaacgcaaaaagccattactaaaagcgggctccagcatcttgcgcctcctccaccaacaccaggagccccatgctccgaaagtgaaagacagatcagatcaacggtcgactggtcagagagcgctacgtacggggagcacatttggttcgagacaaacgtgtcaggcgatttctgttatgtgggggaacagtactgtgttgcccgaatgttacaaaagagtgtcagcaggcgcaaatgcgcagcttgtaagatcgtggtgcacactccttgcatcgagcagttggagaagataaactttcggtgtaagcctagtttcagagagtccgggtcccgcaacgttagagaacctacatttgtgagacaccactgggttcacagacggcgtcaggatgggaaatgtcgccactgcggtaagggatttcaacagaaattcacttttcactcaaaggaaatcgtggctatatcttgcagttggtgcaagcaggcatatcactcaaaggtcagctgtttcatgcttcagcagatcgaggagccctgcagccttggagtgcatgcagctgtcgtaatccctccaacatggattctgagggctagaagaccccagaacacactgaaagcgtccaaaaaaaaaaaaagggccagtttcaagcgcaagagtagcaagaagggaccggaggaaggtcggtggcgaccatttattatccgacctacaccttcacctctcatgaagcccctgctggtgttcgtgaacccgaagtcggggggcaatcaaggcgccaaaataattcagagttttctgtggtaccttaacccacgtcaagttttcgacttgtcgcagggaggacccaaagaagcccttgaaatgtaccgaaaagtccataacttgcgcatcctcgcttgtggaggcgacgggacagtgggttggatcctgtcaaccctggaccagcttaggttaaagcctccacctcccgtggcaatcttacccttagggaccgggaacgatctggcaagaaccctcaactggggaggtggatatacagacgagcccgtctccaaaatcctttctcacgtggaggagggaaacgtagtgcagttggatcgctgggacttgcacgcagaaccgaatcctgaagctgggccggaggatcgggacgaaggagccaccgaccggttacctttagatgtttttaacaactatttctcgctcggttttgacgcccacgtgacactggaatttcatgaaagtagagaagccaacccagagaaatttaatagccgtttcagaaacaaaatgttttacgcgggtaccgctttttccgacttcctgatgggatcatctaaagatctggccaaacacattcgagtagtgtgcgacggtatggatctaaccccaaagatacaagatctaaaaccccagtgtgtggtgttcttaaatataccccgctactgtgctggtacaatgccatgggggcacccaggcgaacaccacgactttgagccccagcggcacgatgacggctatcttgaggtgatcggtttcaccatgactagtctggccgccctgcaggtggggggacacggcgagcggcttacgcaatgcagagaggtcgtgctgaccaccagcaaggccatccccgtgcaggttgacggggaaccatgcaaactcgccgccagtcgcatcaggatagctctgcgcaaccaagctacaatggtgcagaaggcaaaaaggaggagtgccgctccattacatagtgatcagcagcccgtgccagaacagctgcgcatacaggtttcccgcgtttctatgcacgactacgaggccctgcattacgacaaagagcagctcaaggaggcatctgttccccttggcaccgtggtggtcccaggggactcggacctggaactgtgtagagcgcatattgagcggctgcagcaagagcctgatggagcaggcgctaagtctcctacttgccagaagctctctccaaagtggtgttttctggatgcaactactgcatctaggttctatcggatagaccgagcacaggagcatttgaactacgtcacagaaatcgcgcaagacgagatttacatcctggacccggaactgctcggcgcctctgcaaggccggacctgcctacccccacctctcccctgccaacctcaccgtgctcccccactccacggagcctccaaggagacgccgctccaccacagggcgaagagctgattgaggcagccaagaggaatgatttctgtaagctgcaagaactgcatcgggctggtggcgacctaatgcatcgggatgaacagtcccgaacgctccttcatcacgccgtgtcgacgggatccaaggacgtggtcagatacttactcgaccacgctccacccgagatcttggatgctgtggaagaaaatggcgaaacgtgtctgcatcaggccgccgcactaggacagaggaccatctgccactatatcgtagaggctggcgcatctttgatgaagacggaccagcagggtgacactcccagacagcgagcagagaaagcccaggatactgagctagcggcatacctagagaaccgacagcattaccagatgattcagcgggaggaccaagaaacagctgtctag

SEQ ID NO: 25850 - DNA, 2790 bp, Artificial Sequence
  Description of Artificial Sequence: Synthetic coding sequence
atggagccaagagatgggtctcccgaggccagaagcagtgattctgagtctgctagcgcaagtagttctggcagcgagcgggacgcagggcccgagccagataaagctcctcggcgactaaacaaacggcgctttcccgggttaaggctctttggccaccgcaaggccattacaaaatccggccttcagcacctggctccacccccccctacccccggagctccttgctccgagagcgaaagacaaatcagatctactgtagattggtccgagtccgcgacatacggagaacacatctggttcgaaacaaacgtaagcggggatttctgttacgttggagagcagtattgcgtcgcccggatgctccaaaaatccgtgtcccgacgaaagtgcgccgcttgcaagatagtcgtccatactccatgcattgagcagttggagaagataaattttcggtgcaagccgtcttttagagagagcggcagccgtaacgtccgcgaacccacattcgtgcggcaccactgggttcatcgcaggcgccaagatggtaaatgtcggcattgcggcaaggggtttcagcagaaattcacattccattctaaggagatcgtggccatcagttgcagctggtgcaagcaggcatatcactcaaaggtctcatgtttcatgctccagcagattgaggagccatgctccttgggggtacatgcagcggtagtgatcccacctacctggattttacgcgccagaagacctcaaaataccttaaaagcatccaagaaaaagaagcgcgcctcatttaaacggaagagttccaagaagggacccgaggagggaagatggaggcccttcattatccggcctactcctagtcctctcatgaaaccgcttctggtcttcgttaacccaaagagtggaggcaatcagggtgccaaaataattcagtcttttctatggtacttgaacccgcgacaggtgttcgatctctcacagggcgggcccaaggaagccctcgaaatgtatcggaaagtgcacaatctgaggatactggcctgtggtggcgacggaactgtgggctggattctctcaactctggaccagctgcggctgaaacctcctcctcctgtcgcaatcttgccgctgggcacagggaatgacctggcaagaaccttgaattgggggggcggctatacggacgaaccagtttccaaaatcttgtcccatgtggaggaagggaatgtggtgcagctggatagatgggacctgcatgccgagcccaacccagaagccgggcccgaagaccgggacgagggtgctactgacagacttccactcgatgtctttaataattatttctctctgggatttgacgcccacgtgacactggaattccatgaatcccgagaggcgaacccagagaagtttaatagtaggtttagaaacaagatgttctatgctggaactgcattctcagattttctcatggggtcatccaaggacctggcgaagcatattcgcgtagtgtgcgacggcatggatctgacgcccaaaatccaggacctgaaaccacaatgtgtggtgtttctaaatattcccagatactgcgccggcaccatgccctggggccaccccggggagcatcatgacttcgagcctcagcgccatgacgacggctatctggaggtgatcggttttaccatgacttcgcttgcagccctccaggtcggcggtcacggcgaaagactgacacagtgccgggaagtggttttaacaacatccaaggctatcccggtccaggtggacggggagccttgcaaacttgctgcctctcgaatccgcatcgcactccggaaccaggcgacaatggtgcagaaagctaaacgaagaagtgcagcccccctccattccgaccaacagcccgttcctgaacagttgcgaatccaggtgtccagagtcagtatgcacgactatgaagccctgcattacgacaaagaacaactgaaggaagccagtgtcccactgggaacagtggttgtgcctggcgatagcgacctggaattgtgcagagcccacatcgaaaggttgcagcaggagccagatggtgccggagcaaagagccctacttgccagaagctgagtcccaaatggtgtttcctggatgctacaaccgcttctaggttctaccgaatcgatagggctcaggagcaccttaattatgtaaccgagatcgcacaggacgaaatctatattctggaccccgagcttctcggtgcttctgcacggcctgatctgccgacaccaacctcgcctctacctacatctccctgttcccctacacctagaagcttacagggtgatgctgctcctccacaaggggaggagctcatcgaggccgctaagaggaacgatttttgtaaacttcaagaactacatagggcaggcggcgatctcatgcaccgcgatgagcagtcacgtacattattacatcatgcagtcagtacagggagcaaggatgtggtgcgctacttactggaccacgcaccgccagaaatactcgatgccgtggaggagaacggcgagacttgcctgcaccaggctgcagcgcttggacagagaacaatttgtcattacatcgtcgaggctggggccagtcttatgaagactgatcagcaaggagatacgccgagacagcgagccgaaaaggcccaagatactgaactcgctgcttatctagagaacagacaacattaccagatgatccagcgcgaagatcaggaaaccgccgtttag

SEQ ID NO: 25851 - DNA, 3354 bp, Artificial Sequence
  Description of Artificial Sequence: Synthetic coding sequence
atggaaactttctttcggcgccattttcggggaaaggtgccaggaccaggggaagggcaacagcgacccagcagcgtggggctaccaactggcaaggcccggaggagatctcccgcagggcaggccagtagttccttggcacagcggcgcaggagttccgcccaactgcagggttgcctcctctcgtgcggggtacgggcccagggctcctctcggcgccgctcatcaactgtccctcctagctgcaatccacgcttcatagtggataaggttctaacacctcagcctacaaccgtgggggctcagctgttgggggctcctttgttgctcactggcctggtgggcatgaacgaagaagagggcgtgcaagaggacgttgtcgcggaggccagtagtgctattcagcccggcacgaaaaccccaggcccccctcccccccgcggtgcccagccccttctgccattacctagatacctcaggcgggctagtagtcacctgctccctgcggacgcagtctacgatcacgccctatggggcctgcacggatattatcgaaggctgtctcaaagacgaccttctggacagcacccaggccccggggggagaagagccagcggtaccactgcgggcacaatgttgcccactagagtgcgccccctaagtagacggcgacaagttgccctacgaaggaaagcagccggacctcaggcctggtctgctctcctggccaaagccataaccaaaagcgggcttcagcatttagcacctccgcctcccacacccggcgccccatgtagcgagtcggaacgacaaatccgctccacagtggattggtcagagagtgccacatacggagagcacatctggttcgaaacaaacgtatccggagacttttgctacgtcggcgagcagtattgtgtggcccgcatgcttaagtccgtgagcagacggaaatgcgctgcttgcaaaatcgttgttcatactccttgtatagaacagctggaaaaaatcaactttcgttgcaagccttccttccgtgagagcggtagccgcaacgtccgagagcctactttcgtgcggcatcattgggtgcatcgccgccgccaggacgggaaatgccggcattgtggaaaaggttttcaacagaaattcactttccattcaaaagaaattgtggccatctcgtgttcatggtgcaagcaggcctaccactctaaggtctcttgtttcatgctgcaacagattgaggagccctgctctttaggagttcacgccgctgtcgttatccctccaacttggatcctcagggcccggcgcccccaaaacaccctcaaggcatccaagaaaaagaagagagctagtttcaaaaggaagagctcaaagaaggggccagaagagggccgctggcgcccatttatcatccgaccgactccgtctccactcatgaagccactcctcgtattcgttaatcccaaatcaggtggcaatcaaggagcaaagataatccagtctttcctctggtacctgaatccacgacaggtctttgatctgtcccagggcggcccaaaagaggcactggagatgtacaggaaagtccacaatctgagaattctcgcttgcgggggggacggtaccgtaggctggattctctccaccttggaccaacttagactgaagccccctccccctgtggccatcctgccactggggacaggcaacgatctcgcaaggaccctcaactggggaggggggtatacagacgagcccgtttcaaagatcctttcccacgtggaggagggcaatgtcgtgcaactggaccgatgggatttgcacgctgaaccgaatcccgaggcgggaccagaagaccgtgacgagggcgccactgaccgcctaccactcgacgtgtttaacaactatttctccctcgggtttgacgcacacgtgacccttgagttccacgaatcacgcgaagctaacccggaaaagttcaactctcgtttccggaacaagatgttttacgctggaacagccttttccgacttcctgatgggttcttctaaggatttagccaagcacatccgggtggtttgcgatggaatggacctcaccccaaagatacaagacttgaagccacaatgcgtggtgtttttaaacattcctcgctattgtgctgggacaatgccctggggtcatcccggtgaacatcacgacttcgaaccacagcgtcatgatgatggctacttggaagtgatcgggtttacaatgacttccctcgccgcgctgcaggtgggtggccacggcgagagactgacacagtgcagggaggtggtgctaaccacctctaaggctatcccagtgcaggtagacggcgaaccctgtaagcttgccgcctcccggatacgaatagccctgaggaatcaggccaccatggtgcagaaggctaagcggcgtagcgccgcacccctgcattccgatcagcagcctgtccccgagcagctccgcatccaagtgtcacgggtgagcatgcatgattacgaagccctgcactacgacaaggagcagctgaaggaggccagcgtgcctctgggaacagtggtggttcccggggactcggatcttgaactgtgccgcgcccatatcgaacgactgcagcaggaacccgatggagccggtgctaagtcacccacctgtcaaaagctgtctccgaagtggtgcttcctggatgctacaaccgcttcccgattttatagaatcgaccgcgcgcaggaacatctgaattacgtgaccgaaatagcacaggacgagatatacatactggatccagaactactgggggcatccgcgcgccccgatctgccgacaccaaccagtccacttccgacttctccttgtagcccaacccctcgttctcttcagggagatgccgctccgccacagggcgaagagctgatcgaggcagcaaagagaaatgacttttgcaaacttcaggagctgcaccgggctgggggcgacctgatgcacagggacgagcagtccaggacgttgttacatcacgccgtttcaaccggatccaaagacgtcgtcagatacctgcttgaccacgccccccctgagatccttgacgcagtcgaggagaatggcgagacttgtttgcatcaggctgctgccctcggccagagaactatttgccattacatcgtggaggccggagcgagtctgatgaaaaccgaccaacaaggagatacccccaggcaacgtgctgaaaaggcacaggataccgaactggcagcatatctggagaaccgtcagcactatcaaatgatccagcgagaagatcaggaaacggccgtgtag

SEQ ID NO: 25852 - DNA, 2787 bp, Artificial Sequence
  Description of Artificial Sequence: Synthetic coding sequence
atggagccacgagatggctcgccggaagctcgatcctctgacagtgaatccgcttctgcctcctccagtggtagcgagcgtgacgcaggacctgagcccgataaggctccacgaaggcttaacaagcggcgctttcctggcctccgcctgtttggacatcgaaaagcaattaccaagagtggactgcaacacctggcacccccaccccccactcctggagcaccatgctccgaaagcgagagacaaataaggtctaccgtagactggtcggagagtgccacctacggcgagcacatctggtttgaaactaacgtttctggcgatttctgttatgtcggggagcagtattgtgtggcgaggatgctcaagtcagtctctcgacgcaaatgcgcagcatgcaagatcgttgttcacaccccttgtatagagcagctcgagaagataaactttaggtgcaaaccgtccttcagagagagtggcagtaggaatgtgagggagcccaccttcgtccggcatcactgggtccacagaagacgtcaagacggcaagtgtcgccattgtggaaaggggttccagcagaaatttaccttccatagcaaggagatcgtggccattagctgttcctggtgcaaacaagcatatcactctaaggtgtcatgcttcatgctgcaacagattgaggagccttgtagtctaggagtgcatgccgcagtggttattccaccgacctggatcctacgagcacggagaccacagaacacactcaaagcctctaaaaaaaagaagagagcatctttcaagcgcaagagctccaagaaaggaccagaggagggacgctggaggccgtttataattagaccaaccccttcacccttaatgaagcccttgctggtattcgtgaatcctaagagtggcggcaaccaaggagcaaaaataattcagagctttttgtggtatctgaaccctcggcaagtgttcgacttgtcacagggcgggccaaaagaggcactggagatgtatcgaaaggtccataacctcagaatattggcttgcggcggcgatggaaccgtggggtggatcctgagcacgctagatcagctgaggctcaagcctcccccgccagtcgctattttgccactcggtaccggcaatgacttggctcgcacacttaactgggggggcggctatacggacgagccggtgagcaaaattttgtcacatgtggaagagggtaacgtcgtccagttggaccgatgggacttgcacgcggaacctaatccagaggccggaccggaagatcgagatgagggtgccaccgatagactccccctcgatgtcttcaacaattactttagtctgggattcgacgcccacgttacactggaattccacgaatcacgcgaggccaaccccgagaaatttaactccaggtttcgcaacaaaatgttttacgcaggcactgcgttcagcgatttcctcatgggatcttcaaaggatctggcaaagcatatcagggtggtctgcgacggaatggacctgaccccaaagatccaagatctcaagccacagtgcgttgtgtttctgaatatcccccgctactgcgcaggcacaatgccatggggtcacccaggagagcaccacgacttcgagccgcaacgccatgatgacggatacctggaggtaattgggttcacaatgaccagcctggccgccctccaagtaggaggtcacggggagagacttacccagtgtcgggaggtggtcttgactacatccaaggctatccccgtgcaggtggacggggaaccatgtaagctcgctgccagtcgaattaggattgccctcaggaaccaggcgacaatggtccagaaggcaaagcgaaggtctgccgcccccctgcacagcgatcagcagcctgtgcccgagcagttaaggattcaggtgagtcgggtgtctatgcacgactatgaagccctccactatgacaaggagcagttgaaggaggccagtgttcccctcgggacagtggtcgttccaggggattctgacttggagctttgcagagcccacattgaacgcctgcagcaagagcctgatggagccggagcgaagtcaccaacatgtcagaagcttagtcctaaatggtgtttcttggatgcgaccaccgctagcagattttatcggatagatagagcacaggagcatctaaattatgttaccgagatagcccaggacgagatctatatcttggatcccgagttacttggcgcaagcgcacgccctgatctccctacgcctacaagccccctgcccacaagcccatgttctcccacgcctcgctcgctgcagggagatgccgctcctcctcaaggggaagaactgattgaggccgccaaaagaaacgacttttgtaagcttcaggagctgcaccgagcggggggggatctcatgcaccgggacgagcagtcaaggaccttgttgcaccatgccgtctctaccgggagcaaagacgttgtgcgctacctgctggaccatgccccccccgagatattggatgccgtagaggagaacggggaaacatgtctccaccaggctgccgctttagggcagagaaccatatgccactatattgtagaggctggtgcaagcctgatgaagaccgaccagcagggtgatacacctagacagagggccgagaaggcccaggacactgagctcgctgcctacctggaaaatcgacaacactatcagatgattcagagggaggaccaggaaacagctgtctag

SEQ ID NO: 25853 - DNA, 846 bp, Artificial Sequence
  Description of Artificial Sequence: Synthetic coding sequence
atggaacctagagatgggtctccggaggctcggtcatccgacagtgaatccgctagtgcctccagtagtggatccgagagagacgccggacctgaaccagataaggccccacgcaggctgaataagcgccgcttccctgggctcagactctttgggcactcgaagagtaagtcacctacttgccagaaactgtctcccaagtggtgcttcctagacgccacgacagcgagtcgtttctaccggattgatagggcccaggaacatctcaactacgtcactgagatagctcaagatgagatatatatcctcgaccctgagctgctcggcgcctcagctcgccctgacctcccgacgccgacctcaccgttgccgaccagcccttgtagcccaacgccccgctctctccagggggacgccgctccgccccagggcgaggagctcatagaagctgccaagcgaaacgatttctgcaagctacaggaactgcatcgcgccggcggggacctcatgcaccgggatgagcagtcacgcactctactccaccacgctgtgtctaccggtagtaaggacgtcgtaaggtatcttctggatcacgcacccccagaaattctagatgctgtggaggaaaatggagagacctgcctccaccaggctgccgccctgggacaacgaaccatttgccactacattgtggaggccggggcgagtcttatgaaaactgaccagcagggggatacaccgaggcagagagccgagaaggctcaggatacagagctggcagcctaccttgaaaataggcagcactaccagatgattcaaagggaagatcaagagactgctgtctag

SEQ ID NO: 25854 - DNA, 1014 bp, Artificial Sequence
  Description of Artificial Sequence: Synthetic coding sequence
atggcattcttttcccggctcaacttgcaggaggggctgcagaccttctttgttctccagtggataccagtttatatttttctcggagccatcccaatcctgctcattccatatttcctgctgttctctaaattttggccactggctgttctgagtctggcgtggctgacctatgactggaacacacactcccaggggggaagacgcagcgcctgggtgcgaaactggacattatggaagtactttcgaaactatttccctgtgaagttggtgaaaacacacgacctttcacctaaacacaattacattatcgctaaccaccctcacggtattctcagtttcggggtctttataaactttgctaccgaagctacggggatagcccgaatattcccaagcattacacctttcgtgggcactctagaaaggatcttctggatcccaattgtgcgtgaatatgtgatgagtatgggtgtttgcccggtgtcctcctccgccctcaagtacctactgacacagaaagggtcgggaaacgccgttgtaatcgtcgtaggtggggcagctgaggccctgctgtgcaggcccggagcctcaactctcttcctaaaacagagaaagggttttgtgaaaatggccctgcaaactggcgcctatctggtaccaagctactcctttggggagaacgaagtttttaatcaagagacgtttccagagggcacatggctgcgcctttttcagaaaacgtttcaggacactttcaagaagatcttaggactgaatttttgcacattccacggaaggggatttacaagaggctcctgggggtttctgccatttaacaggcccatcactacagttgtgggggagccactcccgatccctagaatcaagagaccgaatcagaagacagttgacaaataccacgcactttacatctcagcactgcgcaagctgttcgatcagcacaaggtggagtatggactgcctgaaacccaggaactcacaatcacctag

SEQ ID NO: 25855 - DNA, 267 bp, Artificial Sequence
  Description of Artificial Sequence: Synthetic coding sequence
atgccagcctttgcagaattcgaaaaggccgccgaggaagtgcgccacctcaaaaccaagccttcagacgaggaaatgctctttatctacgggcactataagcaggccactgtaggcgacatcaatacagagcgccccggcatgcttgactttactggcaaggccaaatgggacgcctggaacgaactgaagggcacatcaaaggaagacgctatgaaagcatacatcaataaagtcgaagagctcaaaaagaaatacggaatatag

SEQ ID NO: 25856 - DNA, 315 bp, Artificial Sequence
  Description of Artificial Sequence: Synthetic coding sequence
atgtggggagacttgtggttgcttcccccagcgtcagctaatcccggtactgggaccgaggccgagttcgagaaggcggccgaagaagtgagacaccttaaaactaagcctagtgatgaggaaatgctgttcatatacgggcactacaagcaggctacggtgggtgacatcaacaccgaacgtcccggcatgctggattttactgggaaggctaaatgggatgcgtggaacgagctgaagggcacaagcaaagaggatgctatgaaggcatacattaataaggtggaggagttgaaaaagaaatacggaatttag

SEQ ID NO: 25857 - DNA, 264 bp, Artificial Sequence
  Description of Artificial Sequence: Synthetic coding sequence
atgagtcaggctgagttcgaaaaagctgccgaggaggtgcggcacctgaagacaaaaccatcggacgaggagatgctattcatatacgggcactacaagcaggcaactgtgggcgatataaatacggagcgcccagggatgttagactttaccggaaaggccaaatgggacgcttggaatgaactcaaaggtacctctaaagaagatgcgatgaaagcgtatataaacaaggtggaagagcttaagaaaaagtacggcatctag

SEQ ID NO: 25858 - DNA, 315 bp, Artificial Sequence
  Description of Artificial Sequence: Synthetic coding sequence
atgtggggcgatctctggttattaccccctgcctctgctaaccccgggacggggaccgaagctgagtttgagaaagccgcagaagaagttcgccacctcaagacgaagcccagcgatgaggaaatgctgtttatttacggccactataaacaggcaacagtaggcgacattaacaccgagcgcccaggaatgctggattttactggcaaggccaagtgggacgcatggaatgaattgaaaggcactagcaaagaagacgcgatgaaggcatatattaacaaggtcgaggaattaaagaaaaagtatgggatttag

SEQ ID NO: 25859 - DNA, 390 bp, Artificial Sequence
  Description of Artificial Sequence: Synthetic coding sequence
atgtcccagcatcgggctgggcggagggggggggtgggcaagcgtggagtaagggggcgagagctcgggggccagggaaaatacggcgccggttgctcagagtgtggcacaagacgaattgccgcacgcggggaggcggagtttgaaaaggccgccgaagaggtgcggcacctcaaaaccaaaccctctgacgaagagatgctcttcatttacgggcactataagcaggctacagtgggtgacatcaacacggaacgtcccggcatgttagacttcaccgggaaagccaaatgggacgcttggaatgagctgaaagggacgagcaaggaggacgcaatgaaagcttacatcaacaaagtcgaggagttgaagaagaaatatgggatttag

SEQ ID NO: 25860 - DNA, 315 bp, Artificial Sequence
  Description of Artificial Sequence: Synthetic coding sequence
atgtggggcgacttgtggttgcttccgcctgccagcgccaatcctggcactggaacagaggcagaatttgagaaagctgctgaggaggtaagacacttgaagactaagccttccgacgaagagatgctgttcatatatggccactacaaacaagccaccgtcggcgatatcaacacagaacgcccgggcatgctggattttaccggcaaggctaagtgggatgcatggaatgagctcaaggggacttccaaggaggatgccatgaaggcatatattaataaggtggaggagcttaaaaagaaatatggaatatag

SEQ ID NO: 25861 - DNA, 447 bp, Artificial Sequence
  Description of Artificial Sequence: Synthetic coding sequence
atggagagatggggcaagggactgcacggcctcgaagagcgtggagatagtgtacctattccaaaacatcgcgcaggcaggagaggcggcgtcggcaagcggggagtgagggggcgagagctgggaggacaggggaagtacggagcaggttgttctgagtgcgggaccaggcgtattgccgcccggggcgaggcagagtttgagaaggccgcagaggaggtccggcatctgaaaactaaacccagtgatgaagagatgctatttatttacggacactataagcaggctacagtcggagacatcaacaccgaacgtccaggaatgctggacttcaccggcaaggcaaagtgggatgcctggaatgaactgaaaggaacatcaaaagaggatgcaatgaaagcgtatataaataaggtcgaggaactgaaaaaaaagtacggtatttag

SEQ ID NO: 25862 - DNA, 564 bp, Artificial Sequence
  Description of Artificial Sequence: Synthetic coding sequence
atgtttctcctgctaaattgcatcgtggctgtttctcagaacatgggtattggaaagaacggggatctgcctcggcctcctctacggaatgaattcaggtacttccagcgcatgacgaccacatcttcggtggagggaaaacaaaatcttgtaatcatgggaagaaagacttggtttagcattcccgagaaaaatcgtcctctcaaagatcgaatcaatctggtgttatctagagaactcaaagagcctccgcagggcgcccatttcctggcacggtccctggacgatgccctgaagctcactgaacgacccgagctcgccaacaaggtggatatgatttggattgttggtgggtcctctgtctacaaagaggcgatgaaccacctaggtcaccttaaactctttgtcaccaggataatgcaggacttcgagagcgatacgttctttagcgaaatagatcttgagaagtacaaattgttgccagagtaccccggggttctgagtgacgtgcaagaggggaaacatattaaatacaagtttgaggtttgtgagaaagacgattag

SEQ ID NO: 25863 - DNA, 564 bp, Artificial Sequence
  Description of Artificial Sequence: Synthetic coding sequence
atgttcctcctgttgaactgcatagtcgccgttagccaaaacatgggcattggaaagaacggagatttgcccaggccaccactgagaaatgaatttcgttacttccaaaggatgacgacaaccagctctgtggaaggtaagcagaatcttgttattatgggacgcaaaacatggttctccattccggagaaaaataggcctttgaaggatcgaattaacctggtgctgagtcgggagctgaaagaaccaccacagggggcgcacttcctagcccgctcccttgatgatgcactgaaactcaccgaaaggcccgagctggcgaacaaggtggacatgatttggattgtcggtggttcaagcgtctataaggaggctatgaatcacctcggtcatcttaagctctttgtgaccaggatcatgcaggattttgaaagcgatacattcttttctgagattgatctcgaaaagtataagctgctgccggagtaccctggcgtcctgagtgacgtccaggaagggaagcacattaaatataagtttgaagtctgtgagaaggatgactag

SEQ ID NO: 25864 - DNA, 564 bp, Artificial Sequence
  Description of Artificial Sequence: Synthetic coding sequence
atgtttttactgttaaattgcatagtcgccgtgtcacagaacatgggaattggaaagaacggtgacctaccccgcccccccctgaggaacgaattccggtacttccagagaatgaccaccacatcttcagtcgaagggaagcaaaaccttgtgatcatgggacgaaagacatggttttccattccagaaaagaatcgaccactcaaggaccggatcaatctggttctgtcccgggaactgaaagaacccccacaaggagctcactttctggcacgatctctggacgatgcactgaagctaaccgaaagacccgaactggcaaacaaagtggacatgatctggatagtgggcggctctagcgtgtataaggaagccatgaatcatctcggccacctgaagctgttcgttacaagaatcatgcaggattttgaatccgacacttttttctccgagatcgacttggagaaatacaagcttctgcctgaatatcctggggtcttaagcgatgtgcaggagggaaagcacataaaatataagtttgaagtgtgcgagaaggacgattag

SEQ ID NO: 25865 - DNA, 345 bp, Artificial Sequence
  Description of Artificial Sequence: Synthetic coding sequence
atgtttctcttgttgaactgtattgtcgcagtttctcagaatatgggaattggtaagaacggcgatctgccacggccacctctgcggaacgagttccggtattttcagaggatgactactacatccagtgtggaagggaaacagaatttggtcataatggggcgaaagacttggttctccattcccgagaagaacaggcctttaaaagacagaattaaccttgtgctgtctcgggagcttaaggaaccaccacagggggctcattttctggcccgctctcttgacgacgccctgaaactaacggaaagaccggagctggcaaataaggtggatatgatctggtag

SEQ ID NO: 25866 - DNA, 597 bp, Artificial Sequence
  Description of Artificial Sequence: Synthetic coding sequence
atgcccgaacagtcaaacgattaccgtgtcgtggtgtttggagcaggcggagtgggcaaaagcagtttggtactgcgctttgtcaagggaactttccgcgacacctatatcccaaccattgaagatacctacagacaggtgataagctgtgacaagagtgtttgcacacttcagataactgatactacaggcagccaccagtttccggccatgcagaggctgagcatcagcaaaggacacgcattcatccttgtgttttcagtcacctcaaagcagagcctggaagagctggggccgatttacaagctgatcgttcagatcaaaggcagcgttgaagatattccagtcatgctggttggaaacaagtgcgatgagacccaaagggaagtggacactagagaagcgcaggcggtcgcgcaagaatggaagtgcgcattcatggagacatccgctaagatgaactacaacgtgaaggagttgtttcaggagttgttgacacttgagacacggcgaaatatgagcctgaacattgatggcaagaggtcagggaagcagaaacgcacggatcgcgtgaagggcaaatgtacgttaatgtag

SEQ ID NO: 25867 - DNA, 600 bp, Artificial Sequence
  Description of Artificial Sequence: Synthetic coding sequence
atgccggaacagtccaatgactacagagtggctgtctttggtgctggcggagtcggtaagtcttcactcgtcttgcgattcgtaaaaggaacattccgagagtcgtacatcccaaccgtcgaggatacctataggcaggtgatctcatgcgacaaaagcatctgtactctgcagatcactgacacaactggctcccatcaattccctgccatgcagcggctctcgatatcaaaagggcacgcattcatcctggtatacagcattacttcccgccaatccctggaggagctgaaacctatctatgaacagatctgtgaaatcaagggcgacgttgagagtattcctatcatgctggttggaaataaatgcgatgaaagcccctcacgcgaagtgcagtctagcgaggccgaagccctcgcccgaacctggaaatgtgcttttatggagacctcggccaaactgaaccataatgtgaaagagcttttccaggagctcctcaacctggaaaaaaggagaactgtttctctgcagatagatggcaaaaaaagtaagcagcagaagagaaaagaaaaactgaaggggaagtgcgttatcatgtag

SEQ ID NO: 25868 - DNA, 690 bp, Artificial Sequence
  Description of Artificial Sequence: Synthetic coding sequence
atgggcaatgccagctttggtagcaaggagcagaagctgttgaagaggctccggctgcttcctgcccttctgatcttgcgggcctttaagccacatcgcaaaatcagagattaccgagtggtagttgtgggcacagcgggcgttggtaaatccacactcctccataaatgggcctcaggtaactttcggcatgagtatttgcccacaatagagaatacctactgccagctcttggggtgcagccatggggtcctctctttgcatattacagacagcaagagcggagacggcaaccgtgcccttcaacgacatgttattgcgagggggcacgcgtttgtgttggtctatagcgtaaccaaaaaagaaacactggaagaattaaaagccttctatgaactgatctgcaagatcaagggcaataaccttcataagtttccaatcgtgctcgtaggcaacaaatcggatgatacacacagggaagttgccctaaacgacggcgccacttgtgccatggagtggaattgtgcatttatggaaatctctgccaaaactgacgtcaacgtgcaggaattgttccacatgctcttgaattacaaaaagaagcccacaacaggtctccaggagcccgagaagaagtcccagatgcctaataccactgagaaactgctggataaatgcatcatcatgtag

SEQ ID NO: 25869 - DNA, 690 bp, Artificial Sequence
  Description of Artificial Sequence: Synthetic coding sequence
atgggcaatgcaagttttggttccaaggagcagaaactcctgaagagattgcgcctgctgcctgcccttctgatactccgggctttcaaaccccaccgaaagatacgggattacagagtggtggtcgtcggcactgctggcgtcggaaaaagtaccttgttacacaagtgggccagcggtaatttccgtcatgaatatcttcccactatcgaaaacacatactgtcagttgctcggctgctctcacggtgtgttatctctccatatcacagacagtaaatcaggcgacgggaatcgggctttgcagcggcatgtgattgctaggggccatgccttcgttctggtgtatagtgtgaccaaaaaggagacactggaagaactgaaggccttttacgaactgatctgtaagatcaaaggaaacaacctgcataagttccctatcgtgctggtcggaaataaatcagacgacacgcatcgcgaggtcgctctcaatgacggggcaacctgcgccatggagtggaactgtgcttttatggaaatatcagcaaagaccgacgtgaacgtgcaggagttgttccatatgttgctcaattacaagaagaaacccaccaccgggctgcaagaacccgagaagaagagccagatgcccaacacgactgaaaagttgctggacaaatgtatcataatgtag

SEQ ID NO: 25870 - DNA, 501 bp, Artificial Sequence
  Description of Artificial Sequence: Synthetic coding sequence
atgggcccagaggctctgtcttcactgctccttctgctgttagtggcctccggggacgccgatatgaaagggcactttgatcccgctaaatgtcggtacgcgttggggatgcaggaccgcacgataccagactcagacatctccgcctcctcatcttggtctgactctactgctgcgcggcactccaggctggagagttctgacggcgacggagcatggtgtcccgcaggtagtgtgtttcctaaggaggaggagtacctgcaagtggacctacagcggctccacttggtcgccctggtgggaacacagggccggcatgcggggggtctgggcaaggaatttagcaggtcttatcgcttgaggtacagtcgtgacggcagacgctggatggggtggaaagaccgatggggacaggaagtgatatccggcaacgaggaccctgaaggggttgtgctgaaagatctcgggcccccaatggtggcccggttggtcaggttctag

SEQ ID NO: 25871 - DNA, 420 bp, Artificial Sequence
  Description of Artificial Sequence: Synthetic coding sequence
atggggcccgaagccttgagctcactactcttactgttgttagtcgccagcggcgatgccgatatgaaaggtcatttcgaccccgccaagtgtcgctatgcgctgggtatgcaggaccgtactattccggatagtgacatctctgctagctcgagctggagcgattcaactgctgcacgacattctaggctggagagcagtgacggtgacggtgcctggtgtcctgccggtagcgtgttccccaaggaggaagagtatttgcaagtggatctccagaggctgcacctcgttgctctggtgggaacacaaggcagacacgcaggcggtttgggaaaagaattctcccgtagctaccgcctccgatacagcagagacgggcgcaggtggatgggatggaaggaccgatggggccaagagtag

SEQ ID NO: 25872 - DNA, 756 bp, Artificial Sequence
  Description of Artificial Sequence: Synthetic coding sequence
atgggcccagaagcgctatccagtcttctcctcttgctgcttgttgcgtcaggagacgctgacatgaaggggcactttgatccagccaagtgccgatacgccctgggtatgcaggacagaacaataccggattcagacatcagtgcctccagcagctggtcagactcaacagctgcccggcactctcggctggaatcaagtgacggcgacggggcatggtgtccggccggcagcgtctttccaaaggaggaggaatatctccaggttgatctgcagaggctccacctcgtcgcgctggtaggtactcagggtagacacgccgggggcctgggcaaggagttttctcgatcgtataggctccggtactcccgtgacggacgtcgatggatgggctggaaagatcggtggggccaggaagttatcagtggtaatgaagaccccgagggagtagttctgaaggacctgggtccaccaatggttgctagactggtgagattttacccccgggccgatcgcgtgatgtcggtgtgcctgcgagtcgagttgtacggatgtttgtggcgggatggccttttatcgtataccgcccccgtcggccagacaatgtacctgtctgaagctgtttacctcaacgattctacctacgatggtcatactgtcggaggtctgcagtatggggggctgggacagcttgccgatggagtcgtcggcttggatgatttccgaaaatctcaggagttgcgggtgtggccctag

SEQ ID NO: 25873 - DNA, 420 bp, Artificial Sequence
  Description of Artificial Sequence: Synthetic coding sequence
atgggcccagaggccctaagctcgctccttcttctgttactcgtcgcaagcggagacgcagacatgaagggccacttcgatccagcaaagtgccgctatgctctcgggatgcaggatagaacgatccccgacagtgacattagtgccagtagctcttggtctgacagtacagcagcgcggcattcgagactagagagtagcgacggtgacggagcctggtgccccgcgggtagcgtgtttcccaaggaagaagaatacctgcaagtggatctgcagcgattgcaccttgtagcccttgttggcacacaggggcggcatgccggtgggcttggtaaggaattctcccgctcttatcgcctgagatactcccgcgatggcaggagatggatgggctggaaagaccgttggggacaagaatag

SEQ ID NO: 25874 - DNA, 756 bp, Artificial Sequence
  Description of Artificial Sequence: Synthetic coding sequence
atgggaccggaggccctgagttccctactactgttactcctagtagcttccggcgatgccgatatgaaaggccattttgaccccgcaaagtgtcggtatgccctcgggatgcaggaccgcactattcccgactctgatatctccgcatccagtagctggagcgactctactgcagctcggcacagtaggctcgagtcaagtgacggagatggagcctggtgtcccgctggttccgtatttcccaaagaagaggaatacttgcaggtggacctgcagagactgcatttagtagctctagtgggaactcagggacgacacgccggggggctggggaaggagttttcgcgttcctatagactgcggtattctagagatggcagaagatggatgggatggaaggatagatggggtcaggaagtaatcagcggaaatgaggatcctgaaggcgtagtacttaaggatctcgggccacccatggtggcacggctggtgaggttctaccctagggcggacagggtcatgagtgtttgtctcagagtcgaactttatggctgcctgtggagagatgggctacttagctatacagctcccgtggggcagacaatgtacctatcagaagcagtttatcttaatgactccacctatgacggacataccgtgggaggtttacagtacggcggtctcggccagctggcagatggagtggtcggattggacgatttccgtaagagccaggaactgcgcgtgtggccctag

SEQ ID NO: 25875 - DNA, 420 bp, Artificial Sequence
  Description of Artificial Sequence: Synthetic coding sequence
atgggccctgaggccctgtcatccctgcttctcctgctgctcgtcgccagcggggatgcggacatgaaaggccatttcgatcccgcgaaatgtcggtacgccctcggcatgcaggaccgcactatcccagatagcgacatctccgccagtagctcttggtccgattccaccgccgccagacacagcagacttgagagctccgatggcgatggagcctggtgtccagccggatccgtgttcccaaaagaagaggagtacctgcaagttgatttacagcgccttcacttagtggcactggttggtactcaaggccggcacgccgggggtctgggcaaggagttctctagaagctatcgactgcgttattctcgagatgggcgccgctggatgggttggaaggacagatggggtcaagagtag

SEQ ID NO: 25876 - DNA, 756 bp, Artificial Sequence
  Description of Artificial Sequence: Synthetic coding sequence
atgggccccgaggcactgagctcgttactgctactgctcctggtggcgtctggcgacgccgacatgaagggccattttgacccagcaaagtgtcgatatgctctggggatgcaggataggaccattccagactctgacatttctgcgagctcctcttggtccgattcaaccgcagctcggcattcccgcttggagagcagcgacggggatggcgcttggtgtccggccggctccgtttttcctaaggaagaggagtacctgcaagtggatctccagaggctgcatctcgtggccctggtagggactcagggcaggcacgcagggggattgggtaaagaattttcaagatcttacagacttagatatagccgggatggccgacgttggatgggatggaaagacagatggggccaggaggtgatatcaggtaacgaggacccagagggcgtggttctgaaagacctcggaccccccatggtggctcggctggtgcgcttttaccctagggccgaccgcgtcatgtctgtgtgcctgcgggttgaattatacgggtgcctctggagagacgggttactgtcttatacagcaccagtaggtcagactatgtacctgtccgaggctgtctacctaaacgactctacttacgatggccatactgtgggtggcttacagtatggcggactgggtcagctcgcggacggagtggttggactggatgattttcgtaaatcccaggaactgagggtgtggccctag

SEQ ID NO: 25877 - DNA, 756 bp, Artificial Sequence
  Description of Artificial Sequence: Synthetic coding sequence
atgggtccagaagctctgtcctctttgttgttacttttgctcgtggcatctggcgatgctgatatgaaaggccacttcgatcccgccaaatgccgctatgctctgggaatgcaggaccgaaccattcctgatagtgatatctcggcgtcaagttcatggtcagactctacggcagctcggcactctcggttagagtcctccgacggtgatggagcatggtgccctgctggttccgtgttccccaaagaggaagagtatttacaggttgacctacaaagactacacttggtagccttggttgggacacagggccgtcatgcaggtggattgggtaaggaattttcacgctcctataggcttcgctactctcgggacggaagacgctggatggggtggaaggatagatggggacaggaggtgatttcagggaatgaggaccccgagggggtggtcctaaaagaccttggcccacctatggtggctaggctcgtgaggttctacccaagggcggaccgcgtgatgtcagtgtgtctccgtgtggagctgtacggctgcctctggcgtgacggtctcctgtcctacacagctccagtgggccaaaccatgtatctcagcgaagcggtttatctgaacgattctacttatgacggccatacggtaggaggtcttcaatacggaggtctcggccagcttgcggatggggtagtcggcctggacgactttaggaaatcccaagagctgcgagtgtggccttag

SEQ ID NO: 25878 - DNA, 420 bp, Artificial Sequence
  Description of Artificial Sequence: Synthetic coding sequence
atgggcccagaggccttgtcctctttattgttacttctcctcgtcgccagtggcgacgcggatatgaaaggccacttcgaccctgcaaagtgcagatacgccctgggtatgcaggacagaacaattccagattctgacatcagcgcttcgagttcgtggagtgacagtacagccgcacgccactctagactcgagagtagcgatggggacggcgcctggtgtcccgccggctcagtctttccaaaggaagaagagtaccttcaggtggacttgcagagacttcacttggtggcattggttggcacacaaggacgccacgccggaggcttgggaaaagagttctcacgtagctataggctgcggtactcccgcgatggacggcggtggatggggtggaaggatagatggggccaagagtag

SEQ ID NO: 25879 - DNA, 192 bp, Artificial Sequence
  Description of Artificial Sequence: Synthetic coding sequence
atgggccctgaagccctcagttccctactgctcctcctgctggtggcatctggagacgctgatatgaaaggccacttcgaccccgcaaagtgccggtatgcgctaggcatgcaggatagaactattccagactctgatatttctgcatcctctagctggtccgatagcactgctgcacgccacagccgctag

SEQ ID NO: 25880 - DNA, 756 bp, Artificial Sequence
  Description of Artificial Sequence: Synthetic coding sequence
atgggaccagaggctctttcttctcttctgcttctgctccttgtggcatccggcgacgcagacatgaaaggtcactttgatcccgcaaagtgtagatatgctctgggaatgcaggatcgtaccattcccgattcggacatctctgctagcagctcatggagtgatagcaccgcagcaagacattctcggctggagagcagtgatggggatggagcctggtgccctgccggttccgtgtttccaaaggaggaggaatatctccaagtggatctacaaaggcttcatcttgtcgccctagtgggaacccaagggcgtcatgccggcggattgggaaaggaattcagtagaagttataggctgaggtactctcgcgacgggagaagatggatgggatggaaggacaggtggggtcaggaggtgatttcagggaacgaggatccagaaggggtggtcttgaaggacctcggacccccaatggtggcgagactagtccgcttttatccccgggccgatagggtcatgtcggtgtgtctgcgcgtggaactttatgggtgcctgtggagagatggtttgctctcatataccgcacccgttgggcagactatgtacctgagcgaagccgtgtatctcaatgattctacttacgacggtcatacagtagggggacttcaatatggtggtctgggccagctagcggacggtgtggtcgggcttgacgattttcgtaagtcccaggagctgagggtctggccttag

SEQ ID NO: 25881 - DNA, 420 bp, Artificial Sequence
  Description of Artificial Sequence: Synthetic coding sequence
atggggccagaggccctcagcagtctgctactgctgctgcttgtggccagcggagatgctgatatgaaaggccactttgatcctgctaagtgcaggtacgcattaggtatgcaggacaggacaattccggattcggacataagcgcttcctctagctggagtgattctaccgcggctcgccatagccgcctcgagagttccgatggcgacggggcatggtgccctgcaggcagtgttttcccaaaagaggaggaatatctgcaggtcgacctccagcgcttgcatctagtggccctggtgggaacccagggtaggcacgcaggaggtctcgggaaggagttctcaagatcctaccgcctgcgatacagccgcgatggcaggcggtggatgggctggaaagataggtggggccaagaatag

SEQ ID NO: 25882 - DNA, 420 bp, Artificial Sequence
  Description of Artificial Sequence: Synthetic coding sequence
atgggccccgaagccctttcctcactgctactcctgctcctggtcgccagcggcgacgcggatatgaaaggtcatttcgatccggccaaatgtcgctacgcactgggtatgcaggaccgtactatccccgactccgatatttccgcctctagcagctggtctgatagcaccgctgcccgacactcacgcctggaaagctctgatggagacggggcctggtgccccgcgggatctgtatttccaaaggaggaggagtacctgcaggtcgatttacaacgacttcacctcgttgccctggtggggactcagggacgtcatgccggaggccttggcaaagaattctccagatcctatcgcttacgctacagccgggatggtcggagatggatgggttggaaagatcgatgggggcaggagtag

SEQ ID NO: 25883 - DNA, 192 bp, Artificial Sequence
  Description of Artificial Sequence: Synthetic coding sequence
atgggacctgaggctttgtctagtctattgttgctgctgctagtcgcatccggggacgcagacatgaagggtcactttgatcccgccaagtgtagatatgccctgggtatgcaggacagaaccatcccggattcggacatttcggcatcctctagttggagcgacagcactgccgcacgacactcgagatag

SEQ ID NO: 25884 - DNA, 630 bp, Artificial Sequence
  Description of Artificial Sequence: Synthetic coding sequence
atgggccccgaggcattatcctccttactcttactactgctagtcgccagcggggacgccgatatgaagggccattttgatcctgccaaatgtcgttatgctctgggaatgcaggaccgaactatccccgacagcgacataagcgcctcgtccagttggtccgacagtacggcagcaagacactcacgtctggagtcatcagatggggacggagcttggtgcccagccggcagcgttttccctaaggaggaggaatacctgcaagtagaccttcagcgcttgcatctcgtggctttggtcggaacgcaaggcagacatgctggcggcctcggaaaggagttcagccggtcgtatcggcttcgctactccagagacgggaggcgctggatgggatggaaagaccggtggggccaagaagtgatctctgggaacgaagatcccgaaggtgtggtgctgaaagacctgggccctccgatggtggcacgactggtgaggttctatccaagagcagaccgcgtcatgtccgtgtgcttgcgggtggaactatacgggtgtctgtggcgcgacggcctcttgtcatataccgcccccgttggccagaccatgtacttgtccgaagctgtctactag

SEQ ID NO: 25885 - DNA, 420 bp, Artificial Sequence
  Description of Artificial Sequence: Synthetic coding sequence
atgggacccgaagccctatcttccctgctgctcctgttattggtggccagtggtgatgccgacatgaagggccactttgatcctgcgaagtgccgatacgctttggggatgcaggaccgcacaattcccgatagcgacataagtgcctccagttcttggtcagacagtacagccgcgagacatagcaggttagagtcatccgatggcgacggcgcttggtgccctgcaggttccgtcttccccaaggaggaagaatacctgcaggtggaccttcagcggctccacctggttgccctggtgggcacgcaggggcgccatgctggcggtctcgggaaggagttttctagaagctaccggctgcgctactcaagagatggaaggaggtggatgggttggaaagatcgttgggggcaagaatag

SEQ ID NO: 25886 - DNA, 420 bp, Artificial Sequence
  Description of Artificial Sequence: Synthetic coding sequence
atgggacccgaagcactttcctcactcctgctgctcttgctcgtggccagcggcgatgccgatatgaaggggcattttgacccggcgaagtgtagatacgctctgggtatgcaggatcggactatcccagattcagacatctctgcctctagtagttggagcgatagcacagctgctcgacacagccggctggagtcgagtgatggtgacggagcatggtgtcccgctggaagcgttttccctaaagaagaggaatatttacaagttgacctgcagcggctgcatctggtggcactcgtgggcacccagggacggcacgcaggagggttggggaaggaattcagccgctcttatcgcctgagatatagccgcgatggccgcaggtggatggggtggaaagatcgatggggccaagagtag

SEQ ID NO: 25887 - DNA, 420 bp, Artificial Sequence
  Description of Artificial Sequence: Synthetic coding sequence
atggggcctgaggccctcagcagcctgttgctattgctcttggtcgcctcaggcgacgctgacatgaaagggcactttgacccagcaaaatgtcgctatgccttgggaatgcaggatagaacaattcctgatagtgacatctctgcgagctcaagctggagtgacagtaccgcggcacgtcacagcaggctggaatcatcagatggcgacggagcctggtgccctgccgggagtgtgttccccaaggaggaagagtatctgcaggtggatcttcagcggttgcacctggtggctctggtcggcacccaaggcagacatgccggaggtttgggtaaggaattctctaggtcttatcgcctcaggtacagcagagatgggcgccggtggatgggatggaaggatcggtggggtcaggaatag

SEQ ID NO: 25888 - DNA, 144 bp, Artificial Sequence
  Description of Artificial Sequence: Synthetic coding sequence
agtgaggctgtgtaccttaacgactccacctacgacggtcacacggtgggaggtctgcagtacggtggcctcggacaactcgccgatggtgtcgtgggcttggatgatttccgaaaatcacaggagttgcgagtctggccatag

SEQ ID NO: 25889 - DNA, 444 bp, Artificial Sequence
  Description of Artificial Sequence: Synthetic coding sequence
atggggcccgaagcgctttcttctcttcttctcctgctgctagtggctagcggggatgccgacatgaaggggcatttcgaccccgctaagtgcagatacgccctggggatgcaagatcgtaccataccagacagcgatatctctgcttcaagctcatggagcgattccaccgctgctcgccactctagactggaatcatctgacggagacggagcctggtgtcctgccggaagtgtcttccctaaggaggaagagtaccttcaggttgatttgcagcgcctgcacctggtggccctggtgggtactcagggtcgacatgctggtgggctgggaaaagagttctcaaggagctaccgtttgcgctactccagggatggtaggcggtggatggggtggaaagaccgctgggggcaggaagtaatcagcggcaatgaggacccctag

SEQ ID NO: 25890 - DNA, 420 bp, Artificial Sequence
  Description of Artificial Sequence: Synthetic coding sequence
atgggacctgaagctctgtcttctctgcttctgctgctgctcgtagcatcgggagatgctgatatgaaaggacacttcgaccccgctaaatgccggtatgcgctcggtatgcaggacaggaccattcccgactccgatatctcggctagcagttcctggtccgactcaaccgcggccaggcattctcggctggaaagctcggacggtgacggggcctggtgccccgccgggtctgtcttccctaaggaagaagaatatctgcaggtggacctgcagcgcctgcatctggtggcactggttgggacacaagggaggcacgctggcggacttgggaaagagttctcaagaagttacagactacggtacagcagagacggaagaagatggatggggtggaaagataggtgggggcaggagtag

SEQ ID NO: 25891 - DNA, 756 bp, Artificial Sequence
  Description of Artificial Sequence: Synthetic coding sequence
atgccacacctggcctccctgttcactgccagtagccgttgttgccctcacccgctgcggcctgagggctcaggagcgatgggtccggaagcactcagcagcctccttctcctgctgttggtggctagcggcgacgctgatatgaaagggcacttcgacccggctaagtgccggtatgcgttgggtatgcaagaccgcaccataccagacagcgatatctccgcctcaagctcttggagcgacagtacagcagcccggcactcccgcctggaatcctcagatggggacggtgcctggtgtcccgccggctctgtgttccctaaggaggaagaatatctgcaggttgatctgcagcggcttcacctggtggcactggtcggcacccaggggaggcatgccggcggtcttgggaaagaattcagtagaagctacaggcttaggtactctcgtgacggacgccgctggatggggtggaaggacaggtgggggcaggaggtgatttccggtaacgaggaccccgagggggtagttcttaaagacttgggccctcctatggtggccaggttggtaaggttttaccccagggcggaccgggtgatgtctgtgtgcctgagggtggaactgtacggttgtctctggcgcggtgaatggctgagcttcctgggaatatgttttctctccagggggcttgagggtggcgagtgtggagagtgggcttcaaggataccatctcccgctggcaaattgtctttatag

SEQ ID NO: 25892 - DNA, 1620 bp, Artificial Sequence
  Description of Artificial Sequence: Synthetic coding sequence
atggtgcccggggcccgcggagggggagccctggccagggccgcaggccgagggcttctggccttactcctcgccgtctctgccccactcagacttcaggccgaggagctgggagatggatgcggccacctcgtcacctaccaagatagcggcactatgacctccaaaaattatccaggtacttaccctaatcacaccgtctgcgagaagacgatcacagttccaaagggcaagagactgatcttgaggctcggagaccttgacatcgaatcccaaacttgcgccagcgactatctcctgttcacttcaagcagtgaccaatatggaccctattgcggctcaatgacagtgccaaaggagctcctcttgaacacaagcgaggtcacggtgcgattcgagtcgggttctcatatcagtggacgaggtttcctacttacctacgcatcatcagatcaccccgacctaattacttgccttgaaagagcctcccattacctcaaaacagagtattcaaagttctgtcctgctggctgtcgagacgtcgccggcgatatttcaggaaatatggtggacggatacagagacacatctctgttatgtaaggctgccattcacgccgggattattgctgatgaactggggggccaaatatcagtgctgcagcggaaagggatctcaagatatgaaggaatattggcgaatggtgttctgagccgagatggaagcctgtccgacaaaagattcctttttacatcaaacggatgctctcgctccctttcgtttgagcctgatgggcagatacgcgctagctcttcttggcagtccgttaatgaatccggggaccaagtgcactggagcccaggacaggcaaggttacaggatcaggggccatcctgggcgagtggggattcttctaataatcataaaccacgtgaatggctggagattgatctaggggaaaaaaaaaagataaccggtatccgaactaccggctctacacagtcaaattttaatttctatgtcaagtcctttgtcatgaatttcaagaacaacaacagtaagtggaaaacctataagggtattgtgaacaacgaggagaaggtctttcagggtaattcaaacttccgggaccctgttcagaataacttcatccctcctattgtcgccaggtacgtacgggtagtgccccagacctggcaccagcgcatcgctttgaaggtggagctaatcggctgtcagatcacccagggcaacgactccctggtgtggcgcaagactagtcagagtacaagtgtgtctaccaagaaggaggatgagaccattacacgccctatcccctcagaagagacatccaccgggattaacatcactacggttgctatccccctcgtgcttttggtggtcctggtgtttgctgggatgggaatttttgccgcatttcgcaaaaagaaaaaaaagggcagcccgtatggcagcgcagaggcacagaagactgactgttggaaacagatcaaatacccgttcgcgcggcatcagagcgccgagttcaccatatcttacgataatgagaaggagatgacacagaagctggatctgattaccagtgatatggccggatag

SEQ ID NO: 25893 - DNA, 2148 bp, Artificial Sequence
  Description of Artificial Sequence: Synthetic coding sequence
atggttcctggggcccgtggcgggggcgcactggcccgggccgcaggaaggggcctgctcgctctcctcctggctgtgagcgcacctcttcggctccaggccgaggagctgggggacggttgtggtcatcttgttacttaccaagattccggcaccatgacctccaaaaattatcctggaacgtatcccaaccataccgtgtgcgagaaaaccattaccgtgcctaaaggaaaaagactgatactccggcttggggacttagacattgagtcgcagacttgcgcctctgactacctactgtttacctcgtcatccgaccagtacggaccttattgtggaagtatgaccgtgccgaaggagctgctgctgaatacatcagaagtgactgtccggttcgaaagcgggagccatatctcgggaagagggtttttgcttacctacgcctcatcagaccatcctgaccttattacctgtcttgaaagggcgtctcattatcttaaaaccgaatactccaagttttgtcccgctggatgccgggacgttgccggtgatatttccggaaatatggttgacgggtaccgagacacctccctgctttgtaaggctgcaatccacgccgggatcattgcggacgagctgggcggacaaatctctgtgctgcagagaaaagggatatcacggtatgaagggattctggccaatggggtactgagtagagacggtagcctcagcgataaacggtttttgtttacttccaacggttgcagccgctcactgtcctttgagcccgacgggcaaattcgcgccagtagctcctggcagagcgtcaatgaaagcggagaccaggtgcattggtcccctggacaggcacgtctgcaagaccagggcccttcttgggcaagtggggattctagcaacaatcataagcctagggagtggctggaaatcgatctgggcgagaagaagaagattactggcatacgtaccaccggatccactcaaagtaactttaacttttatgtgaagtcttttgtgatgaacttcaagaataacaacagtaagtggaagacctataaaggcatcgtaaataatgaggaaaaagtgtttcaggggaatagtaatttccgagaccccgtgcagaacaacttcatcccaccgatagttgccaggtatgtgagggtggtgcctcagacctggcaccagcggatcgccctgaaagtcgagcttattggatgccagattacccaaggcaatgacagccttgtgtggaggaagacatcacaatctacttcggttagtactaagaaggaagatgaaactatcactcggcccattcctagtgaggaaacatcgacaggcataaacataaccaccgtcgctatccccttagtactactcgtcgtgctcgtgtttgcgggcatgggcatcttcgcggcattcagaaagaagaagaaaaaaggtagcccctacggcagcgccgaagcccagaagactgactgttggaaacagatcaaatacccattcgccaggcatcagagcgccgagttcaccatttcctacgacaacgaaaaggagatgacacagaagctggacctcattacaagcgatatggctgactaccagcaacctcttatgataggtacaggtacggtgactcgcaagggcagtacctttcgccccatggacaccgacgccgaggaagcaggggtgagtactgacgcagggggccattatgattgtcctcagagggcaggaagacatgaatacgccctccccctggctccacctgaaccggagtacgctacccctatagtggaaagacatgtcttacgcgcccatacattttctgcccaatccgggtaccgggtgccaggccctcaacctgggcataagcactctctgtctagcggtggcttctcccccgtggctggggttggcgcccaggatggggattatcagaggcctcattcagcacagccggcagaccgcggttatgatcgcccaaaagctgtgtcagctctggctaccgaatccggacatcccgattctcagaaaccaccgactcaccctggcactagcgacagctattcagcgcccagagactgtctgaccccactgaatcagacggcaatgaccgccctactatag

SEQ ID NO: 25894 - DNA, 1551 bp, Artificial Sequence
  Description of Artificial Sequence: Synthetic coding sequence
atggtccctggggcccgaggcgggggcgcactggcccgtgcagctggccgcggcctattagccctcctactcgctgtgtctgcaccattgcgacttcaagctgaagagctcggcgatggctgtggtcatttggttacctaccaggactctggtacaatgaccagcaagaactatccaggtacttatccaaaccataccgtctgcgagaagactattaccgtgcccaaagggaagcgtcttatcttgcgattaggcgatctggatattgaatcacaaacgtgcgcctctgactacctcttgtttacctccagttcagatcagtatgggccatactgcggctctatgaccgtgccgaaagagcttttgctcaacacttcggaggtcaccgtgagattcgagagcggcagtcatatatctggacgggggtttttactcacttacgcctcttcggatcaccccgacctaatcacatgtctggaacgggcgtcgcattacctcaaaacggagtattccaaattctgcccagccggttgcagagacgtggctggtgatatatcgggaaatatggtggacggctatagggacacttccctgttatgcaaggccgcaattcatgcggggatcatcgctgatgagcttggtggccagattagtgtgctgcaacgaaaggggatcagtaggtatgaaggcatcttggcaaacggggtactttctagagacggatcactgtctgacaaacgctttctcttcacaagcaacgggatcaatattacaaccgtggcaattcctctggtccttctcgtcgttcttgtgttcgcaggaatgggcatcttcgcagcttttcggaagaaaaaaaagaaaggctccccatacggcagtgccgaggcccagaagactgattgctggaaacaaataaaatacccatttgctcggcatcagagtgccgagttcaccatcagttatgacaacgagaaggaaatgacccagaagctggatctaatcacaagcgacatggcagattaccagcagcccctgatgattggcacaggaaccgtcacccgcaagggctcaacctttaggccaatggacaccgacgctgaggaggctggcgtcagtactgatgcgggaggccattacgactgcccccagagggctggtcgacatgagtacgctctgcctttggcacctccagagcccgagtatgcaacacctattgtggaacgccacgtactaagggcccataccttttcagcccagtccggctaccgggtgccaggcccccagcccggacataagcactccctttcttcaggtggctttagtcccgttgctggtgtcggagctcaggacggcgattatcagagaccccatagcgcccaaccagctgatcgcggatacgaccgaccgaaagccgtgagtgcactggctaccgagtccgggcatcccgactcccagaaaccgcctacacatcccggaactagtgacagctactcagcacctcgggactgcctgacccctctaaaccagactgcaatgacagccctcctctag

SEQ ID NO: 25895 - DNA, 618 bp, Artificial Sequence
  Description of Artificial Sequence: Synthetic coding sequence
atgaactttaagaataataacagtaaatggaagacctataaggggatagtgaacaacgaggagaaggtcttccaaggaaattccaattttcgcgacccagtgcagaacaattttattccacccatcgttgcaagatacgttcgggttgtaccccagacctggcatcaaaggatcgcattgaaagtcgaattgatcggctgccagattacacagggaaatgattctctggtgtggcgcaaaactagccagtcaacttcagtgagtactaaaaaagaggacgagaccataactaggccaatacccagtgaggagacgagtactggcatcaacatcaccactgttgcaattcccctggttctgctggtagtcctggtgtttgccgggatgggcatttttgcagctttcagaaaaaaaaaaaaaaaaggcagcccatatggatctgccgaagcccagaagaccgattgttggaagcaaattaaataccccttcgcccggcaccagagcgccgagttcacaattagttacgataatgaaaaagaaatgacccagaaactggacctaatcactagtgatatggccgcgagcccagagccggtgtccgagcctttgcctccctag

SEQ ID NO: 25896 - DNA, 2328 bp, Artificial Sequence
  Description of Artificial Sequence: Synthetic coding sequence
atggcgtcccgcgctgttgtcagagcccgaaggtgcccccagtgccctcaggtacgcgccgctgccgcagcccccgcatgggcggcactgcccttgtcacggagtctccccccgtgtagtaacagcagtagctttagtatgccccttttcctgcttctgctcttggttttgctcctactcctcgaagacgctggcgcgcagcagggagacggatgtgggcacacagtgctgggcccagagtcaggcactttaaccagtatcaactatccccagacgtatcccaatagtacagtctgtgagtgggaaatcagggtcaaaatgggggagagagttagaattaaatttggagactttgatatagaggatagcgattcttgccacttcaactatctgaggatctataatggtatcggagtgtcgaggacagagattggcaaatattgcgggctgggattgcagatgaaccacagcattgaatcaaagggcaacgagatcacacttctctttatgagcggtatccacgtgagcgggagaggctttctagccagttattctgtgatcgacaaacaggacctaatcacctgtctcgacaccgcttctaattttctggaaccagagttctcgaaatactgcccagctggatgcctgctgccatttgctgagatcagtggtacaatcccccacggatatagggattcatccccactgtgtatggccggcgtccatgcaggagtcgtgtccaataccctagggggacagatctccgttgtgataagcaaaggaatcccatattacgagtcatcgctggctaacaatgtaacctctgttgtcgggcacctgagtacctcactgtttacatttaagacatccggatgttatggaaccctcggcatggagtctggggtgattgcagatccgcagattaccgcatcatcagtactagaatggacagaccacaccgggcaggagaatagttggaagccgaaaaaggctagactgaagaaaccaggacccccttgggcggccttcgcaactgatgaataccagtggctgcagatcgatctgaacaaggaaaaaaagatcacaggaattatcacgacaggctcaaccatggtcgaacataattattacgtgtccgcttatcggattttgtactctgacgatggccagaaatggacagtgtaccgggagccaggggtggagcaggataagattttccagggcaataaggattatcaccaggacgtgaggaacaattttttgccacccatcatcgccaggttcatccgcgtgaaccctacccaatggcaacagaaaatagccatgaaaatggagttactggggtgccaatttatcccaaagggaaggccaccaaaactgacacaaccaccgccacccaggaacagcaatgacctgaagaacaccaccgctcctccgaaaattgctaagggtagagcccctaagtttacacagcctctccagcctagatcatcaaatgagtttcctgcccaaacggagcagacaacagccagcccagacatcaggaacacaacagtaaccccaaacgtgacaaaggacgtcgccctcgcggccgtgctggtgcccgtgctagtgatggtgctgactactctcatcctgatactggtgtgcgcctggcactggcgaaaccgaaaaaaaaagacggagggcacttatgatctgccctattgggatagggcaggctggtggaagggaatgaaacagttcctgccggcgaaagccgtagaccacgaagaaacaccagtaagatacagttcttccgaggtgaaccatctgtctccgagagaagtgaccaccgtcttgcaggccgatagtgctgagtatgcgcagccactggttggcggcatcgtaggcactcttcaccagaggtccacttttaagcctgaggaaggaaaagaagccggatacgccgacttggacccttacaatagtcctggtcaggaggtttaccacgcatatgccgagcctttgcccatcacagggcctgagtacgctacaccaataatcatggacatgtccgggcatccgaccactagtgtgggtcagccttctacgtcaaccttcaaagctacgggtaatcagcccccaccactagtgggcacgtacaatactctgcttagcaggactgattcctgcagctccgcacaagctcagtacgacacacccaaggctggaaagcccggactccctgccccggacgaattagtataccaagttcctcagtccactcaggaagtgagtggggccggccgagatggcgagtgtgatgtctttaaagagatcctctag

SEQ ID NO: 25897 - DNA, 2370 bp, Artificial Sequence
  Description of Artificial Sequence: Synthetic coding sequence
atggcctccagagctgtggtacgcgctcgcaggtgtccgcagtgtccacaagtgagggccgcagctgccgcgcctgcttgggcagccctgccgctgtcaaggtcactccccccttgttcaaattccagtagtttcagtatgcccctgttcctgctcctcctcctggttctgctcttattactggaagacgccggagctcagcagggcgatggctgtgggcacacagtgttgggtccggagtcaggtacactcacgtcaatcaattatccccaaacctaccccaattccacagtgtgcgagtgggagatccgcgtcaagatgggcgaaagggtgcggatcaagtttggggacttcgacatcgaggacagtgatagttgccattttaactacctccggatctataatgggatcggcgtgtctcggaccgagattggtaagtattgtgggttggggcttcagatgaatcatagtatagagtcgaagggcaatgaaattaccctgctctttatgagtggaatccacgtttccggcaggggcttccttgcatcctattccgtgatcgataagcaggatctgatcacctgcttagataccgctagcaatttccttgagccggaatttagcaaatactgtcccgccggctgtttgcttcccttcgcagaaattagtggcactattccccacggataccgggattcatccccactctgtatggccggcgtacacgcaggagtggtgtcaaataccctcggaggacagatttctgtcgtgatttctaaaggcattccgtattacgagagttccctggcaaataacgtgacatccgtcgtgggtcacctgagcacatctctcttcaccttcaaaacctccggctgctatgggacacttggaatggagtccggagtgatcgcggacccccagataaccgcttcgtcagtgctggaatggacagaccacaccggccaggaaaactcttggaagcctaagaaggcccgcctaaagaaacccggaccaccatgggccgctttcgccacagatgaataccaatggctgcagatcgatctgaataaagagaaaaagatcaccggcatcattaccacgggcagcacaatggttgagcacaattactacgtatctgcatatagaatcttatattctgatgatggccagaagtggaccgtctatcgggagccgggcgtggaacaggacaagatcttccagggcaacaaggactaccatcaggacgttagaaacaatttcctgccacctattattgcccggttcattcgggtgaatcctacacagtggcaacagaagatagctatgaagatggaacttctcggctgccaatttatccctaaggggcggcctcccaagctgactcagccgcctccccctcggaactccaatgaccttaagaatacgacagcgccacctaaaattgcaaaggggcgggccccaaaatttactcagcccctccagcccaggagctccaacgaatttcctgctcagactgagcagaccactgcatcgcctgacattagaaacaccacagtgacgccaaacgtgacaaaagacgtggctttagcagcagtgctcgttcctgtactggtgatggtgctcacgactctcatccttattctggtgtgtgcatggcattggcggaaccggaaaaaaaagaccgagggaacatatgacctcccttactgggacagagccggcttttaccttatggtaagcctggcttgccggcataatgaagggtggtggaagggcatgaaacagtttttacccgccaaagctgtggatcacgaggagacgccagtgaggtactcgtcttctgaagttaaccacctgtcccctagggaggttacaacggttctacaggcagacagcgccgaatacgcccagcccttggtggggggtatagtcgggaccctgcatcaaaggtctacatttaagcccgaggaaggtaaagaagctggctatgctgacctggacccctacaactccccgggccaggaggtctaccacgcctatgcagagcctcttccgataaccggacctgagtacgctacccctataattatggatatgtccggacatcccactactagtgtgggccagccctcgacttctacttttaaagccactggtaaccagccaccaccacttgtgggtacgtacaacactctcttatcccgcaccgattcatgttctagcgctcaggcacagtatgatacgccaaaggcagggaagccaggattgccagccccagacgagctggtgtatcaagtgccacagtcaacccaagaggtctcaggggccgggagggacggcgaatgtgacgtgttcaaggaaatcttatag

SEQ ID NO: 25898 - DNA, 1140 bp, Artificial Sequence
  Description of Artificial Sequence: Synthetic coding sequence
atgcccttatttcttctcctgctcctggtcctgttgttgctccttgaggacgccggggcacagcagggggatggatgtggccatacagtgcttggccctgagtcagggactctgaccagcattaactatccacagacatatcccaatagcaccgtatgcgagtgggagattagagttaaaatgggggagagggtgaggatcaagtttggcgactttgatatcgaagatagcgattcttgtcactttaattatctccgcatctacaatggaatcggagtctccaggaccgaaataggcaaatattgcggccttgggctgcaaatgaatcattcaatagaatccaagggcaacgagattactttactctttatgagcggcatacacgtctcagggagaggctttttggcctcatatagcgtcatcgacaagcagggatcgaactacctattcggacactgcatccagttttggaatttgagctcaggtaagtattgtccggcgggctgtcttctcccatttgccgaaatcagcggaactattccccacggttaccgggactcttccccattatgtatggcgggagtgcatgctggggtggtgtcaaacactctcggcggacagattagtgtggttatcagcaagggcatcccgtactatgagtcatcactcgcaaacaacgttaccagtgtagtgagcgtctccctgctgatggtttttattctgttttttgtgagcggatgctatggaacgttgggaatggagagtggcgacaggggcagcagtaataactctattgtcctggaatggaccgatcacactggccaggagaattcttggaaacccaaaaaacaggctgaaaaaacctggactgcactcgggtttgcgactgacgaataccaatggctgcaaatcgacttaaataaagaaaaaaagattaccggaattattacgactggtagcaccatggtgactattacaatgtgtcttcccacagaatcatgcactgtgatgatgggacgaaacggcctctgcacagagagcctcgtggagcaggataagatcttccaggggaataaggattaccaccaggatgtacgcaataatttcttgcccccaatcatagcacgctttatccgctag

SEQ ID NO: 25899 - DNA, 1884 bp, Artificial Sequence
  Description of Artificial Sequence: Synthetic coding sequence
atgaatctcatcttccataaggacatcctattcggaattccagcaaacaaggtgccacaggatgaatggaccggatatacacctagaggcaaggatgatgagatcccttgccggagaatgcggagtggctcatatataaaagccatgggtgacgaagattccggggactcggacacgtccccaaagccttcacccaaggtggccgcccgcagagaaagttacttaaaggcaactcagcccagtctgacggagctgaccactctgaagatctcaaacgaacactcaccaaagctacagattagaagccattcatatcttcgggctgtgagcgaggtgtcaattaaccggagcttagactctctggaccctgctggtcttttaactagtcccaagttccgctcgaggaatgagtcctatatgcgggcaatgtctacaatctctcaagtgagcgagatggaggtaaatggtcaattcgagtccgtgtgtgaaagcgtgttttccgagctggaaagccaggccgtagaggctttagatctgccgatgccagggtgcttccgaatgcgcagccacagctatgtcagggctatcgaaaaaggctgtagccaggacgatgagtgtgtgtccctgcgtagctcctcccctccaaggacaaccaccactgtgagaaccattcagtcgagcacagtgagcagctgtatcacaacctacaaaaaaacaccaccccccgtcccacctcggacaacaacgaaacccttcatatccattactgcccagagctctacggagtctgcccaggatgcttatatggatggacagggccagaggggcgatataattagtcagagcggactttctaactccaccgaatccctggactccatgaaggcccttacagctgccatcgaagctgcaaacgcacagatccatggcccggcgtcacagcatatgggaaacaatacggctaccgtgacaaccacgactacaattgctacagtcacgaccgaagacaggaagaaagaccatttcaaaaaaaataggtgtctatctattgggattcaagttgatgatgccgaagagcccgataagacaggcgagaacaaggccccatcaaagttccagagcgttggagtccaggtcgaagaggaaaaatgttttcggcgctttacccggtccaacagcgtgactaccgccgttcaagccgacctcgattttcatgataatctggagaactctctggagtccattgaggataattcatgtcctggccccatggcgcgtcagttttcacgcgacgccagcactagtaccgtatcaattcaaggctctggtaatcactatcacgcatgtgctgcagacgatgacttcgatacagatttcgacccgagcattttgccgcctcccgatccgtggatcgattctataaccgaagatcctctggaggcagtgcagcgctcggtgtgtcatcgcgacggccactggttcctaaaactgctccaagctgaacgggatcggatggagggatggtgtcagcagatggaacgggaagagcgcgaaaataacctgccggaggatattctcggaaaaatccgcacagcagtgggctccgcacagctcctgatggctcaaaaattctatcagttcagagagctctgcgaagaaaacctgaatccaaacgcccacccccgtcccacttcacaagatttggcagggttctgggacatgttacagctcagcattgagaacatcagtatgaagttcgacgaattacaccagctcaaggcaaataattggaaacagatggatcctttggataagaaggtggaacaatgtcggttctgtatggttcatctcaagacatgcacaaacacgggtcagtccaaatag

SEQ ID NO: 25900 - DNA, 2082 bp, Artificial Sequence
  Description of Artificial Sequence: Synthetic coding sequence
atgatcgatctgtttaaagctgaatgggtttcaagcgtctgtgtgcaggtgtcccgaaatggaaggactgatcaagtgccgcaagatgagtggaccgggtacactcctcgaggcaaggacgatgaaatcccatgccgaagaatgcgcagtggatcatacattaaggccatgggcgacgaagattctggagattctgataccagccctaaaccctctcccaaggtagcagctcgtcgggaatcttacctcaaggcgacccagccatctctaacggagttaacgacattgaaaatttctaacgaacactctcccaaactgcagattaggagccactcttatcttagagccgtttcagaggtgtccatcaacaggagtctggattcattggatcccgcaggcctcctaacatcaccaaaatttcgctccagaaatgaatcatatatgagagccatgagcactatctcacaagttagcgaaatggaagtcaatgggcagttcgagagtgtctgcgagagcgtcttcagcgagttggagtcccaggcagtggaagccctggaccttcctatgcccggctgctttcgtatgagaagccacagctacgtgagagccatcgaaaagggttgtagtcaggacgacgagtgcgtcagtttgcgctcaagctcaccacctagaaccacaaccaccgtccggacgatacagtcgtcaactggcgttattaagttatcctccgccgtggaagtcagcagctgcatcaccacctacaagaaaactccacctccggtccccccccgcaccacaacaaaaccattcattagtatcaccgcccagagcagcaccgagtctgcccaggatgcttatatggatggtcagggccaaaggggcgacattatttctcaaagtggtctgtctaatagcacagagtcactagatagtatgaaagcgttgactgcagccattgaagccgccaatgcccagattcatggccccgctagccagcatatgggcaataacaccgccaccgtcactacaacgaccacaatagccacagtcactactgaggacaggaaaaaagatcactttaaaaaaaaccggtgcctctccatagggattcaggtggacgatgcagaagaacctgataagacaggtgaaaacaaagctccgagtaaattccagagtgtgggagtgcaggtcgaagaggaaaaatgctttaggcgttttactagaagcaatagtgtgaccacggccgtacaggctgacctggatttccatgataatctggagaacagcttagagagtatcgaagataactcttgtcccggccctatggctcgacagttctccagggacgctagtacctcaacggtctccattcagggatccggtaaccactaccacgcatgcgctgctgacgacgatttcgacaccgactttgacccctccattctgcccccacctgatccatggattgactcgataaccgaggatccgctggaagcggtccaacgatccgtgtgtcatcgtgacgggcattggttcttgaaattgctccaggcagaacgtgaccgcatggaagggtggtgtcagcagatggaaagagaggaaagggaaaataacctgccagaggatatccttggcaagatccggacagctgtggggagcgctcagttgcttatggctcagaaattctaccagtttcgagagctctgcgaagagaatctaaatcccaacgcacaccctagacccacaagccaggacttagccggcttctgggacatgctacagctttccattgaaaatatttcaatgaagtttgatgagctgcaccagctgaaggccaacaactggaagcagatggatccattggacaaaaaagagcggcgggctcctccacctgtgccaaagaagcctgcgaaaggacccgctccacttattagagagaggtctctggagtcgtctcaacgacaagaagcccggaagaggctcatggccgcaaagcgggccgcatctgtgcggcagaactccgcgacagagtcagccgagagcattgagatctacatccctgaagcacagacaagattatag

SEQ ID NO: 25901 - DNA, 2052 bp, Artificial Sequence
  Description of Artificial Sequence: Synthetic coding sequence
atgatagacctcttcaaagcagagtgggtgtcctctgtgtgcgttcaagtgtctaggaacgggagaaccgatcaggtgcctcaggatgaatggactggctatacaccaaggggcaaagacgacgaaattccatgcaggcggatgaggtcggggagctacatcaaagcgatgggcgatgaagacagcggcgattctgacacttcccctaagccaagtcctaaggtcgcagcaaggagagagagctacctaaaagccactcagccaagcttaaccgaacttaccacactgaagatttccaacgaacatagtcccaaactgcagattcgatcccacagctatcttcgtgccgtttccgaagtgagtataaacaggagcctcgacagcctggatccggcagggctgctgacctcccccaaattccggtcacgaaacgagtcttatatgcgggctatgtccacgatatcacaggtgagcgagatggaggtgaacggacaatttgaaagcgtctgcgagtccgtcttttcagaactggagtcccaagccgtagaagccctcgacctgccaatgccaggttgcttccggatgcggtctcattcttacgtacgggctatcgagaaagggtgctcccaggacgatgagtgcgtctctctgcgtagttcatccccccccaggacaaccaccacagtgcggacgatacagtcatcaacagtttcctcctgtataactacctataagaaaacgcctccaccagtccccccccgcactacaaccaaaccattcatctccattacagcccagtcatccactgaatctgcgcaagacgcgtacatggatggccagggtcagaggggcgacattatttctcagagcgggctatccaacagcacagaatctctcgacagcatgaaagcccttaccgccgcgatcgaggctgccaatgcccagatacacggtcccgcctcccagcacatgggtaacaacaccgcaaccgtgacaaccactacaaccattgcaacagtaaccacggaggacagaaaaaaagaccattttaagaaaaatcgctgtttgagcattggcatccaggtagatgacgccgaagaacctgacaagacaggtgagaacaaagcaccatctaagttccaaagcgtaggagtccaggtggaagaggaaaagtgctttagaagattcacccgtagtaatagcgtgacaaccgccgtgcaggccgacttggatttccatgacaacctggagaatagtctggagagcatcgaagataattcttgccccggccccatggcccgacagttctcacgcgacgcctctacttcaaccgtcagcatacaggggtccggtaatcactaccatgcttgcgcggcagatgatgacttcgatacagacttcgatccctccatcctgcctccccccgatccgtggatcgattcaataactgaggatcccctggaagctgttcagcgtagcgtgtgccaccgagatgggcattggtttctcaaactgctgcaagcggagcgggacaggatggagggctggtgtcaacagatggagcgtgaggagagagagaacaaccttccagaggacatactggggaagattagaaccgctgtcgggtctgctcagctgttgatggcccagaaattctaccagtttcgcgagctatgtgaggagaacctcaatcccaatgcccaccccaggccaaccagccaggatctggccggtttttgggacatgcttcagctctcaatagaaaacatctcaatgaaatttgacgagttacaccagctgaaggctaacaactggaaacaaatggatcctctggacaagaaggagaggagggctccgccacctgttcctaagaaacccgccaaggggcccgcccccctgatacgggaacggagtcttgaatcctcccagcgccaggaagccagaaaaagactgatggccgccaagagagcggcaagtgttcggcaaaacagcgccactgagtcagcagagagtattgagatctacattcccgaagcacaaacccgcctctag

SEQ ID NO: 25902 - DNA, 2790 bp, Artificial Sequence
  Description of Artificial Sequence: Synthetic coding sequence
atgaagggtttatccgggagtcgatctcatcaccacggcgttacgtgtgactcagcctgcgattccctctcccaccacagcgaccggaaaccatacctcctctcgccggttgaacaccatccagccgatcacccttactacacacagcggaattcatttcaggctgagtgtgtgggccccttcagcgacccactcgcgagttcaacgttcccacggcgtcactacacttcacagcaagagctgaaagacgaatgtgccctggtgccacggactctcgccactaaagccaaccgaattcctgcaaatttactcgaccagttcgaacgtcaactgccactcagtagagatggctaccacactcttcagtataagagaaccgccgtagagcaccgtagtgacagccccggcagaatcaggcacctggtccacagtgtgcagaagctttttaccaagagccattccttagagggaccctctaagggaagtgtaaatggtggaaaagcctccccagatgaagcacaagccgcgagatacggcaaaagaagcaagtcaaaagaaaggcgagcagaacctaaggcaagaccatccacaagtcccggttggtggtcttcagatgacaacctggatggggatatgtgcatttatcacgctccttccggtgtcatgacaatgggcaggtgtcctgacagatcagcaagccagtacttcctcgaagcctacaacacgatttctgaacaggcagtgaaggcgtccaggtctaataatgatgtgaaatgctcaacctgtgccaatttaccggtgagtctggatacgcctcttctcaagaaaagcgcctggtcgagcaccctgactgtgagccgcgcgcgggaggtgtaccagaaggcaagcgttaacatggatcaggcaatggttaagtctgaaagctgtcagcaggagcgctcttgtcaatacctgcaggtacctcaagatgaatggaccggctatacccctcgggggaaggacgacgagattccctgtcgccggatgcgttcagggagttacattaaggccatgggagacgaggactccggggatagtgatacttctccaaaaccttcacccaaggtggcagccaggagggaaagttacctcaaggccactcaaccaagtctaaccgaactgacaacactcaaaatttctaatgagcacagccctaagctccaaattcgctcacattcatatctgagagccgttagcgaggtgtccattaatcggtcgctcgattcgctggaccctgcggggctgctaacatcacccaagtttagaagcaggaatgagtcttacatgcgagccatgtcaacaataagccaggtgagcgagatggaagtcaatggacagtttgagagcgtatgtgaatccgtgttctccgagctagaaagccaggccgtggaggcccttgatctgcccatgccaggctgcttccgtatgagaagtcattcgtacgttcgggccattgaaaagggttgttcgcaggatgacgagtgtgtcagcttaagatcctcctccccccccagaacaactacaaccgtaagaacaatccagagtagcactgtgagctcttgcatcacgacctacaaaaaaactcctccaccagtacccccgcgcacgacaacaaaacccttcatttcaattactgcccaatcctctaccgaaagcgcgcaggacgcttatatggacgggcaggggcaacgtggtgatattatctcccaaagcggcctaagtaattcgactgaatcactggattccatgaaagctctgactgccgcaatcgaggccgccaatgctcagattcacggacctgcttctcagcacatgggtaataataccgcgaccgtgacgacaaccacaacgattgctacggtcactaccgaggatagaaaaaaagaccatttcaaaaagaatcgctgtctgtctattggtatacaggtggacgatgccgaggagccggataaaactggcgagaataaggccccatcgaaattccagtccgtgggggtgcaggttgaggaagagaaatgcttcaggcggttcaccaggtctaattccgtgactactgccgtacaggccgacttagattttcacgacaaccttgagaactccctggaatccatcgaggataacagctgtcccggaccaatggccagacaattttctagggacgcatcaacaagtaccgtatccatccagggttccggaaaccattatcacgcatgtgcagctgatgacgatttcgatactgacttcgacccatccatcctcccaccacctgacccatggatagatagtatcaccgaagatccactggaagctgtgcagaggagcgtctgccaccgagatgggcactggtttttgaagctactccaggccgagagggatagaatggaaggttggtgtcaacagatggagagagaagaacgagagaataacctgccggaggatattctgggaaagatcaggactgcagttggatcagcacagctcctgatggcccagaagttctaccaattcagggagctgtgcgaggagaacctgaatcctaacgctcacccgcggcctaccagccaggacctggccggcttctgggacatgctgcaactatctattgagaatatttcaatgaaatttgacgagttacaccagctgaaagccaacaattggaagcagatggatcccttggataagaaagtcgagcagtgcagattttgcatggtgcatctcaaaacttgcaccaataccggtcagagcaaatag

SEQ ID NO: 25903 - DNA, 2934 bp, Artificial Sequence
  Description of Artificial Sequence: Synthetic coding sequence
atgaagggcctctctgggtcaaggagccatcatcatggtgtcacgtgtgactctgcgtgtgacagcctttcgcaccactctgataggaaaccctaccttctttccccggtggagcatcatccagccgatcatccctactatactcagcgcaactccttccaggcagagtgcgttgggccgttctccgatcctctcgcctcttctacctttccacgccgccattacacaagccagcaagagctcaaagatgagtgtgcgctggtgcccaggacattagctaccaaggcaaatcgaatccccgcaaacctcctggatcagttcgagcgacagttacctctgtcccgtgatggttatcataccttacagtataaacgaacagccgttgaacaccgaagtgacagtccgggtaggattagacatctggtgcactcggtacaaaagctgttcactaaaagtcactccttagagggaccaagcaaagggagcgtcaatggagggaaggcctccccagacgaagcccaggccgcacgatatggcaaacgcagcaaatctaaggaacggagggccgagcccaaggccagaccttctacctcccccggatggtggtcttccgatgataatctggacggcgacatgtgcatataccacgcacccagcggggtgatgaccatgggtcggtgcccggaccgtagtgcttctcagtactttctcgaagcttacaacactatcagtgaacaggcggtgaaggcttccaggtctaataacgacgttaagtgcagcacatgtgccaatctccccgtctcattggacacccccctgcttaaaaaatcagcctggagttctacgcttacagtctcacgtgcgagagaggtatatcagaaggctagcgtcaatatggaccaggcaatggtgaagagtgagagctgccagcaggaacgctcgtgccagtatttgcaggttcctcaggatgagtggacaggctacacaccgagaggaaaagacgacgagattccgtgtagacgaatgagaagcggttcttacatcaaagctatgggtgacgaagattccggggatagcgacacctctcctaagccgtcgccgaaggtggctgctaggagagaaagttatctaaaagcaacacagcccagtctcactgaactcaccactttaaaaatctcaaatgagcatagcccaaaattgcagatacgatcccactcttaccttcgagccgtcagcgaagtgagcataaataggtccctagatagcttggatcctgcaggtctgctcacgtctcctaaatttcggagtaggaatgagagctacatgcgcgctatgagtacgatctcacaagtctcagagatggaggtcaacggccagttcgagtccgtgtgtgaaagcgtgtttagcgagctggagtcccaggccgttgaggccctcgacttaccaatgcccggttgctttaggatgagaagtcactcctacgtccgcgcaattgagaagggctgtagccaagacgatgaatgtgtctcgctgcgaagctcctcaccccctcgcaccactactacggtgaggaccatacagagctccacagtctcctcttgcatcactacctacaaaaaaaccccacctcctgtgcctcctaggacaaccaccaagccttttatctctatcacagcccagtccagcactgagtcagcccaggacgcatacatggatgggcaagggcagaggggcgatattatttcacagagcggattgtccaacagcactgagagtctggattctatgaaagctcttaccgccgctattgaggccgctaatgcccagatccacggtcccgcctcacagcacatgggcaacaacactgcaacagtgactactaccaccaccatcgcaacagtgaccacggaggaccggaagaaagatcatttcaagaagaatcgctgcttgagcatcggaatccaggtcgacgatgccgaagaacctgataaaactggggagaataaggctccatctaaatttcagtctgtcggagttcaggtcgaggaggagaaatgctttcgcagattcacccgctctaatagtgtgacaacggcagtgcaggctgacttggactttcatgacaatcttgagaacagtcttgaatccatcgaggataactcatgcccgggcccgatggctagacagtttagtcgggatgccagtacgagcactgtcagcatccagggcagcggtaaccattaccacgcgtgtgccgcagacgatgatttcgatacagacttcgatcctagtattctgccccctccggacccgtggatcgactctatcacagaggatcctttggaggcagtccagagaagcgtgtgtcacagagacgggcattggtttttgaagctgctgcaggctgagagggaccgcatggagggctggtgtcagcagatggaaagagaggagagggaaaacaacctccctgaagacatcctgggaaaaatcagaactgcggtggggtcagctcagctcctgatggcccaaaagttttatcagtttagagagttatgtgaagaaaacctgaatcctaatgcacatcctaggccaacaagccaagacctcgcggggttttgggacatgctccaactctctatcgaaaacatctcaatgaagtttgatgagcttcaccagctgaaggccaacaactggaaacagatggacccccttgacaagaaagagcggagagccccaccccccgtgcctaaaaaacccgccaagggaccagcgcccctgatccgcgaacgcagcttggaaagcagtcagcgtcaagaggccagaaaacggttgatggctgccaaaagggcagcgagcgtgagacagaactccgccaccgagagcgccgagtccatcgagatctacatacccgaggctcagacacggttatag

SEQ ID NO: 25904 - DNA, 2028 bp, Artificial Sequence
  Description of Artificial Sequence: Synthetic coding sequence
atgaatctgatctttcacaaggatattctcttcggtatacccgccaataaggtgccccaggacgagtggaccggatatacaccccgaggaaaggacgatgagattccctgccggcgaatgaggtccggatcttatattaaggcgatgggggatgaggacagcggggactcagacacttcccctaagccgagccctaaagtggccgcgaggcgcgaaagctatttgaaagctacacaacccagcctcaccgagttaaccacactgaagatatcgaatgagcatagtccaaaactgcaaatccgaagtcactcctacctgcgggcagtaagcgaagttagcataaaccggtccctcgattcccttgaccccgccggactcctcactagtcccaaatttagaagccgaaatgaatcctatatgagagctatgtccaccataagtcaggtgagtgaaatggaagtgaacggccagttcgaatctgtgtgcgagagcgttttctctgagcttgaatcacaagcagttgaggccctagatctgccgatgcctgggtgcttccgcatgaggagtcattcctacgtaagggctattgagaaagggtgcagtcaggatgacgagtgtgtctccctgcgcagctctagtcctcccaggacaaccaccacggttcggaccattcagtccagcactgtcagttcctgcataacgacatacaagaagacgcctccgcctgtgcctccccgcacaacaactaaaccgttcatctccattacagcacagtcctccaccgaatcagctcaggatgcatatatggatggtcagggccagagaggggacataattagccagtcagggctatctaatagcaccgagtctttagatagtatgaaggcgttgacagcggcgatagaagctgcaaatgctcagatccacggccctgcatcccagcacatgggaaacaatacggccacagtgacaacgacaacaaccattgccacagtgaccactgaagatagaaaaaaggaccattttaaaaagaatagatgcttatctattggaatccaggtggatgacgccgaggagcccgataagacaggagagaacaaggcccctagcaagttccagagtgtcggagttcaagtggaggaggaaaagtgtttcagacgattcacgcgttccaattctgttaccacagccgtgcaggccgacttggacttccacgacaacctcgagaatagtctcgaatctatcgaagataattcttgtccggggcctatggcgaggcagttctccagagatgccagcaccagcaccgtgtccattcaggggtccggtaaccactatcatgcctgcgctgctgacgatgacttcgacacggattttgacccaagcattctgcctcctcccgatccctggattgactctataactgaggatcccttagaagcagtccaacgatcagtgtgtcatagggacggtcactggtttctgaagctcctgcaggcggagcgcgataggatggaaggctggtgccagcagatggaacgggaggagcgggagaataacttaccagaggacatccttggaaaaattagaacagctgtcgggagtgcccagctgctgatggcccagaaattttaccagttcagagaattatgtgaagagaacctcaatccaaatgctcatcctcgtcccacgagtcaggacctagccggtttttgggacatgctgcagctgagcattgagaacataagcatgaaattcgacgaactgcaccagctgaaggcaaataactggaagcagatggacccactggataagaaggagcgcagagcaccaccccctgtcccaaaaaaacctgccaagggaccagcccccctcattagggagaggtctttggagagttcccagcgccaagaggcgcggaagcgcctcatggctgctaagcgcgctgcatccgtccggcaaaactctgcaaccgaatcggctgaatccattgagatctacatacccgaggcgcaaactcgtctgtag

SEQ ID NO: 25905 - DNA, 2790 bp, Artificial Sequence
  Description of Artificial Sequence: Synthetic coding sequence
atgaagggactctcaggctctagatcccaccatcatggtgtcacctgtgattccgcttgtgattcactgagccaccacagcgaccgaaagccatacctcctttctcctgtagagcaccaccccgcggatcacccctattacacacagaggaactcattccaggccgagtgtgtgggacctttttccgaccccttagcaagtagtacatttcctagaaggcattacacaagtcagcaggaattgaaggacgagtgcgccttagttcctcgtacactcgctacgaaagccaatcgtatccctgctaatctgctcgaccagtttgaaaggcagctgccactctccagggatggttatcatactcttcagtataagaggacagctgtggaacatcggagtgacagccccggccgcatacgccatttagtgcactcagtgcaaaagctattcactaagtcccattccttggaggggccttctaagggttctgtgaatgggggtaaagcaagcccagacgaggcccaagcggcaaggtacggcaaacgttcaaagtcaaaagagaggcgagctgagcctaaggcccggcccagcacgtcccccggttggtggtctagcgacgacaatctggacggggatatgtgtatctatcacgctccctccggtgtaatgacaatggggcggtgccccgatcggagcgcatcccagtactttttggaagcctacaatactatatctgaacaggccgtgaaggcgtctaggagtaacaatgacgtaaagtgtagcacatgcgcgaatctgccagtatcactggataccccgctgttaaaaaagtcagcttggtcttctactctcaccgtgtcccgtgccagggaggtgtatcagaaagcatcagtcaacatggatcaggccatggttaaatccgagagctgccagcaggagcgttcctgccagtatcttcaggtcccccaagacgaatggactggatacacaccacggggaaaggacgacgaaatcccgtgcaggagaatgcgttcaggtagctatattaaggcaatgggggacgaggattctggcgactccgatacttcccccaaaccgtcgcccaaggtggctgcgcgccgcgagtcctaccttaaggccacacagccttcacttaccgagctgacaaccttgaagatttctaatgagcatagccctaaactgcagatccggtcacatagttatttgcgggccgtgagcgaagtgtctatcaacaggtccttggattctttagatccggccggattacttaccagccccaagtttagatcacgtaacgagagctatatgagggcgatgagcaccatctcccaagtaagcgaaatggaggtaaacggccagttcgaaagcgtctgcgagtcggtcttctccgagctggagtcccaggctgtcgaagcactggacctgccgatgccaggctgtttcaggatgcgtagccacagctatgtgcgggcaattgagaagggctgctctcaagacgacgaatgcgtaagtctgcgatcctcctctcctccccggacaaccaccaccgttcgaacaatccagtcctccactgtctctagctgcataaccacctacaagaagacgccaccgcccgtccctcctaggacaaccaccaagccattcatctcaataaccgcccagtctagtactgagtccgcgcaggacgcctacatggatgggcagggccagcggggggatatcatctctcagtccggcctgagtaatagcaccgagtctctggattccatgaaggcacttactgccgccatcgaggctgcaaatgcccaaatccatggcccggcatcccagcacatgggtaacaatacagccacggtcacaaccacaacaaccattgctacagtcacaactgaagaccgaaagaaggatcattttaagaagaatcggtgtttatcaattggaattcaggtcgatgatgccgaagagccagataagaccggagagaataaagctccttcaaaattccagtccgtgggtgtgcaggtcgaggaggaaaaatgttttcgtcgattcactagaagcaactcagtgactaccgcggtgcaggccgacctcgacttccatgacaaccttgagaatagcctggagtcaatcgaggacaatagctgtccgggtccaatggctaggcagttcagccgtgacgcaagtacgtccacagtgagtatccaggggagcggcaaccactaccacgcatgtgccgctgatgacgatttcgatactgatttcgatccctctatcctgcctccaccggatccctggatcgattcaatcacagaggacccacttgaggctgtgcagagatcagtgtgccacagggatggacactggttccttaagctcttgcaagccgaacgcgacaggatggaggggtggtgccagcaaatggaacgggaggagagggagaacaacctgcccgaggacatcctggggaagatcagaacagctgtgggtagcgcccaactccttatggctcaaaagttttaccagttccgggagctgtgcgaggaaaacctgaaccctaatgcacacccccggcccacgtcccaggatttggccggcttttgggacatgctgcaactcagtatcgaaaacatctctatgaagttcgacgaactccatcaactgaaggccaacaattggaagcagatggatccactggataaaaaagtcgagcagtgtcggttctgcatggtgcacttgaagacatgcacaaacaccggtcagtcaaagtag

SEQ ID NO: 25906 - DNA, 1986 bp, Artificial Sequence
  Description of Artificial Sequence: Synthetic coding sequence
atggacctgaagaccctgaagctgtttaactcccagctcagatgcggctggttgctgtacatctggaataaggcgtttatggctcatctgagggtgccgcaagatgagtggactggctacaccccccgggggaaagacgatgagataccctgtcgccgtatgcgatccggcagctacatcaaggcgatgggagacgaagactcgggtgatagcgatacgtctcctaaacctagtcccaaggtggccgctcgaagggagagctatttgaaagcaacccagcctagtctgaccgagctcaccaccctcaaaataagcaacgagcattctcccaaactgcagatcagatctcattcatacctgcgcgcggtcagcgaggtcagtataaaccggtcactggactccctagaccctgccgggctgctcacttctccaaaattccgttcccggaacgaatcatatatgagggcaatgagcaccattagtcaggtatcagaaatggaggtcaacgggcaatttgagtcggtgtgcgaatctgtgttttccgagcttgaatctcaagcagtggaggcacttgacctccccatgccaggttgttttcgtatgcggagccactcatacgtccgagccattgaaaaagggtgttcccaggacgacgaatgcgtgagtctgcgatcctcctcaccaccacggacgaccaccacggttcggaccattcagtccagcacagcgcagtctagtacggaatctgctcaggatgcttacatggatggacaaggccagcggggggatatcatcagtcaatcaggcctttccaacagtaccgagtcccttgatagtatgaaggctctgactgccgcaattgaggccgccaacgcccagattcatggcccggccagccagcacatgggaaataataccgctacagtaactacgaccaccactatcgccacagttacaaccgaggacaggaagaaggatcattttaagaaaaacaggtgcctctccattggcatccaggttgatgatgcagaagagccggacaagactggcgaaaataaagccccttccaagttccaatcggtgggagtgcaggtcgaggaagaaaaatgctttcgccgcttcactagaagtaacagtgtcactaccgcagtgcaggctgacctggattttcacgacaatctggaaaacagcctggaatcaatcgaggataacagctgcccaggccccatggccaggcaatttagtcgagatgcctccacttccaccgtgtccattcagggctcaggcaaccactatcacgcttgcgccgctgatgatgatttcgacacagactttgatcctagcatcttacctccgccggatccttggatcgattcaatcacagaagaccccctcgaggccgtccaacggagcgtgtgtcacagggatggacattggttccttaaattactccaggccgagcgcgacaggatggaggggtggtgtcagcaaatggagcgggaggaaagagagaacaatctgccagaggacatcctgggtaaaatcaggactgcggtcggctctgctcagttgttgatggcacagaagttctatcaatttcgcgagctgtgcgaggagaatcttaaccctaatgctcatccaaggccgacctctcaggatttagccggtttttgggacatgctgcagctcagcattgagaatatctcaatgaaattcgatgaactgcatcagctgaaggccaataattggaagcaaatggacccactggataaaaaggagcgccgcgctccccctcccgtgccaaaaaaaccagccaaggggccagcaccattgattagggagagaagtctcgagtcctctcagcgacaggaggcccgcaagaggctgatggctgctaagagggccgcatcagtgaggcagaactcagccacagagtcagcagagagtattgaaatttatattccggaggcgcaaactcggctctag

SEQ ID NO: 25907 - DNA, 2058 bp, Artificial Sequence
  Description of Artificial Sequence: Synthetic coding sequence
atgaacttgatctttcacaaggatatccttttcggaattcccgccaacaaggtacctcaggatgaatggacagggtacaccccccgcgggaaggacgacgagataccctgcagacgaatgcggagcggttcatacatcaaggcgatgggcgatgaagacagtggcgattccgacacatcaccgaaacctagtcccaaggtagccgctagaagagagtcctatcttaaagcaacacaacccagtttgactgagttgactaccctcaagatctcaaatgagcacagcccaaaactgcagatccggtcccatagctatctgagggccgtctccgaagtatccatcaacaggagtctggattccttggatccagctggactgctgacaagccctaagtttcggagtcggaatgaatcatacatgagagcaatgtcgactatttcacaagtaagtgagatggaggttaatggccagttcgagtccgtctgtgaatccgtgttttccgagctggagtctcaagccgtggaggctctggacctaccgatgcctggctgcttccgcatgcgatcacactcctatgtgcgggcaatagagaaaggatgcagtcaggacgatgaatgtgtgtcccttaggagttctagccccccgagaacaaccacaaccgtgcgaaccattcagtcatctacaggggttattaagctgtcttctgccgtggaggtatcatcctgcattaccacatacaagaagacaccacccccagtgccccctcgtacaaccacgaagccatttatttctatcaccgcacagagctcaacagagtccgcccaggacgcctacatggacgggcaggggcaacgtggagacatcatcagccaatccggactgtctaattccactgaaagtctcgatagcatgaaagccctcacagctgcaatcgaagccgcaaacgcccagattcatggtccagcctcacagcatatggggaacaatactgctaccgtgacaacaaccactacaatcgcaactgtcactaccgaggaccggaagaaagaccacttcaaaaaaaacaggtgtctttccatcggaattcaggtggacgacgctgaggaacctgacaagactggagaaaacaaagcacctagcaagttccagagcgtcggcgtgcaggtcgaggaagagaagtgtttcaggcgctttacccggagcaatagcgtcaccacagccgtgcaggccgatttagactttcacgacaacctggaaaatagcctggaatccattgaggacaacagctgccccggacccatggcccgccagttcagcagggacgcctcaacaagcactgttagcatacagggctccggcaaccactaccacgcctgcgcagccgacgatgattttgacaccgattttgacccatctatcctgcctcctcccgatccctggattgacagcattaccgaagatccgcttgaagcagtccagcggagcgtctgccacagagacgggcattggttcttgaaactgttacaggccgaacgcgaccggatggaaggatggtgccaacagatggagcgagaagagcgcgagaataacctgcccgaggacattcttggcaaaattcggacagctgtggggtctgctcagctactgatggcccagaagttttatcagtttcgagagctctgcgaagaaaacctcaacccaaatgcacatcctcgacccacaagccaggatctggctggcttttgggacatgctgcaactgtccatcgaaaacatctccatgaaatttgacgagctccaccagctcaaggccaataattggaagcagatggaccctctggacaagaaggaaagacgggctcctccccctgtgcctaaaaaacctgccaaagggcctgcaccactcatccgagaacggtctttggaatcttcccagagacaggaagcccggaaacgactgatggcggccaagcgtgcagcttccgttaggcagaacagcgccacagagtccgcagagagtattgagatttatatccctgaagcacagacccgcctgtag

SEQ ID NO: 25908 - DNA, 2196 bp, Artificial Sequence
  Description of Artificial Sequence: Synthetic coding sequence
atgggaagcgaaaaagacagcgaatccccacggtctacctctctccatgccgctgctccagaccctaaatgccgctcaggaggccggcgacgtaggcttactctgcactccgttttttcagcttccgctcgcggtcgaagagcacgggctaaaccccaagcggaaccacctccaccagccgcacagcctccgccagctcccgcgccagctgctgcgcaagggcctcccccagaagctctgccagctgagcccgcagctgaagcagaggctgaggccgctgctgccgctgccgaacctggcttcgacgacgaagaggcagccgaaggtggagggcccggagcggaggaagtggaatgtccgctttgcttggtgcggctcccgccagaaagagcccctcggttattgtcgtgtccccaccgttcttgtcgggactgtctacgccactatctcagactggagatctcagagagtagggtgccgatctcatgccccgaatgtagcgaaagactcaatccccatgacatccggctcctgctggcagatcctcctttaatgcacaagtacgaagaatttatgttgcggcgttacctggcttcggaccctgactgccgatggtgtccggcaccagattgtggatacgctgttattgcgtatggttgcgcatcttgtcccaagctgacgtgtgagagagagggatgccagacagagttttgttaccactgcaagcagatttggcatcccaaccagacatgcgatatggctaggcagcaaagagctcagaccctgagagtaaggaccaaacatacatccgggctgtcctatggccaggaatccggccccgatgacattaaaccctgtccccggtgcagtgcatacatcatcaagatgaacgatgggtcttgcaaccacatgacttgcgctgtgtgcggctgcgaattttgctggttgtgcatgaaagagatctcagacctgcattacctatcacccagtggctgcacgttctggggaaaaaagccatggtccagaaagaagaaaatcctgtggcagcttggtacattgatcggggcgccggtgggcatatctctcattgcaggtatagcaatccctgccatggtcattggtatacccgtgtatgtgggcagaaaaatacactcgcgatacgagggcaggaagacaagcaaacacaaaagaaacctcgcaattaccgggggggtaacattgagtgtgatcgcctcccctgtgattgccgcggtatctgttgggattggtgtaccaattatgttagcgtacgtgtacggcgtggttccaatttccctgtgcagaggcgggggatgtggggtttccaccgcaaatggaaagggcgtgaagatcgagttcgacgaggatgatggtcctatcactgttgccgatgcctggagagccttaaagaacccgtccattggcgagtcttcgattgagggactgacctcagttctgtcaacgagcggaagccctactgatggcctgtcagtcatgcaggggccctattcagagaccgcctcttttgcagcgttaagcggcggtaccctttctgggggaatactgtcctcgggcaagggaaagtactccagactggaggtgcaggccgatgtacagaaagagatattccccaaagacacagcatcattgggcgcaatctccgacaatgccagtacacgagcaatggcagggtcaatcattagctcatataacccacaggaccgggaatgtaacaatatggagattcaagtggatattgaagcaaagccttcgcattatcagctggttagcggatcttctacggaggactcattgcacgttcacgcccagatggcggaaaatgaggaggagggcagtggagggggcggcagcgaggaagaccccccatgccgtcatcaaagctgcgagcagaaagactgcctcgcctctaagccttgggatatttctctcgcccagccagagagcatccggtcagacctcgaatctagcgatgcacagtcagacgacgtgcctgacattacttctgacgagtgtggtagtccgcgctcccatacagcagcgtgtccaagtacgccgcgcgcacagggcgcgccatcaccctcggcacacatgaatcttagcgccctggcagaaggtcagaccgtgctaaagccagagggtggcgaggcccgtgtgtag

SEQ ID NO: 25909 - DNA, 2940 bp, Artificial Sequence
  Description of Artificial Sequence: Synthetic coding sequence
atgcgtggataccatggtgatagaggctcacatccaagacccgcccggtttgctgaccagcagcacatggatgtcggccccgctgcccgggcaccatatctccttggctctcgagaagccttttcaacagaacctagattctgcgccccaagggccggactgggtcacatttcccccgaaggccccttgtccctgtctgaggggccgtccgtaggccccgagggtggaccagctggggctggcgtaggggggggaagctctacttttcccaggatgtaccccggccagggcccatttgacacttgtgaggactgtgtggggcacccccagggcaagggcgcacctcgcctcccccctactcttctggaccagttcgagaaacaattgcccgtgcagcaggatggatttcacactttaccctaccagcgcggacctgccggagcagggcccggtcctgccccggggaccggaaccgcccccgagcctcgcagcgagtcaccatccagaattcggcatctggtgcacagcgtacagaaactgttcgctaagtctcactccctggaagcccccggcaaacgcgattataatggtccaaaagccgagggaaggggaggatcagggggcgatagctatcctggacctggttctggcggaccacatactagccaccaccatcaccatcaccatcatcaccaccaccatcaaagcaggcacggcaagcgtagcaaatctaaagatcgtaaaggcgatggaagacatcaggcaaagagtacagggtggtggtcaagcgatgataatctggactcagattcaggattcctcgccggaggtcggcctcctggggagcctggcggaccattctgcctggaaggccccgacggtagctacagagatttgtcttttaaggggagaagcgggggtagtgaaggcagatgtttggcatgcacagggatgtctatgtcccttgacggacagtccgtcaaacggagcgcctggcataccatgatggtgagtcagggtcgcgacggatacccaggggccggcccgggcaaaggcctgttggggcctgagacaaaggccaaagccagaacttaccattatctgcaggttccccaagatgactggggagggtaccccacaggtggcaaggatggcgaaatcccttgcaggcgtatgcgctccggaagctatataaaggccatgggcgacgaggaatctggagacagtgatggttcacctaagacttctcctaaggcggtcgcacggcgcttcactacaaggcggagctcatctgtagaccaagccaggatcaactgttgcgtgccccccagaatccatcccagatctagcattccgggctatagccgatccctgactaccggccaactgtcggacgagttgaatcagcagctcgaggccgtgtgcggcagtgttttcggggaactggaatcccaggctgtggatgcactggatctgcccggatgctttcgcatgagatcacatagctatctccgggctatccaggccggatgctcacaggatgacgactgtctgccccttctggccaccccagctgcggtaagcgggaggcctgggtcaagttttaacttccgcaaagctccacccccaatacctcccgggagtcaggctcccccaaggattagtatcaccgctcaaagttccactgactccgcccacgaatccttcactgcagccgaaggcccagctaggagatgctcatccgctgacggtctcgacggccctgccatgggggcacgaactctggagctcgcccctgtaccccctcgcgcctccccgaaaccaccaacattaatcatcaaaactatccctggacgggaagagcttcgcagcctagctagacagcgaaaatggaggcctagtatcggcgtgcaggtcgaaaccatctccgactccgatacagagaatcgtagcaggcgcgagttccatagcatcggagtacaagtagaggaggacaaacgtagggccaggtttaaaagatctaacagcgtgacagctggcgtgcaggctgacctcgaactggaaggcttagccggtctcgccacagttgccacagaagacaaagccctccagtttgggagatcgttccagaggcatgccagtgaaccacagccaggtcccagggctccaacatatagcgtctttcgtactgtacacacacagggccagtgggcatatagagagggctaccctctgccatacgagccaccagccactgacgggtctccgggcccagctccggctccgactccagggcccggtgcgggacgcagagatagttggatcgagagagggagtcgctctctgcccgattccggcagagcttcgccatgcccccgggatggtgaatggttcattaagatgttgagagctgaagtagagaagctcgagcattggtgccagcagatggaaagggaagcagaagactatgagttgcccgaagaaattctcgaaaagattcgctcggcagtgggctccacgcagttactgctgagccagaaagtgcagcagttttttcggctctgccaacaaagcatggatcctaccgccttccctgtgcccaccttccaagacctcgctggattctgggacctgctgcaactcagcatcgaggacgtgaccttaaagtttctagagctgcaacaattaaaagctaacagctggaaactacttgaaccaaaggaggaaaagaaggttcctcccccgatacccaaaaaacctttgcgcgggagaggtgtgcctgtaaaggaacgttctctggactcggtcgaccgtcagaggcaggaagctcgcaagcgcctcttggcagcaaagcgtgcggcatcatttagacactcatctgcaacagaaagcgcagattctatcgagatctatattcccgaagcccagacacgactgtag

SEQ ID NO: 25910 - DNA, 798 bp, Artificial Sequence
  Description of Artificial Sequence: Synthetic coding sequence
atgtcaatgagtttggatggtcagtccgtgaagcgatccgcttggcacaccatgatggttagtcagggtcgagatgggtatcccggagccgggcccggaaaaggactgctggggcctgaaactaaagcgaaggcccgaacctatcattacctacaggtgcctcaggacgattggggcggttatcccactggcgggaaggacggggaaattccgtgccggcggatgagatcggggtcttatattaaggcgatgggggatgaggagtctggagattccgatggttcacccaaaaccagtccaaaggccgtggcccgtcgattcaccacaaggcgcagctcttctgtggaccaagctcgtataaactgttgcgtgccaccacgcatacaccctcgcagtagcattcccggttatagcaggtctctcactacggggcagctgagtgacgaactcaatcaacaaatggaacgtgaggccgaggactatgagttgccagaagagatcttggaaaaaatcaggagcgcggtgggaagtacacagcttctcctaagccaaaaggtccagcagtttttccgcctctgtcaacaatctatggacccaacagccttcccagtgcctaccttccaagacctggccggtttctgggatctcctgcagttaagtatagaggacgtcaccctcaagttcctggaattgcagcagctgaaggccaacagttggaaactgctggagcccaaagaagagaaaaaggtacctcctccaatcccaacaagacctcccggaccatctcactctaggtag

SEQ ID NO: 25911 - DNA, 2211 bp, Artificial Sequence
  Description of Artificial Sequence: Synthetic coding sequence
atggccggcagctccaccggaggaggtggagtgggagagacaaaagtgatttaccacctggatgaggaagagactccctatttggtaaaaataccagtgcccgcagagcgcataaccctcggggactttaaaagcgtcttgcagagaccagccggagcgaaatattttttcaagagcatggatcaggattttggtgtggtcaaggaggaaatctccgacgataacgctcgactcccttgcttcaatggacgcgtggtgagttggttagtttcctctgataatccacagcctgaaatggcgccacccgtacacgaaccccgagctgagctggcccctcccgctcctccacttcccccccttccgccagagagaacatccggaatcggcgacagccgaccccccagcttccatccaaacgtgtcctcaagccatgagaatctggaaccagaaaccgagaccgagtccgtcgtgagcctgaggcgcgaacggccacgcaggcgcgatagctcagagcacggagctggtgggcatagaaccggaggtccttctcgcctagaacgtcacctggccggatacgaaagtagctctaccctcatgactagcgaactggaaagcacatcactaggagatagtgacgaagaagatactatgtccaggtttagtagttctacagaacaaagcagcgcctcgcggttgctgaagcgacatcgacgtcggagaaagcagcgccctcccagattggaacgcacatcatcattcagttcagttacagacagtacaatgtcgcttaacattatcacggtgaccctgaacatggagaaatacaactttcttggcatctcaattgtgggccaatccaacgagcgaggggacgggggaatctatatcgggtccattatgaagggcggcgctgtggccgcagatgggcggattgaaccaggagatatgttactgcaggtcaatgacatgaattttgaaaacatgtctaacgatgacgccgtacgcgtactgagagacatcgtccacaagcctggaccgatagtcttaacagtggcaaagtgttgggacccctcgccacaggcatacttcacactgccaaggaatgaacccatacagcccatcgatccagctgcatgggtctcacactctgccgctctgaccggaaccttccccgcatatcctggttcatcatcgatgtccaccataacctcaggttcgagtcttccagacggttgcgaaggtagaggcctcagcgtccataccgacatggcgtcagtgactaaggctatggccgcacccgagtctggactggaggtgagggaccgcatgtggctcaagattacaattccaaatgcttttctcgggtccgacgtagtcgactggttgtaccaccatgtggaggggttccccgagagacgggaggcccggaaatatgcttctgggctgctcaaggctgggctaattcggcacacggtcaacaagattaccttttccgagcagtgctattatgttttcggagatctgagtggggggtgtgagagctatctcgtgaacctttccctcaatgacaacgacggaagctccggagcatcagaccaggataccctggcccccctgccaggtgcaaccccatggccgctgttgcccaccttcagctatcagtatcctgccccacacccctattctccccagcctcctccctatcatgaactcagttcctacacctatggggggggatctgcaagctctcaacatagtgaggggtctcgaagctccggctccaccaggtccgacggcggcgccggaagaaccggacgccccgaggaaagggctcccgagagcaagtctggttctgggtcagagagtgaaccttcttcaagaggcggttcactgaggcgggggggcgaggcctctggcacaagcgacggggggccccctccatctcggggcagtacaggaggagctccaaacttgcgcgcccacccagggttgcacccctatgggcctccccccggtatggccctgccatacaaccctatgatggtggtaatgatgcctccgccaccaccacccgtgcctcccgccgttcagccaccgggagccccccccgtgcgagacctggggtcagtgccgccagagctcaccgcttcgaggcaatcatttcatatggctatggggaatccgtcagagttctttgtcgacgtaatgtag

SEQ ID NO: 25912 - DNA, 4575 bp, Artificial Sequence
  Description of Artificial Sequence: Synthetic coding sequence
atggcaatgtccaacggcaataacgatttcgtggtgctttctaacagctccatcgctacatccgctgctaatccatcccctctgaccccatgtgatggcgatcacgccgctcagcagctcaccccaaaggaggcgacccggaccaaagtctcaccgaatggctgcttgcagcttaacggaactgtgaagagtagctttcttcccctggataatcagcgaatgccccagatgctgcctcaatgctgccacccctgtccttatcatcatcccctgacctcccactcctcccaccaggaatgtcatcctgaggctggaccagcagcaccctctgctctggcgtcatgttgtatgcagcctcactctgagtattctgcatctctctgccccaaccactcccccgtctaccagacaacctgttgtttacagccttctccctctttctgcctgcaccatccatggcccgaccatttccagcaccagcccgtgcagcaacacatcgcaaacatccgcccaagccgccctttcaagctgccaaagagctacgctgccctgatcgctgattggccagtggtggtgttaggcatgtgcacgatgtttattgtggtttgcgcccttgtgggagttctcgtgccagagctccccgacttctctgaccctttgctcggatttgagcctcgcggcaccgcgattggccagaggctcgtcacttggaacaacatggtaaagaacacgggctacaaagcgaccctcgccaactaccccttcaaatacgccgatgaacaggctaaatcccacagagatgataggtggagtgacgaccactacgagagagaaaaacgcgaagttgactggaacttccacaaggactctttcttttgtgacgttccctcagatagatattcccgcgtggtgttcacaagcagcggcggggaaacactttggaatctgccggcgattaaaagcatgtgtaacgtggataactctcgtattaggagccatccccagttcggagacctgtgccaacggacgactgctgcttcctgctgtcctagttggactctgggaaactatatagccattctgaataacagaagttcgtgtcagaagatcgtagaaagagatgtgtcccataccctgaagctgctacgaacttgtgccaagcattaccagaatggaactctgggaccagactgctgggacatggccgctcgcagaaaggaccagttgaaatgcaccaacgtccccagaaagtgtacaaagtacaacgcagtataccagattcttcattatcttgtagacaaggacttcatgacaccaaagacagccgactatgccacacccgctctgaaatatagcatgctcttcagccctaccgaaaagggcgagtccatgatgaacatctaccttgacaactttgaaaattggaactcctcggacggggttactaccatcacagggattgagttcggtatcaaacatagcctctttcaggattacctcctgatggacaccgtgtatccagccatcgctatagtaattgtcttattggttatgtgtgtgtatactaagagcatgtttataacactgatgacaatgtttgctataatctccagcctgatcgtgagctattttctgtaccgggtggtgtttcacttcgaatttttcccatttatgaatctaacggctctgattatccttgttggaatcggggcggatgacgcatttgtcttgtgcgacgtgtggaattacactaaatttgataagccccatgccgagacatccgaaactgtcagcataacactgcaacacgcagccctttcaatgttcgtcacttccttcacaaccgctgcagcattttatgctaactatgtgtccaacattacagccattcggtgctttggagtgtatgccggtactgcaatcctcgtaaattatgtgctcatggtgacgtggctcccagcagttgtcgtcttgcacgagcggtaccttctgaacatcttcacatgttttaagaagcctcaacagcagatctatgacaataaaagttgctggacagtggcctgccagaaatgtcacaaggtcctctttgcaatatcagaagcaagtagaatcttttttgagaaagtgttaccttgcatcgtgatcaaatttagatatttgtggctcttctggtttctggccctcacggttggaggcgcatatatagtctgcatcaatccaaagatgaagctaccgagccttgaactctccgagttccaggtctttcggtcttctcatcccttcgaacgctatgatgccgagtataagaagttgtttatgttcgagcgggttcaccacggcgaggagctccacatgcctattaccgttatttggggggtctctcccgaggacaatggaaatccactcaaccctaagtcaaaaggaaagttgactctcgattcatccttcaacatagcaagccctgcaagccaggcctggatcctccatttctgccaaaaacttcggaaccagacattcttttaccagaccgatgaacaggattttacctcttgttttattgaaacctttaaacagtggatggagaatcaggactgtgacgaacctgcactctatccctgttgttctcactggagcttcccctataaacaggaaattttcgagttatgcattaagagagcgatcatggagttagaacggtctaccgggtatcatctggattccaagacacctggtcctcgttttgatattaatgacactatccgtgctgtcgtgcttgaatttcagtccacttatctttttactcttgcctacgagaagatgcaccagttttacaaagaggtggattcgtggatttcaagcgaactgtcctcagcccccgaagggctatccaacggctggtttgtgtcgaacctggagttttatgatctgcaagactctttgtctgatggaacgctgatagccatgggtttaagtgtcgctgtggcattctcagtcatgctgctcaccacgtggaatatcatcattagtctgtatgctatcataagtatcgctggtaccatatttgtgacagtaggcagcctggtgctgctgggctgggaactgaacgttctagagtcagtcacaataagcgtcgcagtgggattgagcgtggacttcgctgtgcattacggtgtggcgtatcgtttagcacccgatccagatagagaagggaaagtgattttcagcttgtcacgtgttgggtctgccatggccatggcagcactgacaacattcgtggcaggagccatgatgatgccatccacggtgctggcttatacccaactcgggacctttatgatgctgattatgtgcatctcctgggcttttgctacctttttcttccagtgcatgtgccgttgcttgggccctcaggggacttgtggccagatccccctgccaaagaaactgcagtgctctgctttttcccacgctttaagcacaagcccctcagacaaaggacagtcaaaaacacataccatcaacgcttatcatctggacccacgtggccccaagagcgagctggaacacgaattttatgagctggaacctctcgcaagccactcgtgcaccgcccctgaaaaaactacgtacgaggagacacacatctgctcagagttcttcaatagtcaagccaagaatctcggcatgcccgtgcatgccgcatacaattccgagttatcgaagagcaccgaaagcgatgctggatccgccctgctgcagcccccactggagcagcacaccgtctgtcactttttctctctgaaccaacgatgcagttgccccgatgcttataagcatctgaactacggaccgcactcctgtcaacagatgggcgactgtctatgccatcaatgctcacctactactagctcctttgttcagatccagaacggagtcgcaccactcaaagctacgcaccaggctgtggagggatttgttcacccaatcacccacatacatcactgcccctgtttgcagggaagagtcaaacccgccgggatgcagaatagcctgcctcgcaactttttcctgcacccagtgcagcacatccaggctcaggagaagattggcaagaccaacgtacatagcttgcagcgctctatagaagagcatttgccaaaaatggccgagcctagttcgtttgtttgtcgcagtacaggctcattactcaagacatgttgtgacccagagaacaagcagcgcgaactgtgtaaaaacagagatgtatctaatctcgaatcgtctgggggcactgagaacaaggctggcggtaaggtcgagctttcgcttagccagacggatgcgtctgtcaactccgagcactttaaccagaatgaacctaaggtgttgttcaatcacctcatgggagaagcaggatgcagatcctgtccgaacaactcccaaagctgtggtcgcattgtgcgcgtgaagtgcaacagcgtggattgtcagatgcctaatatggaagcaaacgttcccgcagtgttaacccacagcgaactgtcaggtgaaagcctgttgatcaaaacattgtag

SEQ ID NO: 25913 - DNA, 555 bp, Artificial Sequence
  Description of Artificial Sequence: Synthetic coding sequence
atggcaatgagcaatggtaacaacgatttcgtcgtgctctcaaactcatcaattgctacctccgcagctaatccttccccacttactccatgtgatggggaccacgccgctcaacagctcacacccaaggaggccactcgaactaaggtgagcccgaacggatgtcttcagctgaacggaaccgtcaagtcctctttcctgccattggataatcagcggatgccacagatgcttccacaatgctgtcatccttgtccctatcaccatccactgacttcccacagtagccaccaggagtgccatcctgaggcggggcctgccgccccgtctgcattagcatcatgttgcatgcagcctcacagtgaatactcggcatcgttgtgcccaaaccacagcccagtctaccagacaacatgttgcctacagccatccccatccttctgtctgcaccatccttggcccgatcacttccagcatcagcctgtgcaacagcatatcgctaacatcaggttcacacgaaaaacaaaatgcgctagctggctcctccaaatgtag

SEQ ID NO: 25914 - DNA, 4206 bp, Artificial Sequence
  Description of Artificial Sequence: Synthetic coding sequence
atggacggtgattcctcgtcgtcttccggtgggtctggtccagcacctggcccgggtcccgagggcgagcaacggccagaaggagaaccactcgcaccggatggaggcagcccagatagtacgcaaaccaaagcagtaccaccagaggcttcccccgagagaagctgctctctgcattcgtgtccactagaggatccatcctcatcatctgggcctccgcccaccaccagtactttacagcccgttggaccctcgagtcctttggcccccgcccactttacttatcctcgggctctgcaggagtaccagggcggaagctcacttcctggccttggcgatagggcggccctgtgttctcatggctctagcctgtcccctagccccgccccaagccagcgcgacggcacatggaagcccccagctgttcaacatcacgtggtgagtgtgcgccaggagcgtgcattccaaatgcctaagtcatattcccagctgattgcagagtggccggtcgccgttctgatgctttgcctggctgttattttcctgtgcacattggcgggactgctgggagcacggctgccggacttctcgaaacctctgctgggattcgagcctcgagacacggacataggaagcaagttggtcgtctggagagccttgcaggccctaactggccccagaaagcttctgtttctgagtcctgatctggaactcaatagttcttcatctcacaacactctcagacccgcccctagaggttccgctcaggagtctgctgttcgccctaggcgaatggttgagccattagaggacaggcggcaagagaatttcttctgcggaccccccgagaagagttatgcaaagctcgtgttcatgtcaactagttcggggagcctgtggaacttgcacgcaattcatagtatgtgcaggatggagcaggatcagataaggtcacacacaagctttggcgccctctgtcagcggaccgcggccaaccagtgctgtccctcttggtcattgggaaactatctggctgtattgtcaaacaggtcctcgtgtctggatactacacaagccgacgccgctaggacattggccctgcttagaacatgtgcattgtactatcacagcggagcattggtcccatcttgcctgggacctggacagaataagagtccccgatgcgcgcaggtccctaccaagtgttcccagtccagcgctatataccagcttctacatttcttgctggaccgtgactttcttagccctcaaaccacagactaccaagtcccatcactgaagtattctctgctgttccttccgacacccaaaggagcctcactgatggacatctacttagataggttggctacaccttggggacttgccgacaactacacatccgtgactggcatggacctcggcctgaagcaggaactgctgcggcacttcctagtgcaggacacggtttaccccctcctcgccctggtggcgatcttttttggaatggctctgtatttgcgctcccttttcctgaccttgatggtcctgctgggcgtactcggatccctcttagtggcattttttctctaccaggttgcattccgaatggcctattttccgttcgtcaacctggctgcgctgctcctcctgagttccgtatgtgctaatcataccctcatcttttttgacctctggagactttctaaatcccagctccccagtggaggtctggcccagagagtaggacgcaccatgcaccacttcggttatctcctgttagtctctggactcaccactagcgccgccttctatgcttcatacctctctcggttgccagccgtgaggtgtctggcattgtttatggggaccgccgtgcttgtgcaccttgctctgacactcgtgtggctcccagccagcgccgtgttgcatgaacgctatctggctcggggctgtgcgcgccgggcgagaggtcgctgggagggttcagccccccggcgtctactactcgccttacaccggagactccgagggctgagaagagctgctgccggaactagtcgccttctgtttcagcgactgctgccttgtggggtgattaaatttcgatacatttggatctgttggtttgccgcattagccgctggaggggcttacatcgctggagtatccccaagactccggctccccactctgccacctcctggcggccaggtctttcgaccaagccacccattcgagagattcgacgccgagtaccgacagctttttctcttcgagcagctgccgcagggagaagggggacatatgcccgtggtgctggtctggggggtacttcccgtagacactggcgaccctttagatccaagatctaacagctccctggtcagagatcccgctttttctgcctccggccccgaggcccaacggtggttactcgccctttgccacagggccaggaatcagagtttctttgacacacttcaggagggttggcctaccttgtgtttcgtggagaccctgcagaggtggatggagagcccctcttgcgccagactagggcctgacttatgttgtggtcactctgacttcccctgggccccccagtttttcctgcattgtttgaagatgatggcccttgagcagggccccgacgggacccaggatctcgggctgcgattcgacgctcacgggtcattagcagctttggttcttcagtttcagaccaatttcaggaactccccagattacaatcagacccagctgttctacaacgaggttagccactggctcgcggcagaactgggaatggctcccccaggcctgagaagaggctggtttacctccaggctggagttgtattcactgcaacactcactttcaactgaacccgccgtcgtgctcggcctggctcttgcgctggcctttgccacgctgttgctgggaacctggaacgttcccctctccctgtttagcgttgccgccgtggctggcaccgtgttgcttactgttggcctgttagtcttactcgaatggcagctgaatacggctgaggctctgttcttgagcgcgagtgtaggactgagtgttgactttactgtgaactactgcatctcctaccacctgtgcccccatccagacagactatccagagtcgcgtttagtctccgacagacttcatgcgcaactgctgtgggcgctgcggctctattcgctgctggcgttcttatgctgcccgccaccgtgttactgtacaggaaattgggcatcattctcatgatggttaaatgtgtatcctgcggattcgcaagtttctttttccagtcactgtgctgcttcttcggcccagagaaaaattgcggacagatcctctggccgtgcgcccatctgccatgggatgctgggacaggggatcctggtggggagaaggccggcaggccacggccagggtccgttggcggcatgcccggctcttgttcggaacagtacgagctgcaaccacttgccaggcgccgatctccttcctttgatacatccactgcgacatccaagcttagtcaccgcccatccgttctgagtgaagatctccagttgcacgatggcccatgctgttcccggcccccacctgcgcctgcttcaccaagggagctgctgctggatcaccaggccgtcttttctcaatgccccgcgttgcagacctcctccccatataagcaagccgggcctagcccaaagacgcgagctcgtcaggattcacaaggagaggaagcagagccactacccgcatcacctgaggcccctgcccactctccaaaagcgaaggccgcggacccgcccgacggattctgtagcagcgcgagtacactcgaaggcctgagcgtttctgacgaaacttgcctgtctacaagtgagccctccgcccgagtgcctgatagtgtgggagtgtccccggatgatctggatgacaccggacagcctgtccttgaaagaggtcagttaaacgggaagcgggataccctgtggctcgcgttgcgggaaacagtttacgacccatctctgcctgccagccatcacagcagcctatcatggaaagggcgcggtgggcccggggatggttcacccgtcgtgctgccaaatagtcaacctgatctgccagatgtttggctcaggagaccttccacgcacacaagtggatattcctcgtag

SEQ ID NO: 25915 - DNA, 1416 bp, Artificial Sequence
  Description of Artificial Sequence: Synthetic coding sequence
atgggcgggacacaggtaaagtgtctcacttccccctcacctatacacagcgctaaatcagaatccatcataactcaaagcgaggaaaaggccgatttcgtgatcatccccgccgaaggtatcgagaaccgtaccgagggcaccgatagtccattgtccagggattggcgccccggtccagggacctaccttgagaccagctgggaggagcagctcctcgaacagcaggaatacctggagaaagagatggaagaagccaagaaaatgatatcaggcctccaagcgctgctgctcaatgggagcctgccggaggacgagcaggagaggcccctggctctctgtgagccgggtgtgaaccctgaggaacagttgataatcatccagtctcgcctcgatcaatcaatggaggagaaccaagatttgaaaaaggagctgttgaagtgcaagcaagaggcccggaatttgcagggaatcaaagatgcgcttcagcagcggctgacccagcaggacacatcagtcctccagctgaaacaagagctcctgcgggctaatatggacaaggatgagctgcataatcaaaatgttgacctccagcgtaagctggatgaacgcaaccgcctgcttggcgaatacaaaaaggagctgggccagaaagatcgcctgttgcagcagcaccaggcaaaactcgaagaggcactacgcaaactatccgacgtgagctatcaccaagtggatctggaaagggaactggagcacaaggacgtgttgctcgcgcactgcatgaaaagggaggccgacgaagcgaccaactataactcccacaactcacagtccaacgggttcctgcttcctaccgcgggaaaaggagctacgtccgtctccaatcgaggcacctcagatctgcagctggtgcgagatgctcttagatcactccggaatagtttctcggggcacgatccacagcaccatactattgatagcttggaacaggggatctcctccctgatggaacgattgcacgtaatggagacccagaaaaaacaggaacggaaggttcgcgtgaagtccccgcggactcaggtcgggtctgagtatagagagagttggcctcctaattcaaaattaccccacagccagtcatcgccaaccgtaagctcaacttgtaccaaagtcctgtactttactgaccggtcgctgactccctttatggtgaatatccccaagcggctagaagaagtgacattgaaagactttaaggccgctatcgaccgggaagggaaccacagatatcacttcaaggctctggatcccgaatttggaaccgtgaaggaagagattttccacgatgatgatgctataccagggtgggagggaaagatcgtcgcgtgggttgaggaagatcatggagagaattag

SEQ ID NO: 25916 - DNA, 2049 bp, Artificial Sequence
  Description of Artificial Sequence: Synthetic coding sequence
atgctcgcctgtttaactagaggcaatctgctcgatgtgcttcaggagggattcaatgagcagcagctgcaagcttatgtcgcgtgggtcaatgcccaactcaagaaacgtccagccgtgaaaccagttcaggacttacgccaggacctacgcgacggcgtcattttggcatatttgattgagatcgtggctggcgaaaagctcagcggcgtgcagctttctcccggcaaccagcaggagatgaagaacaatgtcgagaaagtcctgcaatttgtcgcgagcaaaaagattaggatgcaccagacgtcagctaaggacatcgtcgacggaaatctcaaatccatcatgaggctggtgttagctttggcagcccattttaagccgggcagcagtagaaccgtcaatcagggcagggattccagggctccattgcagagccacaggccgcactgtgccacagccgttgcccagggggcggcggcggcgcttgctgacgtttgccacgatatgtccagaagtggccgggatgtcttcaggtatcgacagcggaacagtagcatggacgaggaaatagaaaacccgtattggtccgtccgggcgctggtgcagcaatacgagggccaacagcgctccccctcagaaagcagttgctcatctcttactagcccttcaccgatccatagcgccaaaagcgagtcaattattacacagtctgaggagaaagccgactttgttatcattcccgccgaagggattgagaaccgcactgaaggcacggactcacccctctcccgcgattggcgacctggccctgggacatatctggaaacctcatgggaagagcaactgttagagcaacaggaatacctggagaaagaaatggaggaggcaaaaaagatgatttccggactgcaggccctgctgctgaatggttcgctacccgaggacgaacaggaaaggccgttggccctgtgcgagcccggtgtgaaccctgaagaacagctgataatcattcagagccgcctggatcagagcatggaagagaatcaagaccttaaaaaagaactcctcaagtgtaagcaagaagccagaaatctccaaggcatcaaggatgcccttcagcaacggctgactcagcaggacacctctgtgctgcagctgaagcaggagcttctgcgggccaatatggacaaggacgagctccacaatcagaacgtggatcttcagcgaaagcttgatgaaagaaataggctactgggggaatataagaaagagctggggcagaaagatcgtcttctgcaacagcaccaggccaagcttgaggaggcattgaggaaactgtctgatgtgtcctaccaccaggtggacttagagcgggaactagagcacaaggacgttctcctggcacattgtatgaagcgggaggccgatgaggcgactaattataactcacataacagccaatctaacgggtttctgcttcctaccgccggcaagggcgccacctctgtttctaacaggggcaccagtgatctgcagttggtgagagatgccctaagatctctgagaaactctttttctggccacgacccccagcaccatacgattgacagcctagaacaagggatctctagcctcatggagagactgcacgtgatggagacccagaaaaaacaagagagaaaagtgcgcgtgaagtccccaagaacccaagtaggaagtgagtatagggaaagctggccacccaatagcaagctaccccactcccagagcagccctacagtgtcttctacctgcaccaaggtcttatactttacagatagatcactgacgccctttatggttaatatcccaaaaagacttgaagaggttaccctgaaagatttcaaggcggcaatcgacagggagggcaatcaccgatatcatttcaaagcattagatccagagtttgggacagtcaaagaggagatctttcacgacgatgatgcaatcccagggtgggagggaaaaatcgtggcctgggtagaagaagatcacggcgagaactag

SEQ ID NO: 25917 - DNA, 660 bp, Artificial Sequence
  Description of Artificial Sequence: Synthetic coding sequence
atgttagcgtgcctgacacggggaaatctgttggatgtgctccaggaggggttcaacgagcaacaacttcaggcgtacgtggcctgggtcaacgcccagctcaagaagcgacctgctgtcaagcctgtgcaagatttaagacaggacctccgggacggagtcattcttgcctaccttatcgaaattgttgcaggcgagaagctttccggggtccaactctcccctggtaatcaacaggagatgaagaacaatgtggagaaggtgctgcaattcgtggcaagcaaaaagattcggatgcaccagacctccgccaaggatatagtggatggcaacttgaaaagcatcatgagactggtgttggcgttggccgcccacttcaaaccagggtctagtcggacagttaaccagggccgcgactcacgtgctccactccaatctcacagaccccattgcgccactgctgtcgcgcagggcgcagctgctgcgttggccgatgtatgtcacgatatgagtcgatccgggcgagatgtgtttagatataggcagcggaattcctctatggatgaagaaatagagaacccatattggtccgtgagagcattggttcagcagtacgagggccagcagcgaagccccagtgaatcctcctgctctcgctag

SEQ ID NO: 25918 - DNA, 1140 bp, Artificial Sequence
  Description of Artificial Sequence: Synthetic coding sequence
atggaaggcaatcgcgacgaggccgaaaagtgtgtggagatcgcaagggaggctctgaatgcaggaaatagagagaaggcccagaggtttttgcagaaagccgagaagctttacccactccccagcgccagggcattgttagaaatcatcatgaagaacggatctactgctggcaactctccacactgcaggaaacctagtggaagtggagaccaaagcaaacccaactgcaccaaggactccacaagcgggtcaggggagggaggaaaaggctatactaaggaccaagtggacggggtcttgtcaataaacaagtgtaagaattactacgaggtgttgggggtgacaaaagacgctggagacgaagacttaaaaaaagcgtacaggaagttggccctgaaatttcacccagataaaaaccatgcccctggagctacagacgcttttaagaagatagggaacgcgtacgccgtgctgtctaacccggaaaaacgaaagcaatatgatctcaccggaaatgaagagcaggcttgcaatcatcagaataacggtcggttcaatttccacagagggtgcgaggctgacattactccagaagatctctttaatatttttttcggcggcgggtttcccagtgggagcgttcactcgttctccaatggcagagcaggctacagtcagcagcaccagcatcgacattctggtcatgagcgggaagaagaaagaggagacgggggcttttcagtgtttatacaactgatgcccatcattgtgttaattcttgtgagtcttctcagtcagctgatggtgtctaacccaccatacagcttgtaccccaggtctggcacgggacaaaccatcaagatgcaaactgagaatctgggggtggtttattacgtgaataaagattttaaaaacgaatacaagggcatgttgctgcagaaggtcgaaaagtcagtggaagaggactatgtgacgaacatccgcaacaattgttggaaagagcgccagcagaagacggatatgcagtacgccgctaaagtgtaccgggatgacagactgagacgcaaagccgacgctttgtcgatggataactgtaaggaattagagagactcacttcactttacaagggtggctag

SEQ ID NO: 25919 - DNA, 1014 bp, Artificial Sequence
  Description of Artificial Sequence: Synthetic coding sequence
atgggcaaagactactactgtatattgggaatcgagaaaggcgcttccgacgaggatataaaaaaagcatacaggaaacaggcactgaagttccatcctgacaaaaacaagtcccctcaggctgaagagaagttcaaagaggtcgccgaagcttatgaggtgctgtctgaccccaaaaaacgtgagatttacgatcagttcggcgaagaagggttgaagggcggagccggcgggacagatggacagggtggcacttttcgatacactttccatggtgatcctcacgctacatttgccgccttttttggggggagcaatcctttcgagatattttttggcagacggatggggggcggtcgagatagtgaggagatggaaatagacggagaccctttcagcgcgttcggattttcaatgaacggttatccacgggaccgcaacagcgtaggtccgagcaggctgaagcaagatccgcccgtaattcatgaactgcgtgtctccctggaggagatctactccggatgtactaaaaggatgaaaatttcccgtaagagactgaatgccgatggaagatcataccggagcgaggacaagatactgaccatagaaatcaaaaaaggatggaaggaaggtacaaagatcacattccctagggaaggggatgagaccccaaatagcattcccgccgacattgtcttcatcataaaagataaggatcacccaaaatttaagagagacggttctaacatcatttataccgctaagatctctctgagagaggccttgtgcggatgttcaatcaacgttcctaccctcgatggccgaaacattcctatgtctgtcaacgatatagtgaagcccggaatgcggcgtagaatcattggatacgggctgccattcccaaaaaatcctgatcagcggggagacctgctgatagagttcgaggtcagtttccctgacacgatttcttcatcaagcaaagaagttctcaggaagcacctgcccgctagctag

SEQ ID NO: 25920 - DNA, 519 bp, Artificial Sequence
  Description of Artificial Sequence: Synthetic coding sequence
atgggaaaagactactactgcatcctgggtattgagaaaggagctagcgacgaggatatcaagaaagcctatcgtaagcaggcccttaaattccaccccgataagaacaagagccctcaggcggaagagaagtttaaggaggtcgcggaagcctatgaagtgttgagtgatcctaaaaaaagggagatatatgatcaatttggagaggagggcctcaagggtggggcgggaggtacagacggtcagggcggaacattcagatacacttttcacggagatccacatgctacttttgctgcttttttcggcgggtctaaccccttcgagattttcttcggccgccgaatgggaggcggccgagactccgaggaaatggaaattgatggagatcccttttcagcttttgggttctcaatgaacggttaccccagagatagaaattccgtcggtccctcaagattgaaacaagacccccccgttatccacgaactgcgggtcagcttggaggaaatctattag

SEQ ID NO: 25921 - DNA, 1083 bp, Artificial Sequence
  Description of Artificial Sequence: Synthetic coding sequence
atgggggccccgctgctgagtcccggatggggcgccggagctgcgggaagacgatggtggatgttgttagcacccctgctacccgcactgctcctggtgaggccggctggagcccttgtagagggactgtactgcgggactcgggattgttacgaggtgctcggagtctctaggagcgccgggaaagctgagatcgcccgcgcttacagacagctggccaggcgctaccatccagatcggtaccgcccacagcccggggatgagggccctggccggacaccccagagcgctgaagaggcattcctgcttgtagcgacagcctatgagactctgaaggatgaagagactcgcaaggattacgattacatgctcgaccacccagaagaatactatagccattattaccattattattcaaggcgcctcgctcccaaagtcgacgtcagagtggttatacttgtatctgtttgcgcaatctctgtcttccaatttttttcctggtggaatagctacaacaaggctatctcatacctcgccactgtgccaaaataccggatccaggccacagaaattgccaagcagcaagggctactgaagaaagctaaagagaagggaaagaacaaaaagtctaaagaggaaatccgggatgaagaagagaacattatcaagaatatcataaaaagtaagatcgatatcaaaggaggctaccagaagcctcagatctgcgatctactgctgtttcagatcatcctcgcccctttccacctctgtagctatattgtttggtattgccggtggatatataatttcaatattaagggtaaagaatacggagaagaagaacgcctgtatatcatcagaaagagcatgaagatgagcaagagccagtttgatagcctcgaggatcaccagaaggagaccttcctcaaaagagaactttggatcaaagagaactacgaggtgtacaaacaggaacaggaggaggagttgaagaaaaagctggcgaacgaccctcgatggaaacgctaccggaggtggatgaagaacgaaggtcccgggaggctgaccttcgtggacgattag

SEQ ID NO: 25922 - DNA, 462 bp, Artificial Sequence
  Description of Artificial Sequence: Synthetic coding sequence
atgggcgccccacttctgtcaccaggatggggagctggcgctgcagggcgccggtggtggatgttgctcgccccattactgcctgctctgttactggtgcggcccgctggcgccctcgtggaaggactgtattgtgggaccagagactgctatgaggtgctgggcgtttccagatcagcgggaaaagccgaaatcgctcgcgcatatcgacaactggccaggcgctaccaccctgataggtaccgaccacagccgggtgatgaagggccaggacgcacgcctcagtctgccgaggaagctttccttctggtcgctacagcctatgaaaccctcaaggtctcccaggctgccgcagaactgcaacagtattgcatgcagaatgcatgcaaggatgcacttctcgttggtgtgcccgcaggttccaacccattccgggagccccggtcctgtgccctcctgtag

SEQ ID NO: 25923 - DNA, 330 bp, Artificial Sequence
  Description of Artificial Sequence: Synthetic coding sequence
atgactgccccttgcagtcagcccgcacaactgcctgggcgacgccagttaggcttggtgccatttccacccccacctccaaggactcctcttctttggttgctcctcctcctgcttgcagccgtggccccggcgcggggttgggaatctggcgacctagaactcttcgacctcgttgaggaggtccaattaaacttctaccagttcctgggtgtacagcaagatgctagctcagctgacattcggaaggcctacaggaagctgagcctcaccctgcaccctgacaagaataaagatgagaacgccgaaacacaattccgccaagtgtag

SEQ ID NO: 25924 - DNA, 1665 bp, Artificial Sequence
  Description of Artificial Sequence: Synthetic coding sequence
atgaccgccccatgctcacaacccgcccaattgccaggaaggcggcagctgggccttgtccccttccctccacccccaccccgcactcccctactctggctgctgctgctcctgttagccgcggtggcacccgcccgtgggtgggagtccggcgatctcgagctgtttgacctggtggaggaggtgcagctgaatttctatcagttcctcggcgtgcagcaggatgcctcgtctgcggatattagaaaagcttaccgcaaactctccctgactttgcatcctgataagaacaaggacgaaaatgccgagacgcaatttcgccagctggttgccatttacgaggtgctgaaggacgatgagcggcgacagcgttatgacgatattctgatcaacggcctccccgactggaggcaacccgtgttctattacaggagggtccgcaagatgagcaatgctgagctcgccttacttctgtttataattctgaccgtgggccattacgctgtggtatggtctatatatttagagaagcagttggatgagctcctgtccagaaaaaaaagagaaaagaaaaagaagaccggcagtaagtctgtggatgtgtcaaagctcggagccagtgaaaaaaatgagagactccttatgaagcctcaatggcatgatctgctcccctgcaaattgggcatttggttctgtctcactcttaaagcactgccccatcttatccaagacgccggacagttttatgccaagtacaaagagacacgtctgaaggagaaggaggacgctttgacaaggacggagctcgagaccctgcagaagcagaagaaagttaagaagcctaagcccgaatttccagtgtacaccccattagagacaacatatattcagtcttacgatcacggtactagcattgaggaaattgaggagcagatggatgattggctcgagaatcgcaaccgcacccagaagaagcaggctcccgagtggacggaagaggacctgagtcagctcaccagatccatggttaaattcccaggcggcacccctggtcgatgggagaaaatagcccacgaattgggtagatctgtgactgatgtgaccacaaaggcgaagcagctgaaggacagcgtaacatgttctcctggcatggtgagactgtcagagcttaaatcaactgttcagaactctcgtcctataaagactgcaacaaccctgccagatgacatgatcacacagcgtgaggacgccgaaggggtcgccgctgaagaagagcaggagggggacagtggcgagcaggagaccggggcgaccgacgctaggccaagaagacggaaacccgccaggctcctcgaagcaaccgctaagcccgaaccagaggaaaagtcacgcgccaagaggcaaaaagatttcgatatagctgagcagaacgaaagcagcgatgaggaaagcctgcggaaagagcgggctcggtccgccgaagagccttggacccagaaccagcaaaagctgctggagcttgcactccagcagtatcctcggggttcttcggatcgctgggacaagatcgcacggtgcgtgccctctaaatctaaggaggactgcatagccaggtacaagctactagtggagctggttcagaagaagaagcaagccaaatcttag

SEQ ID NO: 25925 - DNA, 351 bp, Artificial Sequence
  Description of Artificial Sequence: Synthetic coding sequence
tagggacgcaggcagcttggactggtgcctttccccccgcccccgcctcgtacccccttattgtggctgctgctccttctgctggctgcggtagctccggcgagagggtgggagtctggagatctggaactctttgatctggtcgaggaggtgcagctgaacttctatcaatttctgggcgttcagcaggatgcatcatcggccgatatcaggaaggcctataggaaattatccctgactctgcatcccgacaagaataaagacgagaacgcagagacgcaattccgtcagcttgtggcaatatacgaggtgcttaaagacgacgagcgacggcagcggatgaactactag

SEQ ID NO: 25926 - DNA, 1524 bp, Artificial Sequence
  Description of Artificial Sequence: Synthetic coding sequence
atggcgaccgctctgtccgaggaagaactggataacgaggactactacagtctcctcaacgtcaggagggaagcctcctctgaggagctgaaagcggcataccggaggttatgtatgctctatcaccctgataagcacagggatccagagctaaaatcccaagccgagcggttgtttaatttggtgcaccaagcgtacgaggtgctgagcgaccctcaaacccgggcaatctacgacatttatgggaagcgcggtcttgagatggaggggtgggaggtcgtagagaggcggagaacccccgccgaaattagggaagaattcgagaggctgcaaagggagagagaagaaaggcggctgcagcagcggactaatccaaaggggaccatttccgtgggcgtagacgccactgatttatttgatagatacgacgaggagtatgaggatgtgtctgggtcttcgttcccccagattgaaataaataagatgcacatatcccaaagtatcgaagcaccactcaccgcaacagacacggccatactgtcaggatctttgagcactcaaaacggaaatgggggcggctcaataaactttgctctgcgcagggttacgagtgctaaagggtggggcgagctggaattcggagccggagatttacagggccctctcttcgggttgaagcttttcagaaacctcacgccacgctgctttgtgaccactaattgcgccctccagttctcttccagaggaattcgaccagggctgacaacagtgctcgcccgcaatctggataagaatacagttggctatctacagtggcggtggggcatccagtctgcaatgaacacatcaatcgttcgggacacaaaaaccagtcattttacagtggctctgcagctggggattccacactcatttgccttgatcagctaccagcacaagtttcaagatgatgatcagactcgtgtcaagggatcactgaaagccgggttttttggcacggtggtggaatacggggcagaacgcaagatctctaggcatagcgtattaggagcagctgtatcggttggggtgccacagggggtgtccctgaaggtcaaggaactggagaaacagagagagagcgccgccaccgacgtattacagaagaagcaggaagcagagagcgcagtccgcctcatgcaggagagcgtgcggcggataattgaagctgaggaaagcagaatggggctcattatcgttaacgcttggtacggtaaattcgtcaacgacaagagtcggaaaagcgaaaaagttaaggtgatcgatgtgactgttcccctgcagtgtctggtgaaagatagcaagcttattctgaccgaagccagcaaggccggtttgccggggttctatgacccatgtgtgggggaagagaagaacttaaaagtgctgtatcagtttcgcggggtgcttcaccaagtgatggtgctggactcagaggcgctccggatccccaaacagagtcaccggatagacaccgacggctag

SEQ ID NO: 25927 - DNA, 957 bp, Artificial Sequence
  Description of Artificial Sequence: Synthetic coding sequence
atgctctatcaccccgataagcaccgtgatcccgagctaaagtcacaggccgaacgcttatttaatctggtgcatcaggcctacgaggtactgtcggatccgcaaaccagagcaatctacgatatttatggaaagagggggcttgagatggaaggctgggaggtcgtggaaagacgtcgtacacccgcggagatcagagaagaattcgaaagactccaaagagagcgtgaagagagaaggctgcagcaaaggacgaatcccaagggcactatttccgtaggcgtagacgccacagacctattcgaccggtatgatgaggaatatgaggacgtttctggctcctcgttcccccagattgagattaacaaaatgcacatttcccagtcaatcgaagctccccttactgctactgatacagcaatcctctctggcagtctgtctacccaaaatggcaacgggggcggaagcataaacttcgccctgagacgggtaacgtcagccaaaggctggggagaactcgagttcggtgccggcgacctgcaaggcccattgtttggactgaaactgttcagaaatttaactccccggtgcttcgtgaccactaattgtgccctgcaatttagcagtcgaggaatccggcccggactcaccaccgtccttgctcggaatctagacaagaacactgttggatacttgcagtggcactgttcctcccccctgttacaggtccagagaccccatagaaatacccgcgcctgcgcccccgaaccaagttttagaccatttctccatgtgccaacatgggacgctgaatgctctggcgcccggacccccagcaccgcttggacttcggccgctgttaagctgagggaggcgtgcttgtccggtcccggcagcggatcacaccagctcttactgttgacaccaagaagcaagaggcgcacgggcgggggctag

SEQ ID NO: 25928 - DNA, 1410 bp, Artificial Sequence
  Description of Artificial Sequence: Synthetic coding sequence
atgaaggtggtggaacggcggaggacccccgctgaaatccgcgaggagttcgagcgcctgcaacgggaacgggaagagagacgcctgcagcaacgcacaaatcccaagggaactatctctgtgggcgtggatgctaccgatctgtttgaccggtatgatgaagagtatgaggacgtgagcggcagtagcttccctcagatagaaatcaacaagatgcatataagtcaaagtatcgaggcccccttgacagccacagacacagcaattctctccggaagcttgtccacccagaatggaaatggaggtggatcgattaactttgccctacgcagagtcacatcagcaaagggctggggcgagctcgagttcggagccggggatcttcaaggaccgctttttggacttaagctattcagaaatctcacgccgaggtgcttcgtaactacaaattgtgctctgcaattctcatcaaggggcatcaggccagggttgaccacagttctggccaggaatctggacaagaacacagtggggtaccttcagtggcgctggggtattcaaagcgccatgaatacatccatcgtgcgtgacactaaaacttctcatttcactgtcgccctccagctgggaattccacactcctttgcactgataagctaccaacataagttccaggacgacgatcagactcgagtgaagggcagtctcaaagcgggattttttggtaccgtggtcgaatacggcgcagaaaggaagatctcaaggcactctgtcctcggcgccgcggtgtcagtgggggtaccccagggagtttctctgaaggtgaagcttaatcgggcgtcacagacttacttctttcccatccacttaaccgaccagctactcccttcagccatgttttatgctactgtggggcccctggtggtgtatttcgctatgcataggctgatcattaagccttacctgagagctcagaaggagaaggaactcgagaagcagcgggagagcgccgccaccgatgtcctacaaaagaagcaggaggccgagtccgcggtgcgtttgatgcaagagagtgtccgccggataatcgaagccgaagaatcacggatggggctcattattgtgaatgcctggtacggaaagttcgttaacgataagagccggaaaagcgaaaaagtgaaggtgatcgatgtgactgtaccactgcagtgcctcgtcaaagacagcaaactgatccttactgaggcctcaaaggctggactgccaggcttctatgacccatgcgtgggtgaagagaagaacctgaaggttttataccagttccggggtgtcctccaccaggtgatggtattagatagcgaagctctgaggattcccaaacagagtcaccgaatagacactgacggctag

SEQ ID NO: 25929 - DNA, 1680 bp, Artificial Sequence
  Description of Artificial Sequence: Synthetic coding sequence
atggctaccgcgctttccgaggaagagctcgacaacgaagactattatagtctcttgaacgttcgtagagaggcctcaagcgaagagctgaaagctgcatacaggcggctgtgcatgttgtatcacccagataagcaccgtgacccggagctcaagtctcaggcagaacggcttttcaacctggtccaccaggcatatgaagtgctgtctgatccgcagacacgggccatctacgatatttacggcaagagagggctagagatggaaggttgggaggttgttgagaggaggcggaccccagcagaaataagggaggagttcgaacggctgcaacgggagagagaggagaggcggctccagcagaggaccaatcccaagggtactatcagcgtcggagttgatgccacggatctattcgaccggtatgatgaggagtatgaggatgtaagcgggagttccttccctcaaatagaaatcaataagatgcacatttcacagtcgatagaggcccctctaacggcaaccgataccgccattctgagcgggtcactgagcacacagaacggcaatggcggtggatctatcaacttcgctttgagaagagtaacctccgcaaagggatggggggagctggagttcggtgccggggatctgcagggccccctttttggtctgaagttattccgaaatctcacccccaggtgctttgtgactactaattgcgcactgcaattcagttcacgcggcatccggccaggcttaaccaccgtgctggctcgcaaccttgacaagaacaccgtgggctatctgcagtggaggtgggggatccagagtgcaatgaatacctcaatcgttcgggacacaaagacctcacacttcaccgtcgccctccagctcggaatcccccactcgtttgccctcattagctatcagcataagtttcaggacgacgaccagacacgcgtgaagggatctctgaaggccgggttcttcgggaccgtggtggagtatggcgccgagcgaaaaattagccgtcacagcgtcttaggtgcagctgtaagcgtgggtgtaccacaaggggtgtctctgaaagtgaagttgaacagagccagccagacctacttctttcctattcatctgaccgaccagctcttaccatcagctatgttttatgccactgtggggcctctagttgtctatttcgccatgcaccgactgataataaagccttacctccgtgcacagaaagaaaaagagcttgagaaacaacgggagagtgctgcgacagatgtgctgcagaagaagcaggaggctgagtcggcagtccgactcatgcaggagtcggttagaaggattatcgaagctgaggaatcaagaatgggtctgataattgtcaacgcttggtacggaaagtttgtgaatgataagtcccgcaaaagcgaaaaggttaaggtcatcgatgtgactgtccccctccagtgcttggtgaaagatagcaagttaatcttaaccgaggcatccaaggccggcctcccggggttctacgacccatgcgtgggggaggagaagaatcttaaggtgctctaccagttccgcggtgtgcttcaccaagtgatggtgctggattccgaggccctgcgcatcccaaaacaatctcaccggatagataccgatgggtag

SEQ ID NO: 25930 - DNA, 975 bp, Artificial Sequence
  Description of Artificial Sequence: Synthetic coding sequence
atggctaccgccctcagtgaagaggagctagacaatgaggattactatagcctgctgaacgtgcggagagaggcatcttccgaagagctcaaggccgcctataggcggctgtgcatgctgtaccaccctgacaagcatagagacccagaattaaagagtcaggctgagcgactgtttaatcttgtacatcaagcctacgaagttctgagtgatccccagactagggccatctatgatatctacggaaagcggggcctggagatggaaggctgggaggtggtggagcgaagacgcacacccgctgagatccgcgaggaatttgaacgcctgcaacgcgaacgagaggagagaaggctgcagcagcgaactaatcccaaagggacaatatccgtgggagtggatgccacagacctctttgatcgctacgatgaggagtacgaggacgtgagcgggtcatcattccctcaaatcgagatcaacaagatgcatatttcccaatccattgaagctcctcttaccgccactgacaccgctattctttcaggatctctttccacccagaacgggaacgggggcgggagcattaatttcgctctccggcgagttacatcagccaagggctggggggaacgcatgaccgactgcctgataattggcctcatcgatatctgccagcgctgctcacctcagccagccagtgcatcctgcagactgtgctgttgccacgtgactctgttggaactttacattcccgtgccatcaagaactacagccgtgagttccttcccaatttgctttgtgactacaaactgtgcccttcaattcagttccagggggattagacccgggctgacaaccgtgcttgcgaggaatttggacaaaaacacagttggatacctgcaatggcggtggggaatccagtcggccatgaacacttccatcgtcagggacaccaagacttcacatttcacctag

SEQ ID NO: 25931 - DNA, 999 bp, Artificial Sequence
  Description of Artificial Sequence: Synthetic coding sequence
gcctcaagcgaagagctcaaggcggcgtaccgcaggttgtgtatgctctaccatcctgacaagcatagagatccagagctgaagagtcaggctgagcggcttttcaacctcgtccatcaagcgtatgaagttttatcagaccctcagacacgggctatatacgatatttatggcaagaggggcctcgagatggagggctgggaagtcgtcgaacgcaggcgaaccccagcagagatcagggaggagtttgagaggttgcagagggaaagagaagaacgacgtctgcaacagaggacaaaccccaaagggacgatctccgtgggggtggacgcaacagacctgtttgaccggtatgacgaagagtacgaagacgtgtccggctccagtttcccgcagatcgagatcaacaagatgcacattagccagtcaatcgaagcgcccctcacagccacagatacagcgattctttccggtagtctgtcaacacagaacggcaatggcggtggctctattaactttgccctgaggagagtaacctctgcgaaaggttggggggaactggagttcggggctggagaccttcaggggcccctttttggcctgaaactctttcgaaatttaacgcccagatgctttgttacgactaattgcgccctccagttttcctctcgcggcatccggccaggtttgactactgtcctggcacgcaacctcgacaagaacaccgtgggctacctccagtggcactgctcgagccctctgctccaggtgcagcgccctcaccgtaatactagggcttgcgcccccgagccatcatttcggcctttcctgcatgtgcctacttgggacgccgagtgctccggtgcccgcactccatccactgcatggacgtctgccgctgttaagctacgggaggcttgcctgagcggtcccggtagcgggagccaccagctccttttactgacacctagatccaagcgccggactgggggggggtag

SEQ ID NO: 25932 - DNA, 1566 bp, Artificial Sequence
  Description of Artificial Sequence: Synthetic coding sequence
atgttataccatcctgataaacaccgggaccccgaactaaaaagtcaagccgagcggttattcaacctagtgcaccaagcctacgaggtgctgtcggacccccagacacgggcaatatatgatatctacggcaagcggggactggagatggaaggatgggaggttgtggagcggagaagaacacctgctgagattcgggaggaattcgaacggctccagcgggaaagagaggagcgccgccttcagcagaggacaaatcccaaagggacaattagtgttggagtcgacgcaactgatttattcgacaggtacgatgaggagtacgaagacgttagcggtagttctttcccacaaattgagattaataaaatgcatatatctcaatccattgaagcgcctttgacagccactgatactgccattttgagtggttcattgtccacacagaatggaaatgggggcgggtcgattaactttgccctgcgtcgcgtgacttcagccaaagggtggggtgaattggaattcggcgctggcgatctgcagggtcccctattcggcctgaaactatttcgcaacctgaccccccggtgttttgtcacaacaaattgcgctttacaattctcgtccaggggcatccgtccagggttaacaacagtgctcgccaggaatttggacaaaaacaccgtcgggtatctgcagtggaggtggggcatccagtccgctatgaatacatccatcgtccgcgacactaaaactagccacttcacggttgctctacagctcggcataccacacagttttgctctgattagttatcaacacaagtttcaggacgacgaccagaccagagttaaaggtagcctaaaagcgggcttcttcggtaccgtggtagaatacggagctgaacgaaaaatcagcagacactcagtgcttggggccgctgtgtcagtcggagtacctcagggggtgagtttgaaagtgaaacttaacagagcctctcaaacttacttttttcccattcacctaactgatcagttgctgcccagcgcgatgttctacgctactgtgggaccgttagtggtgtactttgcaatgcatcgccttattattaagccctacctgagggctcagaaagagaaggagctggagaaacagagggaatctgccgctactgacgtgctacagaagaagcaggaagcggaaagcgccgtgagactgatgcaggagtccgttcggcgcatcatcgaggcagaggaatcaaggatgggactgattatcgtcaatgcatggtatggcaaatttgtcaacgataagagtcgcaagtccgagaaagtgaaagtgattgacgtgacagtgccactccagtgtctggtgaaggacagtaaactgatcctaacggaggccagtaaagccggcctgccgggcttttacgatccctgcgtgggggaggagaaaaacctaaaggtgctttatcagttccggggggttctccatcaggtgatggtcttggattccgaagccttgcgaatccccaagcagtctcacaggatcgacacggacggctag

SEQ ID NO: 25933 - DNA, 2109 bp, Artificial Sequence
  Description of Artificial Sequence: Synthetic coding sequence
atggctcagaaacatcccggagagcgtggattatacggtgctcaccattcgggtggagcctcactgcgcaccttgggcccttcagtcgaccccgagatcccctctttctcgggcctgagagacagcgccggcacggccccaaacggcactaggtgcctaactgagcactccggtccgaagcatacacagcatcccaacccagcccattggctggacccttcccacgggccccctggcggcccagggccacctcgtgatgccgaggacccagatcaatctgagacgagcagtgaggaggaaagcggagtagaccaagaattatcaaaagagaatgagacaggtaatcaaaaggatggaaattcttttctgtccattccctctgcttgcaactgccaggggacccccggaattccagaaggcccttacagtgagggcggcaatggcagctcttcgaacttttgccaccattgtacatctcctgccctcggtgaagacgagcttgaagaggagtacgatgacgaggagagcctgaagtttccgagcgatttttctcgcgtcagtagcggaaagaagccaccttcccgccgtcagaggcaccggttcccgactaaagaggatacgagggagggcggcaggcgcgatccaagaagtcccggacgtcataggctcggtcgcaaaagaagtcaggctgataaaaggaaagggctgggcttatggggcgcggaggagctctgccagctaggacaggctggcttttggtggttgatcgaattgctcgtgctcgtgggagaatatgtggagacgtgcggacaccttatctacgcctgccgtcaacttaaatctagcgaccttgatttgtttcgtgtttggatgggagtctggactggccgccttggcggctgggctcaggtcatgtttcaattcctaagtcagggcttctactgtggcgtggggttatttacacggttcttaaagctactgggcgctctgctgctgctggcgctcgccctctttcttggttttctgcaattgggctggcgcttcctggtgggtctgggggatcggcttggctggagagacaaggccacttggctttttagctggttggatagtcctgcccttcagcgctgtctgacactactgagggacagccgcccttggcagaggctcgtgcggatcgtccaatggggctggctcgagttgccatgggtcaaacagaacattaacaggcaagggaatgctcctgtggcatccggacgatactgccagcctgaggaagaggtggcgcggctgctgacaatggctggagtgccagaggacgaactcaacccatttcacgttttgggggttgaagcaactgcttcagacgttgagttgaaaaaagcctaccgtcagctggctgttatggtgcacccagataaaaaccaccacccacgcgctgaggaagcttttaaagttttacgcgctgcatgggatatagtgagtaatgccgagaaacgcaaagagtacgagatgaaaagaatggctgagaacgagctctccagatctgtgaatgaattcctgtccaagctccaggacgatctgaaagaagccatgaatacaatgatgtgttctcgctgccagggcaagcatagacggttcgagatggacagggaacctaaatccgccagatattgcgctgaatgcaataggttacacccagctgaggagggggacttttgggcagaaagttccatgctgggcctgaagataacctacttcgcccttatggacggaaaggtatatgatatcacagaatgggccggttgtcaaagagttggaatcagtccagatacccaccgggtgccttaccacatttcatttggcagtagaattcctggcactagagggaggcagcgggccactcccgatgccccacctgcggatcttcaggactttctgtcccgtattttccaggttccacctggtcagatgcctaacggcaatttcttcgcagccccacaaccagctccaggggccgccgctgccagtaaaccaaactctactgtgccaaaaggcgaagctaagcccaaaagaaggaaaaaggtgaggaggccattccaacgttag

SEQ ID NO: 25934 - DNA, 2109 bp, Artificial Sequence
  Description of Artificial Sequence: Synthetic coding sequence
atggcgcaaaagcatccaggcgagcgcggattgtacggcgctcaccattccggtggtgcttcactgaggactctgggcccctcagtggatccagagatcccctcgtttagcgggctgagagattccgcaggaactgcaccaaacggcacaaggtgcctcaccgagcattccgggcccaagcatacccagcatcctaatcccgcacattggctggatcccagtcacggaccccccggaggccccggaccaccgagagatgccgaggaccccgaccaatcagaaacatcatcggaggaggagagtggagtggaccaggagttatctaaggaaaatgaaacgggtaatcagaaggacggtaactcttttttgagtatcccatccgcttgtaattgtcagggaaccccaggcattccggaaggcccctactctgagggtggtaacggatcttcatcgaacttctgtcaccattgtacgtcacctgcactgggcgaggacgaactcgaagaggaatatgacgatgaagaatcattgaagttccctagtgattttagccgggttagtagcgggaaaaagcctccgagcagacgtcagcgacatcgcttcccaactaaggaggatacaagagaggggggcaggagggatccacgcagccctggacgccaccggctcgggaggaagcgctctcaggccgacaagagaaaaggtctggggttgtggggggcagaagagttgtgtcagcttggtcaggctgggttttggtggctgattgaacttctggtccttgtcggagaatatgtggaaacctgtggccacctgatttacgcttgccggcagcttaaatcttcagacctggatctgttcagagtctggatgggagtgtggaccggacgcctcggtggttgggcccaggtgatgtttcagttcctgagtcaggggttttattgcggtgtggggctgttcactcgtttcttaaaactgttaggcgcccttctcctgctggctctggccctgttcttgggattcctgcagcttggatggcgcttcctcgtgggcctcggtgatcggctgggatggagggataaggccacttggttattcagctggctggacagccctgccctgcagagatgtttaacacttctgcgggactctcggccctggcagagactggttagaatcgttcagtggggctggctggaactgccatgggtaaagcagaatattaatagacagggcaacgcacccgtagcaagtggtaggtactgtcaacccgaagaggaagtagcccgcttgttaaccatggccggcgtgcccgaagacgaactgaatccatttcatgttcttggggtggaggctacagcatctgacgtggagttgaagaaagcgtatcggcaactggcagtgatggtacaccctgacaagaatcaccacccgagagcagaagaagcctttaaagtgctgcgcgccgcttgggacatcgtaagcaatgctgagaagagaaaagagtatgaaatgaagaggatggccgaaaacgagctctcacggtccgttaacgagtttctgtctaagctgcaggacgatttgaaagaggctatgaacacgatgatgtgtagtaggtgtcagggcaaacataggcgcttcgaaatggatagggagccaaagtcggccagatactgtgcagagtgcaatcggcttcacccggcagaggagggcgacttctgggccgagtcctctatgttgggtttgaagataacatattttgcattgatggatggcaaggtctatgatattactgagtgggcaggttgccagcgggtaggcatcagccccgatacccaccgtgtcccgtatcacattagttttggatctaggatccctggaacacggggtagacagagggcaacccctgatgccccgcctgccgatctgcaggacttcctcagccgcatattccaagtgccacctggccagatgcctaatggcaatttttttgccgctccacagcctgcacccggcgccgccgccgcgtccaaacctaacagcacggttccaaaaggtgaggccaaacccaagaggagaaagaaggttcgccgccccttccagcggtag

SEQ ID NO: 25935 - DNA, 2109 bp, Artificial Sequence
  Description of Artificial Sequence: Synthetic coding sequence
atggctcagaagcatccaggagagcgcggtctgtacggcgcacatcacagcggtggcgcaagccttaggaccttggggcccagcgtggatcctgagataccgtcattttctggtcttcgagattccgcagggacggcgccaaatggcacaaggtgtctcacagagcactcggggcctaagcatacccagcaccctaaccccgcccactggctagacccttcacatggtccacccgggggaccagggccgccgagggatgcagaggatcctgatcagtccgaaacatccagcgaggaagagagtggcgttgaccaggaactgtccaaggaaaatgaaactggtaatcaaaaagacggcaactccttcctgtcaataccgagcgcctgtaattgccagggaactccaggcatcccagaaggtccgtacagtgagggcggaaatgggagctcctccaacttttgtcatcattgcactagtccagcactcggtgaggatgaactggaggaagagtacgatgatgaggaatcactgaagttcccctcagatttttcccgggtttcctccggcaaaaagcccccatctcgtcgtcagcgtcaccggttcccgacgaaagaggatactagggagggagggaggcgagaccctcgtagtccagggagacaccgactgggcagaaagcggtctcaggcagacaagaggaagggcttgggtctgtggggagcggaggagttgtgtcaattgggtcaagctggattctggtggctgatcgagctgctggtgttggtcggagaatatgtggaaacttgtggacaccttatttatgcctgcaggcagctaaaatcctccgatctggacttgttcagagtctggatgggcgtatggactgggagactgggcgggtgggctcaggtcatgttccagttcttgtcgcaagggttctactgtggcgtaggactgtttacccgcttcctcaaactcctgggggccctgctgctgctggctctcgccctatttctggggtttctacaattgggctggcgcttcctggtgggactgggagacagattaggttggagggacaaggccacttggctctttagctggttagactctccagcactgcagaggtgtctgaccctgctaagagacagccgaccctggcaacggctggtgaggatcgtacagtgggggtggctcgagctaccttgggtgaaacagaatatcaataggcaaggtaacgcccctgtggcctctgggcggtattgtcaaccggaagaggaggttgcgcgccttctaaccatggcgggggtccccgaggatgaattgaatccgtttcacgtgctgggcgtggaagctacggcgtccgacgtagagctgaagaaggcataccgacaactggctgtgatggtgcaccccgataagaaccatcatcccagagcggaggaagccttcaaggtgctgagagcggcatgggatattgtctccaatgccgaaaagcgcaaggaatacgagatgaagaggatggccgagaatgagttaagcaggtctgtgaacgaattcctgtccaagcttcaggacgatttaaaggaagccatgaacactatgatgtgtagcaggtgccaaggcaaacacagacgatttgagatggacagggaaccaaaaagtgcccgctactgtgcagagtgtaaccgcctgcaccccgcagaagagggggatttctgggctgagagctccatgctggggctgaaaatcacttactttgcattgatggatggtaaggtttacgacattacagagtgggcagggtgccagcgagtcggaatatccccagacacccaccgcgttccgtaccacatctctttcgggtctaggatcccgggcacccgtggccgccagagagctaccccagatgctccacctgccgatctccaggactttctctctcgcatttttcaggtcccaccgggacagatgcctaatgggaacttcttcgcagcaccccagccagcccctggggccgcggccgctagcaagccaaactctacggtgccgaagggtgaggcaaagccaaaacgtaggaagaaggtacgaagaccattccaacggtag

SEQ ID NO: 25936 - DNA, 1239 bp, Artificial Sequence
  Description of Artificial Sequence: Synthetic coding sequence
atgggggtttggacaggacggttgggcggatgggctcaggtgatgtttcagttcctgagccaaggattctactgtggggttggcctgttcacaagatttcttaagcttctaggagctctcttgttactggccctggcattatttctgggctttctacagctggggtggcgctttctggttggtctgggcgatcgcctcggctggagggacaaagcaacttggcttttcagctggctcgacagccccgccctgcagagatgcctgaccttgcttagggactcaaggccctggcagcggttggtgcgcattgtacagtggggatggctcgagctgccgtgggttaagcagaatattaaccggcaggggaatgcccctgtggctagcggcaggtactgccagccagaggaggaagtcgcgagacttctcacaatggccggggttcccgaggacgaattaaaccctttccacgtcttgggggtggaggcaaccgctagcgatgtggagctaaagaaagcctacagacaactggccgtcatggtgcatccagataaaaaccaccacccaagggccgaggaagccttcaaggtattacgagctgcctgggacattgtatctaatgctgaaaagaggaaagagtacgagatgaagagaatggcagaaaacgagctgtctaggtccgttaatgagttcttgagcaaactgcaggacgatctcaaggaggcgatgaatactatgatgtgtagtagatgccagggaaaacatcgccggttcgagatggatagggaaccaaagtccgcacggtattgcgccgaatgtaaccgattacatcccgcggaggaaggggacttttgggccgagtctagtatgctgggactaaagatcacatatttcgcgctgatggatggtaaagtgtatgacatcacggaatgggcaggctgccagcgcgtcggcatctcaccagatactcatagggtgccttatcacatttcatttggtagtcggattcccggcacccgcggcagacagcgggccactcctgacgcgcctccagctgacctgcaggattttctctctagaatctttcaagttccccccggccagatgcccaatggcaattttttcgctgctccccagcctgcaccgggggccgctgctgcctcgaaacctaactcaacagtccccaagggggaggccaagccaaaaagaagaaagaaggttaggcgaccatttcagcgctag

SEQ ID NO: 25937 - DNA, 576 bp, Artificial Sequence
  Description of Artificial Sequence: Synthetic coding sequence
cggaaacggatggcagagaatgaactgtcacggagcgtgaacgagttcctgagcaagctgcaggatgacctgaaggaggctatgaatacgatgatgtgctcccgatgccagggtaagcaccggaggtttgagatggatcgggagcccaaatctgctcgatactgcgcggagtgcaacaggttgcacccggccgaggagggggacttctgggcggagagctctatgttaggcttgaagatcacctacttcgccttgatggatggcaaggtctatgacattacagagtgggccggatgccagcgcgtagggatctctcccgacacccatcgcgtgccctaccatatctcttttggatcccggatcccaggaactcggggtaggcaacgagccactccggatgccccaccggcagacctccaggactttttaagtagaatttttcaagtgcccccaggacagatgccaatgggtacatctctgcagctactcagcctaccccttgaacctctccagcctttatcacccacagcgcagtaccctagggagaagcctaatctgtcaggagggcggaaatag

SEQ ID NO: 25938 - DNA, 240 bp, Artificial Sequence
  Description of Artificial Sequence: Synthetic coding sequence
atggcccagaagcatcctggcgaacggggcctctatggagctcatcattcagggggggcttccttacgcacactcggacctagcgtggacccggagatcccgtctttttctggcctgcgggacagtgctggtactgcccccaatgggacaaggtgtctgacagagcactccgggccaaagcacacgcagcaccccaatccggcgcactggctcgacccaagtcatgggccccctgggtag

SEQ ID NO: 25939 - DNA, 456 bp, Artificial Sequence
  Description of Artificial Sequence: Synthetic coding sequence
atggcacagaagcatcccggcgaaaggggattgtatggagcacatcacagcggaggcgcatcactgcggacccttgggccctccgtggaccctgaaattcccagttttagtggcctccgcgatagcgccggaaccgcacctaacggcacaaggtgtctgacagaacattccggtccaaagcatacacagcatccaaaccccgctcactggttggatccgtcgcacgggccacctggggggcctggacctccccgagacgcagaggacccggatcagagcgagacttcttccgaggaagaatcgggagtggatcaggagctaagtaaggagaatgaaacaggaaatcagaaagacggcaattcttttctgtcgattccctctgcctgcaattgtcagggcacacccggtattcctgaaggaccatattctgagggtgggaatggtagcagctcttag

SEQ ID NO: 25940 - DNA, 453 bp, Artificial Sequence
  Description of Artificial Sequence: Synthetic coding sequence
atggcagcccgcggggtcatagctcccgtgggtgagagtctgagatacgccgagtatttgcagccctctgccaagcggcctgacgccgacgtggaccagcagcggcttgtgagatctctgatcgccgttggcctcggagttgcggccctggcattcgctggacggtacgcttttcggatctggaagcctctggagcaggtaatcaccgagacggctaagaagatctccacaccgagcttctcctcatactataaaggtggattcgaacaaaagatgtcacggagagaggccgggctcattctgggcgtttcccctagcgccggaaaagccaagatccgcactgcccatagaagggtgatgatcctgaaccatcctgacaaaggcggaagcccttatgtggccgcaaaaattaacgaggcgaaggatctgttagaaactacaactaaacactag

SEQ ID NO: 25941 - DNA, 1788 bp, Artificial Sequence
  Description of Artificial Sequence: Synthetic coding sequence
atggaggtccgtaaactgtcgatctcttggcaatttctgatcgttctggtactgattctgcagattctaagtgccctcgatttcgacccttacagggtgctcggggtgtcgaggacggcatctcaagccgacatcaaaaaggcgtataagaagctggcccgtgaatggcaccccgacaagaataaggaccccggagccgaagataagttcattcagatatctaaagcatacgagatcctgtcaaacgaagagaagcgttccaattacgatcagtacggtgatgcgggcgaaaaccagggatatcagaagcagcagcagcaaagggagtatcgctttcgccattttcatgagaacttctattttgacgagagcttcttccactttccatttaactccgaacgacgggatagtattgacgagaaatacttgctgcattttagtcactacgttaatgaagtagtgcctgacagcttcaaaaagccgtacttaattaagattacctcggattggtgcttctcctgtattcacattgagcccgtgtggaaagaagttatccaggagttggaagagctcggcgtgggaatcggggtagtccacgccgggtatgaacgtcgactcgctcaccatctcggtgcccatagcaccccctccatactgggaattatcaacgggaagattagcttttttcacaatgcagtggtgcgggagaacctaaggcaattcgtggaatcactcctccccggtaacttggtagaaaaggtgaccaacaagaattacgtccggttcctgtctgggtggcaacaggaaaacaagccacatgtcttgctgttcgatcagacaccaatcgttccactgctatataagctcaccgcgtttgcatacaaagactatctgtccttcggctatgtttacgtcgggctcagaggcaccgaggaaatgactaggcggtataatatcaatatatatgctcccacgctcttagtgttcaaggaacacatcaaccgccccgctgatgtgattcaggcaagaggcatgaaaaagcaaatcattgacgattttattacccgaaacaagtacttgctggcggcccggttgacgagtcaaaaactgtttcacgagctttgccccgtgaagaggtcgcatcgacagagaaagtattgtgtcgtgctgttgaccgcagagactactaagttgtccaagccattcgaggctttccttagcttcgcattggccaatacgcaggacaccgtgcgtttcgtacatgtttattccaaccggcagcaggagtttgctgatacgctgcttcccgatagcgaagccttccagggcaagtctgctgtaagtatcctggagagaaggaataccgcaggacgggtagtttacaaaacgctagaggacccatggatcgggagcgaatcagataagttcatactcctgggttaccttgatcaacttagaaaggatcccgctctcttgtcttcagaagccgtgctaccagacctaacagacgaattagcacctgtgttcctgcttaggtggttctactccgcttccgattacatctctgattgttgggactccattttccacaataattggcgtgagatgatgcccctgctgtctctcatatttagcgcactattcattctcttcggtaccgtcatcgttcaggctttctctgacagtaatgatgaacgggagtctagtcctccggaaaaagaggaagcccaggaaaagaccggtaagaccgagccatcattcaccaaagagaactcacgcttcttatag

SEQ ID NO: 25942 - DNA, 2349 bp, Artificial Sequence
  Description of Artificial Sequence: Synthetic coding sequence
atggaagtgagaaagctgtctatctcctggcagtttctgatagtcctcgtcttgattctgcagattctgagcgcgctggatttcgatccataccgggtcctcggcgttagtcggaccgcgtcacaagcagatattaaaaaagcatacaagaagttggcaagagagtggcacccggacaagaataaggacccgggagccgaggataagttcattcagatctctaaagcctatgaaatcctgtctaacgaagagaaacggtctaattacgaccagtatggggacgccggtgaaaaccaaggctatcagaaacaacaacagcaaagggaatatagatttaggcatttccacgaaaatttttatttcgatgaatcctttttccatttcccttttaatagcgaaagaagggacagcatcgacgaaaagtatctcctgcatttctcccactacgtgaacgaagtggtcccggacagtttcaaaaagccatatctcatcaaaattacgagcgactggtgtttttcttgtatacacatcgagccggtttggaaggaggtaatccaggagcttgaggagttgggagtggggataggcgtggtgcatgctggctatgagcgcagactcgctcaccaccttggcgctcacagcactccatctatacttggtattattaacggaaagatctcatttttccataatgcagtcgtgcgagagaatctgcggcaatttgtagaatccctgctcccgggcaatctcgttgaaaaggtgacaaacaagaactacgtaagatttctctctggttggcaacaggagaacaagccccatgtgctcttgttcgaccagacacctatcgtgcctttgctctataagctcaccgcttttgcctacaaggattacctgtcttttgggtatgtatacgtcggtctgagagggacagaggagatgacaaggcggtacaacattaacatttacgctccaactttacttgtgttcaaagaacacattaacagacccgccgacgtgatccaagctcggggtatgaagaaacaaatcatagatgatttcattactcggaacaagtatctactggctgcgcgcttgacatctcagaagctgttccacgagctgtgcccagtgaaacggtcacacagacaaaggaaatattgcgtcgtgctcctcactgccgaaacaaccaagctgagcaaacccttcgaagcatttctcagttttgcactcgccaatacgcaggacacagtgcgttttgtccacgtgtatagcaacagacaacaggagttcgccgacacactgttgccagatagcgaggccttccagggcaagtccgctgttagtattctggagagacgaaacaccgcaggacgagtcgtatacaaaacattggaagacccttggatcggtagcgagtctgacaaattcatcctgctaggctatctagaccaactgaggaaagaccctgctcttttgtcctcagaagctgtgctccccgatctaaccgacgagctggctcccgtgtttctccttagatggttctattctgcctctgactacatcagtgattgttgggacagcatttttcacaacaattggcgcgaaatgatgccccttctgagccttatcttctcagctctcttcattttatttggcaccgtaatagtacaggccttctctgattctaacgatgaacgcgaaagcagccctcctgagaaagaagaggcgcaggagaagactggcaaaacagaaccttcttttactaaggagaactcctctaaaattcctaaaaaaggtttcgttgaagttaccgagctgactgacgttacctatacgtccaacttagtgcgtctgcgtccaggacacatgaatgtggttctgatcctgtcaaatagtaccaaaacatcattacttcagaagttcgctttagaggtctatacctttacagggagcagctgcctccacttctcttttctgagtcttgacaaacatcgtgagtggctcgagtatctcctcgaatttgcccaagatgccgcaccaatacccaaccaatatgataaacattttatggagagggattataccggctacgtgttggctcttaatgggcataagaaatatttttgtcttttcaagcctcagaagacagtcgaggaggaggaggccatcggaagttgtagcgatgtggactcctccctctaccttggggagtcacgggggaaaccctcatgcggactgggctctaggcccatcaaaggaaagctatcgaaattgtcactttggatggagagactgcttgagggcagcctgcaaagattctatatccccagttggcccgagttggactag

SEQ ID NO: 25943 - DNA, 1968 bp, Artificial Sequence
  Description of Artificial Sequence: Synthetic coding sequence
atggaggtgaggaagctcagcatatcttggcaatttttaattgttctagtacttattctccaaatcctttccgctcttgatttcgatccatatagggtcctcggagtttcccggactgcaagccaggccgatatcaagaaggcctacaaaaaactcgccagggagtggcatcccgataaaaacaaggatccaggggcagaagataagttcattcagatctctaaagcatacgaaattctgtcaaacgaagagaaacgatccaactatgaccaatatggggacgctggcgagaaccagggctaccagaagcagcagcagcaacgcgagtaccgtttccgccactttcatgagaatttctatttcgatgaaagtttcttccacttccctttcaatagcgagaggcgggactcgattgacgaaaagtatcttctgcattttagtcactatgtgaatgaagtggtgcctgatagttttaagaaaccataccttattaaaatcacgtccgactggtgctttagttgcatccacatagagcccgtgtggaaggaagtcatccaggagttagaagagttaggggtgggcatcggagtggtccatgccggctatgaacggaggctggctcaccacctgggtgcccatagcactccaagcatattggggatcatcaatgggaagatttcttttttccacaatgccgttgtcagggagaatctccgtcagttcgtcgagtcactcctgcctgggaacctggtcgaaaaagttactaataagaattacgtgcgcttcctaagtggttggcagcaggagaacaaacctcatgtactgttgttcgaccagacgcccattgttcctttattgtacaagctaactgccttcgcctacaaagattacctcagcttcggatatgtttacgttggattgcgtggcaccgaggaaatgacccgacgatataatataaatatctatgcaccaacactactggtattcaaggaacacattaaccgccctgccgatgttatccaggctaggggcatgaaaaaacagattatcgacgattttattacacgaaataagtatcttctggctgcccggctgacgtctcagaaattgtttcatgagctgtgtcctgttaaaaggtctcacaggcagaggaagtactgtgtggttctgttgactgccgaaacaaccaagttaagcaaacctttcgaagcattcctctccttcgcgctggccaacacccaggataccgtacgattcgtgcacgtatactccaacaggcagcaggaatttgctgatactctgctccccgacagcgaggcatttcagggaaaatctgcggttagcatactagagcggcgcaacactgctggacgagtcgtctataaaaccctcgaggatccttggatcggttctgagtccgacaagttcattttattgggatatcttgaccagcttagaaaggaccccgcattgctgtcctccgaggcagtgctgccggacttgaccgacgaattggctcccgtctttttgctcagatggttctatagcgcatctgattatatctcagactgttgggactccatcttccacaacaactggcgagagatgatgccgttgttgagcctgatatttagtgctctgtttatattgttcggtaccgtgattgtgcaggcgtttagcgactccaacgatgaaagagaatcatcccctccggaaaaagaggaggcgcaggaaaaaaccgggaaaaccgagccttccttcactaaggagaactcctctaagatccctaaaaaaggcttcgtggaggtcactgaactcactgatgtcacctatacctctaatctggtgaggctacgccccggccacatgaatgtggtgctcattctctctaattccaccaaaacctccttactgcagaaatttgccttggaggtgtatacattcacgggaaaaatcattaggtggtag

SEQ ID NO: 25944 - DNA, 1788 bp, Artificial Sequence
  Description of Artificial Sequence: Synthetic coding sequence
atggaggtcagaaagctgagcatctcctggcagtttctgattgttcttgtcctgatccttcagattctctcagcgctggactttgatccctatagggtgcttggggtcagcaggacagctagccaggccgacatcaaaaaggcatacaagaagttagcacgagaatggcaccctgacaaaaataaagatcccggcgcagaggacaaatttattcagattagcaaagcctatgagattttgtcgaatgaagaaaagcgcagtaattacgaccagtatggcgacgcaggagagaaccagggctatcaaaagcagcaacagcaaagagagtaccgatttagacacttccatgaaaacttctactttgacgagagctttttccactttccatttaactccgaacgccgcgactctattgatgaaaagtacctgctgcacttcagtcactacgtgaacgaggtcgtccccgatagtttcaaaaagccctatctaatcaagattacttccgactggtgcttttcctgtatccacatcgaacccgtctggaaagaagtgatacaggaattggaggaactgggtgtgggaatcggtgtcgtccacgcaggatatgagagacgcctggctcatcacttgggggcacactctacgccgagtattctgggaatcattaacggaaaaatcagttttttccataatgccgtggtgcgggagaacctgagacagttcgtagaaagtttgctacccggtaacttggtagaaaaggtcacaaataagaattacgtccggttcctgagcggctggcagcaggagaataagccccacgtactgctctttgatcagacacctatcgtccccctgctgtacaaactgacagcatttgcctataaagactacttaagcttcggatacgtctacgtagggttaagaggtacagaagagatgacacggagatacaatatcaacatctacgctcctaccctgcttgtcttcaaggagcacatcaaccggcccgctgatgtaatccaagcacgcggtatgaagaaacaaataattgatgactttatcactcgtaacaagtacctgctggcagcacggctgacttcccaaaaactcttccacgagctttgtcccgttaagaggagtcatcggcagcgcaagtattgcgtcgtgctcctaaccgctgaaaccaccaaactcagcaaaccgttcgaggccttcttgagcttcgccctggctaacacccaggatactgtgcggtttgtgcacgtgtactcaaatagacagcaggagttcgctgacactctgttgccagatagtgaagctttccagggcaaatcagcagtaagtatcttggaacggaggaataccgccggcagggttgtgtataagactctcgaggatccgtggattggttccgagtcggataagttcattctgctgggctacctggatcagctcaggaaagaccccgcattgctcagctccgaggctgttctgcctgatctgactgacgaactggcccctgtgttcttgctccggtggttttacagtgcatcagactacatttctgactgctgggatagtatcttccacaacaactggcgggagatgatgccactgctctctctgatcttcagtgccctgtttattctgtttggaactgtaatcgtacaggctttctctgactctaacgacgagagagaatcctccccacccgagaaagaggaagcccaggaaaagacagggaagactgagccttcgttcactaaggaaaactccaggtttctgtag

SEQ ID NO: 25945 - DNA, 1077 bp, Artificial Sequence
  Description of Artificial Sequence: Synthetic coding sequence
atggctgctactcttggcagtggagagaggtggacagaggcttacatcgacgcggtgcggcggaacaagtatcccgaggataccccacccgagagccacgacccatgcggctgttgtaactgcatgaaggcccaaaaagagaagaagtccgagaacgaatggacacagacgcgacagggggagggcaactccacgtactcagaagaacagttgttgggggtgcaacggataaagaagtgcagaaactactacgaaattctgggagtgagccgggatgccagcgacgaggagttgaagaaggcctatcgtaaattggctctgaagttccacccagataaaaattgcgcccctggagccaccgacgcatttaaagccataggaaatgcgttcgcagtgctgagcaatcctgataaacgactcagatacgatgaatacggggacgaacaggtgacatttacagcccctcgagctaggccttataactactacagggactttgaggccgacatcacacctgaggagctgttcaatgtgttctttggtggccactttccgaccggcaacatccacatgttctcgaatgtgacagatgatacgtactactatcgcaggagacacagacacgagcggacacagacccagaaagaggaagaggaagagaagccacagactacatatagcgcttttattcaactcctgcctgttttagtcatagtgatcatatccgttataacacagttgctggccaccaaccccccgtactcgctgttttacaagtcaacgctgggttacactatatcaagggagacacagaatctgcaagtaccttatttcgtcgataagaatttcgataaggcctatcggggggcaagtctgcacgatctagagaagaccattgaaaaagattacatcgattatatacagacatcatgctggaaagagaagcagcagaaatccgagttaacaaatctcgccggactgtatagagacgagaggctgaaacaaaaagccgaatccctgaagctggaaaactgtgagaaactatccaaactgattggcctgcgcagaggcggttag

SEQ ID NO: 25946 - DNA, 78 bp, Artificial Sequence
  Description of Artificial Sequence: Synthetic coding sequence
atggcggcgaccctgggcagtggggaaaggtggactgaagcttacatagacgccgtcaggcgcaataagtatccttag

SEQ ID NO: 25947 - DNA, 522 bp, Artificial Sequence
  Description of Artificial Sequence: Synthetic coding sequence
atggcggccacgttgggttccggggagcggtggacggaggcctacatagacgcagtacgccgcaataaatacccagaagacacccccccagaaagccacgatccatgcgggtgttgcaattgtatgaaggcccagaaagaaaaaaaatccgagaatgaatggacacagactaggcaaggtgagggaaactccacttactctgaggagcaactcctgggcgtgcagcgaatcaagaagtgccggaattattacgagattttaggcgtttctagagatgcctcagatgaggagctcaaaaaggcgtaccggaagctggccctcaaattccatccggacaaaaactgtgcaccaggcgccaccgatgcctttaaggccattgggaatgcctttgccgtgttgtcaaatccagataagagacttcggtacgatgagtacggcgatgagcaggtgaccttcaccgctcctcgcgctagaccgtataattattaccgcgattttgaagccgacatcacacctgaatag

SEQ ID NO: 25948 - DNA, 546 bp, Artificial Sequence
  Description of Artificial Sequence: Synthetic coding sequence
atggctgctaccctgggtagtggcgaacggtggacggaggcttacatcgacgcggtgcgccgcaacaaatatcctgaagacacaccacctgagagtcacgacccatgtggttgctgtaactgtatgaaggcccagaaagaaaagaaatctgagaacgagtggactcagacgcgacaaggcgaaggaaactcaacctattccgaggagcagctgctgggggtgcaaaggatcaagaaatgccggaattattatgaaatcctgggtgtgagcagggatgcaagcgacgaagagcttaagaaggcttacagaaaactggccttgaagttccatccggacaaaaattgcgctcccggggcaacagacgccttcaaggccataggcaacgccttcgctgtgttatcaaaccccgataagaggttgcgatacgatgaatacggggacgaacaggtaacattcaccgcccccagagcacgaccttacaactattacagagatttcgaagcagacatcacccccgaggaattgtttaatgtatttttcggctag

SEQ ID NO: 25949 - DNA, 1026 bp, Artificial Sequence
  Description of Artificial Sequence: Synthetic coding sequence
atggccaaaggcctgctggtcacttacgcactctgggcagtgggtgggcccgctggtctgcaccacctgtatctcggaagagatagccacgctctgttatggatgctgacacttggcggtggaggcctgggctggttatgggagttctggaaactgcctagctttgtcgcacaggcaaacagagctcaaggacagaggcagagccccagaggcgtgacaccccccctttcacctatccgctttgctgcgcaggtgatcgttggtatctacttcgggctcgtggccctgattagtcttagcagcatggtcaacttctatattgtggctctgcctctggctgtaggcctgggtgtgcttctggttgccgccgtgggtaatcagacctccgacttcaaaaacactttaggtagtgccttcctcacatcaccaattttttacggcaggcccattgccatcctccctatcagtgtcgccgcatccattacagcacagcgccacaggcgttacaaggctctggtcgcctctgagccactatcggtgagactctaccgcctaggtttggcctacttggcattcaccggacccctggcgtatagcgccctgtgtaacaccgcggccacgctttcctatgtggcagagaccttcgggtctttcctcaattggttcagcttcttcccattgctcggccggcttatggaatttgtcctcttgctaccttacagaatttggaggttgttgatgggagagactggttttaatagttcatgttttcaggagtgggcaaagctatatgaattcgtccacagctttcaggacgaaaagcgtcagctggcctaccaggtccttggtctaagcgagggcgccacaaacgaggaaattcacagaagctatcaagagcttgttaaggtgtggcacccagatcacaatttggatcaaaccgaggaggcccagagacacttcctggaaatccaagctgcctacgaagtgctgagccagccccggaaaccctgggggtccaggagatag

SEQ ID NO: 25950 - DNA, 1026 bp, Artificial Sequence
  Description of Artificial Sequence: Synthetic coding sequence
atggcaaagggcttgctggtaacatacgccctctgggctgttggcggcccagcagggcttcaccatctatacctcggacgcgacagtcatgccctgctgtggatgttaactctgggtggcggtggacttggttggctgtgggagttttggaagctgccttcctttgtggcccaggccaacagagcacaggggcagcggcaatctccgagaggcgtcacaccccccctgagtcccatccgtttcgccgctcaagttattgtggggatttatttcggcctggtggcgctcatatcactgtccagcatggttaatttttatattgttgccttgccacttgccgtcgggttgggtgttctgctggtcgcagccgtcgggaaccagacctccgactttaaaaatactctggggtcggcttttctaacatccccgatcttctatgggcgccccattgccatcctgcctatcagtgtcgccgcttcaatcaccgcacagcgacaccgccgctataaggcactggtcgcctccgaaccgctctcagtgcgactctataggctgggcctagcatatcttgcatttacagggccgctggcctattccgctctgtgcaacacagccgctaccttaagctacgtcgccgaaaccttcgggagttttctaaactggtttagtttcttccctctcctggggagactcatggagttcgtgctgctgctcccgtataggatctggcgtctcttaatgggtgaaaccggctttaactcctcatgcttccaggaatgggctaagctctatgaattcgtacactcttttcaggatgagaagcgtcagttggcctaccaggttctcggcctgtccgagggagccaccaacgaggaaattcacagatcttaccaggagctggtgaaggtgtggcatcctgatcacaatctcgaccagactgaagaggcacagaggcactttctggagattcaagctgcctacgaggtactatctcagcccagaaagccttggggcagtaggagatag

SEQ ID NO: 25951 - DNA, 681 bp, Artificial Sequence
  Description of Artificial Sequence: Synthetic coding sequence
atggcagcgatgcggtggaggtggtggcagaggctacttccctggaggctgctgcaagcgcgcggattccctcaaaactcagcaccgtcactcgggctgggggccaggacatacagccagggcgactgctcctattcccgcacggccctgtatgacctgctcggcgtgccctctacagccacacaggctcagattaaggctgcctactatagacagtgttttctctaccatcctgaccgaaattcagggagcgcagaagcggcggaaaggttcacccgcatttctcaggcctatgttgtattaggcagcgctactttgcgacgaaagtatgataggggcttgctaagtgacgaggatttgcggggtcccggcgttcggccatctcgcaccccggcaccagaccccggatcccccagaacccctccaccgacgtcaaggacacacgacggcagtcgtgcatcccctggagctaaccgaactatgttcaattttgacgccttctaccaggcccactatggagaacaactggaacgcgagcgccgtctcagagctagaagggaggccctaagaaagaggcaggaatatcgcagcatgaagggactgagatgggaggatacacgcgatacagccgctatttttcttatttttagcatattcatcattattgggttttatatttag

SEQ ID NO: 25952 - DNA, 522 bp, Artificial Sequence
  Description of Artificial Sequence: Synthetic coding sequence
atgcgatggcggtggtggcagcgcctcctgccctggagattgctccaggcacgaggctttccccaaaactctgcgccttcactagggctcggagcccgaacgtatagccagggcgactgctcatatagccgaacagccctgtacgacctgcttggcgtcccttcaaccgcaactcaggcccagatcaaggctgcttattataggcagtgctttctctaccatcccgatagaaactctgggagtgcagaggctgctgaaaggttcacacggatctctcaggcgtacgtcgtgctggggtctgccaccctcaggagaaagtatgatcggggcctgctatccgatgaggatctgagaggccccggcgtgcggccctcccgtacccccgctcctgatccaggctcgccccggactcctcccccaacttcccgatcaatgaagggactccgctgggaggataccagagacactgccgctatttttctaatcttctccatattcattattattggcttctacatctag

SEQ ID NO: 25953 - DNA, 726 bp, Artificial Sequence
  Description of Artificial Sequence: Synthetic coding sequence
atgccccctctgctgccattacggctctgtaggttgtggcctagaaatccgccttctaggctgttgggtgcggccgccggtcagagaagcaggccctccacatattacgagctgcttggggttcaccccggtgctagtacggaggaagtgaagcgcgcattcttcagtaaaagcaaggagttgcacccagaccgcgaccccggcaatccttcattgcacagcagattcgtggaactcagcgaggcctacagagtgttgagtagagagcagtccaggcggtcctacgatgatcagctcagatctgggagccctcccaaatctccccggacaacagttcatgacaagagcgcccatcaaacacactcttcttggacaccgcccaatgcacagtattggtctcagttccactccgtccgaccacagggtcctcagctacggcagcagcagcacaagcagaataagcaggtattaggttactgtctccttctgatgctggctggaatggggctccattacattgcatttcgcaaagtgaagcaaatgcacctcaattttatggatgaaaaggaccgcattatcaccgcattttacaatgaggcccgcgctcgggcccgagccaatcgaggcatcctccagcaggagagacagcgactcggacaaagacagccccctccgtctgaaccaacccagggccccgagatagttcccagaggagccggtccttag

SEQ ID NO: 25954 - DNA, 537 bp, Artificial Sequence
  Description of Artificial Sequence: Synthetic coding sequence
atgcttagaaccgctctgcggggtgcccctcgcttgctttccagggtgcagcccagggcaccctgccttaggcggctctggggacggggtgctaggccggaagtggcaggacgaagaagggcttgggcatgggggtggcgcaggagctcaagcgaacagggtcctggaccagccgccgctcttggccgggttgaagctgcccactaccagctggtgtatacctgcaaggtgtgtgggactcggtcgtcaaagcgaataagcaagctggcctaccaccagggtgtggtcattgtgacgtgtccaggctgtcagaatcatcacatcatcgctgataacctcggatggttttccgacctgaatggtaaacgtaacatcgaggaaattctaacggccagaggagaacaagtgcaccgcgtggcaggtgagggagccctggaactagtgctggaggccgctggagcacctaccagtaccgccgcgcccgaggccggtgaagatgagggacccccctcacccggtaaaacagaacctagctag

SEQ ID NO: 25955 - DNA, 1617 bp, Artificial Sequence
  Description of Artificial Sequence: Synthetic coding sequence
atgactcgagagtgcccctctcccgccccagggcccggggcccctctttcaggcagcgttctggccgaggctgctgtggtgttcgccgtggtgctgtcgatacacgcaaccgtgtgggatcggtactcttggtgcgctgtggccctcgcggtacaggccttctatgtacagtacaagtgggatagactgctgcagcagggctccgctgtcttccaattccggatgagcgctaatagtggcctgttgcctgcgtccatggtgatgcccctgttgggcctcgtgatgaaagagaggtgccagactgccggaaacccatttttcgaaagattcggtattgttgttgccgccactggcatggcagtggctctgttctcctctgtcctggccctgggtatcacccgacccgtgcctaccaacacgtgtgtcatcctcgggctagccgggggagtgatcatatatataatgaagcattctttatccgtgggtgaggtcattgaagtattagaggtgctattaatcttcgtatacctgaacatgatcctgctgtacctactgccccgttgctttacaccaggcgaggccctcttggttcttgggggaattagttttgttcttaaccagcttattaaaaggtctctgactcttgtcgaatcacagggagacccggtcgacttcttcctgttggtggtggtggtggggatggtcctgatggggattttcttctccacactgtttgtattcatggatagtgggacatgggcttcatctatattttttcatcttatgacatgtgtgctgagtttgggtgtagtgttgccctggcttcaccgactgatccgccgaaatcctctgctgtggctgcttcagtttttatttcagaccgacacccggatctatcttctggcatactggagtctgctggcaacccttgcctgtctggttgttctttaccagaatgctaaacggagcagtagcgagagcaagaaacatcaggcgcccacgatcgccagaaagtattttcatctgattgtggtggccacttatatccccggcatcatctttgacaggcctctactgtacgtcgcagcgacagtgtgcctggcggtcttcatattcctggagtacgtgcgttacttccggatcaagccattggggcacactcttagaagctttctatctctattcctggatgagcgggattctgggccattgattcttacacatatatatttgctgctgggcatgagcttgcccatatggctgattcctaggccatgtacccaaaaaggtagcttaggaggcgcccgtgcactcgtaccatacgccggggtcctagccgtgggggtgggagatactgtcgcttcgatcttcggcagcactatgggcgagatccgatggcctggcacaaagaaaacattcgaaggtactatgacttccattttcgcccaaatcattagcgtggccttgattcttatattcgactcaggcgtcgacctgaactatagctacgcctggattctggggagcatcagtacagtatccctcctcgaggcctacacaacccaaatcgacaatctgctcctgcccttgtacctcctgattctgttgatggcatag

SEQ ID NO: 25956 - DNA, 801 bp, Artificial Sequence
  Description of Artificial Sequence: Synthetic coding sequence
atgaccagagagtgcccctcccctgcccccggacccggtgctcctctctcaggctcggtgctcgcggaggctgcggtggtcttcgccgtggtgttgtccatccacgccactgtttgggacaggtatagctggtgcgccgtggcactggcagtgcaggccttttacgtgcagtataagtgggacaggttgctccaacaagggtctgccgtgttccagtttcgcatgtcagcgaacagcggcctgctccctgcttcgatggtcatgcccctcctcggcctggtgatgaaagagaggtgccagacagccggcaatcctttttttgagaggtttgggattgtggtggccgcgaccgggatggcggtggctctgttttcctccgtgttagctctgggtatcacccgcccagttcccacgaacacatgtgtcattctaggtctggcaggcggcgttattatctacataatgaagcactcactctctgtcggcgaagttatcgaagtgctagaagtacttttgatattcgtgtacctcaatatgattctcctgtacctcctaccaaggtgcttcaccccaggcgaagccctgctagtccttggggggatctcatttgtgctgaatcagttgattaaacgaagcctaaccctggtcgaatcccaaggcgacccggtggacttctttttgctggttgtggtggtcggaatggtacttatgggtatcttctttagtaccctgttcgttttcatggattcagggacccgaccacccccaagcccagaatctatcagcacgtccctgtggtag

SEQ ID NO: 25957 - DNA, 717 bp, Artificial Sequence
  Description of Artificial Sequence: Synthetic coding sequence
atggccgctgatggccagtgcagcctacccgcctcttggagacccgtgactctgacacacgtggagtatcctgctggggatctaagcggccatctgctggcatatttaagccttagtcctgtatttgtaattgttgggttcgtgacccttattatctttaaacgggaactccacactattagcttcctgggagggctcgctctgaacgagggcgtcaactggctgatcaagaatgtcatccaagagccgaggccgtgcggagggcctcacaccgcggttggtacaaaatatggaatgcccagttctcatagtcagtttatgtggtttttttctgtgtactcttttttgttcttgtacctccgcatgcaccaaacaaataacgcacggttcctcgacctcctgtggcggcatgtgctctctctaggcctcctggcggttgcatttttagtgtcgtatagtcgggtgtacctgctgtaccacacttggagccaggtgttgtatgggggcatcgccggcgggctcatggccattgcatggttcatctttactcaggaggtcctcacccccctcttccctcgcattgcagcatggccagtgtcagaatttttccttattagggacacctccttgataccaaatgttctttggttcgaatacactgtcacccgcgcggaggcccgaaacaggcaacggaaactgggaacaaaactgcagtag

SEQ ID NO: 25958 - DNA, 588 bp, Artificial Sequence
  Description of Artificial Sequence: Synthetic coding sequence
atggccgccgacggacagtgcagcctcccagctagttggcgcccagtcaccctaactcacgtggaatacccagctggtgacctgtccgggcacctattggcctacctttctctgagccctgtgtttgtcatagtggggttcgtgactttgatcatctttaaaagggagctgcatacgataagtttcctaggagggttggctctgaacgagggggtaaactggctaattaaaaacgtgatacaagaaccacgtccctgcggtggaccacatactgcagtcgggactaagtacggcatgcctagcagccatagccaattcatgtggttcttctcagtctattcctttctgtttctgtacttgcgtatgcaccagaccaataatgcgcgcttcctggatcttctgtggagacacgtgctgtctctcggcttacttgcagttgcatttctggttagttatagtcgtcccgtctccgagttctttctgattcgggataccagcctaattcctaacgttctatggttcgaatatactgtcacaagagccgaagctaggaacaggcaacgcaagctgggaacaaaattgcagtag

SEQ ID NO: 25959 - DNA, 294 bp, Artificial Sequence
  Description of Artificial Sequence: Synthetic coding sequence
atgccgtcttctcatagccagtttatgtggttcttctccgtttattcattcctcttcctgtatcttagaatgcatcagactaacaacgctcgattcctggacctgctatggagacatgttctttctctggggctcctcgcagtggcattcttagtttcctactcaaggcctgtgagtgagttcttcttgattcgggatacatcccttattcctaacgtgctctggtttgaatacacagtgactcgggcagaagctaggaacagacaacgcaagttgggcaccaagctgcaatag

SEQ ID NO: 25960 - DNA, 1227 bp, Artificial Sequence
  Description of Artificial Sequence: Synthetic coding sequence
atgtgggccttcagcgagctcccaatgcctctgctaatcaatctgatagtttcattattgggcttcgtggctacagtaacgctaatccccgcctttagaggccattttatagccgccagattgtgtggacaggacttgaacaaaactagtagacagcagatccccgagagtcagggggtgatttccggtgccgtatttcttattatcctgttctgctttattccctttccattcctgaattgtttcgtgaaagagcagtgcaaagcctttcctcatcacgaatttgtggcactgattggagctctgttagccatttgctgcatgatcttcctgggctttgcagacgacgtgctcaaccttcgctggcgtcacaagcttcttttgcctacagccgcttctctgcctctgctgatggtgtactttacgaacttcggtaatacaacaattgtcgtgcccaagcctttcaggccaatactgggtctgcacctggatctggggatactttactacgtgtacatgggccttctggccgtcttttgtaccaatgcgataaacattctcgcagggatcaatggtctggaggcaggccagtctctggttatcagtgcaagcatcattgtgttcaacctggtggaactggagggtgattgcagagatgaccacgtgttctcactgtactttatgattcccttcttttttacaactctggggttgttataccacaattggtaccccagtcgggtcttcgtcggcgatactttctgttactttgccggcatgacatttgcggtagtgggaattttgggccactttagcaagactatgctcctgttttttatgccccaggtattcaatttcctgtactctctgccacagctactacacatcattccttgtccacgacatcgaatccctaggctgaatatcaaaactgggaagctagagatgagctacagtaaatttaagacgaagtccctgagcttcctgggaacgttcatcctgaaggtggccgaatccctacaattggtgacagtccaccaaagcgagacagaggacggcgagttcactgaatgcaacaacatgacactaatcaacttgctgctgaaagtactgggtcctatccatgagcgtaacctcactcttcttctcctgctgctgcagatcctggggtctgccattactttcagcatcagataccagctcgtccggctgttctatgacgtttag

SEQ ID NO: 25961 - DNA, 1227 bp, Artificial Sequence
  Description of Artificial Sequence: Synthetic coding sequence
atgtgggccttctctgaattgcccatgccacttcttattaacctcattgtgagcttgcttgggttcgttgcgaccgtcacactaatcccagccttcagaggtcattttatagcagcccgtctgtgcggtcaggatctgaataaaacctcaaggcagcagatacccgaatcccagggggttatttccggggcggtattcctcatcatcctgttctgcttcatccccttcccgtttctgaattgtttcgtgaaagagcagtgcaaggcatttccccaccacgagttcgtagctttgatcggtgccctgctcgctatctgctgtatgatcttcctgggctttgccgacgatgtgttaaatctgagatggcggcataagctcttgcttcccactgctgcatctctaccattactaatggtgtactttacaaattttgggaacacgaccatcgtggtgccaaaaccttttcgccctattctgggccttcacttggacttgggcatcctgtattacgtgtatatgggactgctcgctgtattttgcaccaacgcgattaacattcttgcagggattaacggtctggaggctggccagtccctcgtcatttcagccagtatcattgtgttcaacctggttgaattggaaggcgattgccgtgacgatcacgtcttctcactgtacttcatgatccctttcttcttcactacactagggctgttgtaccacaattggtatcccagtcgtgtgtttgtcggcgatacgttttgttacttcgctgggatgacgtttgcagtggtgggcattctcggacatttttccaaaaccatgctcctgttctttatgccccaggtgtttaatttcctttatagtctcccacaactcctgcatataattccttgccctaggcaccgcatcccacgactgaacatcaagactggaaagctcgagatgtcttattccaagtttaagactaagagcctgtcattccttgggacattcatactgaaagtagccgagagccttcagttagttactgtgcatcagtccgaaacagaggacggggagtttacggagtgtaacaatatgaccctcatcaacctgttgctgaaggtgttgggaccaatacacgagcggaatctcaccctcttacttctgttgctgcaaatactgggctcagcaattacattctccattcggtaccagctggtgcgactattctatgacgtctag

SEQ ID NO: 25962 - DNA, 984 bp, Artificial Sequence
  Description of Artificial Sequence: Synthetic coding sequence
atgatattcctgggcttcgctgatgacgtactaaacctaaggtggaggcacaagctgctcctgcctactgccgcatctctgcccctgctcatggtctacttcactaattttggcaataccacaattgtcgtgccaaaaccttttcgtccgatcctggggctacacttggatctgggcatactctattatgtgtatatggggcttctcgcagtgttctgcacaaatgccattaacattctcgcaggcattaacggactggaggctgggcaaagcctggtcattagcgcttccatcatcgttttcaatctcgtggagctggaaggcgactgcagagatgatcatgtatttagcctatacttcatgatcccattttttttcactaccttaggattgctttaccataattggtatccatcaagggtatttgttggcgatacattctgttattttgcggggatgacatttgccgtggttgggattctcggacatttcagtaagactatgctgcttttttttatgcctcaggtttttaattttctgtattccttaccccaactgttgcatattattccctgtccacgccacaggatcccacggctgaatattaagaccggaaaacttgaaatgtcttactctaagtttaaaactaaatccctcagttttcttggcacatttatacttaaagttgccgagtctcttcagctggtgacagtgcaccaaagtgagactgaagatggtgagttcacagaatgcaacaacatgacactcataaatctgcttttaaaggtcctgggaccaattcacgagcggaacctcaccctgctattactcctgctgcaagtccgcatgggcatagagtttatcccgccttgcctgcctttctgtgttattctgacacccgtccacttttccctacagattctcggatcggctatcaccttctccataaggtatcaacttgtccgtctgttttatgatgtctag

SEQ ID NO: 25963 - DNA, 255 bp, Artificial Sequence
  Description of Artificial Sequence: Synthetic coding sequence
atggccaccgggacagatcaggttgtaggcttgggactggtagccgtatctttgattatcttcacgtattacacagcatgggtcatcctgttgcctttcatcgactctcagcacgtcattcataagtacttcttgcctagggcctatgccgttgctatacctctggctgccggactcctcctgttgttgttcgtcgggctcttcataagctacgtgatgctgaagacaaagagggtaaccaagaaggctcagtag

SEQ ID NO: 25964 - DNA, 393 bp, Artificial Sequence
  Description of Artificial Sequence: Synthetic coding sequence
atggccactggcactgaccaggtcgttggattgggcttagtcgcagtttctctgatcatcttcacttactacacagcctgggtgattctactcccatttattgacagccagcacgtgattcacaagtactttttgccgcgagcctatgccgtagcaatcccattagcggccggtctgttgctgctgttatttgttgggaagagcagtcctcctcctcttgaccctggtcaagggtttgggaagacaccacctctaaatatgctgccccactttggcggggccgggagctgcctgccacgaacacatccctggggttttccagtccacccaagccggctgcctgtttccaacttgtgggtctcttggtgtcctaggttattcggactccagtag

SEQ ID NO: 25965 - DNA, 7110 bp, Artificial Sequence
  Description of Artificial Sequence: Synthetic coding sequence
atgaataccgaggaattggagctactttcagacagcaaatatcgtaattacgttgcagccatcgataaggctcttaagaacttcgagtacagcagcgagtgggcagatttgatctcagcactcgggaagcttaataaggtgctgcaaaataatgctaagtatcaagtggtgccaaagaaactcaccatcggtaagaggttggcccagtgtctacaccccgcacttccaggcggggtccatcgcaaagcattggaaacttatgagatcattttcaagatcataggacccaagagactcgccaaggatctgttcttatatagttctggattatttcctctgctcgcgaatgccgctatgtcagtgaagcctaccctcctgagcctgtatgaaatttactacctgcccctcgggaaaaccttgaagccgggtcttcagggactgttgacaggcatcctgccagggctggaagagggttcggagtattatgagcggacaaacatgttactcgagaaagtcgcggccgccgtagatcagtccgccttctattcggctttgtggggctctctactaacctctccagctgtacgcctgcccggcattacttatgtgttagcgcatctgaacaggaagctgtccatggaagatcaactgtatattatcgggagtgacatcgagctcatggtggaggcagtgtcgacctccgtgcaagactcatctgtgcttgtgcagcgctctactttagacctgatcttgttctgcttcccatttcacatgagccaggctacaaggcccgatatgatccgcatcctgagtgctgcactacacgtggttctccggagagatatgtccctgaaccgacgcctgtacgcctggctgctcggacctagaagcactaggcactccaacccagaggaacatgcaacctattattttacaacgttctccaaggaattgctggtgcaggccatggtaggaatccttcaagtcaacggcttcggagaggaaaacacgctgatgcaggatctcaaacccttcaggattctcatctccctcctggacaagcctgagctgggacccgtgatactcgaggacgtgctgatcgaggtcttccgaaccctctactcccagtgtaaggctgagcttgaccttcagacagaacctcctttttctaaagaccatgctcagctctcatctaagctgagggagaacaagaaaaccgccgaactcataaaaaccgccaatctgttattcaacagctttgagccctactatatgtgggactacgtggcaaggtggtttgaagagtgctgtcgtcgtacacttcacgtccgacttcagatcggtcccggcgactccaatgactccagtgagctgcagctgacgaacttttgcttactcgtcgatttcctgctggatatcgtctcactggagacatatattgagatccagaccgaacatctgccccaattgctgctcaggatgatctctgcccttacatcacatctgcaaacattgcacttgtcagagctgacagatagcctgaggctctgcagtaaaattctgtctaaagtacagccacccctgttgagcgcatcaacaggtggagttctgcagttcccctctgggcagaacaacagcgttaaggagtgggaggacaagaaagtctccagcgtgtcacatgagaacccgaccgaggtttttgaggatggtgaaaacccgccttcctcacgtagtagcgaatctggcttcactgagtttatacaataccaggctgatcgcaccgacgacattgacagagagctttccgagggccaaggagcggccgctatccccattggatctacgagctctgagaccgagacggcctctaccgtgggcagtgaggaaaccatcattcaaacaccatctgtcgtaacacagggaacagccactcgttctcggaagacagcccaaaaaaccgcaatgcagtgttgcctcgagtatgtgcagcagttcctcacacggctcattaatctgtatatcatccagaacaatagtttttctcaaagccttgccacagagcaccagggtgatctaggaagggagcagggtgaaacttcaaagtgggatcggaattcacaaggcgatgtcaaggaaaagaatatcagcaagcagaaaactagcaaggagtacctctctgctttcctcgccgcctgccaactctttctggagtgcagtagcttcccagtgtacattgctgaaggtaaccatacaagcgagctgagaagtgaaaagctggagacagattgcgaacacgtccagccaccgcagtggctgcagaccctgatgaatgcatgtagccaggcttccgacttcagcgtccagtcagtagccatctccctggtcatggatcttgtggggctgacacaatcagtggctatggtaacaggcgagaatattaattccgtggagccagcacagcctttaagccctaaccagggcagggtcgccgttgttattcggcccccattaactcaggggaacttgcgatacatcgctgagaaaactgaattttttaaacatgtggctctgacactgtgggaccagcttggcgacggtacccctcagcaccaccaaaagtcagttgagctcttctaccagcttcacaatctggtcccaagcagctcgatttgcgaagacgttatctcccagcagctcacgcataaggacaaaaagattcgcatggaagcacatgccaaatttgcagtgctgtggcacctgacccgggatttacacatcaataaaagctcgtcctttgtgcggagtttcgatagaagtctgttcataatgctagacagtcttaattcattagacggatctacctcctctgtggggcaggcctggcttaaccaggtcctgcaacggcacgatatagccagggttttagaacccctgctcctactcttgctccaccctaagactcagagggtatcagttcaaagagtccaggccgagcgctattggaacaagtctccttgttaccctggtgaagagagtgataagcacttcatgcagaactttgcatgtagcaacgtgtctcaggttcagctgatcacttcgaaaggcaacggagagaagcccttgaccatggatgagatcgagaatttctcattgaccgttaacccactgagtgaccgcctgtcactgctcagtacatcctccgagactattccaatggtcgtgagcgacttcgacctgccggaccagcagatcgagattctccagtcctcagatagcggatgctctcaaagctctgcgggggacaatctaagttacgaggtggatcccgaaaccgttaacgcccaagaggattctcagatgccgaaagagagcagccccgacgatgacgtacaacaggtcgtgtttgatttgatctgcaaagttgtctcagggctcgaggtggaatccgccagtgtcactagccagctggagattgaggccatgccaccaaagtgtagtgatattgaccctgatgaagaaacaatcaaaatagaggacgatagtattcagcagtcccaaaatgccctgctgtccaatgagagcagccagtttttatccgtgagcgccgaggggggccatgaatgcgtagcaaatggcatttcacgcaattcttcaagcccttgtatcagtggtactacacacacactccacgattcctccgtagccagcattgagacaaaaagtcgacagcgcagtcactcttccatacagttcagttttaaggaaaaactgtccgagaaggtgagtgaaaaggaaaccatagtgaaggagagcggtaaacagccaggggcaaaacccaaggtaaagctggcgcgtaagaaggacgacgacaagaaaaagtcatcaaacgaaaagctgaaacagacctctgttttcttttccgatgggttagatctggagaattggtatagctgcggcgagggcgatatctctgagatcgaaagcgacatggggagtcccgggtctagaaaaagtccaaactttaacatccaccctttgtaccagcatgttctgctgtacctccagctttacgactcaagtagaacgctctatgcattttccgccattaaagctatcttgaaaaccaatccgatcgcctttgtgaacgctatcagcaccactagcgtaaacaatgcatatacaccccagttgtcacttctgcagaacctgttggctagacaccggatatctgtgatggggaaagacttctactctcatatccctgtggacagcaatcataactttagatcctctatgtacatagaaatattgatctccctgtgtctctattatatgaggtcacattacccaactcacgtcaaggtgacagcccaggatctgatcgggaatagaaatatgcagatgatgtccattgaaattcttactcttctctttactgaactggcaaaagtcatagagtcctcagctaaaggcttcccctcctttatttcagatatgctgtccaagtgtaaagtgcaaaaggtgatactgcactgtctgctttccagtatttttagtgcgcagaagtggcatagtgagaagatggcggggaagaacctggtcgccgtggaggaaggattctccgaggacagtttgataaacttctcagaagatgaatttgacaatggttcaaccttgcaatcccagctcttaaaggttctgcagcggttgattgttctcgagcaccgagtgatgactatcccagaagagaatgagacgggatttgatttcgtggtctctgacctcgagcacatttctccccaccagccaatgaccagtcttcagtacttgcacgcccaaccaattacctgccagggtatgttcttatgtgcagtcattcgcgcactacaccagcactgtgcttgtaagatgcatccacaatggataggattaatcacctcgaccctgccttacatgggaaaggtcctgcagagggtggtggtgtcagtgaccctgcagctgtgtcgcaacctcgacaaccttatccaacagtataaatacgagacagggctcagcgacagtcgccctttgtggatggccagtatcatccctcccgatatgatcctgactctcctcgagggaatcacagcaattattcattattgtctgctggatcccaccacccaataccaccagctgttggtatcggtggatcagaagcatctattcgaagccagatcaggcatcctgtccatcttgcacatgatcatgagctccgtcactctgctttggagcattctgcaccaagccgatagtagtgagaaaatgacgatcgctgcctcagccagtctgactaccatcaacctcggcgccaccaagaacctacgccagcagattctggaactgctgggacccatctctatgaaccatggcgtgcatttcatggctgccattgcgttcgtatggaatgagagaagacaaaataaaacaacaacacggactaaggttattcccgccgcatctgaggagcagctgctgctagtagagctggtcagaagtatcagcgtgatgcgcgccgagacggtaatacagaccgtgaaggaagtgcttaagcagcctccggccattgctaaggacaaaaagcatctgtcattagaggtttgtatgctgcaattcttttatgcatatatccaacgagtcctcaatgaattcattatgaagaatccttctcttgagaacaagaaagaccagagggacctccaagatgttacgcataagatcgtggatgcaattggtgcaatcgccggatcctctctagagcaaactacttggctgcggcggaatctggaagtgaagccctcgcccaagattatggtggacgggacgaatttagagagcgatgtggaaggaattctagtcaaacacctgggcctgctgtccgtgctggcacacttgctggatatggtgttttattccgatgagaaggagcgcgtcattcccctcctcgtaaacatcatgcattatgtggtgccatacttaaggaatcattcagctcacaacgctccctcttacagagcctgcgtgcagctcttatcgtctctcagtggctatcagtacacccgtcgagcgtggaaaaaagaggcatttgatctgtttatggatccctcattcttccagatggacgcatcctgcgtgaatcattggcgagctattatggacaatttgatgacacacgacaagacaactttccgcgacctaatgaccagagtggcagtggcccagtcatccagtctgaacctgtttgccaatagagacgtcgaattagaacaaagggcaatgctcctgaagcggctggctttcgccattttttccagtgagattgaccagtaccagaagtatctgcccgatatccagggtattcccgtaagtaagtgggtgcagctgctgacagccctcagtccagcctaccgtacgtcaggcccatcggtcgcgggtctggagactacctacacgggcggaaatggattttccaccagttataatagtcagcggtggctcaatttgtatctcagtgcttgcaaattccttgatctggcgctggccttgccatctgaaaacctccctcaatttcaaatgtacagatgggcgttcattccagaagcctcagacgattccgggctggaagtgcggcggcaaggtattcaccagcgtgagtttaaaccttatgttgtgcgcctagccaaattactccgcaagagggctaaggacaaagaagaagatttcaagacggtgatccttgaagggctcgagatggcaaagcatcagaagaatcctgaggaggacaacagtggccgaactcttggatgggaacccggacacctactgctaaccatttgtactgttcgatctatggagcagcttctgccgttttttaacgtgctgagccaggtattcaacagcaaggttacatccagatgcggcggccacagcggctcacctattttatactcgaacgcctttccaaacaaagacatgaagcttgaaaaccacaagccgtgttcaagcaaggcgagacagaaaatcgaggaaatggtcgaaaaggacttcctggaaggcatgatcaagacttag

SEQ ID NO: 25966 - DNA, 7398 bp, Artificial Sequence
  Description of Artificial Sequence: Synthetic coding sequence
atgaacaccgaggagctggagcttctgagtgattccaagtacagaaattacgtagctgcgattgacaaggcactgaaaaacttcgagtatagtagcgagtgggccgatttaattagtgccctcgggaaactaaacaaggttttacagaacaacgctaaataccaagtggtgcctaagaaacttacaataggtaaacggctcgcccaatgcctacatcctgcacttcccgggggagttcatcgcaaggccttggaaacttatgagattattttcaaaatcataggccccaagaggctcgcaaaggatctgtttctatactcatctggtctgttccctctgctggccaacgcagcgatgagcgtgaaaccgaccctgctgtccttgtatgaaatttactaccttccactgggaaaaaccttgaaacctggccttcaaggcctccttaccggaattttacccggattggaggaaggatcagaatactacgaaaggactaatatgctcctcgaaaaggtagctgctgccgtggaccaatccgctttctacagcgctctgtggggtagcctactgacctctcctgccgttagactgcccggaattacgtatgtgctcgcccacctgaataggaaactgtcgatggaggatcagctctacatcattggttcggacattgaactgatggttgaggctgtgagcacatccgtgcaggatagttccgtcctggtccaacggtcaactctggatcttatcctgttctgcttcccctttcacatgagtcaggcaactcggccagacatgattcgaattttgtcagctgcgctgcatgtagtgctgcgacgggatatgtctctgaatagacggttgtatgcgtggctgttaggtttcgacaacaatggggcaattataggtccccgctccactcggcacagtaaccctgaagaacacgctacttactatttcaccacattctccaaggagttgttggtccaagccatggtaggcatcctgcaggtgaatggatttggcgaagaaaatacgctgatgcaggacctaaaaccgttccgaattctgattagtcttttggataagcccgaactgggtccagtcatcctggaggacgtactgatcgaggtctttagaactttatacagccagtgtaaggctgaattggaccttcaaacagagccaccattttcaaaggatcacgctcagttgtcttccaaacttagagagaacaagaaaacagctgagctgattaagaccgccaacctcctcttcaatagttttgagccctactacatgtgggactacgttgcaaggtggtttgaggaatgttgccggcgaactctgcatgtgcggctgcagatcgggcctggcgatagcaacgattcttctgagctccagctcaccaatttttgcctccttgttgatttcttactcgatattgtgtcccttcccaccaggtctatgcgcgtgctctgccaggagacctacatcgaaatccagaccgaacacctgcctcagctgttgctgaggatgatctctgcgctgacttcccatttacaaaccttgcatctttcagagctgactgattccctccgcttgtgttccaaaattctctcgaaggttcagccaccgctgctctctgcaagtacaggaggggtgttacagtttccaagcggccagaataatagcgttaaagagtgggaggacaagaaggtcagcagcgtgtcgcacgaaaatcctaccgaggtattcgaagatggtgagaaccctcctagcagcaggtcttctgaatccggattcacagaattcatccaataccaagccgaccgaaccgacgacatcgatcgcgaactgtctgagggccagggcgccgcggctattccaattggcagtactagctcagagactgagacagccagtacagtcggatcagaggagaccatcattcaaacgcctagcgtagtgacgcagggaacagccacaagaagtcgcaaaaccgcccagaaaactgccatgcagtgttgtctggagtacgttcagcaattcttgactaggttgattaacctgtacatcatccagaataattccttttcacaatccctagccacggaacatcagggagacctggggagggagcagggcgaaacctccaaatgggatcgcaatagtcaaggcgacgttaaggaaaagaacatctctaagcaaaaaacatccaaagagtacctttccgccttcctcgcagcttgtcagttatttctcgaatgctcgagctttccggtgtacattgctgaggggaaccacacttctgagttaagatcggaaaaactcgaaacagattgcgagcacgtgcagcccccacaatggttgcagaccttgatgaatgcgtgctcccaggccagtgacttttccgtccagagtgtggccatctccctcgtcatggatctggtcggactcacccagtcggttgcgatggtgacaggcgaaaacatcaactccgtggagcctgctcagcctctgtccccaaaccagggccgtgtggctgtcgtgatcagaccaccactcacccagggcaacctgcgttatatagcagagaagacagaatttttcaagcatgtcgcacttaccctatgggaccagctgggggatggaacaccgcagcatcaccagaagagcgtggaactgttctaccagttacataatctcgtcccctcatcaagcatttgtgaggatgttatttcacagcagcttactcacaaggataaaaaaattagaatggaggcgcatgccaagtttgctgtgctgtggcacctgacccgcgatctgcacatcaacaaatcgtcttcctttgtcaggtcctttgaccggtctctgttcatcatgctggattccctcaactcccttgatggctctaccagcagcgtaggccaggcttggctgaatcaggtcctgcagcgccatgatattgcgagggtgctagagcccctgctgctactcttgttgcatccaaaaacacagcgagtcagcgtacagcgcgttcaggccgaacgttactggaataaaagtccttgctatcccggcgaggaaagcgataaacattttatgcagaatttcgcgtgctccaacgtgagtcaggtgcagctgattacctctaagggaaacggagagaagcctcttacaatggacgagatagaaaacttttccctgactgtaaaccctctctccgaccggttgtcactgctgagcacctcgtctgagacaatccctatggttgtgtcagatttcgatcttcccgatcagcagattgaaatcttgcagtcaagcgactctggctgctcccagtctagtgctggcgacaatctaagttatgaggtggacccagaaaccgttaatgctcaagaagattctcagatgcccaaagagtcaagccccgacgatgatgtccaacaagtcgtgttcgatcttatatgcaaagtggtttctgggctggaagtggaaagtgcaagcgtgacatcgcagctggagatcgaagctatgcctcctaagtgcagtgatattgatcccgacgaggagactataaagatagaagatgacagtattcaacaatcccaaaacgctctgctttctaacgagagctctcagtttctctctgtctctgctgagggaggccacgagtgcgtggctaacggaatctctcggaactccagctcaccatgcattagcggcacaactcatactcttcacgactcctctgtggcctccatcgagaccaagagccgtcaaagaagccacagctcaatccagttcagcttcaaagaaaagctctccgaaaaggtatctgagaaagagactatcgtgaaggagtcaggcaaacagcccggggcgaaacctaaagtgaagctcgcacggaaaaaagacgatgacaagaagaagagctccaacgagaaactgaaacagactagcgtcttcttctctgacggcttggaccttgaaaattggtattcctgtggtgagggggatatcagcgaaattgagtcggatatggggtcaccagggagccggaaatcacctaactttaatattcaccctttatatcaacatgtgctgctgtatttgcaactgtacgacagtagtaggaccctctacgcgttctctgcgatcaaagctatcctgaaaactaaccccattgcatttgtcaacgcaatcagcaccacaagcgtgaacaacgcctatacccctcagctgtctctcttgcaaaatctgttagcacgtcaccggatttccgtgatgggcaaggacttctactctcacattccagtcgactcaaaccacaactttcggagctcaatgtatattgaaatcctgattagtctgtgtctgtactacatgagatcccattatcccacacacgttaaagttacagcacaggatctcattgggaacaggaacatgcagatgatgtccattgagattctgaccctgttgttcacagagctcgctaaggtgatcgagagctcagctaagggattccccagcttcatcagcgacatgttatccaaatgcaaggtgcaaaaggtgattctgcactgtcttctctcgtctattttttccgctcagaagtggcactcggaaaaaatggcaggcaagaatcttgtcgcagtcgaggagggcttttccgaggactccctcataaacttctccgaagacgaatttgacaacggcagtaccctgcagagccagctgctcaaggtattgcagagattgatcgtgctggagcatcgagtaatgactattcctgaggagaacgagaccggatttgatttcgtggtttcggaccttgaacacattagccctcaccagcccatgacttctttacaatacctccatgcccaacctattacatgccaggggatgttcttatgtgcggttatcagagccctgcatcagcactgcgcttgcaaaatgcacccccagtggataggcctcatcacgagcaccctgccatacatgggtaaggttttgcagcgggtggtagtgtccgtaactttgcaactgtgtaggaacttagacaatctcatccagcagtacaaatatgagacaggactttccgatagccggcctttgtggatggccagtataatcccccctgacatgatactaaccctgttggagggtataacagccatcattcattactgtttgctggatccaacgactcaataccaccaacttttggtgtccgtggatcagaagcacttgttcgaggccagatctggaatcctgtctatcctgcacatgatcatgagctcggttactctcctttggtcaatcttgcaccaagccgactcaagcgaaaaaatgactatagcagcctcagccagcctgacaacaatcaatctgggtgccaccaagaacttaaggcagcaaattttggaattgctggggcccattagcatgaaccacggggtgcacttcatggccgctatagcatttgtgtggaacgaacgacgacagaataaaactactacccggaccaaagtgatccctgcagcctctgaggaacagctgctcttggtcgagttagtgaggtcaatttcggtcatgcgggcagagacggtcatccagacagtgaaagaggtgctcaaacaaccaccggcaatagctaaagacaagaagcaccttagccttgaagtttgtatgctgcagttcttttacgcctacattcaaagaatccccgtcccaaatctggtcgatagctgggctagcctgctgatccttcttaaggactccatccagcttagcctccctgctccaggtcagttccttattctgggcgtgcttaacgagttcattatgaagaatccatcattggaaaataaaaaagatcaaagagatctgcaagacgtgacacacaagattgtggacgccattggagccatcgccggcagctcattggaacagacaacatggcttcggcgcaatctcgaagtgaagcccagccccaagattatggttgatggaacgaatcttgagtccgatgtcgaagatatgctcagcccggccatggaaacagctaatattacaccttctgtctattccgtgcacgccctcacacttctcagcgaagtcctggcacacctgctggacatggtgttttattctgacgaaaaagagagggtcatcccgctcctggtgaatattatgcactatgtggtgccataccttcgcaatcacagtgcccataacgccccttcctacagagcttgtgtccaactgctcagctctctttccggctaccagtacactagaagggcatggaaaaaggaagccttcgatctgttcatggacccaagtttcttccaaatggacgcaagttgtgttaatcattggagagcgatcatggataatctgatgacacacgataagaccacgtttagggatctcatgaccagggtagccgtggctcagtctagcagcttgaacctgtttgccaacagggacgtggagctcgaacagagggctatgctgctcaaacggttggcttttgctatttttagcagcgaaattgatcagtaccagaagtacttgcctgatatccaagaacgactagtggagtctttgaggctgcctcaggtgccaacattacatagtcaagtcttcctctttttccgggtgctgctgctgagaatgagtccacagcatctgacaagcctgtggccaaccatgatcacggagctagtgcaagtatttctgctcatggagcaggagctcactgcagatgaagatatttctagaacctcaggaccttccgttgcagggctggaaacaacgtataccgggggtaacgggttcagcacatcttacaacagccagagatggctcaacctttacctgagcgcctgcaaattcttagacctcgccttggctctgccttctgaaaatctgccacagttccagatgtaccgctgggcctttatacccgaagcatcagatgattcagggctagaagtgaggcggcaggggatacatcagcgcgagttcaagccctatgtcgtcagactggcaaagctgttaagaaaacgagcaaaaaagaaccccgaagaggacaactctggacgcaccctcggatgggaacctgggcatctactcttgaccatttgcaccgtgaggtcaatggagcagttgctgccatttttcaacgtgctgtcccaggtattcaactctaaagtgacttcaagatgcggcggccactctgggagcccaattctgtatagtaatgcttttccgaacaaagacatgaaactcgagaaccacaaaccttgcagcagtaaggcgagacagaagattgaggagatggtcgaaaaggattttctcgagggaatgataaaaacttag

SEQ ID NO: 25967 - DNA, 7110 bp, Artificial Sequence
  Description of Artificial Sequence: Synthetic coding sequence
atgaacacagaagagttggaattgctgagcgactcgaagtaccgaaattacgtagctgccatcgacaaagcactcaaaaacttcgagtattcctccgagtgggctgatctgatatccgcgcttggaaaactcaataaagtgctgcagaataacgccaaataccaggtggtccctaaaaaactgaccattgggaaacggctggcccagtgcctccatcccgcgctgcccggtggagtgcaccgaaaagccctagaaacgtatgagatcatctttaaaatcataggccccaagcgtctggcgaaagatctattcctgtattcgtctgggttgttccctctgctggcaaatgccgcaatgagcgtcaagcccactctgttatcactgtacgagatctattacttacctctcggtaaaacactgaagcccggtcttcaggggctgttaactggtatcctccccgggctagaggaaggctctgaatactatgagagaactaacatgcttctcgaaaaggtcgctgctgcagtggatcaatctgcattttatagcgcattatggggttcactactgacctccccagccgtgcgcctacctggtattacatatgtgctggcccacctcaatcgaaaactgagtatggaggaccaattgtacattattggcagcgatattgagctaatggttgaggccgtgagcaccagtgttcaggacagtagtgtactcgtacagcgttccacactcgatctcatactgttttgtttccccttccatatgtcacaagcaacccgccctgatatgattcgtatcctcagtgcagccctgcacgtggtcctgcggagggacatgtctctcaacagaagactctacgcttggttgctcggaccccgctcaacacgtcactccaaccctgaggaacacgccacctattatttcactaccttttctaaagagttactggtgcaggccatggtgggtatcctccaagtgaacggttttggggaggagaatactctgatgcaagaccttaaaccttttaggatcctaatctcccttctggacaaacctgagttaggacctgtgatcctggaggatgttctgatcgaggttttccgcacactctatagccagtgtaaggcagaacttgaccttcagacagaacccccgtttagtaaggaccacgcccagctctcatccaagctgagagaaaataagaagacagcggagctgatcaaaactgctaacctgctttttaacagcttcgaaccctactatatgtgggactacgtggccagatggtttgaggagtgttgtcgaagaacactgcatgtgcgcttgcagattggcccgggtgactcaaatgatagttctgagcttcagctgaccaatttttgcctactcgttgattttttgcttgacattgtatctctggaaacctacatcgaaattcagaccgagcatctgcctcagcttctgctccgcatgatcagcgccctgacgagccatcttcagaccctgcatttatccgagctgacggactctcttcgcctttgtagcaaaatcctatctaaggtacaaccacctctgctctccgcctccacaggtggggtcctgcagttcccttccggccagaataatagcgtgaaggaatgggaggataaaaaagtttcctccgtgagccacgagaatcctaccgaagtgtttgaagatggtgagaaccccccatcatcacgctcaagtgagtccgggtttactgagttcattcagtaccaagccgatcggaccgatgacattgatagagaactgtctgaaggtcaaggagccgcagccatcccaatcgggagcacctcaagcgagaccgagaccgcctcaaccgtaggaagcgaggaaactatcattcagaccccctcagtggttactcagggcaccgctactcgttctaggaaaacagcacagaaaacagctatgcaatgttgcttggagtacgtgcaacagtttctcaccagactgattaatttgtatattattcagaacaattcttttagccagtcattggcgacggagcaccagggtgatctgggcagagagcagggcgaaacaagcaaatgggatagaaattcacagggggatgtaaaagagaagaatatttctaagcagaagacctccaaagaatacttgtccgccttcctggctgcatgtcagctgttccttgaatgctctagctttcctgtgtacatagcagaggggaaccatacctcagagttaagaagcgagaaactcgagaccgactgcgaacacgtgcagcccccacaatggctgcagaccctgatgaacgcctgttctcaggcttctgatttctctgtccaatcagttgcaatctcccttgtaatggacctggttggactaacccagagcgtagctatggtgacaggtgaaaacattaacagtgtagaaccagcacagcctctgtcacctaatcagggtcgggtagccgtggtgatcaggccaccactgacacagggtaacctgaggtacatcgccgaaaagaccgaattttttaagcacgtcgctcttactttatgggaccaacttggggacggcacccctcagcatcaccagaagtctgtggaactgttctatcagctgcacaatctggtcccatcctcatcaatttgtgaagacgtgattagccaacagttgacccacaaagataagaaaatacgcatggaagcccatgccaaattcgccgtgctctggcaccttacgagagacctccatatcaacaagtcctcatccttcgtgaggagttttgatagatccctgttcatcatgctggactcgcttaattctctggatggaagcacctccagtgtgggacaggcctggctgaaccaggtgctgcagaggcatgatattgcaagagtgctggagcctctgctcctgctgctcctccacccaaaaacgcagagggtttctgtgcagcgggttcaggcagagcgctactggaataaatctccatgttacccaggagaggagtccgataaacactttatgcagaactttgcatgttcaaacgtgtcacaagtgcaactcatcacaagcaaaggaaatggcgaaaaacctctcaccatggacgaaattgagaacttctcactgacagtaaatccactgtccgaccggctcagtctactttcaacatcgtctgagaccattcccatggtagtcagcgattttgatttaccggatcagcagattgaaattcttcagtcatctgacagcggctgttcacagtcctccgcaggcgataatttaagctacgaggttgatcccgaaaccgtgaatgctcaggaagacagccagatgcctaaagaaagcagccctgatgatgacgtacagcaggtcgtgtttgatctcatctgcaaggtggtgagcggcttggaggtggagtccgcgagtgttacctcgcagctggagatcgaggcaatgccccccaaatgcagcgatatcgaccctgacgaggagacgataaaaattgaagacgacagcatccaacagtctcagaacgcgctgttatcgaacgagtcctcacaattcctgtctgtgagtgccgagggaggccacgagtgcgtcgccaatggtatctcacgaaacagcagctccccgtgcatctcaggaaccacccatacattacatgactcctcagtagccagcattgaaacgaagagccggcagcggtctcactcctcaatacagttctcatttaaggagaaactaagcgaaaaggttagcgagaaggagaccattgtcaaagaatcgggaaaacagcctggggccaagcccaaagtaaagctggcgagaaaaaaagatgatgataagaagaaatcttccaatgagaaactgaagcagacttccgtttttttttctgacgggctggatctcgagaattggtatagctgtggcgagggcgacataagtgaaatagagtccgatatgggcagtcccggatcaaggaaatctcctaatttcaatatccacccactgtaccagcacgttctgctgtatttacagctatatgactcaagtcgcaccctgtacgcctttagcgctataaaagcaatcctgaagaccaacccaattgccttcgttaacgccatcagtaccacatccgtcaacaacgcctacaccccgcagctcagtctgctccaaaacctgttagccaggcatagaatatccgtgatgggcaaggatttctatagtcacattccagtggactccaatcacaatttccgttctagtatgtacatcgagatcctgatctcgctgtgcttatattatatgcggagtcactatcctacacatgtcaaggtgacggctcaggatctgattgggaaccggaatatgcagatgatgtccattgagattctcactctgctgttcaccgagctggccaaggtgatcgagagtagcgctaagggattccctagcttcatctccgacatgttatctaagtgcaaagtgcagaaagtgattctgcattgtctgttaagcagtatatttagcgcccagaaatggcattctgagaaaatggcaggcaaaaacttggtggccgtagaggaaggttttagcgaggactccctgattaacttctcggaggacgagtttgacaatggaagtaccttgcaatctcagttgttaaaggtgttgcaaaggttgatcgtgttggaacatagggtgatgacaatccctgaagagaacgagactggctttgattttgttgtcagtgacttggaacacattagcccccatcagccaatgaccagcctgcagtatctacacgcacagcctataacctgtcaggggatgtttctgtgtgcagtgatcagggccctccaccagcattgcgcgtgtaagatgcatccgcagtggatagggctgattacctctaccctcccatacatggggaaggttcttcagagggtggtagtctcagtcaccctccaactatgtagaaacttagataatttgatacagcagtacaagtacgagaccgggctgtctgattccagaccactttggatggcttccattatccctccagacatgattctcaccctgctggagggcattactgccatcatccactactgtctactggatcccaccacccagtaccatcaactcctcgtgagcgtggaccagaagcatctttttgaggccagatccggaatcctcagcatattgcacatgatcatgtcaagtgttacattgttgtggtctattttacaccaggctgactcaagcgaaaagatgaccatcgccgctagtgcatcccttaccaccataaacttgggggccaccaaaaacctccggcagcaaatcctggagctgttaggaccgattagcatgaatcacggcgtgcatttcatggccgcgatcgcattcgtctggaatgaacgcaggcagaacaaaacgaccacacggaccaaagtgatacccgccgcgagcgaggagcagctcctgctggtcgaactggtgcgctccatctctgtgatgagggcagagacggtgatccaaacagttaaagaagtactcaagcaacccccagcgattgccaaggacaaaaaacacctatcccttgaagtgtgtatgctccagttcttctacgcctatattcagagagtgctcaatgaatttatcatgaagaatcccagtctggagaacaaaaaagatcagcgggacctgcaggatgtcacccataagatcgtcgacgccattggcgcaattgcaggctcctcacttgagcagacaacatggctgcggcggaacctggaggtgaaaccctctccaaaaattatggtggatgggactaacttagagtctgacgtggaaggtattctcgtgaaacatctcggattactatctgtgctcgcacacctgcttgacatggtcttctacagcgacgaaaaggaaagagtgatccccctgctggttaacataatgcactacgtggtgccatacctgagaaatcactcggcccacaatgctcccagttatcgggcttgcgtacagttgctgtcttccctgtcaggctatcaatacacccgcagggcgtggaagaaagaagcttttgacttattcatggatcccagcttctttcaaatggatgccagttgcgtgaaccattggcgcgcaatcatggataatctgatgacgcacgataagacaaccttccgggacctgatgactcgagttgctgttgcgcaatcaagttcgcttaatctcttcgccaatagagatgtagagctcgagcagcgagctatgctcctaaagaggttggcctttgccatttttagttctgagatcgaccagtatcagaaatatcttcccgacatacagggaatccccgtgtctaaatgggttcagctgctcactgctctaagtcccgcatataggacctctggcccatctgtggccggcctggagaccacttacaccgggggaaacggcttttcaaccagctataatagccaacggtggcttaatttatatctgagcgcctgtaagttcttagatctcgccctggcactaccatctgaaaatttaccccaatttcagatgtaccgctgggcatttatccctgaggccagtgacgatagtggcttggaagtccggaggcagggaattcaccagagagagtttaaaccgtacgtggtgcgcctggctaagctgctgaggaagagggccaaggataaggaggaggattttaaaactgtcatcttagaaggactggagatggcaaagcaccagaagaatcccgaggaagacaactccggaagaaccctgggctgggagcccggacacctgttgctgaccatatgcacagtacggagtatggagcagctgctgcccttctttaatgtattgagtcaagtgttcaattctaaagtcacatctcgttgtggtggacattccgggtcccccatcctgtacagtaacgcctttcctaacaaggatatgaaactggagaatcataagccctgtagcagcaaagctcgccagaagattgaagagatggtggaaaaagattttctggaaggaatgatcaaaacatag

SEQ ID NO: 25968 - DNA, 690 bp, Artificial Sequence
  Description of Artificial Sequence: Synthetic coding sequence
atgaataccgaggaactggaactgctttcagattcgaagtatcgcaattacgtggcagctattgacaaggccttaaagaacttcgagtatagttccgagtgggcagacctgatttccgcgctcgggaagctcaacaaggtccttcagaataacgcaaagtatcaagtggttccaaaaaagctgacgattgggaagagactggcccagtgcttacatccggctctgcccggcggagtccatcgtaaagcactggagacttacgagattatctttaaaattatcggtcccaaacgcttggcaaaggatcttttcctgtactccagcggcctgtttccccttctcgccaatgccgcaatgtctgtgaagcctaccctgctgagtttatacgagatttactacctccccctcgggaaaaccctgaagcctggcctgcagggcctgctcacaggcattctccccggactcgaagagggatcggaatactatgagagaaccaacatgctcctggagaaggtggctgctgccgtagatcagagcgctttctatagcgccctttggggaagtctgctgacatcgcctgccgttcgattgcctggcattacctatgtgttagcccatttgaaccgaaaattgagcatggaggaccagctttacatcatcggcagcgacatcgagctgatgaagcaatag

SEQ ID NO: 25969 - DNA, 423 bp, Artificial Sequence
  Description of Artificial Sequence: Synthetic coding sequence
atgcaacgcctaaatatcgggtacgttatcaacgttactacacatttgccactttatcactatgaaaaaggtctgtttaactataaaagactgccagcaaccgattccaacaagcagaacttacgccagtatttcgaagaagctttcgaattcatcgaagaagcgcaccagtgcggcaaagggctgttaatacattgccaggctggcgttagccggagcgcaaccattgtgattgcgtatctcatgaaacatacaagaatgaccatgaccgacgcatataagttcgtgaaggggaaacgccctatcatctctccgaatcttaactttatgggccaactgttagagttcgaggaagatttgaacaatggggtgacaccgaggatcctgacgcccaagctcatgggggttgagaccgtagtttag

SEQ ID NO: 25970 - DNA, 1449 bp, Artificial Sequence
  Description of Artificial Sequence: Synthetic coding sequence
atgcctcctagccctctggatgatcgcgtggtcgttgcattgtcaagacctgtgaggcctcaggacctaaacctttgtttggattcttcctatttaggctctgcaaacccaggatcaaattctcaccccccagtaatagccaccaccgtggtcagcttgaaagcggccaacctcacatacatgccaagcagcagtgggtcggcacggagcctgaattgcgggtgttcttctgccagttgttgtaccgtggccacgtatgataaggacaatcaggcccagactcaggccattgctgccggaaccactactaccgctattgggacctccacaacttgtccggctaaccagatggtgaacaacaatgaaaacactgggagcctgtctccttccagtggggtaggtagccccgtctctggcactccaaagcagctggccagtattaagataatttatccgaacgatctggccaaaaagatgaccaagtgctctaagtcccacctgccctcgcaaggtcccgttatcatcgattgtcgaccctttatggaatataataaaagccacattcaaggagcagtgcacattaactgcgccgataaaatctcgcgcaggcggttgcaacagggaaaaatcactgtactggatctgatctcctgccgagaagggaaagattcattcaaacgcatcttcagcaaagagattatagtatacgatgagaacaccaatgaacccagtcgcgtgatgcccagccagccccttcacatagtgctggagtcattgaagcgcgagggaaaggaaccgttagtcctcaaggggggattgtcatcatttaaacagaaccacgaaaatctgtgcgataatagcctgcagctgcaggaatgccgcgaggtaggcggcggcgccagcgctgcgagctcattgctccctcagcccatccccacaacacccgacattgaaaacgccgagctcacaccaattttgccttttctgtttcttggaaacgaacaggacgctcaggaccttgacacgatgcagcggctaaacatcggctatgtgatcaatgtgacaacacacctgcccctttatcactacgaaaaaggcctgtttaattataagcgactcccagcgaccgactccaacaaacagaatctgcggcagtatttcgaggaggccttcgaatttattgaggaggcccaccagtgcggaaagggcctgttgatacactgtcaagccggggtttctcgaagtgccaccattgtgatagcctatctgatgaagcatacgcgcatgaccatgacagatgcatataaatttgtaaaaggaaagcggcccatcatcagccccaacttgaattttatggggcagcttctggaattcgaagaggacttgaacaacggagtcacacccaggatccttactcctaagcttatgggcgtcgagaccgtggtctag

SEQ ID NO: 25971 - DNA, 1284 bp, Artificial Sequence
  Description of Artificial Sequence: Synthetic coding sequence
atgccgccctctccgctggacgacagggtggtagtggcgctatctcgcccggtgaggcctcaggaccttaatctctgtttagactcctcctatcttggaagcgccaatcccggaagcaatagtcaccctccagtgataactaccacagcgattgggacatcaacgacatgcccagccaatcagatggtcaacaacaatgaaaataccggaagcctgagcccctctagcggcgtaggcagccctgtgtctggaactccaaaacagctggcgtcaattaaaattatataccctaatgacctcgccaagaagatgactaaatgtagtaagagccacctgccctcacaggggccggtgatcatcgattgtcgaccatttatggagtacaacaagtcccatatccagggagccgtgcatattaattgcgccgacaagatatcaaggaggcggctgcaacagggcaagataaccgtccttgacttgattagttgccgagagggcaaggattcatttaagagaatcttcagcaaggagataattgtttacgacgagaatactaacgagccgagccgggttatgccatcgcagccactgcacattgttctggaatcactaaaacgggaaggaaaggagcccttagtgcttaaaggcgggctttcctctttcaagcaaaaccacgagaatctgtgtgacaatagcctgcagctccaggaatgcagagaggtgggaggcggagcaagtgccgcatccagccttctgcctcaacccatccccactacgccagatatcgaaaatgcggagctcactccgattttgcccttcctatttttagggaacgaacaagacgcccaggatttggacactatgcagcggctcaacataggctacgtgattaacgtcacgacgcatcttcccctttaccactacgaaaagggattgtttaactataaaaggctgcccgccaccgacagcaataaacaaaatctaagacagtactttgaggaagcattcgaattcatcgaagaagcccatcagtgcggaaagggcctgctaatccactgtcaggcgggcgtgtcacgcagcgctacaattgtaatcgcttacctcatgaaacatacacgcatgaccatgactgacgcatataagttcgtgaagggcaaacgccccatcattagccctaacctgaattttatggggcagcttttggagttcgaagaagatctgaacaacggagtgacacccaggatcctgactcctaaattgatgggagtagaaactgtggtgtag

SEQ ID NO: 25972 - DNA, 423 bp, Artificial Sequence
  Description of Artificial Sequence: Synthetic coding sequence
atgcagcgcctgaatatcggctatgtcatcaatgtgaccacacacttgcccctgtaccattatgaaaagggactcttcaactacaaacgtctgcctgcgaccgacagcaacaagcagaatctgagacagtacttcgaagaagccttcgagtttattgaagaagcgcaccagtgtggcaagggactgctcatccactgtcaggctggagttagtcgatccgcgacgatcgtcatagcttatctcatgaaacacacacgcatgaccatgacagacgcctacaagtttgtgaagggtaagcgcccaattatctcacctaatctgaattttatggggcagctactagaattcgaagaagacctcaataacggcgtaaccccccgaatacttacccccaagcttatgggcgtggagaccgtcgtctag

SEQ ID NO: 25973 - DNA, 888 bp, Artificial Sequence
  Description of Artificial Sequence: Synthetic coding sequence
atgactgagggggtgctacccgggctgtatctcggaaattttatagacgccaaggatctcgaccagctgggccggaacaaaattacacacatcatcagcattcacgagagcccacagcctttactgcaggatatcacttatctgagaattcctgtcgccgataccccggaggtaccaattaaaaaacactttaaagagtgcatcaattttattcattgttgccgactgaatggaggaaactgcctcgtgcactgcttcgctggcatctcgagatctactacaatcgttacagcttacgttatgaccgtgacgggactggggtggcgggatgtgctcgaggccatcaaagcaacccgcccaatcgccaatcccaaccccggctttagacagcaattggaagagttcggctgggcttcgtctcagaagggagcgcgccatcgaaccagtaaaacctccggggctcagtgtcccccaatgacaagcgcaacctgcctgctcgcagcaagggtcgcgctgttatctgccgctctggtgagagaggcaacaggcagaacagcccaacgctgtagactctcgcctcgcgccgcagcagagagacttctgggaccacccccccatgttgctgccggctggagcccagatcccaagtatcagatctgtctgtgcttcggggaagaagatcctggccctacccagcatccgaaggaacagctgatcatggctgacgtccaggtccaacttcgtcccggttctagctcctgcacgctgagcgcttccacggagcggcctgatggatcatcaacgccaggtaaccccgacggcataacccatcttcaatgcagctgcttgcatccgaagcgggccgcatctagttcctgcacgcggtag

SEQ ID NO: 25974 - DNA, 708 bp, Artificial Sequence
  Description of Artificial Sequence: Synthetic coding sequence
atggggaatgggatgaccaaagttctgcccggtctctatctgggtaacttcattgacgctaaggatttagatcagctcggccggaataaaatcactcacatcatttcaatacatgaatctcctcaacccttactgcaagatattacctatctcagaatccccgtggctgacacaccggaagtgccaatcaagaagcacttcaaagagtgtataaactttattcattgttgtcgccttaatggcggaaactgcttggtgcactgcttcgctggaatcagcagaagtaccaccatcgtgactgcttatgttatgacagtaacaggcttgggctggcgggatgtgctcgaggcgataaaagctaccagacccatcgccaaccctaacccgggttttagacaacagctggaggagtttgggtgggctagcagtcagaagctcagacgtcagctcgaagaaaggttcggtgaaagtcccttccgggatgaggaagagcttagggcccttttaccactctgcaaacggtgtcgccagggaagcgcgacgtcggcttcaagcgctggaccgcactctgccgcctcagaaggtactgttcaaaggctggtccctagaacccctcgcgaagcccataggcccctgccactgctggctcgagtcaaacaaactttctcctgtctccccaggtgcctgtcaagaaagggcggcaagtag

SEQ ID NO: 25975 - DNA, 264 bp, Artificial Sequence
  Description of Artificial Sequence: Synthetic coding sequence
atgggaaatggtatgactaagatgcccaagacctggatcagctgggcagagatacggagccacactagcagtctaagtatgagtcaccccagtttatgctgcagaatttctccgaccttcgcgagcaggagccttatccctctccggtacccatccaagtccacctctaagaatgtgtctactagtagcactgcagcagccctcatgggagggaccgctttgtgcacagccctgcaggcctcgctagccgcaccacggctgtag

SEQ ID NO: 25976 - DNA, 699 bp, Artificial Sequence
  Description of Artificial Sequence: Synthetic coding sequence
atgacggagggagtgcttcccggcttgtatctcggcaattttattgacgctaaagatctggaccagctgggacgtaataagatcactcatattatttccatccacgaaagtccccaaccactgctgcaagacattacctacctccggatcccagttgcggatacccccgaagtaccgatcaagaaacatttcaaagaatgtatcaactttatccactgctgtcgtctcaatggtggaaactgcctcgttcattgcttcgcaggcattagccgaagcacaacaattgtgaccgcttacgttatgacagtgaccgggctggggtggagggacgttttggaggccatcaaggctacacgcccaatcgcaaatcccaaccccggttttaggcagcaactggaggaattcggatgggcaagtagccagaagctgcggcggcagctcgaggaacgcttcggagaaagccccttcagagatgaggaggaactccgtgccctgcttcccctgtgcaagcgttgtagacagggcagtgcaacgtctgcttctagcgccggcccccactctgctgcctcagaaggcaccgttcagcgcctggttccccgaaccccgcgggaagcacaccggcccctgcctttgctggcacgggtgaaacagacttttagttgcctgcctcggtgtctatccagaaaagggggcaaatag

SEQ ID NO: 25977 - DNA, 399 bp, Artificial Sequence
  Description of Artificial Sequence: Synthetic coding sequence
atgaccgtgaccggacttgggtggagggatgtacttgaggccattaaggctacaagacctattgccaatcctaatcccgggttccgacagcagctggaggagttcggttgggcctcttctcaaaaactccgacgtcaactcgaagaacggttcggcgagtctccgttcagggatgaggaggagctgcgcgcattgctgcctttgtgcaagagatgtaggcagggatcagcaacttcggcctcctccgccggaccacacagtgccgccagcgaggggaccgttcaacgtttggtaccacggacgccccgggaagcacatcgacctttaccgctactggcgcgggtgaaacagaccttctcttgtctgccaaggtgcctttcacgcaaagggggaaagtag

SEQ ID NO: 25978 - DNA, 399 bp, Artificial Sequence
  Description of Artificial Sequence: Synthetic coding sequence
atgaccgttaccggactgggatggcgagacgtgctagaggccataaaggcaaccaggcctattgcaaatcccaatcctggcttccgacagcagctggaagaatttgggtgggcctcatcccagaaactcagacgacaactggaggaaaggttcggagaatctccattccgcgacgaagaggagctgagagctctgctgcccctgtgcaagagatgcagacagggctcagctacgtcagcttcctctgctggaccacacagcgccgcgtctgagggcacagtccagagacttgtgcctcgcacacccagagaagcccacagacctctacctcttctcgccagggtaaagcaaactttcagttgtctccctaggtgcttgagcaggaagggcggcaagtag

SEQ ID NO: 25979 - DNA, 282 bp, Artificial Sequence
  Description of Artificial Sequence: Synthetic coding sequence
tagactcgcctgccccccggaggatggtctccagaccccaagtaccaaatctgtctatgcttcggagaggaggaccctggaccgactcagcacccaaaggagcagctcatcatggctgacgtccaggtccagctgcggcctgggtctagtagctgtacgctctctgccagcactgaaaggccagatgggagctcgacccccggaaaccctgatgggattacccaccttcagtgctcgtgcctgcaccccaaacgggccgcctcctccagctgcacccgctag

SEQ ID NO: 25980 - DNA, 399 bp, Artificial Sequence
  Description of Artificial Sequence: Synthetic coding sequence
atgacagtcaccggtctgggatggagggacgtgttagaggcgattaaggcgacccgccctatagcgaaccccaaccctgggtttagacagcagcttgaagagttcggctgggcatcaagtcagaagctgcgacgccaactggaggagcgctttggggagtcacccttccgggatgaagaggaacttcgcgctctgctccccctgtgcaaaaggtgtcgtcagggtagcgctacttcagcttcttcagctggacctcactctgcggccagtgagggaacagttcagagactcgttcctcgcacgcctcgcgaggcccataggcccttgccactgcttgctagagtgaaacaaacgttctcctgtctacccagatgcctgtcccggaaaggcgggaaatag

SEQ ID NO: 25981 - DNA, 2514 bp, Artificial Sequence
  Description of Artificial Sequence: Synthetic coding sequence
atggctaaggcggctgcatcgtcatctctggaagacttagatttatctggcgaggaagtgcagcgtctgacctctgcattccaggatcctgagttccggagaatgttctcacagtatgccgaggaactgacagaccctgaaaacaggagaaggtatgaggccgaaataacagccctggaacgggaacgaggcgtggaggtgaggtttgtgcatccagagcccggacacgtgctgagaacaagtctcgacggcgcccgccgctgcttcgtaaatgtctgtagcaacgccctggttggagcaccctccagccggcccgggagtggaggcgaccgaggcgctgccccagggtcgcattggtccttaccttactcactggccccaggtagagagtacgcgggacgctctagttcccgatacatggtgtacgatgtagtgtttcatcccgacgccctggctttagcgcgcaggcacgaaggttttcgccaaatgctcgatgctactgcactcgaagcagttgaaaagcagttcggtgttaagctggacagacgaaatgcaaagaccctcaaggcaaaatacaagggtacgccagaggccgcagtgttgcgtacccccctccccggcgtgatacctgcaaggccagacggtgaacctaaaggacctctgcccgattttccctacccatatcaatatccagcagctccaggtccacgggctccgagcccacccgaagctgcattgcaaccagcccccacggaaccacgctattccgtggtacagcggcatcacgtggatctacaggattaccgctgctcacgggatagcgcacctagccctgtacctcatgaactggtcatcactattgaattaccacttctgcgctccgccgaacaggccgctttagaagtcacccggaagctcctctgtctggactcccggaagcctgactataggctacgactgagcctcccctacccagtagacgacggcagaggaaaagcccaattcaacaaggccaggcggcagttggtggtgacactgccagttgtgcttcccgcagcaagacgcgaacccgcagtggctgttgcggccgcggcgcccgaggaaagcgccgaccgctcagggacggatggccaggcctgtgcaagtgcccgggagggggaggctggacctgcccgatccagggcagaggacggaggacatgacacctgtgtcgcaggggccgcaggtagtggcgtcacaactctgggtgaccccgaagtggccccacccccagcggcagcaggcgaagaaagagttcctaaacctggggagcaggatctgtcgcgacatgccggcagccctcccgggagtgtagaggagccctcgcctggtggagagaacagccccggaggcggagggtcaccctgcctgtcgtctaggtccctggcctggggtagctccgccgggagagagtctgccagaggtgactcgagcgtggaaaccagggaggagagtgaaggcaccggcggccagcgatcggcatgcgccatgggtggcccagggaccaaatcaggggaacccttgtgccctccattgctttgcaaccaggacaaggaaactctgactctattaatccaggtccctcgtattcagccgcagagtctccagggagacttgaaccccctgtggtacaagttgcgctttagtgcacaggatctcgtctattccttctttctgcagttcgcccctgagaacaagctctccaccacagaacccgtaatttccatatcatctaacaacgcagtcattgaattggccaaatctcccgaatctcacgggcactggcgtgaatggtactatggggttaacaacgactcgttggaggagaggctgtttgtcaacgaggagaacgtaaatgaattcttggaagaggtcttgtcctctccatttaagcaaagcatgagcctgactcccccactaattgaggtcctgcaggtgaccgataataagatacagataaatgcaaaattgcaggagtgcagcaactctgaccagctccaaggtaaggaggagcgggtgaatgaggaatctcacctgacagaaaaggagtacatcgaacactgtaatacgccaacaactgactcagactcttccatagccgtcaaggccctacagatagattcctttggcttagttacatgtttccagcaagaaagtctagacgtgagccaaatgatcctcggcaagtcacaacagcctgagtcaaagatgcagtccgagttcattaaggaaaaatccgccacttgctcaaatgaagaaaaggacaacctcaacgagtccgtcattactgaggaaaaagagacggacggcgaccacctgtcaagcctgctgaacaagaccaccgttcataacataccagggttcgattctattaaggagactaacatgcaagatggctctgttcaggtgattaaagatcacgtgaccaactgtgccttctcattccaaaactctctgctgtatgacctggattag

SEQ ID NO: 25982 - DNA, 2370 bp, Artificial Sequence
  Description of Artificial Sequence: Synthetic coding sequence
atggccaaagccgcagcatcgtcatcgctggaggatctggatctatccggcgaagaggtgcagagactcaccagtgccttccaggatcccgaattccggagaatgttctcccagtacgccgaagagctgaccgaccccgagaatagacgtcgctacgaagctgaaatcactgcgctggaaagagaacgtggggtggaggtgagattcgtccatcccgaaccagggcacgtcctgcggaccagcctggacggcgccagaagatgcttcgtgaacgtctgttctaacgctctcgttggggcaccatcttctagacctggatctggtggggaccgcggtgccgcccccgggtctcactggtccctcccttattccctggcccctggacgtgaatacgcgggcaggtcttctagccgttatatggtctatgacgttgtgttccaccccgatgccctggccttagcaagaaggcacgagggatttcgacagatgctggacgctaccgccctggaggccgtcgaaaaacaatttggagtgaaactggatcgccggaatgccaagacattgaaagcaaaatacaaaggcacccccgaggcagccgtacttcgcactccactacccggcgtgatccccgccaggccagacggcgaacctaagggaccactcccagacttcccttatccttatcagtaccctgctgctccagggccccgggctcctagtccacccgaagctgccctgcagccggcccctaccgagcccaggtatagtgtggtacagcgtcatcatgttgacttgcaggactaccgctgttccagagatagtgctccaagtccggttccgcacgaactggtaatcaccattgaactcccattgttgaggagcgcggaacaggccgcattagaggttactaggaagctgttatgtctcgacagccgtaagccagactatcgcctccggctttcgctgccctaccccgtggacgacgggaggggaaaagctcagtttaataaggcccgcagacagcttgtggtgacgctaccagtcgtcctccccgcagctaggcgggagcctgctgtagccgttgccgcagccgctccggaagagtcagcagacaggtcaggaacggacggccaagcatgcgcatctgcacgagaaggtgaggccggaccagccagaagcagagcggaggacggcggtcatgatacatgtgtcgcgggcgccgccggttccggggtgactactctgggggatcctgaggtcgcacctccacctgcagccgctggagaagaacgcgttcccaaacccggggagcaggaccttagcagacacgctggttcgccaccaggtagcgtggaagaaccatcacccgggggagagaattctcccggcggtggtggtagtccttgcctaagctctcgttccctcgcttggggctctagcgccggccgagaatccgccaggggagactctagcgtcgaaacaagagaagaaagtgagggaaccggcggccaacgtagcgcttgtgcgatgggtggccctggaaccaaaagcggcgaaccgttatgccctcctctgctgtgcaaccaggataaggaaacactaaccctcctcattcaggtcccgagaattcagccacagagcttacagggagacctcaaccccttatggtacaaattgaggttcagcgcccaggatctagtatactccttctttctccagtttgccccagagaacaagctgtccactactgagcccgtcatctctatctcaagtaataatgcggtgatcgagctcgcaaaaagccccgagagccacggacattggcgagagtggtattacggggtgaacaacgattccctcgagcttcaagagtgtagtaattcagatcagctccaagggaaagaggaacgcgttaatgaggaaagccaccttaccgaaaaggagtatattgagcattgtaatacgcctactacagacagtgacagctccatagccgtcaaggcgctgcagatcgattcctttggactcgtgacatgcttccaacaggagtccctcgacgtgtctcagatgatcctgggaaaatcccagcagccagaatccaaaatgcagtcagagttcataaaagaaaaatccgctacgtgcagtaatgaagagaaagataacctcaatgaatcggtgattaccgaagaaaaggagacagatggggaccacctctcgagtctgctgaacaagactaccgtacacaatatccctggattcgattccatcaaagagaccaatatgcaagatggctctgtccaggtgattaaggatcacgtgaccaactgcgccttcagttttcagaacagccttttgtacgacttggattag

SEQ ID NO: 25983 - DNA, 2154 bp, Artificial Sequence
  Description of Artificial Sequence: Synthetic coding sequence
atgagcagaaggtcccagagactgacgagatactcacagggcgacgacgatggatcaagttcctccgggggaagttccgtcgccgggtcacagtcgactctgtttaaggatagtccactccgaacgttgaagaggaaaagtagcaacatgaaacgattgagcccagctccgcagttgggcccatcctccgatgctcacactagttactacagtgagagcctggtccacgagtcatggtttccaccgagatcttctctcgaagaactgcacggagacgccaactggggtgaagatttgagggttaggcgcaggaggggaaccggcgggtctgagagtagtagagcttccgggcttgtgggacgaaaggctactgaagattttttgggaagctccagcggttactcttccgaggacgattatgttgggtatagcgacgtggatcagcagagctcatctagccggcttcggtccgcagtgagtcgtgctggaagcctgttgtggatggtcgctaccagtccgggaagactctttcgcctgctctactggtgggctggtaccacgtggtatcgactgaccacagcagcttcactcctggacgtgttcgtcctgaccagaagattctctagtcttaaaaccttcctctggttcttgctgcctctgctgctgttgacctgtctgacctacggtgcttggtatttttacccttatggcctgcagacattccatccagcattggttagctggtgggcagctaaagattcccgccggcctgatgaggggtgggaagctagagatagctccccccatttccaagcagagcagagagtcatgagtcgcgtgcacagcctggaacgtagattggaggctctggccgccgagttcagctctaattggcagaaagaggccatgaggttggaaagactggagctgcggcagggggctcccggtcaaggaggtggaggaggcctgtcacacgaggacacactggcgctgctggaggggttagtctccagacgagaggctgcgctgaaagaagatttcaggagggaaacagcggcgaggatccaggaggagctaagcgctctgagggccgagcatcagcaagactccgaggatctctttaagaagatcgtgcgagcctcacaggagtctgaagctagaattcagcagcttaaaagtgaatggcagtcgatgactcaggaatcattccaggagtccagtgtcaaggaactgcgaaggctggaggatcaactcgccggacttcagcaggagctggcggcccttgccctcaagcaatcatctgtagcagaagaggttgggttgctgcctcagcagatccaggccgtccgggatgacgtggagtcgcagtttcctgcttggatctcccaatttctcgctcggggcggcgggggtagagtaggattgctacagagggaggagatgcaagcccagctcagagagctggagtccaagatcttgacacatgtggcagagatgcaggggaagagtgcccgggaggccgccgcctcgctctcacttaccctgcagaaagagggtgtgatcggcgtcacggaggaacaggtccaccacattgtaaagcaagcactccagcgttactccgaggatcggataggtctcgctgattatgccctcgaatccggaggagcctctgttatctcaacgcggtgctctgagacctacgaaacaaaaacagcccttctaagcctcttcgggatcccactgtggtaccatagccagagtccccgggtgatcctgcagcctgatgtacaccccggaaactgctgggccttccagggaccccagggcttcgcagtggttagactcagcgctagaatccgcccaaccgcagtgacactggaacacgtgccaaaagcactctctcccaacagcacgatcagctctgcccctaaggatttcgcaatctttggcttcgacgaagatctgcaacaagaaggcacattgctgggcaagttcacatatgatcaggacggcgagcccattcagacttttcactttcaggcccccaccatggccacctatcaagtggtggagcttagaatcctgacgaactgggggcaccctgaatatacttgcatctataggtttagagttcacggtgagccggcacattag

SEQ ID NO: 25984 - DNA, 1572 bp, Artificial Sequence
  Description of Artificial Sequence: Synthetic coding sequence
atggcggccgtcggtagggtcgggagcttcggcagctcacctccaggactatcatccacatatactggagggcctctgggtaacgaaatagcctccggcaatggcggtgccgctgcgggggacgacgaggatggtcagaatttatggagctgcattctgagcgaggtgtctacgcggtcccggtccaagcttccagcagggaaaaatgtgctcctgctcggagaagacggcgcaggcaagacatccctgattcggaagattcagggcatagaggagtataagaaaggcagaggtctagagtacctttacctcaatgtccatgatgaggaccgagacgaccagacccggtgtaacgtgtggattctcgacggggacctttaccataaaggcctactgaagttctcattggacgcagtgtccttgaaagatactctggtgatgcttgtggtggatatgtcaaagccctggacagcattggactcactgcaaaaatgggcatcagtggtcagagagcacgtcgacaagctgaagataccccccgaagaaatgaaacagatggagcaaaagctcattcgggacttccaggaatacgtcgagccgggagaagatttccccgcctccccacaacgccgcaacacagcatcgcaggaagacaaggacgatagtgtggttttaccattaggcgctgacactcttacccacaacctcggaatacccgttctggtggtttgtaccaaatgtgatgccatctctgtcctggagaaggagcacgactatcgcgacgagcacttcgatttcatccaatcacatattaggaaattttgcctgcaatacggagcggccctcatctatacctctgtgaaggagaataagaacattgacttggtatacaaatatattgttcagaaactttatggatttccttataaaatccccgcagttgtggtggagaaggatgcagtgtttatcccagccggttgggataacgataagaagataggtattctccacgagaattttcaaacacttaaagctgaagacaatttcgaggacattattactaaaccaccagtgcgaaagtttgtccacgagaaggagataatggctgaggatgaccaagtgttcttaatgaaactccagagtctgctcgccaagcaaccaccaactgccgcaggacgccccgtggacgccagtccacgcgtgccaggcggttcccctaggacccctaacagatcagtcagctctaacgttgcatccgtaagcccaatccccgccggttcaaaaaaaatcgaccctaacatgaaggctggcgccacatccgagggcgtattggcaaacttcttcaattcattgctctccaagaagacgggctcacctggcggccctggcgttagtggaggcagccccgctgggggcgcaggcgggggctcatccggccttccaccctcaactaagaagagtggacagaaacctgtcctggacgtgcacgccgagcttgaccgtatcactcgtaaacccgtcactgtcagtccgacaacgcccactagccctacagaaggagaggctagctag

SEQ ID NO: 25985 - DNA, 351 bp, Artificial Sequence
  Description of Artificial Sequence: Synthetic coding sequence
atggaagaataccaccggcattgcgacgaggtgggcttcaatgcggaggaggcccataacatagtgaaagaatgtgtggatggggtgctgggaggcgaggattataaccataacaatataaatcaatggaccgcttctatcgttgagcagagcctgacccacctcgttaaactcggaaaggcttataaatacatcgtcacgtgcgccgtggtgcagaagagcgcttatggatttcacaccgcttcctcatgtttctgggacacaacttctgatggcacatgcactgtgaggtgggaaaacagaaccatgaattgtattgtcaatgtatttgcaatcgccattgtgttatag

SEQ ID NO: 25986 - DNA, 459 bp, Artificial Sequence
  Description of Artificial Sequence: Synthetic coding sequence
atggaagaatatcaccggcactgcgacgaagtagggtttaatgccgaagaggcgcataatattgtgaaagaatgtgtcgatggtgttctgggtggagaagattacaatcacaataatatcaaccagtggacagcaagcatagtcgaacagagcttgacccatctcgtcaagctcggcaaagcttacaagtatatagtgacttgcgctgtggtccagaagtccgcatacgggttccacacggctagttcttgtttctgggacaccacctctgacggcacctgtactgtacgttgggaaaatcgcacgatgaactgtggagtgttactttgcagaccagggtggtcagctgtcatgcagttccgtctgacagccaccagtgcatcccaggtgcaagtgatattgctgcctcagccccccgagtacctcgagttacaggcccacgccattactccgggatag

SEQ ID NO: 25987 - DNA, 369 bp, Artificial Sequence
  Description of Artificial Sequence: Synthetic coding sequence
atggcccggagcctcggagtactggtggcactaccgttccccttacctgtcggattcaacgccgaggaagcacacaacatcgtaaaggagtgtgtcgatggtgtgctcggcggggaagattataatcacaataatatcaatcaatggaccgcctcaatcgtggaacagtcactcactcatctcgtgaaattaggcaaggcttacaagtatatagtcacctgcgctgttgtccagaaatctgcgtacgggttccataccgccagctcctgcttttgggatacaacgtctgatgggacatgtaccgtacggtgggagaacaggactatgaattgcatcgtgaacgtgttcgcaatagccatagtcctgtag

SEQ ID NO: 25988 - DNA, 1737 bp, Artificial Sequence
  Description of Artificial Sequence: Synthetic coding sequence
atggacccagataagcaagatgccttgaatagcattgagaattccatctaccgcaccgctttcaaactgcaatctgttcagactctatgtcagttagatctcatcgactcctctcttatccagcaggttctactccggccgtccttttgggaggctcggaaacattctctgtcggtccagcagctgagccaggcactacaggaattattccaaaaggcaagagaagagaaccctgggcaggtccacccacgggccccggagctgactctcagtctgctcacaaccatgtacaattccaaggggaccgggttccttcagttgatgcctgctgctgccgccctaatcacactttcaggggacagcccgctatctaaatatcgggccctgttccagctgtacgccgagaactcccgcggtggctacgatagtggcccacggatgactcgacgcgtgctgcgcaaattattgactgatctccaacagatccccacctttgttggagagagccgggccctatgccccgttgaatcagcaacgagaagctgctttcagggtgtgttatccccagcaataaaggaagagaaattcctttcctgggtgcagtcagagcctccaatactgctgtggctgcctacatgtcaccgtctttccgcagccgagagagtcacacatccggcacggtgtaccctgtgccgcacttttcccatcaccggcctaaggtacagatgcttaaaatgcctcaacttcgatatctgtcagatgtgttttctaagtggactccattccaagtctcaccagaagtcacatccagttatagaacactgtatacaaatgtcagcgatgcagaacacaaaactgctcttccggacactcaggaataacctgctccagggtcggtgtaggaagaaagaagcagcgaggaggcaacagcttctggatcaggtgaatcccaagggtgtcccccatcatgctcaggcacgcttacttaaaaagcagctgaaccagtacaaggataaacttcaagcaatctacacatcccaggaagagagaatatgtcgttttgaaaccagaatacataagcttaagacaaatcaagactccctttggaccaaactccagcaaatccggcgagacctgcaggcgagactgcagccacccgggccttcatcatcgtccttccagaacgttggcaataaagtcgatcacagttcaaccgaaaaggtcccgaaagggggagattatctccagatcaaaaacgccaccgaggacgcaagtacaggcgagcccctgcccaagcttgatgaagtggataggtcccataggagtcatacgaatgccgagcacgccctcagaaaccccgaaagccccgagacgacccttcactccacgcgagcccagtcacagactcagaagatgccacagaaggtgattagcgctttaccatcataccaagaaggactgaagcaggatatacccaaaatggtccctgctgagatgtcctctccggccctggccgcggtggaaaagaaagaagcgggcaatattaaggagagaaaagacgaactggaggaggaggagctgcaggaattattgtctaagctgatggacgcgttcaacctggagaccccatccggacccgaatcttcagtgaacatggatctgtattcaggagctcagcgggtctgccgggccttctctgcccttgtagaccaaatcgccctacccaacctgaagtag

SEQ ID NO: 25989 - DNA, 858 bp, Artificial Sequence
  Description of Artificial Sequence: Synthetic coding sequence
atgaataggctgcctgatgattacgatccttacgctgtggaagagccaagcgatgaggaaccagccctatctagcagtgaagacgaggtcgacgtccttcttcacggtacacccgaccagaagagaaaattaataagagagtgtttgactggcgaaagcgagtcgagtagcgaagatgagttcgagaaggaaatggaggcggaactgaacagcaccatgaagaccatggaagataagctctcgagtctcgggacagggagttccagcggtaatggaaaggttgcaaccgctccaaccaggtattatgacgatatctatttcgactcagattcagaagatgaagacagagctgtgcaagtcaccaagaagaagaagaagaaacagcataagatccccactaatgacgagctcttatacgaccccgagaaagataatcgggatcaggcctgggtggatgcgcagaggagaggctaccacggcctcggaccacaacggtcccgacagcagcagcccgttcctaacagcgatgctgtacttaactgtccggcgtgcatgacaactttatgtttggattgtcagcgccatgaatcttacaagacacaataccgcgctatgtttgtcatgaactgtagtataaataaggaagaggtgctgaggtacaaggcgtccgagaacaggaagaaaagacgcgtccataagaagatgaggtctaacagagaagacgcggccgagaaggcagagaccgacgtcgaagaaatctaccatccggtcatgtgtactgagtgttctaccgaggtggcagtgtatgacaaggacgaagtatttcacttctttaacgttcttgcaagtcatagctag

SEQ ID NO: 25990 - DNA, 4236 bp, Artificial Sequence
  Description of Artificial Sequence: Synthetic coding sequence
atgcttaggcgcatcctgcagcgtacaccgggaagagtcgggtcgcagggtagtgacctcgatagctccgcaacaccgatcaacacagtggatgtgaataacgagtcctcttccgaaggcttcatctgccctcaatgcatgaagtctctcggcagcgctgatgagctgttcaagcactatgaggccgtgcatgacgcgggtaacgactcaggacatggcggcgaatcaaatctggcattaaagcgcgatgacgttacgctgctgagacaagaagtacaggatctacaagcatcattgaaagaggagaagtggtattccgaggaactgaaaaaagaactcgagaaatatcagggcctgcagcagcaggaagccaaacctgatggtctggtgacagattcttccgccgaattacagagcctcgagcaacagttagaagaggcccagaccgagaacttcaacattaagcagatgaaagatctcttcgagcagaaagcggcacagctggccaccgaaattgcggacatcaaatccaagtacgatgaagaaaggagtcttagagaggcggcagagcaaaaggtcactcggctgacagaggagctgaataaggaggcaaccgtcattcaggatctgaagactgaactgctccaaaggcctggcatcgaagatgtggcagtgctaaaaaaagagttagttcaggtgcagaccctgatggacaacatgacccttgagcgggaaagagaatcagaaaaactcaaggacgagtgtaagaagttgcagtcccagtatgctagttctgaggccacaatcagccaactcaggtcagagttagcaaagggcccccaggaggtggccgtttacgtgcaggagctccagaagctcaagtcatctgtcaatgagttgacccagaagaatcaaaccttgaccgagaatcttctgaaaaaagaacaggattacaccaagctggaggagaagcacaacgaggagtcagtcagtaagaaaaacatccaggctactctccaccaaaaggacctagactgccagcagcttcaatcgagactcagcgcctccgagacgagcttgcatcgcatccacgtcgagctctccgagaagggggaggccacccaaaagcttaaggaggagctaagtgaggtggagacaaaataccagcacctcaaggcagagtttaaacagctgcaacagcagcgggaagagaaagaacagcacggtttacagctgcaatcggagattaaccagctacactccaaattgttggaaactgaaagacaactgggggaggcgcatggccgcctgaaagagcagcgccagcttagctcagagaaattgatggacaaagagcagcaagtggcagacctacagctgaaattgtcccgcctggaagagcaactgaaagaaaaggtcacgaattctaccgaattacagcatcaactcgataagaccaagcagcagcatcaagaacagcaggcactccagcagtcaactaccgccaagttacgagaggcccagaacgacctggaacaagtgctcaggcagattggtgacaaggatcagaagattcagaatctggaggctttgctgcagaagagcaaagagaatattagcctactggagaaggagcgagaagatctgtatgccaaaatccaagcaggcgaaggggagacagcagtgctcaatcaactacaggaaaaaaaccatacccttcaggagcaggtcacacaacttaccgagaaattgaaaaaccagagtgagtctcacaagcaggcccaggaaaatctacatgatcaggtgcaagaacagaaggcccacctgcgggctgcacaagacagggtgctctccctggagacctcagttaacgaattgaattcacaactcaacgaaagcaaggaaaaggtctcacagctagatatccagattaaggcaaaaaccgaactgctgctgtctgccgaagccgccaagacagcccaaagagctgacttgcagaaccatctggacacagcccagaacgcccttcaggacaaacagcaggaactgaataagataacaacgcaactggatcaagtcacagccaaactgcaggacaagcaggagcactgttctcagttggaaagtcatctgaaggagtacaaggagaagtacctgagcctggaacaaaagacagaagagctagagggacagatcaagaagctggaggccgattcccttgaagttaaagccagcaaagagcaggcattgcaggacctacaacagcagcggcagctcaacacagatctggagctccgagctactgaactgtccaagcagctggagatggagaaggaaattgtcagttctacgcgtttggacctgcagaagaagtcagaggctcttgagtccatcaagcagaagctgaccaaacaggaggaagagaagaaaatcctcaagcaggacttcgaaacactgtctcaagagaccaaaattcagcatgaggaactgaacaacaggatccagaccactgtcaccgagctccagaaggtaaagatggagaaagaagctctaatgactgaattgtccactgtcaaagataagttgtctaaggtgtctgactccctcaagaatagcaaaagtgaattcgagaaggagaaccagaagggcaaggctgcgatcctagatcttgaaaaaacatgcaaggaacttaagcatcagctacaggtgcagatggagaatacgctcaaagagcaaaaggagttgaaaaaatccctggagaaggagaaagaggcctcccaccagctcaaactcgagcttaattcaatgcaggagcagctaattcaagcccagaacacactgaagcaaaatgaaaaagaggaacagcagctgcaggggaatataaatgagctgaagcaaagctcggagcagaagaaaaagcagatcgaagccctccagggcgagctgaagatcgcagtacttcagaagaccgagctggaaaacaaactgcagcagcaattaacccaagctgcccaagagcttgctgctgagaaggagaagataagcgtgttgcagaataattatgagaaatcacaagagacattcaaacagctgcagtccgacttctacggtagggagtctgagctactggcgaccaggcaggatcttaaatccgtcgaagagaaactttcccttgcccaggaagatctaatcagtaatcggaaccagattggcaaccagaacaaattgatacaggaattgaaaaccgctaaggctacccttgaacaggatagtgcgaagaaagagcaacagctgcaggagagatgcaaggccctacaagatattcaaaaagaaaagagtctaaaagagaaagagcttgtcaacgaaaaatctaagctggcagagatcgaagagataaagtgtcgacaagagaaggaaatcaccaagttaaatgaggaattgaagtcccataagctggaatctattaaggagattacaaatctgaaagatgctaaacagttgcttatccagcagaaattagaacttcaggggaaggctgactccctgaaggcagcagtcgagcaagaaaaacgcaaccagcagatactgaaagatcaggtgaaaaaggaggaggaggagctgaaaaaggagtttatagaaaaagaggctaagctgcacagtgaaataaaggaaaaggaggtcggcatgaagaaacacgaagagaacgaggctaaactgaccatgcagattacagccctcaatgagaatcttggcacggtaaaaaaggagtggcagtcatcacagcggcgcgtgtcagagctcgagaagcagactgacgaccttaggggagagattgccgtgctggaagccactgtccagaataaccaggacgaaaggcgggccctgcttgagcgctgtcttaagggtgaaggcgaaatcgagaaactacagacaaaagtcctcgagttgcagcgcaagctggacaacaccaccgccgccgtgcaagaactgggccgggagaaccagagtttgcagatcaagcacacgcaagcactcaacagaaaatgggctgaggacaacgaggtgcagaactgcatggcttgtggaaaagggtttagtgttaccgttagacgtcaccattgtcgacagtgcggcaacatcttctgcgccgagtgtagcgccaagaatgcacttactccttcatcgaagaaacccgttagggtgtgcgatgcctgttttaacgatctccagggatag

SEQ ID NO: 25991 - DNA, 933 bp, Artificial Sequence
  Description of Artificial Sequence: Synthetic coding sequence
ctgaggagagtcgaccatgaaactccaggtagggttggctctcagggatccgaccttgattccagcgctactcccattaatactgtggatgtcaacaatgagagttcaagtgagggcttcatttgtccacagtgtatgaaaagtctgggatccgccgacgaactgttcaaacactatgaagctgttcatgatgccggaaacgactccggccatggcggggaaagtaacctcgccctgaagagagatgatgttaccctgctgcgccaggaagttcaggacttgcaggcctccctaaaagaggagaaatggtattcagaggagcttaaaaaggaactagagaaatatcagggtctccagcagcaagaggcaaagcccgatggcctcgtaaccgattcatccgccgaactgcagagtcttgagcagcagctggaagaggctcagactgaaaattttaatatcaagcagatgaaggacctgtttgaacagaaagccgcgcagcttgctacagaaatcgcagacattaagagcaaatacgatgaggagcgcagcctgcgagaggctgctgagcagaaagttacacggctgaccgaagagctgaacaaagaggcaactgtgatacaggatctgaagaccgaactgctgcagcgtcccggtatcgaggatgtcgccgtcctaaaaaaggaactggttcaagtgcaaaccctgatggacaatatgacacttgaaagagagagagagagcgaaaaactgaaggatgaatgtaagaagctgcaaagtcagtatgcatctagcgaagccaccataagccaattacggagcgagctggcaaagggtcctcaggaagtggcagtgtacgtgcaggagctgcaaaaattaaagagttccgtgaatgaactgactcaaaaaaaccaaaagaagaaaaaaaagaagtag

SEQ ID NO: 25992 - DNA, 1716 bp, Artificial Sequence
  Description of Artificial Sequence: Synthetic coding sequence
atgggccgaattggcattagttgccttttccctgccagctggcacttctctatctcccccgtcggctgccctaggattctgaacacaaatctgaggcagatcatggtcatatccgtgctcgcggctgctgtgagccttctatacttctctgtcgtaattattcgcaataagtacggccggctgacaagagataagaagttccagagatatctcgcacgcgtgaccgacatcgaagccacagataccaataacccgaacgtgaactacggcattgtggtggattgcggatcctcaggatcccgcgtgtttgtttattgctggcccagacacaacggaaacccacacgacctgctggatatcagacagatgagggacaagaacaggaagccagttgttatgaaaatcaagcctggtatcagcgagtttgccacgtctcccgagaaggtgagcgattatatctcgcctttattaaacttcgctgccgagcacgtgcctagggccaagcacaaagagactccgctgtacattttgtgtacggctggtatgcggatactgccggaaagccagcagaaagcgatcctggaggatctgttgacagatattccagtccattttgatttcctcttttctgactcacatgcagaagtgatctctggcaagcaggagggagtgtatgcctggatcgggattaattttgttctggggcgcttcgaacatattgaggatgatgacgaagctgtggtggaggtaaacattccaggttctgagtcatcggaggccatcgtccggaaacgaacagccggaatcctcgacatgggaggcgtctcgacccagattgcatatgaagtccccaaaacggaggaggtcgctaagaatttattagcagagtttaatcttggctgcgacgtgcatcagactgaacatgtttaccgggtctacgtggctacttttcttggatttggagggaatgcagcccgccagaggtacgaggatcggatcttcgcgaataccatccagaaaaatcgtctgttgggcaagcagaccggcctgacgccggatatgccttaccttgatccctgccttccgctggacattaaggatgagatccaacagaacggccagaccatctacctgcgtggtacaggagatttcgacctttgccgagaaacgattcagccttttatgaacaagaccaacgagactcagacaagcctgaacggggtgtatcagccacccatccatttccagaactctgaattctacggatttagtgagttctactattgcacagaggatgttctgcggatgggtggggactacaacgccgctaaatttaccaaagccgccaaggactactgcgccaccaaatggtcaattctgcgggaaaggtttgacagagggctctacgctagccatgcggacttgcatagactaaaataccagtgcttcaagtccgcgtggatgtttgaagtgttccacagggggttctcctttcccgttaattataaatcgctgaagacagccttgcaagtgtatgataaggaggtgcagtggacgctcggcgcaatcctttatcgaacaagattcctgccgcttagaaagattggaatgcttattatcccttgtagcgggggttgccccaaactctgttgcgccgtctggcagcctccaccgtacggagccactaagcatttacagtgcgcggcttggaattag

SEQ ID NO: 25993 - DNA, 1851 bp, Artificial Sequence
  Description of Artificial Sequence: Synthetic coding sequence
atgggacggataggaatatcctgcttattcccagcctcgtggcacttcagcatcagccccgtgggctgtcctaggattctaaacactaatcttcgccaaatcatggtaatcagtgtattggctgcagccgtctccctgctctatttcagcgtggtgattatccgcaacaaatacggtagactcacccgggacaagaagtttcagcggtatcttgcacgggtgactgacatcgaggcaacagatacaaacaatcccaatgtaaactacgggatcgtagtcgattgtggatccagcgggtcaagggttttcgtgtactgctggccccggcataacggaaatccacatgacctcttagacattagacagatgagggacaagaatagaaaacccgtcgttatgaagatcaagcccggtatttctgaatttgcaacatcacctgagaaggtgtctgattatatttcgccgcttctgaactttgcagcggagcacgtgcctcgcgccaagcataaggagacaccactgtatatcctgtgcacagcaggaatgaggattctgcccgaatctcagcagaaagcgatcttggaagatctactgacggacatccccgttcactttgattttttattttctgattctcacgcagaggtgatctcaggaaaacaggagggcgtatacgcctggatcggcattaacttcgttctaggccgttttgagcacatcgaagatgatgacgaggccgtggtcgaagttaatatcccaggaagcgagagttcagaggccattgttcggaagcggacagccggaatactggacatgggcggcgtgtcaacccagatagcttatgaggtccctaagaccgtcagcttcgcttcaagccagcaggaggaggtggcaaagaacctgttggccgagttcaatcttggctgcgatgtccaccaaaccgaacatgtatatagggtttatgtggccaccttcctcggcttcggcgggaatgcagcccgccagcgatatgaagacagaatctttgctaacaccatccagaagaacagactcctagggaaacagactgggctgacaccagacatgccatatctggacccatgcttgccccttgatatcaaggacgaaatccaacaaaatgggcaaacaatatacctccgaggtactggggatttcgatctgtgtcgtgaaacgattcaaccctttatgaacaagacaaacgaaacccagacaagccttaatggcgtgtaccagccacctattcacttccaaaactccgagttctacggcttttctgagttctattattgtaccgaagatgtgctgcggatggggggggactacaacgctgcgaagtttactaaagcagctaaggactattgcgccacaaagtggtccatcctgagagaaaggtttgatcgagggttatatgcctcccatgctgacctgcacaggttgaaatatcagtgcttcaaaagcgcttggatgtttgaggtgttccacaggggcttttcctttccggtcaactataagagtctgaagacagctctgcaagtgtatgacaaagaggtccagtggaccttgggggctatcctgtatcgcacacggttccttccattacgagacattcagcaggaggccttcagagcaagccatacccactggcgcggggttagctttgtctataaccactacctgttctccggctgtttcctcgtggtcctcttggcaatattgctgtatttactgagactcagacgaattcatagaaggacccctcgatctagctccgccgctgccttgtggatggaagaaggactgcctgcccaaaatgccccaggcacgctgtag

SEQ ID NO: 25994 - DNA, 1827 bp, Artificial Sequence
  Description of Artificial Sequence: Synthetic coding sequence
atgggtagaattggaatcagctgcctgttccccgctagctggcatttttctatttctccagtgggctgcccacgcatcctgaatactaacctccgtcagataatggtaatttctgtccttgctgccgccgtttctcttctgtatttttctgtggttataattcggaacaaatatgggagacttactagagataaaaagttccaacggtacctggctagagttacggacatcgaggcaacagatacgaataaccctaatgtcaattacggtattgtagtggactgtggctcttctggatctcgcgtattcgtgtactgctggccacggcataacggcaatcctcatgatctgctcgacattcgacagatgcgggacaagaaccgcaagcccgtggtgatgaagataaagcctggtatttccgaattcgcgacttcacctgagaaagtgtccgactacatatcccctctgctcaacttcgcagcggaacacgtgccccgggccaagcacaaagagactcctctctatatcctgtgtacagcgggaatgcggatcctgccagagagccaacagaaggccattctggaggacctcctgacagacatccctgtgcacttcgattttctgttctcagattcccacgccgaagtgatttcaggcaagcaagaaggagtgtatgcttggatcgggatcaattttgtattaggccgcttcgagcatatcgaggatgatgacgaggccgtggtggaggtgaacatccccgggtcagagagctctgaggctattgtcaggaaacgcacagctggtattctggatatgggaggcgtaagcacacagattgcctatgaagtccccaagactgaagaagtggccaaaaatctgttggctgagttcaacctgggctgcgacgtccatcagaccgaacatgtgtatcgggtgtatgttgcaacgttcctggggttcggcgggaacgccgccagacagagatacgaagatcgaatcttcgccaatactatacagaagaacaggctcctgggcaagcaaaccggcctgactccagacatgccctatttggatccttgccttcccctggatataaaggatgagatacaacagaacggtcaaaccatatatttgcgcggaaccggcgacttcgacctctgtagggagacaatccagccatttatgaacaaaacaaacgagacccagacgagcttgaatggagtctatcagcccccgatccatttccaaaacagtgaattttatggcttcagcgagttttattactgtacagaggatgttttaaggatgggaggtgactataatgccgccaaatttaccaaagcagcaaaggactattgcgccaccaagtggtctatcctgcgggagcggtttgaccgtggtctttatgctagccacgccgatctgcacagattgaagtaccaatgtttcaagtccgcatggatgtttgaggtctttcacagggggttctcatttcccgtcaattataaatccctgaaaaccgctctccaggtgtacgataaagaggtccagtggacgctgggggccattctgtatagaactcggtttcttcctctccgcgatatccaacaggaagccttccgcgcgagtcacactcactggcgcggcgtctcttttgtttataatcactacctgttctccggttgctttctggtggtgcttctggcgatcctcctttatcttttgcgcttgaggcggatccatcgaagaacccctagaagttcctctgcagccgctctgtggatggaagaaggactgccggcccagaatgcccccggcacattatag

SEQ ID NO: 25995 - DNA, 1815 bp, Artificial Sequence
  Description of Artificial Sequence: Synthetic coding sequence
atggcccgaatatccttttcttatttatgtcccgcctcctggtactttactgtgccaacagtgtcccccttcctgagacagagggtagcctttttgggcctgttctttatatcttgcctcctgttgctgatgctgattatagatttccgccactggtcagccagccttcctcgagaccgccaatacgaacggtacctagcacgagtcggagagttagaggctacagatactgaagaccctaatctgaactacgggctggtggtggattgcgggagctccgggagcagaatatttgtctatttttggccacggcataacggaaatccccatgatctgctcgacatcaagcagatgagagatagaaactctcaacccgtggtgaagaagataaaaccgggaatatccgcgatggctgataccccagaacacgcctctgactacttgaggccgttgctgtcgtttgctgccgcgcatgtccccgtgaaaaagcacaaagaaacgccactgtatatattgtgtacagctggcatgagacttttgcccgagaggaagcagctggctatcctggctgacctcgtgaaagacctaccccttgagtttgattttctgtttagccagtctcaggcagaagtgatttccggtaaacaagagggcgtgtacgcttggattggaatcaatttcgtactgggacgttttgaccacgaggatgagagcgacgcggaagccacacaagaactcgccgctggacggaggcggactgttggcattctggacatgggcggagccagtctccaaattgcctacgaggtgcccacatccacatccgtgctgcctgcaaagcaggaggaagctgccaagattctcttggctgaattcaacctgggctgtgatgtgcagcacaccgagcatgtgtaccgggtatatgtgactacattcctggggtttggaggaaatttcgctcgtcagcgttacgaggatctcgttctgaatgagactttgaataaaaataggctcctcggtcagaaaaccggcctctcacctgataatcccttccttgatccttgcttgcccgtgggactcaccgatgtggtggaacggaacagccaggtgctccacgttcgtggtcggggagactgggtctcgtgcggcgcaatgctctcgcctctactggctaggagcaacacaagccaggcatccttaaacggtatttatcagagcccaatcgacttcaacaactcagaattttatggtttcagcgaatttttctattgcacggaggatgttttaagaatcggtggtaggtaccatggacctacatttgccaaagccgcacaagattactgtggtatggcctggtccgtgctcacccagaggttcaaaaatgggttgttcagttcgcacgccgatgagcaccgccttaaatatcagtgtttcaagtctgcatggatgtaccaggtgctgcatgagggttttcactttccctatgactacccgaatctcagaacggcacaactggtgtacgaccgggaggtccagtggacgctaggggctattctctacaagactagattcctcccgctcagagatctacgccaagagggggtccgccaggcacatggctcctggttccggctgtctttcgtgtacaatcactaccttttttttgcctgtatcctcgtcgtgcttctggcaatatttctatatctgctgcgtctgaggcgcatccatcaccggcagacgcgagcatcggcacccctcgacctactgtggctggaagaagtggtgccgatgatgggcgtccaggtggggccatag

SEQ ID NO: 25996 - DNA, 1377 bp, Artificial Sequence
  Description of Artificial Sequence: Synthetic coding sequence
atgggactttccaggaaagaacaagtatttctcgcattgctcggtgcttctggggtgtcaggactgactgccctcatcctgctgctggtggaagccacaagtgtgctgctcccgaccgatataaagttcgggattgtcttcgacgccgggagctcacatacatccctgttcctatatcagtggctcgctaacaaagaaaatggaaccggcgtggtctcccaagcgctagcctgccaagtagagggtcctggaattagctcttatacatcaaatgcagcccaggcaggcgagtccctgcagggctgcctcgaggaagcactggttctgatccccgaggctcaacatcggaagacaccaactttcttgggtgcgacagctggtatgcgtttgctgagccgcaagaattctagccaggccagggatatcttcgccgccgtgacacaagtgcttggccgatctcccgtcgatttctggggagccgaactgcttgccggacaggcagaaggagccttcgggtggataaccgtgaactacggacttgggacactggtgaaatacagcttcactggagagtggatccaaccccctgaagagatgctcgttggagcacttgacatggggggagcttctactcaaatcacatttgttccagggggacccattctggacaaaagcactcaggccgactttaggctgtacggttctgactattccgtatacacacattcctacctttgttttggccgggatcagatgctgagcaggctgctggtggggctggttcagagtagaccggccgccctgctgcggcacccttgctacctgtccgggtatcaaactacgcttgccctgggccctctgtacgaatcgccctgcgtacatgccacccctcctctgagcctgccccagaatctaacggtggaagggactggcaaccctggagcctgcgtctccgcgatacgggaactgttcaatttctcatcctgtcagggtcaggaagactgtgccttcgatggggtctaccagcctcctctgaggggacagttctatgtggaggcgagctaccctgggcaggataggtggctcagagactactgcgcatccgggctgtatatcctgacattactgcacgaggggtatggcttttctgaggagacctggccctccctggagttccgcaagcaagccggtggcgtcgacatcgggtggactcttggctacatgctcaacctgacaggcatgatccctgccgatgctcctgctcaatggcgggcagagagttacggagtctgggtggccaaggttgtgttcatggtcctcgccttggttgccgtagtaggggccgcattagtgcagctcttttggttgcaggattag

SEQ ID NO: 25997 - DNA, 1488 bp, Artificial Sequence
  Description of Artificial Sequence: Synthetic coding sequence
atgggcctgtcaagaaaggaacaggtgttcctggccttattgggggcttcaggagtcagcgggttaacggccttgattttacttttggtggaggccacatctgttctcctgccaacggatattaaattcgggatagtctttgatgcaggctctagccataccagcctctttctctatcagtggttggcgaacaaagaaaatggaaccggggtggtgtcccaggcacttgcctgccaagtcgagggacctggcatttctagctacacttcaaacgcggcccaggccggagagtccctgcaaggctgtctggaggaggccctggtgctgatccctgaggcacagcatagaaagactcccacattcctaggagccacagccggcatgagactgctgtctcgaaaaaatagttcacaggcccgtgatatctttgctgccgtgactcaggtgctcggccggagcccagtggatttttggggggccgagctgctagctgggcaggctgaaggggccttcgggtggatcaccgtgaactacgggctgggcacactcgtgaaatactccttcactggcgaatggatccaaccccccgaagagatgctagtgggagccctcgacatgggtggcgccagcacacagataacctttgtgcccggcggacctatccttgacaagagtactcaggctgacttcagattgtatggctccgactacagcgtgtatacccacagctacctttgctttggacgggatcagatgctatctagattgcttgttggcctcgtccaaagcagacccgctgctctgctgcgtcacccctgttacttgtccggctaccagaccacgctggccttggggcctctgtatgagtcaccatgcgtgcatgcaacgccacccttgagccttcctcagaatttgaccgtcgagggaaccgggaaccctggggcatgtgtatccgcaattcgggaactctttaacttcagttcctgtcagggacaggaggattgcgcgtttgatggtgtgtaccaaccacccctccgggggcagttttacgctttcagcaacttttattatactttccatttccttaatctgactagtagacagccgctcagcacagtcaacgctaccatctgggaattttgtcagagaccctggaaacttgtggaggcatcttaccccgggcaagacagatggctacgggattattgtgcctccggcctgtatattctgacactcttacatgagggatatggcttttctgaggagacttggccatccctagaatttagaaaacaagcagggggggtggacattgggtggacgctgggctatatgctgaatctgacaggaatgataccagccgacgccccggcacaatggagggcggaatcatacggcgtgtgggtggcaaaggttgtctttatggtgttggctctagtggcagtcgtgggcgctgcactggttcagctgttttggcttcaggattag

SEQ ID NO: 25998 - DNA, 1488 bp, Artificial Sequence
  Description of Artificial Sequence: Synthetic coding sequence
atgggcctgagccgcaaggagcaggttttcctcgcgctcctaggggcaagtggtgtctctggcctgaccgccctgattctgctgttagtcgaagctacgtcggtgttattgcctacagacatcaaatttgggattgttttcgatgccgggagctcccacacctccctgttcctttatcaatggcttgccaacaaggaaaatgggacaggcgtggtgtctcaggcattagcgtgccaggtggagggacccggaatcagcagctatacatcgaacgcggcacaggccggcgagagcctacaagggtgcctggaggaagccttagttctgatcccagaggcccagcacagaaagacccccactttcctcggggcaaccgctgggatgagattattgtcacgtaagaattcttcacaggctagagatatctttgctgccgtcacacaagtgctgggacgcagcccagtggacttttggggagccgagcttctggcaggacaggcagagggcgcatttgggtggatcacagtcaattatggactgggcaccctggtgaagtactccttcaccggcgaatggatccagcccccagaggaaatgctcgtgggggcccttgatatggggggtgcttccacgcaaattacttttgtgccgggcggtcccattcttgacaaatctacacaggccgactttcgactgtatggatctgactatagcgtatatacccatagttacctgtgcttcggaagagatcagatgctgtctagattgttggtgggattggtccagtccaggcccgctgcccttctgcgtcacccctgctatctgagcgggtaccaaacaacgctggctttaggaccactatatgagagtccatgcgtgcatgcaaccccaccattatctctcccccagaatctgactgtggaaggcacaggcaatccgggtgcctgtgtcagcgcaatcagagagctcttcaactttagcagctgtcagggccaggaggactgcgcattcgatggagtctaccaaccacccctgaggggccagttctacgcctttagcaatttttactacacattccacttcctgaacctgacgagtcgccagccgctctcaacagtcaatgcgacaatttgggagttctgtcaacgcccttggaaactagtggaagcttcttatcctggacaggataggtggctgcgggactattgcgcctcaggcctgtacatcctgacgctgctgcacgagggatatggttttagcgaggagacatggccctctttggagttccgtaaacaggctggcggagttgacatcggttggacactcggctacatgttgaatcttaccggcatgattcctgccgatgcccctgctcagtggcgggccgaaagttacggagtctgggtcgccaaagtagtgtttatggtgctggccctggtagccgttgtaggcgccgccctggtccagctgttctggcttcaagactag

SEQ ID NO: 25999 - DNA, 1362 bp, Artificial Sequence
  Description of Artificial Sequence: Synthetic coding sequence
atgaagctgctggtgattctgctcttttccggcctcataactgggttcaggtcagacagctcgagctctttaccccccaaactgttgctggtgagctttgacgggtttcgagccgattatctaaaaaactacgaattcccacatttgcaaaatttcattaaggaaggcgtcctggtggagcacgtgaagaatgtgtttatcaccaagacctttcctaaccactacagtatcgtaaccggcctgtacgaggaaagccacgggatagtcgccaattcaatgtacgacgcagtgacgaaaaagcatttttcagattcaaacgacaaagatccattctggtggaatgaggccgtgcccatatgggttacaaaccaattgcaggagaatcgttcatctgctgctgctatgtggcccggaactgatgtgcctatccatgacacaatcagtagctacttcatgaactacaatagtagcgtgtctttcgaagagaggctgaacaacatcacaatgtggctgaataattctaaccctccggtaaccttcgctactctgtactgggaggagccagacgccagtgggcataagtacggccctgaggataaggaaaatatgtccagggtcttgaagaagatcgacgacctgattggagacctggttcagcgcttgaagatgctcggtctgtgggaaaatttgaatgtgatcattactagtgaccacgggatgactcaatgtagccaggaccgcctcattaacttggatagttgtatagatcactcctattacaccctgatcgatctgtctccggtggctgccatcctgccgaagatcaatcgcacagaggtctacaacaagcttaagaactgtagtcctcatatgaatgtctaccttaaagaggacattcccaacagattctactaccagcataacgacaggattcagccaatcatcctggttgccgatgagggatggaccattgttctcaatgagtcatctcagaaactgggcgaccatggttacgataattcactccctagcatgcatccattcctggccgcacatggcccagcctttcataaaggctacaaacatagcactattaacatcgtggacatttatcccatgatgtgccacatcttgggtctgaaaccacatccgaataacgggaccttcggtcacactaaatgcctcctggtagatcagtggtgcatcaacctgccagaagctatcgcaatcgtgatcggctcccttctggttctgaccatgcttacctgcctcatcatcatcatgcagaatcgacttagtgtaccacgccctttttctagactccagctgcaggaggatgatgacgatcctctcatcgggtag

SEQ ID NO: 26000 - DNA, 1362 bp, Artificial Sequence
  Description of Artificial Sequence: Synthetic coding sequence
atgaaattgctggtgatcctgctgtttagcggtctgattacgggtttccgaagcgactccagcagttccctcccaccgaagctgctgctcgtatcatttgatgggtttcgtgccgattacctcaagaattacgaatttcctcacctgcagaactttattaaagagggtgttcttgttgagcatgttaagaatgttttcatcacaaagacatttccgaaccattatagcattgtaaccggactgtatgaagagagccatggcattgtagcaaattccatgtacgatgccgtgacaaagaaacatttcagtgacagcaatgacaaggaccctttttggtggaacgaagcggtgcccatttgggtgaccaaccagctccaggagaaccgcagctcagccgccgcgatgtggccaggtactgatgtccccatccacgacacaatttcatcttacttcatgaattacaactcttctgtgtcattcgaggagagactgaacaatatcactatgtggttaaataattcaaatccacctgtgacgtttgcgacactctactgggaggagcctgacgcatcgggacataagtacggcccagaagataaagaaaacatgagccgggtgctgaaaaagatcgatgacctgatcggcgaccttgtacaaagactgaagatgctgggcctctgggagaacctgaatgttattataacgtccgaccacggtatgacacagtgcagtcaggacagactaatcaacctcgattcctgtattgaccattcatattatactctgatcgatctgagccccgtagcggcaatactgccgaaaattaatagaactgaggtgtataacaagctcaagaactgctcaccacacatgaacgtctatctgaaggaggatatccctaatcggttttattatcagcacaatgatcgcatccagcctattatcctagtcgctgacgaggggtggaccattgtccttaatgaaagttcacaaaaactaggggaccacggctacgataactctctgccctccatgcacccatttcttgctgcgcatgggcccgccttccacaagggatacaagcactccaccattaatatagttgacatctatcccatgatgtgtcatattcttggcctgaaaccacatcccaacaacgggacgtttggtcacacgaagtgtctgttagtagaccagtggtgtatcaatctgccggaggccatcgcgatcgtcatcgggagcctcctggtcctaacaatgctgacctgcctgatcattatcatgcagaacaggctcagtgtgccaaggccattcagccggctgcagctccaggaggacgacgatgatccacttatcgggtag

SEQ ID NO: 26001 - DNA, 1377 bp, Artificial Sequence
  Description of Artificial Sequence: Synthetic coding sequence
atgcggggactggctgtgcttctgacagtggccctggctactttactggcccctggggcaggagctccagtgcaatcccaggggtcacagaataagctgctgttggtctcttttgacggtttcagatggaactacgaccaggatgtggacacacccaatctggacgcaatggctcgggacggagtgaaagcgaggtatatgaccccagcctttgtgacaatgacctcaccctgccactttacactggtgaccggaaaatatattgaaaaccatggggttgtccataatatgtattataacacaactagcaaggtcaagcttccctatcacgctactttggggattcagaggtggtgggataatggatctgtgccaatctggattaccgcccagcggcagggtctgagagccggctcattcttctacccaggtgggaatgtcacctaccagggtgttgcagttaccaggagccgtaaggagggaatcgcacacaactacaaaaacgagactgaatggagagctaacatagatactgtcatggcttggttcaccgaggaggatcttgatttggttaccctttactttggagagcccgattcaaccgggcacaggtacggacccgagtccccagaaaggcgcgagatggtacggcaagttgaccgcactgttggctacctgagagagagcattgcccggaatcatttgaccgaccggctcaatctcataatcactagcgaccatggtatgacgaccgtcgataaaagagccggcgatctagtggaatttcataaatttccaaattttacattccgcgacatcgagttcgagctgctggactatggccccaatgggatgctgttgcccaaggagggccgactcgaaaaggtctacgatgccttaaaagatgctcacccgaagctgcatgtgtataaaaaagaagcgtttcctgaagctttccactacgccaacaaccctcgggtgacccctctgctgatgtattcagacctgggttatgtgatccatggccgtatcaatgtgcagtttaataatggcgaacacggattcgacaataaagatatggatatgaaaaccatctttagggcagtaggtcccagtttcagggctggtcttgaggttgagcccttcgaaagtgtgcacgtatatgagctaatgtgcagactactggggatagtacccgaagcgaacgacggacacctggcaacccttctgcctatgctgcacaccgagtctgcactacctcctgatgggcgcccgaccttgcttccgaaaggccggtcggctctcccaccttccagcaggcccctcctggtcatgggactgctgggaaccgtgattctgctgtctgaggtggcgtag

SEQ ID NO: 26002 - DNA, 1305 bp, Artificial Sequence
  Description of Artificial Sequence: Synthetic coding sequence
atggccgcggcggcaggctcctgcgcacgggtggcggcttggggtggcaaactacgcagaggactcgctgttagcagacaggctgtgcgatctcccggacccctggcggccgcagtcgctggcgcagctctggcaggcgctggggccgcatggcatcacagcagagtgagcgtcgcagccagagacggcagctttacagtctccgcccaaaagaacgtggagcatggtatcatctatattgggaaaccaagcctccgcaagcagcggtttatgcagttttcttccctcgaacatgagggcgaatactatatgacgcccagggattttctgtttagcgtcatgttcgaacagatggaaagaaaaacctctgttaagaagctgaccaaaaaagacatcgaggatactctgagcggcatccagaccgcaggatgcggcagcacgttcttccgagacttaggggacaaaggcctgatttcttatacggaatacctcttcctcttgacaattttgacgaagccccattccgggttccacgtggcattcaaaatgttggacacagacggaaacgagatgattgaaaagagagaatttttcaagctgcagaagattattagtaagcaagatgacctcatgactgtgaagaccaatgagactggctatcaggaagcgatagtgaaggaaccggagatcaacactacgctgcaaatgaggttcttcggaaaacgggggcagcgcaaactgcattataaggagttcaggcggtttatggaaaatttgcagactgaaatccaagagatggagttcctgcagttttcgaaaggcttgtcattcatgcggaaggaggatttcgctgaatggcttttgttttttaccaataccgagaataaagacatctactggaaaaatgtaagggagaagctaagtgctggcgagagtatttcactggatgaattcaagtccttttgccatttcactacacacttggaggattttgctatagctatgcagatgttttccctcgcccataggcctgtgaggctggccgaattcaaaagggcggtgaaagtggcgacgggacaagagctctccaataacattctcgatactgtgtttaagattttcgatctggatggagacgaatgtctgagccatgaagagtttctgggagtgctgaagaatcgtatgcacagggggctgtgggtgccgcaacaccagagtattcaggagtattggaagtgcgtgaagaaggagagtattaagggagttaaggaagtctggaaacaggcaggaaaaggacttttttag

SEQ ID NO: 26003 - DNA, 1593 bp, Artificial Sequence
  Description of Artificial Sequence: Synthetic coding sequence
atggccgccctgcgaagactgctgtggccaccacctcgcgtctccccccctttgtgtgcccatcaaccccttctagggccatggggccgcccagcggtcacaacgctggggctgcctggccggcccttctcttcgagggaggacgaggagcgcgcagtagctgaagcagcgtggagacgccgaagaagatggggtgagttaagcgtggccgcagcagccggaggcggcctggttggactagtatgctatcagctttatggggaccctagagctgggagtcccgcaacaggtcgaccctccaagagcgcagcaaccgagcctgaagaccccccacggggccgggggatgttaccaatcccagtggccgcggctaaggagaccgtcgccatcggcagaaccgacatagaggacttagatctgtacgccactagtcgcgagcggcgatttcgcctgttcgcaagcatagaatgtgaaggtcagctatttatgactccctatgattttatcttagcagtcactacagacgagcccaaggtggccaaaacctggaagagtttgagcaagcaggagctgaatcaaatgctggccgaaacgcctcccgtttggaagggaagctctaagttattcagaaacctgaaggagaagggcgttatcagttataccgaatacctgtttttgctgtgtatcttgacaaagcctcacgcaggttttcggattgcgttcaatatgttcgacacagatggaaacgagatggtggataaaaaagagttcctggtcctgcaggagatcttccgaaaaaaaaatgaaaagcgcgagattaagggcgacgaagaaaaaagggctatgcttcgtctgcagctctatgggtatcattccccaactaattcggtcctcaaaaccgacgccgaggaactcgtgtctcgaagctactgggacacactgcgccgaaacacctcccaggcgctgttctctgacttggctgagcgtgccgatgacataactagtttagtgactgatacaacgctactcgtgcatttcttcggtaagaagggaaaagcagaactaaatttcgaagacttctaccggttcatggacaatttgcagaccgaggtccttgaaatcgagtttctgtcctactcgaacgggatgaatacaatctccgaagaagattttgctcacatcctgctccgttacaccaacgtggagaacaccagcgtgtttcttgaaaatgtgcggtatagcatcccagaggagaaaggtattaccttcgacgaatttcgctctttctttcagtttttgaacaatctggaagatttcgccatcgccttgaacatgtacaattttgcgagtcgtagcataggtcaggacgagtttaaaagagccgtatacgttgccacaggtttaaaattctctccacatttggtcaacaccgtgtttaagatctttgatgtggataaagacgaccagttgtcatataaggaatttattggcataatgaaagaccgcctgcacagaggatttagaggttacaaaacagttcagaaatatccaacttttaaaagctgcttgaaaaaggaactacatagccggtag

SEQ ID NO: 26004 - DNA, 534 bp, Artificial Sequence
  Description of Artificial Sequence: Synthetic coding sequence
atgttcaagcagtacgatgctggccgggacggattcatcgatctgatggaactgaagctcatgatggagaagcttggcgcacctcaaacccatcttggactgaagaacatgattaaagaagtggatgaggattttgacagcaaactgagttttagggagtttttactgatctttaggaaagcggcagcaggcgagcttcaagaagactcgggactttgcgttctcgcaaggctgtctgaaatcgacgtcagcagtgaaggagtgaaaggagctaagtcctttttcgaagcaaagtggaactgggtgtgccggtgggctcctcggaccggctccagaggatcgggctggcagcagctggagagactcccttcctccgccctggcccttcaacagccccaaaatattggtcccggtcatcaaagagtgcaacccctccgaggcggtgaccagggacgcgccggcggcaaagaggaagctggcggcggagacgaagccgcagaaagcggcttgcaaggcgccgccgtgcacttatag

SEQ ID NO: 26005 - DNA, 723 bp, Artificial Sequence
  Description of Artificial Sequence: Synthetic coding sequence
atggctacggatgagctggcaacaaaactatcccggcgccttcagatggagggtgaggggggaggggagacacctgagcaacccgggcttaacggtgcagccgccgcagccgcgggcgctcctgatgaggcagccgaagcattggggagcgctgactgcgagctgagtgccaaactgctccggcgggcagacctgaatcaaggcattggagaaccccagagcccatccaggcgcgtctttaacccatatacagaatttaaagagtttagtcgcaaacagatcaaggatatggagaagatgtttaagcaatacgacgctggacgcgatgggttcatcgacttgatggagcttaagctgatgatggaaaagctcggggctccccaaacgcatttgggcctgaagaacatgattaaggaagtggatgaggatttcgacagtaaactgagcttccgcgaattcctcctgatattcaggaaagccgccgctggagagctgcaagaagacagcggcctttgtgtgctggcccgattgagcgaaatagacgtgagcagtgagggcgtgaagggcgctaagtctttctttgaggccaaagtacaggctataaatgttagttcaagattcgaggaagagatcaaagcagagcaggaagagagaaagaaacaggcagaggagatgaagcagcgtaaggccgctttcaaagagctccagagtacgttcaagtag

SEQ ID NO: 26006 - DNA, 540 bp, Artificial Sequence
  Description of Artificial Sequence: Synthetic coding sequence
taaaaaatgttcaaacaatatgatgcaggacgcgatggatttatagacctgatggaacttaaactgatgatggagaagctgggggccccacagacccacctcgggctgaagaacatgatcaaggaggtggacgaggattttgactctaaattaagcttccgcgagtttctgctgatatttaggaaagctgctgctggggagttgcaggaggattcaggactttgtgtgttagcccgcctgtccgagatcgacgtgagcagcgaaggggtcaagggcgcaaagtctttctttgaagcgaagtggaactgggtttgtcggtgggcaccacgcaccggcagtcgcggcagcggctggcagcagctcgagagacttcccagcagtgccctcgctctgcaacagccgcagaatattggcccgggccaccagagagtgcagcccctgcgtggcggcgatcaaggacgcgctggaggtaaagaggaagccgggggcggggacgaagctgcggaatcggggctgcagggggcagccgtgcatctgtag

SEQ ID NO: 26007 - DNA, 2073 bp, Artificial Sequence
  Description of Artificial Sequence: Synthetic coding sequence
atgaaacgtcttccgctcttagtcgtgttttccacgttgctgaattgttcttatacccagaattgcacaaaaactccatgccttcctaacgctaagtgcgaaattaggaacggcatagaagcatgctattgcaacatgggcttcagcggaaatggcgtaacaatttgcgaggatgacaatgagtgtggaaacctcacccaatcgtgtggagaaaacgctaattgcacaaacactgaagggagttactactgtatgtgtgttcctggatttcgcagctcgtctaaccaggaccggtttattactaatgatggtacggtgtgcatcgagaacgtgaacgcgaactgtcatctcgataacgtctgcattgccgcaaacataaacaaaactcttaccaagatccggagcattaaggagccggttgccctgctgcaggaggtgtatagaaactccgtgacagatctatctcctaccgacatcatcacctatattgaaatcttagccgagtcctcaagtctcctcggttacaagaataatactattagtgctaaggatacattgtcaaattccactctgaccgagtttgtaaaaaccgttaacaattttgtccagagagacacattcgttgtgtgggataagctctccgtcaaccataggaggacacacctgacaaagttgatgcatacagtagagcaagcaaccttacggatttcacagtcctttcagaaaaccacagagtttgacactaactccaccgatatagcccttaaggtctttttctttgactcttacaatatgaagcatatccatccacatatgaatatggacggagactatattaatatattccctaagcggaaggccgcctacgacagtaatgggaatgtcgctgttgcatttgtctactacaagagcatcggtcctttattatcgagctcagataactttctgttgaaaccccagaattatgataacagtgaggaagaagagcgagtgatcagctcagttatatctgtgagcatgagcagcaacccaccaaccctctatgaactggaaaaaataacctttacactctcacaccgtaaggtgactgacaggtaccgctctctctgcgcattttggaattatagccccgacactatgaatgggtcttggtcctcagaagggtgtgagctgacctatagcaatgagactcacacctcatgtagatgcaatcacttgacgcatttcgcaatcctgatgagctccggcccatctatcggaattaaggactacaatattctgacgcggattacccagctcggcatcattatttctttaatctgcctggccatctgcattttcacattttggtttttctcagagatccagtccacacgaacaaccatccacaagaacctgtgttgctcgctcttcctcgcagaattggttttcctggtgggcattaatacaaacaccaacaaactcttctgcagcattatagcgggcctcctgcactactttttcctggccgccttcgcctggatgtgtatcgaagggattcatctgtacttgatcgtagtgggtgtgatttataataaagggttcctacacaaaaatttctacattttcggctatttaagccccgctgtggtggtcggcttctcagcagccctcggctaccgctattacggcaccactaaggtttgctggctgtccacagaaaataacttcatttggtctttcatcggtccagcttgtctaatcatattggtcaacctgttggcctttggcgtgataatctataaagttttccgccacacagcaggactgaaacccgaggtgtcatgttttgaaaacattcgcagctgcgctcggggggcacttgccctgctgtttctcctcgggacaacttggatcttcggtgtgttacacgttgtccacgcatcggtggtgaccgcctatctgttcacagtctctaacgccttccagggaatgttcattttcctttttctctgcgttctttcacggaaaattcaagaagagtactataggttatttaagaacgtgccttgttgctttgggtgcctgcgttag

SEQ ID NO: 26008 - DNA, 450 bp, Artificial Sequence
  Description of Artificial Sequence: Synthetic coding sequence
gtagtggttggctttagcgcggcgttgggctacaggtattatggaacgactaaggtctgttggctgtcaaccgagaataactttatctggagctttataggtcccgcctgtctgatcatcctagtaaatctgttggctttcggagtaataatatacaaagtgtttcgccatacagctggcctgaagcctgaagtgtcttgtttcgagaacatccgtagctgtgcccgtggagcactagccctgctctttctgctgggcaccacatggattttcggcgttctacacgtggttcacgcatcagtggtcaccgcttatctgtttaccgtgtcaaacgctttccagggtatgtttatatttctctttctctgcgtactcagccggaagatccaggaggagtactacagattgttcaagaatgtgccttgctgctttggatgtttgagctgctag

SEQ ID NO: 26009 - DNA, 2472 bp, Artificial Sequence
  Description of Artificial Sequence: Synthetic coding sequence
atggggggccgggtcttcctggtgtttctggccttctgcgtatggcttactctccctggcgctgaaacacaggattcaaggggatgtgcccgatggtgccctcaagacagtagttgcgtaaatgctaccgcatgccgttgtaatccaggattttcaagcttcagcgagattatcacaacgcccatggagacttgtgatgacatcaacgagtgtgcgaccctgagtaaggtgagctgcgggaagttttcagattgctggaacacagagggaagctacgattgcgtgtgttcgccaggctatgagcccgtgtcaggggctaagacttttaaaaacgaaagtgaaaatacatgtcaggatgtagatgaatgccagcagaaccccaggctatgcaaatcatacggaacatgcgtgaacacactcggatcttacacgtgtcaatgcctgcctggattcaagctgaaaccagaggaccctaagctttgcacagatgtaaacgagtgcacatctgggcagaatccttgtcactcaagcacccattgcctgaataacgtgggctcttatcagtgtagatgcaggcctgggtggcagcccatccccggatcacccaatggacctaataacaccgtctgcgaggacgtggacgagtgttccagtgggcagcaccagtgcgattctagtaccgtctgtttcaacacagtcggctcctatagctgcaggtgccggcctggctggaagccacggcacggaattccaaataaccagaaggacactgtttgcgaggacatgaccttctccacttggacacctcctcccggagtacactcacaaaccctatccaggttttttgacaaggttcaagacctcggcagagattataagccagggctggcaaacaacaccattcagtcaatcctgcaggctctggacgagctgctcgaagcgcctggagacctcgagaccctgccgcgcttacagcaacattgtgtggcaagtcacctgttggacggcctcgaagatgttctgcgcggcttgagtaaaaacttgtcaaacggactcctaaacttctcgtatcccgccggtaccgagctctcgttagaggttcagaaacaagttgatagatctgtcacactgcggcaaaatcaggcagttatgcaactggactggaaccaggcacaaaagtccggcgatcccggccccagtgtggtcggcttggtttctatcccgggcatggggaaactgctggcagaggcaccactggttcttgaacccgaaaagcagatgcttctccacgagacccaccaaggactgctgcaggatgggtctcctatcttgcttagcgatgtcatctctgcgtttctgagcaataacgatacgcagaacctatcgtcaccagtcacttttacgttctctcacaggtctgtcatcccaaggcagaaggtgctgtgcgtgttttgggaacatggacagaacggctgcggacattgggccaccaccggctgcagtactattggaactagagacacttctaccatatgccgttgcacacatctatcatcctttgctgtgctcatggcacattacgacgtacaagaggaagatccggtcttgacggtcattacgtacatgggcctgtcagtcagtctcctgtgcctcctactcgccgcccttacctttctgctgtgcaaagccattcagaatacaagtacttccctccacctgcagctctctttatgtctgttcctggctcacctgctgtttttggtcgcaatcgaccagactggccataaagtgctgtgcagcatcattgctggaaccctgcactacctgtacctggccaccctgacatggatgctgttggaagctctctatttatttctaacagcacgaaatcttactgtcgtgaattattcctcaatcaaccggttcatgaagaagctgatgttccccgtgggctacggcgtgccggccgtaactgtcgccatcagtgctgcctcacgaccacacttgtacggcactccctcacggtgttggcttcagcccgagaaagggtttatctggggcttcctaggaccagtgtgtgcaatcttcagcgtgaatcttgtgctgttcttggtgaccttgtggattctgaaaaatagactgtcgagcctgaattcggaggtcagcacgctgcggaatacaagaatgctcgcattcaaagcaacggcccagctgtttatcctgggctgcacctggtgtctgggaatcctgcaagtcgggccggctgctagggtgatggcctatttatttacaatcattaactccttacaaggtgtcttcatctttctggtatattgtctgcttagccagcaagtcagagagcagtacgggaagtggtctaagggaatcagaaagcttaagactgagtcagaaatgcacacgctctcttctagcgcaaaagcagataccagcaagccatcaacggtgaactag

SEQ ID NO: 26010 - DNA, 2472 bp, Artificial Sequence
  Description of Artificial Sequence: Synthetic coding sequence
atgggaggtcgggtgttcctggtcttcttagccttctgcgtctggctgacattgcccggcgccgagacacaagattctcggggctgcgcaaggtggtgcccccaagattcctcatgtgtaaacgccaccgcctgcagatgtaatccagggttttcgagctttagtgagataatcaccacacctatggagacctgcgacgatattaacgagtgtgccacgttgagcaaggtctcctgtggcaaattctcggattgttggaacactgagggatcctatgactgtgtctgttctccaggatatgaaccggtgtctggagccaaaactttcaaaaacgagagcgaaaatacgtgtcaggatgttgatgagtgtcaacagaatcctcggttgtgtaaaagttacgggacatgcgtgaacacccttgggagttatacctgccagtgcttgccaggtttcaagttgaagccagaggatcccaagctctgtacagacgttaatgaatgtactagcggccagaacccatgccattcatcgacccactgcctgaataacgtgggaagctaccagtgccgctgtcgacctggatggcagcctatccctggatccccaaacggtcccaacaacacagtctgtgaggatgttgatgaatgtagttcaggtcagcaccaatgcgattcttcaaccgtatgcttcaatactgtgggcagttacagttgtcggtgtcgccctggatggaaaccccggcatggcattcctaataaccagaaggacacggtgtgcgaggacatgacattttccacatggactcccccaccaggcgtccattctcagacactaagccgtttttttgacaaggtgcaagatctggggagggactacaagcccgggctagccaataacaccattcagtcaattctgcaggctttggatgagctgctagaggcaccaggcgatctcgagaccctgcccaggttgcaacagcattgcgtggcttctcatcttttggacggcctcgaggatgtactgagaggcctctctaagaatctgtccaatggcctgctgaacttctcataccctgctggaaccgaactttcattggaagtacagaaacaggtcgacaggtccgtgacactgagacagaaccaggctgttatgcaactggactggaatcaggcacagaaatctggcgatcccggaccatcagtggtgggtttggtctctatccctggaatgggaaagctattggcagaagcccccctcgtcctcgagcccgagaaacagatgctgttgcacgaaacccatcagggcctgctccaggacggcagccctattttactgagtgacgtgatctcagcctttttgagcaataatgatacccagaatctgagtagtccagtcacttttaccttctcacatcgctctgttataccccggcagaaggtgttatgtgtcttctgggagcacggtcagaatgggtgtggacactgggctactaccggatgctcaacaatcggcacccgcgatacatctacaatatgccgatgtacccatctttcgtcttttgctgtactgatggcgcactacgatgtgcaggaggaggacccagtcctgacagttattacctatatgggcctgtcagtatcactcctgtgcctcctacttgccgctctgacattccttctgtgcaaggctattcagaacacctctacttctctgcacctgcaattgtcactctgcctgttcctcgcccatcttctgtttctggtcgctattgaccagacagggcacaaggttctctgttccattatagcagggactctgcattatctatatctcgctacccttacctggatgctcctggaagccctgtacctgttcctaactgctcgcaacctgactgttgtaaactactctagcatcaatcgctttatgaagaaactcatgtttcccgtggggtatggtgtccccgccgtgacagtcgccatcagcgctgcttcccggccacacctgtatggtacccccagcaggtgttggctccagcctgagaaagggttcatctggggctttcttgggccagtgtgtgctatcttcagtgtgaatctcgtgttattcctcgtgactctgtggatcctgaagaaccgcctgtcctctcttaacagtgaagtcagcaccctgcgtaataccagaatgctggccttcaaggcaacagcccagttattcatcttgggctgcacatggtgcctgggaatcctacaggttggacctgcagcacgtgtgatggcatacctctttactattattaatagcctgcagggagtattcatctttctcgtgtattgtttgctgtcccagcaggtcagggagcagtacggaaaatggtcgaaaggcattagaaagctgaagaccgagtccgagatgcacacactgagtagctccgccaaagcggatacatctaaaccaagcactgtgaattag

SEQ ID NO: 26011 - DNA, 2325 bp, Artificial Sequence
  Description of Artificial Sequence: Synthetic coding sequence
atgggggggcgagtgtttctcgtattcctggctttctgcgtctggctcacattaccgggtgcagagacccaggactctcgcggctgtgcccgctggtgcccacaggacagcagttgcgtaaacgccactgcttgtaggtgcaaccctgggttcagttcattctccgaaattattacgacacccatggaaacctgcgatgatattaacgagtgcgccactctgtctaaggtgtcttgcgggaagtttagcgactgctggaacactgaaggtagttacgactgtgtttgttctcctggatacgaaccagtcagcggggcaaagaccttcaaaaacgaaagcgaaaacacttgtcaggatgtggatgagtgccaacagaatcccagactctgcaaatcctacggcacctgcgttaatacactgggctcctatacctgccagtgcctgcccggctttaaattgaaacccgaggatcctaaactgtgcacagacgttgacgaatgcagtagcggccaacaccaatgcgactcctcaaccgtgtgttttaacactgtcggatcctacagttgcagatgtcgtcccggttggaagccaaggcacggaatacccaataatcagaaagatacggtgtgcgaagacatgactttcagcacatggaccccaccacccggggtccactcacagaccctgtcacggttttttgataaagttcaggacctggggagagactacaagccgggcctcgccaacaacacgattcagtcaatcctgcaagctctggacgagctgcttgaggcgcccggtgacctggagaccctaccacgacttcaacagcactgtgtcgcatcccacttgctggatggtttggaggacgtgttacgtggcctaagtaagaacctgagcaatggattgctgaatttttcataccctgctggcaccgaattgagtttggaagtgcagaaacaggtggacaggagcgtaacactgagacagaatcaagccgttatgcaactggattggaatcaagcccagaagtccggcgatcctggcccgtcggttgttggactggtcagcatcccaggcatggggaagcttctggctgaggcccctttggtactcgagccagagaagcagatgttgcttcacgagacccatcagggcttattgcaggacggcagtcctatcctcctttcggatgttatttccgcattcctatccaataatgacacccagaatctctcaagcccggtgacgttcacatttagtcaccgctcggtgattcctcgccagaaggtgctatgtgtgttttgggagcacggccagaatggttgtggacactgggctacaaccggatgcagcaccatcggaacccgagacaccagtacaatatgccggtgtacccatctgtcaagctttgccgttctgatggcccattatgatgtgcaagaggaagatccagtgctgaccgtgataacttacatgggcctctccgtgtctctactttgcctcctactggctgcactaacattcttgctgtgcaaggccatccagaataccagcacaagcctgcatttgcaactgtccctgtgtctgttcctggctcatctgctgtttctggtcgctatcgatcaaaccggccacaaagtgctgtgtagcattattgccgggacactgcattatctgtatcttgccacgttaacctggatgctgcttgaagcactgtacttgtttctgacggctaggaatttaactgtggtaaactattccagcatcaacagattcatgaagaaactaatgttccccgtcggatacggcgttcccgccgtgacggtggctataagcgctgcctcacgaccccacctgtacggcacaccatcgaggtgctggctgcagcctgaaaagggctttatctggggcttcctggggccagtttgtgccatttttagcgtgaatttagtgctattcctagtgaccctgtggatactgaaaaatcgtttaagtagcctcaattctgaggtgagcaccctgcggaacacaaggatgcttgcattcaaagcaactgctcaactctttatactggggtgcacatggtgtctgggaatcttgcaggtcggtcccgccgccagagtcatggcctaccttttcacaataatcaatagtctccagggcgtcttcattttcttagtctactgcctcctgagccagcaggttcgtgagcaatacggcaagtggagcaagggcattcgaaaattaaagaccgaaagcgagatgcacactctgagttcttctgccaaggcggatacgtctaagcccagtactgtgaattag

SEQ ID NO: 26012 - DNA, 2046 bp, Artificial Sequence
  Description of Artificial Sequence: Synthetic coding sequence
atgggcggtcgagtatttctcgttttcttggctttctgcgtatggctgactctgccaggtgcagagacccaggactctaggggctgtgccaggtggtgccctcaagattcatcttgcgtcaatgcaactgcttgccgatgtaatccaggcttttcaagcttttcggaaatcatcacaactcctatggagacttgcgacgacatcaacgaatgtgcaacgctcagcaaagtgtcttgtggtaaattttctgactgttggaatacggagggaagctacgattgcgtgtgctctccgggatacgagccggtgagtggcgcaaaaaccttcaaaaatgagtcagagaatacatgccaagacatgaccttcagcacttggacaccccccccaggcgttcacagccaaacactgtctagattctttgacaaggttcaagatcttggtagagactacaagccaggtttggcaaataatacaatccagagtatcctccaagctttagatgaacttttggaagcacctggcgacctcgagaccctaccgcggcttcagcagcattgtgtcgcctcacatctgctcgatgggctggaggacgtactgaggggtttgtccaagaatctgtcgaatggcctgcttaatttctcctacccggccggcacagagctgtctttagaagttcagaagcaggttgaccgaagtgtcaccttgcggcagaatcaggctgtcatgcagctggactggaaccaggctcagaagtctggcgacccagggccctccgtcgtggggctcgtgagcattccaggtatgggtaagctgttagctgaggctccgcttgtgcttgagcctgagaaacagatgctgttacacgaaactcaccagggactcctgcaggatggttcccccatcttgctgtccgacgtgataagcgccttcctgtctaacaatgacacacaaaatctatctagccctgtcacgttcaccttttctcacagatccgtcataccccggcaaaaagttctgtgtgtcttttgggaacacgggcagaatgggtgcggtcactgggccacgaccgggtgcagcactatcggtacgagggatacttcaacaatctgtcgatgtacccatctgtcaagcttcgccgtgttgatggcacactacgacgttcaggaggaggatcctgtgctgactgtgatcacatatatgggcctatctgtctccctgttgtgtctcctgctggccgcacttactttcctcctttgcaaggccattcagaacacaagcacctctctgcatctgcaattgtctttatgcttgttcctggcacatcttctgtttttagtcgccatagatcagaccgggcacaaagtactgtgttccatcatagctgggactctgcattatctctacttggccactctcacatggatgctgctcgaggctctttacctgtttctgaccgcgaggaacctgactgtcgttaactacagcagcataaatagattcatgaagaagctcatgttcccagttgggtacggtgtgcctgctgtgacggtggcgatcagcgccgcaagtagacctcatctgtatgggactccctccaggtgttggctccaacccgagaaagggttcatttggggatttctgggccctgtctgcgctattttctctgtcaaccttgttcttttcttagttactctgtggatccttaagaataggctgtcttcccttaattcagaggtttcaaccttgcgtaacaccaggatgcttgcgttcaaagcaaccgcacagctctttattctagggtgtacctggtgccttggaatcctgcaagtgggaccggcagcacgtgtcatggcctatctctttaccatcatcaatagcttgcaaggggttttcattttccttgtttactgtctgctgtcacaacaggtgagagaacaatatgggaagtggagcaagggcattcgcaaacttaagactgagagtgaaatgcacaccctgagctcaagtgccaaagctgacacgtcaaaaccatctaccgtgaactag

SEQ ID NO: 26013 - DNA, 2193 bp, Artificial Sequence
  Description of Artificial Sequence: Synthetic coding sequence
atgggtggtagagtctttctggtgtttctcgcgttctgtgtgtggttaaccctgccaggagctgaaactcaggattcccggggctgcgcaaggtggtgccctcaggacagtagttgtgtgaacgccaccgcttgtcggtgcaacccagggttctcgagcttctccgaaatcattacaactccaatggaaacctgcgacgatatcaacgagtgcgcgaccctgagcaaggtttcctgtgggaagtttagcgattgttggaacactgagggttcttacgattgcgtctgctcaccaggctatgagcctgtgagtggcgctaagacatttaaaaatgaatctgagaatacgtgccaggacgtggatgagtgctccagcggccagcatcagtgtgactcctcaacggtttgctttaacaccgtcggaagttatagttgtcgctgtagacccggatggaaaccgagacatggcattcctaacaaccagaaggatactgtgtgtgaagatatgacattctccacctggacgccccccccaggggtgcactcacagacactgtcgagattttttgacaaagtacaagacctcgggagggattacaaaccgggactcgctaacaacaccatccagtcgatactccaggctttggatgaactgctggaagccccaggagatctagaaaccctccccagattacagcagcactgcgtggcttcacatcttctggacggactggaagacgtgctgagaggactttcaaagaatttgagtaacggattattaaatttctcttaccccgctggtacagagctgtcccttgaggttcaaaagcaggttgacaggagcgtcactctgaggcagaaccaggctgtgatgcagctggattggaaccaagctcaaaagagtggcgatccaggaccatcagtcgtggggctcgtgtccattcccgggatgggtaagcttctcgctgaggcccccctggttctggagccagagaagcagatgttgcttcacgagacccaccagggcctgttacaggatggctcccccatcctcctttcggatgtgatcagcgctttcctgtctaataacgatactcaaaacctgtcctcccctgtgacatttactttttcccaccgtagtgtaattcctagacaaaaggtcttgtgtgtcttttgggagcacggccaaaacgggtgcggacattgggccactacagggtgctcaactattggcactagagatacaagtacgatttgcagatgtactcacctgtcgtcttttgctgtactaatggcacactatgatgtgcaagaggaggacccagtgctgactgtgattacctacatggggttaagcgttagccttctttgtctcctgctcgcagcacttacttttcttctctgtaaagctatacagaatacgagcacgtctcttcacttacaactcagcctgtgcttgttcctcgctcacctgctgttccttgtcgccatcgaccagaccggccataaggtcctgtgttccattatcgcagggaccctacactatttgtatctggccaccttaacttggatgttattggaagctctctatcttttcctcacagcccgcaacctcactgttgtaaattattcatcgatcaaccgattcatgaagaaactcatgtttcccgtgggttatggcgtccccgctgtcacggtggccatcagtgcagcgagtaggccccacctctatggcacccccagcagatgctggctgcagccagaaaaagggttcatctggggctttctgggccctgtgtgtgcgatatttagcgttaatttggttctcttcttggtcactctatggatactcaagaaccggctctcctcattaaatagcgaagtctcaacgttgcgtaatacgcgcatgctagcatttaaggcgaccgcgcaattattcatcctcggctgcacctggtgcctcgggatcctccaggtcggcccagctgccagggtgatggcttatctgttcacaatcattaacagcctccagggggtcttcattttcttggtgtactgcctgcttagccagcaggtgcgggagcaatacgggaaatggagcaagggaatccgcaagctgaagactgagagtgagatgcacactctgtcaagctccgcaaaagcagacacctctaaacccagtaccgtcaattag

SEQ ID NO: 26014 - DNA, 720 bp, Artificial Sequence
  Description of Artificial Sequence: Synthetic coding sequence
atgggaggacgcgtgtttttggtgtttttagccttttgcgtttggttaacactacccggggctgagacccaggactcgcgcggctgcgcgcggtggtgtcctcaagatagctcttgcgtaaatgccaccgcttgtagatgtaatccagggtttagcagctttagtgaaatcatcaccactccaatggagacttgcgatgatatcaacgaatgtgccaccctctcgaaagtgtcctgcggcaaattcagcgattgctggaataccgagggctcctacgactgtgtgtgctcccctggatatgagcccgtttctggggccaaaacgttcaaaaacgagtcagagaatacgtgccaggacgtcgacgagtgtcaacagaacccaaggctgtgcaaaagctacggcacgtgcgtcaacaccctgggatcgtatacctgccaatgcctccccggcttcaagctgaaaccagaggaccccaagctgtgcaccgacgtgaatgagtgtaccagcgggcagaatccttgtcacagcagcactcactgtctgaacaatgttggttcttatcagtgtcgatgccggcccggatggcaaccaatcccggggtcccctaacggaccaaacaacactgtgtgcgagggccgcgaactgcggtcgcatgtacccagggacccgcagacttccgaccacatgtttaatggggcccataccaatcaggctgagtag

SEQ ID NO: 26015 - DNA, 1140 bp, Artificial Sequence
  Description of Artificial Sequence: Synthetic coding sequence
atgggaggcagagtgttcctggtcttcttggccttttgtgtttggttgacactgcctggggcagagacccaggactcacgcggttgcgcccgctggtgccctcaggatagttcttgtgtcaatgccacagcgtgtcggtgtaacccagggttcagcagcttctcggaaattataaccacaccaatggagacttgtgacgatattaatgagtgtgctacactgtctaaagtgtcttgtggaaaattcagtgattgttggaataccgaggggagctacgattgtgtgtgttcccccggatatgaaccagtgtcaggggctaagacctttaaaaacgaatctgaaaatacatgccaggacgttgacgagtgccagcaaaaccccaggctgtgcaaatcgtacggaacctgcgtgaataccttgggctcgtacacctgtcagtgcctgccagggtttaagctgaagcccgaggatccaaagctttgcaccgacgtcgacgagtgcagctctggccagcaccagtgtgacagttccactgtttgtttcaataccgttggtagctatagttgccgatgtcggccagggtggaagccgcgccacggcatccctaataaccaaaaggataccgtgtgtgaagacatgacattttctacatggactcccccacctggcgttcactctcagaccctgagtcgcttttttgataaggtacaagatctcgggcgggactataaaccgggactggcgaataatactattcagagtattctgcaggccctcgatgaactgctggaggcgcctggcgatctggaaacgctccctaggctccagcagcattgcgttgccagccatctgcttgacggactcgaagacgtactgagaggattgagcaagaatttgtcaaatggcctgcttaacttctcttaccctgcggggactgagttatcccttgaggtccagaagcaagtagatcgcagcgttactctgagacagaatcaagccgttatgcagttggattggaatcaggcccagaagagcggagacccgggtggtggatctcgcgctgattgccaccacttgcacggtgccgagaggctgtccgcagtccctcccccggggggacctcatttctcccccgtctag

SEQ ID NO: 26016 - DNA, 678 bp, Artificial Sequence
  Description of Artificial Sequence: Synthetic coding sequence
atgactttttctacttggaccccccctccaggggtgcattcccagacactctccaggttctttgataaggtccaggatttgggacgggattataaacctggcctggcaaataatacaatccagtctatactccaggccctggatgagttgctggaagctccgggcgacctcgagactctgccaagactgcagcagcactgtgtggcaagtcatcttctcgacggcctggaagacgtcctgagaggactgtcaaagaacttaagcaacggcctgctcaatttttcttaccctgccggcacagagttaagcttggaggtccagaagcaggtcgataggagtgtgaccctgcgccagaatcaggctgtcatgcagcttgactggaatcaggcacagaagagtggggatccagtaagtgatccagagaccgaaggagcactttgcctactcggggcctggcctgagtggatgtggtcgctgggtcaccacaggctacagcacaataggcatcaacggcatcagcaccacctgcctctgcacccgccggagcagctgtgtcgacctcacggtcccctccggtgtgcaggaggcggttcacgtgcggactgtcatcatttgcatggtgcagagcgcctcagtgcagtgcccccccccggggggcctcacttcagtcccgtctag

SEQ ID NO: 26017 - DNA, 2298 bp, Artificial Sequence
  Description of Artificial Sequence: Synthetic coding sequence
atgggcggtcgggtattcctggtttttctcgccttctgcgtgtggctgactctgccaggcgccgagacacaggacagcagaggttgtgcccggtggtgtccgcaagacagctcttgcgtgaacgcgacagcatgtcggtgcaaccccgggtttagttccttcagcgagataatcactacgcctatggaaacttgtgacgatatcaacgaatgtgccaccctctctaaagtaagttgcgggaagttcagcgactgttggaatacagagggatcatacgactgcgtctgtagtccagggtatgagccagtgtccggcgccaagacatttaaaaacgaatctgaaaatacctgccaagacgttgatgagtgccaacagaacccccgtctgtgtaagtcatacggaacttgtgttaatacactgggcagctacacctgtcagtgcctgcctggcttcaaactcaaacccgaggacccaaagctctgtactgacgtaaacgagtgcacatcaggtcagaatccatgccatagctctacccattgcttgaacaatgtggggtcttaccagtgtaggtgccgtccaggatggcaacctatccccggaagtcccaacggaccaaataataccgtgtgcgaggatgtcgacgagtgctcctcggggcagcaccagtgtgacagctccactgtttgcttcaacactgtcggtagctacagctgtcggtgcaggccagggtggaagcctaggcacggtatacctaataatcagaaggatacggtgtgtgaagatatgacattcagcacatggactccgccgcctggcgtccactctcagaccctttcgcgcttctttgacaaggtccaggacctggggagggattacaaaccaggtctagctaataacactattcagagcatactgcaggcgctcgatgaattattggaagcccctggcgatctcgagacactgcctagacttcagcagcattgtgtcgccagtcacctgctggatggacttgaagatgtgctgcgggggctgagtaaaaacctttcaaatgggcttctgaactttagctatcccgccgggactgaattgagcctggaggtccagaaacaagtagacaggagtgtcactctgaggcagaaccaagctgtcatgcagttagattggaatcaggcacagaaatccggcgaccccgggccatccgtggtgggcctggtgagcatccctggcatgggcaaactccttgccgaggctccattagtcctcgaacccgagaaacagatgctcttgcatgagacacaccaggggctgctgcaggacgggagtcctatcctgctgagtgacgtgatctcagcttttctgtcaaacaatgatactcaaaaccttagcagcccggtcacgtttaccttttcgcatcgggaagaggatcccgtcctgaccgtcattacatatatgggactctctgtgtccctgctgtgcctccttctggccgccctgaccttcctgctctgcaaggccatacaaaatacctctacaagcctccacttgcaattgagcctgtgcctgttcttagcgcatctgctcttcctggtggcaatcgaccagacaggccacaaagtcctctgttcgatcatagcaggaactctccattacctgtatctcgctacactcacatggatgctgctggaggccttgtatttgttcctgaccgccaggaatcttaccgtcgtaaattatagtagcatcaatcgtttcatgaaaaagcttatgttccccgtaggctatggagtgccggcagtgaccgttgctatatcggctgcttcccggccccatctgtacggcacaccctcaagatgctggctccaacctgagaaaggattcatttggggttttctgggcccggtctgtgcgatttttagtgtcaacctggtcttgttcctggtgacactatggatcctgaagaataggctttctagtctcaattctgaagtgtcaacactgcggaacacccgaatgctcgccttcaaggccacagctcagctgttcattctgggctgcacctggtgtctcggaatcctgcaggtggggccagctgcccgagtaatggcttacctgtttacaatcattaatagcttgcagggggtgttcatctttctcgtatattgcctgttgagccaacaggtgagagagcagtatggtaagtggagtaagggcatccgtaagctgaaaactgaatccgagatgcataccttaagtagctcagccaaggcagatacatccaagccgtccacagtaaactag

SEQ ID NO: 26018 - DNA, 2439 bp, Artificial Sequence
  Description of Artificial Sequence: Synthetic coding sequence
atgggcgggcgagtgtttctagttttcttggccttctgcgtgtggctgacactgcctggggccgaaacacaggactctagaggatgtgcgagatggtgtccacaggattccagttgtgttaacgccaccgcctgtagatgcaaccccggcttctccagcttcagcgagatcattacaacgcctatggagacttgtgatgacatcaacgaatgtgccacactgtccaaggtttcatgtgggaaattttctgattgttggaataccgaaggaagttatgactgtgtgtgttctcccggctacgaacccgtgagcggagcgaaaacatttaagaatgagagcgaaaatacatgtcaagacgtggatgagtgccagcaaaatccgaggctttgtaaatcctatggtacctgtgttaacactctaggtagttatacgtgtcagtgtctgcccgggtttaagcttaagcctgaagaccctaaattgtgtactgacgtgaacgagtgcacctccggacaaaacccatgccatagttctacccactgcctgaataatgtaggaagctaccaatgtagatgccgtcccggctggcagccaattcctgggtctccgaatggacctaataacaccgtctgtgaggatgtcgatgagtgcagctcagggcagcatcaatgtgatagttccactgtgtgttttaacactgtgggctcatacagttgtcgatgcagacctggttggaagccccgacacggcattccaaacaaccagaaggatacagtctgtgaggacatgacctttagcacttggacaccaccccctggcgtacactctcagactcttagcaggttctttgacaaagttcaagatctgggacgggactacaagcccggcctcgcaaacaatactattcagagcatcttgcaagctctggatgagttgctggaagcgccgggggatctggaaaccctgcctcggctccagcagcattgcgtcgcttcacacctgttagatggattggaggacgtacttcggggattgtctaagaacctgtctaatggactcttgaacttcagctacccggccgggacagagctgagtcttgaagttcagaagcaggtcgacagatcagtcaccctcaggcagaatcaagccgtcatgcagctagactggaaccaggctcagaagtctggagacccaggaatggggaaacttttggctgaagcgccgctggtcctggaacctgagaagcaaatgctgctgcacgagacccaccaaggactcctacaggacggcagtcccatcctcctttccgacgtgatttctgccttccttagtaacaacgatacccagaacctttctagccccgtgacgttcaccttttctcatcggtcggtcattcccaggcagaaggtgctgtgtgtattttgggagcatggccagaatggttgcggacactgggcaaccaccgggtgctcaacaattggcactagggatacgagcaccatctgtaggtgtacgcacctgtcgagcttcgcagtgttgatggcgcactatgatgtacaggaggaggaccctgtactcaccgtcataacttacatgggactcagtgttagcctgctgtgcctactgcttgctgctttgacattccttttgtgtaaggcaatccagaacactagcacaagcctgcatctccagctgtccttgtgcctctttctcgcacacctcttgtttctggttgcaatcgaccagacggggcataaggttctgtgttccataattgccggaaccctccattatctgtatctcgccaccctgacttggatgttgctcgaagctctgtacttgttcctcacagcaaggaacctgactgttgttaattattcaagtattaatagattcatgaaaaagctgatgttccccgtgggttatggggtgcctgcagttacagtagctatttcagctgcctcccgcccccatttatatggcactccaagtcgttgctggctccagccagagaagggcttcatatgggggtttctagggcccgtatgtgctatctttagtgttaacctggtcctgttcctagtgactttatggatcctgaagaataggttgtcgtccctcaattccgaagtaagtactctgaggaatacacggatgctggcctttaaggccacagctcagctgtttatcctgggctgtacttggtgtctcggcatcctgcaggtggggcccgccgcaagggtgatggcatacctcttcacaatcataaattccctccaaggagtgtttatcttcttagtttactgcctcctcagccagcaggttagagagcaatatgggaagtggtcaaaggggatacggaaactgaagacggagagcgagatgcatacgttgtcatctagtgcgaaagccgatacatccaagccctcaacggtgaactag

SEQ ID NO: 26019 - DNA, 2874 bp, Artificial Sequence
  Description of Artificial Sequence: Synthetic coding sequence
atgtatggaagcgcacgcaccattaccaacttggagggcagtcccagtagatcccctcggctgcctcgcagtccaagactcgggcacagacgcacctcatccggcggaggtggagggacaggcaagaccctgagcatggagaatatccagagcctgaatgcagcttatgctacttctggcccaatgtatttatcagatcatgaaggcgtcgcctccactacataccccaaggggactatgactctcggcagagcaactaacagagctgtttatggcgggagagtgactgcaatgggctcttctcccaatatagccagcgcaggactgagccacacagatgtcttatcctacacagaccagcacggaggattgaccggaagttcgcatcaccatcaccatcaggttccttcaatgctgcgacaggtcagagattcgaccatgctggacctgcaggctcagcttaaagagctccagagggagaacgacttattgagaaaggagctggatatcaaggactccaaactcggtagtagcatgaacagcatcaagacattttggagcccagagttgaagaaagaaagagtgctaaggaaggaggaagccgctcggatgagcgtactgaaagagcagatgagggtgagtcacgaagagaatcaacacttacagctcactatccaggccctgcaggacgaactcaggacccaacgggacttaaatcacctgctccagcaggagagcgggaaccgcggtgcggagcacttcacgatcgaattgacagaagagaattttcgacgcctccaggctgagcatgaccggcaggctaaagagctattcctcctgaggaagaccttagaagagatggaactgaggatcgagacgcagaaacagactctgaacgctagagatgaaagcatcaagaagctgctggagatgctgcagtccaagggtctcccctctaagagcctcgaagatgacaacgaacgtactcggcgcatggcggaggcagagtcccaggtgtcccacctggaagtgatcctggatcagaaggaaaaggagaatatccacctccgagaagaattgcacaggcgctcccagttgcagcccgaacccgcgaagaccaaggccctgcagacagttatcgagatgaaggatactaagattgcatcgctggagcgaaacatacgcgatctggaggatgaaatccaaatgctgaaggcaaatggcgtcttgaacacagaagatagagaagaagagatcaagcagattgaggtgtataagagccactccaaattcatgaaaacaaaaatagaccagcttaagcaagaactcagcaagaaggaatctgaactccttgctctgcagaccaagctggagacattatcaaatcagaactcggattgtaaacagcacatcgaggtgctcaaggaaagcctaacggcaaaagagcagagggctgcaatccttcagactgaggtcgatgcactgaggttgagactcgaagagaaagaatcctttcttaataaaaaaaccaagcagctgcaggacctgaccgaggagaagggaacgctggccggagagattcgcgacatgaaagacatgctggaagttaaagagcgaaagatcaacgtgctgcagaaaaaaatcgaaaacctgcaagagcaattgcgggataaagacaaacagctgactaacctgaaagatcgtgtcaagagcctgcagactgactcctccaacaccgatactgccctagcaaccctggaagaagctctgtcagagaaagagcgtattatcgaacgcttaaaggaacagcgagaacgcgatgaccgcgagaggttggaagaaatagagagtttccgaaaggagaacaaggacctaaaggagaaagtgaatgccttgcaggcagaattgacagaaaaggaaagtagtcttattgacctgaaggaacatgcctcatcgctagccagcgcgggattaaaacgagattcaaaattgaaatcccttgaaattgcaattgaacagaagaaggaagaatgctcgaagctagaggctcagcttaagaaggcgcacaacattgaagacgacagtagaatgaatccggaattcgccgatcagattaagcagctggataaagaagcgtcctactacagggacgaatgcgggaaagcacaggccgaggtagacaggctgctggagatccttaaggaggtggagaacgaaaaaaatgacaaagataaaaaaatcgccgaactcgagtccctgactctgcgacatatgaaagatcaaaataagaaggttgcaaatttgaaacacaaccagcagcttgagaagaaaaagaacgctcaactgctagaggaagtcagacggcgcgaggacagtatggccgacaattcccaacatttacagattgaagaactgatgaacgctctggaaaagacacgccaggaactcgacgccactaaagccagactcgcttctacccagcaaagtctggcggaaaaggaagcccacctcgccaacctgcgtattgagcgcaggaagcagcttgaagagatcctggaaatgaaacaggaagcactcctcgctgccatctcagaaaaggacgcgaacattgccttgttggagctgtcggctagcaagaaaaagaagacacaggaggaggtgatggcacttaaacgggaaaaggatagactagtgcaccagttaaaacagcagacacaaaatcggatgaaactaatggctgataattatgacgatgatcaccaccattatcaccatcaccatcatcatcatcaccaccggtctcccgggcgctctcagcattctaatcacagacccagcccagaccaggatgatgaggagggaatctgggcctag

SEQ ID NO: 26020 - DNA, 2874 bp, Artificial Sequence
  Description of Artificial Sequence: Synthetic coding sequence
atgtatggcagcgcaagaactattactaatctggagggctccccatcgcgttcccccaggctgccacgatctccacgcttaggacacaggagaacctcttccgggggcggaggaggcaccgggaagacactgtcgatggaaaatatccagtcccttaacgccgcctatgctacctcagggcccatgtatctgtccgaccacgaaggcgtggcaagcacaacatacccaaaagggacaatgacactgggcagggccactaaccgagccgtgtatgggggtcgagttactgcgatgggcagctccccaaacattgctagcgcaggtctttcccatacagatgtcctatcctacacagatcaacatgggggcctgacggggagctcacatcatcaccatcatcaggtaccttcaatgctgagacaggtcagagattcaacgatgctggacctgcaggctcagctaaaggaactccagagggaaaacgatctgcttaggaaggagctcgatatcaaggactctaaactgggcagttccatgaatagcatcaaaactttctggagtcccgagcttaaaaaggagcgggtgctgcggaaggaggaagctgcgcgaatgtccgtacttaaggagcaaatgagagtgtcacacgaggagaaccagcacttacaactcacgatccaggcccttcaggatgaacttcggactcagcgcgacttaaaccacctgttgcagcaagagagcggcaataggggcgcggagcacttcactatcgagttaaccgaggagaactttcggcgacttcaggcagagcacgatagacaagccaaggagctgttcctgttaagaaaaaccctcgaagagatggaattgagaatagagacacaaaaacagaccttgaacgccagagatgagagcatcaagaaactcctcgaaatgctccagagtaagggactaccctctaaaagcttagaggacgataacgaaaggacgcgccggatggctgaggctgaatcacaagtgagccacctggaagtgatcctcgaccaaaaggagaaggagaacatacacttgcgggaggaattacaccgccgctcacagttacagcccgaacccgcgaagaccaaagctcttcagacggttattgagatgaaggacaccaagatcgcaagcttagagaggaacattcgagatcttgaggacgaaatacagatgctcaaggctaacggggtgcttaataccgaagaccgggaggaggagatcaaacaaatcgaggtgtataagtcgcacagcaagttcatgaagaccaagatcgatcagttaaagcaggaattgtcaaaaaaagaatccgaactattagccctgcaaaccaagcttgagacattgagcaatcagaactccgactgtaaacaacacatcgaagttctcaaggaaagtctgacagcaaaggagcagcgtgccgccatacttcagaccgaggttgatgctctgcgtctgcggttagaagagaaagaatcctttctaaacaagaagaccaagcaacttcaggatctgacagaagagaaggggacactggccggcgaaatcagggacatgaaggatatgctggaggttaaggagcgtaagatcaatgtgctccaaaagaaaatcgagaacctgcaagagcagttgagggataaagataaacaactgaccaacctgaaagaccgggttaagtccctgcagacagattcctccaacaccgacactgcactcgctacattagaagaagcactgagcgagaaagaacgaataattgagcggctcaaagagcaacgtgagcgtgacgatagggaaagactggaggaaatcgagagtttcagaaaagaaaacaaagacctcaaagagaaggtcaatgctcttcaggccgaactgactgaaaaggagtcttctttgattgacctgaaggagcacgcttcatccctggcttcagctggcctgaaaagggactccaagctgaagagcctggaaatcgctattgaacaaaagaaagaggaatgtagcaagctcgaggcccagctcaaaaaagcacacaacatcgaggacgattcacgaatgaaccccgagttcgccgaccagatcaagcagctggataaggaagcttcgtactaccgcgacgagtgtggcaaagcgcaagcggaagttgacaggctactagagattcttaaagaggtcgaaaacgagaaaaatgacaaagacaagaaaattgccgagctggaatcccttacacttcgccatatgaaagatcagaacaaaaaagttgccaacttaaaacacaaccaacagttagagaaaaaaaagaatgcccaactgctcgaggaagtcaggaggcgagaggactcaatggcggataattcgcagcacctacagatagaggaactcatgaatgctctggagaaaacacgtcaggaactcgatgctacaaaagcacgccttgcgagtactcagcagtcactcgctgagaaagaagctcacctggcgaatctcagaatcgagagacggaagcagctggaggagattctggagatgaagcaggaggctcttctggccgcaatttccgagaaagacgcgaatatcgccttgcttgaacttagcgcatcgaaaaaaaagaaaactcaggaagaggtcatggcgcttaaaagagagaaggatagactcgtgcatcagctcaagcaacagacccaaaaccgtatgaagctcatggcggataactacgatgatgaccatcatcattatcaccatcaccaccatcatcatcaccaccgaagccctgggagatcacagcacagtaaccatcgaccatcacccgaccaggatgacgaagaaggcatttgggcctag

SEQ ID NO: 26021 - DNA, 1587 bp, Artificial Sequence
  Description of Artificial Sequence: Synthetic coding sequence
taaagaagccagctgcaaccagaacccgccaagactaaagccctgcagaccgtcatagaaatgaaggatacaaagatcgcatccttggaacggaacattcgggacctagaagacgagatccagatgctcaaagctaacggcgttctgaataccgaagaccgtgaggaggaaatcaagcaaatcgaggtctataaatcccatagtaaatttatgaagacgaagattgatcaactcaagcaagaactgtctaaaaaggagtctgaactgctggcccttcagaccaaacttgaaacccttagcaatcaaaactccgactgcaaacagcacatcgaagttctcaaagagtctctgacagccaaggagcagcgggccgcaatcctgcagacagaagttgacgctctgcggctgagactggaagaaaaagagagcttcctcaataagaagaccaaacagttgcaggacctgaccgaggaaaaggggacacttgcaggtgagatcagggacatgaaagacatgctggaagttaaagagcggaagattaacgtgcttcagaagaaaatcgaaaatctgcaagagcagctaagagataaagataagcagctaaccaacctcaaggatagagtgaaatcgttgcaaacggactcctctaacacagacactgccttggctacactggaagaagccctgagtgaaaaggagcgaatcatcgagcgtctgaaggagcagcgcgagcgcgacgaccgggaacgcttggaagagatagaatcttttcggaaggagaataaagacctcaaggaaaaggtaaatgctttgcaggccgagctgaccgagaaagaaagctcactgatcgatttgaaggagcacgccagtagtcttgcctccgccggtcttaagagggatagtaagctgaagagccttgaaatcgccattgaacagaaaaaagaggagtgttctaaactcgaggcacagctgaagaaacaagctgagcagctgttcaatcagatgtataaccccgctcacaatatagaggatgacagcaggatgaacccggagtttgccgaccagatcaagcaactcgacaaagaagccagctactatagagacgaatgcggaaaagcccaggcagaagtggaccgattgctggaaatactaaaagaagtggaaaatgagaagaatgataaggataagaagatagctgagttggagcggcatatgaaagatcaaaacaaaaaggtggcgaacctgaaacataatcagcaattggagaaaaaaaagaacgcacagttgctggaggaagtgagaagacgcgaagattccatggctgacaacagccagcatttacagatcgaggaactgatgaacgctctggaaaagactagacaggagctcgacgctacaaaagctcgcctggcttcaacccagcagtctctggccgagaaagaggcacaccttgcaaaccttcgtattgagcgccgaaaacagctggaagaaattctggaaatgaaacaggaggcattgctcgcagcgatatctgaaaaagatgccaatattgcactgctggaattaagcgccagcaagaagaaatag

SEQ ID NO: 26022 - DNA, 984 bp, Artificial Sequence
  Description of Artificial Sequence: Synthetic coding sequence
atgagggctctccctggcctgctggaagcacgcgcccgcacaccgcgattgctgctcttgcagtgcctgttagctgcagccaggccttcgagcgcggacggctcggccccagattccccatttacctccccaccgttaagggaagaaattatggcgaataacttcagcctggaaagccacaatatttcgctgacggaacactcaagcatgcctgtggagaaaaatataacccttgaaaggcctagtaatgtaaaccttacatgccaatttactaccagtggcgatctcaatgcagtgaatgttacatggaaaaaggatggcgaacagctcgagaacaactacctggtgagcgctactggttctactttgtatacacagtaccgatttacaattatcaacagcaagcagatgggctcttacagctgtttctttcgcgaagagaaggagcaaagaggcacattcaatttcaaggttcccgaactgcacggcaaaaataaaccgctcatctcctacgtcggggactctacagtgttgacctgcaagtgccagaattgtttccccttaaattggacttggtattccagcaatggttccgttaaggtgcccgtgggtgtacagatgaataagtacgtcatcaatgggacctatgccaacgaaaccaagctgaaaatcactcagctgttagaggaggacggtgagtcttactggtgcagagctctctttcagcttggggagtctgaggagcatatagaattagtcgtattgtcctatctcgtaccgttgaagccatttctggttattgttgcggaggtcatcctcttggtggctacaatactcctctgtgagaaatatactcaaaagaagaagaaacactccgatgaaggtaaagaattcgagcaaatcgagcaactgaagtccgatgattccaacggcatagagaataacgtcccacggcaccggaaaaatgagtccttgggtcaatag

SEQ ID NO: 26023 - DNA, 621 bp, Artificial Sequence
  Description of Artificial Sequence: Synthetic coding sequence
atgggtgccgaatgggagctgggcgctgaggcaggaggatccctcctcctgtgcgccgctttacttgccgctggttgcgccttgggtctaaggctaggccgcgggcagggagcagcagatagaggcgctttgatatggctctgctatgacgccctggtgcatttcgccctggagggcccgttcgtgtacctgagtctcgtcggcaatgttgcaaatagtgatggactcatagccagcctgtggaaagagtacgggaaggccgatgctaggtgggtgtacttcgatcccacgatagtcagtgtcgagatcctcacagttgctctagatggaagtctggctttgtttcttatttacgctattgttaaagagaaatattaccgccattttctgcaaatcactctctgcgtgtgcgagctctacgggtgctggatgacattcctgccagaatggctgacccgcagccccaacctgaacacttccaattggctgtactgctggctgtatctgttttttttcaatggggtttgggtgcttatcccagggctgttactctggcagtcttggctggagctgaaaaagatgcatcagaaggaaacctcctccgtcaaaaaattccagtag

SEQ ID NO: 26024 - DNA, 261 bp, Artificial Sequence
  Description of Artificial Sequence: Synthetic coding sequence
atgggggctgagtgggaactgggggctgaggctggaggctccttgctgctgtgtgcagccctgttggctgctgggtgtgccctcggcctgcgcctcgggaggggccagggtgctgccgacagaggtgccttaatttggctgtgttacgacgccctagttcacttcgcgcttgagagggtaggtaaaaccactaatcaggaatctgcaggcgtgctggggagtaccgaatggaactttaagaataccgataaactactttag

SEQ ID NO: 26025 - DNA, 1257 bp, Artificial Sequence
  Description of Artificial Sequence: Synthetic coding sequence
atggctacttccgagcagagcatttgccaggctcgggccagtgtcatggtgtacgatgacacttcaaaaaaatgggttcctatcaagccaggacaacagggattttccaggattaatatttaccataataccgcttctaacacctttagagtggtcggtgtgaaattgcaggaccagcaggtcgtcatcaactatagtatcgtcaagggactgaagtacaaccaagcgactccgaccttccaccagtggcgcgatgcccgccaggtatacgggctcaattttgccagtaaggaagaggccactacctttagtaacgcaatgttgtttgccttaaacataatgaattctcaagagggcggcccctcatcccagcggcaggtgcagaacggtccatcccctgatgagatggacatccagcgccgtcaggtgatggagcaacaccagcaacagcgtcaggaaagccttgaacgaagaacttcggcaaccggccccattctgccgccgggtcatccctccagcgcggcttccgccccagtatcatgctctggacccccccccccgcctcctccacctgtgccgccacctcccacaggagctacaccacccccccccccgccactaccagctgggggcgcacaggggagctcccacgacgaatcttctatgtcaggacttgccgccgcaatcgcaggggctaagttaagaagggtgcagcgaccagaggacgcttcgggcggcagttcacccagcgggacgtccaagtctgatgccaacagggcatcttcggggggaggcgggggtggcttgatggaggagatgaacaagttgctggccaaacgacgtaaggctgcttcccagtctgacaaaccagcagagaagaaagaagacgagagccagatggaggacccctctacaagcccgtcgcctggaactcgagccgcctctcagccccccaatagctcggaggccggccgcaaaccctgggaaaggagtaactctgtggaaaagccagtgagctcgatcttgagtcgtactccttcagttgctaaatcaccggaggcaaagtcccccctgcagtcgcagccgcattcccggatgaagccagcaggcagcgttaatgacatggccctggacgcttttgatctggacagaatgaagcaagaaatactggaggaggtggtgagagagctccacaaagtgaaggaagagattatcgatgccataagacaggaacttagcggcatcagtactacttag

SEQ ID NO: 26026 - DNA, 1251 bp, Artificial Sequence
  Description of Artificial Sequence: Synthetic coding sequence
atgtctgagcagagtatctgccaggcaagagcatcagtgatggtgtatgacgatacaagcaagaagtgggtcccaattaagcccgggcagcagggattcagtcgcattaatatctatcacaacaccgcaagcaacacctttcgcgtcgtcggggtgaagctccaggaccaacaagtcgtgataaactattcgatcgtgaagggattgaaatacaaccaggccacgccgacattccaccagtggagagacgcccgccaggtttacggactgaactttgctagcaaagaggaggccaccactttctctaatgcaatgctattcgctctcaatataatgaatagccaagaaggcggtccgtcttctcagcggcaggtgcagaacggaccaagtcccgacgaaatggacatccaacggcgccaggtcatggaacagcatcagcagcagagacaggaaagcctcgagcgcaggaccagcgccaccggtcccattctgccgccaggtcatccaagttccgccgcatctgcgccggtgagctgcagcggccctccccccccaccacctccacccgtgcctccccctcctaccggcgcaacaccacctccgcctcccccactccccgctggcggagctcagggttcttcacatgacgagtcctctatgagcgggctcgccgcggccattgctggcgcaaaacttcgaagggtgcagaggcctgaggacgcttccggaggtagtagtcccagcggaaccagcaaaagcgacgctaaccgggcatcttccggagggggaggcggagggctgatggaggaaatgaataagctgctggctaagcggcgtaaagccgcctctcagtccgataagcctgctgagaaaaaggaggacgagagccaaatggaagacccctcaacttctccaagcccaggcacaagggccgcttcacagcctcctaatagcagtgaggccgggcggaaaccgtgggagcgttcaaattccgtggagaaaccagtctccagtatactgtctcggacaccttccgtggctaagtcaccagaggctaagagccctctgcagagccagccccacagcaggatgaagcccgcaggctctgtcaacgatatggcgctcgacgccttcgatctagatagaatgaagcaagagattttggaagaggttgtgagggagttgcacaaggtgaaggaagaaatcatagacgcaatcaggcaagagctgtccggaatcagcactacttag

SEQ ID NO: 26027 - DNA, 1146 bp, Artificial Sequence
  Description of Artificial Sequence: Synthetic coding sequence
atggcaaccagtgaacagtcaatctgccaggctcgggcatccgtcatggtctacgacgatacatccaagaagtgggtgccaatcaagcctggtcagcagggatttagccgaattaatatctaccacaataccgcatccaacacatttcgggtggtgggggtgaaacttcaggaccagcaggtggtgatcaactactctatagtgaagggcctgaagtacaatcaagccacacctacgttccaccagtggagggatgcacggcaggtttacggcctcaactttgctagcaaagaagaagccactactttttcaaacgcaatgttgttcgctctgaacatcatgaacagtcaggaggggggcccatcgtcacagcggcaggtgcagaatgggccaagtccggacgagatggacattcagcgccggcaggtgatggaacagcaccagcagcagaggcaggaatctttggagcgacggacaagcgcaacgggcccaatcctccctcctggacatcctagttccgcggccagcgctcccgtgagctgctccggcgccccttccgggctcgccgccgcgattgccggcgccaagctgagaagagtccagagacctgaagatgcaagcgggggatcttcgcccagcggcacatcgaagagcgatgcaaaccgggccagcagtggaggcggggggggaggcttgatggaagaaatgaacaagctgttggcgaaaaggagaaaagctgcgagtcagtcggataaaccggccgagaaaaaggaggacgaatcccaaatggaggacccttcgaccagccctagtcctggtactagggcggcatcgcagcctccaaactcctctgaagcaggacgcaagccttgggagagaagcaattccgtggaaaaacctgtgtcatccattcttagtcggaccccatcagtagctaagtccccagaggccaaatctcctttgcagtcgcagcctcacagccggatgaagcccgcaggttcagttaacgacatggctttggacgcctttgacctcgaccggatgaagcaggagatcctagaggaggtggtccgtgaactgcacaaggtgaaggaggaaatcatcgacgccatcagacaggaattgtccgggatcagcacaacctag

SEQ ID NO: 26028 - DNA, 1173 bp, Artificial Sequence
  Description of Artificial Sequence: Synthetic coding sequence
atgttcgcctttgaggaattcagcgaacaaagtatttgccaggctagagcctccgttatggtctatgatgatacttcaaagaagtgggtgccaattaaacctggccaacagggcttctcccgtatcaatatctaccacaatacagcatcaaacaccttcagggtggttggcgtgaagctgcaggaccagcaagtggtgatcaattactcaattgtcaaggggttaaagtataatcaggccactcccacttttcatcaatggcgagatgcccgccaggtctacggtttgaattttgcttccaaagaagaagctacaaccttttcaaatgccatgctgtttgccctgaacattatgaactctcaggaggggggaccgtctagccagagacaggtgcagaatgggccttctccagacgagatggacatacagcgtcgccaggtgatggaacagcaccaacagcaacgtcaggagagcctcgagcgccgtacaagcgcaaccgggcccattctcccccctggccacccctccagcgcggcttcagcccctgtctcttgcagtgggcctcctcccccccccccccctcctgttcctcccccgccaacaggagccaccccccctccacctccccccctccctgctggcggtgctcagggtagttcccatgacgagtctagtatgtccggtctggctgcggcaattgccggggccaaacttagacgagtgcaacggccagaagatgcctccggaggaagcagcccttcaggaacttcaaaaagcgacgccaacagggcatcctccggagggggcggggggggccttatggaggaaatgaacaaactgctggcaaagagacgtaaggctgcttctcagtcagacaaaccagcagagaaaaaagaggatgagtcccagatggaagatccctccactagcccatctcctggaactcgcgcagccagccaacccccgaacagttccgaagccggtagaaaaccatgggagaggtctaatagtgtggagaagccagtgtcaagcattctgtcacgcacacctagtgttgctaagtctcccgaggcaaagtcgccactgcagtctcagccgcactcaaggtatagaaccaccctgcttctgacatgcccacccggattcggcgctccgctctccccagtaccctag

SEQ ID NO: 26029 - DNA, 639 bp, Artificial Sequence
  Description of Artificial Sequence: Synthetic coding sequence
cctcctcccccgcccccagtgccgccccctcctaccggagcgacaccgcctcccccccctcctctccccgctgggggcgcacaagggagttcccatgatgagtcatccatgagtggtctcgccgctgctattgctggtgccaaactgcgaagagttcaaaggcccgaagatgctagcgggggttcctctccttctggcactagcaaatcggatgccaatcgagccagctccgggggtggcggtgggggcctgatggaagaaatgaataagctccttgcgaagaggcggaaggccgcctctcagtctgataagcctgcggaaaaaaaggaggacgaatcacaaatggaggacccttcaactagcccctcaccgggaaccagggcagcaagccagccgcctaactcatccgaggctggccggaaaccatgggaaaggtctaacagcgtcgaaaagccagtgagcagcattctgagtcgtatgaagcctgcgggatccgtcaatgatatggcgctcgacgcttttgatctcgaccggatgaaacaagaaatcctcgaagaggtcgtaagggaacttcacaaagtgaaagaagaaatcatcgacgctatccgtcaggagctgagcgggatcagcacgacgtag

SEQ ID NO: 26030 - DNA, 1617 bp, Artificial Sequence
  Description of Artificial Sequence: Synthetic coding sequence
atgggactgctcttgttggtcctgatcctaacccccagccttgccgcctatcggcaccctgactttccactgctggaaaaagcccagcagttgctgcagtctacaggtagtccctactccactaattgctggctgtgtacatcatcctcaacagagaccccagggacagcctaccctgcctcgccaagggagtggacttctatcgaggcagaactgcacatatcctaccgatgggacccaaaccttaaaggcttgatgcgacccgccaactctctgctgagcactgtgaagcaggacttccctgatattagacaaaaaccccccatcttcggaccaattttcaccaacatcaaccttatgggtatagcacctatttgtgtcatggccaagcggaagaatggcacaaatgtcggcacactgccatcaaccgtatgtaacgtcacttttacagtggactctaatcaacagacctaccaaacatatactcacaatcaatttcgacatcagccacggttccctaagccgccaaacattactttccctcagggcacgttacttgataagagcagcagattctgccaaggcagaccttcctcttgttcaacccggaatttctggttccggccagctgactacaatcagtgcctgcagatctctaacctgtcatccaccgccgaatgggtcctgctggatcagacgcgtaatagcctattttgggagaacaagacgaaaggggccaatcaaagtcagacaccgtgtgtccaagtccttgccggcatgactattgctaccagttacctgggcatttccgccgtgagcgaatttttcggcactagtcttacccccctattccacttccatatatcaacttgtctgaagacccagggcgctttttatatctgcggacaaagcatccaccagtgcctcccaagcaactggactgggacctgtacgatcggctatgtgacccccgatattttcatagcccccggcaatctgtcactccctatacccatctacggaaatagtccgctgccacgtgtgaggcgcgcaatacactttatacctcttttagccggcctcgggattttggccggaaccggaaccggaattgctggtatcactaaggcatcgctgacatattcccagctttctaaggaaattgctaacaatatcgatactatggcaaaagccctgacgaccatgcaagagcagatcgactcactggctgcagtcgtgctacagaatcggcgggggctggacatgctgacagcagcccagggcgggatatgcctcgccttagacgagaagtgttgcttttgggtgaatcagagcgggaaggtgcaagacaatatacgacagcttcttaaccaggcctccagtctcagagaacgagctacccagggctggttgaactgggaggggacttggaagtggttttcttgggtcctgcccctgacgggacccctggtttctctgttgttacttctccttttcggcccctgtcttctgaatttaattacccagttcgtgagttctcgactgcaggcaattaagctgcaaactaacctgtcagcgggacggcatcctaggaatatccaggagtcgcctttctag

SEQ ID NO: 26031 - DNA, 1617 bp, Artificial Sequence
  Description of Artificial Sequence: Synthetic coding sequence
atgggcctgctcctcctggttctcattttaactccctctttggctgcctatcgccatccagattttcctctgctagaaaaagcccaacagctgcttcagagcacaggcagtccttattccacaaactgttggctctgcacctcatcttctacagagacccccgggacggcttaccccgcgtcccctagggaatggacctctattgaggccgaattgcatatttcctatcggtgggatcccaacctaaagggtctgatgcgtcccgcgaactccctcctctctactgtgaaacaggacttccctgatattcggcagaaaccacccatttttggcccgatttttaccaatatcaatctgatgggtatagcccctatctgtgtcatggccaaaagaaagaacgggactaacgtgggaaccctgccatcaactgtgtgtaatgtcacctttacagtggatagcaatcagcagacttatcagacgtacactcataaccagtttaggcaccaaccaaggtttccaaagcccccaaacatcactttcccccagggcaccctcctggataaaagctcaagattctgccaagggagaccctcttcttgctctaccaggaacttctggttccgaccggctgattacaatcagtgtctgcaaattagtaacctgtcgtccacagccgaatgggtgctgctggatcagactagaaactcactcttttgggagaacaagactaagggggcgaaccaatctcaaaccccatgtgtgcaggtgctggcaggtatgaccatcgctacaagttacctgggcatttctgccgtgtctgaattttttggaacgtcgcttacacccctgttccattttcatatttctacatgtttgaagacgcagggtgctttctacatttgcggtcagtctattcatcagtgcttgccttcgaattggacaggcacatgtacgatcggctacgtcacacctgacatttttatcgctcccggaaacctttctctacccatcccaatttatggcaactcccctctgccccgggtgagacgtgccattcatttcatccccctgctggcaggcctgggcatcttagcagggactggaactggcattgctggcatcaccaaggcttctctcacctatagccaactgagtaaagaaatcgccaacaatattgatacaatggccaaagccctgacaaccatgcaggagcaaatcgactccctcgcggcagtagtgctacagaatcgccggggactcgacatgctgaccgccgcccaggggggcatctgcctggcccttgacgaaaaatgttgtttctgggtgaaccagtccggcaaggtacaggataatattcgccagttgctcaaccaagcctcaagcctgcgcgagcgagccacacaaggctggctgaattgggagggaacatggaaatggttttcatgggtgttgcctctgacgggccctcttgttagcttgttacttctcctgttgtttggtccgtgcctcttaaatctcattacgcaatttgtttctagtcgtctgcaagcaattaaactgcaaaccaatctgagcgccggtcggcatcccaggaacatccaggaatctccgttctag

SEQ ID NO: 26032 - DNA, 1617 bp, Artificial Sequence
  Description of Artificial Sequence: Synthetic coding sequence
atggcacttccctatcacatatttttgtttacggtcctgctcccaagtttcaccctgacagctcctcccccatgcagatgcatgacttcctcaagtccctatcaagagttcctgtggaggatgcagagaccagggaatattgatgctccttcttatcggagcctgtcaaaggggacacccacatttaccgcccacacccatatgccacgcaactgctaccacagcgccaccctttgcatgcacgctaacacacattattggaccggcaagatgatcaatccttcctgtcctggtggactgggcgtcactgtgtgctggacgtacttcacacagaccggcatgagtgatggcgggggagttcaagaccaggctagggaaaagcacgtgaaggaagtgatctcacaactgacgcgggtccatggcacttccagcccatacaagggcctcgacctgagtaaactgcacgagacactgcggacacacacccgcctggtcagcttattcaacaccactctgacggggcttcatgaagtttctgcgcagaatcccacgaactgttggatatgcttgcccctgaattttcgaccatatgtcagtatccctgtgcctgaacagtggaacaatttttcaaccgagattaatacaacatccgtattagttggtcccctagtgagcaacctggaaattacacatacttcaaatctgacttgcgtgaaattcagtaacaccacgtatactactaattctcaatgcatcaggtgggtaaccccaccaactcagatcgtatgtctaccatcaggcatcttctttgtgtgtggtacctcagcatatagatgtttaaatggttcgtctgagtctatgtgcttcttatctttcttggttccgcctatgaccatttatacagagcaggacttatactcatacgtgatcagcaagcctaggaacaaacgcgttccaatcttgcctttcgtgattggggcaggggtgctcggtgctctcgggaccggcatcggaggtattacaacttcgacacaattctattataagttgagccaagaacttaacggcgacatggagagggtggcggactcactggttacccttcaggaccagctcaattcccttgcggcggttgtgttgcagaataggcgcgcactggacctgttgaccgctgaaaggggtggtacctgcttgtttttgggggaggagtgctgctactacgtgaaccagtctggaattgtgacagaaaaggtcaaggagataagagaccggatccagcgtcgcgcagaggagctgagaaataccggaccgtggggtctgctgtctcagtggatgccgtggatcctgccttttctgggtccgttagctgccattatcctgctcctgctcttcggcccttgcatatttaacctcctcgtaaatttcgtgagcagtcggatcgaagcagtaaaactccagatggaaccaaagatgcagtcaaagacaaagatatacaggagaccgttggatagacccgcttccccccgctccgacgttaacgatatcaagggaacaccacccgaagagatatccgctgcacagccactgctcaggcctaacagcgcagggtctagttag

SEQ ID NO: 26033 - DNA, 1710 bp, Artificial Sequence
  Description of Artificial Sequence: Synthetic coding sequence
atgggatccactttaggatgtcacagaagtattcccagggacccctcagacctgtcccacagtcgaaagtttagtgccgcctgcaacttttcaaatatactggttaaccaggagcgcctgaatattaacacagcaaccgaggaggagctcatgaccctccccggcgtgactagagccgtggctcggagtattgtcgagtatcgcgagtacattggaggattcaagaaagtggaggacctcgccctagtctccggggtgggagctaccaagctggagcaagtcaaatttgagatttgcgtgagcagcaaaggcagtagcgctcaacacagtccttcaagccttcgccgcgacctcctggcagagcagcagcctcaccacctcgctaccgccgtgcctctgacaccgagggtgaacatcaataccgctacccctgctcagctgatgagtgtgcgggggctctccgaaaaaatggcactcagcattgtggatttcagacgtgagcatggcccttttcggtctgtggaggacctggtgcggatggatggtatcaacgccgctttccttgacagaattaggcaccaagtttttgccgaacggagtcggccaccttcgacacatactaacgggggcctgacctttacggctaaaccccatccttcccccacgtccctgtctttgcagtccgaggacttggacctgcccccaggcgggcctacccagattatctctacgaggccatcagtagaagccttcggtggtacacgggatggtcgcccagttctgcggctcgctacctggaatctgcagggttgctctgtggaaaaggccaataacccaggcgtgagagaggttgtgtgtatgacgctgcttgagaattccattaagctcctggccgtccaggagctgctcgacagggaagccttggagaaattttgcacagagttaaaccagcccaccctgcctaatatcaggaaatggaagggtcccagaggatgctggaaggcagtggtggctgagaagccctcttctcagctacagaaaggggctggttacgcaggtttcctttgggacgcggccgcggggatggaacttcgagatgccggatctcaggaatcctccccgtctaatggacatgggaagcttgccgggccaagcccttatcttggcagatttaaggtggggtcacacgacctcactttagtgaatctccacttagcagcccttacgctcctgggcagcgaaaacccctcaaagaatcatagcgacggccaccggctagcctctttcgcgcagacccttcaggaaactctcaagggagagaaagatgtcataatattgggtgacttcggacagggccccgacagtaatgactacgacattctgaggaaagagaaattccatcatctcatacctgcacacacctttaccaacatatctaccaaaaatccccagggctctaagtccttagacaatatatggatctccaaaagcctaaaaaaggtttttaccgggcactgggctgtggtgcgcgagggcttgaccaacccttggataccagacaactggtcttgggggggtgtggcctctgagcactgccccgtgttggcagagttttatacggaaaaagactggagcaagaaagatgctccccgaaacggcagcggcgtggccctcgagcgctctgaagccaacatcaagcacgaaagatag

SEQ ID NO: 26034 - DNA, 1710 bp, Artificial Sequence
  Description of Artificial Sequence: Synthetic coding sequence
atgggcagcacactgggctgtcaccggtccattccaagggacccgagtgacttaagccatagtcgcaagttttccgcggcatgtaacttctccaacatcttggtcaatcaggaacgtttaaacataaacacagcaaccgaggaagaactcatgacactcccaggcgtaaccagggctgtggcccgctctatcgtagagtaccgagagtacatcggaggtttcaagaaggttgaggacctggcactagtttcaggcgtgggtgccacaaagcttgagcaagtcaagtttgaaatctgcgtgtccagcaaagggagttccgcccagcactctccgtcgtctcttagacgcgacctgctggcagagcagcagccacaccacctcgccacagctgtgcctctgaccccgagggtgaatattaacaccgccacccccgctcagctcatgtctgtccggggtttgtcagagaagatggccctcagtatcgttgacttccgccgcgaacatggtccgtttcgaagcgtcgaagacctggtaagaatggacggcataaatgctgccttcctggacaggatccgccaccaggtctttgcagaacgctcccgccctcccagtacccacaccaatggaggacttactttcactgccaagccacatccaagtcccacctctctgagtcttcagtcagaagacctcgacctccctccagggggacctacacaaatcattagtacaagaccttccgtggaagcgttcggtggaacacgcgatgggaggccagtgttacggcttgccacctggaatctgcagggctgctccgtggagaaagccaataatcccggcgtgcgagaagtggtctgtatgacacttctggagaacagcattaaattgctggctgtacaggaattattggaccgcgaagcactagaaaaattttgcaccgaactgaatcagcccactctgccgaacatcaggaaatggaaaggcccaagaggctgctggaaagccgtggttgcagagaaaccatcctcccagttgcagaagggcgcagggtatgccggattcctttgggacgctgccgccgggatggagctgcgggatgccggatctcaggagtcaagtccgagtaatggtcacggcaagctggcaggcccttctccgtacctgggccggttcaaggtcggctcacacgacctgacactggtgaatctgcacttggccgcactcacacttctgggctccgaaaacccctctaagaatcattcagacggccaccgcctggcttccttcgcgcaaaccctccaggaaaccctgaagggagagaaagatgtgattattctgggcgacttcgggcaaggccccgattccaatgactatgacattctgagaaaggagaaatttcatcatctgatcccagcccatacattcacgaacattagcacaaagaacccccaaggctctaaatctctggacaatatttggatttcaaagtctctcaaaaaggtgttcaccgggcattgggcagtggtccgagaaggtctcaccaatccctggattcccgataattggagctggggaggggtggcttctgagcactgtcccgtgctggcggagttctatacagagaaagactggtctaagaaggacgctcctcgcaatgggagtggcgttgcacttgaaagaagcgaggctaatattaagcatgaacggtag

SEQ ID NO: 26035 - DNA, 822 bp, Artificial Sequence
  Description of Artificial Sequence: Synthetic coding sequence
atggaagccgctcctagcagattcatgtttttactcttcctgcttacgtgtgagttagccgcagaggtggcggcggaagttgaaaaatcttcagatggtcccggcgctgcacaggaacccacttggctgaccgacgttcccgccgccatggagttcatcgccgcaacggaagttgccgttattgggtttttccaggacctggagattcccgctgtgccgatcctgcacagcatggtacagaagtttccaggggtgtcatttgggatcagtaccgattcagaggtgctgacgcactacaatattaccggaaacaccatctgcctgttccgtttggtcgacaatgagcagctgaatctggaggatgaagacattgagtctatcgatgccacaaaactgtcaaggtttattgagataaattcactgcacatggtcactgagtataatccagtcaccgtcattggcttgtttaactccgtgatccagattcacctgcttttgataatgaataaggctagtccagagtatgaggaaaatatgcacaggtatcagaaagccgcaaagctatttcagggtaagatcttgttcatactcgtcgattccggcatgaaggaaaacgggaaggtgattagcttcttcaaattaaaggagagtcagcttcctgccctggctatctaccagactctggatgacgaatgggataccctgccaacagcagaggtgtctgtggagcatgtccaaaacttctgtgatggcttcttgagcgggaagcttttaaaagaaaacagagagtcagaaggaaaaactcccaaggtggagctgtag

SEQ ID NO: 26036 - DNA, 2934 bp, Artificial Sequence
  Description of Artificial Sequence: Synthetic coding sequence
atgcctgcgagacgcctgttgctcttacttactctgctgttgccaggacttgggatcttcggctctacatccactgtgacactgcccgaaactctcctgtttgtttctacacttgacgggagcctgcatgctgtttcaaaacggacaggcagcattaaatggactctgaaggaagatccggtgctgcaggtgccgacccacgtggaggagccagctttcctccccgatccaaatgacggaagcctctatacgctaggatcaaaaaataacgaaggacttacaaagttgccgttcaccattccggagctcgtgcaggctagcccttgccgctctagcgacgggattctatatatgggcaagaaacaggacatctggtatgtcatcgacttgttgacaggggaaaagcagcagacactgtcttcagcttttgccgactcgttgtgcccctcaaccagcctgctttatctggggaggacagagtacacgatcactatgtacgacacaaaaacacgggagctgcggtggaacgcaacatattttgactacgccgcgtctctacccgaagatgatgtcgattacaagatgagccattttgtctctaatggtgacggcctcgttgttaccgtggatagcgagtccggagatgtgttgtggatccagaactatgctagccctgtggttgccttttacgtgtggcaacgcgaaggcctcaggaaagtgatgcatattaatgtggcagttgagaccctccggtaccttacttttatgtccggcgaagtcggacgtataaccaagtggaaataccctttcccaaaagagaccgaagcaaagagtaagctgacacctacattgtacgtggggaaatactcaacctccctgtacgcctctcccagcatggtccatgaaggtgtcgccgtggttccacggggttccaccctgcctctgttggagggccctcagacagacggagtcacaatcggcgataaaggggaatgtgtaatcactccctccactgatgtcaaattcgatcccgggctaaaatcaaagaacaagttgaattatctgcgaaattactggcttttgataggccaccatgagaccccgctcagcgcctcgactaagatgctggagaggttccccaacaatcttcctaaacatagagagaatgtgatccccgccgactccgagaagaaatccttcgaggaggtcataaaccttgtagaccagacgtcggaaaatgcacccactactgtctcacgcgacgtggaagagaaaccagcccacgcccccgcccggccggaggcacccgtggatagcatgctgaaagacatggccacgatcatcctttctacgttcctcctcatcggctgggtcgccttcataatcacgtacccattatccatgcaccaacagcaacagctgcagcatcagcaattccagaaggagctggagaaaattcagcttctgcagcaacagcaacagcagctgcctttccatccccccggcgataccgctcaggacggagagctgctcgacacatcaggcccctacagtgaaagtagcggaacttcatcccctagtacctctccaagggctagcaaccacagcctttgctcaggcagtagtgcctctaaggcgggttcatcccctagtctggaacaggacgacggggacgaggaaactagtgtggtgatagttggaaagatctcgttctgccctaaggatgtgctggggcacggtgctgagggcacaatcgtgtatcgaggcatgttcgataatcgcgacgtggccgtgaaaagaatcctgccagaatgtttcagttttgccgatcgggaggtacagttgctacgggagagtgatgagcacccgaatgtaatcagatacttttgcaccgagaaggacagacagttccagtatatcgccatcgaactatgtgcagctaccttgcaggaatatgtggagcagaaagatttcgctcacctcggtctggaacccatcacccttctgcagcagactacaagcgggttggcacaccttcattctttaaatatcgtgcatcgggacctcaagccacacaatattcttatcagcatgcctaatgctcatggcaagataaaagctatgatctctgatttcgggctctgcaaaaaactggctgtaggaagacattccttctcacggcggtctggagtgcccgggacggaaggttggatcgctccagagatgctgtctgaagattgtaaggagaaccctacatatacagtggatatctttagcgcaggatgcgttttctattatgtgatctccgaaggcagtcacccttttggtaagtcactgcagaggcaggctaacatactactgggcgcctgtagtctagattgtctgcatcccgagaagcacgaagatgtgatcgcacgggagctgattgagaagatgattgctatggaccctcagaaacggccttctgcgaaacacgtcctgaagcacccctttttttggtccttggaaaaacaactgcaattcttccaggacgttagcgaccgaattgagaaggagtcactcgacggaccaattgtgaaacagctggagcgcggaggcagagccgtggtaaaaatggattggagggagaatataacggtgcctttacaaacggacctccgaaagtttcgcacatataagggcgggtcggttagagaccttctgagagctatgcggaataagaagcaccactaccgcgagttgccagcagaggtgcgtgagacactgggctcgctaccggacgactttgtgtgctactttacttcccgcttccctcacctgctggcccatacttatagagccatggaactatgtagtcatgagcggcttttccaaccatactattttcacgaacctccagagccccagcccccagtgacacccgacgcactgtag

SEQ ID NO: 26037 - DNA, 873 bp, Artificial Sequence
  Description of Artificial Sequence: Synthetic coding sequence
atgccctttgattttagacggttcgacatttacagaaaggtgcctaaggaccttactcagcctacatataccggagccattatcagcatctgttgctgtctctttattcttttcctgtttttgagcgagcttactggttttataactacggaagtcgtgaacgagctctatgtggacgatccagacaaggactccggcgggaagatcgacgtctccttgaatatctcgctcccaaacctgcactgtgagctggttggtttagacatccaagacgagatggggcgccatgaagtgggtcacattgacaatagcatgaaaattcccctgaacaacggcgcgggctgtcggttcgaaggccagtttagcattaacaaagttcccggcaattttcacgtctctactcacagtgctaccgctcaaccacagaaccccgacatgacacacgttatccacaagctttcgttcggcgacaccctgcaagtgcaaaatatccacggcgccttcaatgccctgggcggggccgataggctgacttcaaatcccctggcaagccatgattatatcttgaagatcgtgcccacggtctacgaagacaagtcaggcaagcagagatacagttatcagtatacggtggcgaataaagaatatgttgcatattctcacacagggcgaatcattcctgcgatctggtttcggtatgatcttagtccgattacagtgaaatacactgagcgacgccagccactgtatcgctttatcacaactatctgcgccatcatcggagggacattcacggtcgccgggatcttagactcatgtatatttaccgcgtcagaagcttggaaaaaaattcagctggggaaaatgcattag

SEQ ID NO: 26038 - DNA, 108 bp, Artificial Sequence
  Description of Artificial Sequence: Synthetic coding sequence
tgatgtagcacggcgaacggcgaaaaggactctattaccctcatttctatgaagaatattaatatgaataacggcaaacagtcactctctgccgaaaaggtgttgtag

SEQ ID NO: 26039 - DNA, 219 bp, Artificial Sequence
  Description of Artificial Sequence: Synthetic coding sequence
atgggcacagccggggctatgcagttgtgttgggtcattctgggctttctgttatttcgcgggcacaactctcagccaacaatgacccaaacgtcatctagtcaggggggtttgggcgggttaagtcttaccacggaacccgtgtcctccaaccccggatacataccgagttctgaagccaatagaccctctcacttgtcttcaacggggacgccctag

SEQ ID NO: 26040 - DNA, 768 bp, Artificial Sequence
  Description of Artificial Sequence: Synthetic coding sequence
atggctagccctggtgctggacgggcaccccccgagttacccgaacgaaactgtggctacagggaagtcgagtactgggaccagcggtaccaaggggctgcggattcggctccctacgactggttcggcgatttctcaagtttcagagcactgctggagccagagctgaggcccgaagatcggatcctggtcctgggatgcggcaatagcgccttgtcatatgaactttttctcggggggtttcccaacgtcacttccgtggactattcttccgtagtcgtggcagcaatgcaggcccggcacgcgcacgtcccacagctcagatgggagaccatggatgttcgcaagctcgatttccctagcgcttcatttgacgttgtgctcgaaaaggggaccctggatgctttactggcaggtgagagggatccctggaccgtgagcagcgagggcgtccataccgtcgaccaagtgcttagcgaagtctcaagggtgctcgtccccggtggccgattcattagtatgacgtcagcagctccacatttcaggacccgtcattatgcgcaagcctattatggctggtctcttagacatgctacctacggttctgggttccactttcatttgtacctaatgcacaaaggcggcaagctctccgtagcacagcttgcactgggagcacagattctgtcaccaccacggccgccaacttccccttgtttcctccaagacagcgaccatgaggacttcttatccgctattcagctgtag

SEQ ID NO: 26041 - DNA, 2211 bp, Artificial Sequence
  Description of Artificial Sequence: Synthetic coding sequence
atgaacgtggcactgcaagagctgggggcaggctccaacgtaggattccagaaaggtactagacaacttctaggatctagaacacagctcgagttggtgctggcaggagctagcttgctgttggcggcactcttactggggtgtctggtcgctttgggcgttcagtatcacagagatcccagccactcaacctgtttaacagaggcatgtattagggtggctggcaaaattctggaaagtctggaccggggggtgagtccctgcgaagacttctaccaattctcatgcgggggatggatacggagaaatccactgcccgatggtcgcagtaggtggaatacatttaactcactgtgggaccaaaatcaggccatcctgaaacatctgcttgagaacaccaccttcaattcttccagcgaagctgagcaaaagacccagcggttttatctgagctgccttcaggttgagaggatcgaagaattgggggcgcagcccctgagagacctgatagagaagattggaggatggaatatcactgggccttgggaccaggacaacttcatggaagtgctgaaggccgtggcaggcacatatcgggccaccccattttttacagtctacatctcagctgactctaagtctagtaactcaaacgttatacaggtggaccaatccggactttttctaccatctagggactattacctgaaccggactgctaatgaaaaagtgctgactgcctacctcgactacatggaggagctgggaatgctgttgggtggtagaccaaccagtactagggagcaaatgcaacaggtcctcgaactcgagattcagttggctaacataactgtaccccaggaccaaagaagagacgaggagaagatctaccataaaatgagtatctccgagctgcaagccttggccccaagtatggattggctagagtttctctccttcctgctgtcccctctagagttatctgactctgaacccgtggtggtttatgggatggattatcttcaacaggtgtccgaacttattaaccgtacagaaccttcaattctgaataactatctcatctggaacctcgtccagaaaacaaccagcagcctggatcggcgcttcgaaagtgcacaggagaagttgttggagaccctgtatgggacgaagaagtcctgtgtcccccggtggcagacttgcatatccaacaccgatgacgccctgggcttcgcgctcggcagcttattcgtgaaagcaacctttgatagacagtcgaaggaaatcgcagagggcatgatttccgagatccgcaccgcctttgaggaagctctagggcagcttgtctggatggacgagaagactaggcaagcggcaaaggagaaggctgacgcgatatatgacatgattggttttccagatttcatcctggagccaaaagagctggacgacgtgtacgatggttacgagattagcgaagatagtttcttccaaaatatgctgaacctttataacttcagcgctaaggtcatggccgatcagctgcgcaaaccacccagtagagaccagtggtctatgacccctcagacagtcaatgcttattacttaccgaccaagaacgagattgtgttccccgctgggatccttcaggcccccttctacgccaggaaccatccaaaggctttaaacttcgggggcattggcgttgtgatggggcacgagcttacacacgcattcgatgatcagggtagggagtatgacaaggagggaaacctacggccatggtggcagaacgaatccctggccgcttttcggaatcacactgcatgcatggaagaacagtacaaccagtaccaagttaacggtgaaaggcttaatggtcgtcagacacttggagaaaatattgccgataatggaggcctgaaggctgcatataacgcttacaaggcctggctcaggaaacatggcgaagagcagcagctgccagcagtaggcctaacaaatcatcagctgttctttgtggggttcgcacaggtgtggtgcagcgtgaggactcccgagagctcacacgagggcctggtgactgacccacactctccagccaggtttcgcgtgctgggcaccctgtcaaattcaagagactttttaagacatttcggctgccccgtggggtccccaatgaatccaggccagctatgcgaagtgtggtag

SEQ ID NO: 26042 - DNA, 2652 bp, Artificial Sequence
  Description of Artificial Sequence: Synthetic coding sequence
atggcttcaccgggcgcagggcgcgctccacccgaactgcctgagcggaattgtggctaccgcgaggtggaatattgggatcaacgataccaaggggccgcagattcagcaccctacgattggtttggtgatttctctagcttcagggcactgctggaacctgagctccgcccagaggataggatcctagtgctaggatgcggtaactctgctctgagttacgaactgttcctggggggcttccccaatgttacctcagtggactattcttcagtggtggttgcggccatgcaggcgcggcacgcccacgtcccacagctgcggtgggagactatggatgtcagaaaattggattttccttcagcatcttttgatgtcgtgctggaaaagggaaccctcgacgccctgctcgccggagagagagacccctggaccgtgagctcagagggagtccacactgtggatcaggttttatctgaggtgggtttccaaaaggggactagacaactgctcggttctagaactcaactcgagctagtcctggcaggcgccagcctcttactggcagccttgctgctgggctgcctcgtggccttgggagtgcagtatcatcgcgaccccagtcattccacatgcctgaccgaggcgtgtattagagtagcaggaaagattctggagagtcttgacagaggtgtttcaccatgcgaagacttctatcagttctcctgcggaggctggatcaggcggaatcctctgcccgatggaaggagcaggtggaacactttcaatagtctgtgggaccaaaaccaggcaatcctcaagcacctgctggaaaacaccaccttcaattcaagctcagaggcggagcagaagacgcaacgtttttacctatcctgcctacaggttgaaagaatcgaagagctgggggctcaaccattgagagacctaatcgaaaaaattggaggctggaacattacaggtccctgggatcaggataatttcatggaagtgctgaaggctgtcgcaggcacataccgcgccaccccgtttttcacagtatacattagcgctgacagcaagtccagtaacagcaacgtgatacaagtcgaccagtctgggttatttttgcctagccgggactactatctcaatcgtaccgctaacgaaaaagtcctcacagcatatttggactatatggaagagcttggtatgctgctgggaggacggccgactagcaccagggagcagatgcagcaggtgctggaactggaaattcagttggcaaatataacagtaccccaggatcagcggagggacgaagaaaaaatctaccacaagatgtccatatccgagctacaggcccttgctccctccatggactggctcgaattcctttcatttctgctgtcacctctcgaactttccgatagcgaacccgtggtcgtttacggcatggattacctccagcaggtttccgagttgatcaataggacagagccatccatactgaacaactatctcatatggaacctcgtccagaaaaccacttccagcctggaccgcaggtttgaatccgcacaggagaagttgctggaaacgctttacggcacaaaaaagtcatgtgtgcccaggtggcagacgtgcatttctaataccgacgacgcactcggctttgctctagggtcgctctttgtaaaggcgacattcgatagacagagtaaagagattgcagaaggaatgattagcgaaatccgcactgccttcgaggaagcgctaggtcaacttgtgtggatggatgaaaaaacccgccaggcagctaaggaaaaggccgacgctatctacgatatgatcggcttcccggattttattctggagcctaaggagctcgatgatgtgtacgacgggtatgagatctctgaggatagtttctttcaaaacatgctgaatttatacaattttagtgccaaggtgatggcggaccagttgaggaagcctccatctagagatcagtggtctatgaccccccagacagtgaatgcgtattacttgccaacaaagaatgagattgtatttcccgccgggattctgcaggcaccattttacgccaggaatcacccgaaggccctgaactttgggggaataggagtcgtgatgggtcacgaactgacacacgcgttcgacgatcaaggcagagaatatgataaagaagggaatcttcgtccctggtggcagaatgaatcactggcagcttttaggaaccatactgcttgcatggaagagcagtacaaccagtaccaggtgaacggtgagcggctcaatggacgacagactctgggagagaatatcgcagataatgggggacttaaagcggcctacaatgcctataaggcctggcttcgtaaacacggtgaggaacagcagttgccagccgtggggctgactaaccatcagctgttctttgtggggttcgctcaggtgtggtgcagcgtcaggacccctgaatcttctcatgaagggctggtgacagacccgcattcgcctgccagatttcgggtgctgggcacgttatccaacagccgggactttctccgacactttggatgcccggtgggtagtcctatgaatcctgggcagttatgtgaggtttggtag

SEQ ID NO: 26043 - DNA, 2298 bp, Artificial Sequence
  Description of Artificial Sequence: Synthetic coding sequence
atgaacgtggcattacaggaactgggagccggatccaacatggttgagtacaaacgggctaccctcagggacgaggacgcgcctgaaacacccgtagagggcggcgcctcgccagatgcgatggaggtgggcttccagaagggcacgaggcagttgctaggcagcagaacacaactggaactggtacttgcaggggcttcccttctccttgcggctctactgctcggctgcctcgtggcactgggagtccagtaccatagggaccctagccactccacctgccttaccgaagcctgcatccgcgtcgcaggaaaaattctggaaagtctcgacagaggggtgagcccttgcgaagacttttaccagttctcctgcggaggctggatccgacggaacccgctgcctgacggtcggtccagatggaacacttttaactcactttgggatcagaatcaggccatcttgaagcatctcctcgagaacaccaccttcaattcctcatccgaggcggaacagaaaacacagcggttctatctgagttgcctccaggtggaacggattgaggaactgggggcccagcctttgcgcgatctgattgaaaaaattggcggctggaacattaccggtccctgggatcaagataatttcatggaggtgctcaaggccgtcgcaggcacctatcgcgccacacctttctttaccgtgtatatcagcgctgatagcaagtccagcaattccaatgtgatacaagtggaccaaagtggcctctttcttcctagccgcgactactatctcaaccggacagccaacgaaaaggttctgactgcatatctggattacatggaggaacttggaatgctgctgggcggtagacctacttctacccgggaacaaatgcagcaggtattagaattggagatccaactcgcaaacatcaccgtgcctcaagaccagcggcgcgatgaggagaaaatataccacaagatgtcaatcagcgaactccaggccctggctcctagcatggattggcttgaattcctttcttttttgctatcacccttggagctatcagactcagaacctgtcgtcgtttatgggatggattatttgcaacaggtttctgagttgataaaccgcactgagccctcaattctgaacaactatttgatctggaatctcgtacaaaaaactacgagttccctggatcgccgttttgagtccgcccaggaaaagctgttagagacactatacgggacaaaaaagtcttgtgtgccgcgctggcagacctgtattagtaacactgacgacgcgctgggtttcgcactggggagtttgtttgtgaaagccaccttcgaccgacaatcaaaggagatcgccgagggaatgatttccgagatccgaactgcatttgaggaagcattgggccagttggtgtggatggacgaaaagacgaggcaggcggccaaagagaaagccgacgcaatttacgacatgattggttttcctgatttcatcctcgagccgaaggaacttgacgacgtgtatgacggatacgaaatctccgaagacagctttttccagaacatgttgaatctttacaacttcagcgccaaagtaatggcagaccagctgcggaagccaccctctagggaccaatggtcgatgacgccacagacagtaaatgcttactacctgcccaccaaaaacgaaattgtcttccctgccggaattttacaggcccccttttacgccaggaatcaccccaaggcacttaatttcggcgggataggcgtggtcatgggccatgaacttacacacgcatttgatgaccaaggaagagaatatgataaggaagggaatctgagaccatggtggcaaaacgagtccctggccgcattccgtaatcacaccgcttgcatggaagaacagtacaaccagtaccaagtcaatggtgagcgcctcaacggccgccagacattgggagaaaatatcgccgataatggtggtctgaaggctgcctacaacgcatataaggcttggcttagaaaacacggggaagaacagcaattacctgctgtaggtctgaccaatcaccaattattcttcgtagggttcgcacaggtttggtgcagcgtgagaaccccagaatcctcccacgaaggcctggtgactgatccacactcccctgcgcggtttcgagtcttaggtactctgagcaacagtagggactttctgagacacttcggctgtcccgtgggcagcccgatgaatcccgggcagctctgcgaagtgtggtag

SEQ ID NO: 26044 - DNA, 2436 bp, Artificial Sequence
  Description of Artificial Sequence: Synthetic coding sequence
atgaatgtggccctgcaggaactcggagccgggtcaaatatggtagaatataaacgcgcaactttaagagatgaggacgcacctgagactcctgtggaggggggagcaagtccggacgccatggaggttgggaagggagccagtcctttctctccaggcccgtctcccgggatgactcctggtacaccccgttctagcggcctgttttggcgtgtgacatgcccacatcttagaagtatctccggactgtgctctagaacaatggtcggctttcaaaaaggaacccggcaattgctcgggtctcgcacacagctggagctcgtgctggcaggcgcttctctcctgctggctgcactgttactgggctgtttagtcgcactcggtgttcagtatcatcgcgacccaagtcacagcacttgtttgacggaagcttgcattagagtagccggcaagatcttggagtcactagacagaggtgtctcaccttgcgaggatttttaccaattctcttgtggcgggtggatccgcagaaatccgctccccgatggccgaagtcgttggaacacattcaactcactgtgggaccagaaccaggccattcttaagcatctcttagagaatactacttttaattcatcctccgaggccgaacaaaagacacagagattctaccttagctgccttcaggtggagcgcattgaggaacttggagcccagccattaagagacctcatagaaaaaatcggtggctggaacattacaggcccgtgggaccaggacaatttcatggaggtccttaaagcagttgccggcacttacagggccacccctttctttacggtctacatctctgctgacagcaagtctagtaattctaatgttattcaagtcgatcaatccggcctgttcttgccgagtcgcgactactacctgaatcgcacggcaaatgaaaaggtactgaccgcttatctcgactacatggaagagctgggcatgttactgggagggcgacctacctcaaccagggaacaaatgcagcaggtgctggaactggaaatccagctggccaacattactgtgccccaggaccagaggcgggacgaggaaaaaatttatcataagatgagcatctccgagcttcaagctctagccccctcaatggattggctggaattcttgtccttcttgctgagccctctcgaactctctgacagcgagccggtggtggtgtatggcatggattatcttcagcaggtgtccgagttgattaaccggacagaaccatctatcctaaacaactaccttatctggaatctcgtgcagaaaacaacatcgtctctggatagaagattcgaatctgctcaggaaaaactgctagagacactctacggtaccaaaaagagctgcgtgccgaggtggcagacctgtattagcaacactgacgacgccttagggttcgcgttgggatctcttttcgtaaaagcgactttcgaccgacagagcaaggagatcgcagaaggaatgatctcagaaatcaggaccgctttcgaggaggccttgggccaacttgtgtggatggatgaaaaaactcggcaggctgccaaagaaaaagcagacgccatctacgacatgattggtttcccagacttcatactggaaccaaaagagcttgacgacgtgtacgacggatacgagatcagcgaggactccttcttccagaacatgctgaatctgtacaacttcagcgcaaaggtaatggccgatcaattaagaaaacccccaagtcgggaccagtggtcgatgacccctcagaccgtcaacgcctattacttgccaaccaaaaatgagatagtcttcccagccggtattttgcaggctccattctatgctcggaaccaccccaaggctttaaattttggtgggatcggagtggtgatgggccacgagctcacccacgcctttgacgaccagggtagagagtatgataaggagggaaacttacgaccctggtggcaaaacgagtcattggccgccttccgtaaccacactgcttgtatggaggagcagtataaccagtatcaggtgaatggtgaacgtttgaatggaaggcagaccctaggcgagaacatcgccgacaatggggggctaaaggctgcctataacgcttacaaagcctggctgcggaagcacggagaagagcagcagctgcctgctgtaggcctcaccaatcaccagctatttttcgtggggtttgcacaagtgtggtgctctgtccgtacccctgagagtagtcacgagggtttggtcactgacccccactcccccgctcgattcagagtccttgggacgcttagcaactcccgcgacttcctcagacatttcggctgccccgttggatcaccaatgaatcccggccagctttgtgaggtgtggtag

SEQ ID NO: 26045 - DNA, 786 bp, Artificial Sequence
  Description of Artificial Sequence: Synthetic coding sequence
atgttgagggttttgtgtctgctacggccgtggcggcctctgagggcccggggatgcgcctctgacggcgccgctggcggatccgagattcaggttcgggcactggcgggccccgaccaaggtattactgagattcttatgaaccggccctccgccagaaacgccctcgggaatgtctttgtctcagagcttctggagactctagcacagctcagggaggacaggcaagttagggtgttactcttccgctctggggtcaaaggcgtcttctgcgctggcgctgatctgaaggaacgcgaacagatgagcgaagcggaagtgggggtgtttgtccagaggcttcgtggactgatgaatgacattgcgtccagcgccgtcatgggcctcatcgagaccacgcgagggctgttacctggcgccggcggtacccagaggttgccccgctgcctcggtgtcgcgcttgccaaagagttgatcttcacagggcgacggctcagtgggaccgaagcccatgtgttgggcctcgtaaaccacgcagtagcacagaatgaagagggcgacgcagcctaccagagagccagagctctggcccaagaaattctcccccaggcacccattgccgtccgtcttgggaaggtggcaatcgaccgcggaacggaggtggacatcgccagcggcatggccattgagggcatgtgttatgcacagaatattcccaccagagaccgccttgagggaatggctgcatttcgcgagaagcggacacccaagtttgtagggaagtag

SEQ ID NO: 26046 - DNA, 879 bp, Artificial Sequence
  Description of Artificial Sequence: Synthetic coding sequence
atgttaagagttctttgcctgctgcgcccatggaggccattgagggctagggggtgcgcctccgatggggcggccggcggtagtgaaatccaggtccgtgcactcgcagggcctgaccagggcatcacagaaatacttatgaaccggccctccgcgcggaacgcattaggcaacgtgttcgtttcagaactcctggagacgctggcgcagcttcgggaggatcgacaagtgcgcgtgctgctgtttcgcagtggtgtcaagggagtgttttgcgccggggccgacctcaaggagagggaacaaatgagcgaagctgaggtgggtgtgtttgtgcaaagactcaggggcctgatgaacgacatcgccgccttccccgcccctacaatagccgctatggatgggttcgcactggggggcggcttagaactggccctggcctgcgaccttcgagtagctgccagctctgctgttatgggcctgatcgagaccactcgcggactactgcccggcgctggcggaacccagcgcctgcccagatgcctcggagtagctctggccaaggagttgattttcacaggaaggcggctcagtggcacagaggcacatgttctgggtctcgtcaatcatgccgtcgcccagaatgaagaaggcgacgcggcataccagagggcccgggctttggcacaagaaatcttgccccaggcacctatcgcagtccgccttggcaaggttgcgatcgaccgaggcacagaggttgatatcgcttccggcatggctatagaagggatgtgctatgcacaaaatatccctacacgggaccggttagagggaatggctgcttttagggagaagcgaacacccaagttcgttggcaagtag

SEQ ID NO: 26047 - DNA, 741 bp, Artificial Sequence
  Description of Artificial Sequence: Synthetic coding sequence
atgaacagaccgagcgccagaaatgcattggggaacgtttttgtatccgagttgctggagacgctcgcccaactgcgcgaggaccgacaggtaagagttctgctcttcagatccggagtgaagggcgtgttttgtgcgggggcagatttgaaagagcgggaacagatgtcggaggctgaggtaggcgtgttcgtgcagagactcagaggtctgatgaatgacattgcggcctttcccgccccaactatagccgccatggatggttttgctctgggaggaggcctagagctcgccctagcctgtgacctaagagtcgcggcctccagcgcagtgatgggcttgatcgaaacaacccgcggtctcctccctggggctggggggactcagagacttccccgctgcctgggggtggcgctagcgaaagaattgatatttactggccgtcgactgagtggcacagaagctcatgtcctgggtctcgtcaatcacgccgttgcacagaacgaggagggagatgccgcttatcagcgcgcacgggcccttgcacaggaaatactccctcaggctccaatcgctgtcagactcggcaaagttgccattgatagggggacagaagtggacattgcctccggaatggctatcgagggaatgtgttacgcacaaaatattcccactagagaccgcttagagggaatggccgccttcagagagaaaagaacccctaaattcgtcggaaagtag

SEQ ID NO: 26048 - DNA, 384 bp, Artificial Sequence
  Description of Artificial Sequence: Synthetic coding sequence
atgaaccgaccgtccgcccgaaacgctttgggtaacgtgttcgtttccgagttactcgagactctcgcacagctgcgcgaagacagacaggtgagggtcctgctgtttagatccggcgtgaagggcgtcttttgtgcgggggctgacttgaaggagcgcgaacagatgtccgaggccgaagtgggagttttcgtccagagattacgagggctgatgaatgacattgctgcattccctgcccctactattgccgccatggatggatttgctcttggcggagggcttgagctagccctagcttgcgatctgagggtcgcaggcactgggccaggtttgggcgccggcggcggggccagggaatctggggtttctgagactgggtag

SEQ ID NO: 26049 - DNA, 660 bp, Artificial Sequence
  Description of Artificial Sequence: Synthetic coding sequence
atgctgcgggtcctgtgtttgctccgtccatggcgacccctgcgagccaggggatgcgctagcgacggggctgctggcggtagcgagatccaggtacgtgccttggctggtccagaccaggggatcactgagattctgatgaataggccttccgcccgtaacgccctgggaaatgtgttcgtgagtgagcttttggaaaccttggcccaactgcgtgaggacaggcaggttcgagtcctgctgttccgatccggggtgaagggagtattttgcgctggcgcagacctgaaagagcgcgagcagatgtccgaagccgaggtcggcgtgtttgtacagagactcaggggcctgatgaatgatattgcttccagcgcggtgatgggattgatagaaacaaccagaggactccttcctggggctggcggaacacagcggctgccccgatgcctgggcgtggcacttgccaaagaactgatcttcaccggaaggagactgagtggtactgaggcgcatgtgctcgggctcgtgaatcacgccgtggctcagaacgaggagggagacgccgcctaccagcgagcgcgtgctctggcgcaggaaatccttcctcaggtcgatatcgcctctggcatggcgatcgagggtatgtgctacgcccagtag

SEQ ID NO: 26050 - DNA, 912 bp, Artificial Sequence
  Description of Artificial Sequence: Synthetic coding sequence
atggcagctgtggctgtcctacgcgctttcggcgcttccggacccatgtgcttgcgccggggcccatgggcacagctgccagccaggttctgtagtcgggatcccgccggcgctgggcgccgcgagtctgagcctcgaccaaccagcgcaaggcagctagatgggattcgcaacatagtcctgagcaatcccaaaaaacgaaatgccctctctctggccatgctgaagtccttgcagtccgatattttacatgacgccgactccaacgacctcaaagtgataatcatctccgctgagggacctgtcttcagttcagggcatgaccttaaggagctgaccgaggaacagggtcgagactatcacgcagaggtattccagacctgcagcaaagtcatgatgcatatccggaatcaccctgtccccgttattgccatggtaaatggtctcgccgcagccgccggttgtcagctggtcgcctcatgcgacatcgctgtggcctctgataagagttccttcgctactcccggcgtgaacgtaggactgttctgtagtaccccaggggttgccctggcccgcgcggtccctagaaaggtggccctcgagatgctcttcacaggagagccaatctccgctcaggaggcactcttgcacggactgctgagcaaggtcgtgccagaggctgagctacaagaagaaactatgaggattgcacgcaagatcgcctctctgtcccgtcccgtggtctctctggggaaagccacattctacaaacagttgccccaagaccttggaaccgcttattatctgaccagccaggccatggtcgataacctcgccctgagagatggtcaggagggcattacagcctttcttcagaaaaggaagcctgtgtggtcgcacgagcctgtatag

SEQ ID NO: 26051 - DNA, 726 bp, Artificial Sequence
  Description of Artificial Sequence: Synthetic coding sequence
atggcagcagttgcagttctgagagctttcggagcttctggcccaatgtgtcttaggcgaggtccctgggcccagctcccagccagattttgtagccgagacccagcgggtgccgggaggagggaatctgagccacggcccacctcggctcgtcagctcgatggcatcagatctgcccccgggcgagcaggttcatccagatggtgccgtgtgggagtgagagcgcccccactgacccggggggggccaggcgagcccgagccacgcctccgaccgtggggcggaaatagcccctgccctgggcccggcccaggtagcgaaacaaggcggaatattgtactttcaaatcccaaaaaaaggaacgccctgagccttgctatgctcaaaagcctgcagtctgatattttgcatgacgctgactctaacgatctcaaagtgatcattatttcagctgagggccccgtgtttagtagtggccatgatttgaaagaactgacagaggagcagggacgggattaccacgcagaagtttttcagacatgctcgaaggtgatgatgcacatcagaaatcacccggtcccggtgatcgcaatggttaacgggttagccgcagctgccggctgccagctcgttgcgtcatgtgacattgccgttgcttctgacaaatcttctttcgccaccccaggagtgaacgtggggctcttttgttcgacaccaggcgtttag

SEQ ID NO: 26052 - DNA, 501 bp, Artificial Sequence
  Description of Artificial Sequence: Synthetic coding sequence
atgctgaaaagcctccagtcggacatattgcacgacgctgatagcaacgacttgaaagtgattatcatctctgctgaagggcctgtattctcctcaggccacgatctgaaagagctgacagaggaacagggcagagactaccatgccgaggtcttccaaacctgtagtaaggttatgatgcatattagaaatcacccggtccccgtgattgcaatggtgaacgggctggccgcagcagccggctgccagttagtcgcaagttgtgacattgcagtggctagtgacaagagctctttcgccacacctggagttaatgtcgggctgttttgctcaacccccggcgtcgcacttgcaagagccgttcctcggaaagtggcccttgagatgctattcaccggggaaccaatttcggcacaggaggccctcctgcacggtctgctttcaaaggtagtccccgaagcggagctgcaggaggagaccatgcgcatcgcaaggaagtag

SEQ ID NO: 26053 - DNA, 909 bp, Artificial Sequence
  Description of Artificial Sequence: Synthetic coding sequence
atggctctcgttgcctctgtgcgggtgcccgctcgggtactgctgagagctggagctcgattacccggcgccgccctcggtcggacagaacgcgcagccggaggcggtgatggcgcgagacgctttggaagtcagagggtcctggttgagcctgacgcaggtgcaggggtggccgtcatgaagtttaaaaacccccccgttaatagcctttctttagagtttctgactgagctcgtcatcagtctggagaaactcgagaacgacaagtcctttagaggcgttattctgaccagtgatcggcctggcgtgttctccgctgggctggaccttactgagatgtgtggcaggagccccgcgcactatgcaggctactggaaggcggtccaggagctgtggctcaggctgtatcagtccaatcttgtgctcgtttccgcgattaacggcgcatgtcctgcaggaggctgtctcgttgcgctcacctgcgattaccggattttggctgacaatcctcggtattgtatcggcttgaatgaaacacaacttggaattattgcaccgttttggctgaaggatactctggaaaataccataggacatcgggctgctgagcgcgcgttacagttaggactgctgtttccgcccgccgaggccctgcaggtcggtattgttgaccaggtggtgccagaggagcaggtgcagtctacggctctaagcgccattgcccagtggatggccatcccggaccatgctaggcaattaaccaaagcaatgatgcggaaggctacggcttcccgcttagtgacccaacgcgatgcagacgtacagaacttcgtgagctttatttcaaaagattcaatacagaagagcctgcagatgtacctcgaaagactgaaggaggaaaagggctag

SEQ ID NO: 26054 - DNA, 858 bp, Artificial Sequence
  Description of Artificial Sequence: Synthetic coding sequence
atggctctcgtggccagcgtacgcgtcccagctcgtgtcttgctgcgtgcaggtgctcgtcttccaggagctgcacttggccggactgagcgcgccgctggtggcggcgatggcgctcggaggtttggctcccaaagagtgctggtcgagccggacgcaggcgctggcgttgcagtgatgaagttcaagaaccctccagtgaactcactctccctggaattcctaacggaacttgtgattagcttagaaaagttggaaaacgataaatcctttagaggcgtgattttgacctccgatagacctggcgtgtttagtgcagggcttgacctcacagagatgtgtggtagaagccctgcccactacgccggctactggaaagccgtccaggaactctggctgcgcctttaccagtccaatttggtgttagttagtgcgattaatggggcatgccccgctggaggatgtctcgtcgcactcacttgcgattatcggatcctggctgataacccacgattaaaggatacgctggagaatactatcggacaccgcgccgctgaacgtgccctccagctgggacttctcttcccgcccgccgaagctctacaggtgggtatagtggaccaggttgtcccggaagaacaggtgcaatccaccgccctctctgccatcgcccagtggatggctatccccgaccatgccaggcagctcacaaaggccatgatgcgcaaggcgactgctagccgcctcgtcactcagagggacgctgacgtacaaaactttgtatcgttcatcagtaaggatagtatccagaagtcactacaaatgtacctggagagattgaaagaagagaagggatag

SEQ ID NO: 26055 - DNA, 1095 bp, Artificial Sequence
  Description of Artificial Sequence: Synthetic coding sequence
atgaacagaaccgccatgcgtgccagccaaaaagatttcgagaacagcatgaaccaagttaagctgctcaagaaggaccccggtaacgaggttaagctgaaactttatgctctgtataagcaggcaacagagggtccatgcaacatgcctaaaccaggggtatttgacttaatcaacaaggcaaaatgggacgcatggaacgctctgggttcactccccaaggaggctgcacggcagaactatgtcgatctggtgagctccctgagcccctccttagaaagttcctcacaagttgaaccgggcactgatagaaagtcaacgggattcgagacactggtggtcacgtccgaagatgggattactaagattatgttcaaccgcccaaaaaagaagaacgccatcaacactgagatgtaccacgaaatcatgcgggcactgaaagcagcttccaaagacgattccatcatcacggtgctgactgggaacggtgattactatagtagcggcaatgacttgacaaatttcacagacatcccacccggcggggtggaagagaaagctaagaataacgctgtgcttctccgcgagtttgtgggctgttttatcgatttccctaagccactgatcgccgtggtaaatggaccagccgtgggaatttcagttacgctgttgggcctgtttgatgctgtctacgccagtgatcgcgcaacgttccatacacccttttcccatttaggacagtcaccagagggctgcagtagttataccttcccaaagatcatgagtcctgcaaaagcaactgaaatgctgatctttgggaagaaattgacagctggagaggcatgtgcacagggcctggtaacagaagttttcccggattcaacttttcagaaggaagtgtggactagactcaaagcattcgccaagctgccaccgaacgccctcaggatctcaaaggaagtcattaggaaaagggagcgggagaaattgcacgccgtaaacgctgaggagtgcaatgttctacaggggcggtggctcagcgatgagtgcaccaatgctgtggttaacttcctttccaggaagtcaaaactgtag

SEQ ID NO: 26056 - DNA, 1185 bp, Artificial Sequence
  Description of Artificial Sequence: Synthetic coding sequence
atggctatggcctatttagcttggaggcttgcccgacggtcttgtccttcctctttacaggtgacgtccttccccgtcgtgcagttgcatatgaatcgcacggctatgagagcttcacagaaggacttcgagaatagcatgaaccaggtgaagctcctcaagaaggatcccgggaacgaggtaaaactcaaactgtatgctctttataagcaggccaccgagggtccatgtaatatgcccaagcccggggtttttgatctgatcaacaaagcgaagtgggacgcgtggaatgccctcggcagcctaccgaaggaggctgctcggcagaactatgtggatctggttagctctctgtcgccttcactggagtcctcctcgcaggtggagcccggaacggatcggaaaagtacaggctttgaaacgctcgtcgtgactagtgaggatggcataacgaagataatgttcaatcggcccaaaaagaaaaacgcaattaacaccgagatgtatcacgagatcatgcgggctctgaaagcagcatccaaagatgatagtattattactgtcttaactggcaacggtgactactattcgagcggaaatgatctgacaaattttacagatatacctccaggcggcgttgaggagaaagccaagaacaatgcagtgctccttagggaatttgtcggttgtttcatcgacttccccaagccattgatcgcagtcgtgaacgggcctgccgtgggcattagcgtcacactgctggggctcttcgacgcggtctacgcgtctgatagggcaaccttccacacaccattctctcacttgggccagagccctgaaggatgcagtagttatacctttcccaaaattatgagccccgctaaagcaaccgaaatgcttatcttcggtaagaaacttaccgccggggaagcctgcgcccagggcctggtgactgaagtttttccggactcaacttttcaaaaggaggtatggaccaggctgaaagccttcgcaaagctcccacccaacgcgctgcgtatctcgaaagaggtgatcaggaagcgggaaagagagaaacttcacgcagtcaatgctgaggagtgtaatgtactgcaaggtcgttggttaagcgacgaatgtacaaacgcagtggtgaatttcttaagccggaagagcaaactctag

SEQ ID NO: 26057 - DNA, 1095 bp, Artificial Sequence
  Description of Artificial Sequence: Synthetic coding sequence
atgaatcgcaccgctatgcgggcttcccagaaagacttcgagaattctatgaatcaggtgaagctgttgaagaaggaccctggaaacgaggttaagctcaagctgtacgctctgtacaagcaggctaccgaaggtccctgtaacatgcccaaacctggggtgttcgatctaatcaataaagccaagtgggacgcttggaatgccctgggatcactccccaaggaggccgcccgacaaaattacgtggatcttgtgagcagcctaagcccaagcctcgaatcctcaagtcaggtagagccaggaacggaccggaagtccacgggattcgagaccctcgtagtcacatccgaagacggtatcacaaagatcatgttcaatcgccctaaaaaaaaaaatgccatcaacaccgaaatgtatcatgagatcatgcgggccctgaaggccgcctccaaagatgattcaatcatcactgttctgacagggaatggagactattattcatctggcaacgatttaacaaatttcactgatattcctcccggcggtgtggaggagaaggcaaagaacaatgccgtactgttgcgcgagtttgtgggctgtttcatagatttcccgaaacctctgattgcggtggtcaatggacccgcggtggggatcagtgtgactctcctggggctctttgacgccgtgtatgctagcgaccgagccactttccacacccctttctctcatctcggtcagtccccagaaggctgctcaagttacactttccccaagatcatgtctccagccaaggccactgagatgctcatctttggcaaaaaactgaccgcaggcgaggcctgcgctcagggactggtgacagaggtgttccccgatagtacttttcaaaaggaggtttggaccagacttaaagcgtttgccaagctccctcccaatgccttgcgtatctcaaaggaggttataagaaagcgcgagcgggagaagctgcacgcggtgaatgcagaggaatgtaacgtccttcagggtcggtggctctctgatgagtgtaccaatgccgtcgtgaatttcctttcccgcaagagcaaactctag

SEQ ID NO: 26058 - DNA, 684 bp, Artificial Sequence
  Description of Artificial Sequence: Synthetic coding sequence
atgtatcatgaaattatgcgagcactgaaggccgcttcaaaggatgactccatcattaccgttctgactggaaacggtgactattatagcagtgggaatgatttgaccaactttactgacattcctcccggtggcgtggaagaaaaagctaagaacaatgctgtgttactgcgggagttcgtgggttgcttcatcgacttcccgaagccactgattgccgtggtaaatggtcccgccgttgggatttcagtgactctcctgggtttgtttgatgccgtgtacgcatccgaccgggcaactttccacacaccattctcccacctcggtcagtcccctgagggctgcagcagttatactttcccaaaaattatgtctcctgccaaggccaccgaaatgctgattttcggaaaaaagctgactgccggggaagcctgcgcgcaggggttggtcaccgaagtattccccgattccaccttccagaaagaagtgtggacacggctgaaggcattcgcgaagctcccccccaacgccctccgcattagtaaagaggtgattagaaaaagggaacgagaaaagctccacgccgttaatgcagaggaatgcaacgtgctccagggaaggtggctatccgacgagtgcacaaacgcggttgtgaattttctctccagaaaatctaaactctag

SEQ ID NO: 26059 - DNA, 1095 bp, Artificial Sequence
  Description of Artificial Sequence: Synthetic coding sequence
atgaatagaacagccatgcgtgcttctcaaaaggattttgagaactctatgaatcaggtcaagctgcttaagaaggaccccggaaatgaggtcaagcttaaactatatgcgctctacaagcaggctaccgaaggtccgtgcaatatgccaaagccgggagtcttcgacctgataaataaagcaaaatgggacgcctggaatgcactaggatccctcccaaaagaagcggcccgccaaaattacgtagatttggtgtcgtctctctccccgagtttagagtcatccagccaggtggaaccaggtaccgatcgaaagtctaccggattcgagacacttgtcgtcacctctgaggatgggatcacaaagatcatgtttaataggcccaaaaaaaaaaatgcaatcaatacggagatgtaccacgagatcatgagagcgcttaaggcagcgtctaaggatgatagcattatcacggtcctgacgggaaacggcgactactattcgagtggaaatgacctcactaattttaccgatattccccccggcggggttgaggagaaggcaaaaaacaacgcagtgctactgcgcgagttcgttggctgttttatcgattttccaaagcccctgattgccgtggtgaatgggcctgccgtgggcatatcagttaccctgcttggactctttgacgccgtgtatgcgtccgatcgggccaccttccatactccgttttctcatctggggcagagccccgaggggtgttcttcctatactttcccaaaaataatgtcaccggcaaaagctacagagatgctcatctttggaaagaagctgactgccggcgaggcgtgcgctcagggcttagtcaccgaggtgttccctgactctacctttcaaaaggaggtgtggaccagactaaaggcatttgcgaaactgcctcctaacgcccttcgcatttccaaggaggtgatcaggaaacgcgagcgggaaaaacttcacgctgttaacgccgaggaatgtaacgtcctgcaggggcgctggcttagcgatgagtgcacaaacgccgtcgtcaacttcctgagccggaagagtaagctctag

SEQ ID NO: 26060 - DNA, 2961 bp, Artificial Sequence
  Description of Artificial Sequence: Synthetic coding sequence
atggcaggcattttctacttcgcactcttctcctgtctcttcggcatctgcgacgccgtgaccggatctcgggtgtatccagcaaacgaagttactttgctcgattccaggtcagtacagggggaactcggatggattgcaagcccgttagagggcggatgggaggaggtcagcatcatggacgagaagaataccccaatccgcacctaccaggtttgtaacgtaatggagccctcccagaacaactggctgagaacagactggattacacgggagggagcccagcgggtatatattgagattaaatttactctgcgagattgcaacagcctgccgggggtcatgggtacatgcaaagaaaccttcaacctctattactacgagtcagataacgataaggaacgcttcattagggagaatcagtttgttaagattgatacgattgccgccgacgaatcattcacccaagtggacatcggcgataggatcatgaagcttaacactgagataagggatgtgggaccccttagcaaaaaggggttttacttggcattccaggacgtgggtgcttgtatcgccctagtaagcgtacgggttttctataagaagtgtcctctgaccgtgcgtaatcttgcacagtttccggataccataaccggagcagatactagctccctcgtggaggtcagggggagttgtgtcaataatagcgaagaaaaggacgttcccaaaatgtactgcggtgcagacggggagtggttagtgcctatcggcaattgtctgtgtaacgctggacacgaggaacgttccggtgagtgtcaggcctgcaagattgggtattacaaagctctcagcacggacgctacctgcgccaaatgccccccccactcctactctgtgtgggagggggctaccagctgtacatgtgatcgcgggttcttccgagctgacaatgacgctgcaagcatgccatgcacccgacctccctctgccccccttaacctgatcagcaacgttaatgaaacgagcgtgaatctcgaatggtcatcccctcagaacactggggggagacaggacatctcttataacgtggtgtgcaaaaagtgcggagccggggatccgtctaagtgcaggccctgtggttctggcgttcactacactccacagcagaacgggctgaaaaccaccaaggtgtcaatcacagacttgctagcacatactaattataccttcgagatttgggcagtaaacggagtctccaaatacaatccaaacccagatcagtctgtttcagtcaccgtgaccactaaccaggctgccccaagctctattgcactggtccaagcaaaggaagtgacaaggtatagcgtggccctggcctggcttgagccagacaggcctaatggtgttatactggaatatgaagttaagtactacgagaaagatcagaatgagcggagctaccgaattgtgaggaccgcagcccgcaacacagacatcaaggggctgaatccgcttactagctacgtgtttcatgtccgagctcggaccgcagctggttacggggacttctccgaacccctggaggtaactaccaatacggtgccgtccaggatcataggtgatggtgcaaactcaactgtgctgttagtgtcagtgagcggcagtgtagtgctggtggtgattctaatcgccgctttcgtgattagtaggcgacgttcaaaatactctaaagctaaacaggaggcagacgaggaaaagcatctaaaccagggtgtgcggacttatgtcgatccattcacttacgaagatcccaatcaggcagtgcgggagttcgcgaaagagattgacgcctcttgcattaagatcgagaaagtgatcggcgtgggggagtttggagaagtctgctctggcaggttgaaagtccccggtaagcgggagatctgtgtggcaatcaaaactttgaaagccggatacaccgataagcaacgccgcgacttcctgagcgaggcttcaattatgggccagtttgaccatcccaatattattcaccttgaaggtgtggttaccaagtgcaagcccgtgatgatcatcacagagtacatggagaacggaagtttagacgcttttctgagaaagaacgatggcagattcaccgtgatccagctggttggcatgttgcgcggaatagggagcggaatgaagtacttgagcgatatgtcctatgtacatcgtgacctggctgcccgaaacatcctcgtgaacagcaatttggtgtgtaaggtgtcagacttcggcatgagccgggtgctcgaggacgaccctgaggccgcttatacaacccgaggcggcaagattcccattcggtggacggcgcctgaggcaatagcataccgtaagtttacctcggcttcagacgtctggagctacggcattgtcatgtgggaggtgatgtcttacggcgagcgcccctattgggacatgtccaatcaggatgtcattaaagctatagaggaaggctacaggcttccaccccctatggactgtccaatcgccttgcaccagttaatgttagactgctggcaaaaagaacgatctgaccgcccgaagttcggtcagattgtgaatatgctcgataaactgattagaaacccaaattccttgaagcggaccgggaccgagtccagtaggcctaacaccgccctgctggatccttcatcaccagagttttcagcggttgtgagcgtcggagattggctacaggcgattaaaatggaccggtataaggacaacttcaccgctgcaggatataccacgctggaggcagtagtgcatgtaaaccaagaagacctggcccggatcggcatcacagctattactcaccagaataagattttatccagcgtgcaagcaatgaggacacagatgcagcagatgcacggacggatggtgcccgtgtag

SEQ ID NO: 26061 - DNA, 2808 bp, Artificial Sequence
  Description of Artificial Sequence: Synthetic coding sequence
atgaagtgggaagaggtctccatcatggatgagaaaaatactccaatccgtacctatcaggtgtgcaatgtcatggaaccatcgcagaacaactggttgaggaccgattggattaccagggaaggtgcccaaagagtgtacatcgaaatcaaattcaccctgcgagactgcaattccctaccgggcgtcatgggcacgtgtaaggagacattcaacctgtactactacgagtctgacaatgacaaggaacgattcatccgcgagaatcagttcgtgaagatcgatactatcgctgctgacgagagcttcacgcaggtcgatattggcgataggatcatgaaactgaatacagaaatacgggatgtgggaccactgtctaagaagggattttatttagcattccaggacgtgggcgcctgcattgcccttgttagcgttcgggtgttctataaaaagtgcccactcacagtaagaaatctagcccagttccctgacacaatcactggcgccgacacttcgtctctcgtagaagtcagaggctcgtgcgtgaacaattccgaggagaaagacgtcccaaagatgtattgtggcgcagacggtgaatggctggtcccgatcggtaactgtctttgcaacgctggccacgaagaaaggagtggtgagtgccaggcgtgcaaaattggttactacaaagccctgtccactgatgctacatgcgccaaatgcccaccacatagttactctgtgtgggaaggcgcgacctcctgcacatgtgaccgaggctttttccgtgcggacaacgacgccgcatctatgccctgtaccaggcctccctcagccccgctgaatctgatcagtaatgtgaatgaaactagcgtcaaccttgagtggtctagcccgcagaatacaggcgggaggcaggacatttcatacaacgttgtgtgtaagaagtgtggcgcaggtgatccttcaaaatgtagaccctgcggctctggcgttcactatactccacagcagaatgggcttaagacaactaaggtgtcaataacagatttactggcccatactaactacacctttgagatctgggctgtgaacggtgtcagtaaatacaatcctaacccagaccaaagcgtttctgtaacagtgactacgaaccaggcagcaccttcatccattgcactggtacaagcgaaagaagtaactcgttactctgtggctctggcttggctggagccggatcgaccaaacggcgtaattctcgagtatgaggttaagtactatgagaaagaccagaatgagaggtcatatcgcattgtgcgaactgccgcccgcaatacagatattaagggtctgaacccattgaccagctatgtctttcacgtccgcgcccgcaccgccgcaggatatggtgatttctcagaacctctcgaagtgaccaccaacacggttccatccaggatcatcggcgatggagccaacagcacagtattgctggtctctgtgagtggctccgtcgtcctggtagtaatactgatagccgcctttgtgattagccgtaggagatccaagtacagtaaagccaaacaggaggctgatgaggaaaaacacctgaatcagggagtgcggacatacgtggacccgtttacctacgaagatccgaaccaggcagtgcgtgagtttgctaaagagatagacgcctcgtgcattaagatcgagaaagtgataggagtgggggaatttggcgaggtctgttccgggcggctcaaggtccccgggaaaagggagatctgtgttgctattaaaaccttgaaggcagggtacaccgacaaacaaagacgcgattttctgagtgaggcaagcataatgggtcagtttgatcatcccaatatcattcacctggagggagtggtcacgaagtgcaagcccgtcatgatcatcaccgagtacatggaaaacggaagtctggacgccttccttcggaaaaacgacggtagattcactgttattcagttggtaggtatgctgcggggtattgggtccggtatgaaatacctctcagacatgtcttacgtccatagggatctggccgccaggaatatcctcgtgaactccaaccttgtgtgcaaggtatcagattttggcatgtcacgcgtgcttgaggacgaccccgaagcagcctatactactagagggggcaagataccaatacggtggaccgctccagaggctattgcataccgcaagttcaccagtgccagcgacgtgtggagctacggcatcgtaatgtgggaggtgatgtcttatggagagagaccttactgggacatgtctaaccaggatgtcatcaaggctattgaggagggatataggttacccccccctatggattgccctattgcactgcaccagctgatgctcgactgttggcagaaagaacgctccgataggccaaaattcgggcagatcgtaaatatgttagacaaactgattcgaaatcctaacagcctgaagcgcactggcaccgaatcaagtagacctaatactgcactactggacccttcttcccctgaattctctgccgtggttagcgtgggcgactggctgcaagccattaagatggaccggtacaaagataattttacggctgccgggtatacaacgttagaggctgtggttcatgttaatcaagaggacctggcccgtattggaataaccgccattacgcaccaaaacaaaatcttgagtagcgtccaagcgatgcgtacacagatgcagcagatgcatggccgaatggtgcctgtatag

SEQ ID NO: 26062 - DNA, 2850 bp, Artificial Sequence
  Description of Artificial Sequence: Synthetic coding sequence
atggccggcatcttttattttgccctgttcagctgcctgttcgggatttgtgatgcagtgaccggctcaagggtgtaccctgcaaacgaggtcaccctcctggattcccgtagcgtgcagggagaattgggatggatcgcctcccctttggaagggggttgggaagaggtgagcatcatggacgagaaaaatacgcctattcggacgtaccaggtttgcaacgttatggagcccagtcagaacaactggctgcgaaccgattggatcaccagggaaggtgcccagcgggtctacatagagatcaaatttactctgagggattgcaattctttaccaggcgttatgggcacctgcaaagagaccttcaacctgtattattacgaatctgacaatgataaggaacgcttcatccgagagaaccagtttgtcaagatcgataccattgccgctgacgagtcctttactcaggtggatatcggcgaccgaatcatgaagttgaatacagagatcagagatgtgggccctttgtccaagaaggggttctacctggcattccaggacgttggggcctgcattgccctggtgtctgttcgagtattttataagaagtgtcctctgaccgtccggaatcttgcccaatttccagataccatcacaggagccgacactagcagcctggtagaagtccggggctcgtgcgttaacaattctgaagaaaaagacgtcccaaagatgtattgcggagctgatggggaatggctggtacctattggaaactgtttgtgtaacgccggccacgaagagcggagcggcgagtgccaggcctgtaagattggttactataaggccctgtccacagatgcgacctgcgcaaaatgtcccccacactcatactcagtctgggagggggcaaccagttgtacctgcgaccgcggattctttagagccgacaatgacgcagcctccatgccttgtacacggcctccctcagcaccccttaatctaatctctaacgtcaacgaaacctccgtgaatcttgaatggtcctctccacagaatacaggcggacggcaggacatcagttacaacgtggtttgtaagaaatgtggagccggagacccatccaaatgcagaccatgcggatctggtgtccattataccccccagcaaaatggactcaaaaccaccaaagtgagtattaccgaccttctagctcacaccaactacacgttcgaaatctgggctgttaatggagttagcaaatataacccaaatcccgaccagtctgtcagtgtgactgtaaccaccaatcaagccgcaccatcatccatcgctctggtccaagcgaaggaggtcacaagatacagcgtcgccctagcctggctggagcctgacagaccaaatggggtgatcctggaatatgaggtcaaatactacgaaaaggaccaaaacgaacgatcataccgtattgtgagaaccgccgcccggaacaccgacattaagggcctaaaccccctcactagttatgtgtttcacgtgagggctcgcacggctgctggatacggagacttttccgagccccttgaggtcaccacgaacacagtgccctcaaggatcatcggcgacggagccaacagcacagttctcctagtaagtgtgtctgggagcgtggtcttggtagtgatccttattgccgctttcgtcatttcccgccgcaggtccaagtactctaaggcaaagcaggaggccgacgaagaaaaacacctgaatcaaggagttcgcacctatgtggatccatttacctacgaagatcccaatcaggccgtaagggaattcgccaaagaaattgacgccagttgtatcaagatcgaaaaggtgattggtgttggagagtttggggaagtttgctccggacgtctcaaggtgccaggtaaacgagaaatttgtgttgccatcaagactctgaaagccggatacaccgataaacagcggagggacttcctgtctgaggcaagcataatgggccaatttgatcatccaaacattatccacttggaaggcgtcgttacgaagtgtaaaccagttatgataatcacagagtatatggagaatggaagcctcgacgctttcctgcgaaagaacgacggcagattcaccgtgatccagctagttggtatgctccgcggaatcggttctggcatgaaatatctgtcggatatgtcctatgtccatcgggatctggcagccagaaacatactggtaaacagcaacttggtttgcaaagttagtgattttggcatgtctagggtgctggaggatgacccagaggctgcttacactacaagaggcgggaaaataccaattaggtggacagctccggaggccatcgcttaccgtaagttcaccagcgccagtgatgtctggtcctatggaattgtcatgtgggaggtgatgagttatggggaaaggccctattgggacatgagcaatcaagacgtgatcaaagctattgaagagggctaccggttgcctccccctatggactgtcccatcgccctgcatcaactcatgctggactgctggcagaaggagagatccgataggccgaagttcggtcagatagtcaacatgctggacaaacttatacgcaaccctaacagcctgaagcggaccggtacagaaagcagcaggccaaacacagcactcctcgacccatcctctcccgaattttccgctgtagtgtccgtcggggattggctgcaggcaatcaagatggaccgttacaaggacaactttaccgccgccggttatacaaccctagaagccgttgtccatgtcaatcaagagtag

SEQ ID NO: 26063 - DNA, 2961 bp, Artificial Sequence
  Description of Artificial Sequence: Synthetic coding sequence
atggccggaattttctacttcgccctgtttagctgtctgttcggcatttgcgacgctgtcaccggttcacgagtttatccagcaaacgaagtgacgttactggattcaagatcagtccagggcgaactgggatggatcgcctctccactggagggaggatgggaggaagtgtccattatggatgagaaaaacaccccaatcaggacgtatcaggtctgtaatgtcatggagccctctcagaacaactggctccgaaccgactggatcacccgggagggcgcccagcgcgtgtatatcgagataaagttcacccttcgcgactgcaattccctgcccggcgtgatgggaacctgcaaggaaacgtttaacctgtattattatgagagcgacaatgataaggagagatttataagggaaaatcagttcgtaaaaatcgatacgatagctgccgacgagagcttcactcaagtggacatcggcgaccggatcatgaagctgaacactgaaatccgcgacgtaggtccactaagtaaaaaaggtttctacttggcttttcaggacgtgggggcgtgcatcgccctcgtttccgtacgcgtcttctacaaaaaatgcccactgacagtccgaaatctcgcccagttccccgacaccatcaccggagccgacaccagttctctggtcgaggtacggggctcatgtgttaataactctgaagagaaggacgtcccaaagatgtactgcggggctgatggcgagtggcttgtgcctattggaaactgtctgtgcaatgccggccacgaggaacgttcgggcgagtgccaagcgtgtaagattggctattataaagctctcagcaccgatgcgacctgcgccaagtgccccccacattcctattcggtctgggagggcgctacctcctgcacgtgcgatcgggggtttttcagggcagataatgacgcagcctctatgccatgcaccaggcccccatctgctcccctgaacttaatctccaacgtaaacgaaacctcagtcaacctggaatggtcaagcccacagaatactggcggtaggcaggatatctcttacaacgtagtttgtaaaaaatgcggggccggggacccctctaaatgtaggccatgcggttcaggtgtgcactacactccacagcagaacgggttgaagacaaccaaggtgtctatcaccgatttgttagcacatacaaactacacatttgaaatctgggcagtaaacggagtgagcaagtataatcctaatcccgaccaatccgtatccgtaaccgtgaccacaaatcaagccgctcctagcagtattgcgttggtgcaagcaaaggaggttacccggtatagtgtggctctagcttggctcgagcccgatcgcccaaatggcgtaattcttgagtatgaagtaaaatattacgagaaggatcagaacgagcgcagctacagaatcgttcgaacggcggccaggaataccgatatcaagggccttaaccccctcacatcttatgtgttccatgtgcgcgcgaggaccgcggcagggtacggtgattttagcgaacccctggaagtgactactaataccgtgccatcccgcataattggcgacggtgccaactccacagtgctgttagtgagtgtgtctggttccgtggtcttggtggtgatccttatagccgcttttgtcatcagcaggagacgcagtaaatactctaaggcaaaacaggaagctgacgaagagaaacacctgaaccagggtgttcgaacatacgtggatcctttcacatacgaagatccaaaccaggccgtcagggagttcgctaaggagatcgatgcctcttgcattaagattgagaaagtgatcggtgtgggagaatttggggaggtatgttccggcaggctcaaggtccctgggaagagggagatttgcgtagcaatcaaaaccttaaaggccggttatacagacaagcagaggagggacttcctgagcgaagcctccatcatgggccagtttgatcatcctaatataatccatctggaaggtgtggtcacaaagtgtaagccagtaatgattatcacagagtatatggaaaatggttcactggacgcctttctcagaaaaaacgatgggcggttcacagtgatccagcttgtgggcatgttgaggggtattgggtcgggaatgaaatacctgtccgacatgtcctacgtgcaccgggacctggccgccaggaatattcttgtgaacagtaacttggtgtgtaaggtttccgacttcggaatgtcaagggtcctcgaggatgacccagaggccgcatacacaacacgaggaggcaaaatcccaatcagatggacggccccagaagccatagcttatcgtaagtttacgagcgcgagcgacgtgtggtcctatggcatcgtcatgtgggaggttatgagttatggggaaaggccatactgggacatgtcaaaccaggatgttattaaggccatcgaggaggggtatcggttgccaccacctatggactgcccaatcgctcttcaccagctgatgctcgactgctggcagaaggagagatctgataggccaaaattcggccagatagttaatatgcttgataagttaattaggaatccaaacagccttaagcgcaccggaacagagtcaagtcgcccaaacacagccctgctcgaccctagttctcccgagttttccgccgtggttagcgtgggtgactggctgcaagctatcaaaatggatcgctataaagacaactttactgctgcaggttacaccacccttgaagccgtggtccacgttaatcaggaagatcttgctagaattggcataacagcaatcacccatcagaataagattctttcttcggtgcaggcaatgaggacccagatgcagcagatgcacgggcgaatggtgccggtgtag

SEQ ID NO: 26064 - DNA, 276 bp, Artificial Sequence
  Description of Artificial Sequence: Synthetic coding sequence
atggcaggcatattttacttcgcgctattttcctgtctattcggcatatgtgacgccgtgacaggctcgagagtgtaccctgcaaatgaagtgacactgctggatagtagatcagtccaaggcgaactcggatggattgcctcaccacttgaaggagggtgggaggaagtttcaatcatggacgaaaaaaacaccccaatccgaacctaccaggtctgcaatgttatggagccgtcccagaacaactggctcaggacagactggataacccggtag

SEQ ID NO: 26065 - DNA, 450 bp, Artificial Sequence
  Description of Artificial Sequence: Synthetic coding sequence
atggccgggattttctactttgccttgttttcatgtctctttggcatttgcgatgctgtcactggctcacgcgtgtacccagctaacgaagtgacattgctggatagtcgttcagtccagggcgaactcggctggattgcgtcccctctggaaggggggtgggaggaagtctcaattatggacgagaagaatacccccattcgcacgtaccaagtctgtaatgtgatggaacccagccagaataattggctgagaactgactggatcaccagagagggcgcccagcgagtttatatcgagatcaaattcacattgagggactgcaattcactgccgggggtgatgggaacctgtaaggaaacatttaatttatactattacgaatcagacaatgacaaagaaaggtttatccgagagaaccaattcgtgaaaatagataccatcgcttag

SEQ ID NO: 26066 - DNA, 840 bp, Artificial Sequence
  Description of Artificial Sequence: Synthetic coding sequence
atggtattccagaccagatacccttcttggattatcctttgctatatctggctgctgagattcgcacatacgggagaggcacaggctgccaaggaagtcctgctactcgacagcaaggcccagcagaccgaattagagtggatttcttctccacctaacggctgggaggagatctccggccttgacgaaaactatactccaattcggacttatcaagtgtgtcaggtaatggagccgaatcagaataactggttgcggacaaactggatctcgaagggtaacgcccaaagaatttttgtggagctgaaattcacacttagagattgtaactccctccctggagttctcggtacgtgcaaagagacctttaacctttattattatgagactgattatgacacaggcagaaatattcgggaaaacctctatgtcaaaatagatactatcgcagcggatgaatcattcactcagggcgacctgggggagagaaaaatgaagttaaacacagaggtgcgagagatagggcctctaagcaagaagggattctacctggcctttcaagacgttggagcctgcattgctctggtttctgtgaaagtctattataagaagtgctggtcaattatcgaaaatctggccatttttccggacacagttaccggatccgagttttcgtctctcgtggaggtaaggggcacctgcgtatccagcgccgaggaggaggccgagaacgcccctagaatgcattgttccgcggagggcgagtggctagtcccaatcggcaaatgcatatgcaaggccggctaccaacagaagggggacacctgcgagcgcaaatag

SEQ ID NO: 26067 - DNA, 2997 bp, Artificial Sequence
  Description of Artificial Sequence: Synthetic coding sequence
atggtgtttcagactcggtacccaagctggattattctgtgttatatctggctgttgagattcgcccatactggcgaggcccaagctgccaaggaagtcctgttgctggatagcaaagcccagcagaccgagctagaatggatctccagtcccccaaatggctgggaagagatttccgggttggatgaaaattacaccccaatcagaacctaccaggtatgtcaggtcatggaacccaaccagaataattggctgaggaccaactggatcagtaagggcaacgcgcagcgtatattcgtggaactgaaattcaccttgagagattgcaattcgttacccggcgttctgggtacatgtaaggagactttcaatctgtactattatgagaccgattatgataccggccggaatattcgggaaaacctgtatgtcaaaatagatactatcgccgcagacgagtccttcacgcaaggagatctcggcgaaagaaagatgaagttgaacacagaggtccgcgagatcggacctctgtccaaaaagggcttctatcttgctttccaggacgtaggagcttgcatcgccctggtttcggtgaaggtgtattacaaaaaatgctggtcgattatcgagaacctagctatcttccctgataccgtgactggctcggagttttcctctttggtagaggtgcggggcacatgtgtctctagtgctgaggaagaggcagagaacgcaccgcggatgcactgcagcgctgagggggagtggctggtaccgataggcaaatgcatctgcaaagctggataccagcagaagggggatacttgtgagccttgcggcagaggcttctacaaatcttctagccaggacctccagtgttcgagatgccccacccatagtttcagcgacaaggaggggagctcacggtgcgagtgcgaggatggctattacagggccccgtccgaccctccctacgtagcatgcacacggccaccatcagcacctcaaaatctgatctttaacataaatcaaactaccgtcagcttggaatggtctccacccgcggataatgggggaaggaacgacgtcacatatcggatcctctgcaaaagatgtagttgggaacaaggcgagtgcgtaccatgcggcagcaatattggctacatgcctcagcagaccgggctcgaggataactatgttactgttatggatctccttgcccacgccaactatacctttgaagttgaggctgtgaacggcgtgagcgacttgtctcggtctcagcgcctgttcgcagccgtgagcatcaccacaggccaggctgctccttcgcaggtctctggcgtgatgaaagagcgtgtacttcagcgctcagtcgaactgtcttggcaggaacccgagcacccgaacggagtgattaccgagtatgagatcaagtactacgaaaaggatcaacgggagcgtacgtactctacagtgaagactaaaagcacatccgcctccattaataacttgaagccaggtaccgtgtacgtttttcagatccgagccttcactgcagccggttatggtaactattcacctcgcctggatgtagcaactctggaagaggccacgggtaaaatgtttgaggccacagccgtgagcagcgagcaaaatcccgtgattatcattgctgtggttgcagtcgctggtacaatcatcctggtgttcatggtgttcgggtttattatcggaaggaggcactgcggatatagcaaggccgatcaggaaggtgatgaggagctgtactttcacttcaagttcccagggactaaaacttacatcgatcctgagacctacgaagatccgaatcgggccgtccaccagtttgccaaagaactcgacgcctcatgcattaagatcgaacgtgtgataggggcaggcgagttcggagaggtgtgttctggccgattgaagctcccaggaaagcgggatgttgccgtggccatcaaaacacttaaagtcggctacaccgaaaaacagagacgcgacttcctctgcgaggcctcgatcatgggtcagtttgaccacccaaatgttgtacatttggagggtgtggtgactcgcggaaagccagtcatgattgtgattgaattcatggaaaacggcgcactggatgcttttttgagaaagcatgacgggcagttcaccgtcatccagctggtggggatgttacgcgggatagcagcgggaatgagatatctcgccgacatgggatatgtgcaccgtgacctcgctgcgcggaacatactcgtgaatagtaacctcgtctgcaaagtgtcagactttgggttgtctagagtgatagaggacgacccagaagcagtatacacaacaacaggtggcaagattccagtccgttggaccgcccccgaagccatacagtacaggaagtttacaagtgctagcgacgtgtggagctatggtatcgtgatgtgggaggtgatgtcttacggagagaggccttactgggatatgtccaatcaagacgtcatcaaggcgatcgaggaggggtacaggctgcccgctcctatggactgtcctgcaggactccatcaactgatgctcgactgctggcagaaagaacgggctgagcgacccaagttcgagcagattgtcgggatcctggataagatgatcagaaatccaaattcactgaaaacacccctcgggacgtgcagccgaccaatcagtccactactggaccagaacactcctgatttcaccacgttctgcagcgtgggggaatggttgcaggccatcaaaatggaaaggtataaagacaacttcacagcagctgggtacaactctttggagagcgttgcacgaatgacaattgaggacgttatgagtctgggaattactctggttggccaccagaagaaaatcatgagctccatccagacaatgcgggcccagatgctacatctccacggaactgggatccaagtctag

SEQ ID NO: 26068 - DNA, 687 bp, Artificial Sequence
  Description of Artificial Sequence: Synthetic coding sequence
atgcttcatgtggagatgcttactttagtttttcttgtgctctggatgtgtgtgttcagccaggaccccggctctaaggctgtggccgatcggtacgctgtctactggaatagtagtaaccccagattccaaaggggcgactaccacattgatgtttgcatcaatgactatctcgacgtgttctgcccccactacgaagactccgtccccgaagacaaaactgagcgctacgtgctgtatatggtgaactttgacggctattccgcatgcgatcatacgtcaaagggatttaagcgttgggagtgcaacaggccacactcccctaacggtccactcaaattttctgaaaagtttcaactcttcaccccattcagcctcggttttgaatttcgccctggtagggagtatttttacatctcgtcagcaatacccgataatgggcgcaggtcctgtctcaagcttaaagtatttgtgcgtccaactaattcatgtatgaaaacaatcggtgtccatgatcgagtgtttgatgttaacgacaaggttgagaacagtctggaaccagctgacgatactgtgcacgaaagtgccgagccgtcccggggagagaacgctgcacagaccccaaggataccgagccgactcctggctatcctgctgttcctgctggcaatgctgcttaccttgtag

SEQ ID NO: 26069 - DNA, 2595 bp, Artificial Sequence
  Description of Artificial Sequence: Synthetic coding sequence
atggccgccccacttatccccttgtctcagcagattcctacagggaactctctgtatgaatcttactacaagcaggtcgaccctgcttatacgggccgtgtcggagcctctgaggctgccctgttcctgaagaaatctggcttgtctgacatcatcctgggcaagatctgggacctcgcggatcccgagggaaaggggtttcttgacaagcaggggttttatgtcgcactgcgtctagtcgcatgcgcccagtccggacacgaggttacactaagcaacttgaacctgagtatgcctccccccaaatttcatgatacttcaagtcccctgatggtaacgccaccctctgcagaagcccactgggccgtgcgggtggaggaaaaagctaagtttgacggaatattcgagtccctgttacccatcaacggcctgctgtcgggtgataaagtcaagcctgtccttatgaatagtaaactgcccttagatgttctgggtcgtgtctgggatctatcagatatagacaaagacggccacctggacagagacgagttcgctgtggcaatgcacctggtttaccgggccctcgagaaggagccggtcccctccgccttacctccctcgctcattcctccatcgaagagaaaaaagactgttttcccaggggcggtgcctgtgctgcccgctagccccccccccaaggacagcttacgcagtaccccctcacacggctctgtctccagcctgaattccacaggtagtctcagccctaagcattcgctcaaacagacccagccgactgtaaactgggtcgtacccgtggcagataaaatgcgattcgacgaaatctttctgaagactgatctggacttggatggatatgtatcaggccaggaagttaaggaaatatttatgcactccggactgacacaaaacttattggcccacatttgggctctcgcggacacgagacagactggcaagctgtcgaaagaccagttcgctctcgccatgtacttcattcagcagaaggtgagtaagggcatcgatccgccacaagtgctgagtcctgatatggtcccaccttccgaacgaggtacccctggaccagattccagcggctccctgggctcgggcgagtttacaggtgtcaaggaactggacgatatcagccaagaaatagcacagttacagcgcgaaaaatactctctcgagcaggacattcgcgaaaaagaagaagctattcgccaaaaaacaagcgaagtccaggaactgcagaacgaccttgatagagaaacatcatccctccaggagctggaggcccagaaacaggacgctcaggaccgtctcgatgaaatggaccagcaaaaagccaaacttcgcgatatgctctcagacgttagacagaagtgtcaagatgagacccagatgatctcatcccttaagactcagattcagtcgcaggaatctgacctcaagagtcaggaagacgacctgaatcgcgccaaaagcgagctgaataggcttcagcaggaggaaacacagcttgagcagtctatccaggccggcagagtccagctcgagaccatcatcaaatccctcaagagcacacaggacgagatcaaccaggctcgttctaaactcagtcaactgcacgagagtcggcaggaagcccataggtctcttgagcaatatgaccaagtcctcgacggggcacacggcgcgagtcttaccgacttagccaacctgtctgagggagtttcactggccgagcgtgggagcttcggagcgatggatgacccattcaagaataaagccctcctgtttagcaacaacacccaggaattgcatcctgatccattccaaacagaggacccattcaagtcggacccgttcaaaggagccgaccctttcaaaggggatcctttccaaaatgacccatttgcagagcagcagactacttccaccgaccccttcggtggcgaccccttcaaagaatctgacccatttagaggatccgctacagacgatttttttaaaaaacagacaaagaatgacccctttacaagcgaccccttcaccaagaatccgtctcttccgagtaaactggacccctttgagtcatctgacccattcagctcctcctctgtgagcagtaaagggtccgacccgttcggcaccctagaccctttcggctccggcagtttcaatagcgccgaagggttcgccgatttttcccaaatgagtaagccgccgccctcaggcccgtttacaagttctttgggtggggctggattcagtgatgatccttttaaaagcaaacaggacaccccagccctaccgccaaagaaacccgctccaccccgtccaaaacctccctccggcaagagtacaccagtgagtcaactcggctccgcagactttcctgaagctccagatccttttcagcccctgggggcagacagcggggacccctttcagtctaagaagggctttggagatcccttttccgggaaggacccctttgttccgtcatcagcagccaagccatccaaagccagtgctagcggatttgcggattttacgtcagtgtcttag

SEQ ID NO: 26070 - DNA, 2733 bp, Artificial Sequence
  Description of Artificial Sequence: Synthetic coding sequence
atggcagccccactaataccactgtctcaacagatcccaactggcaattctctgtatgagtcctactacaaacaggttgaccctgcctacaccggtagagttggggccagtgaagccgccctgttcctgaaaaagagcggcctttctgacattatattggggaagatttgggacctcgctgaccctgaagggaagggattccttgacaagcagggcttctatgtggcactccggctggttgcgtgtgcacagagtggccacgaggtgaccctgtccaacctgaacctgtccatgccacctcccaagttccacgacaccagttctcctctgatggtgactcctccctcagctgaagcacactgggccgtgagagtggaagaaaaggccaaatttgatggaatcttcgaatctttactgccgatcaatgggttgctctcaggcgacaaagttaagcctgtactgatgaattcaaaactccctctggatgtgcttggccgcgtgtgggatctaagtgatattgataaggacgggcacctggaccgcgacgaattcgccgttgccatgcacctggtgtaccgggcgcttgaaaaggagccagtgccatcagcgctccctccaagcttaatccccccaagcaaacggaaaaagacagtattcccaggcgccgtaccagtgctgcccgccagcccaccacccaaggatagcctaaggtccaccccttcacatgggagcgttagttcacttaactcgaccgggagtttgtcccctaagcatagcctgaaacagacccagccaacggttaattgggttgttcctgtggccgataaaatgagattcgacgaaattttccttaaaaccgatttggacctggatggttacgtcagcggccaagaagtaaaagaaatatttatgcattccggcctaactcagaacctcctcgcacacatatgggctctggcagatactcgccagaccggtaagctgagcaaagatcagtttgcactcgccatgtattttattcagcagaaggtgtcaaaggggattgatcctcctcaggtcctctcaccggatatggtccccccatcagagcgggggacacctggccccgacagcagcggtagcttgggcagtggagagtttacgggagtgaaggagctggatgacatcagccaggagatcgcccagcttcagagggaaaagtactccctcgaacaggacatccgcgagaaggaagaggctatacgacagaaaacaagcgaggtccaggaactgcagaacgacctggacagagagacctcctcccttcaggagttggaggctcagaagcaggatgcacaggacagattggacgaaatggaccaacagaaggctaagctcagggatatgctgtcggacgtccggcagaaatgtcaggacgaaacacagatgataagtagtttgaaaacgcagatccagtcccaggagtccgatttgaagtcccaggaggacgaccttaatcgagccaagtctgagctgaatagacttcagcaggaggagacacaactggaacagtcgattcaggctggacgggtgcaattagaaacaatcattaagagcctcaagtctacccaggacgagatcaaccaggcccggtctaagctaagccagcttcatgagtcgcgccaggaggctcacagatctctcgagcagtacgatcaggtcctggatggcgcccatggggcttcgttgacagacctggcaaacctgtcggagggagtctccctggcagagcgtggctctttcggagctatggatgacccatttaaaaataaagcattgctgttctccaataacacgcaggaactgcatcccgatccattccagactgaagaccccttcaagtccgaccccttcaaaggcgcagatccctttaagggtgatccattccagaatgaccctttcgctgaacagcaaacgacaagcacagatcccttcggaggtgacccctttaaggagagcgatccattcagaggcagcgcgaccgacgattttttcaagaagcagaccaaaaatgacccattcacaagcgatccattcacaaagaatccttctctgccatctaaactggatcccttcgagagctcagacccgttttccagttctagcgtgagctccaaggggagcgatccattcggtactcttgatccatttggctcaggctcattcaattctgctgaaggattcgcagacttctcacagatgtcaaagccgccaccatctggacccttcacatcttccctgggcggcgcaggattttccgatgatccattcaagtctaaacaggatacccccgccctcccccctaaaaagcccgcacccccacgcccaaagcccccgagcggaaaatcaactcccgtgtcccaacttggcagtgcggacttcccagaagcccctgaccccttccaacctcttggcgccgacagtggggacccatttcagagcaagaagggattcggggaccccttttctgggaaagaccctttcgtgccttccagtgcagctaaaccaagtaaggcttccgctagcggttttgccgacttcacatccttcggaaacgaggaacagcagctggcgtgggcaaagcgagagagcgagaaggcagagcaggaacgactcgcgcggctgagaagacaggagcaagaggacctggagctggccatcgcgctgtccaaggcagacatgcctgctgcatag

SEQ ID NO: 26071 - DNA, 2265 bp, Artificial Sequence
  Description of Artificial Sequence: Synthetic coding sequence
atggccgctcccctcattcccctctctcagcagattccaactggaaattcgctgtatgaatcctattataagcaggtggatcccgcgtacacgggcagagtcggcgcctctgaggccgccttgtttttgaaaaagagtgggctgtcagacatcatcctcggcaagatttgggacctggcagatccggaaggcaagggtttcctggacaagcaaggcttctatgtggctctgagattggtagcttgtgctcagagcggccatgaggtaacactgtccaatctgaatctgtccatgcccccacctaagttccacgatacgtccagtccgctcatggtgacgccacctagcgccgaagcgcattgggccgttcgcgtggaagagaaagcgaagttcgatgggatctttgaaagtttgctcccgattaacggactactgagcggcgataaagtgaagcccgttcttatgaatagcaaacttccacttgatgtgttgggcagggtctgggatctctcagacattgacaaagatggccatctggaccgagacgaatttgctgtggctatgcatttggtgtatagagcactggaaaaagagcccgtgcctagtgctctccccccatctttgatccccccctctaaacggaaaaagaccgtcttccccggcgccgtgcctgtcctacccgccagtccaccgccaaaggacagcctgcggtccactccctcccacggttccgtctccagtttgaactctactggaagcctgagtcctaagcactctctaaagcagacacagcccacagtgaactgggtagttcccgtggcagacaagatgcgatttgatgaaattttccttaagacagacctcgacctagatggctacgtctccggacaagaggtgaaggagatttttatgcactctggactgactcagaacctcctggcccatatatgggctctggcagacacccgccagactgggaaattaagcaaagatcagtttgccttggctatgtactttattcaacagaaggtctctaaaggaattgatcctccacaggttctgtcacctgacatggtgccccctagcgaacggggcacccctgggccagactcttcaggtagcctgggctccggtgagtttaccggggtgaaggagttggatgacatcagccaagaaattgctcagctgcagcgggaaaaatacagcttagaacaggacatcagagagaaagaggaggccattagacaaaagacctctgaggtgcaagagttacaaaatgacctcgatcgcgagacatcttcactgcaggaacttgaagctcaaaaacaggacgcacaagacaggctggacgagatggatcagcaaaaagccaagcttcgcgacatgctttcagacgtaagacagaagtgtcaagacgagacccagatgattagcagtttaaagactcagattcagtcccaggagtccgacttaaaatcacaggaggacgatcttaaccgagctaaaagtgaactcaaccgtctgcaacaggaggagacccaactcgagcagagcatccaggccggccgggtgcagctcgagaccattatcaaatcactgaaatccacccaggatgagattaatcaggcacggtctaaactgtctcaattacacgaatcccgccaggaggcccataggagcctcgagcaatacgaccaggtgctggacggggctcacggagctagcttgactgatctagccaacctgtccgagggagtcagcttagccgagagggggtcatttggcgccatggacgatccatttaaaaataaagctttgctctttagcaacaacacccaagagctgcaccccgaccctttccaaacagaggacccctttaagagcgaccccttcaagggcgctgacccttttaaaggcgatccctttcagaatgaccctttcgcagagcaacagacaaccagtaccgatccatttggaggcgatccattcaaggagtctgaccccttccggggaagtgccactgacgacttttttaagaaacaaaccaaaaatgacccatttacatctgatccattcactaagaatccatcgctgccgagtaagctggatcccttcgagtcaagcgatcccttcagctcttctagcgtgagctccaaaggctctgacccgtttggcacgttggatcccttcggttctgggtccttcaacagcgcagaaggttttgcagatttcagccagatgtccaaggtgaaggtgcatctatag

SEQ ID NO: 26072 - DNA, 1806 bp, Artificial Sequence
  Description of Artificial Sequence: Synthetic coding sequence
atggcggccccgctcattcccctgtcccagcaaatcccaacaggcaattccctctatgagagttattacaagcaggttgacccagcgtataccggcagggttggagcctctgaagctgctctgttcctgaagaaaagcggactcagtgacatcattctgggaaagatctgggatttggctgatcctgagggcaaaggcttcttggataagcagggattttacgtagcccttcggctggtggcctgcgcacaatccggtcatgaagtgaccctgtcaaacctcaacctgagcatgccaccccccaagtttcacgacaccagtagccctctcatggtgacacccccctccgcggaagcccattgggccgtcagggtggaggaaaaggctaagttcgacgggatctttgagtccctcttacccataaatgggctgctgtccggcgacaaggtgaaaccagtgttgatgaattctaagctcccactcgatgtactggggagagtgtgggacctcagcgatatagataaggacggccacctggatcgcgatgagttcgccgtggccatgcacctcgtctaccgtgcgctagagaaagagcccgtcccctccgccctgccaccatcactcataccaccctccaagcgtaaaaagacggtgtttccgggcgcagtgccagtactcccagctagcccacctcctaaggatagtttacggtcgaccccctctcacggaagtgtctcttccctgaacagtaccggctccctctccccgaagcacagcctgaagcaaacacaacctaccgtcaactgggtcgttccggtcgccgacaagatgcggtttgatgagatcttcctgaaaactgatttagatctggatggctacgtcagcggacaggaggtcaaagaaattttcatgcactcaggcctgacgcagaaccttttggctcatatctgggccctcgccgacactcggcagaccggcaaactttctaaagatcagttcgccctcgccatgtatttcatccaacagaaagtatccaagggcatcgacccaccacaggttctgtcccctgatatggtgccccctagcgagcgaggcacgcccggcccagattctagcgggtccctcggaagcggagaattcacaggtgtcaaggagttagacgacatctcacaggaaatcgcccagctccagagggaaaagtatagcctcgagcaggatattcgtgaaaaggaagaagccattagacaaaaaacctctgaagtgcaagaacttcagaacgacctcgacagggaaacgagttcactccaagaactggaggcgcagaaacaggatgcccaggatcgattggacgagatggaccagcagaaagccaagttgcgcgatatgctctcagatgtgcggcagaagtgtcaggatgaaacccaaatgatcagcagcctgaagactcagatccagtcgcaagaatccgatttaaaatctcaggaagacgatttgaaccgggccaaatctgagctgaaccggctgcagcaagaggagacacagctggagcaatcgatccaagcaggacgtgtacagttggaaacaattatcaaatctttgaaaagcacccaggacgagattaaccaagccagatctaagctctcccagctacatgagagcaggcaagaagctcaccgatctctagaacagtatgatcaggttctggatggagcccacggagcaagtctgacagatcttgctaatctgagcgagggagtgtccttagccgaaaggggtagttttggagcgatggttaaggtggaatag

SEQ ID NO: 26073 - DNA, 1824 bp, Artificial Sequence
  Description of Artificial Sequence: Synthetic coding sequence
atgtggatgacaccaaaacgctcgaaaatggaggttgacgaggcactggtcttccgccccgagtggacccagcgatacctagtggttgagccacccgagggagacggagctttgtgcctggtttgccgacgcttgatagtggcgacacgagaaagggatgtgagaaggcactatgaagccgaacacgagtattatgagcgctatgttgctgacggcgaacgggctgccctggttgaaaggctgagacagggagatctccccgtagcctcctttactccggaagagagggctgcgagggccgggttggggctgtgccggctgctggctctgaaaggtcggggctggggcgaaggcgattttgtgtatcagtgcatggaagtgcttctgcgagaagtcctgcccgagcacgtctctgtgctccagggtgttgacctgtcccccgatatcactcggcagcgcatcctgtcaattgataggaatctccggaaccaactgtttaacagagcacgggatttcaaggcctactctctcgcactggacgaccaggcgttcgtggcatacgagaactacctgctggtgttcattagaggcgtcgggccggagttggaagtccaggaggacctgcttacgattatcaacctaacccaccattttagcgttggcgccctgatgtcggccatactggaatccttacaaacagcaggactctctctccaaaggatggtcggacttacaacaacgcacacactgcggatgatcggtgagaattcaggattagtgtcctacatgcgtgaaaaagccgttagccccaactgttggaatgtgattcactactccggtttcctccacctggaacttttgagctcttacgatgtcgatgtgaatcagattattaataccatcagtgagtggattgttctgataaagacacgcggagtccgccgccccgaatttcaaaccctgcttaccgagtccgagagtgagcacggggaaagagtcaacggccgctgcctgaataattggctgcggcgcggaaagactttaaaactcattttttccctcagaaaggagatggaggccttcctggtcagtgtgggggccaccactgtgcatttcagtgataagcaatggctatgtgattttggcttcctggtcgacatcatggagcacttgcgcgagctcagcgaagaactgagggtgagcaaggtgttcgccgcagccgcttttgatcatatttgcactttcgaggtcaaattaaatctctttcagcgccatatagaggagaaaaaccttaccgattttcccgctctgcgcgaagtcgtagacgagcttaaacaacaaaataaggaggacgaaaaaattttcgaccccgaccgatatcagatggttatttgcagactgcagaaggagttcgaaaggcactttaaagacctccgcttcatcaagaaggacctggaattgttttctaatccattcaatttcaaacccgagtacgcacctatttctgtgagagtggagctgacaaagcttcaagcaaacactaacttgtggaatgagtatagaataaaggatttggggcagttctacgccggcttatctgccgagtcatatcccatcatcaaaggcgttgcgtgtaaggtggcgtccttatttgactctaaccagatttgcgaaaaggccttctcctatttaacacgaaaccaacatacgctttctcaaccgttaaccgatgagcacttacaggctctcttccgggttgcgacgacggagatggagccaggttgggatgacctggtccgggaacggaatgaatctaacccctag

SEQ ID NO: 26074 - DNA, 1089 bp, Artificial Sequence
  Description of Artificial Sequence: Synthetic coding sequence
atggctcgtctgcgggactgcttaccacggctgatgctgaccctgagaagcctcttgttctggtccctggtctattgttactgtggtttatgcgcttccattcatcttttgaagcttttgtggtcacttggtaaggggccagcgcagaccttccggaggcctgcccgtgagcaccctccagcgtgccttagcgatccctccctgggcacacactgctatgtgcggattaaagattccggcctgaggtttcattacgttgcagcaggcgagcggggcaaaccattaatgttgttgttgcacggatttccagaattctggtactcgtggcgctaccagctgcgagaatttaagtccgagtatagagtcgtggcattggaccttagaggctatggggaaacagacgccccaattcaccgtcaaaactacaaactggattgtcttatcacggacattaaagatatcctggactctttgggatattctaagtgtgtccttataggacacgactggggtggcatgattgcctggctgattgccatctgttaccccgaaatggttatgaagctgatagttatcaacttcccacatccaaacgtcttcaccgagtacatccttagacaccccgcccagttactcaagagctcttactattatttctttcaaattccctggttccccgagtttatgttctctatcaacgatttcaaggtgctcaaacatctgttcacgagccactctactggcatagggcgcaaaggctgtcagttaacaaccgaagacctcgaagcttatatatacgttttttcacagcccggggcattatcagggccaataaatcactaccgaaacattttctcatgtcttccactcaagcaccatatggtcactacccccactttactcctttggggggaaaacgacgcatttatggaggtggaaatggccgaggtcaccaaaatttatgtaaagaactactttcgcctcaccatcctgtccgaggctagccactggctccagcaggaccagccagacatagtgaataaattgatatggactttcttaaaagaggagacaagaaaaaaagattag

SEQ ID NO: 26075 - DNA, 1974 bp, Artificial Sequence
  Description of Artificial Sequence: Synthetic coding sequence
atgcagtggcgggccttggtgctaggactggtcctgctgcgcctgggccttcacggtgttctttggcttgtgtttggcctggggccaagcatgggcttctaccagcgattccccctgagttttggatttcagcgcctgaggagtccagatggcccggctagccccaccagcggccccgttggacgccctgggggcgttagtggaccctcatggcttcagccacctggcacaggggcggctcagtctcccagaaaggccccccgaagaccgggcccaggtatgtgtggtccggctaattggggttatgtacttggcgggagaggccgaggccccgacgaatacgagaagagatactccggagccttccccccacagctccgcgcccagatgcgcgacctggccaggggcatgttcgtcttcgggtatgacaactatatggcacacgcctttcctcaagatgagctgaatcctattcactgtcgtggacggggaccggacagaggtgacccatccaatctgaacatcaacgatgtgcttggaaactattccctcaccctggtagatgcactcgacaccctcgcaattatggggaactccagcgagtttcaaaaggctgtgaagttggtcatcaatacggtctcgttcgataaagactccaccgtccaggtgttcgaggctacaatacgggtactagggagccttttatccgcccaccgaattatcacagattccaagcagccctttggagacatgacaattaaggactacgataatgagttgctgtacatggcccatgacttggccgtgcgcctcctgccagcttttgaaaatacgaaaaccggcatcccttatcctcgagtcaacctaaagaccggggttccacccgacacaaataatgaaacctgcactgccggagccgggtctcttctagtggagttcggaatcctgagtcggctgcttggcgactctaccttcgaatgggtggcacgcagagcagtgaaggccctctggaacctgcgctcaaacgataccggcctactcgggaacgtggttaatatccagacgggtcattgggttggcaagcagagtggcctgggcgccggactcgacagcttttatgaatatctgctcaaatcttacatactgttcggagaaaaggaggatttggaaatgttcaacgctgcctatcaatcaatccaaaattatctgcgtcgggggcgcgaggcctgcaacgagggagaaggggaccccccactgtatgtgaatgtgaatatgttctctggacagttaatgaatacttggatcgatagcctgcaggccttcttccctggtctgcaagtcctaatcggcgacgtggaagacgctatctgtttacacgccttctactatgccatctggaagaggtacggggcactgcccgagaggtacaattggcagctccaggcccccgatgtactattctacccccttcggccagagctggtggagtcaacttatctcctttatcaggctacgaagaaccccttttacctgcacgttgggatggacatcctccagtcactggagaagtatacaaaagtcaagtgcggatatgccaccctccaccatgtgattgataagagcacggaggaccggatggagtcattctttctctccgagacttgtaagtatctgtatctcctgtttgacgaggataatccagtgcataaaagtggaacacggtatatgttcacaaccgaaggccatatcgtcagcgtggacgagcacttaagggagctcccttggaaggagtttttttcagaagagggagggcaggaccagggcggcaaatctgtgcaccgccccaagccacatgaactaaaggtaattaattcttctagcaactgcaacagagtgccagatgaaaggcggtattctcttcccttgaaatcaatctatatgcgtcagattgatcagatggtagggctgatctag

SEQ ID NO: 26076 - DNA, 639 bp, Artificial Sequence
  Description of Artificial Sequence: Synthetic coding sequence
atgcactggattcatcttcaggtgcttgggtcattgctctcagcccaccggatcatcacagattcaaaacagccctttggcgacatgaccatcaaggattacgacaatgaactgctttatatggcacatgatcttgcggtaaggctcctgccggcctttgagaatacaaaaacggggattccataccctagagtgaatctgaaaaccggcgtgccccctgacaccaataacgagacatgcaccgccggagccggctccctgcttgtcgagttcggaatcctcagccgactgttgggggactcgacgtttgagtgggtagcccgccgcgcagtaaaagccctgtggaatctccgatccaatgatactggcctcctcggtaatgtcgttaacattcaaacaggccactgggtgggcaagcaatcagggctcggcgcaggactggattctttctacgaataccttcttaaaagctacattctatttggcgagaaagaagatctggaaatgttcaatgcggcataccagtcgatccagaactatctacgacgcggtcgagaggcatgcaatgagggggagggggacccaccactttgccagagagagcacgtccagtgggccgccgacgagcacttagactag

SEQ ID NO: 26077 - DNA, 1131 bp, Artificial Sequence
  Description of Artificial Sequence: Synthetic coding sequence
atggggaattccagtgagttccagaaggcagtcaagcttgtaataaacacagtgagcttcgataaagactccacggtacaggtgttcgaagcgacgattagagttttgggatcgctcttgtctgcacatcgaatcattaccgactccaaacagccctttggcgatatgactataaaagactacgataacgagctcctgtacatggcacacgacctggctgtaagactactccccgccttcgaaaatacaaagaccggcattccttacccaagggttaatctgaaaactggcgtgccacccgacacaaataacgagacatgcacagcgggcgccggctccctgttggttgagttcggcatcttgtcaaggttgctaggagatagcacattcgagtgggtggcaagacgggcagtcaaggcactctggaacttgagatccaacgacactggactcctgggcaatgtggtcaatatccagacaggccactgggtgggcaaacagtccggcctcggcgccggactggactcgttctatgagtaccttttaaaaagttatattctgttcggtgagaaagaggacttagagatgttcaatgctgcgtaccagagcattcagaattatctgaggcggggacgggaagcatgtaacgaaggcgaaggggacccccctctctacgtgaatgttaatatgttcagcgggcagctgatgaacacctggattgattccctccaggccttcttccctggcttgcaagtcctgatcggagacgtcgaagatgcaatctgtctgcacgccttttactacgccatctggaagaggtatggcgcgttgccggaacgttacaactggcagttgcaggctccggacgtcttgttctacccactccggcccgagctagtggagagtacctatctgctataccaggccaccaaaaacccattctacctccatgtcggcatggacattctgcagagtcttgagaaatacaccaaagtgaagtgcggctacgccaccctgcatcacgtcattgacaaaagtaccgaagaccgtatggagtccttcttcctatctgaaacttgtaaatatctgtatcttgtttgtgtcctgcaggacgagccccgcaacatctag

SEQ ID NO: 26078 - DNA, 2799 bp, Artificial Sequence
  Description of Artificial Sequence: Synthetic coding sequence
atgtctgaggccggtggaagaggatgcggcagtccagtccctcagcgggctagatggcgactggttgccgctacggccgcgttttgtctcgttagcgccactagcgtctggacagcaggtgctgagccaatgtccagagaagaaaaacaaaagctaggtaatcaagtcctcgagatgttcgaccacgcgtacgggaactacatggagcacgcgtaccctgctgacgaacttatgcctctgacgtgtcggggccgcgtgaggggacaggagcccagccggggtgatgtcgatgatgctttgggtaaattcagcctgacgctgattgactccttggacaccctggttgtgctgaataaaacaaaggaatttgaggatgcggtgcgcaaagtgttaagggacgtgaacttggacaatgatgtagtcgtctccgtgttcgagacaaatatacgggttctgggaggcctgttgggtgggcattcactggcaatcatgctgaaagagaaaggggagtacatgcagtggtataatgacgagttgcttcagatggcaaagcaattgggctataaacttcttccagccttcaatacgacaagtggtctcccgtatcctcgaatcaatcttaagttcgggatccggaaacccgaggcccgcacagggacggagactgatacctgtaccgcctgtgccggtacattaatcttggagttcgccgccctgtcccgcttcaccggagcgaccatctttgaagaatacgcacgcaaggccttagactttttatgggaaaagagacagcgaagctccaatctggtgggagttaccattaacatacacacaggggactgggtgcgtaaggatagcggcgtaggggctggcatcgactcttactatgaatacctgctcaaagcatacgtcctgctgggtgacgactcattcctcgaacgttttaatactcactatgacgccataatgcgttatatctcacaaccccctcttttgttggacgtccatatccataagcctatgctgaacgcacggacttggatggatgccctacttgctttcttccctgggctgcaggttctgaagggagatattcgtcctgccattgagactcacgaaatgctttatcaggtaatcaagaagcataattttttacctgaagcattcacgaccgatttccgcgttcattgggcccagcatcctctgcgacccgagttcgcagagagcacctactttctctataaagcaacaggtgatccatattatctagaggtcggcaagacactgatagaaaatctgaacaaatatgcgcgggtaccctgcggattcgccgcaatgaaagatgtgagaaccggctcccatgaggatagaatggacagtttcttcctagctgagatgtttaagtacttatacctgctttttgcagacaaggaagacatcatcttcgatatcgaggattatatcttcactacagaggcccacctcctgcccctttggctgtccactaccaaccagtcaatctctaaaaagaatacaacctccgagtataccgaactcgatgattctaactttgactggacctgcccaaacacccagatcctatttccaaacgacccactgtatgcgcagagcatccgcgagcccctgaaaaatgtcgtggataagagctgcccccgcggaattattcgggttgaggagtcttttaggtctggagccaaaccaccactgcgggctcgagacttcatggccacaaatccagagcacttagagattctgaagaagatgggggtttctctcattcaccttaaggacggaagggttcagctcgtgcaacacgcaatccaggccgcctccagcatagatgcggaggatggactaaggttcatgcaggaaatgattgaactctcatcgcaacagcagaaggagcaacagctacctccaagagccgtccagattgtgagccatccatttttcggccgagtagtgctcacggcagggcctgcccaattcggactagatctctcaaaacataaggaaacgcgtggtttcgtggctagctccaagcctagcaacggctgcagcgagcttacaaatcccgaagctgtgatgggaaaaatcgccttgatccagagagggcagtgtatgtttgctgagaaggctaggaatatccagaacgcaggggcaattggggggatcgtgatcgatgataacgagggctccagttccgatacagcccctctctttcagatggccggcgatggcaaggataccgatgatattaaaattcccatgttatttctgttcagcaaagaaggaagtataatcttagacgccatcagagagtatgaagaggttgaggttctgttgtctgataaggccaaagatagggatcctgaaatggaaaacgaggagcagccttcaagcgaaaatgactcccaaaatcagtctggggaacagataagctcaagttcacaggaggtggacctggttgatcaggaatcttccgaggagaattctctgaatagtcaccctgaatctctctcactggctgacatggacaacgctgcctcaatctccccttcagagcagacctcaaacccaactgagaatcacgaaaccaccaacctgaacggggagtgcactgatttggacaaccagctccaggaacagagcgagacagaggaggattcaaaccccaacgtcagctggggaaaaaaagtgcaacccatcgattcaattctcgcagactggaatgaggacattgaggcctttgagatgatggagaaggacgaactgtag

SEQ ID NO: 26079 - DNA, 2718 bp, Artificial Sequence
  Description of Artificial Sequence: Synthetic coding sequence
atgtcaagagaagaaaaacaaaagctgggtaatcaggtgctcgagatgttcgatcatgcttacggcaattacatggaacatgcatacccagcagatgaactaatgccactcacctgtcgggggagggtgagaggacaggagccaagccggggcgacgtggacgacgctctagggaagttctctctgaccctgatagactctctggacaccctcgtcgtcctaaacaaaactaaagagtttgaagatgctgttcggaaagtcctgcgggacgtgaatttggacaatgatgtggtcgtctcggtctttgagaccaatatcagagttctgggtgggctcctgggtgggcattcccttgcgattatgctcaaagagaagggggagtatatgcaatggtacaacgatgagctgctgcagatggcaaaacagttgggatacaagctgctccctgcgttcaatacaacgtctggcctcccctatccccggatcaatctgaaattcgggatcagaaagccagaagccaggactggcacagagacagacacgtgtacagcttgcgcaggaacactgatccttgagttcgcggcattgtcccggttcacaggcgccacgatctttgaggagtacgcaaggaaggcccttgacttcctatgggaaaagagacagcgaagcagtaacctagtcggcgtgaccataaatatccatactggagattgggtgcggaaggactccggcgttggtgccggaatagacagctattacgagtatctcctcaaagcatacgtgctgttgggggatgactctttcttagagcggtttaatacacattacgacgccatcatgcggtacatcagtcagccgcccctcttactggacgttcacattcataaacccatgttgaacgcacggacctggatggatgcgctactcgcttttttccccggactccaagttttgaagggagacatacgccccgccatcgaaacccatgaaatgttgtatcaggtcattaaaaagcacaacttcttgcccgaggcattcaccacagactttcgagtgcattgggctcagcatccacttaggcctgaattcgcagagtccacttactttctctacaaggccaccggcgacccatactatctagaggtcgggaagacactgattgagaacttgaacaagtacgcgagggttccctgtgggttcgctgctatgaaagacgtgcgtaccggatcacacgaggatcgcatggactccttttttctggcagagatgttcaagtacctttacctgctcttcgccgacaaggaggatataatctttgacattgaggactacatctttaccacggaggcacacctgctgccactgtggctgagcactaccaatcagtccataagtaagaaaaacaccacatccgaatataccgaactcgacgacagtaactttgattggacctgccccaacacccagattctgtttccaaacgacccgctgtacgctcagagcatcagggagccactcaagaacgtggtggacaagagttgtccacggggtataatacgcgtggaggagtccttccggagcggcgcaaagccccctttgagagctcgcgacttcatggctaccaacccagaacatttggaaatactgaaaaagatgggcgtctcgcttattcacctgaaagatgggcgcgtacaactggtgcaacacgcaatccaggctgccagttccatcgacgcggaagacggtctcaggtttatgcaagagatgatcgagctttcctcccaacaacagaaggaacagcaattgccccctagggccgtgcagattgttagccatcccttcttcggccgggtggtgcttaccgccgggcccgcacaatttgggctggatctctccaaacataaggaaaccaggggattcgttgcatcaagcaagccctctaacggctgttcagagctgactaaccccgaggcggtgatggggaagatagctctcattcagcgaggtcaatgtatgtttgcagagaaggctcgcaatattcagaatgctggtgctattggcgggattgtgatcgacgacaacgaaggctcaagcagtgataccgccccactcttccagatggctggagacggtaaagacactgatgatatcaagatacctatgctttttctcttttcgaaggaaggtagtatcatcttggacgcaatcagggagtacgaggaggtagaagtcctcttgtcagacaaggccaaggaccgcgccgccatcctgaagggcaaaatgatccctagctacatcattaacagtaatcccgagatggagaatgaggagcagcccagctcagagaatgactctcaaaatcagtcgggcgagcagatctcaagcagctcgcaggaggtggacttggttgatcaagaatcttcagaagagaactccttgaattcccatccggaaagtttgtccctggctgacatggacaatgcagccagcatatccccgagtgagcagacctccaatccaacggagaatcatgagactaccaatctgaatggggaatgtaccgacctggataatcagctccaggagcagagtgaaaccgaggaggattctaatcccaatgtgagctggggcaagaaagtgcaaccgattgattcaatcttggccgattggaacgaggacatcgaggccttcgaaatgatggagaaagacgagctgtag

SEQ ID NO: 26080 - DNA, 1314 bp, Artificial Sequence
  Description of Artificial Sequence: Synthetic coding sequence
atggcagccccatcgtggagaggggcccggctcgtgcagagcgtgctgcgcgtgtggcaggtggggcctcacgttgctcgagagcgggtcatccccttctccagcctgctgggtttccaacggaggtgtgtgagctgtgtggccggatctgccttttctggccctagactggccagtgcctcgcgatccaacggacaggggagcgccctagatcattttctgggtttctctcagccagactcttctgtgacaccctgtgtgcctgccgtctctatgaatcgcgacgagcaagatgtgctgttagtgcatcaccctgatatgcccgagaactcccgagtgctgagagtggtgttgttgggagcacctaacgctggcaagtccacgctatccaaccagttacttggaagaaaagtctttcctgtgtctaggaaggtacacactaccagatgtcaggctctcggtgttataacggaaaaggaaactcaggttatcttactcgacaccccaggcattatttctcccggcaagcagaagcgccaccaccttgaactgagtctcttagaagatccctggaagagcatggaaagcgccgatttagttgtagttctagtggacgttagtgacaaatggactagaaaccagctatctccccagctgttgcggtgcctcacaaagtactctcagatcccctctgtgcttgttatgaacaaggtcgactgcttaaaacaaaagagcgtattgttagagctcaccgcagctctgaccgagggggtcgtgaacggaaaaaagctaaaaatgaggcaggcctttcattcacatccagggacacactgcccctctcctgccgtgaaagatcccaatacacagtccgtgggcaatccacaaagaattggctggcctcattttaaagaaatattcatgttatctgcattgagccaagaagatgtcaaaactctgaagcagtatctactgacacaggctcagccaggcccttgggagtaccacagcgctgtcttgactagccagaccccagaagagatatgcgcaaacatcatccgtgaaaaacttctcgagcacctcccacaggaggtcccgtataatgtgcagcagaaaacagctgtctgggaagaggggcctggaggggagctggtgatccaacagaagctgctggtgcctaaagaaagctatgtgaaactgctcatcggccccaagggccatgtgatatcacaaatcgcacaagaggcaggacacgacctgatggatattttcttgtgcgacgtggacatacgcctgtcggtgaagctgctcaaatag

SEQ ID NO: 26081 - DNA, 732 bp, Artificial Sequence
  Description of Artificial Sequence: Synthetic coding sequence
atgtcccgaatgagctcttggagtatcacactgatttgtttgagaattcccggctcatacgagtggtcaagctgggagcctcgtatgcaggggagccagcactcacccaccagttattgggccgagcggtgttccctatttccaggccgctgcatactgctcgcagcaaagctgtggggctcttcacagcggaggcgtccgcgttggtgggttcccaccaagggggttctcgagactggacaacgcgtcaaactgcgcggctcacctctgccatcagcactgaaaaagatgatggttacatttatttatattttactggatacccccggcattatcagtcctggaaagcagaagcgccatcacttagaattaagcctgctggaggacccctggaagagtatggagagtgctgatctcgttgttgtactcgtggacgtatccgataaatggactcgcaaccaactgtccccgcaacttcttagatgcttgaccaagtactctcagatcccgtcagtgcttgttatgaacaaagtggattgtctcaaacagaagtccgtgctgttagagctcaccgccgcactgactgagggcgtcgtgaacggtaaaaaattgaagatgcgacaggcattccattcacaccctggaacacactgcccctctcctgccgtcaaggatcccaatacacagagcgtggggaacccccagagaatcgggtggccccattttaagtag

SEQ ID NO: 26082 - DNA, 1167 bp, Artificial Sequence
  Description of Artificial Sequence: Synthetic coding sequence
atggaagcactcggaaaactaaagcagttcgacgcgtaccctaagactctggaggattttagggtgaagacatgtggcggcgcaacagtaacaatcgtgtcgggactcctcatgcttctcctgtttctctctgagctgcaatactatttaaccacagaagttcaccccgagctgtatgtagacaaatcccgaggcgacaaactcaagataaacatcgatgtgttgttcccgcacatgccttgcgcatacctgagtattgatgcaatggacgtggccggggagcagcagctggacgtggagcacaacctgtttaaacagaggttggacaaagatggcatccctgtgtcctcagaggccgagcggcatgagttgggtaaagtggaggtgacagtcttcgaccctgattctctggaccctgaccggtgcgagtcatgctacggcgccgaggcggaagatataaaatgctgcaatacatgcgaggacgtccgtgaagcctaccgcagacgaggctgggcgttcaaaaacccagatacgatcgagcagtgcaggcgagagggcttttctcagaagatgcaagaacagaagaatgaggggtgccaggtgtacggctttttggaggtgaacaaggtggccgggaacttccattttgctccaggtaagagcttccaacagagccacgtgcatgtccagggagaggaggtgcacgacctgcaaagttttggccttgataacatcaatatgacacattatatccagcatttgagcttcggcgaagactatcccggaattgtgaatccattggatcacacaaacgtgaccgctccacaggccagcatgatgtttcagtacttcgtgaaggtcgttcccactgtttacatgaaagtcgacggagaggtgctcaggacgaatcagttctccgtcacacgccatgaaaaggtggctaacggtttactgggggaccaaggacttcccggagtttttgtcttatacgaattgagcccaatgatggtcaaactgacagaaaagcaccgcagtttcacgcacttcctcacaggggtgtgcgcaatcattgggggaatgtttacagtggccggtttaattgatagcttgatctatcattctgctagagcaatacagaagaagattgatctcggtaaaaccacttag

SEQ ID NO: 26083 - DNA, 1152 bp, Artificial Sequence
  Description of Artificial Sequence: Synthetic coding sequence
atggaggccctgggaaaactgaagcagttcgatgcgtatcccaaaactctggaggatttcagggttaaaacatgcggcggcgccaccgttacgatcgtgtctggactgctcatgttgctgttatttttatccgaattacagtattatctcaccacggaggtccacccggagctgtatgtggacaagtcccgcggcgacaagcttaagatcaacatagacgtcctttttcctcacatgccatgtgcatatctgagtattgacgccatggatgtggccggcgagcaacagctcgacgtagaacataacctctttaagcagcggcttgataaagatgggatccccgtctcgagcgaagccgaaaggcacgagctgggtaaagttgaagtgaccgtgttcgatccagactcactggatcctgaccgctgtgaatcttgctacggggccgaggcagaagacatcaagtgttgcaatacctgcgaggacgttcgggaggcttaccgccgaaggggctgggcctttaaaaaccccgacacaatcgagcagtgtcgacgggagggcttctcccagaagatgcaggagcagaagaacgaaggctgccaggtgtatggttttttagaggttaataaagtcgctggcaacttccattttgctcctggaaagtccttccaacagagccacgttcatgtgcacgatttgcagagttttgggctggacaacatcaatatgacacattatatccagcacctgtcttttggggaagactatcctggaattgttaacccactcgatcataccaacgtgacagcccctcaagcctctatgatgttccagtacttcgtgaaggttgttcctaccgtttacatgaaagtagacggcgaggttcttcgcactaatcagttttccgtgacgcgccacgagaaggtcgcaaatggtcttctgggcgaccagggcctgcctggggttttcgtgctctacgagctttcgcctatgatggtgaagctgacagaaaaacatcgatcattcacccatttcctcacgggtgtgtgcgccatcattgggggaatgttcactgtggccgggctgattgatagcctgatttatcacagtgctagagcgatacagaagaagatcgatctggggaagactacatag

SEQ ID NO: 26084 - DNA, 597 bp, Artificial Sequence
  Description of Artificial Sequence: Synthetic coding sequence
ctgtcagtcgccttttcttgttgttacggagcggaggcagaggatatcaaatgttgtaacacatgcgaggatgtgcgcgaggcttacagacggcgcggctgggcattcaagaatccggataccatcgaacaatgccgacgcgagggtttttcccagaagatgcaggagcagaagaatgagggctgccaggtttacgggttcctcgaagtaaacaaagtcgctggcaatttccatttcgctccaggcaaatcattccagcagagccacgttcacgtgcatgacttacaatcatttggtctggacaacattaacatgacccactatatccagcacttaagtttcggggaagattatcctgggattgtgaacccactggaccatacaaatgtgacagccccccaggcttcgatgatgtttcaatacttcgtaaaggtggtgcccactgtctacatgaaagttgacggcgaagtcctgagaacaaaccagttttcagtgacccgccacgaaaaagtggcgaatgggctcctgggagatcaaggtctgccaggggtctttgcgcacctccctctaagcaccagccatcccgaggaaaactag

SEQ ID NO: 26085 - DNA, 1167 bp, Artificial Sequence
  Description of Artificial Sequence: Synthetic coding sequence
atggaagcccttggtaaactgaaacaatttgacgcttacccgaagaccctggaggacttccgcgtgaagacatgtggtggcgcgacagttaccatcgtatctggcttgctcatgttgctgctgttcctgagcgaactgcagtactatctgacgactgaggttcaccccgagctgtatgtcgacaaaagccggggtgacaaattgaaaattaatattgacgtgctcttcccccacatgccgtgcgcatatctgagcatcgatgctatggacgtagcgggggaacaacaactggatgtcgagcacaatttattcaagcagagactggataaagatggcatccccgtctctagcgaggcggagaggcacgagttggggaaggtagaagtaaccgtctttgatcctgactcactcgatcctgacaggtgcgagagctgttatggagccgaggctgaggatattaagtgttgtaatacctgcgaggatgttcgagaggcataccgacggcgtggatgggcttttaagaatccagataccatcgagcaatgcaggcgcgaagggtttagccagaaaatgcaagagcagaagaatgaggggtgccaggtgtatgggtttctcgaagtgaacaaggtcgcaggcaactttcacttcgcccccgggaagagttttcagcaaagccacgtgcacgtccacgcggtagagattcacgacctgcagagcttcgggcttgacaacattaacatgacacactatatccaacacttatccttcggagaggactacccaggcatcgtgaatcccctagaccacacaaacgtgacagccccgcaggccagcatgatgtttcagtattttgtaaaggtggtacctacggtgtacatgaaggttgacggagaagtgttgagaactaaccagttcagtgtgactaggcacgagaaagtggcaaacggcctgctgggagaccagggactgcctggggtcttcgtgctgtatgaattgagccccatgatggttaagctgacggagaagcacagatcttttactcattttctgactggtgtgtgcgcaatcattggcggcatgtttacagtggccggtctgatcgattcgttgatatatcacagtgcgcgagccatccagaaaaagatcgatctgggtaagacaacctag

SEQ ID NO: 26086 - DNA, 1197 bp, Artificial Sequence
  Description of Artificial Sequence: Synthetic coding sequence
atggaggccctgggaaaactgaagcagtttgacgcctaccccaagacattagaggactttagagtaaaaacttgcggcggggcgacggtcaccatcgtgtcagggctgttgatgcttctgctcttcctgtcagagctccagtattatctcaccacagaggtgcaccccgagctttatgtggacaaaagcagaggagataagctaaagatcaacatcgatgtcctgttcccgcacatgccttgtgcctacctatcgattgatgccatggatgttgctggcgaacagcagctcgatgtggaacacaacctgttcaagcaaagactggacaaagacggcatacctgtttccagtgaagcagaacgtcacgagctcgggaaggtggaggtgactgtgtttgatcctgactccctggatcctgaccggtgtgaatcgtgttacggcgcggaggcggaggacatcaaatgttgcaatacctgtgaggacgtgcgggaagcatacagacggcgaggctgggcttttaagaaccctgataccatcgaacaatgccggagggaagggttttcccagaaaatgcaggaacaaaaaaatgaaggctgccaagtttatgggttcctcgaagtgaataaggtagccggcaatttccacttcgcacccggaaagagctttcagcaatcccatgttcacggatgcgtgtgccgattgaagatgatcgcccggtccttggcctgtgttcacgatttacagagcttcggtctggataacatcaacatgacccactatattcagcacctgtctttcggtgaggattaccccggcatcgtgaacccacttgaccacactaacgttacagcgcctcaggcctcaatgatgttccagtactttgtaaaggtggtccccaccgtgtatatgaaagtagacggggaagtcctgcgcactaaccagtttagcgtgacccggcatgagaaagtcgcgaacggcctcctgggagaccagggcctgcccggggtgtttgtgctgtacgagctgtcccctatgatggtaaagctcaccgagaagcaccgatcattcacacactttctaacaggcgtgtgcgcaattattggcggcatgttcactgtggccggactcattgactcactgatctatcactctgcccgggcaattcaaaaaaagatcgacttagggaaaaccacctag

SEQ ID NO: 26087 - DNA, 1407 bp, Artificial Sequence
  Description of Artificial Sequence: Synthetic coding sequence
atgggaaggggctgggggttcctattcggcttgctcggcgctgtgtggctcctttcttctggccacggtgaagagcagcctcctgaaactgctgcccaacggtgtttctgtcaggtgagcggatacctggacgactgcacatgcgacgttgagacaattgacagattcaacaattacagactctttccaaggctacagaagctgttagagtccgactacttccggtactacaaagtcaacctcaaacgcccatgccccttctggaatgacatttcccagtgcggccgaagggattgtgcagtcaagccctgccagtctgatgaggtgcccgatggcattaagagcgctagttataaatactctgaagaggctaacaacctgatcgaggaatgtgagcaggcggaaaggctgggcgcagttgatgaatctctctcagaggagacacagaaagccgtgctgcaatggaccaagcatgatgattcttctgataacttctgtgaggcagatgacatacagtctcccgaggctgagtacgtcgatctcctgctaaatccagagcgctacacaggctacaagggccccgacgcctggaagatctggaatgtgatttacgaggaaaattgcttcaaaccccaaacgattaagagacctctcaaccccttagcatccggccagggcacatctgaggagaatacattttatagttggctggaaggcctttgcgtagaaaagcgcgctttttatcggcttatctctggtttacatgcttcaattaacgtccatctctctgcgcggtacctgctgcaggagacctggctggaaaagaagtggggccacaacattactgagtttcagcagaggtttgatggcattttgacagagggggaaggtccccgtaggcttaagaatctgtactttctgtatctcatcgagctaagggcccttagtaaagttttgcccttcttcgagcgcccagatttccagctgtttaccggtaacaaaattcaggatgaagaaaataaaatgctgctcctcgagattctacacgaaatcaagtcctttcccctccattttgatgagaactccttctttgcgggagataagaaggaagcacacaagctaaaggaagactttagactgcactttagaaacatctcacgaattatggactgcgtgggctgctttaaatgcaggctgtggggcaagctgcagactcaggggctgggcactgccctgaaaatcctgttttctgagaagcttatcgccaacatgcccgagtctggcccaagctacgagttccacctgactcgacaggagatcgtgtctctgtttaatgcttttggccgcatatctacatctgtcaaagaactagagaattttaggaacctgttacagaacattcattag

SEQ ID NO: 26088 - DNA, 522 bp, Artificial Sequence
  Description of Artificial Sequence: Synthetic coding sequence
tggggtcctaacatcaaggagttcaagcatcgattcgatccagtggagacaaaaggggaaggacctcgccggttaaagaatctctatttcctatacttgatcgagttgagagccttgagcaaggtcgccccctatttcgagaggtctattgtggacctgtacaccgggaatgctgaggaagacgctgataccaaaacacttctgctgaatattttccaggacactaagtccttccccatgcattttgatgaaaaatccatgtttgctggtgacaaaaagggagcaaagtcattaaaagaggagtttcgattgcattttaaaaacatttctcgaataatggattgcgtgggatgtgataaatgtcggttgtggggaaaactgcagactcaaggattgggcaccgcccttaaaattctgttctccgagaaggaaatccaaaaactgcccgaaaattctcccagcaaagggtttcagcttaccaggcaagagatcgtcgcccttctgaatgcttttggtcgttag

SEQ ID NO: 26089 - DNA, 435 bp, Artificial Sequence
  Description of Artificial Sequence: Synthetic coding sequence
atgtcacagggtgtaagaagggcaggtgcgggacagggggtagcagcggcggtccagctgctggtcaccctgtccttcctgcgttcagtagtggaagctcaggtgacaggggtcctcgatgactgcctgtgcgacattgacagcatagacaatttcaatacttacaagatttttccaaaaataaaaaagctgcaggaacgagactacttcaggtattacaaggtgaacctaaaaagaccttgtcctttctgggccgaggacggccattgctccattaaggattgtcacgtcgaaccctgtccagagtccaagataccggtcggcattaaagctgggcactctaacaagtacttgaagatggccaacaatactaaagagctggaagactgtgaacaggcgaacaaactgggcgcaatcaacagcacgcttcgctag

SEQ ID NO: 26090 - DNA, 1404 bp, Artificial Sequence
  Description of Artificial Sequence: Synthetic coding sequence
atgagtcagggcgtcaggcgtgccggtgcaggacaaggtgtagccgccgccgtccagctattggtcacgctgtcttttctgaggagtgtcgtggaagcccaggtcaccggcgttctggacgattgcttgtgcgacatagactcaattgacaacttcaatacctataaaatcttccccaagatcaaaaagcttcaggagcgtgattacttccgatattataaagtcaacctgaaaaggccatgtcctttttgggccgaagatggacattgtagcatcaaggattgccatgttgagccatgccctgaatccaaaatccccgtgggcatcaaggctggacatagtaataaatacctgaagatggccaataacaccaaagaactggaagattgtgagcaggcgaacaaactcggggcaatcaatagcaccctttccaaccagagcaaagaggcgtttattgattgggccagatatgacgattccagagaccatttttgtgaattggacgacgagaggtcccccgccgcccaatacgtggatcttctgctgaaccccgaacgttacaccggctacaaagggacgagcgcttggcgggtatggaacagcatttatgaggagaactgcttcaaacccagatcggtgtataggcctctcaaccctctcgcacctagcaggggagaggacgatggtgagtcattctatacctggcttgaggggctgtgcctggaaaaacgcgttttttataagctgatctcaggcttgcacgcatcaattaatctgcatctctgtgccaactatctgctggaagaaacgtggggcaagccgagttgggggcccaacataaaggaatttaagcatcggtttgacccagtagagacaaaaggggaaggacctaggcgtctgaaaaacctttactttttatatttaattgaactgcgcgccctttcaaaagtcgccccttatttcgagcgctctattgtagacctctacacaggaaatgctgaggaagacgccgataccaagaccctgctgctgaatatcttccaagacacgaagagttttcccatgcattttgatgaaaaaagcatgttcgctggagataaaaaaggcgctaaaagcctgaaagaggaatttagattgcacttcaagaatatttcccgtattatggactgcgtcggttgtgacaagtgccggttatggggaaagctgcagacacaagggctgggcacggcactgaagatcctttttagcgaaaaggaaatacagaagctcccagagaatagcccgagcaagggttttcagctcactaggcaagagatcgtggcgctgctaaatgcatttggacggctgtcgacttcaatcagagacctgcagaacttcaaggtcctcctgcagcatagcaggtag

SEQ ID NO: 26091 - DNA, 216 bp, Artificial Sequence
  Description of Artificial Sequence: Synthetic coding sequence
atggctaataacaccaaggagctggaagactgcgaacaggccaacaagctgggagcgattaatagtactttgtcaaatcaatctaaggaagccttcatcgactgggctcgctacgatgatagcagagaccacttttgcgagctggatgatgaacgatcgccggccgctcagtacgttgatctactgctgaacccagaaaggtatacgggctactag

SEQ ID NO: 26092 - DNA, 702 bp, Artificial Sequence
  Description of Artificial Sequence: Synthetic coding sequence
atggagctgccaactaagcctggtacttttgatctcgggttggccacctggagtccgtccttccagggggaaacacaccgcgcccaagcgcgtcgtcgcgatgtaggccgccaactgcccgagtataaggccgtcgtagttggggcatcaggtgttggcaaatccgctcttaccatccagctgaatcaccagtgttttgtggaagatcatgacccaaccattcaggatagctattggaaagaactgactctcgacagcggagattgcattttaaatgtgctcgatactgccggtcaggcaatccaccgcgccctccgcgaccagtgccttgctgtttgcgacggcgtgttaggcgtgttcgccttagatgacccaagctccctgattcagttgcagcagatttgggccacatggggacctcatcctgcccaaccgttagtcttggtgggaaacaagtgcgacctggtcacaacggccggagacgcgcacgccgccgcagctgcactcgcccatagctggggagcacacttcgtagaaacctcggcaaagacccggcaaggagtggaggaagcattctctctgctcgtgcacgagattcaacgcgttcaggaggcgatggcaaaggagcctatggcacgaagctgccgcgaaaagaccaggcaccagaaagccacgtgtcactgcgggtgttcagtcgcctag

SEQ ID NO: 26093 - DNA, 2178 bp, Artificial Sequence
  Description of Artificial Sequence: Synthetic coding sequence
atggccatggccatgagcgacagtggcgcatcgcgtctgcgtaggcaactggagtccggagggttcgaggctcggctgtatgtcaaacagctttcgcaacagtccgacggggaccgagatctgcaggagcaccgtcagcgcatccaagccctggcagaggagacggctcagaatctgaaaaggaatgtctatcagaactaccgccagtttatagaaaccgctcgcgagatcagttacctggaatctgagatgtatcagctgagccacctgttgactgagcagaagtccagtctcgaaagtattccgctgactcttctccccgcagcagcagccgccggcgcggctgctgcgtccggaggggaggaaggagtcggaggggccggcggtagagaccacctgcggggccaggccggattttttagtacccccggtggggcttctcgggatggtagcggaccgggggaggaaggcaaacaaaggactctgaccactctcctcgagaaggtggaaggctgccggcacttgctcgagacaccaggccaataccttgtatacaacggtgatctggtcgagtatgatgcagatcacatggctcaactgcagagggtacacgggttcctgatgaatgattgcttgctagtggcgacctggctgccccagagacggggcatgtaccgttataacgctctgtactcattggatgggctggccgtggttaacgtgaaggataacccacctatgaaggatatgtttaagctgcttatgtttcctgagagccggatatttcaggctgagaatgctaaaatcaaacgggagtggttggaagtcctggaggacacgaagcgcgccctcagtgaaaagcggcggcgggagcaggaagaagccgccgcaccacgcgggcctcctcaggttacatccaaagccacaaatcccttcgaggatgacgaagaagaggagccagcggtcccagaagtcgaagaagagaaggtggatctctcaatggaatggattcaagagcttcctgaagatcttgatgtgtgtattgcccagagagacttcgagggagctgtcgaccttctggacaagttgaaccattacctggaagataaaccatcacccccgccagttaaggaactgagggccaaagttgaagagagggtccggcagctgaccgaagtgcttgtcttcgaattaagccccgaccgtagcctcagaggtggacccaaagcaacgcgacgggcggtgagtcagttgatcagattgggccaatgcaccaaagcatgtgaactgtttctgagaaaccgcgccgcagccgtccacaccgccatcaggcagctcagaattgaaggagcaacactgctatatattcataagctgtgccatgtgttttttacttctcttctggaaaccgcacgggagttcgagattgatttcgccggtaccgacagcggctgttattcggccttcgtcgtttgggcccgaagcgccatgggtatgtttgtagacgcattcagcaagcaagtgttcgattctaaagaaagcctgtctactgcagcagagtgcgtaaaagttgccaaagaacattgccaacagctcggtgacatcggcctggacctgacttttattattcacgcgttactcgtgaaggacattcagggggcactacattcatataaggagatcatcatcgaagcaacaaaacaccgcaactccgaagagatgtggaggagaatgaacctgatgaccccggaggccttgggaaagcttaaagaagagatgaagagctgtggtgtttctaactttgagcagtataccggtgatgattgctgggttaacctgagctatactgtcgtggctttcacaaagcagacaatggggttccttgaagaagccttgaagctgtacttcccggaactacacatggtcctgttggagagcctggttgagataattctagtagccgtccaacacgtcgattattctctcaggtgtgagcaggatcctgaaaagaaagctttcatcagacagaacgcaagttttctatacgagacagtgttgcccgtcgtagagaaaagattcgaggagggagtgggcaaaccagcaaaacagctccaagatctgagaaatgctagccggctgatcagggttaaccccgagagtaccacctccgtcgtgtag

SEQ ID NO: 26094 - DNA, 2166 bp, Artificial Sequence
  Description of Artificial Sequence: Synthetic coding sequence
atgtcagatagcggagcgtccagactgagaaggcagctcgagagtggcggatttgaggcaaggctgtatgtgaagcagctcagtcaacaatcagacggcgatcgcgatctccaggaacaccgacagcgcatacaggccctggctgaagagactgcccagaacctgaaacggaatgtttaccagaactacagacaatttatcgagactgcgcgtgagatcagctaccttgaaagcgagatgtaccagctttcccacttgctgaccgagcagaagtctagcctggagtctatacccttgactctgctgcctgcagccgccgccgcaggcgctgctgctgccagcggaggtgaagaaggggtgggcggtgccggggggagggatcaccttcgaggtcaggctggattcttttccacaccaggcggggcgagccgagacggatctgggccaggggaggaagggaaacaaaggacactgacaaccctcctggagaaggtcgagggatgccgacatcttttagaaaccccagggcagtatttagtgtacaacggcgacctagtggagtatgacgccgatcacatggcccagcttcagcgagtccacggcttcctgatgaacgattgtctgctcgttgctacatggctcccacagaggagagggatgtataggtataacgccttgtacagcctggacggcctggcagtcgtaaatgtcaaagacaatccaccaatgaaagacatgttcaagctgttgatgttcccagaaagccgcatcttccaagcggaaaacgccaaaatcaagagggagtggttggaggtgcttgaggacacaaagagggccctgtcggagaaacgccgacgggagcaggaggaggccgccgcaccccgggggcccccacaggttacatctaaagcgacaaatcctttcgaggacgacgaggaagaagagcctgccgtgcctgaggtggaggaagagaaggtcgaccttagcatggagtggatccaggaactccccgaagacctcgacgtctgtattgcacagcgcgattttgagggtgccgttgatctactggataagctcaaccattatctggaggacaagccctctccaccgccggtgaaggagttaagggccaaggtcgaagagcgggtccgacagctgacagaagtgcttgtgttcgagttgagcccagacaggtctctcagggggggtcccaaggccacccgccgggccgtgagccagctcattaggttagggcagtgcacgaaagcttgcgagcttttcctacgcaatagagccgccgccgtgcacactgcgatacgtcagcttcggatcgaaggggcgactttactttatatacacaagctttgtcatgtgttctttacgtctctgttggagactgcacgggagttcgagatcgatttcgctgggactgattctggatgctattccgcctttgtcgtttgggcacgctcagcgatgggcatgttcgttgatgcctttagcaaacaagtgttcgactctaaggaatcactgagcacggcagccgaatgcgtgaaagtggctaaggaacactgccagcagttaggggacatcggcctcgatctcacgttcataatccacgctctcctggttaaagatatccagggcgccttacattcttataaggaaatcatcattgaggctactaaacaccggaactccgaggagatgtggagacgtatgaatttgatgaccccggaggccctggggaaactgaaggaagagatgaagtcttgcggggtgtcgaatttcgagcagtacaccggggacgactgttgggttaatcttagctatactgttgtggctttcaccaaacagaccatgggtttcttggaggaagccctcaagctgtacttccccgagctacacatggtgctgctcgaatcgctggtcgagattatcctggtggctgttcagcatgttgattactccttgaggtgcgagcaggaccctgaaaagaaggccttcatccgccaaaatgctagctttctgtacgagaccgtgctgccagttgtggaaaagcggtttgaagagggcgtgggaaagcccgcaaagcagctacaggatctgcggaacgcctctagactgatccgagtgaaccccgagagcaccacatccgtcgtctag

SEQ ID NO: 26095 - DNA, 3345 bp, Artificial Sequence
  Description of Artificial Sequence: Synthetic coding sequence
atggaacggtcacctggcgaaggtccgtccccttctccaatggatcagccttccgctccgtctgatcctaccgaccagcccccagctgcccacgctaagccggacccagggagcggaggccagcctgccggtcccggcgcagccggggaagcgttagccgtactcacttccttcgggagacggctgttggtcttaatcccagtttatttagccggggctgttgggctcagtgtcgggttcgtcctgttcggactggccctgtacttgggatggcgccgcgtcagggatgaaaaagagcggtccctcagggcagctaggcagctcctggacgatgaggaacaactgactgcgaaaacactatacatgtcccatcgggagcttccagcgtgggtgtccttccccgatgttgaaaaagcggagtggctcaataagatagtggcccaggtctggcccttcttagggcagtacatggaaaagctgctcgctgaaacagtggctcccgccgtaaggggcagcaaccctcatcttcagactttcacatttactagggtcgaacttggagaaaagcccctgaggatcataggcgttaaagttcatccaggccaacggaaggaacagattctgctggatttgaacatcagctatgtgggcgacgtgcagattgatgtcgaggtcaaaaagtatttttgcaaggcaggagttaagggaatgcagctgcatggcgtcctgagggtcatactcgagcccctgatcggcgatctcccattcgtgggagctgtctcaatgttctttattaggaggcccaccctcgacattaactggaccgggatgaccaacctgctcgacatccctgggctctcgtccttatctgatacaatgatcatggattctattgctgctttcctcgtgctgcctaatcggctgttggtgccactggtcccagatctccaggatgtcgcacagctcagatctcccctgccacgtggcatcattcggatccatctgctcgcagccagaggtctgtcctctaaagacaaatacgtgaaggggctgatagaaggaaagtcagatccctatgccctggttcgactcggcacccagaccttctgctcgcgcgtcatcgacgaggagctgaatcctcagtggggggagacctatgaagttatggtccacgaagtgcccggccaggagattgaagtggaagtgtttgataaggatcccgacaaagatgacttcctgggaagaatgaagttagacgtaggaaaggtactgcaagcctctgtccttgatgactggttcccgctgcaaggcggacaaggccaagtccatctaaggctggaatggttgtccttgctttccgacgccgaaaagctggagcaagtgcttcagtggaactggggagtcagctcccggcccgaccctcctagcgccgccattctcgttgtgtacttggacagagcacaagacctgccgatggttacctccgaattgtacccaccgcagctcaagaagggcaacaaggagcccaaccccatggtccagctgagcatccaggacgtaacacaggagtcaaaggcagtgtactcaacaaattgccctgtgtgggaggaggcgttccgatttttcctgcaggaccctcagtctcaggagctggatgtccaggttaaggacgacagtagggccctgactctaggtgccctcaccctccccttggcccgcctacttacggctcccgagttgatactagaccaatggttccaactctctagctctgggcccaatagccgactctacatgaagctcgttatgagaatattatacctggatagttcggagatctgctttcctactgtgcccggctgccctggagcatgggatgtcgactctgaaaacccccaaagaggaagttctgtcgacgctccacctagaccatgtcatacgacgccagactcccagttcggaaccgaacatgtactaagaattcacgtactcgaagctcaggatttgatcgccaaggacaggtttctcggcgggctcgttaagggcaaatctgatccttatgtcaaattgaaactggcgggacgttcctttagaagccacgtcgtgagagaggatttaaacccacgctggaacgaagtctttgaggtcatcgtgacctctgtacctggccaggagctcgaggtggaagttttcgacaaagacctggacaaagacgacttcctaggccggtgtaaagtgaggcttacaacagtgctgaattctggcttcctcgatgagtggctaacactggaggatgttcctagtggtcgcttgcacttgcgattagagaggctgacgcccagaccgacagctgctgagctcgaagaggtgctgcaggtgaacagcttgatccagactcagaagtccgctgaattggcggcggctttgctgagcatctatatggaaagagcagaggatctccctctcaggaaggggacaaagcacctgagtccctatgccactttgaccgtgggagactctagtcataaaactaagaccatttcgcagacctctgcgcctgtgtgggacgaaagtgcttcttttttgattagaaagccacatacggagtccctggagcttcaggttaggggggagggaactggagtactgggcagcctctctctgcctctttctgaactcctggttgctgatcagctgtgtcttgataggtggttcacattatcgtccggccagggacaggtgctcctgagagcccagctgggtatactggtgagccaacacagtggagtggaggcccatagccactcctactcacatagctcttcgtccctcagcgaggagcctgagcttagcgggggccccccacacatcacatcatccgcgcctgaacttaggcagcgattaactcacgtcgacagccctctggaggctccagccgggcctctcgggcaggtcaaactcaccctctggtactatagtgaagagagaaaactggtgagcattgtgcacggatgcaggagtctcagacaaaatggtagagacccaccagatccctacgtgagcctgttgctcctccccgataaaaaccgtgggactaagcggagaaccagccagaaaaaaagaaccctgtctcccgaatttaatgaacgctttgagtgggaactcccacttgatgaagctcaacggaggaagttggacgttagcgtaaaaagtaacagctcatttatgtcgcgagagagagagctactagggaaggttcagctggacctcgctgaaaccgacctctcgcagggcgtggctaggtggtacgatctcatggacaataaagacaagggctcttcgtag

SEQ ID NO: 26096 - DNA, 3315 bp, Artificial Sequence
  Description of Artificial Sequence: Synthetic coding sequence
atggagcgctctcccggagagggcccgtctccatcacccatggaccagccctccgcaccatccgaccccacggaccagccaccagctgcccacgcgaaaccagatcctgggagtggcgggcaacctgctggacccggcgcagcgggcgaggctctggcggtgctgacgtcatttggacggagactcctggtgctcattccagtataccttgccggcgccgtaggcctttccgtggggtttgtgctgtttggtttagccctgtatctcggctggaggcgggttagagatgaaaaggaacggtcactgagagccgcccgccagcttctggatgacgaggagcagctgaccgctaaaacactgtacatgtctcatcgggaactccctgcatgggtcagttttcccgacgtggagaaggcggagtggttaaataagattgtggctcaagtttggccctttcttgggcagtatatggaaaagttactggccgaaacggtggctccagctgtaagaggtagcaacccgcatcttcagacctttacgttcacaagggtagagctgggagagaaacctctccggatcattggcgtgaaggtgcaccctggtcagaggaaagagcagattcttctcgatctaaatatatcttatgtcggagatgtgcagattgatgtcgaagtcaaaaagtacttctgtaaggccggcgtgaagggtatgcagttgcacggcgtgctgagagtaatactcgaaccactgataggcgacctgcctttcgtaggcgccgttagtatgttcttcatccgcagacccacactggatatcaactggacaggcatgactaatcttctggacatcccaggcctgtcctcattgtccgatacaatgattatggattccatcgccgccttcttggttttaccaaaccgcctgttagtaccactggtgccagacctgcaagacgtggctcagctacgctcacctttaccccgcggcattataagaattcacctcctcgcagctcgaggattatcctcaaaagacaagtacgtgaagggacttatagaaggcaaatcagacccctatgccctggttagactgggaactcaaacgttttgctcccgtgttatcgatgaggaacttaaccctcagtggggtgaaacatacgaggttatggtacacgaggttccggggcaggaaatcgaggtagaagtgttcgataaagaccctgacaaagacgacttcctggggaggatgaagctggacgtgggaaaggtgctccaggccagcgttcttgacgactggttcccccttcaaggggggcagggacaagtacacctgcggctggaatggttatctcttctctctgatgcggaaaagttggaacaggttctccagtggaattggggggtgtcctcacgcccagacccccccagtgccgcaatccttgtggtgtatcttgatagagctcaagatctgccactgaaaaaaggcaacaaggaacctaaccccatggtccagctgtccattcaggacgtaactcaggaatcaaaagccgtctactccaccaactgtccagtttgggaagaggcttttcggttcttcctccaggacccacagtctcaggaactcgacgtgcaggtgaaggatgactcccgggctctgacgctgggcgcactgaccctccctcttgcgcgacttctcactgccccggaattgattctggatcaatggttccagctcagcagctccggtccgaactctcggctttacatgaaattggtgatgcggatcctgtacttagatagttccgagatctgcttcccgactgtgccgggatgccctggtgcttgggatgtggactcggaaaatccccagagaggctcatccgtcgacgcgccccctcggccctgtcacaccactcctgactcccagttcgggacagagcatgtcctccggattcatgtacttgaggcacaggatctcattgcaaaggaccgatttctgggtggcctggtgaagggtaagtctgatccatatgtcaagctgaaattggccggcaggagttttcgttcacacgtcgttcgggaggatctcaaccctcgctggaacgaagtgttcgaggtcatagtgacatccgttcctgggcaggagttggaagtggaggtgttcgataaagatctggacaaagatgattttctaggaaggtgcaaggtacgtctgactaccgtgctcaacagcggcttcctagacgaatggctgacgttggaggatgtgccatcgggcagactccatctgaggcttgagagacttacaccacggccaaccgccgccgagcttgaggaggtgctgcaggttaattctcttatccagacacagaagtccgccgaactggctgccgctcttctatcaatctatatggagagggccgaggacctgcctctgcgcaagggcactaaacacctgtcaccatacgcgactctcacagtgggcgactctagccacaaaaccaaaactatctctcagaccagcgctcccgtgtgggatgaatccgcttcctttttgattcgcaagccgcataccgaaagcctcgagctccaggttaggggggagggcaccggggtactcggctccctgagtctgcctctgtctgagctattggtagctgaccaactgtgtttagatcgatggtttacactctcgtcgggccagggccaggtgctcttacgggcacagttgggaatcctggtctctcagcactcaggtgtggaagctcattcccacagctattcccatagctcttcttctctgtccgaggagccagagttgtccggcggacccccacatattacgagctcagcaccagagctccgccaacggctgacacacgtcgacagcccactagaagctcctgccgggcccctgggccaagtcaaactaaccctctggtattacagtgaggagcgaaagctggtttccatcgtccacggatgccgctctctccgtcagaacgggcgagatccacccgatccgtacgtatcacttttgctcctcccagacaagaatcgagggactaaacggcgtacatctcagaagaagaggacgctgagcccagagttcaacgaacgctttgagtgggagctgccattggacgaagctcagcgaaggaagctggatgtgtccgtcaagtcaaactctagtttcatgtcacgcgagcgtgaacttttgggcaaggtccagctggacctggcagaaaccgatctgagccaaggagtggctcgttggtacgatcttatggacaacaaggacaaggggtctagttag

SEQ ID NO: 26097 - DNA, 3177 bp, Artificial Sequence
  Description of Artificial Sequence: Synthetic coding sequence
atggaacgctcaccaggggaggggccgtcccctagtccaatggatcaaccaagcgccccgtccgaccctacagaccaaccacctgccgcccacgctaaacctgacccgggcagcggaggccaacctgccggtcccggtgctgccggggaggcactggcagtgttaacttcattcggaaggaggcttctggtgctcattccagtttacctggcgggggcagttggtctgtctgtggggtttgtgctcttcggtctggccctttacctcggctggcggcgggtcagagatgagaaggaacggagtctccgggccgcacgtcagttactcgacgacgagaaacttctggcagagaccgtggcccctgccgtgcgcggctccaatccgcacctccagacattcacatttaccagagtggagctgggcgaaaaacccctgcgcatcatcggcgtgaaggtgcatccggggcagaggaaagaacagatcctcctggacctgaacatatcctatgtcggtgacgtacagattgacgttgaggtgaaaaagtacttctgtaaggccggggtgaagggcatgcagctgcacggcgtactgcgcgtgattctggagccccttatcggcgatttgccttttgtgggcgcagtaagtatgttttttattagacggcctacccttgacattaattggacaggcatgacaaacctgctggatattcccggactctcttccttaagtgacacgatgataatggactctattgcagcgttcctggtcctacccaatagactgctggtgccactggtgcctgacctgcaggacgtggcacaactgcgaagtccactgccacgcgggatcatacgcatccacttacttgccgccagaggactgtcctccaaggataagtatgttaaagggttaattgagggtaagtcagacccttacgctctggtgcgcctggggacacagacattctgcagtagagtgatcgacgaggagttgaaccctcagtggggcgaaacgtatgaagtgatggtccacgaagtcccggggcaggagatcgaggtagaggtatttgataaggatccagacaaggatgatttcttaggacgcatgaaactcgatgtcgggaaagtcctgcaggcttccgtgctcgacgactggtttcctcttcaaggaggccaggggcaggtccatctgaggctcgaatggttgtctctactttccgatgctgagaaactagagcaagtcttgcagtggaactggggagtgagtagcagaccagaccctccatccgccgccatcctggtggtgtatctagacagagcccaggacttgcctctgaagaaaggaaacaaggagcctaaccctatggtgcaattatccatccaggatgttacgcaggaaagcaaggccgtgtactcaacaaactgcccagtctgggaggaagcttttcgattttttcttcaggaccctcagagccaggagctggacgttcaagtgaaggatgattcccgcgcccttaccctcggcgctttgactctacccctggccaggctgttgaccgcccctgagctaattctggaccaatggtttcaacttagcagctctggaccaaattctaggctctatatgaaattagtgatgcgtatactgtatctagacagctccgagatttgcttccctactgtacccggctgccccggtgcctgggacgtggatagcgagaatcctcagaggggctcaagtgttgacgctccaccacggccatgtcatactaccccggactcccagttcggcacagagcatgtcttgaggattcatgtactcgaagctcaggacctcatcgcaaaggaccggtttctaggaggcttagtgaaaggaaagagcgacccatatgtcaaactgaaactggccggtagatccttcagatcccatgttgttcgcgaggatttgaatcctcggtggaatgaagtgtttgaggtaattgtgaccagcgtcccggggcaggagctggaggtcgaagtgtttgacaaagacctcgataaggacgacttccttggcagatgtaaagtgcgccttaccaccgtactcaattcagggtttctggacgagtggctgacactggaggacgtcccctctggaagactccatctgcggttggagcgtctgactcctcgcccgacagccgcggagcttgaggaagtgctacaggtgaactctcttattcagactcagaagtcggccgagctggccgcagctcttttgagcatctacatggagagagccgaggacctgcctctccgtaagggaactaaacacctgagtccatatgccacactgaccgtgggggactcatcccacaagactaagacaataagtcaaacatcggctcccgtgtgggatgaatccgcttcgttcctcattcggaagccccacacagagtcgttggaactccaggtgaggggcgagggtaccggagtgctagggtccctgagcctgcccctgtccgagctgttggtcgccgatcagctgtgcctggatcgatggttcaccctttctagtggacagggccaggttcttctaagagcacagttgggaattcttgtatcccagcactcaggcgtcgaagcacacagccacagctactcccacagcagttcaagcctttcagaagagcccgagcttagcggaggtcccccccacatcacctcctccgctccggaactacgccagagactgactcatgtcgattcgccacttgaagctcctgctggaccactggggcaggtgaagctgactctgtggtactatagcgaggaaaggaaactggtctcgatagtgcacggctgccgctcacttcggcagaacgggagggacccccctgatccttatgtgtccctcttacttctgccagataagaatcgaggaacaaagcggaggacgtcccagaaaaagcgaactctctcacctgaattcaacgagcgatttgaatgggagcttcctctggatgaagctcagcgccggaaactggacgtttcagtcaaatcgaacagtagctttatgtcgcgagaaagggaactcctaggaaaagtgcagctggacctggccgagaccgacctctctcagggcgtagctaggtggtacgacttaatggacaataaagacaagggatcgtcatag

SEQ ID NO: 26098 - DNA, 3345 bp, Artificial Sequence
  Description of Artificial Sequence: Synthetic coding sequence
atggagagaagcccaggggagggcccatcccccagcccaatggatcaacctagcgctcccagcgatcctactgatcaaccgccggctgcgcacgcgaagccagatcctggctcgggagggcaaccagctggccctggggccgctggcgaagcacttgccgttctgactagcttcgggcgacgtttactcgtgctcatccctgtgtaccttgcaggagccgtcggcctaagcgtaggatttgtgcttttcggcctagccctatacctgggatggcggagggtgcgggacgaaaaagagcgaagcctgcgcgccgcgcgccagctcctcgacgatgaagaacagctgaccgccaagaccttgtatatgtcacaccgggaacttcccgcctgggtgagctttcctgacgtggaaaaggccgagtggctgaataaaatcgtagcccaagtgtggcccttcctgggtcagtacatggaaaaactgctggccgagaccgtagccccggccgtccgagggtcgaatccgcacctgcaaacctttaccttcactagggttgaactgggagagaaacccctcaggattatcggagtaaaagtccacccaggtcagaggaaagagcagatccttcttgatctgaatatctcatacgtcggagacgtccagattgatgtcgaggttaaaaagtacttctgcaaggctggagtcaaaggtatgcagctccatggagttctgagagtcatcctcgagccactgattggggatctgccgtttgtgggcgcggtgagcatgttttttattcgccgtccaacccttgacattaactggacaggcatgaccaatctgttggacatcccaggactgagtagtttgagtgatactatgataatggattccatcgccgcattcttggttctaccaaaccgcctgctcgtccccttggtgcccgacctgcaggatgtggcgcagctgagatcccccctgccacgagggattattcgaatccatttgctggcggccagagggctgtcttcgaaggataagtatgtgaaaggcctaatcgagggcaagtcagatccctacgcattggtgcgcctgggcacccagacattctgttcacgggtaattgacgaggaactcaatcctcagtggggtgagacttacgaggtgatggtgcacgaggtgcccgggcaggagatcgaggtggaggtttttgataaggatcctgacaaggacgattttttaggccgtatgaagctggatgtcgggaaagttttacaggcgtccgtgctggacgattggttcccactccaaggcgggcaaggtcaggttcatctccggctggaatggcttagtctgctgtcagacgctgaaaaactagagcaggtgctgcagtggaattggggggtcagctctcgaccggatccaccgagcgctgcgattttggtagtgtatctagatagggcacaggatcttccaatggtaacaagtgaattgtatcctcctcagcttaaaaagggaaataaagagccaaacccaatggtgcagctcagcatccaggatgttacacaggaatctaaggccgtctacagcacaaactgcccagtgtgggaggaagcatttcgattcttcctgcaagacccccagtcccaagaactggacgtccaagtcaaagatgactccagagccctgaccctgggcgccctgacgctaccattggctcggctcttaacggcccctgagctgattctggaccaatggtttcagctttcatcatcaggcccgaacagtcggctctatatgaagttggtgatgcgcatattgtacctggactcctccgagatttgttttcctaccgttcccgggtgtccaggggcttgggatgttgatagcgaaaaccctcaaagaggctccagcgtagacgccccgcctcgcccttgtcacacgactcccgacagtcagttcggcactgagcatgtgcttaggattcacgtactagaagcgcaggacctgattgctaaagatagattcctaggcggcctggtgaaaggaaaatccgacccctatgttaagctcaagctggctggccgaagcttccgctcccatgtcgtgagggaggacctgaatccaaggtggaacgaggtattcgaagtcatcgtgactagtgtaccaggccaggagttagaagtcgaagtcttcgataaggacctcgataaggatgacttccttggcagatgcaaggtgcggctgacaactgttctcaacagtggcttcctggatgagtggctcaccctcgaggacgtcccttcgggtaggctgcaccttagactggaaaggctgaccccaagacccactgccgcagaattagaggaggtgctccaggtcaatagtctcatccaaacccagaagagtgcggagttggcagcagcactcttgagtatctacatggagagggcagaggacctccccttacggaagggaactaaacacctgtccccatatgctactctcacagtgggtgactctagccataagaccaagactatatctcagacaagcgcccccgtatgggacgaaagcgccagctttctgattcgcaagccccacacagaatctcttgaattacaggtaaggggagaagggactggcgtactgggcagtttatccctccccctgtcagagctcctcgtggccgaccagctctgcctggataggtggtttactctgagctccggtcagggccaggtgttactgcgcgcacaactgggtatcctggtgtcccaacattccggcgtggaggcccactcacatagctacagccattcatccagctccctgtcagaggaacccgagttgagcggaggccctccacatataacatcctccgctccagagctgcgccagcggctgacacatgttgactcgcccctcgaagcccctgcagggccactcgggcaggtgaagctaaccctgtggtactattcagaagagcggaagctggtgtccatcgttcacggatgtaggagcctgcggcagaacggccgagatccccccgatccttacgtcagcttactactcttgcctgacaagaacagaggtaccaaacgcaggacttctcagaagaagcgtactctatctccagagttcaacgagcggtttgaatgggagctccctctcgatgaggcacagaggcgcaagcttgatgtgtcggtaaagtccaacagttcgtttatgtcacgcgaaagagaattgctcggtaaggtccaactcgaccttgctgagaccgacctgtcacagggggtcgctcggtggtacgatcttatggataacaaagacaaggggagtagttag

SEQ ID NO: 26099 - DNA, 2661 bp, Artificial Sequence
  Description of Artificial Sequence: Synthetic coding sequence
atgcgagctgaggaaccctgtgctcctggggccccaagcgccctgggtgcacagagaactccaggcccagagcttaggctgtccagccagcttctgccagagctatgtaccttcgtagtgagagttctgttttatttgggaccggtctatctcgccggatacctgggcctgtccattacatggctcctgcttggagcacttctatggatgtggtggaggagaaaccgacgtgggaaactgggtcgtctggctgccgcctttgaatttctcgacaacgaaagagagtttatttccagggagctccgaggacagcacctcccggcctggattcatttccctgacgtcgagcgggtggagtgggccaataagatcatctcccaaacctggccttacctgtctatgattatggagtcaaaattccgggagaaattggagcccaaaattcgcgagaagagcatccatcttagaacttttacgtttactaaactgtacttcgggcagaaatgtccccgcgtgaacggcgtgaaggcccacaccaatacctgcaatagaagaagggtgaccgtcgacctccagatttgctatattggcgattgcgagattagcgtagaactgcagaagattcaggcaggagtcaatggaattcagttgcaggggactttgagggtaatactggagcctctactggtcgacaaaccgtttgttggagccgtcactgtttttttcctgcaaaagcctcacctccagatcaattggactggcctcaccaatctattggatgctccagggattaatgatgtgtccgactctttgcttgaggatttgatcgcgacccatttagttttgcctaaccgagtgaccgtgccggtgaagaagggcctagatctgactaatctgcgtttcccactgccctgcggggtgatacgagtgcacctcctcgaagctgagcagctggcccaaaaagataattttttaggacttagggggaagtcggatccctatgctaaggtgtcgatcggactccagcacttccgcagcagaaccatctacaggaacttaaatcccacttggaatgaagttttcgagtttatggtgtacgaggttcctggtcaggatctggaagtcgacctctatgacgaggacaccgacagggatgacttcctggggagtctgcaaatttgtttgggggacgtgatgactaacagggttgtggatgaatggtttgtgcttaacgatactactagtgggagattacacctcaggctggaatggctttccttactgacagatcaagaagtcttgaccgaagaccacgggggcctgtcaactgcaatcctggtggtgtttctggagagcgcatgcaacctaccccgaaacccatttgattatctgaatggcgaatatcgagcaaagaagctgtcaaggttcgcccgcaataaagtgagcaaggatccatctagttatgtgaaactaagcgtaggaaagaagacacatacctccaagacctgcccgcacaataaagatcccgtgtggtcccaagttttcagtttcttcgttcataacgtggctacagagcgtctccacctgaaggtccttgacgacgatcaggagtgcgctctaggcatgctcgaagtgcccttatgtcagatactcccatatgcggatctcacactggaacagcgcttccaactggaccactccggcctggattccttgatttctatgagactggtgctgcggtttcttcaggtggaagagagagagttgggctccccgtacaccggaccagaagcgctgaaaaagggtccgctgttgatcaagaaagtggccacaaatcagggacccaaagctcagccccaggaggagggacccactgacctcccatgtcctcctgatcccgcctctgatacaaaagatgtatcacggagcaccaccacgacaacatccgcaacaacagtggctaccgagcccaccagccaggagacaggccccgagcccaagggcaaggactcagccaagagattttgtgagccgatcggtgaaaaaaagtcacccgccactatctttcttacagtccctggcccacattctccgggcccaattaaaagccccaggcctatgaaatgtcccgcctctccattcgcgtggccaccaaaacgactggcaccttctatgagctcactgaattccctcgcgtcctcctgtttcgatttggctgatatctccctgaatatagagggcggtgatttgcgaagacgacagctgggtgaaatccaactgactgttcgctatgtctgcctccgtcgttgcctcagtgtactgatcaacggctgtaggaacttgaccccgtgcacatccagcggtgctgacccctatgtgagggtctatctgctgccagagagaaaatgggcatgccgcaagaagacgtctgtgaagcgcaagaccttggaacctctgtttgacgagacgttcgagttctttgtccccatggaagaggtgaaaaaaaggagcctggatgtcgctgtgaagaactccaggcctctgggctcacaccgtagaaaagagctggggaaagtgctgatcgacctgtccaaggaagatctaattaaaggcttttcacagtggtatgaattgacacccaatgggcagccgcgatcttag

SEQ ID NO: 26100 - DNA, 2463 bp, Artificial Sequence
  Description of Artificial Sequence: Synthetic coding sequence
atgctgagattgggcctgtgtgcagcagcactcctgtgtgtgtgtcggcccggtgcagtcagggctgattgctggctgatcgagggggacaagggctatgtatggctggcgatctgctcccagaatcaaccaccgtacgaaacaatcccacagcatattaattcaactgtgcacgaccttagattgaacgagaacaaactgaaagccgtcttatactcctccctgaaccgctttgggaacttgacagatttgaatttgacaaaaaatgaaatttcctacatcgaggatggggcttttctgggacaatcttctttgcaggtgttgcagctgggatacaacaaactgagcaacctgacagaggggatgctgcggggcatgtctcggcttcagtttttatttgtccagcataacctaatcgaggtagtgactccgaccgcattttccgagtgcccatccctgattagcattgacctgagctctaaccgtctgagcaggctcgatggcgctacctttgcatctctggcgtcgttaatggtctgtgagcttgcaggcaacccctttaattgcgagtgtgacctgtttggcttcctggcctggctggtggtgttcaataatgtcactaagaattatgacagactgcagtgcgaatctcccagagaatttgctggctaccccctgctcgtgcctaggccctatcacagcctaaacgctatcacggttctgcaggcaaagtgtagaaacggcagcctccctgcacgaccagttagccatccaactccctattccacagacgcccagcgggagcccgacgagaatagcgggttcaacccagacgagatattaagcgtagaaccacccgcttcatctaccaccgatgcaagtgccgggcccgcaattaagctgcaccacgtaacgttcacctctgctactctcgtagttatcatcccacatccatacagcaaaatgtacatactcgttcagtataacaactcttacttcagcgacgtgatgactctgaagaacaaaaaggagatcgttaccctggataagttgcgggcgcacaccgagtacacattttgcgtcacatccctaaggaattctcgtaggttcaaccacacatgcttgacctttaccacccgcgatccagttcctggtgatctggcacccagcacatccacgacaacgcattacatcatgacaattttggggtgtctgtttggaatggtcatagtgctgggggcagtatattattgcctacgcaagcggagaatgcaagaggaaaaacaaaagtccgttaatgtgaaaaagacgatactcgagatgaggtacggagccgacgtcgatgctggaagcattgtgcatgccgcccagaagctgggcgagccccccgttctgcctgtgtcgcgcatggcgagcatcccctccatgattggcgagaaactgccaaccgccaaaggattggaagctggcttagatactccaaaagtggcgaccaagggaaattacattgaggttaggacgggggccggcggagacggactggccagacctgaagatgatttgcccgatcttgaaaacggtcagggctccgccgccgagattagcacgatcgctaaagaggtagataaggtcaaccagatcatcaataattgcatcgatgcacttaagctggacagcgctagctttctgggcggcgggtcttcaagcggagaccctgagctggctttcgaatgtcagtcattacctgcagcagccgccgcctcatctgccactgggccaggcgcactggaacggcctagctttctttcgcccccctataaggaatcatcccatcaccccctacagaggcagctgagtgccgacgctgcagtgactcgcaaaacctgcagcgtgtcatcttcaggaagtattaagagcgcaaaagtgttcagtttagatgtcccagatcatcccgcggcaacaggcctggccaagggcgactccaagtacatcgagaagggctccccactgaatagcccccttgacagactccccctcgtgcctgccggtagtggagggggttccggcggcggcggcggaattcaccacctggaggttaagccggcgtatcactgttcagagcacaggcactcgtttccagccctatactacgaagagggggccgactccctgagtcagcgagttagcttcctgaaaccacttaccagatcgaagcgagatagcacatacagccaactttcaccccgccactactattccggatacagttcttcgccggagtactcgtccgagagcacacataagatctgggaaaggtttcgcccgtacaagaagcatcatcgagaggaagtgtatatggccgccgggcatgccctgagaaaaaaggtacagttcgccaaagacgaggaccttcatgatatactggattactggaagggggtctccgctcagcagaagctatag

SEQ ID NO: 26101 - DNA, 2463 bp, Artificial Sequence
  Description of Artificial Sequence: Synthetic coding sequence
atgcttcgcctcggtctctgtgccgccgctctgttatgtgtgtgtaggcccggcgccgtcagggctgactgctggttaattgaaggcgataagggctacgtgtggcttgccatttgctctcaaaatcagccgccttacgagacaatcccacaacacatcaattcaacggtgcacgacttgcggctgaacgaaaacaaattgaaggccgtgctctattcttctctcaaccgatttggtaatctcacagacctcaacctgactaagaatgagatctcctacatagaggatggcgcctttctaggtcagagttccctacaggtgctgcaactcggttataacaagctttccaaccttacagagggcatgctgagaggaatgagccggctgcagttcctcttcgtgcagcacaatctcattgaagtcgttacgcccacagccttctctgaatgtccgtcactcatttccatcgacctatctagtaaccggttatctcggttggacggcgccacattcgctagtttagccagtctaatggtttgtgaactggcgggtaatccgttcaactgtgaatgcgatttgttcgggtttcttgcttggctggttgtattcaacaacgtgacaaagaattacgataggctccagtgtgaaagtcctcgagagttcgccgggtaccctctcctggtcccacgtccctatcacagcttgaatgcaattacggtgctccaggctaaatgtagaaatggatcccttccagctcgccccgtgtcccatcccacaccttactctactgacgcacagagggagcctgacgaaaacagcgggttcaaccctgatgaaatcctttcagtggaaccccccgcctcgtctactacagacgcatccgcgggtccggctatcaaactgcaccacgtaaccttcacctctgctacactggtggtcattattccgcacccttattccaagatgtacattctggtccagtataataactcttacttcagtgatgtgatgacactgaaaaataagaaagaaattgtgaccttagataaattgagggctcacaccgaatacactttctgtgtgaccagtctacgcaactcccgccgtttcaatcacacctgtctgaccttcacaacccgtgacccagtcccgggtgacctcgccccttccacctccaccacaacacattatatcatgacgattctcggctgcctctttggcatggtaattgtgctgggcgcggtgtactattgcctccgaaagcggcggatgcaagaggagaagcagaagtccgtgaatgtaaaaaagactattctggagatgcgctacggagccgatgtggatgccggcagcattgtgcatgcagcacagaagctgggagaaccgcctgtacttcctgtgtcacgcatggcctccattccttcaatgatcggagagaaactacctacagcaaagggactggaggctggtcttgacaccccaaaggtcgccaccaaggggaactatattgaggtgaggaccggcgctggaggcgatggattagcccgacctgaggatgaccttccagacctggagaacggacagggcagcgcagccgagattagcaccattgcaaaggaggttgataaggtgaaccagattatcaataattgcatagacgctttgaagctcgactccgcctcattcctcggcggcggatcttcgagcggggaccctgagctggcgtttgagtgccagtctcttcccgctgctgccgcggcaagctccgctactggccccggggccctggagcgccccagtttcctctccccaccatacaaggagagcagccatcatcccttacagagacaattgtctgctgatgctgcggtgacccgaaaaacttgtagcgtgtcgtcctcaggaagtataaagtccgccaaggtcttcagtctcgacgtcccagatcacccggccgctaccggactggctaagggggattcgaagtatattgagaagggatctcccttaaactctccgctagaccgtctgcccctggtaccggcaggatcaggaggaggatcgggcggcgggggagggatacatcacctggaggtgaagccggcctaccactgctctgaacatcggcatagtttccccgccctgtattatgaggaaggagcagattcactgtctcaaagggtgtcatttctaaagcctcttaccagatctaagcgagattcaacctattctcagctctcccccagacattactacagtggatatagctcctcaccggaatacagtagcgaaagcacccacaagatatgggaacggtttagaccttacaagaaacatcacagagaggaggtatatatggccgcagggcacgctcttcggaagaaggtgcagttcgccaaggatgaagacttacatgatattctcgactattggaagggggtatcagctcaacagaagctttag

SEQ ID NO: 26102 - DNA, 558 bp, Artificial Sequence
  Description of Artificial Sequence: Synthetic coding sequence
atggtgggccttagatggtggaatcacatagacgaagacgggaagtcacactgggtttttgagtcacgcaaggagagttctcaggagaataaaacagtctccgaggccgagtcccggattttctggttgggcctgatcgcatgttctgtgctatgggtcattttcgccttcagtgcgctgttttcgtttacggttaagtggctcgctgtagtgatcatgggcgtggttctgcaaggagccaatctctatggttacatccgctgcaaagtaaggtcccggaagcacctcacctcaatggctacgtcctatttcggaaagcagtttttgaggcagaggagaagtaggcacatcgctcagacagggctgaaagtcttgggctctcgcgatcctccagctagtgcctttcagagcgccgggatcactggtgtgtcacgatgccccggccatccatcgaggaagttccatcaggactcgcagaagacacttgacttccctggaagttaccttaaaaacatgacccccgggcggcccatgtctcccataccccttcgacagtag

SEQ ID NO: 26103 - DNA, 864 bp, Artificial Sequence
  Description of Artificial Sequence: Synthetic coding sequence
atgccccccctgtgggcgcttctggccctggggtgcctccgcttcggctcagctgtaaacctgcaacctcagctggcctcagtaacgtttgcaactaacaaccccacgctgaccactgtagctctggaaaaacctctatgtatgtttgactccaaggaggcccttacaggaacccatgaggtgtacctgtacgtcctggttgactccgcgattagccgaaacgcgtccgtacaggattcgaccaacaccccgctcgggtctacctttctacagacggaaggaggtcgtacaggtccttacaaagctgttgcgtttgacctaattccttgcagtgatctgccctccctggacgctatcggcgatgttagtaaagcttcccaaattctgaacgcttacttggttagggtgggcgcaaacggaacatgcctatgggatcctaatttccagggactgtgcaacgccccgctctccgccgccaccgagtatcgatttaaatacgtgctcgtcaacatgtcaacgggcctcgttgaggatcagacactctggtctgatccaatcagaacgaatcagcttactccgtatagcacaatcgatacttggccaggcagacggtcaggaggaatgatagtcattacctccattttgggctccctgccctttttccttctcgtgggctttgcaggtgcgatcgccctgagtctggttgatatgggaagtagcgatggcgagacaacacatgattcccaaatcacccaggaagcggtccccaagtcattgggagccagtgaaagctcctatacctctgtgaatagaggtccaccactggaccgagcggaggtctactccagcaagctccaggactag

SEQ ID NO: 26104 - DNA, 528 bp, Artificial Sequence
  Description of Artificial Sequence: Synthetic coding sequence
atgaaatacggtgtactgcatatacatgggctatacaccgatccgtgcggcgtggtattggatccctctgggtataaagacgtcacgcaggatgccgaagtgatggaggtgctccagaacctgtaccggacaaaaagctttctcttcgtgggttgcggagaaacactgagggatcagattttccaggctctgttcctttattcggtgccgaacaaggtggacctcgaacactacatgcttgtgcttaaggaaaacgaggaccactttttcaagcaccaggccgacatgcttctgcacgggatcaaggtggtaagctatggagactgttttgatcacttcccgggctatgtgcaggatcttgcaacccagatatgtaagcagcaatctccagatgcagatcgggtggacagcacgaccctgttgggaaacgcctgtcaagattgtgctaaacgcaaattggaagagaacggcattgaggtatcgaagaagaggacacagtcggacactgacgacgccggcgggtcgtag

SEQ ID NO: 26105 - DNA, 420 bp, Artificial Sequence
  Description of Artificial Sequence: Synthetic coding sequence
atggattccgtggagaaaacaaccaataggtctgaacagaagtcaaggaagttcctgaaaagccttatccgaaagcagcctcaagagctcttacttgtgatcggaactggagtgagcgcagccgtggcacctggaatcccagccctttgttcctggcgctcatgtatcgaggccgtgatcgaggcagcggagcaacttgaagtattacaccccggcgacgttgccgaattcaggagaaaggtgactaaggacagagacttattggtcgtcgcacacgatttgattaggaaaatgtctcctcggacaggagatgctaaaccctcatttttccaagattgcctcatggaggtattcgatgatttggaacagcacatcagaagccctgttgtgctgcagtcgatactctcattgatggactag

SEQ ID NO: 26106 - DNA, 1074 bp, Artificial Sequence
  Description of Artificial Sequence: Synthetic coding sequence
atggatagcgtggagaagaccacaaataggtctgaacagaaaagtagaaagtttctcaagagccttatccgtaaacagccccaggaactcttgctagtgatcggcaccggcgtatcggccgcagtagcccctggcatcccagctctatgtagttggagaagctgcatagaggccgtcatcgaagccgccgagcagctcgaagtccttcatccaggagatgtcgccgaattcagacggaaggtcacgaaagatagggacctgctggtcgtggcacacgacttgatccggaagatgagccccaggactggcgatgccaagccaagctttttccaagactgcctgatggaagtgtttgatgatctggagcagcacattcgcagccctgtggtgttacagtctatcttgagcctgatggacaggggcgccatggtgctaactacaaactacgacaaccttctggaggcatttggccgcaggcaaaacaagcctatggaatccctggatcttaaggataagacaaaggtgcttgaatgggcaagaggccatatgaagtacggagttctgcatatccacggtctctacacagatccctgtggagtcgtgttggacccttccggttataaagacgtgacacaggacgcagaggtgatggaggtcctgcagaacctgtaccgcaccaagtcatttctcttcgtaggctgcggcgagaccttacgggatcagatctttcaagctctgtttctgtacagcgtgcccaataaggtcgacctggaacactatatgctggttctgaaggaaaatgaagatcacttttttaaacaccaagccgacatgctccttcacggaatcaaggtggtgtcatatggcgactgtttcgatcactttccaggctatgttcaggacctcgcgacccagatctgtaaacagcagtctcccgacgccgaccgggtcgattcaacgacactgctgggtaacgcctgtcaggattgtgccaagcgaaaactcgaggagaatgggattgaggtaagtaaaaagcgaacccagtccgatactgatgacgccggcgggagttag

SEQ ID NO: 26107 - DNA, 822 bp, Artificial Sequence
  Description of Artificial Sequence: Synthetic coding sequence
atggaccctgtgcctggtaccgacagcgctcctctggccggattggcctggtcatctgcttctgcaccacccccacgtggcttttctgctattagctgcactgttgaaggggcgccagcctcattcgggaagagcttcgcccagaagagtggctattttctgtgcctttcttcattggggtcattagaaaacccccaagagaacgtcgtggcagatattcagatcgtggtggataagtctcccctaccgttggggttttcacctgtttgtgaccccatggacagcaaggcgtcggttagcaaaaagaaacgaatgtgcgtgaagttgttgccactgggcgcaaccgataccgctgtatttgacgtgcggctgtctgggaagactaaaactgtgccaggatacctgcgtataggggatatgggggggttcgctatctggtgcaaaaaagctaaagccccccgacctgtgccaaagccaagaggccttagcagggatatgcaggggctcagtttggatgctgcatcccagcccagcaaggggggactcctcgagaggacagcctcgagactgggaagccgagcatccacacttcggaggaatgactctatatacgaagcttcttccttgtacggtatctccgccatggacggggtgcctttcacgctccacccaagatttgaagggaaaagttgctctcctctagccttctctgcatttggggacctgacaataaagtcactcgcggacatagaggaagagtataattatgggttcgttgttgagaaaactgctgcagctcgactgccacctagtgtatcttag

SEQ ID NO: 26108 - DNA, 702 bp, Artificial Sequence
  Description of Artificial Sequence: Synthetic coding sequence
atggatccggtgcccggaactgactctgcgcctttggccggtctggcctggtcttcggcctccgctccgcctcccagaggattctctgctatttcgtgcacagtcgaaggggccccagcctccttcggcaaatcattcgctcagaagagtggctactttctctgtctatccagcctgggctctctagagaatccccaggaaaacgtcgttgcagacatccagatcgtggtggataaaagccctttacctctgggcttttcgcccgtctgtgatccaatggatagcaaggccagtgtgtcaaagaagaagagaatgtgcgtcaagctgcttcccctcggcgcaacggacacggcagttttcgacgtgaggttgtcaggaaagacaaaaacagtacctggctatctgcgcatcggtaaagggggactcctggagaggactgctagtagactgggatctcgtgcgtccacactccggagaaacgattccatttacgaagcctcctccctatatggcatctcagctatggacggagttccattcacacttcatccaagattcgagggtaaatcgtgcagcccgttggcatttagcgctttcggcgatttaactatcaaatcccttgcggatatagaagaggagtacaactacggctttgtagtggagaaaactgcagccgccaggctcccaccatccgtctcttag

SEQ ID NO: 26109 - DNA, 822 bp, Artificial Sequence
  Description of Artificial Sequence: Synthetic coding sequence
atggacccggtgccaggcaccgacagcgctcctctggcaggactagcctggtcttcagcgagcgcgccacctccacggggatttagcgcaatatcctgcacagtggaaggggcaccggcatccttcggtaagagctttgcccagaaatcaggctacttcttgtgcttaagctctttgggaagccttgagaacccccaggagaacgtagtggccgacatccagattgtggtcgacaagtcacctctcccgctcggcttctccccggtttgcgatccaatggacagcaaagcctcagtaagcaaaaaaaagcgtatgtgcgtcaagctccttccgctgggcgccacagacactgctgtgtttgatgtcaggctgagtggaaaaactaagaccgttcccgggtaccttcgcattggcgatatgggcggttttgcgatctggtgcaagaaagctaaagcgccaaggccagtcccgaagccgagaggcctgagccgtgacatgcagggcctcagcttggacgcagcgtcccagccgagtaagggaggcctattagagagaacagcctctcggctcggctcccgtgcttccacgcttcggcgcaacgactccatttatgaggctagttcactgtacggaatttcggccatggatggcgtgcctttcaccctgcacccccgctttgaaggaaaaagttgcagtccactagccttcagcgcatttggggaccttaccatcaagagcttagcagatatagaagaggaatataactacgggttcgtagtagaaaagacagcagccgctagacttcctccaagcgtgtcttag

SEQ ID NO: 26110 - DNA, 960 bp, Artificial Sequence
  Description of Artificial Sequence: Synthetic coding sequence
atgaggagctgcttttgtgttcggcgtagtcgagatcctcctcctccacagccacctcctccacctccgcagagaggtacagaccagtcaactatgcccgaagtgaaagacctcagtgaagctctgccagagacatctatggaccccatcactggtgtcggggtagtagccagtcggaacagagctcctacaggatacgatgtggtggcgcagaccgccgatggcgtggacgccgacctttggaaagatggactattcaaatctaaagttacacgatacctctgctttactagaagcttttctaaagagaattctcatctcggtaacgtcctggttgacatgaaactcattgacatcaaagatacgctgcctgtgggtttcatccctattcaggagacggtggacacacaagaagtggcgttcaggaaaaaacggctttgcatcaagtttatcccgagagatagcacagaagctgccatatgtgatattaggataatggggcggaccaagcaagccccaccccagtacacattcattggggaactaaattctatgggtatttggtacagaatggggagggtgcccagaaatcacgacagcagtcagcccacgactccatcccagagtagtgctgctagcacccctgccccaaatttgcctcgccacatttccctaactctccccgcaacattccgggggcggaacagtacgcggaccgattacgagtatcagcacagtaacctctatgctatttcggcaatggacggcgtcccatttatgatctcagagaagttttcctgtgtaccagagtccatgcagccattcgatctcctgggcattacaatcaagtccttagctgagatcgagaaggaatatgaatacagcttccggacagagcaatctgcagcagcgcggctgccgccctctccgacccgatgccaacagatcccccagagctag

SEQ ID NO: 26111 - DNA, 618 bp, Artificial Sequence
  Description of Artificial Sequence: Synthetic coding sequence
atggatacaggactgagttcccagccctccgaggaggaccaaagtacaatgccagaagtcaaggacctctccgaggccctgccggaaacgagtatggaccccatcaccggagtgggagtggtcgcttcaagaaatagggccccaaccggctacgatgtggttgcccagacagctgatggagtcgatgccgatttatggaaagacggtctctttaaatctaaagtgacacgctatctgtgcttcaccaggtccttttctaaggaaaactcgcaccttggtaatgttttagtcgacatgaagttaattgatattaaagatacattgccggtgggctttatcccgatccaggagacagtagatactcaggaagttgctttcaggaagaaacgcctctgtattaaatttattccccgggacagcactgaggctgccatttgtgacatcagaatcatgggtagaacaaaacaggccccacctcagtatacttttatcggagaattgaacagcatggggatttggtataggatgggccgagtccctcgtaaccacgatagctcccagcctaccactccttcccaaagctctgctgcaagcacacctgcgcccaacctcccctag

SEQ ID NO: 26112 - DNA, 915 bp, Artificial Sequence
  Description of Artificial Sequence: Synthetic coding sequence
atggatactggactatcctcccaaccttccgaggaggatcagagtaccatgcccgaggtaaaggatcttagtgaagccttgccagagaccagcatggaccctatcaccggagtgggggtggtggcctcacggaatagagctccaactggttacgatgtggtggcccagacagcagatggggtcgacgcggatctttggaaggacggcctattcaagagtaaagtaacgcggtatctttgttttactaggtcattctccaaggagaattcccacctggggaatgtgctcgttgatatgaagctgatagacataaaggacaccttgccggtaggttttattcccatccaggagactgtcgatacacaagaagtggcatttcgaaaaaaaagactgtgcatcaaatttatcccaagagatagcacagaagctgcgatctgtgatataaggattatgggccgcaccaaacaagctccaccgcagtacacatttatcggagagctcaattctatgggcatctggtaccggatgggtcgggtcccccgcaaccacgatagttcgcagcctaccactccaagccagagtagcgccgcctccacccctgcaccaaatctaccgcgtcatatatccttaacattgcccgccacgttcaggggtcgaaattcgactcggacagactatgaataccagcactccaacctctacgcaatttccgccatggatggggttccattcatgatttcggagaagttcagctgcgtcccagaaagtatgcaaccatttgatctcctgggcattacaatcaaatcccttgccgagattgagaaggagtacgaatactcttttcgcactgagcagagcgccgcggctcggttacccccatcccctaccagatgccagcaaattccccagtcatag

SEQ ID NO: 26113 - DNA, 645 bp, Artificial Sequence
  Description of Artificial Sequence: Synthetic coding sequence
atggaggcccctgcccacggactagagccctgcggatggggtgcttgttggttagtctgctatactgtaggcaggagagctggaagctggctacgcagctgggctggacccccatggcgtttccctgagacaaagccatctgttagtagcgtccaaggccgcaggctcgaggcacggcgcagagtcgcacaaaccgctgatggcgtcgatgccgatttgtggaaggacgggcttttcaaaagtaaagtgacccgatacctgtgttttaccaggagcttctccaaagagaatagtcacctggggaacgttctggtcgatatgaaactgatagatatcaaggacaccctaccggtgggattcatccccatccaggaaaccgtggatacccaggaagttgccttcaggaagaaacgactgtgcattaaatttattcctagggattcaactgaagctgccatttgcgatattcgaatcatgggccgaactaaacaggccccccctcagtatacatttataggcgagctgaattctatggggatctggtaccggatgggacgagtaccgcgaaaccacgattcctcccagcccactaccccgtcccagtcttcggccgcgtccactcctgcacccaacctccctcgctag

SEQ ID NO: 26114 - DNA, 666 bp, Artificial Sequence
  Description of Artificial Sequence: Synthetic coding sequence
atgcggtcgtgcttctgcgtgaggcggagcagggatccgcctcctccccagccaccccctccaccgccccagcgcggaaccgaccaatccaccatgccagaggtcaaggatctgtcggaggctcttcctgagacgtcaatggacccaatcactggtgttggggtggtcgcctcccggaatcgcgccccaaccggctacgatgtagtggctcaaacagccgacggcgtggatgctgatctctggaaggacggcctgttcaagagcaaggttactcgatacctgtgctttacccggagctttagcaaggaaaacagccacctaggcaatgtgctagtggacatgaaacttattgacatcaaggacacattgccagttggctttatccctatacaggaaacggttgacacacaggaggttgcattcagaaaaaaacgcctttgtattaagtttatacctcgggactctactgaagccgctatttgcgacattagaatcatgggccgcactaagcaggccccaccgcaatacacatttatcggggaacttaactcaatgggcatttggtatcgcatgggcagggtccctaggaatcacgacagctctcagcccacgactccctcacagagtagcgctgcatcaactcccgctcctaacttgccccgatag

SEQ ID NO: 26115 - DNA, 2787 bp, Artificial Sequence
  Description of Artificial Sequence: Synthetic coding sequence
atgggaggctccgcctctagccagttagatgaaggaaagtgtgcctatatccgaggcaaaaccgaagccgctatcaagaacttctcaccctactactcccgacagtactcagttgcgttctgtaaccacgtcaggacagaggtggaacagcagcgggatctaacttctcaattcctgaaaacaaaaccgccactagctcctggtacaatcctgtatgaagctgagttgagccagttctccgaagacatcaagaagtggaaagagcgttacgttgtcgttaagaacgactacgccgtggagtcctatgagaataaagaagcatatcagaggggtgccgcacccaagtgccggattctccccgctggtgggaaagtcctgacttcagaggatgagtacaatttgctctcggatcgtcacttccctgatcctttagcctcttccgagaaggagaatacacagcctttcgttgttctgccaaaagaatttccagtctatctgtggcagcctttcttccggcacggttatttctgcttccatgaggccgcagaccaaaagcgattttcagccttgctgagcgactgtgtaagacatctaaatcacgactacatgaaacagatgaccttcgaggcacaggcattcctggaagcggtgcagttcttccggcaagaaaaaggacactatggctcctgggagatgatcacaggagacgagattcaaatcttatctaatctggtgatggaagagttgctgcccaccctgcagaccgatctgttgcccaagatgaaaggcaagaagaacgaccgtaagagaacctggctcggcttgctcgaggaggcatatacactggtgcagcatcaggtatccgagggtctctccgcgctcaaggaagaatgcagggcactaacgaaggggctggaaggtaccatccgctcagatatggaccaaattgtgaattctaagaactatctgattgggaagatcaaggcaatggtcgcgcagccggccgaaaagagttgccttgaatcagttcagccattcctggcaagtatcttggaggagttgatgggtccggtcagtagtgggttcagcgaagtgagagtgttgtttgaaaaggaggtcaacgaagtctcgcagaatttccaaacaacgaaagattctgtccagcttaaggaacatcttgatcggctcatgaatctgccgctacactccgtgaagatggagccatgctacactaaggtcaatcttctgcacgagcgccttcaggacctaaagagtcggtttcggtttccccacattgatctggttgtgcaaaggacccaaaattatatgcaggaacttatggagaacgcagtctttacgttcgaacagttactcagccctcacctccaaggcgaggcttcgaagacagcagtggctatcgagaaagtgaaactccgcgtgttgaaacagtacgactatgattcctccaccatccgaaagaaaatattccaggaggccctggtgcaaatcactctgcccaccgtgcagaaagcgctggctagcacatgcaagcctgagttacagaagtatgaacaattcattttcgcggatcatacaaacatgatccacgtggaaaacgtttatgaggagatcctgcaccagatactactcgatgaaactctgaaagtgatcaaagaggctgcaatcctcaaaaagcacaaccttttcgaggacaacatggctctccctagcgagagcgtttcatctctgacagacctaaaaccgcccaccgggtctaatcaagcaagtcctgcccgccgcgcctcggccatcctcccgggggtgttgggctctgagaccctcagtaatgaggttttccaggagagtgaagaggagaaacagcccgaagtaccttcttccttggccaaaggcgagtcattatcactccctggccccagtcctccacccgacggcaccgagcaagtcattattagccgtgtggatgacccggtggtgaaccctgtggcaaccgaggacacggccggactccctgggacctgttccagcgaactggaatttggtggaacactggaagatgaggagccagcacaggaggaaccagagccaatcaccgcctctggaagcctaaaagctcttcgtaaacttctaacagcttccgtcgaggtgcccgtggattccgctcctgtgatggaagaagacacgaatggcgagtcccatgtcccacaagagaacgaagaggaagaggaaaaggaaccttctcaggcagccgctatacatcccgataattgtgaagagtcggaagtatcagagagagaggcccagcctccttgcccagaggcccatggcgaggagttagggggatttcctgaagtgggcagtcctgccagcccccccgccagtggaggtctgaccgaggaacctcttggcccaatggagggagaactgcctggggaggcttgtacactgaccgcacatgaaggacgcgggggtaaatgcactgaggaaggtgacgcgtcgcagcaggaagggtgtacgctaggttctgatccgatttgtctcagcgagagccaggtgagcgaagaacaggaggagatgggagggcagtcttctgctgcccaggctacagcatccgtcaacgccgaagagatcaaggtggcgagaatccacgaatgccagtgggtggtcgaagacgctcccaacccagacgttttactaagccataaggatgatgtcaaagaaggcgagggaggccaggaatcatttccggagttgccaagtgaggagtag

SEQ ID NO: 26116 - DNA, 303 bp, Artificial Sequence
  Description of Artificial Sequence: Synthetic coding sequence
taagccgtggccatcgagaaggtcaaactgcgtgtgttgaagcagtatgattatgactcatcaaccatacgaaagaaaatctttcaggaggctctggtgcagattaccctcccaactgtgcagaaggctctcgcatccacttgcaagcccgagcttcagaagtatgagcagtttatttttgcggatcataccaacatgattcacgtagaaaacgtgtacgaggaaattctccaccagatactactggatgaaacactgaaaggcgcttacattcctataaaatgcagtagcctgaagagttag

SEQ ID NO: 26117 - DNA, 1632 bp, Artificial Sequence
  Description of Artificial Sequence: Synthetic coding sequence
atggcttccggcggtggtggtggaaataccggtgcgggaggagggccgggcatgggcctctcgctcggcctgggcttaggactctcccttggaatgtccgaagccactagcgaggcagaagaggaggctgctactgctgaggctgtcggtcgacttgctacaaccctttggctgcggcttcgagggtgggaggctgtgttggccgctgctcaaagacttctggtttgggagaagcccctgcacagccttgtgaccgccgccgccctaaatggactcttctggctgctcagcagcagttcgctaaggccattcttcctgctgtccgtttctctgctcgcttactttctcctggatctgtggcaaccgagattcctcccggatgtcagtgcgagctctcccgaagaaccacactctgattcagaaggggccggctccggagcccgcccgcacctccttagcgtcccagagctgtgtcgatacctggctgagagctggttaacttttcagattcatcttcaggagctactccagtataagaggcagaacccagcccagttctgtgtcagggtgtgttcaggttgcgcggtgctcgcggtcctgggccattacgttccaggtattatgatcagttatatagttctcctctctatactgctatggccgcttgtggtctaccacgagttgatccaaaggatgtatacccggcttgagccgctgttgatgcagctggattatagtatgaaggccgaagccaacgccctacaccacaagcacgataagagaaaacgacagggaaaaaatgctccgccaggcggcgacgagcccctggcagagactgagtccgagtccgaggcggagctagcaggcttctccccagtggtggacgtgaaaaaaacagccctggcgctggccatcactgactctgaactgtcagacgaagaggccagcatcctggaaagcggcggcttctctgttagccgcgccaccactccccagttgacagacgtgtccgaggacctggatcaacagtcattaccttctgaacccgaagagacgttgtctcgggaccttggtgaaggagaagagggagagctagctcctcctgaagacttattaggccgcccgcaggccctgagcagacaagctcttgattcggaggaagaggaggaggacgttgctgcgaaagagactttactgagattaagtagccctctgcacttcgtgaatactcattttaatggtgcgggcagtccccccgatggagtgaagtgtagccctggaggccccgtcgaaacactctctccggaaacagtctccgggggtctcactgcactccctggcaccttgtcacctcctctttgcttagttggatctgatccggcaccatcccctagcatcttgccgcctgtgccccaagatagtccgcaacccctgcccgccccagaagaagaggaggcactaaccactgaagattttgaactgctggatcagggcgagctcgaacagctcaatgcagaacttggcttggagccggagacacctccaaaaccccctgatgcgcctccactcggcccagacattcactcactggttcagagtgatcaggaagcccaggccgtagccgaaccgtag

SEQ ID NO: 26118 - DNA, 906 bp, Artificial Sequence
  Description of Artificial Sequence: Synthetic coding sequence
atgatttcgtatattgttctgttaagcatcctgttatggcccttagtagtatatcatgagctcatccagcgcatgtatacccgtctcgagcctctcctgatgcagctggattactccatgaaagccgaagctaacgccctacaccataaacacgacaagcgcaagaggcagggaaagaacgcgccaccaggtggagacgaacctctggctgagactgagtctgagagcgaagctgaactggccggattttcgcccgttgtcgatgtcaaaaaaactgcactggcccttgcgatcacagattccgaactttccgacgaagaagctagtatcctggagagcgggggcttctccgtcagccgggctacaacgccacagttgaccgacgtgagtgaggatctcgaccaacagagcctaccaagtgaacccgaggagacactttcaagagatctgggagagggagaagagggtgagctggcgcctccggaagacttactcgggcgcccacaggcgttgagcagacaggctcttgatagtgaagaggaagaggaggacgttgccgccaaagaaactctcctccgactgtcctctcctctacacttcgtaaatacacacttcaacggagcagggagcccacctgacggagtgaagtgtagccccggcggtcccgttgaaacgctgtcacccgagacagacagcccacagccacttccggctcctgaggaggaggaagccttgactactgaagattttgagcttctggatcagggggagctggagcaacttaatgctgagctcgggctggaacctgaaacaccaccaaagccccccgatgcaccccccctagggccagatatccactctctggtccagtccgatcaggaggcccaagccgtcgccgaaccttag

SEQ ID NO: 26119 - DNA, 1401 bp, Artificial Sequence
  Description of Artificial Sequence: Synthetic coding sequence
atggccgaggctgagggggttcctacaactcctggaccagccagcgggagtacttttcgtggaagaagggacgtttctggctcctgggagagagaccaacaggtggaggcagctcagcgagcactggtcgaggtgttgggaccctatgaaccactcctgtcaagagttcaggccgccctggtgtgggagcgacctgctcgatcagcactatggtgtttggggctgaatgctgcattctggttctttgcacttacctcgctgagactcgtattcctcctagcctttgggctgatgatcatcgtttgcattgatcagtggaaaaataagatctggccagaaattaaggtgccccgcccagacgccctcgataatgagtcctggggctttgtccaccccagactgctgagcgtgccagagctgtgtcatcatgtcgccgaggtctgggtgagcggcaccatatttattagaaacgtcttgctatttaagaagcaaaaccccggcaagttctgcttgctctcttgcgggatcctgactttcctcgccgttcttggacgttacgttcccggcctgctgctctcctatttgatgctggtgacagtgatgatgtggcctctcgcagtttaccataggctgtgggatagagcctatgttagactgaaacctgctctacaaaggcttgactttagcgtcagggggtacatgatgtcgaagcagcgggagcggcagctaagaaggagagcactgcatcctgagcgtgccatggacaaccattctgacagcgaggaggaactggcagccttttgtccacagctggacgactcaaccgtagcaagagagctggcgattactgactctgagcactccgacgcggaggttagctgtaccgacaatgggactttcaacttaagccgtgggcaaacccctctgactgagggtagcgaggatctcgatggccactcagacccagaagagagttttgcccgggatctgccagattttccatcaatcaatatggatcctgctggacttgatgatgaagatgacacaagtataggtatgcccagcctgatgtacagatcaccacctggagcggaggaaccccaggctccacccgcctcccgcgatgaagccgccctgcctgagttgctgctgggagcgctgccagtgggaagtaacttgacctcgaatctagcctccctcgtgtcccaaggaatgattcagctcgctttgagcggcgcttcccagcccggccccagcggcgcgcctgctcagcgggcaacgaggggcttcctaaggtcacccagctcggatctggataccgatgctgaaggagatgattttgaactccttgatcaatccgaacttagccagttagaccctgcctcctcccgctctcactag

SEQ ID NO: 26120 - DNA, 816 bp, Artificial Sequence
  Description of Artificial Sequence: Synthetic coding sequence
atgctggtcaccgtcatgatgtggcctctggccgtataccaccgattgtgggatcgggcttatgtcaggctgaaacctgctctgcaacggttagacttctccgtaagaggatacatgatgtctaagcaaagggaacgccaattgcggcggcgtgccttacaccccgagcgcgccatggataatcacagtgattcagaggaagagttggctgccttctgccctcagctagacgactccacagtggccagggaactggccatcacagacagcgaacactctgatgctgaggtgtcatgtacagacaacggcacatttaacctgagccgcgggcagacccccctgactgagggttccgaagatctggacgggcactcggacccggaagagagctttgcccgcgatttaccggactttccaagcatcaatatggatcctgctggacttgacgatgaagacgacacatctatcggcatgccctccttgatgtacagatcaccccctggtgccgaggaacctcaagcaccacctgcctcacgagacgaggccgcactgcctgaactgctgctgggagccctcccggtgggctctaacctcaccagcaatttggcaagtctcgtgtcccaaggtatgatccagcttgctctctccggcgcatcacaacccgggcccagcggcgccccagcacaaagagcaacaagggggtttttacggagtccatcctcggatcttgacacagatgccgaaggagatgacttcgaactactcgaccagtccgaactttctcaactagacccagccagcagtcgctcacactag

SEQ ID NO: 26121 - DNA, 3960 bp, Artificial Sequence
  Description of Artificial Sequence: Synthetic coding sequence
atgaccgaggtgcaagccatggtcgagttctccgtggagttaaacaagttttataacgtggatctattccaaaggggattctatcagatccgagcatccatgaaaatcccatctcgaatcccgcacagggttgaggcgagccttctccacgccacggggatgacactcgcattcccagcgagcgtacacgatagtcttatctgcagtaaaacgtttcaaatcctgtacaagaatgaagaagtcgtcttaaatgatgtaatgatcttcaaggtgaaaatgcttctcgacgaacgaaagatagaagagactctcgaagagatgaatttcctgttatccctagatctacactttaccgatggagattattctgctgacgaccttaacgctctgcagcttatatcatctagaaccttgaaactgcatttctcaccacatcggggattgcatcaccatgtgaacgtcatgtttgactatttccacctgtctgtcgtatctgtaacagtgcatgcctcccttgttgcattacatcagccattaatatcctttcctagacccgtgaagaccacatggctgaaccgcaacgcgcctgcacaaaacaaggattcggtgattccaaccctggagtctgtcgtgtttggtattaattatacaaagcagttatcacctgatggctgctctttcattatcgccgactctttcctccatcacgcctatcgcttccactacaccctgtgcgcaaccctgctgttagcgttcaaaggcttacatagctatttcattaccgttactgaagagattccctcctgtcagaaactggaactcgaagaaatggatgtcgaagccagattgacggaactgtgtgaggaagtcaagaaaatcgagaatcccgatgagctagctgaactgatcaatatgaacctcgcacagctctgctcattactgatggccctgtggggccagtttcttgaagtgattacacttcacgaggagttaaggatcctgctggcccaggagcaccacacgctcagagtgagacgtttttcagaagcatttttctgtttcgagcatcctcgtgaggcggctatcgcataccaagagctgcatgctcagtctcacctccaaatgtgtaccgccattaaaaatacgtcattctgtagttcactcccccctcttcccatcgaatgctccgagctcgacggtgacctgaattccctccctattatttttgaggataggtacctggacagcgtaacggagggcaagctcgacatctcccaagacgatagtgagattactcagatggaacacaacctggctagtcggaggagcagtgatgactgtcacgaccatcagactactcctagccttggggtgcggaccattgaaataaagccctcaaacaaggaccccttttctggggaaaatataaccgtgaaactcgggccttggactgagcttcgacaagaagagatactagtcgacaatctcttgcccaacttcgagtcactcgaatcaaatggcaaatccaaatcaatagagattacgttcgaaaaggaagcactccaagaagcgaaatgtctgtccatcggggaatctctgacaaagctgaggtccaacttgcctgctcccagcaccaaggaatatcacgtggtggtgtctggagatacaattaaactccccgatatcagcgcaacatacgccagctcacgcttttcagacagcggggttgagagtgaaccctcttcttttgcaacacacccaaacactgacctggtgttcgagacagtccaggggcagggcccctgcaacagtgagcgattgtttccacagctgctcatgaaacctgactacaacgttaaattcagcctcggaaaccattgtaccgaatctacctctgctatctctgagattcaatctagcctcacctcgatcaactccctaccttctgacgatgaattatccccagacgagaactcaaagaagtccgtcgtacctgaatgtcacctgaatgattccaagactgtgctaaaccttggcaccaccgatttgcctaagtgcgacgacactaaaaagagctccattactcttcaacagcagtcagttgtgttcagcggaaacctggacaacgagactgtggccatccatagcctgaacagcagcatcaaggatcctctacagtttgtgttcagcgacgaagagacctctagtgatgtgaagtcatcatgttcctcaaaacctaacttggacaccatgtgcaaaggctttcagtcacctgataaatccaataactcgacgggcaccgccattaccctgaattccaagctgatctgcctcggcacaccctgtgtcattagcggctctatttcaagcaacacagacgtctccgaggatcggactatgaaaaaaaattccgacgtgttaaatttaactcaaatgtattcagagatccccactgtggaatcagagacacacctgggaactagtgaccctttctcagccagcactgacattgtaaaacagggattagtagagaattattttggctcacagagttctactgatatctcagacacatgtgcagtgagctattccaatgctctcagtccccagaaagagacgtcagagaaggagatcagtaatctccagcaggaacaggacaaggaggacgaagaagaggagcaggaccagcaaatggtgcagaacgggtattacgaagagacggactactccgcactggacggcactataaatgcacattacacctcccgcgatgaattaatggaagaacgccttaccaaaagtgagaagatcaattccgattacttaagagacggtatcaatatgcctacagtgtgtaccagcgggtgtttgtctttcccaagtgcgccccgggaatccccctgcaacgtgaaatactcaagtaagagtaaattcgacgcaattactaaacagcctagctctacatcctacaactttacgagctccatttcctggtatgaatctagtccaaaaccccagatccaggcctttctgcaggcaaaagaagaactgaaattactaaagctaccaggtttcatgtatagcgaggtgcccctattggcctctagcgttccatatttctccgtggaggaggaagatgggagcgaggacggggtgcatcttattgtctgcgttcacggtctcgatgggaattcagccgatctgaggcttgtcaaaacatacatagaactgggcctgccaggtggccggattgactttctcatgtcagaacgcaaccagaacgatacattcgccgacttcgattcaatgacagatagactcttagatgagattatccagtacatccagatctactccctgacggtatcaaagatctccttcattggccactccttaggaaaccttatcatccgtagcgtcctgacaaggccccgatttaaatactacctaaacaaattgcacaccttcctatcactgtcggggcctcacctgggcaccctgtataattccagtgccctcgtgaacacagggctgtggtttatgcagaaatggaagaagagtgggagcctcctgcaattgacctgccgggaccactccgatccccgccagacattcctgtataagttgtcaaataaggccggactgcactattttaaaaatgtggtcttggtgggcagcttgcaggaccgttacgtgccctatcattcggcccgaatagagatgtgtaagaccgcattgaaagacaagcagagcggccagatctacagtgagatgattcacaatttgctgcggccggtgctccagtccaaggactgcaaccttgtgagatataacgtaattaacgcacttcctaacactgctgactccttgatcgggagggcagctcacatcgcagttctggacagtgagatcttcctggagaagttttttctagtcgctgccttgaagtattttcagtag

SEQ ID NO: 26122 - DNA, 3909 bp, Artificial Sequence
  Description of Artificial Sequence: Synthetic coding sequence
atgaccgaggtgcaggcaatggtcgaattttccgttgagctcaataaattttataacgttgatctgttccagcgggggaagactttccagatcctgtataagaacgaagaagtggtgctgaatgacgtcatgattttcaaggtgaaaatgctgctcgacgagagaaagatcgaagagacgctcgaagaaatgaatttcctgctgtctctggaccttcactttacggatggcgattattctgctgacgacctcaatgccctccagctgattagttccaggacactgaaactccatttctcccctcataggggacttcaccaccatgtgaacgtgatgttcgactatttccacctctcagtggtaagtgtgaccgtccacgcaagtctcgtcgcgctccatcagccacttataagcttccctcgaccagtcaaaactacctggttgaaccgcaacgccccagcccagaataaggattcagtcatacccaccctagagtccgtggtgttcggcataaattatacaaagcaactgtccccggatggctgcagtttcatcattgctgatagttttcttcaccacgcctatcggttccactatacattatgcgctacactcctgctggcattcaaaggacttcatagttacttcattaccgtgaccgaggagatccctagctgccaaaaactggagttggcgaaggcaaacatgcaactcctgtacgaacgactcttgaggcgaaaacagctgcgcacccagaaagataaccacctggaagagatggatgtagaggcacgcttaaccgaactgtgcgaggaagtaaagaaaattgagaaccccgatgagctggcagaactgatcaatatgaacctcgcccagctgtgctcactcttaatggctctatggggacagtttttggaagtgataaccctgcacgaggaactcagaattttgctcgcacaggaacaccacacactgcgagtgcgcagatttagtgaggccttcttttgctttgagcatcccagggaagccgctattgcttaccaggagctgcatgcgcaatcccacctacagatgtgcacagctatcaaaaatacgtcattctgttctagcttacctcctttacccatagaatgttcagagttggacggggatctgaactcgctgcccattatctttgaggaccggtacctggattcagtaactgagggtaagctggacatttcccaggacgactcagagatcacacaaatggagcataatcttgcctccagacggagctcggacgactgtcatgaccatcagacaacgcccagcttgggtgtgagaactattgagattaaaccctcgaataaagatcccttttctggagagaatatcacggtaaagctggggccctggaccgagctccgtcaagaagagatacttgtggacaacctcctgcctaacttcgagagtctggagtctaacggcaagagtaagtccattgaaatcacctttgaaaaagaagctctgcaggaggctaagtgccttagcatcggagagagcctgaccaagcttcgttcaaacttgccagcaccctctacgaaggagtaccacgtcgtggtcagcggggatacaataaagctacctgatatcagcgctacttatgcttccagccgcttcagcgatagcggagtagagtctgagccgagttcattcgctacacacccaaataccgacctggttttcgaaacggtccaggggcaggggccttgtaattccgagaggctctttcctcaattgttaatgaagccagactacaatgtcaaattcagcctggggaaccattgcacagagtcaacgtcggctatttctgagattcagagttctcttactagcatcaactcattgccatccgatgacgaactgtctcccgatgagaacagcaaaaaatccgtcgtccctgagtgccatctcaacgacagcaagacggtgctgaatttgggaactactgacctaccaaagtgcgacgacaccaagaagagcagtattacgctccagcagcagtcggtggttttttctgggaatctggacaacgaaacggtggctatccactcgcttaattcctcaatcaaggacccactccaatttgtgttttcggatgaagaaacatcctccgatgtcaagtccagctgctcctcaaagccgaacctagatactatgtgtaaggggttccagtctcccgacaaatctaataactctaccggcacagcaattacactaaactctaagttgatttgtctgggcacaccatgcgtgattagcggttccatcagctcaaataccgacgtcagtgaagaccgcaccatgaagaaaaactctgacgttttgaatctcactcagatgtattccgagattcctacggtggagagtgaaacccacctcggcacctctgatcccttctcagcctcaaccgacatcgtgaaacagggtctggtggagaactacttcggctcccagtcatccactgatatctccgatacctgcgccgtcagttacagtaatgccctctccccacagaaggaaacatccgagaaagaaatttccaacttacagcaggagcaggataaagaggacgaggaagaggaacaagatcagcagatggtgcaaaatggatactacgaggaaaccgactacagcgccctcgatggaacaatcaacgctcactacacatccagggatgaactcatggaggagagactgactaagagtgagaagatcaattctgactacctgcgagacggcataaacatgccgactgtctgtactagtggctgtctgtcttttccctctgccccgagagaatcgccctgcaatgtgaagtactcgtccaaatcaaaattcgacgccattacaaaacagccgagttccactagttataacttcacttcctcaattagctggtacgaatcttcaccgaaaccccaaattcaggccttcctgcaggctaaagaggagctcaagctgttgaagttacctggctttatgtattctgaggtgcccttgcttgcatcttccgtgccttatttctctgtggaagaggaggacgggtcggaggatggggtgcacctcatcgtgtgcgtccatggactggatgggaatagtgccgatttaagactagtgaaaacctacattgagttgggactgcccggcggacgcatcgactttctcatgtcagaaaggaaccagaatgacactttcgcagattttgacagcatgaccgacaggctgctagacgagatcatccagtatatccagatctactctctgactgtgagcaaaatcagcttcattgggcacagcctgggcaacctgattatcaggagcgtgcttactcgtcccagatttaagtactacctgaacaagctccatacgtttctctcactaagcggaccccacctcggcacgttatataatagctcagcacttgtcaataccgggctgtggtttatgcagaaatggaaaaagtccggctctttgttgcagttaacctgccgcgaccattctgatccacggcagacattcttatacaaactttccaataaagctgggctgcactactttaaaaacgtggtactcgttggctctctgcaggaccggtacgtcccctatcacagtgctcggatcgagatgtgtaaaacggctctcaaggacaagcagagtggtcagatatactctgaaatgatccataacctgttgagacccgtgctgcagagtaaggattgcaacctcgtgcgctacaatgttataaatgcactcccgaatactgcagatagtttgatcggacgcgcagcacacattgctgtcctagatagtgaaatctttctagagaagttcttcctggtggctgccctgaaatatttccagtag

SEQ ID NO: 26123 - DNA, 4548 bp, Artificial Sequence
  Description of Artificial Sequence: Synthetic coding sequence
atgacagaggttcaagcaatggtggagttctcggttgagctgaacaagttctacaatgtggatctgttccagcggggcttctatcagatccgagcaagcatgaagatcccatctcgtatccctcatcgggtcgaggctagtctattgcatgcgactgggatgaccctcgcatttcccgcctcagtgcatgactccctgatctgtagcaaaacgtttcagattttgtacaagaatgaagaagtcgttcttaacgacgtgatgatcttcaaggttaagatgttgcttgacgaaaggaagatcgaagaaacgcttgaggagatgaacttcctgttatcgctggaccttcactttactgacggtgattatagtgctgacgatctcaatgcactgcagttgatctcctcacgaaccctgaaactacacttctctcctcataggggattgcaccaccacgtgaacgtaatgtttgactacttccacctgtctgtggtgtctgtgacggtacacgcttcactcgtggcactgcaccagcccctgatcagcttcccacgacctgtgaagacaacgtggttaaaccgaaatgctcccgcccagaacaaggatagcgtgatacctacacttgagagcgtggtgtttggaatcaattacactaagcaactaagtcccgacggctgcagcttcataatcgctgacagttttttgcatcatgcatatagattccactataccctgtgcgctacactactgttggcctttaagggactacattcttattttattaccgtgacagaggagattccatcttgccagaaattggagttagaggagatggacgtggaagctcgactgactgagctctgtgaggaggtaaagaagattgagaatcccgacgaactcgccgagcttattaatatgaacctcgcccagctttgcagcctactgatggcactttggggacagttcctggaagttatcacactccacgaggaactgcggattctccttgctcaggagcaccatactctgagagtccgacgcttttctgaggcattcttttgtttcgaacacccaagagaagctgccattgcatatcaggagctgcacgctcagagtcatctccaaatgtgtacggctatcaagaataccagcttttgcagctccctgccacctcttcccatagagtgcagtgagctggacggggatttgaactcccttcctattattttcgaagaccggtatctcgatagcgtcacagaggatctggacgctccctggatgggcatccagaaccttcaacgtagtgaaagctcaaaaatggacaaatatgaaacagaggagtcctctgttgccgggttatcctctcccgaactgaaggtgcgtcctgcaggggccagctccatttggtacactgagggagaaaagcagttgacaaaaagcctgaagggaaagaacgaggagagcaataaatctaaggtaaaggtcacaaagctcatgaaaactatgaaatctgagaatacgaagaaactgatcaaacagaactctaaggattcagttgtcttggtcggctataagtgcctgaagagcaccgccagtaacgacctgatcaagtgttttgagggaaacccaagccacagccaaaaggaaggcctagaccctaccatatgtggctacaacttcgaccccaagacttacatgcggcagacatctcagaaagaagcaagttgcctgcccactaatacagagcgcacagagcagaaatcgccagatatagagaatgtccaacctgaccagtttgatccccttaattcaggcaacttgaacctgtgtgccaatctgtctatcagcggcaaactggatatctctcaagacgatagtgagataacccaaatggagcataaccttgcatctcggaggtctagtgatgactgtcatgaccaccagaccacccctagcttgggggttcgtacgatcgagattaagccttcaaataaggatccctttagtggagaaaatattactgtgaagcttggcccatggacagaactaaggcaggaggagattttggtggataatttacttcctaatttcgagtcactcgagagcaatgggaaatccaagtcaatcgagatcacctttgaaaaggaggccctgcaggaggcaaaatgcctgtccatcggggaatccttgacaaagttgcggtctaacttgcccgctccatcaactaaggaataccatgtagtcgtgtcaggagataccatcaaactgcctgacatttcagccacatacgccagctcacgctttagcgactctggcgtcgagagtgagcctagctccttcgccacacatcccaacacagacctggtttttgagaccgtgcaggggcagggcccctgtaattcagagaggcttttcccacaattgctaatgaagccggattataacgtgaagttttctttgggcaatcactgcaccgagagcacgagtgcaataagtgagatacaaagtagtctcacatccatcaacagcttgccatccgacgatgagctgagccccgatgaaaatagcaaaaagtccgtcgtccccgagtgtcatctgaacgattctaaaaccgtgctcaacctgggcacgacagatctgcccaagtgcgatgacacaaagaagtcttcaataacgctgcagcagcagtcagtggtctttagcgggaatctggataatgagacagtagcaattcactcactgaacagctcaatcaaagaccccctacagtttgtgttcagcgacgaggaaaccagctccgatgtgaaatcctcctgtagcagtaaaccaaacctggataccatgtgcaaagggttccagtccccggataagtctaataactccacagggaccgccataacactcaactccaagttgatctgcctgggcaccccctgtgtgatctcagggtccatctcatcgaacaccgatgtcagcgaggaccgtacaatgaagaaaaactctgatgtcttgaacttgactcaaatgtactcggagatacctaccgtggagagcgagacccacttgggcacatcagacccgttttcagccagtacagatattgtgaagcagggccttgtggaaaactacttcggctcccaatcctccactgacattagcgatacatgcgcagtctcttactctaatgccctgtccccccagaaagaaacttcagaaaaggagatttcaaatctccagcaggaacaggacaaggaagatgaagaagaagaacaggatcaacagatggttcagaatggctactatgaagagacggactatagcgcactggatggtacaattaacgctcactacacaagtcgagatgagctgatggaagaacgcctaactaaatccgaaaagatcaacagcgactatttacgtgacggtatcaacatgcctacagtgtgcacctccggttgtctcagctttccctctgccccacgcgagtctccttgtaacgttaagtatagctcaaagtcaaagttcgacgctatcaccaaacaaccctcttctacgtcttacaatttcaccagttcaattagctggtacgaatcctcccctaagccacaaattcaggctttcctccaggctaaagaagagctgaaactgctgaagctacctggatttatgtactcggaggtaccccttctggcgtcaagcgtgccttatttcagcgtagaagaggaggacggctccgaagacggggtgcatctcatcgtgtgtgtgcacggtctcgacggcaattctgctgacctgagactcgttaaaacgtacattgaactgggtctaccgggcgggcggattgactttctaatgtctgaacgaaaccaaaacgatacctttgccgattttgactcaatgactgaccgattgctcgatgaaataattcagtatatccaaatatactcactgaccgtatctaaaattagttttatcggacactctctcggtaatctcataatacggtcagtacttacccgtccgcgcttcaaatattatcttaataaactgcataccttcctgtccttatctggcccccacctggggacactgtacaactcctcagctctggtaaacacaggtctatggttcatgcagaaatggaagaaatccggatccctgcttcaattgacatgtcgggaccatagtgatccacgccaaacctttctatacaagctatccaataaggcaggcctgcattacttcaagaacgtggtactcgttggctccttacaagatcgctatgtgccctaccactccgccagaattgagatgtgtaagactgcacttaaagataagcagtctggccagatatattctgagatgattcataatctgctgcgtccggtgcttcagtcgaaggattgtaatctggtgagatataacgtgataaacgcactcccaaataccgccgattcactgatcgggagggctgcacacatagcagtgctggactctgaaatcttcctggagaagtttttcctcgtggctgctttgaaatattttcaatag

SEQ ID NO: 26124 - DNA, 3909 bp, Artificial Sequence
  Description of Artificial Sequence: Synthetic coding sequence
atgactgaggtgcaggccatggtagaattcagcgtggagctcaataagttttataacgtcgacttgtttcagagggggaaaacgtttcaaatactgtacaagaatgaggaggtagtgcttaatgatgtcatgatcttcaaagtgaaaatgctcttggatgagcggaagattgaggagactctggaagaaatgaatttcttgctcagcctggacctccatttcacagatggtgattactcagcagacgatctcaatgcgctccagttgataagtagcaggacgctgaagctacatttctctcctcaccggggcctgcatcatcacgtgaatgtgatgttcgattacttccacctgagtgttgtttcagtgaccgtacatgccagcttggtggctctgcaccagcctctgatatcattcccccgaccagttaagactacttggcttaaccgcaatgctcctgcacagaataaagactctgttattccaactcttgaaagtgtcgtgttcggcatcaactacaccaagcaattaagtcctgacggctgctccttcatcatcgccgattcattcctgcatcatgcttataggtttcattacactttgtgcgcaaccctgctcttggcatttaaagggttgcacagttacttcattacagttaccgaagagatccccagctgccagaagctggaactagccaaggcaaatatgcaactgctatacgagcgactcctgaggcgcaagcaattgcgcactcagaaggacaatcacctcgaagaaatggacgtggaagctaggctgaccgaattgtgtgaggaggtgaagaaaatcgaaaacccagacgaactggccgagttgataaacatgaatttagcccagttgtgctctctgctcatggctctttggggacagttcctcgaggtgatcacgttacacgaggaattacgcatactgttggctcaggagcaccataccctgcgggtgcgccgattttcagaagccttcttctgtttcgagcatcctcgtgaagctgcaattgcttatcaggaactccatgctcagagccacctccagatgtgcaccgccatcaaaaacacatcattctgctcttctctgccccccttacctattgaatgtagcgagttggacggcgacctgaactctctccccatcatctttgaggatcggtatttggatagtgtgacagagggtaaactagatatctcccaggacgattccgaaatcacacagatggaacataacctcgccagccgcagatcatcagacgactgtcacgaccaccaaacaacccctagtctcggagtgcgcaccatagaaattaagccctccaacaaagacccattctccggcgaaaatatcaccgttaagctgggtccctggacggaactaaggcaggaagagattctcgtggacaatcttctgccaaattttgaatctctggaaagtaatgggaagtctaagagcatcgaaatcacatttgagaaggaggcccttcaggaagcaaagtgtctgtcaattggggaaagtttgactaaactgcgctccaatctccccgcccccagcaccaaagaatatcacgtcgtggtgtccggcgacactatcaagctaccagatatcagtgcgacttacgcctccagccggttcagcgactcgggtgttgagagtgagccctctagctttgccactcatccaaataccgacttagtgttcgaaactgttcagggccaggggccttgcaactctgaaagactttttcctcagctccttatgaagcctgattataacgttaagttttcccttggaaaccactgcaccgagtccacaagcgctattagcgaaatccagagttctctgacttctatcaatagtttgccttcagacgacgagctcagccccgatgagaacagcaagaaatctgtagtgcccgagtgccacctcaacgattcgaagactgtgttgaatctggggaccactgacctgcctaagtgtgacgacacgaagaaaagctcgattacattgcagcagcagtccgtcgtttttagcggtaatcttgacaatgagactgtcgccattcattccttgaattctagcattaaggatccattgcagtttgtcttcagtgacgaagagacctcaagtgacgttaagtcatcttgttccagcaagccaaatctggacactatgtgcaagggcttccagtccccagacaaatctaataactcaactggaaccgcaattacattgaacagtaaactcatctgccttgggacaccctgcgtgatctctggctccataagctccaatactgacgtcagtgaggaccgaactatgaaaaaaaacagtgacgtgcttaatctgacacagatgtactccgaaataccaacagtggagtctgaaactcacctgggtacctcagatccttttagcgcatccacagacatcgtgaagcagggtcttgttgagaactatttcggctcccagagtagcaccgacatctctgatacttgcgcggtgagctactcaaatgcactttcaccacagaaggaaacctctgaaaaggaaatcagcaacctccagcaggaacaggataaggaggacgaggaagaggagcaggaccaacagatggtccagaacggatactatgaggagactgactattctgcccttgacggcaccattaatgctcactatacctcgcgcgatgagttgatggaagagcggttgacaaaatcagagaaaattaatagcgattacctgcgcgacggtataaatatgcctacggtgtgtacatctggatgcttgagcttcccgagcgcccctcgtgagagtccttgcaacgtgaaatatagcagcaaaagcaagttcgacgctatcacaaagcagccgtcatcaacctcctacaatttcacctctagtataagttggtatgagtcttcccccaaaccacagattcaggcgtttctgcaagctaaggaggagctgaaattgctgaagttaccgggctttatgtactctgaagttccactccttgcgtccagcgtcccatactttagcgttgaagaagaggacgggagtgaagatggggttcaccttatcgtgtgcgtccatggcttggacgggaatagcgccgatctgcggttggtcaaaacctacattgaactcggacttcctggcggcagaatcgactttctgatgtccgagcgcaaccagaacgatacatttgccgatttcgacagcatgaccgataggttattggatgagatcatccaatatatccaaatctacagcctgacggtatccaaaatcagcttcattggacatagtctcgggaatcttatcattaggtccgtattgacacggccacgttttaagtactacctgaataagctgcatacctttttgtccctgagtggcccccatcttggaacgctgtataatagttcagcattagtgaacacgggcttgtggtttatgcagaaatggaaaaaaagtggatctttgttgcagttgacttgtagagaccattctgacccgagacagactttcttgtacaaactctccaataaagcgggccttcactacttcaaaaatgtggttcttgtcggcagcttgcaggaccggtatgttccctatcactcagccaggatagaaatgtgtaagacggctctcaaagataaacagagcgggcagatctacagtgaaatgattcataacttgctgcggcccgtgctccaatcaaaggactgcaacctagtgcgatacaacgtgatcaacgccctccccaacacggccgattctctcattggcagagcggctcacatcgctgttctggattccgaaatatttctggagaaattttttctcgtagccgcattgaaatacttccagtag

SEQ ID NO: 26125 - DNA, 153 bp, Artificial Sequence
  Description of Artificial Sequence: Synthetic coding sequence
atgacggaggtccaggccatggttgagttctcggttgagctgaacaagttctataatgttgatctgttccaacgggggttctatcaaatccgggcgtcaatgaaaataccctctagaatcccccatcgggttgaggcaagcctgttacattag

SEQ ID NO: 26126 - DNA, 96 bp, Artificial Sequence
  Description of Artificial Sequence: Synthetic coding sequence
atgaccgaggttcaggctatggttgaatttagcgtggagctcaataaattttacaacgtggacctctttcaacgcggattctaccaaattcgatag

SEQ ID NO: 26127 - DNA, 1518 bp, Artificial Sequence
  Description of Artificial Sequence: Synthetic coding sequence
atgactgaggttcaggccatggtggaattttcagtggaactgaataagttttataatgttgacctgttccagagaggtttctaccagattagagcctctatgaaaatccctagtcgcatcccccaccgcgtggaagcaagtctgttgcacgcgacaggaatgaccctcgccttcccggcttctgtgcacgacagcctcatctgctccaaaacttttcaaatcttgtacaagaacgaggaggtggttcttaacgacgtgatgatcttcaaggtgaaaatgctgttagacgagagaaaaatcgaggaaactctggaggagatgaattttttgttgtctctcgatttgcactttactgatggagactactctgcggatgacctcaacgcgttgcaactgattagtagtagaaccttgaagttacacttttctccacatcgagggctgcaccatcatgtgaatgtcatgtttgattacttccatttgtccgtagtcagtgtgaccgttcatgcctctctcgtggccctgcaccaaccgcttatctcattccccaggccagtgaagacaacatggcttaacaggaacgccccagcacagaacaaggacagcgtcatccctactctcgaatctgtggtttttgggattaactacacaaagcagctgagtcctgatggctgttcattcatcatcgcagattctttcctgcaccacgcatataggtttcattacactctgtgcgccactctcctactcgcatttaaaggccttcattcatacttcattaccgtaactgaagaaataccatcttgccaaaaattagaactcgaggagatggatgttgaggccagactgacagaattatgtgaggaagtcaagaaaatcgaaaatcctgacgaactggccgagttgatcaacatgaacttggctcagctctgctcgctcttaatggcattgtgggggcagttccttgaggtgatcactctccatgaggagctgaggatcctacttgctcaggagcaccatacgctcagagtacggcggttctccgaggcattcttttgttttgaacacccgagagaggccgcaattgcctatcaagagctgcacgcacaatctcatctgcagatgtgcaccgcaataaagaacacttccttctgtagttccctgccaccgctaccaattgagtgcagcgaattagatggggatcttaattccctgccgataatttttgaagaccgctatttagacagcgtgaccgaagacctcgatgccccttggatggggatccagaaccttcaaaggtccgagagtagcaaaatggataagtacgagacagaggagagtagtgtcgccggtctctcgagtccagaattaaaggttcgccccgcaggagcgtcctccatttggtataccgaaggtgagaagcagctgacaaagagcttgaaaggcaaaaacgaagaatcgaataagagtaaagttaaggtgactaaattaatgaaaactatgaagtccgaaaactag

SEQ ID NO: 26128 - DNA, 462 bp, Artificial Sequence
  Description of Artificial Sequence: Synthetic coding sequence
atgtctgagatccaaggcaccgtcgagttttctgtcgagctgcacaaattttataatgtggacctgttccagcgcggctattaccagattcgcgtcaccctgaaggtgtcctctcgtattccccataggctgtccgcttccatagccggtcagaccgagagcagctccctccattctgcgtgtgttcacgatagcaccgtgcactccagggtttttcagatactctaccgcaatgaggaggtgccaatcaacgatgccgttgttttccgggtccatctacttctgggaggagagagaatggaggacgccttgagtgaggtggatttccagctgaaagtcgacctccacttcaccgatagcgaacagcagttgcgggacgtggcgggagcgcccatggtgagttcgcggaccttgggcctgcactttcacccaaggaacgggctgcaccatcaggtgccctag

SEQ ID NO: 26129 - DNA, 4221 bp, Artificial Sequence
  Description of Artificial Sequence: Synthetic coding sequence
atgtccgagattcagggcacggtggagttcagcgtcgaattgcacaaattctacaacgtcgacttattccagcgggggtactaccagattagggtgaccctgaaagtctcttcgcgcataccacatcggttatctgcctccattgcaggacagacagaaagctcaagtctccattccgcctgcgtccacgattcaacggtgcattctcgagtgtttcagattctctatagaaatgaggaggtccctatcaacgacgccgtggtgttccgtgtacacctgttgctcggtggggagcggatggaggatgcgttgagcgaagtcgattttcagcttaaggttgacctgcacttcactgactctgaacaacagctaagggacgtggctggtgccccaatggtgtcatccagaaccctgggcctgcacttccacccgcgcaatggactacaccatcaggtccccgttatgtttgactactttcatctctcagtgatcagtgtcaccgtgcacgctgcactggtggcgcttcagcagccccttatatctttcacgagaccaggccgagggtcctggctgggcaaaggaggcccggataccgggcaggagcaatctatcatctcgttggagaatctggtcttcggggctggttattgcaaacccacttcaagtgaagggtcattctacattaccagcgagaactgcatgcaacacgcccataagtggcatagagacctctgccttctgttgctccatgcctacaggggcttacgactgcacttcttagttatcatgagagacatcccggagcttccacacacagagctggaagccctagctgtcgaagagactctgtcacagctctgctctgaactgcaaatgttaaacaaccctgaaaagatcgcagagcagattagcaaagatctggcatggcttaccagccacatgatgaccctgtggacccagttccttgacactgtgactttgcactcccaagtgacgacatatcttactcaagaacaccacacactccgcgtgcggcgcttcagcgaagcctttttctatatggaacatcaaaaactggctgtgttgacatttcaggaaaatctgatccagacacatagccagttgagcctggacatcagaaattccgagtaccttacgagtatgcccccattacccgccgagtgcttggatatagacggggattggaacacgttacccgtcatcttcgaagatcgctatgttgactgccctgccactgggcacaacctgtccgtttacccaaatttcgacgtgcctgtgacaagtcctacaataatgaacctgaaggacaaagaggataactgtatggtgaacagtaacctgtcgttccgggaagatctagtgctgtccacgataaaaccttctcagatggactctgacgaggaggtgatcaggtgtcctgagcctggtgagaatgtcgctacccagaaccacatggatatgtgtagtgaatctcaggtgtacatcagcatcggagaattccagaacaaggcaggggtgccggaggacgagtgctggacaggccagactagcgatgcaggcacctacccagtggccgacgtggacacctcgagaaggagcccaggcccagaggacgggcaggcccccgtgctgacctatatagatgtgaagtcctccaataagaaccctagcagggcggaaccactagtggctttcaatgctcaacacgaatctcggtcctcccgcgataaatacgggttggataggaccgggctcagcaaggtggtcgtgggcgggagtcaccaaaacgctatctcctctgataagacaacactgcacgagctcagtaccctcggaaaggggatcgaccaggaaggaaagatggtgctattgtccctgaagctaaccccaagcgagccttgcgatccactctcgtctactctgcgcgagccactggatatccggagttcgctcaaggattcacacactgaagagcaggaagagttatctgtactgtcaggagttatcaaacgaagttcatccatcatttcagactcaggtattgaatctgaaccatcgagtgttgcgtggagcgaagccagaagcagagcgttggagctgcctagcgatagggaagtgctgcatccattcgttcggcggcacgcattacaccgcaacagcctcgaaggaggacatactgaatcaaatacaagcttgcctagcggaattcaagcgtcactgacgtctatatcttccctcccgttcgaggaggacgagagggaagtcgctctgaccaagctgacaaagtctgtgtcggccccccacatcagtagccccgaagaggctgccgaggatgctgataccaaacagcaggatgggggcttcgctgaaccttccgacatgcattctaaatcacagggctcaccaggtagttgttctcagctgtgtggggactccgggactgacgcgggcgctgaccatcccctagtggagatagtgttagacgccgacaaccagcaagggcctggctacatagatatccccaaagggaaaggtaagcagtttgatgctcagggccattgtctcccagatggacgcactgagaatactcctggtgtggaaacaaagggtctgaatctgaagatacccagagtcatagccctggaaaacccccgaacccggtccctccaccgggccctggaggagacacctaagggtatgcctaaagaccttaacgtcggccagcaggcattaagcaactctgggatctccgaagtggaaggattaagtcagcaccaggtgcctgagctatcctgtaccagcgcagcagacgctatcaatcgaaatagcaccggtcagcagtcacagtctggttcgccctgtatcatggacgacaccgcctttaaccgcggagtgaatgcgttccccgaagccaaacataaggccggcacagtgtgtcccaccgttacccactccgtccattcccaggtgctgaaaaaccaggaactcaaagctgggacgagtattatgggaagtcatctaacttctgccgagacgtttaccctggacagcctgaaggccgtggaagtagtaaatctgagcgtaagttgcaccgccacctgcttgcctttttcaagcgttccaaaggaaacccccgccagggccgggttttcatccaagcagacacttttccctataactcaccagcctctgggctctttcggcgtggtgagtactcactccagtactctggacgaggaggtctctgaacgcatgttctccttttaccaggccaaggaaaagtttaaaaaggaactgaagatcgagggattcttgtactctgacctgacagtgttggccagcgacattccatacttcccaccagaggaggaggaagaaaatctggaagacggcattcatcttgttgtgtgcgtccatggactggatggcaactctgcagacctccgactcgtcaaaacatttattgagctgggacttcctggcggtaagctcgactttctaatgtcagagaagaatcagatggacacattcgccgattttgacactatgaccgatcggctgctcgatgagatcatccagcacatccagctgtacaatttgagcatttcgcgcatttcctttataggccacagtcttggtaatattattatacgatcggtcctcacgcggccaagattcagatactatctgaataagttacatactttcctctctttgtccggcccacacctgggtactctgtacaacaattccacccttgtaagcacaggactatggttgatgcagaagctgaaaaagtccggcagcttactgcagctgactttccgggataacgctgatctgagaaagtgtttcctgtaccaactcagccaaaagaccggattgcagtattttaagaacgtggtgctggtggcatctcctcaggatcgatacgtaccattccatagcgctaggatcgagatgtgcaagactgcgctgaaggatcgccacactggtccggtgtatgcagagatgatcaacaaccttctgggccctcttgtggaggccaaagactgtactctgatacgacataacgtgtttcacgctctacccaacaccgccaataccctgatcgggagagccgcccatatagcggtgctggatagcgaactatttctcgaaaagttcttccttgtcgcagggcttaactatttcaagtag

SEQ ID NO: 26130 - DNA, 207 bp, Artificial Sequence
  Description of Artificial Sequence: Synthetic coding sequence
atgagcgagattcagggaactgtagagtttagtgtggagcttcacaaattttataatgtggacctgtttcagcgcggctattaccaaatcagggtgaccctgaaggtgtcttctcgaataccacacagactgagcgccagtatcgctggacagacggaggttctgaacatacacatgtccgagcaggaacctgctcagggaaaatag

SEQ ID NO: 26131 - DNA, 1197 bp, Artificial Sequence
  Description of Artificial Sequence: Synthetic coding sequence
atggtctgccgcgagcaactcagcaagaatcaagtgaagtgggtttttgccgggattacttgtgtctcagttgtggtgattgctgccattgtgcttgccattacgctgagacgcccaggttgcgagctggaggcttgcagcccagacgcggacatgctggattacctgctgtcgctcggtcagatttccaggagagatgctctagaggttacatggtatcatgccgccaactccaagaaggccatgaccgcggcacttaactccaacattaccgtcttagaggcagacgtgaacgtggagggcctgggtaccgcaaacgaaaccggcgtacccatcatggctcacccacctaccatctattccgacaacaccttggaacaatggttggacgccgtcttaggctcctcccagaaaggcataaagctggattttaagaatatcaaggccgttggcccttccctggatctactgcgccagcttaccgaagagggcaaggtccggcgccccatctggataaacgccgatatactgaagggccccaacatgctgatcagcaccgaagttaacgcaactcaatttttggcgctcgtgcaggagaaatacccgaaagcaacgctctctcctggttggacaaccttttacatgagcacaagtcctaatcgcacctatacccaagctatggttgagaagatgcatgaactggtcgggggtgtccctcagcgagtcactttccctgttagaagttcaatggtgagggcagcttggcctcacttcagttggctccttagccagtctgagcggtattccttaactctgtggcaagcggcgtcagaccccatgagtgtcgaggacttgttatacgtgcgggacaatactgctgtccaccaggtgtattacgatatcttcgagccactgctgctgactgacatgctggaattgtgccaaggactgtggcaacccgtgagttttcaaatgcaagctatgctcctgggacactctacagccggcgccataggaagacttctggcaagctccccacgcgcaaccgttacggtcgaacacaaccctgccggcggggattacgctagcgttagaactgcactcctcgcagcacgggccgtcgatagaactagagtatattatagactgccgcagggttaccacaaagacctgctggcccatgtcggtcgcaattag

SEQ ID NO: 26132 - DNA, 1758 bp, Artificial Sequence
  Description of Artificial Sequence: Synthetic coding sequence
atggtatgtcgggagcagttatcaaagaatcaggttaagtgggtgttcgcaggaataacatgcgtgagcgtcgtggtgattgccgccatcgtgcttgcaattacgttgcgtcggcctggctgcgaactggaggcctgttccccagatgctgacatgctggactatctccttagccttgggcagatctctcggagggatgcgctcgaggtgacctggtatcacgccgccaattctaaaaaggctatgacagccgcgctaaattctaacatcaccgtgctcgaagccgacgtgaacgtggaaggtcttggcacagcaaatgaaactggagtaccaatcatggcacacccacccacaatatacagcgataatacacttgagcagtggctcgacgctgttctagggtctagccaaaaaggtatcaagttggatttcaagaatattaaggcagtgggcccttcactggatcttctgaggcagctgactgaggagggaaaggtacgtagacccatttggatcaacgctgacattctcaaaggacccaatatgcttattagtaccgaagttaacgctacccagtttcttgcgctcgtgcaggaaaaatatcctaaggcaactctctccccaggctggacgaccttctatatgtccactagccccaaccgcacatatacacaggcaatggtggaaaaaatgcacgaattggtgggcggggtgccacagagagtcactttccccgtccgatctagtatggtcagggccgcctggccacatttcagttggctgctttcccaaagtgagcggtacagtctaacattgtggcaggctgcctctgaccctatgtccgtcgaagatttgctctatgttcgggacaacaccgcagtccaccaggtgtattatgacatcttcgagcccctgctcagccagttcaagcagttggccctgaatgcgacccggaaaccgatgtattacaccggagggtctctgatccccttacttcagcttccaggcgatgatgggctgaatgtggaatggttggttccagatgtgcagggttccgggaagactgctacaatgactctccctgacactgaaggaatgattctcctgaataccggactcgaaggtacagtggcggagaaccctgtgcctatcgtgcacacaccttcagggaacattctcaccctggaatcttgcctccaacaactggcgacccaccccggacattggggcattcacctgcagattgccgagccggcagctctcagaccatcactggccctgctggctcgtctctcttctctcggcttgctgcattggcccgtctgggtgggagcaaagatatcgcatggttccttttctgttcctggtcacgtagccggccgggagttgttaactgctgttgctgaagtattccctcacgtgactgttgccccaggttggcctgaagaagtgttaggaagtggctacagggagcagctattgacagacatgttagagctgtgtcagggcctctggcaacccgtgagctttcagatgcaggctatgttactcgggcacagcactgctggagccatcggacgtctgctagcgagcagtcctcgagcgaccgtaactgtcgagcataatcctgcaggcggtgactacgcatccgttcgcacggctctcctggccgctagagccgtcgaccgcacacgagtttattaccgactgccccaggggtatcacaaagacctgctggctcatgtgggcaggaattag

SEQ ID NO: 26133 - DNA, 936 bp, Artificial Sequence
  Description of Artificial Sequence: Synthetic coding sequence
atggtatgcagagaacagctcagtaagaatcaggttaaatgggtgttcgctgggataacgtgtgtgtcagtggttgtgatcgctgctatcgtacttgccatcactctgagaaggcccggttgtgaactcgaggcctgttctccggacgccgacatgttagactacctcctctccctgggccagatctcccggcgcgacgctctggaagttacatggtatcacgccgccaattcaaagaaagcaatgaccgccgccttgaatagcaatatcacggtgctggaggccgacgtgaacgttgaaggactgggcaccgcaaatgaaactggcgtgcccataatggcacaccctccaaccatttactcagacaatactctcgagcaatggctggacgctgtcctcggatcttcacagaaagggatcaagctggacttcaagaacatcaaagccgtgggcccgtctctcgatctgttgaggcagttgaccgaggaggggaaagtacgaagaccaatctggatcaacgctgacatcctgaagggacctaacatgcttatctccaccgaagtgaacgcaacacagttccttgcactcgttcaagagaaataccctaaagcaacccttagtcccggatggacaactttctatatgagcacatcaccaaacagaacctatacccaagcaatggtcgagaagatgcatgagctggtgggtggggtacctcagagagtgacatttcccgtccgcagctctatggtgcgcgccgcctggcctcacttttcctggcttctaagtcaatctgaacggtattctctaactttgtggcaggctgctagcgatccaatgtccgtggaggacttgctgtatgtaagagataatacagctgtccaccaagtctattatgacatcttcgagcccttactgtgtagccagatctgttag

SEQ ID NO: 26134 - DNA, 1377 bp, Artificial Sequence
  Description of Artificial Sequence: Synthetic coding sequence
atgacacgtggggcctggatgtgccgtcagtatgatgatggactgaagatctggctggctgctcctcgcgagaacgaaaagccttttattgactctgagcgagctcagaaatggcggctgtcactcgcttcactcctatttttcactgtgctgctgagcgaccatctctggttctgtgcggaagcaaagttgactcgggcccgtgacaaggaacaccagcagcagcagcgtcagcagcagcagcagcagcagcagcagcgtcaacgacagcaacaacaacaacagcggcggcagcaggagcctagctggccagctctactcgcaagtatgggcgagagtagccccgccgcccaggcacataggctgctgtccgctagctcatcacccacactcccaccaagcccgggcgatgggggcggcggcggcggtaaaggtaatcggggcaaggatgatcgcgggaaggcgctgttcttagggaactctgctaagccagtctggaggctcgagacttgctatcctcagggtgcttcatctggccagtgttttactgttgaaaacgccgatgcggtgtgcgcaagaaattggtccagaggcgccgcaggcggagatgggcaagaggtccgtagcaaacaccccacccccctgtggaatttaagcgacttctatctttccttctgcaacagctacactctgtgggagctgtttagcggtcttagctcaccaaatacgctgaactgctcattggatgttgtgcttaaggaaggaggagagatgaccacctgcaggcaatgtgtagaggcgtaccaagattacgaccatcatgcgcaggaaaaatatgaggaattcgagagcgtcctgcataaataccttcagtctgaggagtatagtgtgaagagctgtccagaagactgcaaaatagtatacaaagcatggctgtgcagccagtattttgaagtgacccagttcaactgtcggaagaccatcccatgtaagcagtactgtctagaggtccaaacccgctgtcctttcatacttccggacaacgacgaagtaatatacgggggactgtcttcctttatctgcactggcctgtatgagacttttctcactaacgatgagccagagtgttgtgacgtgaggcgggaagagaagagcaataacccatctaaaggcaccgtagaaaagagtggatcatgtcacagaactagcctcacagtgagctccgccactcgtctgtgtaactcccggcttaagctgtgcgtactggttcttattctcctacacacagtgctgacagcctccgcagctcagaacaccgcgggtctcagcttcggaggaatcaacacgctggaggaaaactctacaaacgaggagtag

SEQ ID NO: 26135 - DNA, 1419 bp, Artificial Sequence
  Description of Artificial Sequence: Synthetic coding sequence
atgttccggggcgcatggatgtggcctggaaaggacgccgcagcacttaccatttgttgctgttgttgctgctgggcacctcgacccagcgacaagccatgtgctgattccgagcgagcacaaagatggcgcctctctctcgcaagtctcctgttttttaccgtcctgttagccgaccacctgtggctgtgcgccggagcccgcccgagagccagagaactgagctctgctatgaggcccccctggggagcggggagagaacggcagcccgttcccccaagggcagttcttcccctaccccctccacctcctggcgaaccatccgcaccaccagggacctgtggccctcgttatagcaacctcacaaaagccgctcccgctgccgggtctagaccagtgtgcgggggcgtgcccgaacctactgggcttgatgctgcctgtactaaactgcagtctcttcagagactctttgagcctaccacgcccgccccgcccttacgcccaccagactcacttagtcgggcgcccgccgagttcccatctgccaagaagaacctgctcaaaggacatttccgaaacttcactctgtctttctgcgatacctacaccgtatgggatttacttctcggtatggatcgccctgattcactagattgttccttggacactctgatgggcgacctcttggctgtcgtggcatcccctggctccggtgcttgggaggcatgttcaaactgcattgaagcttatcagaggttggatcgacacgcccaggagaaatatgatgagttcgatttagtgctgcataagtatctacaggcagaagaatacagtatacgctcctgcacgaagggatgcaaagctgtgtacaaggcctggctgtgtagcgagtacttcagtgtgactcagcaggaatgccagagatgggtgccttgcaagcaatactgcctagaggttcaaacccggtgtccgtttatcctgccagacaatgaggagatggtctatggagggcttcccggtttcatctgtacaggattgttggatacatccccgaaacgactcgagacaaagtgttgtgacgtgcaatgggtatcctgtgaagctaagaagaagaaattcaaagagtctgaggcccccaaaacacaccagcagcagtttcatcactcttatttccatcattaccaccaacagtaccaccactaccatccacaccacgatccccccggacgggttagtaataaacccgcgctgctacccgtgtctggtggatcccgccttagtccttctcgcataagactctgtgtgctggttctcatgctgcttcataccgtagttagtttctctagcaatcagggaggcggcgggctcggtctcgaaacattgccagctctcgaagaggggctcaccagagaggaatag

SEQ ID NO: 26136 - DNA, 642 bp, Artificial Sequence
  Description of Artificial Sequence: Synthetic coding sequence
atggacccgctacagaagagaaaccccgcaagcccaagcaagagctctcccatgaccgccgcagaaacttcccaagaagggcctgccccgtcacagcctagctactcagagcagccaatgatgggcctgagtaatctgtccccgggcccggggccaagccaggccgtcccacttcctgagggactcttgaggcagagatatcgtgaagagaagactctcgaagaacgaagatgggagaggctcgaattcctccagcgaaaaaaggcgtttctgaggcacgtcagaaggcggcacagggaccacatggcaccctacgccgtcggccgtgaggcacgaatcagccctctcggagaccggagccaaaaccggttcaggtgtgagtgtcggtattgtcagtcccacaggcctaacctgagcggcattccaggggagtcaaatcgcgcccctcacccatctagctgggaaaccctagtgcaggggttgtcaggactcacactttccctgggaacaaaccaacccgggccactcccagaagctgccctgcaaccccaggaaactgaagaaaagcgacagcgggagcgtcaacaggagtcgaagatcatgtttcaacggttgctaaaacagtggctggaagaaaattag

SEQ ID NO: 26137 - DNA, 642 bp, Artificial Sequence
  Description of Artificial Sequence: Synthetic coding sequence
atggatcccctacagaagagaaaccctgcaagtcctagcaaatcatcgcctatgacagccgcggagacctctcaggagggccccgcacctagtcagccctcttactcagagcagcctatgatgggcctgagcaaccttagcccgggtcctggtcccagccaggccgtgccactgccggaaggattgctcaggcagcgatacagagaagagaagacactcgaagagaggcgttgggagagacttgaattcctccagagaaagaaagcgtttttgcgtcacgtccggcgtagacacagggaccacatggccccgtacgcggtgggtagggaggctcgaatttctcccttgggggatagatcccaaaaccgatttcggtgcgagtgccgctactgtcagagccaccgacctaacctgtccggaattccaggcgaaagcaatcgcgcaccccaccctagctcttgggagactcttgtacagggacttagtggcctgaccctttcactgggcacaaaccagcccgggcccctgccggaggcggctttgcagccgcaggagaccgaagaaaagcgccagagagaaagacagcaagaaagcaagattatgtttcagagattgcttaagcagtggttggaggaaaactag

SEQ ID NO: 26138 - DNA, 642 bp, Artificial Sequence
  Description of Artificial Sequence: Synthetic coding sequence
atggaccccctgcagaaacggaatccagcgtctccaagcaagagctccccgatgacagccgccgagaccagccaggagggaccagcccccagtcaaccttcttactcagaacaacccatgatgggactttccaatctctctcccggtcctggaccttcccaggctgtgccactccccgaaggcctgttgcggcagagataccgggaagagaaaaccctcgaggagcggcggtgggaaaggctggagtttctgcagcggaagaaagcttttctgaggcacgtcagacgcaggcatagggaccacatggccccatacgccgtggggagggaggcccgcatctccccactgggcgatcgatctcagaatcgctttcgctgtgagtgtcggtactgccaaagtcatagacccaatctgtcggggattcccggagagtcaaatagggcaccccacccaagcagctgggaaaccctggtccaggggctgagcggcttaacattgtccctgggaacaaaccagcctgggcccctgccggaggccgctctccaacctcaggagacagaggaaaaacgacagagggagagacagcaagagtctaaaattatgtttcaacgactcctcaagcaatggcttgaggagaattag

SEQ ID NO: 26139 - DNA, 381 bp, Artificial Sequence
  Description of Artificial Sequence: Synthetic coding sequence
atggatccactgcagaagaggaaccctgccagtccttccaaatcatcgcctatgaccgcagcagaaacaagccaggaaggcccagccccctcccaaccaagctacagcgagcagccgatgatgggactaagcaacctgtcccctggtcccggaccatcccaggctgtgcctttgcccgagggattactaaggcagcggtacagggaagagaaaacgctggaggaacgcaggtgggagcgcttagagtttcttcagaggaagaaagcgttccttagacatgtaagaagaagacacagggatcacatggctccatacgccgtcggcagagaggcaaggattagcccactcggggaccgttcccagaatcgatttcgatgctag

SEQ ID NO: 26140 - DNA, 555 bp, Artificial Sequence
  Description of Artificial Sequence: Synthetic coding sequence
atggaccctcttcaaaaaaggaaccctgcgtccccttctaagtccagccccatgaccgccgcagagacttcccaggagggccccgccccgtcccagcccagttactccgagcaaccaatgatgggtctgagcaacctgtcacctggaccggggcccagccaggcggtgcctctgccggaaggcctgttgagacagcggtaccgtgaggagaaaaccctggaggaaaggcgctgggagcgactcgaattccttcaacgtaaaaaagccttcctgaggcatgtgagaagacgtcatagagatcatatggcaccatatgccgttggaagggaagccaggatttcgcccttgggcgataggagccagaatagatttcgatgtgagtgtcgatattgtcaatctcacagacctaacttgtccggaatccccggggaaagcaaccgcgccccccacccaagttcgtgggaaacactcgtccagggactgtccgggctgacgctttcgcttgggactaaccagccaggacctctgccggaagccgcgctgcagccccagtag

SEQ ID NO: 26141 - DNA, 642 bp, Artificial Sequence
  Description of Artificial Sequence: Synthetic coding sequence
atggaccctctgcagaaacgcaatcccgcatccccttctaagagcagccctatgaccgccgctgagacatctcaggaaggaccagccccatcacaaccgagctactccgaacagcctatgatggggctgtctaacctgtctccagggcctgggcccagtcaggctgtgccacttccagaaggattactccgccagcgttacagagaggaaaagacattagaagagcgacgatgggagaggctagagtttctgcagcgcaagaaggcctttttaaggcatgtgaggcgcaggcacagagatcatatggcaccctatgcagtgggtagggaagcccgcatatcccccctaggcgatcgctcccagaataggttccgctgtgagtgtagatattgccagagccatagaccaaatctgtctggcattcctggggagtctaaccgggctccccatccctcgtcgtgggagacactggtccagggactctcaggtctgactctgagtctcggcaccaatcagccaggccctttgccggaagcggccctgcaacctcaggaaaccgaagaaaagcgccagcgcgagaggcagcaggaaagtaaaatcatgtttcagagacttcttaaacagtggcttgaagagaactag

SEQ ID NO: 26142 - DNA, 33 bp, Artificial Sequence
  Description of Artificial Sequence: Synthetic coding sequence
atggatccattgcagaagcggaacccggcctag

SEQ ID NO: 26143 - DNA, 567 bp, Artificial Sequence
  Description of Artificial Sequence: Synthetic coding sequence
atggatcctcttcaaaagcggaaccccgctagtccctcaaagtcttcacctatgactgctgccgagacttcccaggaggggccagccccttcacagccaagctacagcgagcaacccatgatgggcctcagcaatctcagccctgggcccggtccatcccaggccgttcctctgcccgagggcctcctccgacagaggtatcgcgaagagaaaacccttgaggaaagacggtgggaacgactggaatttctgcagaggaaaaaggcctttttgcgccatgtgaggcgtagacaccgcgatcacatggcaccctatgcagtgggcagggaagcccgaatctcacctctcggagacaggagtcagaacaggttcaggtgcgaatgtcgctattgtcaaagccacaggcctaacctgtctggaatcccaggagagagtaacagggctccccatccttcatcctgggagaccttggtgcagggcctaagcggactcaccttgtctctaggaactaaccagccaggtccattacccgaggccgccctgcagccccaggagactgaggagtag

SEQ ID NO: 26144 - DNA, 327 bp, Artificial Sequence
  Description of Artificial Sequence: Synthetic coding sequence
atggaccctctgcagaaacgcaaccctgcaagtccttcaaagagctcccccatgaccgcggcggaaacctctcaagaagggcccgcccccagccagccttcatattctgaacaacctatgatgggattgtccaacctgtcacccggcccaggcccctcccaagctgtgcctctccccgagggcctgctaaggcagcgctacagagaggagaagaccctggaggagcgccggtgggagcggttggaattcctgcagcgcaagaaagcttttctgcgtcacgtgcgccgacggcacagagaccatatggccccctacgccgtgggctag

SEQ ID NO: 26145 - DNA, 336 bp, Artificial Sequence
  Description of Artificial Sequence: Synthetic coding sequence
atggacccgctacagaaacgaaacccggcatctccatcgaagtccagccctatgacagcagcagagacaagccaggaaggacctgccccatctcaaccgagctactctgaacaaccgatgatgggcctttcgaatctgtcacccggtccggggcccagccaggcagttcccttgccagagggcctcttgaggcagcgatacagagaggagaaaacactggaagaacgcaggtgggaacgtctggaattcttgcagcgaaagaaggccttcctccggcatgtgcgccgacgccaccgcgatcacatggccccatacgccgttggtagagaagcctag

SEQ ID NO: 26146 - DNA, 396 bp, Artificial Sequence
  Description of Artificial Sequence: Synthetic coding sequence
atggatcctctgcagaagcgtaaccctgcctcacctagcaaaagttcaccaatgaccgctgcggaaacaagccaggagggccccgcccctagtcagccctcctacagcgaacagcctatgatgggtcttagcaatctttcacccggtcccgggccgagtcaagcggtgcccttacctgaaggcctgttacggcagcgatacagggaggaaaagacattggaggaacgtagatgggagaggttagagttcctgcaaagaaaaaaggccttcctgagacacgtacggaggcggcacagagaccatatggccccctacgccgtggggcgcgaggcccggatcagcccactcggcgatagatctcagaacaggtttcgctgtgaatgtcgatattgttag

SEQ ID NO: 26147 - DNA, 12 bp, Artificial Sequence
  Description of Artificial Sequence: Synthetic coding sequence
atggatccgtag

SEQ ID NO: 26148 - DNA, 258 bp, Artificial Sequence
  Description of Artificial Sequence: Synthetic coding sequence
atggaccccctgcaaaagcggaatccagcttcaccatcaaaaagctcgcccatgacggcagcagaaacttcacaagaaggtcctgcgccatcccagcccagttatagcgaacagccaatgatgggactatcaaacctctctcctggacctggcccttcacaggccgttcccctccccgagggcctgctgcggcagcgctatcgagaggaaaagacattggaggagcggcgatgggaacggttggaattcctgcagtag

SEQ ID NO: 26149 - DNA, 642 bp, Artificial Sequence
  Description of Artificial Sequence: Synthetic coding sequence
atggaccccctacagaaacgaaaccctgcctccccatccaaaagcagccccatgacggcagccgagaccagtcaggagggccctgctccctcccagccaagctacagcgaacagcccatgatgggactgagcaacctcagccccgggcccggcccaagtcaggctgtcccccttcccgagggcttgctgcggcaacgatatcgcgaagaaaagacactagaagaacgcagatgggagagactggaatttctccagaggaaaaaagctttcctgcggcatgtccgtaggaggcatcgggaccatatggcaccttacgcagtcggcagggaagcgcggatctcgccactcggagatcgcagtcaaaatcgcttcagatgcgaatgccgatactgccagtcacatcgacctaatctgtccggcatcccgggggagagtaatagggcaccccacccatcctcctgggagacccttgttcagggactaagcggactgacactgtctctcggaaccaaccagccaggccctctcccggaagcagctctgcagcctcaagagacagaggagaagagacagagggaaaggcagcaggaatccaagatcatgtttcagcgtctgttaaagcagtggctggaagagaactag

SEQ ID NO: 26150 - DNA, 642 bp, Artificial Sequence
  Description of Artificial Sequence: Synthetic coding sequence
atggatcctcttcagaaaagaaatcctgccagccccagcaagtcctctcctatgacggctgcagaaacttcccaggagggacccgccccttcccagccaagctactcggagcagcctatgatgggcttgagtaatctcagcccgggaccagggccatctcaggcagtgcccttgcctgagggcctgctccgccagcgatacagggaggagaaaacgcttgaggagaggagatgggagagactggagtttcttcagcggaagaaggcattcctcagacatgttagaagacggcaccgagaccatatggcgccatatgctgtgggccgggaggctcggatcagtcctctcggggatcgtagccagaatcgcttcagatgtgagtgtcgatactgtcagagccatcgacctaatctgtccggcattcctggggaatccaatcgagccccccatcccagcagctgggaaaccttagttcaggggctgtcagggctgacactgtctctgggaactaatcagcctggacctctacctgaggccgccctgcagcctcaagaaaccgaggagaaaagacagagagagagacagcaggagtcaaagattatgtttcagcgtctgctgaaacaatggctggaggaaaattag

SEQ ID NO: 26151 - DNA, 642 bp, Artificial Sequence
  Description of Artificial Sequence: Synthetic coding sequence
atggatcctctccaaaagcgaaatcctgcttcccctagcaaaagctcccctatgacagccgccgagacctcccaagaagggccagcgcccagccaaccatcctacagcgaacagccaatgatgggcctcagcaacctgagcccagggcctggaccctcccaggccgtgccactgcctgagggactgctgagacagcggtatagagaagagaagacgttggaggagagacggtgggaacggctcgagttcttacagcgtaagaaagccttcctgcgacatgttagacgccgccaccgggaccacatggccccatacgctgtcggcagagaggcacggataagcccattgggcgaccggagccagaaccgcttcaggtgtgagtgccgttactgccaatcccacaggcccaacttgtctggcatccccggagaaagcaacagagccccccacccttccagctgggagactctggtgcaaggcttgtctggtctgacgctcagtctgggtaccaaccagcctggccccctccccgaggcggccttgcagccccaggagacagaggagaagcggcagcgggaacgccagcaagaaagtaaaattatgtttcaaaggctgctcaagcagtggctggaggagaattag

SEQ ID NO: 26152 - DNA, 642 bp, Artificial Sequence
  Description of Artificial Sequence: Synthetic coding sequence
atggaccccttgcaaaagagaaaccccgcaagcccctctaagtcttctcccatgaccgctgctgaaacttcccaggagggacctgctccaagccaacctagctacagtgaacagcccatgatgggactgtccaatctctcaccgggtcctggcccttcgcaggcagtccctctgcctgaaggtctactgcgccagaggtatagagaagagaaaactctcgaggaacgcaggtgggagcgcctggagttcctccaacgtaaaaaagctttcctgcgccatgttcggcggcggcaccgcgaccacatggctccctacgcggttgggagagaggccagaatctctcctttaggggaccggtcccagaatcggttcagatgcgaatgtcggtattgtcaaagtcatagacccaacctctcaggtattcctggggaatcaaaccgagctccccacccatcatcttgggaaacactcgtgcagggcttgtccggcctgaccctaagtttgggtaccaatcagccaggccctctgccagaagctgctctgcagccccaggagacagaagaaaagcggcagagggagcgtcagcaggagagtaaaatcatgttccagaggcttctcaagcagtggcttgaagagaactag

SEQ ID NO: 26153 - DNA, 642 bp, Artificial Sequence
  Description of Artificial Sequence: Synthetic coding sequence
atggaccctctgcaaaagcgaaaccctgcctctccatccaaatcttcccctatgactgcagccgaaacttcacaggaaggacccgctccaagccaacccagttacagcgagcagcccatgatggggctgtctaacctgagtcccggccccggcccttcacaggcagtaccccttcccgaaggcctcctgagacaaaggtatagggaggaaaaaactcttgaagagagacggtgggagagactagagttccttcagcgtaagaaggcgtttctgagacatgtgagaaggagacaccgcgaccacatggctccctacgctgtggggcgggaggcccgaatttctcctctgggagatcggtcacaaaaccggtttcgatgtgagtgcaggtattgccagtcacacagaccaaatctgtccggaatccccggggaatctaatagagcgccgcatccatcctcatgggagaccttggtgcagggattgtccggactaacactgtctctggggaccaatcagcccggccccttgcctgaggctgctctacagccgcaggagactgaagagaagcgccagcgcgaacgccagcaggagtccaagattatgttccagcgtttactcaaacaatggctggaagagaactag

SEQ ID NO: 26154 - DNA, 642 bp, Artificial Sequence
  Description of Artificial Sequence: Synthetic coding sequence
atggatccgttgcagaagcggaacccagcatccccttctaaatcttctcccatgaccgcagctgagacatcccaagaagggccagctcccagtcagccttcatacagtgagcaacctatgatgggcctttctaacctgagcccggggccaggaccaagtcaggctgtccctctgcccgagggattactgcgccagcgttaccgggaggaaaagactctcgaggagaggaggtgggagcgactggagttccttcagcggaaaaaagcgttccttcgccacgttcggcgccggcaccgagaccatatggccccgtatgctgttggaagagaagccagaatttcccctctcggggacaggagtcaaaatcgctttaggtgcgagtgccggtattgtcagtcccacagacccaacctgagtggcatcccaggcgagtctaaccgagcgccacacccttcttcctgggaaacgttggtgcagggattgtctggccttactctgtctctcggtacaaaccagcccggcccactgcctgaagctgcccttcagccgcaggagaccgaggaaaaacggcagagggagcggcagcaagaatcaaagatcatgttccaacggctacttaaacaatggctcgaggagaattag

SEQ ID NO: 26155 - DNA, 642 bp, Artificial Sequence
  Description of Artificial Sequence: Synthetic coding sequence
atggacccccttcagaagagaaaccccgccagcccctctaagtctagcccaatgacggctgccgagacaagtcaagagggccccgccccctcccaacctagctattccgagcaaccaatgatgggactgtcaaacctgtccccaggtcccggcccaagtcaagccgtgccactcccagaaggtctgctgagacagaggtaccgggaggaaaagacccttgaagagcgcagatgggagcgcctagagttcctccagcggaaaaaagccttcctccggcacgttcggagacgccatagggaccatatggccccctatgccgtcgggcgcgaagctaggatcagccccttgggcgaccgttcccagaaccgatttagatgcgaatgtcggtactgccagtcacatagaccaaatcttagtggtattccgggtgaatccaatcgggccccgcacccctcaagttgggagacactggtgcaaggtctcagtggcctgacactgagtctggggacgaaccaacctggacccctccctgaagcggcactccagccccaagagactgaggaaaagcgacaaagggagcgtcagcaggagtctaaaataatgtttcagaggctcctgaaacagtggttggaggagaactag

SEQ ID NO: 26156 - DNA, 573 bp, Artificial Sequence
  Description of Artificial Sequence: Synthetic coding sequence
atgtctggagcctgcacctcctacgtgtcggcagagcaggaggtggtgcgcgggttttcctgcccacgacccggcggcgaggccgccgctgtgttttgctgtgggttccgtgatcacaagtactgctgtgatgacccacactcattcttcccatacgaacactcttatatgtggtggctgtctatcggcgcgctcataggtctgagcgtggctgccgtcgtgctcctggcctttattgtgaccgcttgcgtgctttgctacctgttcatctcttccaaaccccataccaagcttgatctgggactgtcacttcagacggccggacctgaggaagtgagtccagattgccagggtgtcaacaccgggatggccgcggaagtcccgaaagtgtccccactccagcagtcttatagctgtctgaatcctcagcttgagtccaatgaaggccaggcggtgaattctaagcggctactccatcattgcttcatggccacggttaccaccagtgacatcccaggaagcccagaagaggccagcgtccctaatccagacctgtgcggccccgtgccttag

SEQ ID NO: 26157 - DNA, 510 bp, Artificial Sequence
  Description of Artificial Sequence: Synthetic coding sequence
atgggtagtttgtcaggtttacgcctcgccgccggaagctgtttccgtctatgcgaacgggatgtcagtagtagtctcaggctgacaaggtcctctgaccttaaaaggattaatggattttgtaccaaaccccaagaatctccgggagctccgtcccgccacttacagcagagtgcattcacccagacttacggtttggctgaaaaggatccacatatggtgaggtcgctccaggaggacgagattcctgaaaccgtgagcctcgagatgctggacgccgccaagaataaaatgagagtgaaaatttcatatctcatgatcgctctcacagtcgttggatgcattttctggcttctgcgggcccggtcctgtcctaagactagggattttaataaactagaattgcgcaaggagagctccagcgaacggggcagctcctacgaggggcaaaaccgcgtggcagaagtaagtgtgttggccatcttgaagatccaggagttgtgctactag

SEQ ID NO: 26158 - DNA, 465 bp, Artificial Sequence
  Description of Artificial Sequence: Synthetic coding sequence
atggggagtttatcaggcttgcgcctggccgcagggtcctgtttccgcctttgtgagcgtgacgtctctagcagtctgagactgacccggagcagcgatttgaaaagaatcaatggtttctgcacaaagccacaggagagtcccggcgcgccatcccgtacttacaatcgagtgccgcttcataagccaactgattggcaaaaaaagatccttatttggtctgggagatttaagaaggaggatgaaatcccggaaacagtgagcctggaaatgcttgatgctgctaaaaacaagatgcgtgttaagatctcgtacctgatgattgccctaacggttgtgggatgcattttcatggttatcgaaggaaaaaaagccgcccagagacatgagacactgacatctctgaatctggagaagaaagcccgactgaaggaggaggcagctatgaaagccaaaacagaatag

SEQ ID NO: 26159 - DNA, 489 bp, Artificial Sequence
  Description of Artificial Sequence: Synthetic coding sequence
atgctgcgcgcagttggcagcctgctccggttgggcaggggcctgactgtccgctgtggccccggcgcgcctctggaagcaacacgccgccccgcccccgcccttcctccgagaggactaccttgttacagcagtggcggcgcaccatctaactcaggcccgcaggggcatggagaaatccaccgcgtgcccacacaaagacgccccagccagttcgacaagaagatcctcttatggaccggaaggtttaaatccatggaggagatacctccaaggatcccccctgaaatgattgacaccgctcggaataaagcacgcgtaaaagcttgctatatcatgattgggttaactataattgcttgcttcgcggttatcgtatcagccaaacgcgcggtggaacgccatgagagcctgacaagctggaatctcgctaaaaaggccaaatggcgagaagaggccgccttggccgctcaagcaaaggcaaagtag

SEQ ID NO: 26160 - DNA, 504 bp, Artificial Sequence
  Description of Artificial Sequence: Synthetic coding sequence
atgaccgccggcacggtcgtgattactggcggcatactcgctaccgttatactactgtgcatcattgcagtgttatgctattgccggcttcaatattattgttgtaagaagtcaggaaccgaggtagctgacgaggaagaagaacgagagcatgacttgccaacacaccctaggggcccgacctgtaatgcatgctcgagccaggccttggacggccgaggctcattggcccccctgacttctgagccctgctcgcagccttgcggagttgctgcctctcattgtaccacgtgctcaccctattcctctcccttttacatcaggacagcagacatggtgccgaacggcggtgggggcgaacggctcagtttcgcacccacttattacaaggaaggcggccctcctagcttgaaactcgccgcaccgcagagctacccagtgacttggcccgggtccgggcgtgaagccttcaccaatcccagggccatttcgactgatgtttag

SEQ ID NO: 26161 - DNA, 501 bp, Artificial Sequence
  Description of Artificial Sequence: Synthetic coding sequence
atgaccgccggtacagttgtaatcacgggagggattctggccacagtgatcctgttgtgcattattgcggtgctctgttattgccgactgcaatactattgttgcaaaaaggacgaaagcgaagaagatgaagaggagcctgactttgccgtccattcacacctccctcccttgcacagtaatagaaacctcgtactcaccaatggaccagccctctacccgaccgccagcacgtctttctcacagaagagcccacaagccagggcgctgtgcagaagttgctctcattgcgagcccccaaccttctttctccaggagccccccgaagaagaggaggacgtgttaaacggaggcgagagggttctgtacaagagtgtgagccaggaagacgttgagctccctccaggggggtttggcgggctacaggccctcaacccaaacaggctgagcgcaatgcgggaggcgttcgctaggtccaggagcatctctacagatgtttag

SEQ ID NO: 26162 - DNA, 501 bp, Artificial Sequence
  Description of Artificial Sequence: Synthetic coding sequence
atgacagccggcactgtagtcatcacaggaggcatactggccacagtgatattactctgcatcattgctgtactgtgctactgcaggcttcagtattactgctgcaaaaaagacgagagcgaagaggatgaagaggaaccagacttcgctgttcattcacacctcccgcccctgcacagcaaccggaacttggtgctgacgaacggacccgctttgtatccaacagcctctactagcttctctcagaaaagcccgcaggctcgggccctttgtcgaagctgttctcactgcgagcctcctacattctttttgcaggagccacccgaagaggaagaagacgtgctgaatggcggcgaacgcgtcctctataaaagtgtcagtcaggaagacgtggaattgccacctggcggatttggtggtctacaggccctgaaccccaatagactgagtgcaatgcgcgaagcctttgcaaggtcacgcagtatcagtactgatgtctag

SEQ ID NO: 26163 - DNA, 177 bp, Artificial Sequence
  Description of Artificial Sequence: Synthetic coding sequence
atgaattggaaagtgctggaacatgtgcacctgctgctgtacatcttggcagccaagaccttaatactctgcctcgcctttgctggtgtcaagatctaccagcgcaagagactggaggctaagcagcagaagctcgaggccgaacggaaaaagcagtctgagaaaaaggataattag

SEQ ID NO: 26164 - DNA, 177 bp, Artificial Sequence
  Description of Artificial Sequence: Synthetic coding sequence
atgaactggaaggtgctggaacacgttccattactgttgtatattctagccgcgaagacgcttattctgtgcctcacctttgctggggtcaagatgtatcagagaaaacgcctggaggcaaagcaacagaaactggaagccgagagaaagaagcaaagcgaaaagaaagacaactag

SEQ ID NO: 26165 - DNA, 177 bp, Artificial Sequence
  Description of Artificial Sequence: Synthetic coding sequence
atgaactggaaagttctggagcatgtgccactgttgctctatattctggctgcaaagaccttaattttgtgtctcacatttgctggtgtcaaaatgtatcagaggaagaggctcgaggctaaacagcagaagctcgaagctgaaaggaaaaagcagagcgagaagaaagacaattag

SEQ ID NO: 26166 - DNA, 597 bp, Artificial Sequence
  Description of Artificial Sequence: Synthetic coding sequence
atgtcccggagtgccactctcctgctgtgtctgctagggtgccatgtctggaaagcagtgacaaaaacgctgcgtgaacccggagccggagcacaggaggttaccctgaaggtacacatatccgacgcttctacacaccagcctgtggctgatgcactcattgagatattcacaaatcaagcaagcatcgcttcagggacctctggtactgatggagtcgcatttatcaagtttcaatacaagctgggtagtcagttgattgtcacggctagcaagcatgcctatgtgccaaactccgctccttggaagccgattcgtctgcccgtattctcctccttgagtctaggactgctgccagagcgcagtgctacattgatggtgtatgaggatgtggtgcaaatcgtgtctggttttcaagggaatagcactaggcacgatctaacacccgttaccgcggtctccgtgcacctgctgagtagcaatggcactccagtgttagtggacggtccgatttatgtgacagtcccccttgcaacccagagtagtttacgtcataatgcctacgtagccgcttggcggttcgaccaaaaactgtag

SEQ ID NO: 26167 - DNA, 2673 bp, Artificial Sequence
  Description of Artificial Sequence: Synthetic coding sequence
atgtctcggtctgcaaccttactgctatgtttactcggctgtcacgtgtggaaggcggtcacaaaaaccttgcgggagcctggcgccggggcacaggaggtgactctgaaggtccacattagtgatgccagtacacaccagcctgtcgcggacgcgctgatcgaaatcttcaccaatcaggcgagtattgcaagcggtacgtcaggtactgacggggttgccttcatcaagttccagtacaaacttggcagtcagctgatcgtgaccgctagcaagcacgcgtatgtgccaaacagcgccccttggaaacccattcgcctacctgtctttagcagcttaagcctggggctgttaccagagcggagcgccaccctgatggtatacgaggatgtggtacagatcgtatccgggtttcagggcgcccgaccacaacctcgggtgcactttcagcggagagcgctgcgcctgcccgaaaatacaagctattcggacctgacagcctttctcaccgcggccagttccccctcagaggtcgacagctttccttacttgagaggcctcgatggcaacggcaccgggaactcaaccagacacgacttgacaccagtaacagcagttagcgtgcatctgctcagctccaacgggacgcccgtgttggttgatggtcccatatatgttacggtgccactcgcaacccaatcctcactgaggcacaatgcatatgtggcagcctggcgtttcgatcagaaactgggcacctggttgaagagcgggctgggcctagttcaccaggaaggatcacagctgacatggacctacatcgcacctcagctagggtattgggtggcagcaatgtccccccccatcccaggtcctgtagtcacacaggatattactacctatcatacagtgttcctactggcaatactaggaggcatggcctttattctgctcgtgcttctgtgccttctcttatactattgcagacggaagtgcctgaagccgaggcagcaccaccggaaattgcagcttcctgctggattggagtctagcaagagggatcagagcaccagtatgagtcatattaacctgctgttctctagacgggcttccgaatttccaggacccttatcagttacttctcatggacgcccagaagctccaggcacgaaagagctgatgtccggggtacacttagaaatgatgtccccaggaggtgagggagaccttcacacacctatgctcaagttgtcttactctacctcacaagagtttagctcgcgagaagagctcttgtcgtgtaaagaggaggacaagagccagattagttttgataacctcaccccaagcggtaccctcggaaaggactaccataagagcgtggaagtctttccactcaaggcccggaaatctatggagcgcgaaggatacgaatcatcaggcaacgatgactatcgcggctcctataacactgtcctgagccagcctcttttcgagaagcaggatcgtgagggacccgcgtccaccggctctaaactcaccattcaagagcacttgtatcctgccccttcctcaccagaaaaggagcaactgttggaccgtcgaccaaccgaatgcatgatgagcagatcggttgatcatctagagaggcctacttcctttccaagaccagggcagctgatctgctgttcatctgtggatcaggtcaacgattcagtatatcggaaggtcttgccagccctggttatcccagcccattatatgaagctccccggcgatcacagttacgtgtctcaacctctggttgtccccgccgaccagcagttggagattgagagactccaagcggaactttctaaccctcatgcagggatcttccctcatccctcaagccaaattcagccccagccgctgtcatcacaggccattagccagcagcacctccaagatgccggcacgagagagtggagccctcagaatgcctcgatgtccgaaagtctgagtattcccgccagtctgaacgacgcggccctagcccagatgaacagcgaagtacaactgctgaccgagaaagcccttatggaactcggagggggtaagcctctgccccacccgagagcatggtttgtatctctcgatggaaggtccaacgcacacgtgcgacactcatatatcgacctccagcgggcggggaggaatggaagcaacgacgcaagtctggattcgggggtcgatatgaatgaacccaagtcagcccgcaaggggcgaggagacgccctcagtcttcagcagaattacccgcccgtccaggagcaccagcagaaggaaccgcgcgcacctgactcaacagcctatactcagctcgtctacttagacgacgtggagcaatctggatcggaatgcgggaccacagtctgtacacctgaagattcagctctgagatgcctcttggagggaagctctcgtcgctcaggcggccaactgccgagtctccaagaagaaactaccaggaggacagctgatgcccccagtgaaccagccgccagccctcatcagagacgttctgctcatgaagaggaagaggacgatgatgatgatgaccaaggcgaagacaagaagtcaccctggcagaagcgggaagagaggcctctgatggccttcaacatcaagtag

SEQ ID NO: 26168 - DNA, 2670 bp, Artificial Sequence
  Description of Artificial Sequence: Synthetic coding sequence
gggggggacgagcaagtccgggatgcagccgccgtcccagccggcctgccgaggctcgaggggggcgataccttacgggaaccaggggctggggctcaggaggtcacactcaaggtgcacatatcagacgcctccacccatcagcctgtggccgatgcactaattgagatctttacaaaccaagcctcaattgcatctggaacgtcaggaaccgacggagttgcattcatcaagttccagtacaaactgggctcccaactgattgttaccgcctccaagcacgcctacgtgcctaacagtgccccctggaagcccatcagactgcctgtgttcagtagcctgagtctcgggctgcttcccgagcgctcagccaccctgatggtctatgaggatgtcgtacagatcgtgagcgggttccagggagcccgacctcagcctagagtacatttccagaggcgcgctcttaggctaccagagaacacaagctactctgatttgactgcctttctcaccgccgccagctctcctagcgaagtcgactcatttccttatttgcgtggcttggatggtaatgggacggggaactccacccgtcatgaccttaccccagtcaccgctgtgagcgtgcacctgctaagttcaaacgggaccccagtgctggtggatggtccaatttatgtcaccgtacccctggcgacccagtcatctctgcggcacaatgcatacgtcgccgcttggcgctttgaccaaaagctcgggacctggctgaagtctggcctgggactagtgcatcaggagggctcacagctcacttggacctatatcgccccccagctggggtactgggttgccgcgatgtctcctcctatcccgggcccggtcgttacccaggatattaccacctaccacaccgtattcttgctggcaatactcgggggaatggcattcatcctattggtactgctgtgtctgctgctatactactgtaggcgcaagtgtctgaaacctagacagcaccataggaagctgcagctccctgcaggactggagagttccaaaagagatcagtccacctccatgtcccatataaacctgctcttctctcgccgggctagcgaatttccgggtccgctgtcagtgacctctcacggacgtccagaggcgcccgggaccaaagaacttatgtccggagtccacctcgaaatgatgtcccccggcggtgagggagacctgcacacacctatgctcaagctgtcgtacagtacctcccaggaattcagctccagggaggagttgttgagttgtaaggaagaagataagtcccagatctctttcgataacctcacaccaagcggcacccttggcaaagattaccataagagcgttgaggtgttccccttgaaagcacgcaaatctatggaaagagagggctatgaatccagcatgatgactacgggcgtggtgactactccttgttcacacagcttgtacctcaagtctaggacagagaaagttcagccgccgcgcgaggcgaattccccctttagaaacatctgtacacccagactgcaccatctccgaaagaatagctgctggaccgccgacccattgaacatgatgagtagatccgtagaccacctggaacgaccaacctcttttcccagacccggacagttgatttgttgttcctcagtggatcaggtcaatgattcagtgtataggaaagtccttcctgctctcgtgatacccgctcactatatgaaactgcctggtgatcatagctatgtctcccagcctctggtcgtcccagctgatcaacaactggaaattgagcgcctccaggcagagctgagcaaccctcacgccggaatttttccacacccctcctctcagatccaaccccaacccctctccagccaagccatctcccaacagcatttgcaagacgctgggactagagagtggagccctcaaaatgcatctatgtcagaaagtctgagcatcccagcctctttgaatgacgcagctcttgcacagatgaacagtgaagttcagctgctcacagagaaggctcttatggagttaggaggaggtaagccactgcctcacccaagagcctggtttgtcagcctggacggccgatccaacgcacacgtgcgccattcgtatatcgatttgcagcgggctggaagaaatggcagcaatgacgcatctctggattccggggtcgatatgaacgaaccaaagtccgcccgcaaaggcaggggcgacgccctgagccttcagcagaactacccaccagtgcaggaacaccagcaaaaagaaccgcgagcccctgatagcactgcctatacacaactggtctaccttgacgacgtggagcagagcggctccgagtgcggcactacggtgtgcacccctgaagactctgcccttagatgcttgcttgagggcagttctcgtaggtccgggggacagttgccaagcctccaagaagagacaacccggaggacagccgacgctccttcagagcctgcagcctccccccaccagaggagaagtgcacatgaagaagaagaggacgacgacgacgacgaccagggggaggacaagaaatctccctggcagaagagagaggagaggccccttatggcatttaacattaaatag

SEQ ID NO: 26169 - DNA, 597 bp, Artificial Sequence
  Description of Artificial Sequence: Synthetic coding sequence
atgtctcggtccgccactctcctgctctgtcttcttggctgtcatgtttggaaagctgtgacgaagacccttcgggagcccggcgctggggctcaggaagtgacactcaaggtacacattagcgacgcatccacacatcagccagtcgctgacgctctcatcgagatctttaccaatcaggcctccatcgccagcggtacatccggtaccgatggggttgcatttatcaaatttcaatataaacttggctcacagctcatcgttaccgcctctaagcacgcctacgtgcccaatagcgccccttggaaacctatcagactgcccgtgttttctagcctgagccttggcttactgccggagaggtcggcaaccctgatggtgtacgaggatgtagtgcagatagtctccggatttcagggcaactctacgcggcatgatcttacccctgttacagccgtgagtgttcacctgctgagttccaatgggacgccagtgctcgtggacggacccatttacgtgacagtgccactcgcaacccaatcctcactccgtcacaacgcttacgtggccgcttggcgatttgatcagaagttgtag

SEQ ID NO: 26170 - DNA, 2481 bp, Artificial Sequence
  Description of Artificial Sequence: Synthetic coding sequence
atgcccccggccagcggaccttcggtgttggccaggcttttgcctctgctcggtctgcttctaggtagcgctagccgggcgcccgggaaaagccctccagagccaccaagcccccaggagatactgatcaaagtccaggtctacgtgtcgggagaactggtccctcttgcacgtgcttccgtggatgtgtttggcaatcgcacattgctcgcagccggtactaccgattccgaaggcgtggccactttgcctctgagctaccgcctgggaacttgggtgctggtcaccgccgcgcgccccggcttcctcacgaactcggtgccttggagggttgataagctgcctctgtatgccagcgtgagcctgtatttgctccctgagcgacctgcgacactcattctgtacgaggatttagtccacatcctgttggggtcgcctggagcaaggtcccaaccactggtgcagttccaacggagagccgccaggctgccagtgagctctacctattctcagctctgggccagcctgacacccgcctcaacccagcaagaaatgagggctttcccagccttcttaggaactgaagccagctcttccggcaatgggtcttggcttgaactgatgcctctgacggctgtgtcggtgcacttgctgacggggaacggaaccgaggtgccactctcaggtccaatccatttgtcactgcccgtccccagtgagactcgagcgcttaccgtgggaacctccattcccgcctggcggttcgacccgaaaagtggcctttgggtgagaaatggcaccggggtgatccggaaggaaggaagacagctgtactggacatttgtgtcaccccaattgggatattgggttgccgctatggcctctccaaccgcgggcctggtaaccataacttcaggcattcaggacattggtacgtatcacaccattttcctcttaacaatcctggccgcactggctctcctcgttctgatcctgctttgcttactgatctactactgtcgacgcaggtgcctgaagccaaggcaacagcaccgaaagttacaactgagcggcccctccgacggcaacaagcgagatcaggctacctcaatgtctcagctgcatctgatctgcgggggcccattggaacctgccccttcgggagacccggaggccccccctcccgggcccctccactcggccttctcttcttcccgagaccttgcatcctcaagggatgatttcttccgcactaaaccgcggtccgcttctaggccggccgccgaaccatcgggtgcccgcggaggtgagtccgccggcctgaagggagcccggtcagcggagggcccaggaggcctggagcctggtcttgaagagcacaggcgagggccatctggagccgccgcttttctgcacgaaccaccctctcctccccccccttttgatcactacttgggccataaaggcgcggcagagggcaagacccctgacttcctcctgtcacaatccgtagatcagctggcgcggccccccagcttgggccaggctgggcagttgatattctgcggctccatcgatcacttgaaagataatgtgtacaggaatgtgatgccaaccctcgtgatccctgctcactacgtgaggcttggaggggaagcaggagctgccggcgtgggtgacgagccagccccgccggaagggactgcacctggtcctgcccgcgcattcccccagccagacccgcagagaccccagatgcccgggcactctggacctggaggtgaggggggtggcgggggaggtgaaggatggggagcagggagggccgcacccgtgagcggttcagtgaccatccccgtgcttttcaatgagtctactatggcccaactcaatggggaactgcaggcgctcacagagaaaaaactcctggaattaggcgtgaaaccacacccacgggcttggtttgtttcgctggatggccgtagcaattctcaggttaggcactcatacatagacctccaggccggagggggcgccagatcaacggacgcttctttagacagtggtgtggatgtccacgaagctcgccctgctcgacgcagacccgccagagaggaacgcgagagggctcctccagccgcgcctccccccccccccgccccccccaggctggccctgagtgaagatacagaaccatcctcttccgaatcgcgcactggcctgtgtagcccagaggataatagcctgaccccactgctcgatgaggtcgcggcccctgagggtagagccgctaccgtccctcgcgggagagggcgttcccgcggcgattcatccaggtccagtgcatccgagctgagaagagattccctcacttcaccggaagacgagttgggcgccgaagtcggcgatgaggctggggacaagaaatccccctggcaaagaagagaggagcgccctcttatggtctttaacgttaagtag

SEQ ID NO: 26171 - DNA, 1284 bp, Artificial Sequence
  Description of Artificial Sequence: Synthetic coding sequence
atggcccggctgtgcaggagagtaccctgtactctgctgctgggcctggcagtcgtgctgcttaaggctaggcttgttcctgctgccgcccgggctgaattgagcaggagcgacctttcactgatccagcaacagcagcagcagcaacaacagcagcagcagcagcaaaagcaattggaagaggctgaagaagagcggacagaggttccaggagctacctcaacgcttactgtgccagtcagcgtctttatgctgaaggtccaggtgaatgacataatctctcgtcagtacctgtcacaagccgttgttgaggtgtttgtgaactacacaaagaccaattcaactgtgactaagtccaacggcgctgtgcttatcaaggtcccatacaagctcggtctttcacttacaataatcgcgtacaaagacgggtatgtcctgacacctctaccgtggaaaacaagacggatgccgatctactcatccgtgactctgtccttgttcccccagtcccaggccaatatctggttatttgaggacaccgtgttaatcacaggcaagctggcagacgccaaatcccagccaagcgttcagttctctaaggccttgataaagctgcccgacaaccatcatataagtaatgtcaccggttatctgactgttctccagcaatttttgaaggtggataactttctacatacgaccggcattactctcaataagcctggctttgaaaatatagaattaacacccctcgccgcaatctgtgtgaaaatttattctggcggaaaggaactgaaggtcaatggctccattcaagtttctttaccactgctacggcttaatgatatttctgcaggagacagaatccccgcctggacatttgacatgaatacaggcgcgtgggtcaatcacggccggggaatggtgaaagagcacaataaccatctcatttggacttacgacgccccccacctgggatattggattgctgcgcctcttcctggtacccgggggtccggaatcaacgaagattctaaggacatcacggcttaccacacagtgttcctcacagcgatccttggcgggaccattgtgatcgtgattggattttttgcagtgctgctttgttactgccgcgacaagtgcggcaccccgcagaaaagggagcgcaatatcacaaagctggaagtgctgaaacgcgaccagaccacatccacgacccacatcaaccacattcgcaatagaagaaagtcctttcacgggaagaattcaggcaggttctag

SEQ ID NO: 26172 - DNA, 2481 bp, Artificial Sequence
  Description of Artificial Sequence: Synthetic coding sequence
atggcccgcttgtgccgacgggtcccctgcacgctgcttctcggtctagcggtggtcctgttaaaagcccgtctggtgcctgcagcagccagggctgagctttcgcgcagcgacttaagtctgattcagcagcagcagcaacaacagcaacagcagcagcagcagcagaaacaactggaggaagccgaggaggagaggacggaagtgcccggcgctacaagcactctgaccgtcccagtctcggtgtttatgctaaaggtgcaagtcaatgacataattagccgacaatacctctctcaagccgtggttgaggtgtttgtgaattacacaaaaaccaattcaactgttaccaagtctaatggcgcggtccttattaaagtcccatacaaactaggtttgtctttaacgatcatcgcatacaaggatggttacgttctgacccccctgccctggaaaacacgtagaatgcctatctattctagtgttacacttagcctctttccacagagccaggctaacatctggttgtttgaggacaccgtgcttattaccgggaagcttgcggacgccaagagccagccttcagtgcagttcagcaaagccctcatcaaactccccgacaatcaccacatttcaaatgtcactggctatctgactgttctacagcaattcttgaaagtggataacttcctccatacaacaggaatcaccttaaataagccagggttcgagaacatagagttaacccccctggcggccatctgtgtcaagatatacagcggcggaaaagagcttaaggtgaacggttctattcaggtgagcttgcccctcctgagattgaacgatatctccgccggagacagaattccagcctggacttttgacatgaatacaggcgcttgggtaaaccatggacgaggcatggtaaaggaacacaataatcatctgatatggacctacgatgccccacatctcggctactggatagccgcccccctgcccggcacaaggggcagcggcatcaacgaggattcaaaagacattaccgcttaccacacagtattcttaacagctattctcgggggaaccatagtgattgtgatcggcttttttgctgtgctcttatgctactgcagggacaaatgtggaactccgcagaaaagagagcggaacatcactaagttagaggtgctgaagcgggatcagacgacgtctactacccacataaatcacatcagcaccgtcaaggttgcgctcaaggccgaggacaagtcccagctttttaacgcaaaaaattcctcttatagcccacagaagaaagaacccagtaaagccgaaacagaggaacgggttagtatggtgaaaacaagggacgattttaagatatacaatgaagacgtctcctttctctcggtaaaccagaataattatagccgtaatcccacacagagtctagaacctaatgttggcagtaagcagccgaaacacataaacaataacctcagtagttctctgggagatgcacaagacgagaaaagatatctcaccggcaatgaggaagcctacgggcggagtcacattcccgaacaactgatgcacatatattctcagcccatcgcgattctgcaaactagcgatctgttctctaccccggagcagcttcacaccgctaagtctgcgacactgccccgcaaggggcagctagtgtatggccaactgatggagccagttaatagggaaaacttcacacagactctgccaaaaatgcccatccattctcacgctcagccccccgatgctcgggaggaggacatcatcttggagggccagcagtcccttccgagccaagcatctgactggtccagatactcaagctcactcttggagtctgtctctgtgcctggcacgttgaacgaagccgtggtcatgactcccttctcatccgagctgcagggcatctcagaacagaccttattggaactgagcaagggaaagccctctccacatccacgagcttggtttgtttcactcgacggtaagccggttgcacaagtccgacactcattcattgatctgaagaaaggcaagcggacccaatccaacgacacatcccttgatagcggcgtggacatgaacgaactgcactcatcaaggaagctcgagagggagaaaaccttcattaagtcaatgcatcaaccaaagattttgtatctggaggatctggatctatcgtcatcagaaagcggcactacagtgtgcagcccagaagacccagcactgcggcacatccttgacgggggctctggcgtcatcatggagcaccccggggaagaaagccccggacgtaagtccacggttgaagactttgaggccaacacttcaccaaccaaacgccgggggcggcctcccctcgcaaaaagagattccaaaacaaacatttggaaaaagcgagaagagagacctctaattcccatcaattag

SEQ ID NO: 26173 - DNA, 708 bp, Artificial Sequence
  Description of Artificial Sequence: Synthetic coding sequence
atggagcaagatgatccggtcgaggccttgacagagctgagagaaagacggctgggggctctggagctccttcaagcggctgctggcagtggcctggcagcttacgccgtctgggccttgctgctacagcctggctttaggcgggtgcctctgcggctgcaggtcccatatgtaggagcctcggcccggcaagtagagcatgtcctgtccctgctgcggggcaggccgggaaaaactgtcgacctaggctcaggcgacggccgcatcgttctggccgctcacagatgcggactacgcccagccgtggggtacgagctgaacccttggttggtcgcccttgctcgtctccacgcttggagagcggggtgcgccggtagcgtgtgttaccgccgaaaagacctttggaaagtgtctctgagagattgcaggaatgtctcagttttcctcgctcctagcgtgctgcccctgctggaggacaagctcaggaccgagttacctgctggtgcaagagtggtcagcgggaggtttcccctcccaacgtggcagcccgtgaccgctgtcggagaaggtctggatcgggtctgggcatacgacgttcccgagggtgggcaggcgggggaagccgcgtcatcacggatacctatccaggccgcccctggccctagctccgcccctattccgggcggtctcatctcacaagcctcatag

SEQ ID NO: 26174 - DNA, 879 bp, Artificial Sequence
  Description of Artificial Sequence: Synthetic coding sequence
atggctcagcccccacccgatgtggaaggagacgattgtcttcccgcctacagacacctgttctgccctgacctcttacgtgacaaagttgccttcatcaccggagggggatccggcatcggatttcggatcgcagaaattttcatgcgacatggatgccatacagttatcgcctctcggtctctgccgcgggtccttacagctgctaggaagctggcaggggctaccggccggaggtgcttaccattatctatggacgttcgcgccccacctgccgtgatggcagcagtcgaccaggcactaaaggagttcggtcggatcgatattctcataaattgcgccgcaggaaattttctctgtccagctggagcgctcagtttcaatgccttcaagactgtgatggatatcgacacatcgggcacgttcaacgtgagccgagttctctatgaaaagtttttccgcgatcatgggggagtgatcgttaacattactgccaccctaggcaatagaggacaggcactgcaggtacacgccggttccgccaaggcagctgtggacgctatgaccagacacctggccgtggagtggggccctcagaacatcagagtgaattcactcgcgcccggcccaatctccgggactgaaggacttcggagactgggtggacctcaggccagtctgagcacgaaggtgacagcgtcacctcttcagaggctggggaacaagaccgaaatcgctcactcagtcctgtacctcgcttctcctttagcctcctatgtgacgggcgccgtgctcgtcgcggacggaggagcgtggctgactttccctaacggtgttaagggactcccagacttcgcctcattctcagccaagctatag

SEQ ID NO: 26175 - DNA, 702 bp, Artificial Sequence
  Description of Artificial Sequence: Synthetic coding sequence
atggagggaggagggggtattcccctagaaacgctgaaagaagaatcccaaagcaggcatgttctgccagcctctttcgaagtgaattcactgcagaagagcaactgggggtttttactcaccggactggtgggtggtacactggtggccgtgtatgcagtggccactcctttcgttacccccgcattaaggaaagtttgtctgccattcgtacccgcaacaacaaaacagatagaaaatgtagtgaaaatgctgaggtgcaggagaggtagcttggttgatatcggcagtggggacgggcggatcgtcattgcagccgctaaaaaaggcttcacagccgttgggtatgagcttaatccatggctggtgtggtattctcgataccgtgcctggagggagggcgttcacggcagtgcgaagttttatataagcgacctctggaaagttacatttagccagtatagtaacgttgtgatctttggcgtaccccagatgatgctccaactggaaaagaaactcgagcgggagcttgaggatgatgcacgtgtcatcgcttgccgtttcccctttccccattggacacctgaccacgtcaccggcgagggcattgacaccgtttgggcttacgatgcatccacatttcgcggccgcgaaaagagaccatgtacatcgatgcattttcagctgcctatccaagcttag

SEQ ID NO: 26176 - DNA, 573 bp, Artificial Sequence
  Description of Artificial Sequence: Synthetic coding sequence
atgaaggcctcccagtgctgctgctgtttaagccatttgctcgcttctgtgctgctgcttctcttgctccccgagttaagtgggcctttagcggttttgcttcaggctgccgaggcagcaccagggttaggcccacctgacccaaggcctagaaccctgcccccccttcctccaggacccactccagctcagcagcccggtcgggggctggcagaagcagccggccctcgcgggtctgaggggggtaatggttctaaccccgtggccggcttagagaccgacgatcatggaggtaaagccggggaaggctcggttggcggggggttagctgtttctccaaaccctggagataaaccaatgacacaacgcgccttgactgttctgatggtagtgtcgggagccgttctggtatacttcgtggtgcgcaccgtgaggatgcgcagaagaaaccgaaagacccgccggtacggggtgctcgatactaatattgagaatatggaacttaccccactcgagcaggacgacgaagacgacgacaatacccttttcgacgctaatcaccccagacgttag

SEQ ID NO: 26177 - DNA, 480 bp, Artificial Sequence
  Description of Artificial Sequence: Synthetic coding sequence
atgagagcagtgcctctgccggcaccgctgcttcctctgctactcctggctctcttggccgcaccggctgctagagccagccgtgccgaatctgtgtccgctccatggcccgaaccagagcgcgagtccagaccccctcccggccccggccctggaaacacaacgcgttttggaagcggggccgcgggagggtccggaagcagctcaagcaacagcagcggagatgcattagttacccgcatttctatcctcctcagggacctgcccacactgaaggcagctgtcattgtagctttcgctttcaccacgctgcttatcgcatgtctgctccttcgcgtctttaggagcggaaagcgactgaagaaaacgcgtaagtatgatataataaccactcctgcggaaagagtagagatggccccactgaatgaggaagacgacgaagatgaggattctaccgtgtttgatattaaatacaggtag

SEQ ID NO: 26178 - DNA, 1293 bp, Artificial Sequence
  Description of Artificial Sequence: Synthetic coding sequence
atggcagcgaggttgctccgcggctccctgcgagtgctcgggggccaccgcgcccctcggcagctaccagccgcacggtgctctcattcaggcggcgaggagaggcttgaaacgccttctgccaaaaagttaaccgacatcgggataagaaggatcttcagtccagaacacgacatcttccgtaagtccgtccgaaagttcttccaagaggaggtgattcctcaccactccgagtgggaaaaagcaggcgaggtctctcgggaagtttgggagaaggccggcaagcagggactcctcggggtcaatattgcagaacatctcggcggaattggcggtgatttgtactcagctgccatcgtttgggaagagcaggcttatagcaactgtagcggacccgggttcagtatacattccggaatagtaatgagctacatcaccaaccacggcagtgaggagcagattaagcatttcatacctcagatgacggctggaaaatgtatcggcgctatagccatgaccgagcctggtgctggtagcgacctgcagggaatcaaaacaaatgccaagaaggatggaagcgattggatactgaatggaagtaaggtgttcatctctaatggttccctgtccgatgtggtgatcgtcgttgccgtgaccaaccatgaggcgcctagtccagctcatggcatcagtctattccttgttgagaatggcatgaaaggcttcattaaggggagaaagcttcataagatgggactcaaggcacaggacacagctgagctctttttcgaagacattaggcttcctgctagcgccttgttgggtgaagaaaacaaaggtttttattacatcatgaaggagcttccacaagaacgcctgttgatagctgacgtcgccattagcgcctcagaattcatgttcgaggaaactcggaattatgttaagcagcgtaaagctttcgggaagactgtggcacacttgcaaactgtacaacacaaactggccgagctgaagacacatatttgcgtcactcgggcctttgtggataattgcctacagctgcacgaagccaagagactggatagcgcaacagcctgtatggccaagtactgggccagcgagttgcagaactctgtagcctacgactgtgtgcagctgcacgggggctgggggtatatgtgggaatatcccattgccaaagcctatgttgacgcgcgtgtgcaaccaatttatggtggaacaaacgaaatcatgaaagagcttattgcaagggagatagtgtttgacaagtag

SEQ ID NO: 26179 - DNA, 459 bp, Artificial Sequence
  Description of Artificial Sequence: Synthetic coding sequence
atgagactgcccctgagccattctcccgaacatgtggagatggctctgttatcaaacatcttagcagcctactccttcgttagcgaaaatcctgaacgggctgccttgtatttcgtatcgggcgtctgtatcggactggtgctgacgctggcagcactggttattcggatatcttgccacaccgattgtaggcgccgacccggcaagaaatttctacaggatagagagagctccagtgacagttcagatagcgaggatggcagcgaagacaccgtcagcgatctgtccgtgcgcagacacaggagattcgagcgcactttaaataagaacgtgtttacctcagcggaggaactggagcgggctcaacggctcgaggaaagagagcgcattatacgtgagatttggatgaatggccagccagaggttccaggaactcgctcgctgaaccggtattattag

SEQ ID NO: 26180 - DNA, 459 bp, Artificial Sequence
  Description of Artificial Sequence: Synthetic coding sequence
atgaggctgcccctgagtcacagtcctgaacatgtggagatggcattactttctaatattcttgctgcttattcgttcgtaagcgagaaccccgagagagctgcgctgtactttgtcagtggtgtttgtattggattggtactaacgttagccgccctggtgattaggatctcttgccatactgattgcagacgcagacccgggaaaaagttcttgcaggatcgcgagtcatcctccgacagcagcgattcggaggatggctccgaggatactgtcagcgacctgtcagtgcgaagacatcggcgctttgaacggaccctgaacaagaatgtcttcactagcgcagaggaactggagagagctcaaaggctggaagagcgcgaacggataatcagagagatttggatgaacggacaaccagaggtccccggcacccgaagcttgaatcgctattattag

SEQ ID NO: 26181 - DNA, 459 bp, Artificial Sequence
  Description of Artificial Sequence: Synthetic coding sequence
atgcgccttcccctgagccactctcctgagcatgttgagatggccctgttgtctaacattctggctgcctactccttcgtgtctgagaaccctgagagggcagccttatatttcgtgtccggagtgtgcatcgggttagtcctaaccctggccgcgctggtgataaggatctcttgtcacacagattgtcggaggcgtcctggtaaaaaattccttcaggacagggagagctcaagcgactcttcagattctgaagatgggtccgaggacaccgtgtccgacttatctgtcaggcggcaccggcgcttcgaaaggaccctgaacaagaacgtcttcaccagtgctgaggagctggagcgcgctcaacggctggaagagagagagcgcattattagagagatttggatgaacggtcaacctgaagttcctggaactcggtccttaaaccggtactactag

SEQ ID NO: 26182 - DNA, 432 bp, Artificial Sequence
  Description of Artificial Sequence: Synthetic coding sequence
atgcggttacctttgtcccacagccccgagcacgtggagatggcactcctgtcgaatatcctagccgcatatagctttgttagtgagaatcctgaaagggcagccctttactttgtgtctggggtatgcatcggcctggtcttgacactggcggctcttgtgatccggatctcgtgtcataccgactgtcgaagacggcccggcaaaaagtttctgcaggaccgggagtccagttcagattcatctgactccgaagacggatcagaagacacagtcagtgacctctcggtgaggaggcatagacggtttgagcgaacccttaataaaaacgtcttcacctccgctgaagagttagagcgggcacagagattagaagagcgagaaaggattattcgggagatctggatgaatggacaacctgaagtgccgtag

SEQ ID NO: 26183 - DNA, 306 bp, Artificial Sequence
  Description of Artificial Sequence: Synthetic coding sequence
atgcgattaccactctcacacagtccagagcacgtggagatggcacttctgagcaatattcttgccgcgtattccttcgtctcagagaatcctgagagagcggcactgtactttgtgtcaggggtgtgcataggactagtgttgactttggccgccttagtgatcagaatttcctgccacacagattgtcgaaggaggccgggaaagaaattcctccaggatcgcgaatcgtcaagcgacagctccgacagcgaagatggcagtgaggacacagtgtctgacctgtccgtgagacggcaccggtag

SEQ ID NO: 26184 - DNA, 612 bp, Artificial Sequence
  Description of Artificial Sequence: Synthetic coding sequence
atgctgcagcaggatagcaacgacgatactgaggacgtgtccctgtttgacgccgaagaggagacgaccaacaggccccggaaagccaagatacgacatcccgtagcctcatttttccatcttttttttagagtaagcgccattattgtctgcctgttgtgtgagctactgtcatcatcttttatcacctgcatggtgaccataatactgctgttgtcatgcgatttttgggctgtgaagaacgtaaccggccgtcttatggtgggacttcgctggtggaaccacattgatgaggacggcaagtcacactgggtgttcgaatccagaaaggaatcaagtcaggagaacaaaaccgtctcggaggcggaatctcgcatattttggctcggactcatagcctgcagtgtgttgtgggtgatcttcgctttcagcgctctcttttctttcactgttaaatggctagccgtcgtgattatgggggtcgtccttcagggggctaacctgtacggctatatacgctgtaaggtgaggtcccggaagcatctcacttcaatggcaaccagctacttcggtaagcagtttcttcggcaggtgagtgtgttttggatgtag

SEQ ID NO: 26185 - DNA, 642 bp, Artificial Sequence
  Description of Artificial Sequence: Synthetic coding sequence
atgaaacaggccctggtcgatgatactgaggacgtaagcctggattttggcaacgaggaggaactggcatttagaaaggctaagatccgacaccccctcgcgactttcttccacctgttcttcagggtgtcagccattgtcacctacgtatcctgcgattggttctcaaaatcatttgtgggatgtttcgttatggtgctgctcctgctgtctcttgacttttggtcagtgaagaacgtgacaggcagactacttgttggcctgagatggtggaatcagattgacgaggacggtaaatcgcattggatcttcgaggcccgtaaggtgtctcctaattcgattgctgcgaccgaagcggaagcccgaatattttggcttggcctcattatctgcccaatgatttggatcgtttttttcttcagcacactctttagcttaaagctgaagtggcttgccctcgtcgtggcaggtatttccctccaagccgcaaatctgtacggttacatactttgtaagatgggcggaaactctgacatcggaaaagtgacagcttcctttctttctcaaacagtatttcagacagcgtgtccaggtgatttccaaaaacccggactggagggtcttgagattcaccagcattag

SEQ ID NO: 26186 - DNA, 567 bp, Artificial Sequence
  Description of Artificial Sequence: Synthetic coding sequence
atgaagcaagccctggtggatgacaccgaagatgtatcccttgactttgggaacgaagaggagctggctttccggaaagctaagatccgggaccgggtctctaagctgctggcgtccgtgatcctgctgccctggcctcccaaggtgctgggacttaagaacgtcactggtcgcctgctcgtgggtctgcgatggtggaatcaaatcgacgaggacggcaaatcccattggatatttgaagctagaaaggtgtctcctaattctatcgctgctacagaagccgaggcacgtatattttggctcggcctgataatttgccccatgatttggattgtgttcttttttagcacacttttcagtctgaaattgaaatggctggctctggtggtcgcggggatatcgctacaagccgccaatctgtacggatatattctgtgtaagatgggcggaaattccgacataggaaaagtaactgcgagtttcctcagccagaccgtgtttcagacagcctgtccaggggacttccagaaaccaggcttagagggcctggaaatacaccagcactag

SEQ ID NO: 26187 - DNA, 618 bp, Artificial Sequence
  Description of Artificial Sequence: Synthetic coding sequence
atgctccaacaggatagtaatgacgacacggaagatgtcagtctatttgacgccgaggaagaaacgaccaataggccgagaaaggccaaaattcgtcatccagtggcctcattttttcacctgttctttcgcgtctctgccattatagtctatctgctgtgtggattgttaagcagctctttcatcacatgcatggtgactatcatcctgctgctgtcctgcgatttctgggccgtaaaaaacgtgacgggcagactgatggttggacttaggtggtggaatcatattgacgaagacgggaagtcgcactgggtatttgaatccaggaaagaatcctcgcaggaaaataagacggttagtgaagctgaatcaagaatattctggctaggcctgatagcttgccccgtcttgtgggtcatcttcgccttcagcgccttgttttctttcagggtgaagtggctggcagttgtgatcatgggggttgtcctgcaaggcgcaaacctgtatggctacattcgctgcaaggtcagaagtcgtaagcacctcacatcaatggcaacatcatatttcgggaaacagtttttgagacagaacactggcgatgatcaaaccagctag

SEQ ID NO: 26188 - DNA, 786 bp, Artificial Sequence
  Description of Artificial Sequence: Synthetic coding sequence
atgacctgttggctgcgcggcgtgaccgctacatttggtagacccgctgagtggcctggttatttgtcacacttgtgtggccgcagcgcagcaatggacttaggccccatgagaaaaagctatcgcggggatcgcgaggcttttgaggagacccacttgacctctctggaccctgtgaagcaattcgctgcatggttcgaagaggctgtgcagtgccccgatatcggagaggcaaatgctatgtgtctggccacctgcacaagagacgggaaaccaagcgcccgcatgcttttactaaaaggtttcggaaaggacggtttcaggtttttcaccaactttgagagtcgtaagggcaaggaattagactctaaccctttcgctagcttggtattttattgggagccactgaaccgtcaggtccgcgttgaaggcccagtgaagaaactgccggaagaggaggctgaatgttatttccatagtcggccaaaatcctcccagatcggcgccgtggtgtcccaccaatccagtgtcattcccgacagggaatatctacgtaaaaagaatgaggaactggaacagttgtatcaggatcaagaagtgccaaaacccaaaagttggggcggctacgttctttatccacaagtgatggaattctggcagggacagacaaacagactacacgatcggatcgtctttcggcgtggactgccaactggagattccccgttggggcccatgactcacagaggggaggaggattggctgtatgaacggcttgctccctag

SEQ ID NO: 26189 - DNA, 612 bp, Artificial Sequence
  Description of Artificial Sequence: Synthetic coding sequence
atgcttcagcaggacagtaatgacgatacagaagatgtgtcccttttcgacgcggaggaagagacgaccaaccggccaaggaaagctaagattagacacccagtggccagcttcttccatctcttcttcagggtgtccgcaatcattgtgtgtttactctgtgagctactctcgtcttccttcataacctgcatggtgaccatcattctgctgttaagctgtgacttctgggcagtgaagaacgtgacaggtaggctcatggtgggccttcgctggtggaatcacatcgacgaggatggtaagtctcattgggtttttgaatcccggaaggaatccagccaggagaataagaccgtttctgaagcagagtcacggatcttttggctaggcctgatagcctgctcagtgttgtgggtaatctttgctttctcagcacttttctcattcactgtcaagtggcttgctgtggtgataatgggtgtggtgctccagggcgccaacctatacggttacatcagatgcaaggtacgatctaggaagcatctgacaagcatggcgacctcgtacttcggaaagcagttcctacggcaggtgtcagttttctggatgtag

SEQ ID NO: 26190 - DNA, 558 bp, Artificial Sequence
  Description of Artificial Sequence: Synthetic coding sequence
atggtgggattacgatggtggaaccacatcgacgaagacggtaagtcacactgggtcttcgaaagccgcaaagagagcagtcaggaaaacaaaaccgtctcagaggccgaatctcgaatcttttggttgggccttattgcctgcagcgtactgtgggtcatttttgcattttcagcactcttctcgttcaccgtaaagtggctcgctgtagttatcatgggggtggtactgcagggcgcaaatctttatggctacattcgatgtaaggtccgctctcgcaagcacttaacatccatggcgacatcctacttcggaaaacagtttctgcggcagcgtcgatctcgccacattgcacagaccgggctcaaagttctgggctctcgcgatcctcccgcatcagccttccagtcggctgggattaccggggtcagtaggtgtcccggacacccaagcaggaagtttcaccaagactcccaaaagactcttgactttccagggtcatacctaaaaaacatgaccccgggccggcctatgtctcctatccctcttcggcagtag

SEQ ID NO: 26191 - DNA, 1110 bp, Artificial Sequence
  Description of Artificial Sequence: Synthetic coding sequence
atgccacccatgctttggcttctcctccactttgcagctccagccctcggattctacttttccatctcatgtccttctggcaaacagtgtcagcaggccttgctgtctgggaatgatattctgctctactgtaatagtagcggtgcacattggtattacctttttactcagggcaagaagggccgcttaacatccttgactaacatcagcaacatggaaattatgccagaagggagtctcctcatcaaagatcccctgccaagccagaccggcttgtatcattgttggaacaaaaacggccgccaggtggtccagtatgagatcgactttcaggacgtgactacgttgcacatcacacataaagacctgggccaacgtccactgcagaacgagacactccatctgggctctaaacagttaatctttacgtggtgggaaccatggcaagactgcaaccgatgcgaagaacctggagagtgcaagcggctgggctatcggtacattgaggaaccccttgaagaggctatgccatgctggctgtaccttggcgaagtactcgtttggtcttcacgacttcgtccagagctccaagtcgaagcgtgccacgtacagtgtaccaataacacacagctccgggtggattacgtgatatttgataatttccggctcgacgaaaagacagagtttgtctggctggattgtccgctgggcagtatgtatcgcccggtgaattggcgggctaacgatacacctttaacctgggaaagtcagctgtcaggacaggattttaccacctttctcgatccgtccacaggcggccggcaattgcaggtcttccagcctgccgtgtacaagtgcttcgtgcaacaggagctcgtcgcacagtttaagccagcagcctccctggagaccctggaggctcaatggcgtgagaatgacgcgcagtggcgggaggctcggaaagccctgagaggcagagccgacagtgtgctcaaaggcctgaagctggtcctgctggtggtcactgtcctagccctgctcggcgctttattaaagtgcattcatccctcacccggacgtcgctccacccaagtccttgttgtaaagtag

SEQ ID NO: 26192 - DNA, 1620 bp, Artificial Sequence
  Description of Artificial Sequence: Synthetic coding sequence
atgcctccagctggcggcccaagagcgcccagaccggcagcactgcctagaagcctgagccgattgagagagtgcccaggccgtagcagaattgtattagcactgggcgctacgcagatggccctgggatgtttgattgtggccgtgtctttcgctgccctggctctcaccacatctgcaagagttaggcacagttgtccgttctgggctgggttttctgtcctactgagtgggctaatcggggttgtgtcatggaagcgacctctgtcattagtgattacgttttttatgctcctgtctgcggtgtgtgtgatgctcaacctggctggctcaattctttcctgtcaaaacgctcagctggttaattccttggaaggttgccagctcatcaagttcgattccgttgaggtatgcgtctgctgcgagttgcagcaccagagtagcgggtgctcaaaccttggggaaacgctgaagttaaatcccctgcaggaaaactgcaatgcagtgagattgacactcaaggacctgctcttctcagtctgtgcactgaatgtcctctccaccatagtgtgcgccttggcgaccgcgatgtgctgtatgcaaatggtttcaagtgatgttctgcagatgttcctccctcagaggtcgcaccctgcaaacccaacttgtgtcactcctcacggtacagtgcttcatcaaactctggacttcgatgagttcattccccctctgccgcctcctccgtattacccaccggagtacacctgcaccccgtctacagaggcccagcgcgggttgcatcttgatttcgctcctagcccatttggcactctgtatgatgtggctattaacagcccggggctgctgtaccctgctgagttgcctcctccctacgaggctgtggtcggacagcctccagctagtcaagtcacctcaattggacaacaggttgctgaaagttccagcggtgaccccaacactagcgccggtttctctacgcctgtccccgctgatagcacaagtcttttggtcagtgagggaaccgccactcctggctcatcaccatcgccagatggccctgtaggggcccccgccccatcggagccagccctaccacccggacacgtatcccccgaggatccaggcatggggagccaggtccagcctgggccaggccgggtatcacggtcgacctccgaccctacactatgtacatcatccatggcgggtgacgcctccagccatagaccatcttgttcccaggaccttgaggcagggctgagcgaagccgtgccaggatcagcttcaatgagccggtcagcgacagcagcatgcagggctcagctttctccagctggcgacccagatacctggaagacagaccaacgacccacgcccgagcctttccccgcaacatctaaagagcgaccccggtccctggtggacagcaaggcatacgcagacgcaagagtcctggtggcaaaatttctggagcattcacactgtgcactgccaacagaagcacaacacatggtcggagccatgagactagcagtgaccaatgaggagagattggaagaagaagccgtgtttggggcagatgttctggaccaagtgtag

SEQ ID NO: 26193 - DNA, 1353 bp, Artificial Sequence
  Description of Artificial Sequence: Synthetic coding sequence
atgatattgttggtgaacctgtttgtgcttctaagcgtggtctgcgtcctgctcaatctcgccggattcatcctgggctgtcagggcgcccaatttgtgtcctccgtgccacggtgtgacctggtggatctgggcgagggtaagatctgtttttgttgcgaagagtttcaacctgcaaagtgcacagataaagagaacgcactcaaactttttcctgtacagccctgctccgccgttcatcttctgctgaaaaaggtgctctttgctctttgtgcactgaacgcactgactacaacagtatgccttgttgctgctgccctcagatacctccagatatttgcaacacgcaggtcttgtattgatgaaagccaaattagcgcggaagaagccgaagatcacggaagaatacctgatccagacgacttcgttccgcctgttcctcccccaagttatttcgccaccttctattcatgcacccctaggatgaaccggagaatggtgggccccgatgtgatcccgctgcctcacatttatggtgcacgcatcaagggtgtcgaagtgttttgccccctggacccacctcccccatacgaggcagttgtcagccagatggatcaggaacagggatcctctttccagatgtcggaggggtcagaggcggcagtcatccccttagacctcggctgcacacaagtgacccaagatggtgacatccctaacatcccagcggaagaaaatgccagtacttcaaccccttcctctacactggtgcgccctatacggtcaaggcgggctctgccccctctgcgaaccaggagtaagagtgaccccgtactccatccctctgaggaacgggcggcccctgtcctgtcttgcgaagccgccacacagaccgagagacgtctggatttggcggccgttactctaagacgtggcctgcgcagccgcgcgagcagatgtaggcccaggtccctgattgattacaagagctacatggataccaagctgctggtggcccgctttttggaacagtcttcctgtaccatgaccccagatattcacgaactagtcgagaacatcaaatccgtgttaaagtctgatgaggaacatatggaagaggcaatcacttccgcaagctttctggagcagatcatggcaccactacagccatctacctctcgtgcacataagctgccctcccggaggcagcctgggcttttgcacctgcagagctgtggtgacctgcacacattcacacccgccggccgcccacgcgcagagcgcaggcctcggagagtggaagcggaacgcccccattccctgatcggggtaatcagagagacagttctttag

SEQ ID NO: 26194 - DNA, 858 bp, Artificial Sequence
  Description of Artificial Sequence: Synthetic coding sequence
atggtaggccccgatgtgattccgttgcctcacatctacggcgcccgcattaaaggcgtcgaggtgttttgtccactcgacccacctcccccatacgaggcggtcgtgtcccagatggaccaggagcagggttcttctttccaaatgagtgaggggagcgaggccgctgtgattccactggacctgggttgcacccaggtcacacaggacggagatattccgaacattcccgcagaggaaaacgcctcaacaagcacgcctagctcaactctggtccggcctattcgatccaggcgggccctccccccactccgaacccggagcaaatctgatccggtccttcacccctccgaggaaagagccgccccagttttaagctgtgaagctgctacacaaactgaaaggcggttagatctcgccgctgttaccctgcgccgaggcctgaggagtagagccagcaggtgcagacctcggtctttgatcgactataagagttatatggacactaaactgctggtggctcgctttttggagcagagttcttgcacgatgacccctgacatccacgaattagtggaaaacatcaaaagcgttttgaagagcgatgaggagcacatggaggaggccattacatcagccagcttcttagagcagataatggcgccactgcagccctccacatcccgggctcacaagcttccatctagacgacaacccggacttctgcacctgcagagctgcggcgacctccacacctttacacccgccggccggccaagggccgagaggcgccccaggcgcgtcgaggcggagcggccccactcattgattggagtgatccgtgaaacggtgctgtag

SEQ ID NO: 26195 - DNA, 714 bp, Artificial Sequence
  Description of Artificial Sequence: Synthetic coding sequence
atgacctgttttggtccctatcccataggcacagggctccagggcatcaccctatgctgtttccccagcttctgtaaaatgaagagtaggatgtgcatggcaatttctatttgtcagatgctgtccatgctctcttttgtagtatgcgctttcaggtaccggcatatgtttaagagagggtggcctatggggacgtgttgcctctttctccctaccgcagcccccgtcttaagttgcgaagcggcgacacaaacggagagacggctggacctggccgccgtaacattgagaagaggactgcgttccagggccagtcgttgtcggccaagatctctgatcgactacaagtcttatatggacacgaagcttcttgtggcccgcttcctagaacaatcctcatgcacaatgactcctgacatacacgaactggtcgagaatattaaatctgtgctgaagagcgatgaggagcatatggaggaggccattacttcggcgtccttcctcgagcagattatggctccactgcaaccgagcacaagtcgagcccacaaactgccttcacgccggcaaccggggctgcttcatctccagagctgtggggacttgcacacattcacccccgctggacggcctcgggccgagaggagaccccgccgggttgaggcagagcggccccacagccttattggcgtgataagagaaacagttctttag

SEQ ID NO: 26196 - DNA, 1350 bp, Artificial Sequence
  Description of Artificial Sequence: Synthetic coding sequence
gtgctgctggtgaatctcttcgtcctattgtccgtcgtttgtgtgttgctgaacctcgccggtttcattctcggttgccagggtgcccaatttgtctccagcgtgcctcgctgcgacctcgtagacctcggtgagggaaagatctgtttctgctgtgaagagttccagccagccaagtgtacagataaggaaaacgcgctcaagctttttccagtccaaccatgtagtgctgttcatctgctcctgaagaaggtcctgtttgccctgtgtgccctgaacgccttgacaacaactgtctgccttgtggccgcagcactgcgctacctgcagatcttcgccacgaggagaagctgtatcgatgaaagccaaatctcagctgaggaggctgaggatcacggtcgcatccctgaccctgacgactttgtcccccctgtgcccccacctagctattttgctacattttacagttgcacgcccagaatgaaccgccgcatggttggtcccgacgttatcccactacctcacatctacggggctcgaattaaaggagtggaggtgttctgcccactcgaccctccacctccatatgaggccgtggtaagtcagatggatcaggaacagggaagctctttccagatgtcagagggatccgaggccgccgttattccacttgacttggggtgcactcaggtgactcaggacggcgatattcccaacataccagcggaggaaaatgccagtacttcaacccctagtagcacattggtacgccctatacggtctagaagggccttaccccctcttcgcactaggtcgaagtctgacccagtgctccatccctccgaggaacgcgcagcgccagtcctgagttgtgaagccgccacccagaccgagcggcgcttggatctagcagctgtcaccctacgaagaggtctgcgctctcgagcatcccgctgcaggccgcggtccctcatcgactacaagagctatatggacactaagctgctggtggctaggtttctggagcagtcgtcctgtacaatgacccccgatatacatgagctagttgaaaatatcaagtctgtgttgaagagcgacgaggagcacatggaagaggcaatcacatccgcatcattcctagagcagatcatggcgcctttgcaaccttcgacttcccgcgcacataaacttccttctagaaggcagcctgggcttctgcacctgcaatcttgtggcgacctccatacatttacaccggccggacgccctagagccgagagaagaccccggcgagtggaggccgagagaccacatagcctcattggcgttatcagagagacagtgctgtag

SEQ ID NO: 26197 - DNA, 1353 bp, Artificial Sequence
  Description of Artificial Sequence: Synthetic coding sequence
atgatcctgctagtgaatctgttcgtcctactttcagttgtttgcgtgctgctcaatctggctggttttatactggggtgtcagggggcccaattcgtatccagcgtaccccggtgcgatctggtcgatttaggcgagggaaaaatttgcttctgctgcgaggaattccagcctgctaagtgcacagataaggagaatgcccttaagctgtttccggtgcagccctgttcagcagtgcacttactcctcaaaaaggtcctgttcgctttgtgtgcactgaacgccctgacaactacagtctgcctggttgcggcagctcttcgctacctgcagatttttgccaccagacgcagttgcattgacgagagccagatctcagctgaagaggccgaagaccatggcagaatccccgatccagatgatttcgtcccacccgttcccccaccctcttacttcgccacgttttattcatgtacccctagaatgaataggcggatggtggggcccgatgtgattcccttaccacacatttacggggctagaattaagggcgtggaagtgttttgccctttggacccaccacctccttacgaagcagtggtgagccagatggaccaggaacagggatccagcttccagatgtctgaggggagcgaagcagccgttatccctctcgatctggggtgcactcaggtcacacaggatggcgacataccaaatatcccagcagaagagaacgcctccaccagcaccccgtcatcaacacttgtgaggcccatccgctcacggcgggctttgcctcctctgcgcacccggtccaagagcgatccagtcttgcacccttcagaggagcgagctgccccagttctctcttgtgaggccgccacccagacggaacgccggctggatctggccgcagtcacactccgccgcggccttcggtcacgcgcgtctaggtgtcgcccccggagcctgattgattataagtcttacatggataccaagctgctggttgcacgctttctggaacaatctagttgcaccatgacccctgatattcatgaactggtggaaaacatcaagagtgttctgaagagtgacgaagagcatatggaggaggcaattacttcagcctcttttctggaacagatcatggctccgttacaaccttcaactagccgggcgcacaagcttcccagtcgccggcagccaggcctgctgcacctgcaatcgtgtggcgatctgcatacctttacaccagctggaaggccaagggccgagcgacgcccgcgccgagtggaggctgaacggccccacagtctgatcggtgtgatacgggaaacagttctgtag

SEQ ID NO: 26198 - DNA, 1074 bp, Artificial Sequence
  Description of Artificial Sequence: Synthetic coding sequence
atgggtctgcggggcgacagccaggcaacactgttcgacccacagctgcacgacggctcctgtatttgcgagagggtcgcatccatcgtggatgtttcaatggactcaggaagtcttgtgctttctgctattggagatctgccaggtgggagttccccatcagaggactcttgccttcttgagttgcagggtagcgtgaggtcagtagattacgtgctgtttagatctatccagcggagcagagcaggttactgtctctccctggattgtgggcttcgggggccctttgaagagtctccattaccacgacgccccccccgggctgcccgctcatacagctgctcagcgccggaggctccacccccccttggggcaccaaccgcggcacgcagctgtcacagattagaggggtggcccccttgggttggtccatgcttccctgattcaagcgggagccttactcccccggggcatcgcccaccgcacccagcctcaccaccgccactgttgctccccaggtcgcactccgaccctggcatcacaacctcctctgatactgcggattttcgagacctgtacacaaaggtgctcgaggaggaggcagcatccgtgtcttcagccgacacaggtttgtgtagcgaggcatgcctttttcggctcgctcgctgccccagcccaaagctcctgagagctcggtcagccgaaaagcggcgacctgtgcctactttccaaaaggtacccctcccatcgggccccgccccagctcactctctgggggacctcaaaggaagctggcctggccgaggactggttacacgattcctgcaaatttctcgcaaagcacccgacccatccggaacaggagcccacggccacaagcaggttcccagatcactttgggggaggccagggcgtgagtccctgcatttgcgcagctgcggggacctcagttcttcctcttgcggagtatcctgtctagctgctggttggtcagttgtccctgcccccaccgcctctgcttccaccggggcggcaggtcgccttggcagcgacttgggctttcttagtcattag

SEQ ID NO: 26199 - DNA, 729 bp, Artificial Sequence
  Description of Artificial Sequence: Synthetic coding sequence
atgatgccatcccccagcgatagctctcgcagtctaacgtctagaccgagcacacgcggacttacgcacctgcgtttacaccgaccatggctgcaggccttgctgaccctgggcttggtccaggtgttgttggggattctcgtcgtgaccttttcaatggtcgcctcttctgtgacgacaactgagtccatcaagcgctcgtgtccctcatgggcagggtttagcaacctgttgttttcggtgtgtggattgaccatttgtgctgctatcatctgtaccctaagtgccattgtgtgctgcatccagatattttcactcgatctggtacacaccctcgcccctgagcgcagtgtgagcggacccctggggccgctcgggtgcacgtcccctccgccagcacctctgctgcatacgatgctggacttggaagagtttgtcccacctgtcccaccccccccctactacccgcctgaatacacttgctctagcgagacagatgcccagtctattacctacaatgggtcaatggacagtccagttcctctgtaccccactgactgtcctccaagctacgaggccgttatgggcctgcgaggaggaaaacagatcctcgtgccactaaggatgagagttgccctctccgacctccaaggacactatggccagggtaagggcatggcccaggtttttaagtaccgagtgacatgtgcgtatgctatgggctggtag

SEQ ID NO: 26200 - DNA, 1719 bp, Artificial Sequence
  Description of Artificial Sequence: Synthetic coding sequence
atgatgcctagtccatccgatagttcacgatctctgacctcacggccttctacccgaggtctgactcatctgaggctgcaccggccttggctgcaggcgctgttgactttaggtctggttcaagtgttgctcggaatactagtcgtgactttctctatggtcgcttcctcagtgactacaacggaatccattaagcgcagctgtcctagctgggccggattcagtaatttgctgttcagcgtctgcgggcttacaatttgcgccgccattatatgcaccttatccgcaattgtttgctgcatacagatcttctcgctcgacctcgttcatactttggcccccgagcgcagtgtaagcggacctttaggtcctcttggatgcacctcccctccacctgcacccctcctgcacactatgctcgacctggaggagtttgtcccacctgtgcctccccccccatactatcccccagagtatacctgcagctctgagactgatgctcagtccatcacttacaacggtagcatggattcaccagtaccgctctaccccactgattgccctccgagctacgaggcagtgatgggactcagaggcgatagccaagcgacgctgtttgacccccagctgcatgatggctcttgcatctgcgagcgcgtcgcatctatagtggacgtatcaatggactcagggagtctcgtgttgtctgctataggggatctccctggaggctcttcaccaagcgaagattcctgtctgctggaactccaggggtccgtccgttctgtggactatgttctcttcagatcaatccaacgctctcgggcagggtactgccttagtctggattgtggcttgaggggtcctttcgaagagagcccactgccaaggcggccacctagggcagcgcggagctactcatgcagcgcccccgaggcacccccgcccctgggcgcgcctaccgctgccagatcttgccatcggcttgaaggctggcccccttgggtggggccgtgcttccccgagcttcgaagacgggtgcctcgcgggggcgggaggccggccgctgctccccctactcgcgcaccaacacgtcgctttagtgacagcagcgggtctttaaccccacccggtcaccgacctcctcatccagccagccccccccctcttctgctaccccgctcccattctgaccccggtataaccacgtcatccgataccgccgacttcagagatctgtataccaaagtgctggaggaggaagcagcatccgtgagtagcgctgatacgggtctgtgttccgaggcctgcctgtttagacttgcgaggtgccccagccccaagctgctgagggccaggtccgctgaaaaacgccgcccagtccctacgttccagaaagtacccctcccaagcggacccgctcctgcccacagtctgggagatctgaagggaagttggcccggtcgtggactcgtcactaggtttttgcaaataagtcgcaaggccccagacccgagtgggacaggagcccatggccacaagcaagttccaaggtcactttggggtagacccggccgtgaatctctgcacctgcgatcgtgtggggatcttagcagttctagctctctgcggagactcttgtcaggtcgcaggctcgagcgcggcacaagacctcatagtctgtcgctgaacggcgggtctcgcgagaccggcctgtag

SEQ ID NO: 26201 - DNA, 2007 bp, Artificial Sequence
  Description of Artificial Sequence: Synthetic coding sequence
atgatgccttccccaagcgattctagccgctctctcacttctagaccctccacgagaggtctgacccatcttcgcctgcaccggccatggcttcaggctctgctaaccctgggacttgttcaggtgctgctcgggatcctggtggttacatttagtatggtggcctcctctgtgactacgactgagtcaattaagcgatcttgcccgagctgggccggctttagcctcgcctttagcggagtcgtaggaatagtcagctggaagcggccttttacactggttatctctttctttagcttgctctccgtgctgtgcgtcatgttgtcaatggccggctccgttctatcatgcaaaaacgcacagctggccagggacttccagcagtgctccttggaagggaaggtctgtgtgtgctgtccatcagttccgctgctgcgaccttgtcctgagtccggacaagaacttaaagtggcccctaattctacatgcgacgaggcccgcggggccttaaagaacctcctgttcagcgtttgcggactaactatttgcgccgctatcatctgcacacttagcgccattgtgtgttgtatccaaatcttcagcttggacttggtgcacacacttgccccagagagatcagtttctggtccacttggtcccctgggatgcaccagcccacctcctgctccgctgcttcatacaatgctagatctggaggaatttgtgcctcctgttcccccaccaccatactatccccctgagtatacatgctcttctgagaccgacgcccagagcatcacttacaacggctcaatggattctcccgtgcccctatatccaacagattgtcctccgtcttacgaggctgttatgggactaagaggtgactctcaagctacccttttcgacccacagttgcacgacggctcatgcatttgcgagcgagtggccagtattgtcgatgttagcatggactccggatcccttgtgctcagtgccatcggagacctgcccgggggatccagtccttccgaagacagctgtctgctcgagctccagggctcagtgaggtctgtagactatgttttgttccgaagcattcagaggtctcgagccgggtactgtctctcactggactgcggtctgcggggcccattcgaagaatctcccctgcctcgccgaccaccaagagcagctaggtcctactcatgttctgctccagaggcccctcccccgctgggggccccaactgccgcaagaagctgtcatcgtctggaaggctggcccccgtgggtgggcccctgctttcctgagctgcgcagacgcgtgcctagggggggggggcgcccagctgccgcccctccaacacgagctccgaccaggcgttttagcgatagttctggctcactgacccctcctggacatagacctccacaccctgcctcccccccccccttactgttgcctcggagccatagcgatcctggaattacgactagttccgatacagccgactttcgcgatctgtatacaaaggtgctggaagaagaggccgcctcagtgtcctctgcagatactgggttgtgcagtgaggcttgcttgtttcggcttgccagatgcccaagccctaagttattgcgagccaggagtgctgaaaaacgacggccagtgccgacttttcaaaaagtgcccttgccatcaggccccgcacccgcccactccctcggcgacctgaagggaagctggccaggcagaggactggttacacggttcctgcaaatcagcaggaaagcccctgatccgagtgggacgggcgctcacggacataagcaggtgcctaggtcgctatggggtcggcccgggagggaatctctccaccttagatcatgtggggatctgtcctcctcttcctccctccggcgcctgctgtctggacggcggctggagagggggacgcgaccgcactctctttcccttaatggcggttccagagagacaggcctgtag

SEQ ID NO: 26202 - DNA, 1953 bp, Artificial Sequence
  Description of Artificial Sequence: Synthetic coding sequence
atgatgccatcaccctctgattcttctcgttccctgaccagccgtccgtccacacgtggactgacgcatctgcgtctccatcgaccctggctgcaggctctcctgaccctcggcctggtgcaggtcctgctcggaattctggtggtgacattctccatggtagcctcttctgttacgactacggagtcaatcaaacgcagttgtccgtcctgggctggcttctccatctccttcttttctctcttaagtgtcctgtgtgtgatgctatccatggccgggtccgttttgagctgcaagaacgcccagctagccagagatttccaacagtgttccctggagggcaaggtctgcgtgtgttgtccgagtgtacccttacttagaccatgtcccgaatcgggtcaggagctgaaagtggcaccgaactccacttgtgacgaagctcgaggtgctctgaaaaacctcctttttagtgtttgtggcttgactatatgcgcggctataatctgcactctatctgccatcgtgtgctgcatccaaatattctctctggatcttgtacacacccagctggctcccgaacgctcagtgagcgggccattgggccccctgggatgtacctcccctccccccgctcctctccttcacaccatgctggacctcgaggaattcgtcccaccggttccaccaccaccctattatccccctgagtatacatgctcttccgaaaccgatgctcagagcatcacttataatggcagcatggattctcccgtgccactgtatccaactgactgtcctccctcttatgaggctgtcatgggattaagaggtgatagtcaggctactttattcgatccgcagctgcatgatggaagctgtatatgtgagcgagtagccagcattgtggatgtgtctatggactccggctcactggtgctatccgccattggtgatctcccgggaggatctagtccatccgaggattcctgtctgctggagcttcaaggcagtgtgagaagtgtggactacgtcctgtttagaagcatccagagatcaagggctggctattgcctgagcttggattgcgggctgcggggccctttcgaggagtcacctctacctagaaggcccccacgagccgctcgctcttattcttgtagcgcacctgaagcccctccccccctcggagcacctactgctgcgagatcttgtcacagactcgaggggtggccaccttgggtgggaccatgcttcccggagctaaggaggcgggttcccaggggtggcgggcggcctgcagccgcgccccctaccagagcgcccacccgacgcttttcagacagtagcgggtcactcacgccacctggacacagacccccacacccagcttcccctccacctctgctgttacctcgttcacacagcgaccccggaattactacctcatctgacacagccgattttcgagacctatataccaaagttctggaggaggaggctgcttctgtgtcctctgccgatacaggcctgtgtagtgaggcttgtctgttccgccttgcacggtgccccagccctaagcttctccgagctagatccgcggaaaaaaggcggccagttccaactttccagaaggtgcccctcccatctggccccgctccagcacacagtcttggggatctgaagggatcctggcctggtcggggattggttacccggtttttacaaatcagtcgcaaggcgcccgacccttcaggcaccggagcacacggacacaagcaggtgcctcgtagtctgtgggggagacctggtcgggagtccttgcatctccggtcctgcggggatctcagcagtagcagtagcctccggcggctactctccggcagacgcctggagcgcggcacaagaccgcacagtttgtctctgaatggaggctcccgcgaaacagggctgtag

SEQ ID NO: 26203 - DNA, 435 bp, Artificial Sequence
  Description of Artificial Sequence: Synthetic coding sequence
atgatgccttccccatcagatagttctagatctttgacaagccgaccttcaactcggggtctgactcacttgcggttacacagaccttggcttcaggcccttcttaccctcggcttggttcaggtactgctggggatcctcgtagtcaccttctcaatggtcgcgagttccgtgacgactaccgaaagtatcaaaaggtcttgcccttcatgggccgggttctcaaatctcctgttcagtgtctgcggcttgacaatttgtgccgccattatatgtacattgagtgcaatagtgtgttgcatccaaatctttagcctggatctcgtacacacgctgacctcgggtaccttcatccctaaatgcctgaggaagaaactgctcctctttccactccagatccaaggatctgctctgaagccggcgtcaagtgcttag

SEQ ID NO: 26204 - DNA, 1560 bp, Artificial Sequence
  Description of Artificial Sequence: Synthetic coding sequence
atgacatgccctgacaaaccagggcagctaattaactggttcatttgctcgctgtgcgtacccagagttagaaagctctggtctagcagacgacctagaacgcgacgtaatctactccttgggaccgcttgtgccatatacttaggctttttagttagccaggtagggcgggcgtcgctgcagcacggacaggctgccgaaaagggacctcataggtcgcgagacaccgccgagccgtcattccccgagattcctctcgatggcacattggcgcctccggaaagtcaggggaacggatccacgctccagccgaatgtggtttacattaccttaagatctaagcgctctaagccagccaacattcgcggcaccgtcaagccaaagcgtaggaaaaaacatgctgtcgccagcgctgctcccggacaggaagccctcgttggtccatcactccagccccaggaagctgctcgggaggcagatgctgtggccccagggtatgcacagggcgccaatctggtgaaaattggcgaacgtccatggcggctggttcgcggaccaggtgtgcgcgcaggcggaccggattttttgcagccctctagccgcgaaagtaacatacggatctactccgagtcagcaccctcatggctctcaaaagatgacattcgcagaatgaggctgctggctgattcggctgtggccgggcttaggccggtgtccagccgcagcggagcaaggctgttagtgttggaagggggagccccgggggcggttctcagatgcggtcctagcccttgtggtctgcttaagcagccacttgacatgagcgaagtctttgctttccatttggaccggatcctggggcttaaccgcaccctgccaagtgtctctagaaaggccgaatttatccaagatggccgcccctgccccattatcttatgggatgctagcttgtcctctgcatccaatgacactcattcctccgtgaagctgacgtgggggacctatcagcagctattgaagcagaaatgctggcagaacggccgggtccccaagccggaaagtggttgtacagagattcatcaccatgagtggagcaagatggctctttttgacttcctgctgcaaatctataaccgcctggatacaaattgctgcggttttcggccacggaaggaagatgcctgcgtgcagaacggccttaggcctaaatgcgatgaccagggcagtgcggctctggcacatattattcagcggaaacacgatcccaggcaccttgtgttcatagacaacaaaggcttttttgatcgaagcgaagacaacttgaacttcaaactgcttgaagggatcaaggagttccccgcatccgccgtgagcgttttgaagtctcagcatttgcggcaaaagctcctccagagtttgttcttagacaaagtgtattgggagagtcagggcggacgacaagggattgaaaaacttatcgatgtcatcgagcaccgagcgaaaattcttatcacctacattaatgctcatggggtgaaagtgctgcctatgaacgagtag

SEQ ID NO: 26205 - DNA, 1560 bp, Artificial Sequence
  Description of Artificial Sequence: Synthetic coding sequence
atgacctgcccggataagccggggcagcttatcaactggtttatctgctccctgtgtgtgcctagagtacgcaagctctggagcagtcgacgcccaaggacaagacggaacctattgctgggtacagcctgcgctatttacctcggattccttgtcagtcaagtggggagggccagcttgcagcacggtcaggcagccgaaaaaggccctcatcggtcaagggacactgcagaaccgagtttccccgagatccccttagatggcacgctggccccccctgagtcccagggcaacgggtcgacactgcagccaaacgtagtctatattacccttcggagtaagcggagtaaacctgccaacattcggggaaccgtgaagccaaaaagacgaaaaaagcatgcagtggcctctgctgctccgggccaggaagccctcgtcggcccaagcttacaaccgcaggaggctgcgagagaggccgatgcagtggccccgggctacgcccaaggcgccaaccttgtgaagattggagaaagaccctggcgtctggtcaggggccccggggtcagggctggagggcccgacttcttgcagccctcttcccgggagtccaacattagaatctacagcgaatccgccccttcttggctgtctaaggatgatataaggcgcatgagactgcttgccgattccgccgtggcgggcctccggccagtgtcatctagaagtggcgctcgcctgttggtcttggaagggggggccccaggggctgtcctacggtgcggaccttccccttgtggcctgctcaaacagcctctcgatatgtctgaggtgttcgccttccatttggaccgcattctcggcctgaatcgtactcttcctagcgtcagtcggaaagctgagttcattcaggacggccggccatgtcccattattctgtgggacgctagtctctctagcgcttcgaacgacacccactcatccgtgaagctaacgtggggaacttatcagcaacttttgaaacaaaaatgctggcagaacgggcgcgttcccaagcccgagtctggatgcactgagattcaccaccatgaatggagcaagatggcactcttcgacttcctcttgcaaatctacaatcgcctcgataccaattgctgtggcttcagaccccgcaaggaggacgcctgtgtccagaacggtctgaggccaaagtgtgacgaccagggcagtgctgcactggctcacattatccaacgaaaacatgaccctcggcacttggtctttatagataataagggcttctttgaccgctctgaggacaatctgaactttaaactcctggagggcatcaaggagttcccagccagcgccgtctccgtgctaaaatcgcagcaccttcggcaaaaactgcttcagtctcttttcctggacaaggtatattgggagagccaaggtggtcgacaaggaattgagaagttaatcgacgttatcgaacatcgcgcaaagatattgatcacatatattaatgcccacggcgttaaagttctgccaatgaacgagtag

SEQ ID NO: 26206 - DNA, 1560 bp, Artificial Sequence
  Description of Artificial Sequence: Synthetic coding sequence
atgacatgcccggataagccaggtcagcttattaactggttcatttgcagcctctgtgtgcctcgcgtgcgaaagctctggtctagtcgcagacctcggactcgaagaaacctcctcctcggtactgcatgcgctatatacctgggttttcttgtatcccaggtcggcagagcaagtttgcagcatggtcaggctgccgaaaaagggccccataggtcacgggatacggcagaaccttccttcccagaaatccccctggatggcacactggctccccccgagtctcaggggaacggtagcacactccagccgaacgtagtctatatcactctgaggtctaagaggtcaaagcctgctaatatccgtggcaccgtcaagccaaaaagacgtaaaaagcatgccgtcgccagcgccgccccaggacaggaagctcttgtgggtcctagccttcaacctcaagaagcagcccgcgaggctgacgccgtggctcccggctatgcccagggagccaatctggttaagataggggagcgcccatggcgcctagtgagggggccaggggtccgagccggcggacccgatttcttgcagccctccagccgggaaagcaatatacgaatttactccgagagcgctccttcctggctgtcaaaggacgatatcagaagaatgagactactggctgatagtgccgtggccgggctccgccccgtgagcagtcgctccggggcgagactcctggtgctggaggggggcgcccccggcgcagtgctgagatgcgggccatccccttgcgggctcctcaaacagccactcgatatgtctgaagtcttcgcttttcatctggatagaatcctgggcctaaatcgcacattacccagcgtgtctcgaaaagccgaatttattcaggatggccggccatgcccaattatcctgtgggacgccagcttatcctccgcctccaatgacacccattctagcgttaagctgacatgggggacctaccagcagttgctcaagcagaagtgttggcaaaacggaagagttcccaaaccagagtcagggtgtaccgagatccaccaccacgaatggtcaaagatggcactgttcgacttcctactgcaaatctacaatcgtctcgataccaactgttgcggcttcaggccccgtaaggaagacgcctgcgtgcagaatggcctgcgccctaagtgcgatgatcaagggtcagcagcactggcccatatcatacagcggaagcatgatccacggcaccttgtttttatagacaacaagggctttttcgatagaagcgaggataatctcaactttaaattactggaagggattaaagagttccctgctagcgcagtctctgtgctcaagagccagcatctacgccagaagcttttgcagagcctgttcctcgataaagtctactgggaaagtcagggcgggagacagggaatcgagaagcttattgacgtgattgagcatcgcgcaaaaatcctgattacatatatcaatgcccatggggtgaaagttctccctatgaatgaatag

SEQ ID NO: 26207 - DNA, 1584 bp, Artificial Sequence
  Description of Artificial Sequence: Synthetic coding sequence
atgacttgccctgataaacctgggcagctcatcaactggtttatttgcagcttgtgtgtccccagggtgcgcaagctgtggtcaagcaggcgacctagaacccgaaggaacctgttgcttggaacagcgtgtgcaatctatctgggctttctggtctcccaagtaggccgggcctcactgcagcacgggcaggccgctgagaagggcccacatcggagcagggacacagccgaacccagctttccagagatacctctggatggaacgctggctccaccagagagccaagggaacggatccacactgcaacctaacgtggtttatattaccctcagaagcaagaggtccaagcccgccaacatcagggggacagtgaaacctaaaaggcgcaagaaacatgccgttgccagcgccgctcctggtcaagaagcgctcgtagggccctcgctgcagccgcaggaagcagcccgcgaggcagacgccgttgcccccggttacgcgcagggggcaaacctcgtgaaaattggagaaaggccatggagactggtccgtggcccaggcgtgcgcgccggcggtccagactttctccagccaagtagtcgggagagcaatatcaggatctactcagaaagtgctccttcctggttgtctaaggacgatatcaggcgaatgcgccttcttgctgattcggctgtcgccggcctgcgtcctgtcagcagtagaagcggggcccgactgctcgtgttagaagggggggcccccggtgctgtgctgcggtgcggcccgagcccatgcggactcttaaagcagcccctggatatgagcgaagtcttcgcctttcacctggatcgaattcttggcctgaatcggacgctgccttcagtgtctaggaaggccgaatttatccaggcggcagctgcagcctgcttgtcgatgagactcgcatttttcatatttccagcctgggaagacatgcgcgtgcctggcaagtgctgcatagggcatgcccgactgacgtggggaacatatcaacaactattgaaacaaaagtgttggcagaacgggcgtgtccccaaacccgaatctggctgtacagagattcatcaccacgagtggagtaagatggcactattcgactttcttctgcagatctataacaggctcgatacaaactgctgtgggtttaggccccgtaaggaggatgcttgcgtccagaatggccttagacctaaatgtgacgatcaggggtcggctgcccttgcccatatcatccaaaggaagcacgatccgcgtcacctcgtcttcatcgataataaggggtttttcgaccggagtgaggacaacttgaacttcaaactgctggagggaattaaggaattcccggcctctgcagtgtccgtgttaaagtcccagcacttaaggcaaaagttgctgcagtcactttttctggacaaagtctattgggagagtcagggcggccggcaggggatcgagaaactaatagatgtgatagagcacagagctaagattcttattacttacatcaacgcccacggtgtcaaggtccttcctatgaacgagtag

SEQ ID NO: 26208 - DNA, 996 bp, Artificial Sequence
  Description of Artificial Sequence: Synthetic coding sequence
atgacctgccccgacaaacccggtcagctgatcaattggttcatttgctctctgtgtgtgcccagggtgagaaaactgtggagctcacgtcgaccaaggacaaggcgaaatctactgcttggaaccgcatgcgccatctacctgggttttctcgtgtcacaagttggacgcgcttccttgcaacacggccaagccgccgagaagggtccccaccgtagccgagacaccgccgagcctagctttcccgaaattcctctggacgggaccctggcccctcctgaaagtcagggaaatggcagcactctgcagccaaacgtggtttacatcacccttagatctaaacggagcaagccagccaatatcagaggaactgttaagccaaaaagacgcaagaagcacgccgtagcctccgccgcccctggccaagaagccctcgtcggacccagccttcagcctcaggaggctgcaagagaggcagatgctgtggctccaggatatgcccagggagctaacctggtgaaaatcggggagcgcccctggaggttggtgaggggcccaggcgttcgcgcaggggggcctgacttcctacagcctagctcccgggagagtaacatccggatttacagcgaatccgcaccgtcctggctgtccaaagacgatatccgaaggatgagacttctggccgacagtgccgttgctgggctgagaccggtgagctctcgttccggggcacgactgctggtgctggaaggcggcgcgcccggcgctgtccttcggtgcggaccaagtccatgtgggttgcttaagcagcctctggacatgtctgaagtgtttgcctttcatttagatagaatcctggggctgaataggactctgccctctgtgtcccgcaaggccgagttcattcagggtaatcggtttacttgtttcgtcatctgtagctgctggggcttttggttcatctttttcttcccatccttatccttttccaagtag

SEQ ID NO: 26209 - DNA, 1608 bp, Artificial Sequence
  Description of Artificial Sequence: Synthetic coding sequence
atgactccagagagtcgggacacaacagatctgtcccccggtggtacccaggagatggaaggaatcgttattgtgaaagtagaagaggaagatgaagaggatcactttcagaaggagcggaataaagttgagtcttcaccgcaggtgcttagtaggtctacaaccatgaatgagagggcattgctttccagctatctagtcgcttaccgagtggccaaggaaaagatggcacacaccgccgcagagaaaatcattctcccagcctgtatggacatggttagaacgatttttgatgataaaagcgccgacaaactgaggaccatccccttgtctgacaacacaatctctaggcggatttgcactatcgcgaagcaccttgaagccatgcttatcaccaggctccagagcgggatcgattttgccattcagcttgacgagtccactgacattgcttcttgcccaacgctcttggtttatgtgcggtacgtgtggcaggacgacttcgttgaagacttactctgctgtctgaatcttaactctcacataactggcctggacttgttcaccgaactggagaattgtctgttgggccagtacaagttgaattggaagcactgtaaaggaattagttccgatgggacagctaacatgaccggcaaacatagtaggttaacggaaaagttgctggaggcaacacataataacgccgtgtggaatcactgttttatccaccgggaagccttagtgagcaaggaaatctccccctctctcatggacgtgctaaagaacgccgtgaagaccgtgaactttatcaagggttctagtcttaattcccgtcttctcgagattttttgcagcgaaattggggtcaaccatacgcacctcctgtttcatacagaagtgcgatggttgtcgcagggcaaggttctcagccgagtgtacgagctaaggaacgaaatctatatatttctcgtggagaagcagagtcacctggctaacatcttcgaagacgatatttgggttaccaagctggcatatttgagcgacatatttgggatcctcaacgaactttccctcaagatgcaggggaagaacaatgacattttccaatatttagaacatatcctagggttccaaaaaaccctgctactctggcaggcacgcctcaagtccaacagaccatcatattatatgttccccacactgctgcagcatatcgaggagaacataataaatgaagattgtctgaaagagatcaaactcgagatccttctacacctgaccagcctgtcacagacttttaactattatttcccggaagagaaatttgaatccctgaaggaaaacatttggatgaaggacccgtttgcctttcagaacccagaaagtataatagagctgaatttggaaccagaagaggagaacgaactcctgcaacttagtagtagctttactctgaagaattattacaagattctgtctcttagcgccttttggattaaaattaaggacgacttccctctactgtcacgtaaaagtatcctccttctgttgccgtttactaccacttacctttgtgaactgggattctctatcctcacacgctag

SEQ ID NO: 26210 - DNA, 1722 bp, Artificial Sequence
  Description of Artificial Sequence: Synthetic coding sequence
atgacacccgaatctagagacaccacggacttatcccccgggggcactcaggaaatggaagggatcgtcatcgttaaagtagaggaagaggacgaagaggatcacttccagaaggaacgcaacaaggtagagagcagccctcaggtcctcagtaggtccacaaccatgaacgagagagctttgctctcatcctatctggttgcttacagagttgccaaagaaaagatggcccatactgcagcagaaaagattattttaccagcctgcatggacatggttagaacgattttcgacgataaatccgcggataagctccgcactataccactgagcgacaacacaatctccaggaggatctgtaccatcgccaaacatctggaggctatgttgatcacccgcttacagtcaggaatcgattttgctatacagttagatgagagcaccgacattgcgtcttgccccaccttgttggtgtacgtccgctacgtctggcaggacgatttcgtggaggatttattatgctgtctgaacctgaactcacacattaccgggctagaccttttcacagagctggagaattgccttctcggacagtacaagctcaattggaaacactgtaaaggcattagttccgacggtactgcgaacatgaccgggaaacactcaaggctgacagaaaagctcttggaggctacgcataataatgctgtttggaaccactgtttcatccaccgcgaagcactcgttagtaaagagatctctccctccctgatggatgtccttaagaacgccgtaaaaacggtcaattttataaaagggagtagcctgaactcgcggttgctggagatcttctgctccgagatcggggttaaccacacacacttgctgttccataccgaagtgcgctggctatcacagggtaaggtgctatcacgggtgtatgaactccgaaacgagatctacattttcctggtcgaaaaacaaagccacttggccaacatcttcgaagacgacatttgggtgaccaaactcgcgtatctttccgacatttttggcattttaaatgagttatctttaaagatgcagggaaagaacaacgatatttttcagtatctggagcatatcttaggctttcagaaaaccttactgttatggcaggccaggttgaaatcaaaccggcctagctattatatgttccccacgctgctgcagcacattgaggagaatattattaacgaagactgcttgaaagagattaagttggaaattcttcttcacctgacatctctctcccagaccttcaattattacttcccagaggaaaaattcgagagcctgaaggaaaatatctggatgaaggacccttttgccttccaaaatcccgaaagcattatcgaattgaatctggagcctgaggaagagaatgagctgttacagttatctagcagttttacacttaagaactattacaagattctttcactaagcgccttttggattaagatcaaggatgactttccattgctgtccaggaaaagcattctgttattgctgccctttacgacaacttatctgtgcgagctggggttctcaatcctcacaagactgaaaacgaaaaagagaaaccgcctgaacagcgcccccgatatgagggtggctcttagttcttgtgtgcctgattggaaagaactgatgaatcggcaggcccatccctcacattag

SEQ ID NO: 26211 - DNA, 4008 bp, Artificial Sequence
  Description of Artificial Sequence: Synthetic coding sequence
atgctgagccctacgttcgtcttatgggaagtcggataccccctatacatttacgggagcatctttatagtgattgttataatttggcaagtgaaacggtcccaccatgagctatcatccgaacccaaacgcagctgttgtcggtgccatcagaaggtcagacagcgcgctagagatgccgcatctactgccagaaggcgatctcgggaagaggcggaaaagccacagaaactgctgtctatcattaagtctcaggggtggctccctctcgaacgctcggtaagacgcatcctgtgcgccgacccttgttgtcagatatgcaattccgtagcacttgagatccagcagctcctggttggcgagaataatcaaatcagcctgacattgtcagggcctctgcagggatcctcatgcctggaaatgctgagcacgagttccatgtctctcgatcagtcgctcgaatttcactcttggcacacgcgggagttgtcactgtctagcgtcacccctaccttgtcgcagttaaccgatcagaagagcttgacacagagcgccgcacagtccacctatgccgacggaattcaggattattgggccgaccatctgcaactaggacaggagtttcaggtccctgacgttctgcgggggccgaacacgattgcaagttcacgcattgaaaaacctcgcgcacctctgaatcaggaggagatgacacagtcaaacccaagtctggtacaaggcaatcaggggcagcatcatttaaatagccaggtttccttattgtctttgaatcccgaaaccctaaaccggatgcaccccatggctctgcacatggtcctgcctgctcaccttccattcctgtcgccagaggtgcttcgcctcctagaagttcatgtgaaaaaatggatgcactttcaaaggtgggggctgcctagaagagtggaagagtccctgagacagttgatgccaaatcctccactgtactaccagcctggcaatgatcagccagtgagcttcaacttaaaaaacacaccccaagtgtcattgcaccgcttcgagacgatatccttgcagacctggtgctcctgcgtagccggacagcctattcagaccttttgggtcagcgaatggagcaccatgaaccccgagcaacggcaccactgccagcagacacccaaccctatggctctggctctgcccagccccgcattaaaagcactcagtggccctcacccccagagcggcggacaggataacgactcaggatccgatctacaacaaaagtattcccagctcttctgtggtttgccatcattgcattcagaatcactggtggccacctttatgggctctcaagggctcccaaagattgagaatgtgcccaagcctccccttaaggatccattcctttttaatgaactgagtttccctcagctgttacctaagacctctcctcaatctgcgcccccatctagcccactctcccctaactggatgagcccaagcgatcaccagcgcgcccagataaatgttccctttctgactctggccgagtatgaggcacttgaatggcatctattacaaaggcagctacagcttcagtggggttggcctgcagcactccaacggagccaacacacgcagtgccttatgcagcacgagccctgtgggaaagcacaatcccccgaaaccactacagcttcccagaccggaaaatctattagcgtgctgactagagagctactcttcttcccagagcacgcgcggaagctgctcgagttccatatccaaaaacaactgatacgccaccgatggggtctcccacagaagattcagcaatcaatacagctgttactcacttctaccgatcaacagactgtttcgtcctccagcacagctctggccaacgtgtctatacctcagccggtcgctcttgaagcgaacggtgcatgcgacgtgctgagcccgattgccgcacccgtctctataccaagaccacatctgctaacccaggtcaaggctattctacagtcccatatagatagtaaatgtggacaaatccaccagggcaagattcccgcctgtgttcatcggtcttgggactgcagaatttccggcgttctcgccgttgctccgttcccctgtatacctgagagtcagtttctcgagctgcaaacagccagtgatcctgatcttcatcacaaagtaatgccttggatgcctacagccttagatcagcagcagcaggctctgccaggcaccgtgacagaacacccgaagctgctgagagtgctctctgtggaagctattgaaaagctggagactactctgcgccataagcatctagcctttctgagtggcctgcctgctctttactacgtggcactgccccgagctctcgcacccgccgttacatcccagtcagttataaccgagatggaaccctcaccagtagagatcccagccgaaccactgatccagatggtgtctttcgaggagcagtgcattagtttgggaccttgtccccagggcaataacgaatcctgtacagacgtggctaaagaattccagcctgccgttcctgtgaagggaaccatggagaccttgcctctggaaagccagactcatcccacgagcccacacagcctgcaaacacacattctaacaaaactgaactttcacctgcgtaaaaaggtgctggagatccagtggggcattcccatccgagcacgaaagagccgggaacaaacagtagcggccccagagaacatctcaacccagaaatccctggagtccctgaatcaccagggggagaccttactccaagagttgcctatacctcccgacactctgcctgcacccaacccggaaggcgttcatctgaaggagcaattggcgaatgacttgaaggcagttcagcagaaccaaaaacagagtaattctaaagccgtgcctcagggttccgcccactcagtgtccaagatctcccagcccagtggggatatgacagaggcccacatgccgtgcgtacaggtcgaggccaacgtaaataagcctagcctggaagagccttgtgggccagaaccccaatccccatcaaaatcaaaagacccagcccacgtgcccatgctcgctggtaaccgggaggaccccgaggaaaccaaggctgccagggaccaccgcgagggtgacgcaggatttggaaggagcagcactagggaagaacgccggcctgccgaagaccagcgaccagcagggatgctgcctaacaagacccccaggggcagttggcggtggtcacgctcctttcacttggcagacccctgtcaacattcccctcagcaccacccccaactgaaactcccacagctcccgccacgggtccctggagagaaggaaagcgaaaaggatctccaggatagccagacaaagttgacagtcatcctcgaacctgccactataccagaaaacgctcagaccgtgctgccacaggctagccaagggcagcccttcctgtcccagccaacacaggcgaagcccctgcaaggccagacactccaggggcaggttttgcatggcttggtgatgccagtgcacgcgcagaaaaagcccagtctaacggagtcctcatttcgaaataagatcaagtgttttctgcagcatataaaccctaagacaaagggaaaagggcatgaggacagcatgttctccgcggcagctaaagtggctaagactcgtaaagaaaatgtggccaagagcctcgcccccgcgaagtcgccagtggggcggtctaaaactgaaaaaccgacaggctgttccaaggctcaatcgaggcccgcccagaagctcgtcgggcccgcctttttagacggacctcaaagcctggacgacaaactgagactgcactcccggcagccaggaagcgccagcgccctcgggtatccacggcattgcccccggcactgcccacgggaggcttgtgcaaataagccaggacaccccacatag

SEQ ID NO: 26212 - DNA, 516 bp, Artificial Sequence
  Description of Artificial Sequence: Synthetic coding sequence
atgtggactctcaaaagttccctggttctcctcttgtgcttgacttgctcctacgctttcatgtttagttcactgaggcagaagaccagcgaaccacaagggaaggtgcagtatggagagcacttccggattagacagaatctgcccgaacacacacagggctggttgggatccaagtggttatggctgttatttgtggttgtgccttttgtcatcctacagtgtcagcgcgatagcgagaaaaacaaagaacagagtccccccgggctgcggggcggtcaacttcattccccgctgaagaagaagcgaaacgcttctcccaataaggactgtgctttcaacaccctcatggagctcgaagtcgaactaatgaagtttgtatcaaaggtaagaaacctgaagagagctatggccactggatcaggcagtaacctgagacttcggaagagtgagatgcctgcagacccataccacgtgactatctgcgagatttggggagaggagagtagtagctag

SEQ ID NO: 26213 - DNA, 516 bp, Artificial Sequence
  Description of Artificial Sequence: Synthetic coding sequence
atgtggacccttaaatccagtctcgtactgctgctctgcctaacttgcagttacgcctttatgttttcgagcctgaggcagaaaacttccgaaccacaggggaaagttccttgtggggagcatttccgcatcagacaaaatttgcctgagcatacacagggatggcttgggtctaagtggctttggctgctgttcgctgtggtccccttcgttatcttgcagtgtcagagggactctgagaaaaataaagaacagagcccccccggacttagaggatttccattccgcaccccacttaaaaagaatcagaatgcaagtctgtacaaggactgcgtgtttaataccctgaatgaactcgaggtggagctcctgaagttcgtctcggaagtgcagaacctgaagggggccatggccacagggagcggatctaatctgaagctccgaagatctgaaatgcctgcagatccttatcatgtcaccatctgcaaaatttggggggaagagtctagcagttag

SEQ ID NO: 26214 - DNA, 4026 bp, Artificial Sequence
  Description of Artificial Sequence: Synthetic coding sequence
atgatgaaccgaaccacgcctgatcaggaactggcaccagcctctgagcccgtgtgggaaaggccctggagtgttgaggagatccggaggtcctcccaaagctggtcattggccgcagatgcaggcttactccagtttttgcaggagtttagccaacagacaatatctcggacccatgagattaagaaacaagttgatggcctgattcgcgagactaaggctactgactgccgattacacaacgtcttcaacgactttcttatgctgagcaatacgcaatttatcgagaatagagtttacgatgaagaggtggaggagccggttctcaaagctgaggccgagaaaactgagcaagagaaaaccagggagcagaaggaagtcgatctcattcctaaggtgcaagaagccgttaactatgggctccaggttctggattccgcattcgaacaacttgatataaaggccgggaacagtgacagcgaggaggacgacgctaacggccgagtggagttgatattggagcccaaggatctgtatatcgaccgcccactgccttatctcattgggtctaagctgttcatggaacaggaggacgtgggactaggtgagctttcatctgaggagggctcggttggcagtgaccgtggctcgatagttgacacagaggaggaaaaggaggaggaagagtcggatgaggactttgcacaccactctgataacgaacagaaccggcacaccacacagatgagcgacgaagaggaggatgatgatggctgtgatctcttcgccgattctgagaaggaagaggaggatatagaggacatagaggaaaatacaaggccaaagcgctcaaggcccacaagttttgccgatgaactggcagctcgaattaagggtgatgccgtgggaagggtcgacgaagagccaacgacactgccatcgggcgaggccaaaccaaggaaaactttaaaggagaagaaggagcgccgcacaccgtcagatgatgaagaggataatctcttcgccccacctaaattgactgacgaagacttctcaccgtttgggtccgggggaggcctcttttccggagggaaaggccttttcgatgatgaggacgaggagtccgatctgttcacggaggctcctcaggacagacaggcgggagcctccgtcaaagaggaatcgtcttcgagcaaaccaggtaaaaagatccctgctggagctgttagcgtgttcctaggagacacagatgttttcggcgctgccagcgtcccttcaatgaaagagccccagaaaccagaacagccaacccctcgaaagtctccgtatgggccacctcccaccggacttttcgatgacgacgatggtgatgatgatgacgatttctttagtgcaccccacagtaagccgagcaagactggaaaggtgcagagtacagccgacatatttggggatgaagagggagacctctttaaagagaaagctgtggctagcccagaagctacggttagccagactgacgagaacaaagcacgagctgaaaagaaggtcacccttagctcaagtaaaaatcttaagccttcctccgagaccaagacccagaagggattgttcagtgacgaagaggactccgaagatctgttcagcagccagagtgctagcaagctgaaaggcgcttccttacttccagggaaactgccaaccctggtgagcctgtttgacgatgaggacgaggaggataatctctttggcgggactgccgccaaaaagcagactctttgtctccaagctcagagggaggagaaagccaaggcaagtgagctgtcaaaaaagaaagccagcgccctgctcttttcttctgatgaggaggaccagtggaacattccagccagccagacacatctggcctctgactccagatccaaaggggaacccagggactcaggtacgctgcagagccaagaggccaaggctgtgaagaagacgagcctgttcgaggaagacgaggaagacgatctcttcgcgatcgccaaagattcccagaaaaaaacccagagggtgtctctacttttcgaagacgatgtggactctggcggtagcctattcggttctcctccaaccagcgtgccccccgccacaaagaaaaaagagacggtaagcgaggccccccctctactcttctctgacgaagaagagaaagaagcccagttgggtgtaaagtccgttgataagaaagtggagagtgctaaggaatcccttaaattcgggaggactgatgtcgcagaaagtgagaaggaaggcctgctgacgcgatcagcacaagaaactgtgaaacactctgacctgttctcctccagctcgccatgggacaagggcacaaagccccgcacgaaaacggtgctctctcttttcgatgaagaggaagacaaaatggaggatcagaatattatacaggcacctcagaaggaagtggggaaaggccgggatcccgacgctcatcccaagagtacgggcgtttttcaggatgaggaactgctattttctcataagttacaaaaagacaacgacccagacgtggacctgtttgccggcaccaaaaagacgaaactcctcgagccttcagtgggcagcttgtttggtgatgatgaggacgacgaccttttcagttctgcaaagagccagccactggtgcaggaaaaaaaacgggtggttaaaaaggatcactcggtggactcatttaagaatcaaaaacaccccgaaagtatccagggttccaaagagaagggcatttggaagccagagaccccccaggactcctccggactcgcaccattcaaaacgaaagaaccctccacacggattggaaagatccaggcaaatcttgccattaaccccgctgccctcctgccaaccgccgcctctcaaatctccgaagtgaaaccagtgcttccggagctcgccttcccgtcctcagaacacaggaggtctcacggccttgagtccgtgccagttctaccaggttccggcgaagctggcgtgtcattcgatctaccagctcaggctgatacgctgcacagcgcaaataaatccagagtgaagatgcgtgggaaacggcgaccccagacaagagccgcaaggagactcgcggcccaagaatcatctgaaactgaagatatgagcgttccacgaggtccaatcgcacaatgggccgatggcgccatttcaccaaatggccatcgtccacagctgcgcgctgcttctggcgaggactctaccgaagaagccctggctgcagcagccgcaccttgggagggtggacctgtacctggagtggacaggtcacctttcgcaaagagcctcggacacagccgtggggaagctgacttgttcgactcaggagacatttttagtactggaactggatcccagtctgtggagcgcacaaagcctaaggccaagattgctgaaaaccctgcaaatccgccagtgggaggaaaagctaaaagtcctatgttccccgccctgggtgaggccagttcagacgacgatctgttccagagtgccaagccaaaaccagccaagaagacaaatccattcccactcctcgaggacgaagatgatcttttcacagaccagaaagtcaagaagaacgaaactaaatccaattcccagcaggacgtcattctgacgactcaggacatcttcgaagatgacatctttgctaccgaggctattaaaccttcacagaagacgcgtgaaaaagaaaaaaccctcgaatctaatctgtttgacgataacattgatatttttgccgatctcacagtcaagcctaaagaaaagagtaaaaaaaaagttgaagcgaaaagcatattcgatgacgatatggatgacattttttccagcggcattcaagcaaaaaccactaagcctaagtcacgatcagcgcaagcggcccctgagccgaggttcgagcataaagtcagcaatatatttgatgatcctttgaacgcctttgggggtcaatag

SEQ ID NO: 26215 - DNA, 3840 bp, Artificial Sequence
  Description of Artificial Sequence: Synthetic coding sequence
atgatgaatagaaccacacccgaccaggaactggctccggcttcggagcctgtctgggagcgcccctggagcgtggaagaaattaggagaagctctcaaagctggagcttggccgctgacgccgggctgctccagttcctgcaggagttctcacagcaaaccatctcaagaacccatgaaattaaaaagcaagtcgacggccttatccgtgaaactaaagccactgactgtcgcctgcataatgtcttcaacgattttctcatgctttccaatactcagttcatagagaaccgagtgtacgacgaagaggtggaggaaccagtgctcaaagcagaggctgaaaaaaccgagcaggagaaaaccagagagcagaaggaagttgacctgattccaaaagtccaggaggcagttaactatggtttgcaggttctggacagtgctttcgaacagttggacatcaaagctggcaattctgattccgaagaggatgacgccaatggacgcgttgagctcattctggaacccaaggacctgtacatagaccggcccttaccgtatcttattggatctaaactctttatggagcaggaagacgttggactgggagagctcagttctgaggagggctcagtgggatccgatagaggatcgattgtcgatacggaggaagaaaaagaggaagaagagtctgacgaggatttcgctcatcatagcgacaatgagcaaaatagacatactacacagatgagtgatgaagaagaggatgacgacggatgtgacttgttcgccgatagtgagaaagaggaagaggatattgaggacatagaggaaaatacgcgcccgaaacggtcgagacctacctctttcgcagacgagttggccgctagaatcaagggagatgctgtgggtcgcgttgatgaggaacctacaaccctgccttcgggtgaggccaagccaagaaagaccctcaaagagaaaaaggaacgccgcacacctagtgatgatgaggaagataatctgtttgcccccccaaagttgacagacgaagactttagcccattcggctccggcgggggtctcttttcaggggggaagggcttgttcgatgatgaggatgaggaatctgatctgttcaccgaggccccccaagatcggcaagcaggagcaagcgtgaaggaggagtcttcatccagcaagccaggcaagaaaatccctgcaggggccgtgtccgtctttcttggggacacagatgtgtttggcgcagcaagtgtgccctctatgaaagagcctcagaagcccgagcagccaaccccccgtaaatccccttatggtcctccgccaacagggttgtttgatgacgatgacggcgatgatgatgacgattttttctcagctccgcacagtaaacctagtaagacaggcaaagtgcagtcgaccgccgacatattcggtgatgaagaaggggacttgttcaaggagaaggctgtggctagccccgaagcaaccgtaagtcagaccgatgagaacaaagcgagggcagagaagaaagttaccctgtcctcctcaaaaaacctaaaaccaagcagtgagaccaagacgcagaaaggccttttctctgacgaggaggacagcgaagacctgtttagcagccaaagcgcaagcaagctaaagggagcttctctcctccctggtaagctcccaacactggttagtttgttcgacgacgaagacgaggaggacaatctgttcggaggcacggccgctaaaaagcagactctgtgcctgcaggcccagagggaagagaaggccaaggcaagcgaacttagtaaaaaaaaggcctcggctctactcttctcaagcgatgaggaggaccagtggaacattcccgcgagccagacgcacctagcttctgacagccgaagcaagggcgaaccgcgggatagtggcacgcttcagtcccaggaggcaaaagccgtcaagaagacaagcctctttgaagaggacgaggaagacgacttattcgccattgccaaagacagccagaagaagactcagcgagtttctctcctgttcgaggacgatgtggatagtggcgggtcacttttcggcagtccacctaccagcgttccgcccgcaacaaaaaagaaggagacggtctccgaggctcctccacttctgttttctgacgaggaggaaaaagaggcccagctgggagtcaagagcgtcgataagaaggtggagtcagccaaagagtccctgaagtttggtagaaccgatgtcgcagagagcgagaaggaaggactactgactagatctgcccaggagaccgtgaagcattccgatctgttttcttcttcctcaccgtgggacaaaggaactaagcctcggacgaagacagtcctcagtctgttcgacgaagaggaagataagatggaggatcagaatattatccaggccccacagaaggaagtcggaaaaggcagggacccagacgcgcatcctaaaagcaccggggtgttccaggacgaggaacttttgttcagtcataaactgcagaaagataacgaccctgacgtggatttgtttgccggcactaagaagactaagctactggagccatcagtgggctctctgttcggagacgatgaagatgatgatctgttctcatccgctaaatcacagcccctggctaacctagctatcaacccggctgctctgctcccgactgcagcatctcaaatctccgaggtgaaaccagtgctacctgagctggccttcccctcttccgagcaccggcggtcacatggcttggaatcggtcccagtgctaccgggtagcggggaggctggagtgtcattcgacctgcctgcccaggccgacactctgcactctgccaataaaagcagagtcaagatgcggggcaagcggcggcctcagacaagggctgcccgacgtctggccgctcaggagagcagcgaaactgaggatatgtccgtgccgaggggtcccattgcccagtgggctgatggggcgatctcacccaatgggcaccggccccagctccgtgctgcctctggggaagactctaccgaagaagcactggccgcggccgcagccccatgggaaggtggaccagtgcccggtgtggatcggtcaccattcgccaagagtctgggccattcccggggcgaggctgatctgttcgattcaggagatatttttagcaccggaacgggatctcagtccgtcgagcgaactaagccaaaagcaaagattgccgaaaaccccgccaacccacccgtaggagggaaggccaagtcccctatgttccccgcacttggtgaggcctcctccgacgatgacctcttccagtctgcaaagccgaaacccgcaaaaaagaccaacccttttcccttgctggaagatgaggacgacctgttcacagatcagaaggtcaaaaaaaatgaaacaaaatctaacagtcaacaggacgtcatcttgaccacccaggacattttcgaagatgacatcttcgccacagaggcgatcaagccgtcccaaaagactcgggaaaaggagaagacattagagtcaaatttattcgatgacaacatcgatattttcgccgatttgactgtcaagcccaaagaaaaatctaagaaaaaggtggaagccaaatccatttttgatgatgatatggatgatattttttcttccgggatacaagccaagactacaaaacccaaaagtcggtcggcacaggcggccccagaaccgcggtttgaacataaagtcagcaacattttcgacgatcccctgaatgcattcggtggtcagtag

SEQ ID NO: 26216 - DNA, 3963 bp, Artificial Sequence
  Description of Artificial Sequence: Synthetic coding sequence
atgatgaaccggacaacccccgaccaagaactggctcctgcatccgaacccgtctgggagaggccatggtcagtggaagagatcagaagaagctcccaaagctggtcacttgctgctgatgccggcctgctacagttcttacaggaattttctcagcaaacaatatccaggacacacgaaatcaagaaacaagttgacggactaatacgggaaacaaaagcaaccgattgtcggcttcataatgtgtttaatgattttctgatgttgagcaacactcagtttatagaaaatagagtctacgatgaggaggtggaggagccagtactcaaagccgaggccgagaagaccgaacaggagaaaacaagggagcagaaagaagtggacctcatccccaaagtgcaggaggctgtgaactacggcttacaagtcctagattcagccttcgaacagctagatatcaaagcaggaaacagtgattctgaggaggacgacgccaacggaagggtcgagctgatcctggagcctaaagacctgtacattgatcgcccccttccttacctcattgggtccaaactgttcatggaacaggaggacgtgggcttgggtgaactctcttccgaggaagggtcagtcggatctgatcggggctctattgtcgacactgaagaagagaaagaggaggaggaatcagacgaagactttgcgcatcatagcgataatgaacagaaccgccacactacacaaatgagtgatgaggaggaggatgacgacggatgcgacctcttcgcagattccgaaaaggaggaggaggacatcgaggacatcgaggagaacacccggccaaagaggtccaggcctacctctttcgcagatgagctggcagcaagaataaaaggtgacgcagtgggtagggtggatgaggagccaacaacactacccagtggtgaggctaaaccaaggaaaactcttaaagagaaaaaagagcgccgcacaccttcagatgatgaggaggacaatctttttgcccctccgaaactgaccgacgaggatttctcccctttcgggtccggcggtggactcttttcaggtggcaagggtctgtttgatgatgaagacgaggagtctgatctgttcacagaggccccacaggaccgccaagcaggagctagcgtcaaagaagagagcagctccagcaaacctggcaagaaaattccagccggcgctgtgtccgttttcctgggcgacaccgatgtgtttggggccgccagtgtccctagtatgaaggagccgcaaaagccggagcagcctacaccaagaaagagcccttacggtcctccgcctaccggactgttcgatgacgacgatggggatgacgatgacgacttcttttctgctccacattctaagccctcaaaaactgggaaggtccagagcaccgccgatatcttcggcgacgaggagggagatctgttcaaggaaaaagccgttgccagcccagaggctacggtgtctcagaccgatgagaacaaagctcgggctgaaaagaaagtcacgctgtcttcgtccaaaaatctgaaaccaagcagcgaaactaagactcaaaaaggactatttagtgatgaggaggatagtgaggatttgttttcatcacagagtgcctccaaactcaagggcgcttccctcctgcccgggaagctccctacgttggtgagcctgttcgacgatgaagatgaagaggacaacctgtttggcggaacagccgcaaagaaacagactctctgcctgcaagcccagcgcgaggagaaggccaaagcttctgagctgagtaagaaaaaggcgtctgccctgctcttcagctccgacgaggaagaccagtggaacattccggcctcccagacgcatctcgcttccgattcaagatccaaaggggaaccacgagactccggtacattacagtcccaggaggcaaaagcagttaaaaaaacctctctttttgaggaggatgaagaagacgacctcttcgctatcgcaaaagatagccaaaaaaagacacaaagggtgtcactcctcttcgaagatgacgtcgactccggcggctctctgttcggaagtccccccaccagcgtgccacccgcaacgaagaagaaggaaactgtctcggaggcaccccctctactgttctctgacgaagaagaaaaggaagcccagcttggcgtcaaaagcgtggacaagaaggtcgagtctgctaaggagtcactgaagtttggacggactgacgtcgctgagagtgagaaagaaggattactgacccgcagtgctcaggaaacggtgaagcattcggacctgttcagcagttcgtcaccatgggataagggaacgaagccacggacaaagacagtgttatcattgttcgatgaagaggaggataaaatggaagatcagaacatcatccaggctccgcagaaggaggttggcaaaggacgggatcccgatgcccatccgaagagcaccggggtgtttcaggatgaggagctgctgttcagccacaagctgcagaaagacaatgatcctgacgtcgacctgttcgccgggacaaaaaagacgaagttactagagcctagtgtcgggtcactatttggagatgatgaagacgatgatctttttagctccgctaagtcccagcccttggttcaggagaagaagcgcgtggttaagaaggaccactccgtcgactcattcaagaatcagaagcatccagagtctatccagggttctaaggagaaaggaatctggaaacctgagaccccacaggccaatctcgcaataaatcccgccgcactcctgccaaccgccgcaagccagattagcgaggtgaagcctgttctgccagagctggcattccctagtagcgaacataggaggtcccatggccttgaaagcgtgccagtcctacccgggagcggcgaagcaggagtgagcttcgatctccctgcccaggcggatacactccattcagctaacaagagtagagtcaaaatgcgaggaaagaggcgccctcagaccagggctgccaggcgcttggctgcacaggagtcttctgagacagaagatatgagcgtgccacggggaccaatagcccagtgggcagatggagctatttcccccaacggccatagacctcaactcagagccgcgtcaggtgaggactccactgaagaggccttggccgcggccgctgcaccttgggagggaggccccgtgccgggcgtagataggagtcctttcgccaagagcctcgggcactccaggggcgaagcagatctctttgattctggtgacattttctcgaccggcacaggatctcaaagcgtggagcggaccaagccaaaagctaaaatcgctgagaatcctgcaaatccccccgtgggcgggaaagctaagtccccgatgttccccgccctcggtgaggccagttctgatgacgatctgtttcagtcagcaaagcccaagccggccaaaaaaaccaacccctttcctttgttggaagatgaagatgacctgttcaccgatcagaaagtaaagaaaaatgaaacaaaatcgaactcccagcaggacgtcatcctgaccacccaggatatcttcgaagacgatatttttgcgactgaagccataaaaccaagccaaaagacccgggagaaagagaagactttagagtccaatctgtttgacgacaacatagacatcttcgcagacttaacagtcaagcccaaggagaaatccaaaaaaaaagtggaggccaaatccatctttgatgacgacatggatgatattttttcctccggaatacaggccaaaaccaccaagccaaagtcccgatctgcacaggcagcaccagaacctcggtttgagcacaaagtctcaaatatctttgacgatcctttaaacgcgttcggtggccagtag

SEQ ID NO: 26217 - DNA, 3762 bp, Artificial Sequence
  Description of Artificial Sequence: Synthetic coding sequence
atgccacgcctgtcaggcaaatctgtccgtgtgtacgacgaggaggttgaggagcccgtgctaaaagcagaggctgagaagacggaacaagaaaaaacgcgagagcagaaggaagtggacctcatccctaaggtgcaggaggctgtaaactatggcctgcaggtcctcgattcagcctttgaacaactggatatcaaggcagggaactccgacagcgaagaggacgacgccaacggccgagtcgaattaatcctggaacctaaagacctttacatcgaccgacctcttccttatctaataggaagcaagctcttcatggaacaagaggacgtcggtttaggagagctgagctccgaagagggttccgtgggatccgatcgcggcagcattgtggacacagaagaagaaaaggaagaggaggagtccgacgaggatttcgcccatcattctgataacgaacagaacagacataccacacagatgtctgatgaggaagaggacgatgacggttgtgatctttttgcagactctgagaaagaagaagaggatattgaagacattgaggaaaacacaagacccaaacggagccggccgacttcctttgctgatgagctcgccgcccgcatcaaaggagatgctgtcggacgtgttgacgaggaacccacgaccctgccgtccggcgaggccaaaccccgcaagaccctgaaagagaaaaaggaacgaaggacgccttcagacgacgaggaggataatctgtttgccccacccaagctcactgacgaagatttctcccctttcggctccggagggggcctcttctccgggggaaaaggccttttcgatgacgaggatgaggagtccgatctttttacggaggcgccacaggacaggcaggccggtgctagcgtcaaagaggagtcgtccagctcaaagccaggaaagaagatcccagccggtgccgtgtctgtgttccttggcgatactgatgtgttcggtgccgcgagtgttccttctatgaaagaacctcaaaaaccggagcagccaactccccgcaagtcaccttacggaccgccaccaacaggactgttcgatgacgatgatggggacgatgatgatgacttcttttccgcccctcatagcaaaccttcaaaaacaggcaaagtacagtctaccgccgatatattcggtgatgaggagggcgatctcttcaaagaaaaagccgtggcaagccctgaggcaacagtgagccagactgatgaaaataaagccagagctgagaaaaaagtaacactttcctcttccaagaaccttaagccttcgagcgagactaaaactcagaaagggttattctccgatgaagaagatagtgaggacttattttcctctcagtccgcatccaaactgaaaggagccagtctgctgccgggtaagttgccgacactggttagcctgttcgacgacgaagatgaagaagataacctgttcggcgggaccgctgcaaaaaagcagactctatgcttacaggctcagcgggaagagaaggcaaaagcttccgaactttcaaagaaaaaagcgagtgccctgttattttcctcggatgaggaagaccagtggaatatcccggcttcacaaacacacttggcctctgacagcaggtcgaagggcgagccccgagactccggcacattgcagtcccaggaggccaaggctgttaagaaaacaagccttttcgaagaggacgaggaggatgatctgttcgcgatcgcaaaagacagccagaagaagactcagcgggtatctctattgtttgaagatgatgtggatagcggcggcagcctgtttggaagccccccaacaagcgtgccccctgcaacaaaaaaaaaggagacggtcagtgaagctcccccgctgctgttttccgatgaagaagagaaggaggcccagctaggggtgaagagtgtcgacaaaaaagtggagtctgcaaaggaatctctcaagttcggacgaaccgatgtggccgagtctgaaaaggagggattgctgacgaggtccgcccaagaaacggtgaagcatagtgatctcttttccagctcctctccgtgggacaagggcacaaaacctcggactaaaactgttctgagtctgtttgacgaagaggaagataagatggaggatcagaatatcattcaggcgcctcagaaagaagttggaaaaggaagggatcccgacgctcaccctaagtcgactggcgtcttccaagacgaggagctcctattctcacacaagctacagaaggacaatgaccctgatgtggacttgtttgccgggactaaaaagactaaactcctcgagccttctgtaggcagtctcttcggtgatgacgaggacgacgaccttttcagctctgcgaagagccagcccttggtgcaagaaaaaaagcgagtggtcaagaaagatcattcagtagattctttcaaaaatcagaagcatcccgagtcgatccagggctctaaagagaagggcatctggaaacctgagactccgcaggattcatccgggctggctccctttaaaacaaaggagccgagcactaggattgggaaaattcaggctaatttagcaatcaaccccgccgccctgctcccaacagccgcaagccagatctcagaagtgaagccggtcctgccagaacttgcgttcccgagttccgaacatcgtaggtcgcatgggctggagagcgtcccagtgttgcctggctcaggagaggcaggcgtgtcttttgacttacctgcccaggccgacacactgcattcagctaacaaatcacgcgtgaaaatgcgcgggaagcgcagaccacagacaagagcggcacgtagactagccgcccaagagtccagcgagacagaggatatgtccgtgccaaggggccccattgcacagtgggctgatggggctatcagtcctaacgggcatcgaccccagcttcgggctgcttctggcgaagatagcactgaggaagcactcgccgctgcggcagccccatgggagggcggacccgttcctggtgtggatcgctctccgtttgccaagtctctgggtcactcccgcggggaagctgacctgttcgactccggagacattttttcaaccggcacaggttcacagagtgtggaacgcactaagcccaaagccaagatcgctgagaacccagcgaaccctcctgtcggaggtaaggcaaagtcccctatgtttcctgccctcggggaagcaagctcagacgatgacctcttccagagcgcgaaacccaaacccgccaagaagacaaaccccttccctctgctggaagacgaagatgacctctttaccgaccagaaggtgaagaaaaatgagaccaagagcaattctcagcaagatgtcatcctgacaacacaggatatctttgaggacgacattttcgccacagaggccatcaaaccttctcagaagaccagggagaaggagaagactctagagtcaaacctctttgacgacaatatagacatcttcgccgacctcacagtgaagccaaaagagaaaagtaaaaagaaagtggaagctaagagcatttttgatgatgatatggacgacatcttctcttccggtatccaggccaagactactaagccaaaatctagaagcgctcaggccgctcctgagcccagatttgaacacaaagtgagtaatatcttcgatgatcccttgaatgcgttcgggggtcaatag

SEQ ID NO: 26218 - DNA, 3204 bp, Artificial Sequence
  Description of Artificial Sequence: Synthetic coding sequence
atgaatcggaccaccccagatcaggagctggctcctgcttctgagccagtgtgggagaggccatggtcagtggaggaaattcggcgatctagtcagagctggagccttgccgcagatgctggccttctgcaattccttcaggaattctcccaacagacaatcagcagaactcacgaaataaaaaagcaggtggatggacttatccgagagacgaaggctaccgactgtcgcctgcacaatgtgttcaacgactttctcatgctttctaacacccagttcattgaaaacagggtctacgatgaagagggctctgtcggctcagaccgtggctcaatcgtcgatacagaggaggagaaggaggaggaggagagtgatgaggacttcgctcaccactcagacaacgagcagaacaggcacaccacccagatgagtgatgaggaggaggacgatgacgggtgcgatcttttcgcagattcagagaaggaggaggaagacatagaggatatcgaggaaaataccaggccgaaaaggagtcgacccactagctttgccgatgagttggctgcccgaatcaaaggcgatgccgtggggcgcgtggatgaggaaccaacaacgcttccaagcggtgaagctaagcctcggaaaactctcaaggagaaaaaggagaggcggacacctagcgacgatgaagaagacaacctatttgcgccccctaaattgaccgacgaggatttctcaccgtttggcagtggcggaggcctgtttagcggcggcaaaggtctgtttgatgatgaggatgaagagtccgacctgttcacagaggccccacaggaccggcaggccggagcctcagttaaggaggagagttcaagctccaaacccggaaagaagatcccagccggagctgtatcagtctttttaggtgatacggacgtcttcggggccgcttctgtaccttcaatgaaagaaccgcagaaacccgagcaacccaccccaaggaagtccccgtatggaccaccacctaccggcttattcgatgacgatgacggagacgacgacgacgatttcttctccgcacctcactccaagccttccaagacagggaaagtgcaatcaaccgcagatatttttggcgatgaggagggtgacctcttcaaggagaaagccgttgcctcccccgaggccacggtatcgcagactgacgaaaacaaagcaagggctgagaaaaaggtgactctgagctcatctaagaacttgaaacccagctccgaaaccaaaacacaaaagggactgtttagcgacgaggaagactcagaggacctgttcagtagccagagtgcaagtaaactgaaaggcgcatctctcctgcctggcaagctgcctactttggtgtccttgttcgatgacgaggatgaagaggataatctcttcggtggcacagccgcaaaaaaacagacactgtgtcttcaggcacagagggaggagaaagccaaggccagtgagctgtccaagaagaaagcaagcgcccttctgttctctagcgacgaagaggaccagtggaatattcctgccagtcagacccatctcgcatccgactctcgttctaagggcgagccacgtgattctggcactctccagagtcaggaagctaaggctgtaaaaaagaccagcctgttcgaggaggatgaagaagacgacctcttcgctatcgcaaaggatagtcagaagaagacacagcgagtgtcactcctctttgaagacgatgttgatagcgggggcagtctttttggctctccacccacgagtgtgccaccagcgaccaagaagaaagaaacagtgtctgaggcaccacccctcctgttttccgacgaagaagaaaaggaggctcagcttggagtcaagagcgtagataagaaggtcgagagcgctaaggaatcgcttaagtttggtagaacagatgttgccgaatcagagaaggaagggctgctaactcggagtgcacaggagacagtgaaacactccgacttgtttagtagcagctccccatgggacaagggtactaaacccaggacaaagaccgtgttgtcactattcgacgaggaggaggacaagatggaggatcaaaatattatccaggctccccagaaagaggtggggaaaggcagagatcccgacgcccacccaaaaagcacaggagtattccaagacgaagagctgctcttttctcataagctccaaaaggacaacgaccccgacgtagatctctttgcaggtactaagaagactaagctgctggagccatctgtggggtcgctgttcggcgatgacgaggacgacgatcttttctcctctgctaagagccagcccctcgtgcaggaaaagaagcgagtcgtgaaaaaggaccactctgttgattcattcaagaatcagaagcatcccgaatccatccaaggttccaaagaaaaaggaatatggaagcctgagactccccaggactcctctgggctcgcaccttttaagacgaaggagccgtcgacccggatcggaaaaatccaggcgaacctcgcaatcaatcccgccgcgttacttcccaccgccgcttctcagatttctgaggtgaaacctgttctgcctgagctagctttccccagttcagagcataggaggtctcatggcctggagtccgtccccgttctacctggaagtggtgaagccggcgtgtcatttgacttgccggcccaagcagacacactccattctgccaataaatcgagagttaaaatgcgcgggaagcgccgcccacagactcgcgcagccaggcgcctggccgctcaggaaagttccgagaccgaagatatgtcagtgccgaggggccccattgcccagtgggcagatggcgcgatctctcccaatggtcacaggcctcagttgcgcgctgcttcgggggaagattcaacagaagaagccctggcagccgctgctgcaccgtgggagggaggccctgtgccaggcgttgaccggtccccgtttgcgaaaagcttgggccactcccggggagaagccgacttgttcgatagcggtgacatcttcagcacaggaaccggcagtcagtccgtggaacggactaagcctaaagccaagttcggtaaactctggccgccccactgccacatactcttgatcaaattttactggaatacatag

SEQ ID NO: 26219 - DNA, 471 bp, Artificial Sequence
  Description of Artificial Sequence: Synthetic coding sequence
agcccctgggataagggcactaagccacggaccaaaacagtgctctccctgttcgatgaggaggaggataagatggaggaccaaaatataattcaggccccccagaaagaggtcgggaaaggccgtgaccccgatgctcatccaaagtccacaggggttttccaggacgaggaattgttattcagccacaagcttcagaaggataacgaccccgacgtagatctttttgctggcacgaaaaagaccaagctcctggaaccttctgttggatcactctttggggacgacgaagacgacgacctcttttcttccgccaagtcacagcccctcgttcaggagaagaaacgagttgtgaaaaaagaccactctgtggactcttttaaaaatcaaaagcatcccgaaagtatccaggggtcaaaggagaaaggaatctggaaaccggaaaccccacaggtgaggaacccactgtag

SEQ ID NO: 26220 - DNA, 3672 bp, Artificial Sequence
  Description of Artificial Sequence: Synthetic coding sequence
agggtatatgacgaggaagttgaagagcccgtccttaaggcggaggccgaaaagactgaacaagagaaaacccgggaacagaaagaggtcgatctcatccctaaggtacaggaggctgtgaactatgggctgcaggtgctcgactcagctttcgaacagcttgatataaaagctggcaactccgatagtgaggaggatgatgcaaatgggagggtggagttaatcctagagcccaaggatttatatatcgaccgtccattgccgtaccttatcggctctaaactgtttatggagcaggaagacgtgggcctgggcgaactgtcaagcgaagaagggtccgtggggtctgacagggggtcaattgtggatacagaggaggagaaggaagaagaagagtcagatgaggactttgcccaccactctgacaacgaacagaaccgtcataccacacagatgagtgacgaagaggaggacgatgacggttgtgatcttttcgctgacagcgaaaaagaggaggaagacattgaggatattgaggagaatacaaggccaaagagaagccggcctaccagctttgccgacgagctggcagccaggatcaaaggtgacgctgtaggtagggtggatgaagaacctaccaccttgccttccggggaagccaagcccaggaagaccttgaaggaaaaaaaggagaggagaaccccctccgacgacgaggaggacaatctgtttaccccacctaaactgactgatgaagacttctctcccttcggctctggcgggggcctctttagtggcgggaaaggcttgttcgacgatgaggacgaggagagcgacctgtttaccgaggcccctcaggacaggcaggcaggcgcttcggtgaaagaggagtcttcttcttccaaacctggcaagaaaatccccgccggggccgtctccgtctttctgggtgacaccgacgtcttcggtgccgcctctgttcctagtatgaaagaacctcagaagccggaacagcccactccaagaaaaagtccctatggccctcctcccacaggtctcttcgacgatgatgatggcgacgacgatgacgatttttttagtgccccccattctaagccctctaaaaccggaaaagtgcagtctaccgcagatattttcggggacgaagagggagacctgttcaaagagaaggcagttgcatctccagaggccactgtatcacaaacggacgagaataaagctcgggccgaaaagaaagtgacactgtcaagcagcaaaaatcttaagcccagctcggagaccaagacccagaaagggctgttctctgacgaggaggacagtgaagatctattctcctcacagtcagcgtccaagctgaaaggggcatcccttctgccgggcaagctgcctacttcagtgagcctgtttgatgacgaagatgaggaggataatctgttcggcgggacagcagcaaagaagcagactctgtgcctgcaggcacaacgggaggaaaaagccaaggcctccgaattaagtaagaaaaaggccagtgcgcttctgtttagcagcgatgaagaggaccagtggaacatcccagcctcccagactcacttggcgagcgactcaaggtcgaagggggagcctagggattccggcacattacagtcccaggaggcaaaagcagtgaagaaaacctcactgtttgaggaggatgaggaggacgatctctttgctattgccaaggattcccagaaaaagacgcagcgcgttagtctgttgtttgaagacgatgtagactctcgaggtagcctgtttggaagtccgccaacgtcagtcccccccgccacaaaaaagaaggaaactgtctccgaggctccaccattgctgttctcagatgaagaggagaaagaagcacagctgggagtgaagagtgtagataaaaaggtcgaatcagcaaaggagagcctcaagtttgggcggacagacgtcgcagagtctgaaaaggagggcctgctgaccagaagcgctcaagaaacagtaaaacactcagatttgttttcctctagttcaccctgggacaaaggcactaagcctcgaacgaaaactgttctgtctttgtttgatgaggaggaggataaaatggaggaccagaatataatccaggccccgcagaaggaagtgggcaagggacgggatccagatgcccatccaaaaagcaccggtgtgttccaggatgaggagctgttgtttagtcacaagttgcagaaggataacgatcctgacgtggatctgtttgcaggtactaagaaaacaaagctgctcgagccatccgtgggatcactgtttggagatgatgaagacgatgacttgttctcatccgctaagtcacagccattagttcaggagaagaaacgcgttgtcaagaaggaccattctgttgactcgtttaagaaccagaaacaccccgagagcatacaggggtcaaaggagaaggggatctggaaaccggaaaccccgcaggccaacttagctattaacccggccgcactactgccgacagccgcttctcagatatcagaagtgaaaccagtattgccggaactagccttcccttcgtctgaacacagacgcagccatggtttagaatcggtgccggtgttaccaggttctggagaggcaggggtctcctttgatcttccagcacaagccgataccttgcacagtgctaacaaaagcagggtaaagatgcggggcaaacggcgacctcagacccgcgccgccagacggcttgccgcgcaagaaagctctgagaccgaagacatgtctgtgccccgcggcccaattgcccaatgggccgacggggcaattagtcctaatggacataggccgcagctacgagctgccagcggagaagactccaccgaggaggctttggcggctgcggcagctccttgggagggcggaccagttcctggtgtcgaccgctccccattcgccaaatctctggggcacagccgcggagaggccgacctgtttgacagtggagacatattctcaactggtacgggaagtcagagcgtagagaggacaaaacctaaagccaagatcgccgagaatcctgcaaacccgccggtgggagggaaggcaaaaagccccatgtttccggcattgggtgaggctagctccgacgacgatctgttccagtctgctaaacccaagcccgcaaagaagacgaacaccttcccgttgttggaggatgaagacgacctgttcaccgatcagaaagtgaaaaaaaacgagaccaaaagcaacagccaacaagatgtgattttgactacccaggacatcttcgaagacgacattttcgctacagaggccataaagccttcccaaaagactcgtgagaaggaaaagacattggaaagcaatttattcgacgacaacatcgatatattcgctgacctgaccgtgaagcccaaagaaaaaagtaagaagaaagtagaggccaagtccatcttcgacgacgacatggacgacattttctctagcggcatccaagccaagactaccaaaccaaagagtagatctgcacaggccgccccagagccaagatttgaacataaggtcagcaatatattcgacgacccccttaacgcctttggtgggcaatag

SEQ ID NO: 26221 - DNA, 3762 bp, Artificial Sequence
  Description of Artificial Sequence: Synthetic coding sequence
atgccaaggttatcggggaagtcagtgcgggtttacgatgaggaggtggaagaaccggtgctcaaagctgaagcagagaagacagagcaggaaaagacccgcgagcagaaggaggttgatcttatacctaaggtgcaggaggctgtgaactatgggttgcaggtgctcgacagcgccttcgagcagctggatatcaaggctgggaatagcgattcagaggaggatgatgccaacgggcgggtggaactgatattagaacctaaagatttgtacatcgatcgacccttgccatatctgatcggtagcaagctgttcatggagcaggaggacgtaggtttaggcgagctaagtagtgaggaaggatccgtggggtcggaccgcgggagcatcgtggacactgaggaggaaaaggaggaagaagaaagtgatgaggactttgcacaccactctgacaacgaacagaaccggcatactacacagatgtctgatgaggaggaggacgacgacggttgtgatctttttgccgactcagagaaggaagaggaagatatcgaagatatagaagagaacacacggccaaagcggagcagaccaacctcatttgcagacgagctcgctgccaggatcaagggtgacgccgtcggacgggtcgacgaggagccaaccactttgcctagtggcgaggccaagccaagaaaaacactgaaggagaagaaggaaagaagaactccaagtgatgatgaagaagacaatctgtttaccccccccaagctgacagacgaagacttcagtccttttggaagtggaggcggattgttttcaggcgggaagggactgttcgacgacgaagatgaagagagcgacctattcaccgaggctccgcaggatagacaggctggagcctctgttaaggaggagtcgagctcctccaagcctggaaaaaagattcctgcaggcgcagtcagcgtttttctcggtgatactgatgtttttggcgctgcctctgtgcctagcatgaaagagcctcagaaacccgaacagcctacgccacgcaagtctccctacgggcccccgccaaccgggctgttcgacgatgacgatggcgacgacgacgatgacttcttctctgctccacactccaagccgtcaaagacggggaaggtgcaaagtaccgctgacatcttcggcgatgaagaaggcgatttgtttaaggaaaaagccgtagcatctcctgaagctaccgtctcccaaacagacgaaaacaaggccagagctgaaaagaaggtcacactcagtagtagcaaaaatctgaaaccctcaagtgagacaaagactcagaaaggtctattctccgatgaggaggactcagaagatctcttcagttcgcagagtgcgtccaaacttaaaggggcgagcctgctaccagggaagctacctacaagtgtctcactcttcgacgatgaggacgaggaggacaatctgtttggcggaactgccgcaaagaagcagacactctgtctgcaggcccagcgagaagagaaggccaaagcttccgaattgtcgaaaaaaaaggcatccgcgctgctcttctcttctgatgaggaggatcagtggaacatccctgcgtcacagactcatctagcttctgactcgcggtccaagggggaacccagggattctggcacgttgcaatcgcaggaagctaaggccgtgaaaaagacctcccttttcgaggaggacgaggaggacgacttgtttgccatagctaaagatagccagaaaaaaacacaaagggtatcactgctgtttgaagacgatgtggattctagaggaagcctgttcggatcacctcctacctccgtgcccccggccactaaaaagaaggaaacagtctccgaggcccctccgcttctgttctctgatgaagaagagaaggaagctcagcttggtgtcaaaagtgtcgataagaaggtggagtctgccaaggaaagcttgaagtttggacgaactgacgtcgccgaatctgagaaggaagggctgctcactcgcagcgctcaggagaccgttaagcatagcgacctgttctcgtccagctcaccttgggataagggaactaagccaagaaccaagacagtcctgtccctgtttgacgaggaagaagataaaatggaggaccagaacatcatccaggctcctcagaaagaagtggggaaggggcgggacccagatgctcacccaaaaagtacgggcgtgttccaggatgaggaactgctgttttctcacaagctgcagaaggataatgatcctgatgtggatctttttgccgggaccaaaaaaactaaacttttagaaccctccgttggttctctgttcggagacgacgaagatgacgatcttttcagctctgccaaaagccagccattagttcaggagaaaaagcgcgtcgtgaagaaggaccactcagtagattcattcaaaaatcagaagcaccctgaaagcatccagggttctaaggagaagggaatttggaaaccagagacaccccaagactcatccgggttggccccctttaagactaaggaaccaagtacaagaattggaaaaattcaggcaaacttggccatcaacccagctgcccttttaccaaccgccgctagccagataagcgaggttaagccagtcctcccggagctggcatttccctcatccgagcacagacggtctcacggcctcgagtctgttcccgttttgccaggctccggtgaggcaggcgtgtccttcgacctgcctgctcaagcggatacactgcactccgcaaataagtccagagttaagatgagagggaagagacggcctcagacccgtgccgcccgccgccttgcagctcaagagtcttccgaaacagaagacatgtccgttcctcgggggccaattgcacaatgggccgacggggcgattagcccaaatggacaccgcccacagttgcgagctgcaagcggtgaagacagcacagaagaggcactcgccgcggccgccgctccctgggagggcggaccggtcccgggtgtggaccggtcccccttcgccaagagtctaggtcactcacgaggtgaggctgatctgtttgattctggagacatattcagtaccggtaccggatctcagtccgtggagcggaccaagccgaaggccaaaatcgccgaaaatcctgcaaatcccccagtcggaggcaaggccaagtcccctatgtttcccgctctcggcgaggcctcatcggacgacgatctgtttcaaagtgcaaaacctaaacctgctaagaagaccaatacatttcccttgctagaagatgaagatgatcttttcacagaccagaaggtgaagaaaaatgaaacgaaatctaacagccaacaggacgtgatcctgaccacccaagacatttttgaggacgacatttttgctactgaagccattaagccctcccagaagacccgggagaaggaaaaaaccctagagtctaacctctttgatgacaacattgacatctttgccgatttgaccgtgaaacctaaggagaagtcgaaaaagaaggttgaggcgaagtccatctttgatgacgacatggatgacatcttctcctccgggatccaggctaagaccactaagcccaaaagcagatccgctcaagcagctcccgagcccagatttgagcataaagtgagcaatatattcgacgacccactgaatgcgtttggtgggcagtag

SEQ ID NO: 26222 - DNA, 828 bp, Artificial Sequence
  Description of Artificial Sequence: Synthetic coding sequence
gagcctagcgtcggatctctgtttggcgacgacgaagatgatgacctctttagctcggctaagtctcagcctcttgtgcaggaaaagaagcgtgtagtgaagaaagaccatagtgttgactcatttaaaaaccagaaacaccccgagagtatacagggttctaaagagaaggggatttggaagcccgagacacctcaagacagcagcggcctggcccctttcaagaccaaagagccgagtactagaataggcaagatccaggctaacctggctataaatccagctgcccttctgcccacagcggccagtcaaatttccgaagtgaaacccgtcctgccagaattagccttcccttcatccgagcatcgcaggtcacacggcctggaatctgtgcctgttctcccagggtccggagaagcaggtgtgtcttttgatttgccggcccaggccgatactctccactcagctaataaaagtcgagttaaaatgaggggtaaacggagaccccagacccgagccgcccgcaggctggcagcacaggaaagtagtgagacggaagacatgtcagtccctcgggggccaatcgcacagtgggctgacggagcaatttccccgaacggtcaccggccccaactgcgcgccgcgagcggcgaggacagcacagaggaggcacttgcagctgctgctgctccttgggaaggggggcccgtgcccggagtggatcggtctccttttgcaaagtcactgggccacagtcggggcgaggcagacttgttcgacagcggcgacatcttcagcactggtaccggaagccagagtgtggagtag

SEQ ID NO: 26223 - DNA, 2769 bp, Artificial Sequence
  Description of Artificial Sequence: Synthetic coding sequence
atgcgaaaaaggatgatgatggcagtcacattctccctgacactgcgccgcagacgtaaaattttgagaacactgaagaagatattggacctgaaagaggctgatctacacaggctgcaaatgagctggctgcccgcttcgcgggggatgccttgggtagagtggaccagaagcagacagccctatccgcaggagaagcagaatctgggacgccacagcaagaggcgcagaaaaggggagctgctgcagactatgaagcggattacatattctcacccccctctcacggatgaggacttttccccatttggatctggcggcgggttattcagtgggggcaaaggactctttgatgacgaggatgaggaaagcgatttgttcaccgaagccccccaggaccgacaggcaggagcgtccgttaaggaggaatccagcagctcaaaaccaggtaagaaaatcccggcaggcgccgttagcgtgtttctgggtgatactgacgtcttcggcgctgcttcggtgccctccatgaaggaaccccagaagcccgaacagcctacacctagaaagtccccatacggaccaccaccaactgggctgttcgatgacgatgatggggatgatgatgatgattttttctccgctccgcattcaaagccgagcaaaaccggcaaggtgcagagcacggccgacatatttggcgatgaggagggggatttattcaaagagaaggccgtggccagccctgaagcaaccgtttcccagactgatgagaataaggctcgcgcggagaagaaggtcacgcttagcagctccaaaaacctgaaaccatcttctgagacaaagacccagaaagggctgtttagcgatgaggaagactctgaggatcttttctcttcgcagtccgcctcgaagcttaagggcgcttctctcctccctgggaagctgccaacatcagttagcctgttcgatgacgaagacgaggaggacaatctgttcgggggaacggccgctaagaagcaaactctgtgcctacaggcccaaagggaagagaaagccaaagccagtgaacttagtaagaaaaaagcgtcagctttgctgttttcctcggatgaggaggaccaatggaatatccctgctagtcaaacacatctggcatctgattctaggagcaaaggcgagccccgagattccggaactctccagagccaggaagcgaaggccgtgaagaagacatccttattcgaagaagatgaggaagatgatctctttgcgatcgctaaagactcccagaaaaagacacaaagggtgagtttgcttttcgaggatgatgttgatagcaggggaagcctgtttgggtctccaccaacttctgttccgccggccaccaaaaaaaaagagacagtttccgaggcacctccgctgttgttctccgatgaagaagaaaaagaggcgcagttaggtgtgaagtctgtggacaaaaaagtggaatccgctaaggagagtctcaaatttgggaggaccgacgtcgcggagtccgaaaaagaggggctgctgacacggtcagctcaggagactgttaaacactccgaccttttcagttcatcttccccatgggataagggaaccaagccaaggaccaagactgtcctgtcactgttcgacgaggaggaggacaagatggaggatcaaaatatcattcaagccccgcagaaagaagtgggaaagggccgcgaccccgatgcccatccaaagagcactggagtgttccaggatgaagagctgctgttttcccataagcttcagaaagataatgacccagacgtggatctgttcgccgggacgaaaaagacgaagctgctggagccttctgtaggatctctgttcggcgatgatgaggacgacgatctcttcagtagtgcgaaatctcagcccctggtgcaggagaaaaagagggttgtaaagaaggatcattcagttgattcgtttaagaaccagaagcatcccgaatcaatccaaggatctaaggaaaagggcatctggaaacctgaaaccccccaggattcttccggcttggcacctttcaagacaaaggagccaagtacgcgaattggaaagattcaggcaaacctggcgatcaacccagccgccctacttccgacggcagcctcacagatatccgaggtgaagccagtgctgccagagttggcctttccgagcagcgaacacaggcgatcccatggcctggaaagcgttcccgtcttgcccgggtccggagaggccggcgtctcgtttgatctgccggcgcaggctgatacactccattctgcaaacaaatcaagggtgaagatgcgtggcaagaggagaccacagacacgggcagcacggcggctggccgctcaagagagttctgagactgaggacatgagcgtgcccagggggcccatagcacagtgggctgacggcgccattagtcccaatgggcaccgtccccagctgagggccgcatctggagaggattccactgaagaagctttagccgcggccgccgccccttgggagggggggccagtgccaggggtggataggagtccctttgctaagtctctgggccattcccggggggaagccgatctgtttgatagcggcgatatattcagcaccgggacaggctcgcagtcagtagagcggacaaagccgaaagcaaagttcggcaagctctggcctccccattgccacattcttctcatcaagttctattggaacacatag

SEQ ID NO: 26224 - DNA, 1533 bp, Artificial Sequence
  Description of Artificial Sequence: Synthetic coding sequence
atggaggaccagaatattattcaggcgccacagaaagaggtggggaaagggcgggacccagatgcccatccaaagagtaccggcgtgttccaggacgaggaactcctcttcagccataagttacagaaagataacgacccggacgtcgatctttttgcagggacaaagaagactaagcttttggagccctctgtgggcagtctgtttggagatgacgaggacgacgacttattctcatctgccaagtcccagcctctggtgcaggaaaaaaagcgggttgtgaagaaagaccattccgttgattctttcaagaaccagaaacacccagaatccatccaggggtccaaagaaaagggcatttggaaacctgagaccccacaagccaacctcgcaataaatcctgctgccttgctacctaccgcagccagtcaaatttcagaggtgaaaccagtcctccctgaactggctttcccaagctcagaacatagaagatctcacggcctcgagagcgtccccgtgctccctgggtctggcgaggcaggagtgtcattcgatctgcccgcgcaggccgacaccttacattccgcaaacaaaagtagagtgaaaatgcgaggcaaaagacgcccacaaaccagagcagcaaggcggctggcggctcaggagtctagcgaaacagaggatatgagtgtcccccgtggccctatcgcccaatgggctgatggtgcaattagcccaaacggacaccgtccccagctgcgagccgcttccggagaagatagtaccgaagaggcacttgccgctgccgccgctccatgggaaggaggcccagttcctggcgtcgacaggagtcccttcgcgaaaagcctggggcactcacgcggcgaagccgatttgttcgactccggggacatcttctccaccgggaccgggagccagagtgtggagcgcaccaaaccaaaagctaagatagccgaaaaccccgcaaaccctccagttggtggaaaggcaaagtcaccaatgttcccagccctcggtgaggcttcttcagacgacgacctttttcagagcgccaagcctaagcctgctaaaaaaactaacaccttccccctgcttgaggacgaggatgatttgtttaccgatcaaaaggttaaaaagaacgagaccaagagcaacagccaacaggacgtgattctgaccacccaggacattttcgaagacgatattttcgctacagaagctattaaaccatcacagaagactcgcgagaaggagaagactttagagtcgaatctcttcgatgacaatatcgatatcttcgccgatttgacagtgaagcctaaggagaaaagcaaaaaaaaagttgaagcaaaatctatctttgatgacgatatggacgacatctttagtagcggtattcaggcgaaaacaacaaagcctaaatccagatctgcccaggctgctcccgagcctaggttcgagcataaagtctccaacattttcgacgaccccttaaatgcgtttggaggccagtag

SEQ ID NO: 26225 - DNA, 819 bp, Artificial Sequence
  Description of Artificial Sequence: Synthetic coding sequence
atgcagtggaacgttccgcgcacagtctcacggctggctcggcgcacttgtctggagccacataacgccggactttttggccactgccagaacgtgaagggcccccttcttctgtacaacgccgaatccaaggtggtattggtccaaggaccacaaaagcagtggctgcatctgtccgccgctcagtgtgtggccaaggagcgcagacccttagacgcacacccaccccagccgggtgtgctccgtcataaacagggcaagcagcatgtctcattccgccgggtctttagtagctcagcgactgcgcagggaactccggaaaagaaggaagagcccgatccgttacaggacaaaagtatctcgctgtatcagcgatttaaaaaaaccttcaggcagtacggcaaggtgctcataccagtacatctgattacgtcaggggtgtggtttggcactttttactatgcagctctcaaaggcgtgaatgtcgtgcctttcctggagctaattggactgccagatagtgtggtatccattctgaagaactcgcagagcggcaatgcgctcaccgcctatgcactttttaagatcgctacgcctgcacgctatacggtgactcttggtggaacctctgtaaccgtgaaatatctcagatctcatgggtatatgagtaccccaccccccgtgaaggaatatctgcaggaccgcatggaagaaactaaggagttaatcaccgaaaagatggaggaaacaaaggatcgcctgactgagaaactacaagagaccaaggagaaagtaagtttcaaaaagaaggtagagtag

SEQ ID NO: 26226 - DNA, 819 bp, Artificial Sequence
  Description of Artificial Sequence: Synthetic coding sequence
atgcagtggaacgtaccgcgcactgtctcaaggctggccagacgcacgtgcctggaacctcacaacgccgggctgttcggccattgccagaatgtgaagggcccgctcctcttgtataacgcggagagtaaggtcgtcttagtccaagggccccagaagcagtggctgcacctgagcgcagcccagtgcgtggccaaggagagacggccacttgacgctcacccgccccaaccaggagtgttacgacataagcagggaaagcagcacgtatccttcaggagagtgttctcatcctctgctactgcgcagggcacaccagagaagaaagaagaacctgaccctctgcaggacaagagcattagtctgtaccagcggttcaaaaagaccttcagacagtacggcaaagtgctgattcccgttcatctcatcacctcaggcgtctggttcggcaccttctactatgccgccttgaaaggtgtaaatgtggtgccgtttctggagctgatcggtctcccagattcggtggtgtctattcttaagaattctcagagtggtaatgccctcaccgcttacgccctcttcaagattgccactccggcccgttatacagtgacactgggtgggacctccgtcacagttaagtatctgcgcagccacgggtatatgtccaccccacctccggtgaaggagtatctgcaagatagaatggaagaaacgaaggagctgataacggagaagatggaagaaaccaaagacaggctcaccgaaaaactgcaggagacaaaagaaaaagtgtcatttaagaagaaagtggaatag

SEQ ID NO: 26227 - DNA, 579 bp, Artificial Sequence
  Description of Artificial Sequence: Synthetic coding sequence
atggccggcctgctcgccctgctgggccctgcgggtagggtgggagcccgcgtgcgacctcgggcgacttggctgcttggcgccaccgctccatgcgccccacctcccctcgcccttgctctgctgccccccagattggacgcacgcctactgcggacggcacgcggtgattgtaggggccatcaggaccctagtcaggcaacgggcacaaccggttcctccgttagttgtacggaagagaaaaaacagagcaagtcacagcaactaaagaagatttttcaggaatatggtaccgtgggagttagtctgcatatcggcatcagtctgattagtttgggcattttttatatggtggtgtccagcggagtggacatgccagccatacttctgaagctcgggtttaaggaaagtctggttcaatcgaagatggctgccggaacgtccacttttgttgtggcatatgccatccataagttatttgcacccgtccgcataagcattacactcgtgtcagtacctctgatagtgcgttactttagaaaggtcggttttttcaagcccccagccgctaagccctag

SEQ ID NO: 26228 - DNA, 945 bp, Artificial Sequence
  Description of Artificial Sequence: Synthetic coding sequence
atgtgcccgacactgaacaatatcgtttcgtccctgcagaggaacggaatctttatcaattccctcattgcagccttgaccatcggaggccagcaactgtttagctcatctactttctcctgtccttgtcaggtaggaaaaaatttctattatggttcagcttttcttgtgattcctgctcttatattgctggtggccggctttgccctgcggtcacagatgtggactataacgggggagtactgctgctcttgtgccccaccctatcgcagaatctcaccactggagtgtaagctggcttgtctgagattcttttccatcaccggacgtgcagtgatcgctccattgacctggctcgccgtgaccctgctgacgggtacctattatgagtgtgcagcctctgaattcgcgtcagtggaccattatccgatgttcgataacgtgagtgcctctaaacgcgaggaaattctagcaggcttcccatgctgcagatccgctccctccgacgtgatactggtcagggatgaaatagcattgctacatagataccagagccagatgctgggctggattctgattactctggccactatcgccgccttagtgtcctgttgcgtggctaaatgttgctcacccttgactagcctgcagcactgctactggacaagccacctccagaatgaaagagagctctttgagcaggcagctgaacagcacagtagacttctgatgatgcataggatcaagaaactgttcgggttcatccccggatctgaggacgtcaaacacatcaggatcccctcatgccaggattggaaggacatcagcgtcccgactctgttatgtatgggggatgacctccagggacactatagttttctgggcaatagggtagacgaggataacgaagaggacagatcaagaggaattgagctaaagccttag

SEQ ID NO: 26229 - DNA, 387 bp, Artificial Sequence
  Description of Artificial Sequence: Synthetic coding sequence
atgcttggctggatcctcatcacgctcgctactatcgcggccctggtatcctgctgtgtggcaaagtgctgttcccccctaacaagtctccagcattgttactggacatcccatctgcagaatgaaagggaactattcgagcaggccgccgagcagcatagccggctccttatgatgcatcgcatcaaaaaactatttggttttattccgggttctgaggatgttaaacatatccgtatccccagctgtcaagattggaaagatatttccgtgcctaccctcctgtgcatgggagacgacttgcaagggcattactctttcttaggaaaccgggtagacgaggacaacgaggaggacagatctcgtggaatcgaactgaaaccttag

SEQ ID NO: 26230 - DNA, 516 bp, Artificial Sequence
  Description of Artificial Sequence: Synthetic coding sequence
atgttcgataacgtctccgcttctaaaagggaggaaattctcgcaggcttcccctgctgtaggtcggcccctagcgacgtcattctggtgcgggacgaaatagcactcctacaccgataccagtctcaaatgcttggatggatcctaattaccctggctaccatcgcggcactggtgagctgttgtgtggccaagtgttgctccccactgacctcactacagcattgttattggaccagtcacctgcagaacgaacgggagctctttgagcaggcagctgagcagcacagtcggctgctcatgatgcaccgaattaaaaagttattcggtttcattcctggctccgaggacgtcaaacacattcggatccccagctgtcaagattggaaggacattagtgtgccgaccctgttatgcatgggggatgatctgcaaggacattactccttcctggggaaccgtgtggatgaggataacgaagaggacagaagtcgcggaatagaattgaagccttag

SEQ ID NO: 26231 - DNA, 513 bp, Artificial Sequence
  Description of Artificial Sequence: Synthetic coding sequence
atggccccaagatccgctaaggagacctttcgtataaatccaaacgtcgcagcaaatttatctgccccatcagatgtaatcttagtccgtgatgaaatcgcacttctccaccgctatcagagccagatgttggggtggatcctcatcactctggccaccattgctgccctggtgtcctgctgtgtagctaagtgttgctcccccttaactagtttacagcattgctactggaccagccatctgcagaacgagcgggagctgtttgaacaggctgccgagcaacactcacggcttcttatgatgcatagaatcaaaaaacttttcgggttcatccccgggtctgaggatgtgaagcacatccggatcccgagctgtcaggactggaaagacatctccgtacctacacttctctgcatgggagatgatcttcaaggccactactccttcttggggaatagggtcgatgaggataatgaggaggatcgcagccgcggcatcgagcttaaaccctag

SEQ ID NO: 26232 - DNA, 372 bp, Artificial Sequence
  Description of Artificial Sequence: Synthetic coding sequence
atgctcggatggattctcatcactctggcaacaattgccgccctggtctcgtgctgtgtagcaaagtgctgctccccactgacatccctgcagcattgttactggacctctcatctgcagaatgagagggaacttttcgaacaggccgcagaacagcactcccggctgctgatgatgcacagaattaagaaattatttggttttatcccgggcagtgaggacgtcaagcatataaggatcccttcatgtcaggactggaaagacatcagcgtacccacactcctgtgtatgggcgatgacctgcagggccattactcttttttaggcaatcgggttgatgaagacaatgaggaagacaggtctcgtggctag

SEQ ID NO: 26233 - DNA, 930 bp, Artificial Sequence
  Description of Artificial Sequence: Synthetic coding sequence
atggacgccttccaggggatattaaaattcttcctgaaccagaagaccgtcattgggtattcctttatggccctgcttaccgtcggcagcgagcgcctgttctccgtagtagccttcaagtgtccttgttccaccgagaacatgacttacggactcgtgttccttttcgcccccgcatgggtcctgctgatcctgggcttttttctgaataaccgctcttggaggcttttcaccggatgttgtgttaatccaagaaagatattcccacggggacacagctgcaggttcttttacgtcctaggtcagattactttatctagtttggtggcacccgtcatgtggctgagcgtggcactgctcaacggcaccttctacgagtgcgctatgtctggcacccgatcgagtgggcttctggaactcatttgtaaagggaaacccaaagaatgctgggaggaactacataaagtctcctgtgggaaaacatctatgctgcccaccgtgaatgaggagctgaaattgagcttacaggcccagtcccagatcctgggctggtgtcttatctgttctgctagcttcttcagcctcctaacgacatgctacgcccgctgtaggagtaaagtaagctacctacagcttagtttttggaaaacttatgcgcaaaaggagaaggaacagcttgagaacacctttctcgactacgccaacaaactcagcgaaagaaatctgaaatgcttttttgaaaataagcgtccagatccgtttccaatgccaaccttcgccgcctgggaagccgcttctgagttacactcctttcaccaatcccagcagcattattcgactctccacagagtagttgacaatggcctgcagttgagtcccgaggatgacgagaccactatggttctggtcgggactgcccataacatgtag

SEQ ID NO: 26234 - DNA, 948 bp, Artificial Sequence
  Description of Artificial Sequence: Synthetic coding sequence
atggagaagtttcgcgctgttctcgacttgcatgtcaagcaccatagcgctctgggttacggacttgtgaccttgctgaccgctggaggggagagaattttctccgcggttgcgttccagtgtccctgttccgccgcctggaatcttccatacggcctcgtcttcctgttagtgcccgcgcttgcgctcttccttcttggctacgtgctatctgcacgaacatggagactgctcactggctgctgttctagcgctcgcgcctcttgcggatctgcccttagaggcagcctggtgtgtactcagattagcgctgccgccgctctcgcccccctgacatgggtggccgtggcccttctgggcggagcattttacgaatgtgctgccactgggtctgctgcttttgcccagcgtctgtgtttagggcgtaaccgtagttgcgcagctgaattaccgctcgtcccatgcaaccaggctaaggccagcgacgtccaggacctgctgaaggatctgaaggcgcaatcccaagtgcttggatggatcctaattgcagtggtgatcatcattctgctgatttttacatcagtcactcggtgcctgagccctgtgagtttcctgcaacttaaattctggaagatatatctggagcaagagcagcaaatattgaagtcaaaggcgacagaacacgccactgagcttgcaaaagaaaatattaagtgtttttttgaaggaagccatcctaaagagtacaatacgccaagcatgaaggaatggcagcagatttcttccctgtacacgtttaatcctaagggtcagtactattcgatgcttcataagtacgtcaataggaaagagaagactcattccatcagaagtacagaaggggatactgttatccccgtgctgggctttgtggatagttcagggatcaattctacccccgagctctag

SEQ ID NO: 26235 - DNA, 204 bp, Artificial Sequence
  Description of Artificial Sequence: Synthetic coding sequence
atgagaaagccccaggccggcaccggcgaagcggctcgcgatccttcactgagacccgctagaacggtgctcgttggagatcaggacgagtacactgcagccgaaaataaatcacctcgtggcacattatgccccaccggcgagcagagaattcacgcccgcgaagatgcttgcatattttcccgtctcttcagtgaaaaatag

SEQ ID NO: 26236 - DNA, 393 bp, Artificial Sequence
  Description of Artificial Sequence: Synthetic coding sequence
atggcagccccacctgagcccggggagccggaggaacggaaggcatcttgcacctctctccatctgagttattggaagagcctaaagctgttggggtttttagatgtggaaaacactccctgcgccagacatagcatcctatacggttcattaggaagcgtggtggccggcttcggacacttcttgttcacttcccggatcagaagatcatgcgacgtgggggtgggaggatttatattggtgaccttagggtgttggtttcactgccgctacaactacgccaaacaaagaatccaggagagaattgctagggaggaaatcaagaaaaagattctgtatgagggcacccaccttgaccctgagcgcaaacacaacggttccagttctaactag

SEQ ID NO: 26237 - DNA, 357 bp, Artificial Sequence
  Description of Artificial Sequence: Synthetic coding sequence
atggcggcccctcccgagcctggagaacccgaggagcggaaaagtttgaaattgctaggcttccttgatgtcgagaacacaccctgcgccaggcattctatcctgtatggcagcttaggatcggtcgtcgcgggctttggtcactttttgttcacctccagaatccgtcggagctgcgatgtgggggtaggcgggttcatcctggtgacactaggatgctggttccattgtaggtacaattatgccaaacagcggatccaggaaagaatcgcaagagaggagatcaagaagaagattctctacgaaggcacccacctggatcccgagcggaaacacaatggctccagttcgaactag

SEQ ID NO: 26238 - DNA, 1680 bp, Artificial Sequence
  Description of Artificial Sequence: Synthetic coding sequence
atggtcgaaaaaatccttattcaccgaattctcaccttgtttcccaacgccatcgcccgaaaactcctgctgatgttgacattcatcttgattttctggatcatttacctggcctcaaaagaccacaccaagttttccttcaatctggagaaccacatcatcctcaaccagggaaacattttcaaaaagtacagccacagcgagacccccctgtgccctgcagtaagcccaaaagagacagagctgagaattaaggacatcatggagaagctcgatcagcaaattcctcctcgacccttcactcacgtgaacaccactacttccgctacacactcaactgcaacaattctgaacccccaggacacctactgtagaggcgatcagctggatattttactggaagtgcgggatcatctgggccacaggaagcagtatgggggggattttctgcgcgctagaatgtacagtactgctctcatggcaggcgcaagcggcaaagtaaccgattttaataacggcacgtacttggtgtctttcactctgttttgggaggggcaggtctcactgagtcttctattaattcaccctagcgagggcgtctcagccctgtggagagccagaaaccaggggtgtgatagaatcatatttactggcctattcgccaacaggtcatccaatgtctttacggagtgtggactcacgcttaacaccaatgctgagctttgtcagtatatggacgatcgcgatcaggaggcgttttattgcgtccgcccacagcacatgccttgcgaagccttaactcacatgacaactcggacgcggaacatctcttatctgagtaaggaggaatggcgactcttccaccgctccaatattggagttgaaatgatgaagaactttacaccaattgaggtgattccctgcaataaatcggaaaacataaaaaagaattgtcaaattgggatgaaaaccccgtttcctagcggctacaccctgaaaaaaatgtggattacagccttctgcaagcagattaagtttaatgagacaaagaatatcaatgactgtttggagcggaaattaatttatttaatgggtgactctactctgcatcagtggatctactacctgcagaaagccgtgaagacactcaaatactttgaccaccacggcgccgggatcttcaaaacacacgtgcttctagatgtcgaaagacacattctgatccagtggaagaagcacggacaccccttcgtcacgaagaagctatttagcgtgaaagatgaaaattacattccccgggagatcgaccaggtagctggagataaaaacacggccatcgtaataactctcggacaacacttcagaccattccctatcaatatttttatccggcgggccatcaatatccagaaggccatcgagcggctattcttacgaagccctgaaaccaaggtaattttaaagaccgagaacactcgcgaaattgagcagaatgccgagatgtttagcgacttccatgggtacattcaaaatttaataatccgcgatatattcgtggatctcaacgtgggcatcatcgacgcttgggacatgactatcgcctattgtaccaacaacgctcatccccccgactacgtcattcaaaaccagattggcatgtttttaaattacatttgttag

SEQ ID NO: 26239 - DNA, 1098 bp, Artificial Sequence
  Description of Artificial Sequence: Synthetic coding sequence
atggtagaaaaaatcctcatccatcggatcctaaccctttttcccaatgccattgcacgtaagctcctcctgatgctgacatttattctgatattttggatcatctatcttgcgagcaaggaccatactaaatttagcttcaacttggaaaatcatataattctaaatcaaggaaatattttcaagaaatattcacacagcgagacgccgctgtgccctgctgtctctccgaaggaaaccgagttacgcatcaaggacattatggaaaaactggatcagcagattccaccccggccatttacccatgtcaacaccaccactagtgccacccattctacagcaactattcttaatcctcaggacacctattgcagaggagatcagctggacattctactggaagttcgcgatcacttgggacacagaaaacaatacggtggcgactttttacgcgctagaatgtactcaacagctctaatggccggcgcatccgggaaggttacggactttaataatggcacatatctggtttcttttacgctgttctgggaaggccaagtgtccctgtccctgctgctgattcacccttcagagggtgtcagtgctctctggagagcccggaatcagggctgtgatcggatcatcttcacaggcctctttgcaaatcggagctccaacgtctttacagagtgcgggctcacactgaacaccaacgcagagctttgccagtacatggatgaccgtgaccaggaggccttctattgtgtgaggccccagcatatgccatgtgaagcactgacccacatgactacacggaccagaaacatctcatatctgtctaaggaagaatggcgtcttttccacagaagcaatataggagtggagatgatgaaaaactttacacccatagaggttatcccatgtcccgccttgttctactttatttttagggacagcctgaccctctctcctagattggaatgctctgggatgatttctgctcattgtaacctatgcctcccgggtagctccgactcaccagatagcgcgagccatgttgccggcatcacatcagtgcagaggcacacatggctttag

SEQ ID NO: 26240 - DNA, 726 bp, Artificial Sequence
  Description of Artificial Sequence: Synthetic coding sequence
tagcagacagcccgttgccatagtggccttgtaagctccgtgcaggcaataatggcctctactgccggttacatcgtgtcaacttcctgcaaacatataatagacgaccaacactggttaagcagtgcctacactcagttcgcagtcccatactttatttatgatatatacgccatgtttctgtgccactggcacaagcaccaagtcaaaggtcacggcggtgacgatggggccgcgcgagcacctggctccacctgggcaattgctcgtgggtacctccacaaagagttcttgatggttcttcaccatgcagctatggttctggtttgctttcctctgagtgtagtgtggcgacagggcaagggtgacttctttctggggtgcatgttaatggcagaagtctcaacaccctttgtttgcctgggtaagatcttaatccagtataagcagcagcatacactgctccataaagttaatggcgcactgatgctgctcagcttcctctgttgtcgtgtgttgctgtttccctacttgtactgggcctacggtcggcacgcgggactccccctcttagccgtcccactcgcaatccccgcccatgtgaacttgggcgccgctctactgctggcgcctcagttgtactggtttttcctcatctgccggggggcatgtcgccttttctggcctcgatcaagacctcctccagcatgccaggcccaagactag

SEQ ID NO: 26241 - DNA, 825 bp, Artificial Sequence
  Description of Artificial Sequence: Synthetic coding sequence
atgctgactccaatggtcgccggcggagtggtatttcctgggcttttcctcctttcaaagaacacactgcagaggttaccgcaattacgatgggaggaggccgatgccgtcattgtgtcggcccggctggtgagtagcgtgcaggccattatggcctctaccgccggatacattgtctcaactagctgcaagcacattatagacgaccagcactggctctccagcgcctacacccagttcgcagtgccctatttcatatacgatatttatgcaatgttcctgtgtcactggcacaaacaccaggtgaagggacatggaggcgatgatggggccgcccgagcccccggcagtacttgggctatcgctcgcggttatctgcacaaggaattcctcatggttctgcaccatgcggcaatggttctggtgtgtttcccactttctgtcgtctggcgccagggaaagggagattttttcctgggctgtatgcttatggcagaggtctccacacctttcgtttgtctggggaaaatcttaatccagtacaaacagcagcacaccttgttgcacaaggtgaacggagcgctcatgctcctcagctttctgtgctgccgggtgctcctgtttccatacctctattgggcctacggtcgtcacgccgggctgccactcctggccgtgccgctggccatccctgcccacgtcaatttaggcgccgcattattactggccccacagctctattggttctttctgatttgccgtggcgcctgtaggctcttctggcctaggtctagaccccctcccgcctgccaggcccaggactag

SEQ ID NO: 26242 - DNA, 1287 bp, Artificial Sequence
  Description of Artificial Sequence: Synthetic coding sequence
atggccaggagtttatgcccgggagcttggcttaggaaaccatactacctccaagcgcggttcagctatgtgagaatgaaatatttatttttcagctggctggtggttttcgtaggttcatggattatatacgtgcagtattctacttacaccgagctgtgtaggggcaaggactgtaagaagattatttgtgacaagtacaagacaggcgtgattgatggacctgcttgtaattccctgtgcgtcaccgaaaccttatactttggaaagtgtctgtccacaaagcctaataaccagatgtatttaggcatctgggataacttgccgggagttgtgaaatgtcagatggagcaagctctgcacttggacttcggcactgagctcgaaccgaggaaggaaatcgtgctcttcgacaagcccacacgcgggaccaccgttcagaagtttaaggagatggtatactcactatttaaggccaagctcggggatcagggaaacctaagcgaactcgtgaaccttattctcacagtggcagacggtgacaaagacggacaggtctccctgggcgaagccaaatctgcgtgggccttgttgcagctgaatgaattcttgctcatggtgattctgcaggacaaggaacacactcccaagctgatggggttctgtggggacctgtatgtgatggaatctgttgagtatacctctttatacgggattagcctgccttgggtcattgagctgtttatccccagcggatttcgtagatctatggatcagttatttacaccctcctggcctcggaaagccaaaattgcaattgggctgctcgagttcgtcgaagacgtgtttcacggaccctatggcaacttcctaatgtgcgacacttcagccaagaatctgggatataacgataaatacgacctcaagatggtggatatgcggaagattgtgccagagaccaatctgaaggaactgataaaagatcgacactgtgagagcgacctcgattgtgtgtatggcacagactgtcgtacttcttgtgatcagagcactatgaaatgtacttcagaggtgattcagccgaatctggccaaagcttgtcagctgctgaaggactatttgttgagaggggccccctccgagattagggaagagctggaaaaacaactatacagttgcatcgcccttaaggtgacagcaaaccagatggaaatggagcactccctcatccttaataacctcaagacattgctgtggaagaagatttcttacaccaatgactcatag

SEQ ID NO: 26243 - DNA, 489 bp, Artificial Sequence
  Description of Artificial Sequence: Synthetic coding sequence
atggccaggtccttatgtccaggcgcctggctgcggaagccatattacctccaggcccggttctcttatgtgaggatgaagtatctatttttttcatggctcgtggttttcgttggcagctggatcatctatgtacagtatagcacctacacagagttgtgccggggtaaggactgcaagaagataatttgtgataagtacaaaacaggcgtgattgatggtcctgcctgcaactccctctgcgtgacagaaaccttatacttcggcaaatgtctgtctaccaaacccaataatcaaatgtacctgggcatctgggacaacttaccgggcgtggtgaaatgccagatggaacaagcactgcatctcgattttggcaccgagctagagccacgcaaggagatcgtgctgttcgacaagcctactcgaggcaccacagttcaaaaattcaaggagatggtgtacagcctcttcaaagaccgccaccgctag

SEQ ID NO: 26244 - DNA, 1035 bp, Artificial Sequence
  Description of Artificial Sequence: Synthetic coding sequence
atggttgaatggaggacatgcctgtccgtggctccaggccaacaggtgtactcagggctttggcgggacaaggatgtgactatcaagtgtggcatcgaggagacactggactcgaaggctaggtccgatgccgctccccgccgggaactggtgttgtttgacaaacctacaaggggcacaagcatcaaggagttcagggaaatgactctttcattcctaaaggctaacctgggggacctccccagtcttcctgctctggtggggcaggtgctgcttatggccgatttcaacaaagataacagagtgtccttggcagaagccaagagcgtgtgggcattactgcaacgtaacgaattcctcctccttttaagcttacaggagaaagagcatgcatcccgattgctcgggtactgcggagacttgtacttgacagagggtgtcccccacggagcctggcatgccgccgcactgccaccattgctacgccctctgctgccccccgctctccagggagctttacaacagtggctcggcccagcctggccctggagagctaaaatcgccattgggctactggagttcgtggaggaattgttccatgggtcttacggtaccttctatatgtgtgagaccaccctggccaatgtggggtacacggctacatatgacttcaagatggccgatttgcaacaggttgctcccgaagccactgttcggagatttttgcagggtcggcgctgcgagcattccacagactgcacctatggcagagactgccgggccccgtgcgatcggctcatgaggcagtgcaaaggagacctgatccagcctaatctggcaaaggtgtgtgcactgcttcgtggctacctattgcctggggcccccgcagatttgagagaggaattgggtacccagctccgcacctgcaccacactttcaggactcgcctctcaggtcgaggcccatcactccttagtcctaagccaccttaaaaccctgttgtggaagaaaatatcaaacaccaagtacagttag

SEQ ID NO: 26245 - DNA, 1296 bp, Artificial Sequence
  Description of Artificial Sequence: Synthetic coding sequence
atgcgccgcctacgaaggttggctcatctcgttctcttttgccccttttccaaacgcttacagggccgcttacctggcctgcgcgttaggtgtatcttcctcgcctggctaggggtgtttgccggctcatggctagtatatgtgcattacagtagctattccgaaaggtgcagagggcacgtgtgtcaggtggttatttgcgaccagtataggaagggcattatcagcggcagcgtatgccaggacttatgcgaactccatatggtggaatggaggacatgcttgagcgtggcaccaggacagcaggtgtactccggactgtggagggacaaggacgttaccataaagtgtggaattgaggagaccctggacagtaaagctcggtccgatgctgcgcctcggcgggagctggttctgtttgacaagcccacacgtggaacctcaattaaggagtttagagaaatgacattgagcttcttaaaagcaaatcttggagacctcccaagcctgccagcgttggtgggtcaggtgctgctcatggccgactttaataaagataaccgtgtttccctagccgaggctaaatctgtctgggctcttcttcagagaaatgagttccttctgctgctgtcgctgcaggaaaaggaacacgcctccaggctcctgggctactgtggcgatttgtatttgacagaaggggtgcctcacggggcttggcatgccgctgccctgcctccactgttgcgacctctgctcccacccgccctgcagggggctctccagcaatggctggggcccgcttggccatggcgcgctaaaattgccattggtctgctggaattcgtagaggaactgttccacggaagttacggcacgttctacatgtgtgaaaccactctggcaaacgttggatacacagccacttatgactttaaaatggctgacctgcagcaggtagctcccgaagccaccgtgcgtcgcttcctgcagggccggcgatgtgagcactctacagactgtacctacggccgcgactgccgtgcaccatgtgaccgtttaatgaggcagtgcaagggtgacctgatccagccgaatcttgccaaggtttgcgccctgctcaggggctatctccttccaggagcccctgccgatctaagagaagagctgggcacccagctgcgaacatgtactacgctctcaggcctggctagccaggttgaagcccaccatagcctcgttttgtcacatctgaaaacactgctgtggaaaaagatcagcaataccaagtatagttag

SEQ ID NO: 26246 - DNA, 1260 bp, Artificial Sequence
  Description of Artificial Sequence: Synthetic coding sequence
atggcccgagcagccggagcacggggccccgcaggctggtgccgccgaaggggcaggtgcggacgggggaccttgctcgccttcgcagcttggactgcgggctgggtattggctgccgctcttctgcttcgtgcccatccgggagtactatctgagcgttgcacagatgaaaaaagtcggaggattttggccgccctgtgccaagactatcagggagggacactggctggagatctgtgtgaagatctgtgcgtcgcgggtgagctcctattccagcggtgtcttcactataacaggggaaagaaagtcctacaagccgactggagaggacgccctgtagtcttaaagtctaaggaggaggcattctcatcattcccccccctctcactcctcgaggaagaggccggcgaggggggccaggacatgccagaggctgagttattgcttatggtggccggcgaggtgaagtccgcccttgggttggaactgtccaactcaagcctgggcccatggtggcctgggcgccggggcccacgctggcggggccagctggccagcctgtgggcactgcttcagcaggaggaatacgtatacttttccttgctgcaggacctgtcgccccacgtcctaccagtgttgggcagttgcggccacttctatgcagttgagtttttagctgccggtagtccccatcaccgcgctctattccccttggatagagcacctggggctcccggagggggccaggcgaaggcaatctctgacattgcactcagttttctcgatatggtaaaccactttgatagtgacttcagccaccggctgcacctttgtgacatcaagcctgagaacttcgcgattagaagcgattttaccgtcgtggcgattgatgtggacatggcattctttgagccaaagatgagagaaattttagagcaaaactgtaccggggacgaggactgcaatttttttgactgcttctcacggtgtgacctgcgggtgaacaagtgtggcgcccagagagtgaataacaacctccaggtcatttgcgacaaaatcttcagacactggttctcagccccgctcaagagcagtgcagtttcctttcagttgcaactccagctccaggaggctgtccaggagtgtgctgaccctggtgtgccttcaggcaatactcgcagagctgccagtagcgtattctggaagctacgtcagctgctccaggcgactctacgcgagctccaggaagccgagaagtag

SEQ ID NO: 26247 - DNA, 1050 bp, Artificial Sequence
  Description of Artificial Sequence: Synthetic coding sequence
atgcaccagtctctgacacagcagagatcttctgatatgtcactccccgatagtatgggcgcctttaatcgccgcaaaagaaactccatttatgttaccgtcacgttgctcattgtcagcgttctgatccttaccgttggattggcagctactactcgaactcagaatgtgactgttggaggttactacccgggcgtgatactgggatttgggagcttcctcggtatcatcggatccaacttgatcgagaacaaacgccaaatgttggttgcctcaattgtatttatctccttcggcgttattgccgcgttttgctgtgctattgttgacggagtgtttgccgctaggcatattgacctcaagcccctttatgcaaatagatgtcattacgtccctaagacctcccagaaagaagccgaggaagttatatcttcctcaaccaagaattcccctagcacccgcgtcatgaggaatctgacccaggcagccagagaggtgaactgcccccacctcagtcgcgagttttgcaccccaaggatcaggggtaatacatgtttttgttgcgatctgtacaattgtggtaaccgggtggagatcacgggaggatattatgagtacatcgatgttagttcctgtcaggatatcatccatctgtaccacctgctctggtctgcaaccatcctcaacattgtgggtctcttcctcggcatcatcacagccgccgtgctgggaggctttaaagatatgaatcccaccttacccgctctgaattgctcagttgagaacacacatccaactgtatcttattacgcacatccccaagtggccagttataacacatactaccatagcccgccgcacctaccaccgtattccgcatatgacttccagcattctggcgttttcccttcaagtccgccctctggactctcagatgaacctcaaagtgcaagccccagtccgtcttacatgtggtcgtctagcgccccaccccggtattcccccccttactaccccccattcgagaagccccctccgtactctccctag

SEQ ID NO: 26248 - DNA, 558 bp, Artificial Sequence
  Description of Artificial Sequence: Synthetic coding sequence
atggtgaattgcccgcatctctctcgtgaattctgtacacctagaatccgggggaatacttgtttctgctgcgacctctataactgtggcaatcgcgtggagatcactggaggctactatgaatacatagatgtgtcctcatgccaagatattatccatttgtaccatcttttgtggagcgccacaatcctcaatatcgtgggattgttcttgggaattataacagccgcagtactggggggatttaaggacatgaaccctaccctgccggctctcaattgcagtgtggaaaatacccacccaaccgtgtcctactatgcccacccacaggtcgccagttataatacctattatcattcacctccccacctcccaccatattctgcctatgattttcaacacagcggtgtgtttccatcgtcaccgccaagcggactgtcagacgagccgcagtccgctagcccctcccccagctatatgtggtctagcagcgcgcccccccgttattcgcccccttactatccccctttcgaaaaacctccaccatattcaccttag

SEQ ID NO: 26249 - DNA, 978 bp, Artificial Sequence
  Description of Artificial Sequence: Synthetic coding sequence
atgcaccagtctctgactcagcaaaggtcaagtgatatgtctctgcccgatagtatgggggcttttaataggaggaaaaggaatagcatttacgtgacagtgaccctgcttatagtgtctgtcctcattttaactgtgggcttggccgcgaccaccagaacccagaatgttacagtgggcggttattaccccggtgtgattctcggatttggctcctttctgggcataattgggtcgaatttgatagaaaacaaacgccaaatgctcgtcgccagtattgtgtttatatcatttggagttattgccgccttctgttgcgccatcgtcgacggcgtgtttgccgcaaggcacatcgatctgaagcccctatatgcaaatagatgccattatgtacccaagaccagccagaaagaggccgaggaagtgaattgcccacacctaagcagagagttctgcaccccacgtatccgcgggaatacctgtttttgttgtgacttgtataattgtggaaatcgggtggaaatcactggcggctactatgagtatatcgatgttagcagttgtcaagatattatccacttgtaccacttactgtggagcgctactatcctcaatattgtcggcctgttccttgggattatcaccgcagcggtgctggggggtttcaaggacatgaaccctacgttgccggctttgaattgttctgtggagaacacgcatcccactgttagctactacgcccaccctcaagtcgctagctacaatacgtattatcacagtccacctcatctacccccttactccgcttatgactttcaacactccggagtatttccctctagcccacctagtgggttgtccgatgagccacagagtgcatcaccttctccaagttatatgtggagcagttctgcaccgcccagatacagcccaccctactatcccccctttgagaaaccacctccttactccccctag

SEQ ID NO: 26250 - DNA, 726 bp, Artificial Sequence
  Description of Artificial Sequence: Synthetic coding sequence
atgcatcagtctctgactcagcagcgcagcagcgacatgagtctgccagattctatgggggccttcaaccggagaaagagaaacagcatttacgtcactgtcactcttctcatagtgtccgtcctgatcctgaccgtcgggttggctgcaaccacccgtacacagaatgtgacagtcggcggatactacccgggggtcatcctcggcttcggaagcttcctggggatcatcgggtccaacctgattgagaataagagacagatgctggtcgcatccatcgtgtttatttctttcggcgtgattgcggccttctgttgcgctattgtggatggagtgttcgccgctcgtcatattgatctcaaaccactctatgctaaccgctgtcactatgtgcccaagacgtctcagaaggaggcagaagagaatccaaccctgcctgcactgaactgctctgtcgagaacacccaccctacggttagctattatgctcaccctcaggtggcctcctacaacacctattaccacagtccccctcacctccccccgtattctgcctacgattttcagcattctggagttttcccaagctccccccccagtggcctgtccgacgaaccgcagagcgcatccccatcgcccagctacatgtggtccagttccgcccctcctcgctactcacccccctactacccgccttttgagaaaccacccccttactccccttag

SEQ ID NO: 26251 - DNA, 981 bp, Artificial Sequence
  Description of Artificial Sequence: Synthetic coding sequence
atgcagcctccagtcccaggtccacttgggctgcttgaccccgccgagggactctcccgccggaagaagacctccctgtggtttgtaggaagcttactgctggtctctgtgttaatcgtaacggtcggcctggccgccacaactcgaaccgagaacgtcacggttggggggtactatcctgggataatccttggctttgggtcgtttttaggcattatcggtattaatttagtagaaaaccggcgacaaatgcttgtggctgctatagtgtttataagcttcggggtcgtggccgcgttttgctgtgccatagtggacggcgtattcgccgcccagcacattgagccaaggcctctgacgaccggacggtgtcagttttatagctccggggtgggttatctgtatgacgtatatcagactgaagtgacctgccattcactggatggaaagtgtcagttaaaagtccgcagtaatacgtgttattgttgtgacctctatgcctgtggctctgccgagcccagccctgcctactacgaattcataggagtctctggttgtcaggacgttttgcacctgtaccgcttgctctgggcctcagcggtgctgaacgttctggggctgttcctggggatcatcacagccgcagtgctaggagcgttcaaagacatggtgccactgtctcagcttgcgtatggaccagcggtccctcctcagacattatataacccggcccagcagatactggcttacgcagggtttcggttgacccccgagcctgttccaacatgcagttcttatcctctgccactgcagccgtgttctcgattccccgtcgcccccagctccgctcttgcctcgagtgaggatctccaacccccttccccttctagctccggctcaggcctgccaggtcaagcaccaccatgttatgcgccaacctatttcccaccgggtgaaaaacccccgccgtatgctccttag

SEQ ID NO: 26252 - DNA, 1899 bp, Artificial Sequence
  Description of Artificial Sequence: Synthetic coding sequence
atgtcagattgctgcagcgccccaggaatctcttgggaagcaggcgtggggagaccagccgtgcctggactggagctgcagatccgtagaggagcaatgtctgaagagaccgtttctgaatcacagtttagcctcaaaacagcagccctgcgggtgttcgatctccccttaacctggtactactctcttagccagatcaagtttagtcccgtggcaaaaaaattgtttgtggtcactgctgtgtccgccattagtgtcattttcttggctcatcacttcaagcggaaacgtgggaaaaagaaggggaaaattctgccctgggagcccgagcaccttatcctggagtacacgaagagggccgccagcgacaaggggtctagctgtagctccagccggcagaacttgaccttaagcctctcctctactaaggacaagggctcacaagtttgcaactatgctaatggcggtctgttctccaagtactctggctctgcccagagcttagcatccgtacagagtgtcaatagctgtcacagttgtgcatgtggaaactctaattcctgggacaaagccgatgaggatgatatcaaactcgtgaacatcccggtgacaaccccagaaaacctgtacctgatgggtatggagctgtttgaggaagcactgcgtaggtgggagcaggctctgacatttcgcaatcgccaggcagaagatgaagcgtgcggctctattaagctcggcgccggggacgcgattgccgaggagaatgtagacgatatcattagcaccgagttcattcacaaactcgaggccctgcttcagagggcttatcggttgcaggaggagtttgaagcaactcttggcgcatctgatccaaactctctcgcagatgacattgataaagacaccgatattacaatgaagggcaatgtagaagactttggcctgcgggacaccttaagcatcgcgtccaccgactcttttgcatcagctgcggagttagctgagcacagagaagtgagacacacctatagcctggagtccctatgccactgcccgttctacgaggaggctatgcatctagtggaggagggcaagatctactctcgagttctgcgtaccgagatgctagagtgcctcggggactcagactttttggcaaaactgcactgcattcgccaggcttttcaggtgatcctttccgaatcagcaaatcgtatcttcttggcggagagtggccgtaagatcttatccgccctgatcgttaaggctcgcaagaatcctaagaaattcgaggacgtctttgacgaaatgatttacttcttagaacagacggaccactggggcagcaccgagatggagcttgctgctaggggagtgaagaacttgaatttctacgatgttgttcttgattttatactcatggatagttttgaagatctggaaaatccccctacttccatccaaaatgtggtcaataatcgctggctcaatagttcgttcaaggagactgccgtcgcatcatcctgttggtctgttctgaaacagaagaggcagcagatgaagatcccagatggtttcttcgcccatttttacgcaatttgcgagcacatcagcccagtgctcgcctggggttttctcgggcccagaaactccctttacgacctctgctgttttttcaagaatcaggtactattgtttcttaaggacatcttcgatttcgaaaaagtgagatactcttctaccgaaacactcgcagaggacctgatgcagctcctgattcgacgcactgaattgctcatggcctatttagaggcagacgccctgaggcataccagctcttgtctgtcttcccacgggcatgtaatgagcaccggcctgcttgaggcgaaggttcagtag

SEQ ID NO: 26253 - DNA, 1788 bp, Artificial Sequence
  Description of Artificial Sequence: Synthetic coding sequence
atgagcgactgctgctctgcccccgggattagctgggaggcaggtgtcggacgccccgcagtccctggtctggagctccagattaagttctcccctgtggctaagaaactgtttgttgtgaccgctgtgtccgcaatttcggtgatttttctggcccatcactttaagcgaaaacgtgggaaaaagaaaggaaagattctcccttgggaaccggagcatctcatacttgaatacaccaagcgcgctgcatctgataagggcagctcctgttcgagctcccgacagaatttaacgctttccctgtcgtctacgaaagataagggctcacaggtctgtaactacgccaatggcggattattctccaagtatagtggaagcgcccagagcctggcttctgtccagtccgttaactcctgtcactcctgcgcctgcggtaactcaaactcctgggataaagcagacgaggacgatatcaaactggtcaacatccctgtgacaacaccagagaacctgtatctgatgggcatggagctgtttgaggaagctctccggcgatgggaacaggctctgacctttagaaaccggcaagccgaagatgaagcctgtggatctatcaaactcggagccggggatgctatcgcagaagaaaatgtcgatgatatcatttccacagaatttattcataagttagaagccctgctccagcgggcctatcgcctgcaggaggaattcgaagccacgctcggtgcatcagatcccaactccctggccgacgacatcgataaggatactgatataactatgaagggaaacgtcgaggacttcggtctgcgcgatactctgtcaatagcgagtacagattcctttgcttccgccgccgagctggccgaacaccgggaggtgaggcacacttactctctcgaatcactgtgtcactgtcctttttacgaagaagcaatgcacttggtagaagagggcaaaatttattcacgagtattgaggaccgagatgctcgagtgtctgggggacagtgattttcttgccaaattacactgtatccgccaagcctttcaggtgatcctctcagaaagtgctaaccgcatctttttggcagagtctgggaggaagattttgtcggcactaattgtgaaggctcgtaagaatccaaaaaagtttgaggacgtctttgatgaaatgatttattttctcgaacagaccgaccattgggggagtaccgagatggaattggccgctcgcggcgttaagaacctgaatttctacgacgtggtactggactttattctgatggatagtttcgaagatctagagaaccctcccacatccatccagaatgtggtaaacaaccgatggctcaattcatcctttaaagagactgcggttgcaagctcatgctggtccgtgttaaaacagaaaagacagcagatgaagcagattccagatggattttttgctcacttctacgctatctgcgaacacattagcccggtactggcctggggattcctcggacctcgtaattccctgtacgatctgtgctgtttttttaagaaccaggttttattgttcctgaaagatattttcgacttcgaaaaagtgcgctattccagtaccgaaaccctggcagaggacttgatgcagttactgatacgtcggactgaactgcttatggcttatctggaggccgatgcactaaggcatactagttcctgtctgtcttcccacggccacgtgatgagcaccggacttctggaggccaaagtacaatag

SEQ ID NO: 26254 - DNA, 972 bp, Artificial Sequence
  Description of Artificial Sequence: Synthetic coding sequence
atggccttccgaagggccgaagggacatcgatgattcaggccctggcaatgacagttgccgagatccccgtctttttatacaccacttttggtcagtccgcgttctctcagttgcgactgacaccgggcttgaggaaggtgctgtttgccactgcactaggcactgtggcactagctttggccgcacatcagttaaagcgcagacggagacggaaaaagcaggtaggccccgagatgggcggggagcaactcggaactgtccccctgccgattctgttggctaggaaggtgcccagtgtcaaaaaagggtattcaagtcggcgagtgcagtcccccagtagcaaaagcaatgatacactgagcggcattagttcaatagaaccatccaaacacagcggcagcagtcactctgtagccagcatgatggcagttaactcgtcgtcaccgaccgctgcctgctccgggctgtgggacgccagggggatggaggagtccttgaccacctctgacggtaatgccgagagcctctacatgcagggaatggagctatttgaagaagccctgcagaaatgggaacaggccctgtcagtggggcagcgaggcgattctggtagcactcccatgccgcgtgatgggctgcggaacccagagacggcctcagagcctttaagtgagactgaatcccattcagtcgccaggctggagtgttccggtgctatcagcgctcaatgcaatctcagattcttgggttcccgggactcacccgcctcagctagccaggtagctggtatcaccgccagagtcactgccgaaggcgtttgtcgcgaagcgggcgtacctgcggcgccatgtttgccaccagctggaggagtccgcttacatctgccacgccggcagcacgccgccagacctcgagaggatcctcacgccgccccagaccgaggcctcgcagcagccgccggaggaagatag

SEQ ID NO: 26255 - DNA, 1782 bp, Artificial Sequence
  Description of Artificial Sequence: Synthetic coding sequence
atggctttcagaagagctgagggcacctcgatgatccaggcactggctatgacagtggcggagattccagttttcctctacaccacattcggtcagtccgccttctcccaactgaggttgaccccgggattacgcaaagtattattcgcaaccgcactcggtacagtggcccttgccctcgctgcccaccagctgaaacgtcgcaggcgccggaagaaacaggtgggaccagagatgggcggcgagcagcttggaactgtccccctcccgatactgttggccaggaaagtcccttccgttaaaaaaggctacagttcaagacgcgttcaatcaccatcatctaagagcaatgataccctgagcggaatctcttcaattgagcctagcaaacacagtgggtcatcacacagcgtggctagtatgatggcggtgaatagcagttcccctacagccgcctgcagtggactgtgggatgcaagaggaatggaggagtctctaacaactagtgatgggaatgcagagagcctgtacatgcagggaatggaactgtttgaagaagccctgcagaagtgggagcaggccctcagcgttgggcagagaggcgactcgggttccacccccatgcctcgcgacggcctgagaaacccggagaccgcgtctgaacccctatccgagccggagtcccagcgcaaagagtttgccgaaaagctggagtcccttctacatcgagcgtaccacctgcaagaggaatttggatcgacatttcccgccgacagtatgcttctggacctagagagaaccttgatgttgccactgactgaggggagtctcagattgcgagcggatgatgaggactccctgaccagcgaggactcctttttttcggctaccgaactgtttgaaagcctgcaaacaggcgattacccaattcccctctcgcgcccggctgccgcttacgaagaagcattgcagctcgtgaaagaggggcgtgtaccatgcaggactctacgcacagagctactcggttgttactctgaccaggattttctggccaaactacactgtgttagacaagcctttgaaggcctgctggaggataaatctaatcagttattttttggaaaagttggaaggcagatggtcacaggtctaatgaccaaggctgaaaaatcacccaaaggttttttggagagctatgaagaaatgttgagctatgctctgcgtccagagacatgggccactacgcgcctggaactggaagggcggggcgtcgtgtgcatgagttttttcgatatcgtcctggacttcattttgatggatgcattcgaggacttggagaatccacccgccagcgtcttagcagtcctgcggaatagatggctgagcgacagtttcaaagagacagctctggctacggcatgctggagcgtgctgaaggccaagaggcgtctgctcatggtccctgatggtttcatctcgcacttctatagtgtaagtgaacacgtttctccagttcttgcattcggattcttgggacccaaacctcagctcgctgaggtgtgtgccttttttaagcaccaaattgttcagtatctgcgcgacatgtttgatttagataacgtgcgctacactagcctgccggccctggcagatgacatcctgcagctctctagaaggcgcagcgagatattgctagggtatttaggagtccccgcggcaagctctgcaggggttaatggagccttgccccgtgagaatggacctctgggggagttgcagtag

SEQ ID NO: 26256 - DNA, 1050 bp, Artificial Sequence
  Description of Artificial Sequence: Synthetic coding sequence
atggcctttcggagagccgagggtactagtatgatccaggctttggccatgacagttgcggagattccagtattcctgtacaccacttttgggcaaagcgctttctcccagctccgcctgacacccggactgaggaaagtgctttttgcaaccgcgctgggtacagtggcacttgccctggcagcgcaccagttaaagcgccggcggcgaaggaagaagcaagtggggcccgagatggggggtgaacagctgggaaccgtgccactccccatcctgctcgcaaggaaggtccccagcgtgaaaaaaggctattcctcaagaagggtgcagtctccctcctctaaatctaacgataccctcagtggcataagtagcatcgaaccgagcaagcactccggatcttcgcattcggttgcttcgatgatggcggtcaattcatcctccccaacagcagcctgctcaggactttgggacgctagaggcatggaggagagtctcactacttccgatgggaacgctgaatcgctgtacatgcagggcatggaactctttgaagaggccctacaaaaatgggaacaagccctctccgttggacagcgcggcgattccggctctacgccaatgccgcgggacggcctacgcaaccccgagaccgcttctgagccgctgtcagagcctgaaagtcaacgcaaagaattcgccgagaagctggagagcctgttgcatagagcataccacttgcaggaagagttcggttccacattcccagctgatagcatgcttctggatctcgagcgcactctcatgctgcctctgaccgaggggagcctcagacttagagctgacgatgaggattcactgacctccgaagatagctttttcagcgccactgaactgtttgagagcctgcagacgggcgactatcctattcccctgtcccgaccggccgccgcttatgaggaggcactgcaattggtgaaagagggcagagtgccatgccggacgctgcgagccccaaaggcgtcgtggcgggccacccggcgctgctag

SEQ ID NO: 26257 - DNA, 303 bp, Artificial Sequence
  Description of Artificial Sequence: Synthetic coding sequence
atggccttccggcgggccgaaggcacttctatgattcaggctcttgccatgaccgtcgctgaaattcctgtcttcctgtatacaacgtttggccagagcgccttttcacagttacggctgaccccagggcttagaaaggtgctgttcgccactgctctaggtaccgttgcactggccctcgccgcccatcaattaaagcgacgccggcgacggaagaagcaagtgggtcccgagatgggaggcgaacagctaggtaccgtgcccctgcccattttgctcgcaaggaaggtgccttctgtttag

SEQ ID NO: 26258 - DNA, 384 bp, Artificial Sequence
  Description of Artificial Sequence: Synthetic coding sequence
atgtggcgggaactcaggggttgccccggtggggatgtggaaactgcacagagactcagccagagaaggcgagggaaatcttctgaggcggtacctgagaagacctggcgcgcgcaaagaatgtcccaaaggcggagaggtgaatcatccgaagccgtacccgaaaaaacctggaaggagctacgaaattccgaaaccgtgcccgagaaaacctggaagcagctaaggcgatgtctgcaggaagacgtggagcgggttcagagactcagcttgctcctccatctagcagttttcttgtggataataatcgctattaatttcagcaattctggagtgaaatcacagagttcaacatacttgccgtcagggaaaattctaaagtag

SEQ ID NO: 26259 - DNA, 384 bp, Artificial Sequence
  Description of Artificial Sequence: Synthetic coding sequence
atgtggcgggagttacgtggctgcccaggaggggacgtggaaacggcccaaagactttcacagcgcaggcgtgggaagtccagcgaggccgtgcctgaaaaaacatggcgcgcgcagcggatgtctcagaggagaagaggtgagtcgtccgaagccgtgcctgagaaaacgtggaaagagctgcgaaacagtgaaactgtgcccgagaaaacctggaagcaactccggcgctgcctgcaggaagatgtagagcgcgtgcaaagattatctctgctactgcatctggcagtgttcctgtggataattatcgcaattaatttttctaactctggcgtgaagagtcagtcctcaacgtatctgcccagcggcaagattctcaagtag

SEQ ID NO: 26260 - DNA, 4044 bp, Artificial Sequence
  Description of Artificial Sequence: Synthetic coding sequence
atggaaaatctccctttcccattgaagctgcttagcgccagcagtctgaacgcaccaagcagcacaccttgggtccttgatatttttctgaccttggtgttcgctctggggttctttttcctcttactgccttatctgtcatacttcaggtgcgacgacccaccttctccttcacctggtaagcgaaagtgtcctgttgggcgaaggcggcggcctcgtggacggatgaaaaatcacagccttagggccggtagagagtgcccacgggggctccaggagaccagtgacctgctgagccaactgcaaagcctgctgggtccacatctagacaagggagactttggccagctgagcggccctgacccccctggtgaagttggagagagggctcctgatggagcgtcccagagcagccatgaacccatggaagacgccgcccctattctctccccacttgcctcacctgaccctcaagctaaacacccccaggatctagcttcgacgcccagcccaggaccaatgaccactagcgtctcatcgctcagcgcatctcagccacccgaaccctctttaccactggagcatccctctcccgagccaccggcactgtttccccaccctcctcataccccagacccactggcctgttcgcctcctccccccaaaggctttacggcccctccgcttagggacagcacactgattacaccatcccactgtgacagcgtggcccttccactggggacagtgccacagagcctgagcccacacgaggacttagtggcaagcgtgcctgccatctccgggcttgggggaagcaacagccacgttagcgcttccagtcggtggcaagaaaccgctcgcacatcatgcgcgttcaattcgtctgtccagcaagaccatctgagccgacaccccccagaaacttatcagatggaggccggatccctctttcttttgtcttctgatggacaaaacgccgtaggaatccaagttaccgagacagctaaagtgaatatctgggaagagaaagagaatgtagggtctttcacagataggatgacccccgaaaaacacctgaatagcttacggaatcttgcaaagagcttggacgcagagcaggataccaccaaccccaagcccttctggaacatgggagagaatagcaagcagctacccggccctcagaaattatctgatcccagactgtggcaagagtcattttggaagaactattcccagttgttctggggccttcctagcctgcatagtgagtccctggttgccaacgcttgggttactgacagatcatacactctgcaaagcccacctttcctctttaacgagatgtccaacgtatgcccgatccagagggagactacaatgtcacctttgctgttccaggcccagcccccctcccacctgggccccgagtgccagccgttcatttcctcaacacctcagtttagaccaactcctatggcccaggcagaagctcaggcccacctgcaaagcagtttcccggtgttatcccccgctttcccaagcttgatcaaaaacacaggtgtcgcatgtccagcttcccaaaataaagtccaggcgttgtcactccccgagacacagcatccagaatggcccttgcttcgcagacagctggagggtcgcttagcacttccgtctagagtgcagaagagtcaagacgttttcagtgtttctacccccaatcttcctcaggaaagcctgacgagtattttgcccgaaaattttcctgtgtcacctgagctgagacgtcaactcgaacagcatatcaagaagtggattattcaacactggggcaatctaggccgaattcaggagtctctggatctgatgcagctccgggatgagagcccgggcacaagccaagccaagggcaaaccctctccttggcagtcaagtatgtcgacaggggaatcctctaaggaagctcagaaagtcaagttccagttagaacgggacccctgcccccacttagggcagattctcggagagacgcctcagaacctgagcagggatatgaagagttttccgaggaaggtattgggggtgacttctgaagaatcagaaaggaacttacgtaaacccctgagatccgatagtggtagtgatcttttaagatgtacggagagaacccatatcgagaatatcctgaaggcccacatgggtcggaacctgggtcagaccaacgagggccttatccccgtcagggtacgccgttcatggctcgccgtgaaccaggcattaccggtgagcaatacccacgtgaaaaccagtaacctagcagctcccaaaagtgggaaagcgtgcgtcaataccgcacaggtactctcttttctggagccttgcacccagcagggactgggggcacatatcgtgcgtttttgggctaagcatcggtggggactgcccctcagggtcctaaagcccatccaatgcttcaagctggagaaagtgagcagcctctctctgactcagctggccggtccatccagtgctacgtgtgagtctggggctgggtcggaggtggaagtcgatatgttcctgaggaagccccctatggcctcgctgcgtaagcaagtgctgaccaaggcctctgatcacatgccagaatcactgcttgctagcagtcctgcctggaagcagttccagagggctcccagaggcatcccttcgtggaatgaccatggccccttgaagccccctcctgcaggacaggaaggccggtggcccagcaagccacttacatattcactgaccgggagcactcagcagtcccgatcactgggggcccagtcatcaaaagcaggagagacccgtgaggccgtgccacagtgtcgtgtgccgctggagacgtgcatgctggcaaatctgcaagctactagcgaggatatgcacgggtttgaagctcctgggacttcaaagagttcactacatccccgggtgtctgtctctcaggatccaaggaaactgtgcctgatggaggaggttgtcaacgagttcgaacccggaatggccaccaagtcagaaacacagccacaagtttgcgccgccgtggtgctgctccctgacggccaggctagtgtcgttcctcatgcctccgaaaacctcgtttctcaagttcctcagggacacttacagtcaatgccagcaggtaatatgcgcgcctcacaggaactgcatgacttgatggccgcaagacggtctaaattagtccacgaggaaccaagaaaccctaactgccaggggagctgtaaaaatcagaggcctatgtttccccccatccacaagtccgaaaaatctagaaagcctaacctggaaaagcatgaggaacgccttgaaggcctgcgcacacctcaactgacaccggtgcgtaagaccgaggacacgcatcaagatgaaggggtgcagctgctgcccagcaaaaagcagccgccaagtgtcagtcactttggcgggaacattaaacagttttttcaatggatcttctcgaaaaagaagagcaaaccagctccggtgacagctgagtcccagaagaccgtgaaaaatcgaagttgcgtttactcaagctctgccgaggcccaaggattgatgactgcggttggccagatgctcgacgaaaaaatgtccctttgtcacgcaagacatgcctccaaagtgaatcagcacaagcagaagttccaggcgcccgtttgtggattcccctgtaatcatagacacctcttttactctgaacacggtaggatcctgagttacgcggcaagtagtcaacaagccaccctgaaatctcagggctgcccaaacagggaccgacagattagaaaccaacagccactgaagtccgtccgctgcaataatgagcagtggggcctgaggcacccgcagatcctccaccccaaaaaggccgtgagcccggtgagccccctgcagcattggccaaaaacatcaggggcttccagccaccaccaccattgcccccggcactgcttgctgtgggaaggaatttag

SEQ ID NO: 26261 - DNA, 4044 bp, Artificial Sequence
  Description of Artificial Sequence: Synthetic coding sequence
atggaaaatcttcctttcccattgaagttgctgtccgcatctagtttgaacgcccccagttctacaccctgggtattggacatttttcttacactcgtgttcgctctcggatttttctttctcctcctgccatacttgtcctacttcaggtgtgacgatcccccgtctccaagtcccggcaaacggaagtgcccagtcggccggaggcggagaccaagggggaggatgaaaaatcatagcctgagagcaggcagagaatgccgcagaggcttacaggaaactagtgatttgctgtcccaactgcagagcttgctggggccccacctggataaaggggatttcggacagctgagcggtcccgacccaccaggcgaagtgggggaacgcgccccagatggcgcgtcacaaagttcgcatgaaccaatggaggacgccgctcccattctgtcccccctcgcctcccccgatcctcaggcaaagcatccccaagatctggcatcaacccccagtcctgggcccatgaccactagtgtgagttccctttcagccagccaacccccagaaccatctcttcctcttgagcatcctagcccagagccaccggctctgttcccacacccaccccacacgcccgatcctttggcttgttctcctcctccccccaagggcttcactgcaccacccctgcgggactccaccctcataaccccaagtcactgtgactctgtggcacttcccttgggcactgttccacagtcactaagcccacatgaggatctggtggcttccgtgcccgctattagcgggttggggggaagtaatagtcacgtgtctgcctccagccgctggcaggagaccgcacggaccagttgcgcttttaatagctctgtacaacaagaccacttgtcacgacaccccccagagacctaccagatggaagccggtagccttttcctcctatcgtctgatggccagaacgctgtagggattcaagtgacggaaaccgccaaggttaatatctgggaagagaaagaaaacgtcggcagttttacagacaggatgactcccgaaaaacacctgaatagtttgaggaaccttgctaagagcttggatgcagaacaagatacaaccaatcccaaacccttttggaacatgggggagaacagtaaacagctacccgggccccagaaattcagtgatccgaggctctggcaggaatcgttttggaagaactattcacagctgttctgggggcttccttctctccactccgagagtctagtggcaaatgcctgggttactgaccgaagttacacattgcagtctcccccttttttatttaatgaaatgagtaatgtttgtcccatccagcgggaaactacaatgagtcccctgttatttcaggcgcagccgccctcccatctcggcccggagtgccagcccttcatttcatcaacaccccagtttagaccgacgcccatggctcaagcagaggcgcaggcccacctgcagtcgtcattcccggtgctctcccctgcattccctagcctcatcaaaaataccggcgttgcgtgccctgccagtcagaacaaggtccaggccctgtcactccctgagactcagcatccagagtggccactgctgagaagacagctagagggaagattggcactgcccagtcgggtgcagaaaagtcaggatgttttctccgtaagcacccctaaccttcctcaggagagtctcactagcatcctcccagagaattttcctgtgagccctgagctccgcagacagcttgagcaacacattaaaaaatggatcatacagcattggggcaatctgggccgcatccaggagagtctggacctgatgcaactacgcgatgagtcccccggcactagccaggcaaaaggcaagccctcaccctggcagtcttcaatgagtactggcgaatcctcaaaagaggcacagaaggtgaaattccaactggagcgggatccatgcccccacctggggcagatactcggcgaaactccccaaaacttgtcaagggacatgaagtctttccctaggaaggttcttggggtcaccagcgaggaatccgagcggaacctgcgcaaacctctgaggtccgactctggctctgacctcctccgctgcacagagcggactcacatagaaaatattcttaaggcgcacatgggacgcaatctcgggcagaccaacgagggcctgatcccggtgcgagtgagaagaagttggctcgccgtgaaccaggcccttcctgtgtctaacacccacgtcaagacctctaacctggccgcccccaaatctggaaaggcctgtgtgaacacagcacaggtgctttcatttttggagccctgtacccagcagggcctaggagctcacatcgtccggttttgggccaaacaccgttggggactgcccctgcgggtcctgaagccgattcagtgcttcaagcttgagaaggtctcttcactctccttaacgcaattggcaggtcccagcagtgcaacctgcgagagcggggccgggagtgaagtcgaggttgacatgttcttgcggaagccaccaatggctagtctgaggaaacaagtactcacgaaagctagcgaccacatgccagagagtttactggcctcatcccccgcctggaagcagttccaacgggcccctaggggaattccgtcatggaacgaccatggcccgctgaaacctccccctgctgggcaggaaggtagatggcctagtaagcccctcacttattcactgacggggagtacacagcagtcccggtctctcggagcccaatcctccaaagcaggcgaaactcgcgaggctgtgcctcaatgcagggtacctctggaaacgtgtatgctcgccaatctgcaagcaacgagtgaagacatgcacgggttcgaggccccaggcacatcaaaatcaagcctccatccaagggtaagcgtgagtcaagacccacgaaagttgtgcctgatggaagaggtggtaaatgagtttgagccaggcatggcgactaaatccgagacccaaccacaggtgtgcgccgctgtggtactcttacccgatggccaggccagcgtagtcccccatgcctccgagaacctggtgagtcaagtcccacaggggcacctccagtctatgccaacagggaacatgcgagcttcccaggagttgcatgacctgatggccgctcgcagaagtaaactggtgcacgaggagcctcgtaatccgaattgccaaggcagttgtaaatcccagcggcccatgttccccccgatccacaagtcagaaaaatctagaaaacccaatctcgaaaaacatgaagagagactggaggggttgagaacgcctcaactgacccccgtgaggaaaacagaagacacccaccaggatgagggtgtccagctgttgcccagcaagaagcaacctccgagcgtgtctcattttggcggcaacataaagcagtttttccagtggatcttttccaaaaaaaagagcaaacctgcacccgtgactgcggaaagtcaaaaaacggtgaagaaccgtagctgcgtttattcttcaagcgccgaagcccagggcctaatgaccgcagtcggccagatgctggatgagaaaatgagtctgtgccacgccaggcatgcgtctaaagtgaatcaacacaaacaaaaattccaggcccctgtatgtggctttccctgcaaccatcgtcacctgttttattccgagcacgggcggattctgtcctacgcggcctcatctcaacaggcaacacttaaatcccagggctgtcccaacagagatcgtcagatacgaaatcagcagcccctgaagagtgtgaggtgcaataacgagcagtggggactacgacatcctcagattctgcaccccaaaaaggccgtgtcccctgtcagccccctgcaacattggccaaagacctctggcgcttcgtcccaccatcaccattgcccaagacactgcctcctctgggaaggaatctag

SEQ ID NO: 26262 - DNA, 4044 bp, Artificial Sequence
  Description of Artificial Sequence: Synthetic coding sequence
atggagaatctacccttccccctcaaactgctgagcgcctcctccttaaatgctcctagcagtaccccttgggttttggacatattcctaaccctcgtgtttgctttgggattctttttcctcctcctcccttatctgagttattttcgttgcgatgatcccccgagccctagtcccggcaaacggaaatgtcctgtgggcagacggagaaggccaagaggccgtatgaagaaccacagcctgcgcgctggacgcgagtgtcgacggggcctggaagaaacctcagatctgctgtcccaactgcagtccttattaggcccccatctcgataagggcgacttcggccaactctcaggtccagaccccccaggagaggtgggggagcgcgccccagatggagcttcacaatcttcgcatgagcccatggaagacgctgcgcctatcctttcgctattggcttctcccgacccccaggccaagcaccctcaagatctcgcatctactccttccccaggacccatgaccaccagtgttagttctctgagcgcgtcacaaccccctgagcccagtttacctctggagcacccatctcccgaaccaccagctcttttcccccaccctccccatacaccggacccactcgcttgcagtttacccccgcccaagggcttcaccgcccccccattgcgcgatagtactctcataacccctagtcattgtgatagtgtcgctctccccttaggcactgtgccacaaagcctgtccccgcacgaagatcttgtcgctagcgtgcctgccatcagcgggctgggaggttctaacagtcacgtgtcagctagtagtaggtggcaggagacggctagaacctcatgtgccttcaactcatcagtgcagcaagatcatctgtcgcgtcaccccccagagacatgtcagatggaggccggttccctgtttctccttagttcggacggccagaacgtcgttggaattcaggtgaccgagacagccaaggttaacatctgggaggaaaaagagaacgtggggtctttcacaaaccgcatgactcctgagaaacacctcaacagcctgcggaatctggccaagtctctggatgccgagcaggacacgacgaatcccaaacctttctggaatatgggggaaaacagtaagcaattacccgggccccagaagctaagcgacccccgcttgtggcaggaatcattttggaagaactattctcagctattttggggtttgcctagtctgcacagtgagtctctcgtggccaatgcatgggttacagatcgttcctacacactgcagagccctccttttttattcaacgaaatgtccaacgtttgccccatccagagggaaaccaccatgtctccactgctgtttcaggcacagcccctgagtcacctgggcccagaatgccaaccctttatcagctccacacctcagtttaggcctacacccatggcacaagcagaggcccaggcccacctacagagcagctttcccgtgttgtcacccgcattcccttcactgatccaaaacacaggtgttgcctgtcccgcctcacagaacaaggtgcaggcactcagtctcccagaaacccagcatcccgaatggcccttgttgagacgccagctggaagggcggctcgccctaccctccagggttcaaaagtcacaagacgtattcagtgtatcaactcccaatttgccccaagaaagtctgacaagcatcctccctgagaattttcccgtatcacccgagttgcgccgacagctcgagcagcatataaaaaagtggatcattcagcattggggaaacctgggtagaatccaggagagtttagatctaatgcagctccaagatgagtctcccggaaccagtcaggccaaggggaaaccatctccttggcagtctagcatgtctactggagaatcttcaaaagaagctcagaaggtaaaattccaacttgagcgggatccctgcccacacctggggcagatcttgggcgagacaccgcagaacctatctcgggacatgaagtcttttccccggaaggtgctgggcgtgaccagcgaagaacttgaacgcaatttgcgcaaacccttgcgatctgatagcggcagcgacctcctaagatgtacggagaggactcacattgaaaacatcctcaaggcacacatggggcggaacctggggcagaccaacgagggcctcattcccgtgcgggtccgacggtcttggctggccgtcaaccaggcgttgcccgtgtccaacactcacgtaaagaccagcaatctagcagccccaaagtctggaaaggcctgcgttaatacagcgcaagtccttagttttctggagccttgcactcagcagggcctcggggctcatatcgtaaggttttgggccaaacacagatggggcctccccctgagagttctgaaaccaatccagtgcttcaaattggaaaaggtctccagcctaagcttaacacagctcgctggccccagcagcgcaacatgtgaaagcggcgccggcagcgaggtcgaggtggacatgttcctgaggaagcctcccatggcttctctcagaaagcaggtgttgaccaaggccagtgaccatatgcctgagagcctgcttgcctcaagcccggcgtggaagcagtttcaaagggccccgcgcggcattccctcctggaacgaccatgagccgctaaagcctcctcccgccgggcaagagggaaggtggcccagtaagcccttgacatacagtttaactgggtctacccagcagtcccgtagcctcggtgcccaatcctccaaggctggcgagactcgggaggcagtgccacagtgtcgggtgccactcgagacttgtatgcttgccaatctacaggccactagtgaggacgtccacgggtttgaagcccccgggacgtctaaaagctctttgcatcctcgagtgagcgtcagtcaggatcctcgcaagctgtgcctgatggaggaagttgtgtccgaattcgaaccaggcatggctactaaatcagaaacacagccacaggtgtgcgctgcagttgtacttctgcctgacggacaagcctctgtcgtaccccatgcttccgagaatctggtgtcccaggttcctcagggccatttgcagtccatgccaactggcaatatgagagcaagccaggagctgcatgatttgatggctgcccggcgaagtaaactggtgcatgaagaaccccggaagcctaattgtcaaggatcttgtaagagtcagagacccatgttcccacctattcacaagagcgagaaattcagaaaacccaacctggaaaagcatgaggaaagactggagggtttgcggactccgcagctcactcctgtacggaagacggaagatactcaccaagatgagggggtgcaactgctgccgagcaagaaacaaccacctagtgtatccccgtttggagagaacatcaagcaaatctttcagtggatattctccaaaaagaagtccaagccagcacccgtgaccgctgagtctcaaaagaccgtgaagaaccggtcttgcgtgtactcatcctcagcagaagcccagggcttgatgaccgccgtggggcagatgctggatgagaaaatgtctctctgtcacgcccggcacgcatccaaggtgaaccagcataaacagaaatttcaggcgcctgtgtgcgggttcccgtgtaaccatcggcacctcttttactccgaacacggcagaatcctgtcttatgccgcctcaagccagcaggccacactgaaatcacagggctgccctaatagagacagacagatacgcaatcagcagcctctgaagtccgtgcggtgcaataacgagcagtggggtttgagacatccccagattctgcatcctaagaaggcggtgtcacccgtttcaccaccgcagcactggccgaagacctccggcgccagcagccaccatcaccactgccccagacactgtcttctttgggaaggtatttag

SEQ ID NO: 26263 - DNA, 4074 bp, Artificial Sequence
  Description of Artificial Sequence: Synthetic coding sequence
taacttctggagtccaacgcacccatccatatggagaacctgccctttcctctgaagttgctttccgcaagctccctcaacgccccctcatccaccccctgggtcttggatattttccttacactcgtgttcgccctggggtttttcttcgtacttctcccttatttgagttacttcagatgcgacgatccgccctcccccagcccaggaaaacgcaagtgtccagtgggtcgccgcagaagaccgaggggtcgcatgaagaaccattctctcagggcaggaagagagtgccgccgaggcttagaggagacgagtgacctgctgagccagctccagtctcttctggggcctcatctggataaaggagacttcggccagctcagcggaccagacccaccgggcgaggtgggcgaaagggctccagatggagcctcccagtcctctcacgaacccatggaggacgcagccccaattctgtctcccctcgccagcccagacccacaggctaaacacccacaggatctggccagcacaccttcccctggcccaatgaccacatcagttagctctctttcagccagccaaccacccgagccctctctgccccttgagcatccgtcccctgagcctccagccctgtttcctcacccaccccatactccagatcccctcgcctgcagtttgcctccccccaaagggtttaccgctcccccccttcgggatagcacactgattacaccttcacactgcgacagtgtggccttcccactgggaacagtcccacagagcctgagcccacacgaggatttagttgcttctgtccccgcaatctcagggctgggtgggagcaacagccatgtcagcgcctcttccagatggcaggagactgcccgaaccagctgtgcctttaatagttctgtgcaacaggaccacctgagcagacatcccccagaaacgtgccaaatggaggctggatccttgttcctactgagcagcgacggccagaatgttgtaggcatacaagtgaccgagacagcaaaggtaaacatatgggaagagaaagaaaatgtgggctcatttaccaacaggatgacgcccgagaaacatctcaatagcttgaggaacctggccaagtcccttgacgctgagcaggacactacaaatcccaaaccgttttggaacatgggcgaaaacagcaagcaacttcctggcccccagaagctttcggatccacggctgtggcaagaatctttctggaagaattattcacagctgttctgggggctgcccagccttcacagcgagtcccttgtggctaatgcctgggttacagatagatcttacactctgcagtcaccaccttttcttttcaacgagatgtcaaatgtttgtccaattcaacgcgaaactacaatgagccccttacttttccaggcgcagccactgagccacctgggaccagagtgccagccatttatctctagcaccccacagtttagacccacacccatggcacaggcggaagcacaggcacatctgcagagctcttttccggtcctgagcccggcgttcccgtccctgatccagaacaccggagtggcatgtcccgcatcacagaacaaagttcaagcgctgagcctccctgagacgcaacacccggagtggcctctgctcagaagacagttggagggaagattagccttgccttcccgcgtacagaagtcccaggatgtgttcagcgtctcaaccccaaatctgccccaagagtctctgacttctattcttcccgaaaattttcctgttagccccgagttacgtcggcagttggaacaacatattaagaaatggatcatccagcactggggcaatctcggtcgtattcaagagtcactcgacctgatgcaactcagagatgaatccccagggacctcacaggctaaagggaagcctagcccgtggcagagctccatgtcgaccggcgagagctcgaaggaggcccagaaagtaaaattccagctggagagagatccttgcccccacctcggtcagatcttgggggaaacaccccaaaacctgtcaagggatatgaaaagttttccccgtaaagtcctaggcgtgacctctgaagagctggaacgtaatctgcgtaagccgctgagatccgactcgggctccgacttgctgcggtgcacggaaaggacacacattgagaacattctgaaggctcatatggggcgcaacttagggcagaccaatgaaggcctgatccccgtccgcgtccggcgttcctggctcgctgtaaaccaggcactgccggtctctaacactcatgtgaagacaagcaatctggccgctcccaagagcggcaaagcctgcgtaaatacagcccaagtgctgagtttcctcgagccatgtactcaacagggattaggcgcgcatatcgtacgcttctgggctaaacataggtggggacttcctctgagagttctgaagcccatccagtgtttcaaactggagaaggttagcagcctctccctgacccagctcgccggtccctccagcgctacctgtgagtcgggtgctggctcagaagttgaggtggatatgttcttgcgaaagcctcccatggcatctctccgcaagcaagtgctgacaaaggcatctgatcacatgcccgagagcctgttagcttcgtcacccgcttggaaacaatttcagagggcgcctcggggcataccctcctggaatgaccacgagcctctgaagccacccccagccggacaggaaggcaggtggcctagcaagccgttgacctactcacttacaggcagcattcaacagtctcgatcattgggtgcacagagctcaaaagccggggaaacgagagaagccgtgccccagtgcagggtgccactggagacatgtatgttggctaatctccaggccaccagtgaagacgttcatgggtttgaagccccaggaacctcaaagtcttccttgcacccccgagtaagcgtgtcccaggacccccgtaaattgtgtttgatggaagaagtggtgaacgaattcgaacctggaatggccacaaaaagcgagacacaacctcaggtgtgcgcagctgtggtgctgctaccagatggtcaggcgtcagtcgtgccccacgctagtgagaatctcgtgagccaggtgcctcaaggccacctgcagagtatgcccacaggaaatatgcgggcgagccaggaactccacgacctgatggccgctaggcgcagcaaactggttcatgaagaacctcggaaccccaattgtcagggctcgtgcaagagccagcgtcccatgttccccccaatacacaagtctgaaaagagtcgcaagccaaatctcgagaagcacgaggagagacttgagggactcagaactcctcagcttacgcctgtaagaaagaccgaggacacacatcaggacgaaggtgtgcagctcctgccgagcaaaaaacagccaccatcagtcagcccatttggtgagaatattaagcagatatttcaatggatctttagcaagaagaaaagtaagccagcccccgtcactgcagagagccagaagacagtcaagaaccgtagccgggtctatagttcctccgcagaggcacagggtctgatgacggcagtaggacaaatgctagataaaaaaatgtccctgtgtcacgcgcgacacgcttccaaggtcaatcagcacaaacaaaaattccaggcacccgtctgtggctttccatgcaaccatcgccatctcttctacagcgaacacgggagaattctctcctacgctgcttcaagccaacaggccacactgaaaagccagggctgcccgaaccgtgatagacagatcaggaaccagcagccgcttaaaagcgttcgatgtaataacgagcagtggggattgagacatcctcagatcctccacccgaagaaggccgtgtcccctgtgtcaccgccacaacactggcctaaaacctcgggggcttctagccaccaccatcattgtcccaggcattgcttactttgggaaggaatttag

SEQ ID NO: 26264 - DNA, 4044 bp, Artificial Sequence
  Description of Artificial Sequence: Synthetic coding sequence
atggagaaccttcccttccccttaaagttgctctctgctagtagcctaaacgcaccctcgtccacgccttgggttctagacatcttccttactctcgttttcgccctcggcttctttttcgtgctactcccatatctctcctacttccgctgcgatgaccctccttctccttcccccgggaaacgaaagtgccctgtgggaaggagaaggagaccgagagggcgcatgaaaaaccacagtctccgagcaggtcgtgagtgtaggcgggggttagaggagaccagtgatttgctgtctcagctgcagtctttgctaggaccacatctagataaaggcgacttcggacaattgagcgggccagatccaccaggggaggttggcgagagggctccggatggcgcaagtcagtcctctcatgagcctatggaagacgcggcccctatcctgtctccactagccagcccagaccctcaggctaaacatccacaagacttggcgagcacgccaagtcccggacccatgaccacatctgtctcatcattatctgccagccaacccccagagccctccctcccattggaacatccaagtcccgaacctccagccctatttccccaccctccccacacaccggaccctttggcatgcagcctgccaccgcctaagggcttcacagcccccccgctccgggactcaaccctgattaccccttctcattgtgactcagttgcattcccccttggaaccgttccacaatcattgagtccacatgaagacctagttgcctccgtccccgctattagcggattgggggggtctaatagccatgtctccgcaagcagcagatggcaggaaacagccaggacatcgtgcgcctttaacagctcagtccagcaggatcatttgtctcggcatccgcctgagacctgccagatggaagcagggtccctctttctcctatcttctgatgggcagaatgtggtgggtatccaagttactgaaaccgccaaagtgaacatatgggaagaaaaggaaaacgtggggtcattcaccaatagaatgacgcctgaaaaacatttaaattctttgcgcaatctcgctaagtcccttgatgccgaacaggatacgacgaacccgaagcccttttggaacatgggcgagaactcaaaacagctgcctggcccacaaaaactgtccgatcctagattgtggcaggaatcattctggaagaattatagtcagctgttttggggcttgccatccctacatagtgagagcctcgtggctaacgcttgggtgaccgacaggagttataccctgcagagtccacctttcttgttcaatgaaatgagtaatgtatgtccaatccagagagagacaaccatgagtcctcttcttttccaggcgcagccgctgtcccatttgggccctgagtgccagccctttatcagctccaccccccagttcaggcctactcccatggcccaagcggaggcccaggctcacctgcagagttcgttccctgtgctttctccagctttcccatcactcatacaaaatactggagtggcatgcccagcgtcacagaataaggtccaagctctctcactgcccgagacacagcatcctgaatggcctctgctcagacggcaactggaagggagactcgctctgccctccagagtccagaaatctcaggatgttttctcagtctccacccccaacttaccccaggaaagcctgacttcaattctccccgaaaattttccagtctcaccagagctaaggagacagctggaacagcacataaagaagtggatcatacagcactggggtaacctaggccgcatacaggaaagcctggatctgatgcagcttagagatgaatcgcctggcacttcccaggcgaaaggaaagccaagcccatggcagtcctctatgtctactggagagagctccaaagaagcgcaaaaagttaagtttcagctcgaaagagacccatgcccccatctcggacaaattctgggcgagaccccccaaaacttgtcacgggatatgaagtcattcccccggaaggtgctaggcgtgacctccgaggagctggaaaggaatcttcgaaaaccgctccgcagcgactctgggagtgatcttctgcgctgtaccgaaagaacccacatcgaaaacatcctcaaggctcacatggggcgcaacctcggacagaccaatgaaggacttatccctgtcagggttcggcgttcatggcttgccgtgaatcaggcattacccgtctccaatacccacgtcaagacctcaaacctggccgcccctaagtcaggaaaggcctgcgtgaacacagcccaggtgctgtctttcctcgagccctgcacacagcaggggttaggggcccatattgtccgcttctgggctaaacacaggtgggggctccctttacgcgttcttaaacctattcagtgtttcaagctcgagaaagtgtcctcgttgagcctgacgcagcttgccggaccatcctccgcaacctgtgagagcggtgccggaagcgaggttgaagtggacatgtttctgcgcaagccccctatggcatctcttaggaagcaagtacttaccaaggcgagcgaccacatgccggaaagcctgctggcttcaagtcctgcatggaagcagttccagcgtgcccccagaggtattccttcttggaatgatcatgaacccctgaaacctcccccagcaggacaggagggaagatggccgagcaagcctctcacatacagcctgactggttctatccagcagagtcggtcactgggggcccagtcatccaaggcaggtgagacacgcgaggctgttcctcagtgtagggtaccccttgaaacatgtatgcttgctaatttacaggcaacatccgaagatgtgcacggttttgaagccccagggaccagcaagagcagcctgcacccaagagtgtcggtttctcaggacccaagaaagctgtgcttgatggaggaagtggtgaacgaatttgaacccggcatggcaacgaagtcagagacgcagcctcaggtttgcgctgcagtggtgttgctgcccgacggtcaagccagtgtagtgccgcatgcgtcagaaaacctggtttctcaggtaccgcaaggacaccttcaatccatgcccactggtaatatgagggctagccaggaactgcatgacctcatggcagcccgacggtctaaactcgtccacgaggagcctcggaaccccaactgtcagggaagctgtaaaagccagaggcccatgttccctccaatccataaatcagaaaagtccagaaaaccaaacctggagaagcacgaggagcggcttgagggacttagaaccccgcaattgactccagtaaggaagactgaggacacccaccaagacgaaggggtccagctgctacctagcaagaagcaaccgccttcagtttcccctttcggcgagaatatcaagcaaatcttccagtggatcttctctaaaaagaagtccaaacccgctccggtgaccgctgaatctcagaagactgttaaaaatcgctctagggtctattcatcctccgcggaagctcagggattgatgacggcagtgggccagatgctcgacaaaaagatgagcctctgtcatgctcgtcacgcaagcaaggtaaatcagcataaacaaaaattccaagccccagtttgtgggtttccctgtaatcataggcacctgttctactcggagcacggccggatcctctcttatgccgcgtcatcacagcaggccactttaaaaagccagggctgtccaaatcgagatcggcaaatcaggaaccagcagcccctgaagtccgttcgctgtaataatgagcaatggggattacggcaccctcagatacttcaccccaagaaagcagtgagtccagtgtctccaccccagcactggccaaagacatccggcgcatcttcccatcatcaccactgtcctcgccactgtctcctgtgggaaggtatctag

SEQ ID NO: 26265 - DNA, 4044 bp, Artificial Sequence
  Description of Artificial Sequence: Synthetic coding sequence
atggagaacctccccttccccctaaaacttttgtctgcctctagccttaacgccccttcaagcaccccatgggtcctggatatttttctgacactcgtgttcgcgctcgggtttttctttttgcttctgccgtacttgtcctatttcaggtgtgacgaccccccatctccttcccctggcaaacgaaagtgccccgtaggccgccgtagaagaccgcggggcaggatgaagaaccacagcctgcgggctggtagggagtgccggagaggattagaggagacctcagatctgctcagccagctccagtcactgttgggcccccatttagacaaaggagacttcggtcagctctcaggccctgatccccccggcgaggtcggcgaacgcgctcccgacggcgctagccagagttcacacgagcccatggaggacgcagcgcctatcctctctccgctcgcatctcccgacccccaggcaaaacacccccaagatctagcatctaccccttcccccggaccgatgacaactagcgtctcctccctatctgcaagtcagccaccggagccctctttgcctctggaacacccgtctcctgaaccgcctgctctatttccccaccctccccacactcctgatcccttggcttgctcgttgcctcctccgaaaggctttactgctccccctttgcgagattcaacactcatcacgccatcccactgcgattccgtggcattcccactgggaactgtccctcagtccctctcaccacatgaagacctagtggcctctgttccagccatctctggtctagggggctctaacagtcacgtgtccgcatcatcgagatggcaagagactgccagaacctcctgcgcattcaactccagtgtacagcaagatcacctgtctcgccatcccccagaaacatgtcagatggaggccggatccctgttccttttgagctccgatggtcaaaatgtggtgggtatccaggtgacagaaaccgccaaggtgaatatctgggaggaaaaggaaaacgtaggcagttttaccaacaggatgacccccgaaaaacacctgaatagtcttagaaatcttgcgaagtctctggacgctgagcaggacaccacaaatcctaaacctttctggaacatgggcgagaattccaagcagctccctggccctcaaaagctctcagacccacggctctggcaggagtcgttctggaagaactacagccagcttttttggggcttgccaagcctgcattcggagtccctcgtcgctaatgcctgggttactgaccggtcatacactctccaaagcccaccgtttctctttaacgaaatgagcaatgtgtgtcctatacaaagggagacaaccatgagcccactacttttccaagcacaaccgctgtcccacctgggaccggagtgtcagccttttatctcttctactcctcagttccgccccactcctatggcccaggctgaggctcaggcccatctgcagagctcgttccctgtgttatctcccgcttttccaagtctgattcagaataccggggtagcctgtccggcctcccaaaataaagtccaggcactctctctgccagaaactcagcaccctgagtggccgttgctccgccggcagctggaaggacggctggcactgccgtctcgagtccagaaatcacaagacgtgttcagcgtttccactcctaacctgcctcaggagagcctcacctctattctcccagagaacttccctgtatcacccgagctgcggaggcaattggaacagcacatcaagaaatggattatccaacattggggaaacttgggtcggatccaagaatctcttgatctcatgcaactgagagacgaatcacctggtacttctcaggcaaaggggaaaccatctccatggcaatcatctatgagcacaggcgagggaagcaaagaagctcagaaggttaaattccagctggagagagatccatgccctcacctaggtcagattctgggggagactccccagaaccttagcagagacatgaagtctttcccccggaaggtgctcggcgttacatcggaggagctggaacgcaatctgagaaagcctcttcggtccgactctggctccgacctcctgcgctgtactgaacggacgcacattgagaatatcttgaaggctcacatgggccgcaatctgggccaaaccaacgaagggctcatcccagtgtgtgtcaggagatcttggttggccgtgaatcaggcgcttcccgtttctaatacacatgtgaagacctccaatctggcggcccccaagagtggaaaagcttgcgtaaacaccgcacaggtactgtcattcctggaaccctgtacacagcagggtctcggcgctcacattgtgaggttttgggctaaacatcggtggggactcccactgagggttctcaagcccattcagtgtttcaaactcgagaaagtttcctctctgagtttgacacagctggcggggccatccagcgccacctgtgagtccggcgccgggagcgaggtggaagtggacatgttcctgcggaaaccaccaatggctagtcttcgtaagcaggtgctgacaaaagcctcagatcacatgcctgaaagtctcttggcctccagccccgcatggaagcagtttcagcgggcccccagaggcatccctagctggaacgaccacgaacctctcaaacccccccctgccggacaggaaggccgatggccatctaaacccttgacctattctttgactgggtctattcagcagtcaagatccctgggagcccagagctccaaggctggcgagacacgcgaagcagtaccccaatgccgggtgccccttgagacatgtatgctcgccaacctgcaggctaccagcgaggatgttcacgggtttgaagcccctggaactagtaaaagttccctgcacccccgcgtctcagtgagccaggatccgaggaagctgtgcttaatggaagaggtggtgaatgaatttgagcccggtatggccacgaagtccgagacacaacctcaggtttgtgcggccgtggtcctgttacccgatgggcaggcaagcgtggttccccacgcctccgagaatttagttagccaggtgccccagggacacttgcagtctatgccaaccggcaatatgagggcgtcgcaggagctgcatgacctgatggcagcaaggagaagcaagctggtacatgaagagccacgtaaccccaactgccagggttcctgcaagagtcagagaccaatgtttccgcccattcacaagagtgaaaagtccaggaagccgaacctggaaaagcacgaagaacgtctcgaggggctgcgaacacctcagctgacgcccgtgcggaaaaccgaagacacccaccaagacgagggcgtacaactacttccctccaagaagcaacccccttccgtgtctccctttggggagaatatcaaacagatcttccaatggatcttttcaaaaaagaagagtaagccggctcccgtcaccgcggagtcccaaaagactgttaagaatcgctcacgagtgtattcaagctcggctgaagctcagggactgatgactgccgttggccagatgttggatgaaaagatgagtctctgccacgcacggcatgcatctaaggtaaaccagcataagcaaaaattccaagccccagtctgtgggttcccttgtaatcaccggcacctcttttactccgagcacggtcgaatactcagttacgccgcttcttctcaacaagctaccctgaagtcccagggctgccccaaccgggataggcaaatcagaaaccaacaacctctcaaatccgtgcgatgcaacaatgagcagtgggggctgagacatccacagatccttcacccaaaaaaagctgtgtcccctgtgtccccaccccaacactggcccaaaacatccggcgcgtcaagccaccaccatcactgccctcggcattgcctcctttgggagggtatttag

SEQ ID NO: 26266 - DNA, 4032 bp, Artificial Sequence
  Description of Artificial Sequence: Synthetic coding sequence
atggagaacctgccttttccactcaaactcctctcagcttcttcacttaacgccccttcgtcgaccccctgggtcctggacatctttttgaccctggtctttgccttaggttttttcttcctcctactcccttacctgtcctactttcattgtgatgatccccctagtccttctcctggaaagcgcaagtgcccagtcggtcgtagaagacgcccccgcggcaggatgaaaaaccactccctgagagctggtcgagaatgcccaagaggactggaggaaacgtcagatttgttatctcaactccagagcctcttggggccacatctagataagggtgatttcgggcagctttctggtcccgaccctcctggagaggtgggagagcgggcgccagatggtgcgtctcagtctagccacgagcctatggaggacgccgccccaatcctttcaccactggcttctcctgacccccaggctaaacatccccaggacctcgcttccaccccgtctcctggacctatgaccacatcagtttcttctctgagcgcgtcccaaccacctgagccatcactacctctggagcacccctcccctgaacccccggctctgttcccccaccctccccacacccccgaccccctggcctgtagtccacctcccccaaaaggcttcacggcaccacccttgcgggacagcaccctaatcaccccctctcattgtgattctgtagccctcccacttgggacagtaccccagtcccttagtccgcatgaagatcttgtggccagtgtccccgcaatctctggacttggcgggagcaacagccacgtgtctgcatctagccgatggcaagaaactgcgcggaccagctgcgcctttaactcaagtgtgcagcaggacccactcagcaggcatccccctgagacctgccaaatggaagccgggagtctttttctcttgtcctccgatggccagaacgtggtcggtattcaggttacagaaacagccaaggtcaacatctgggaagaaaaagagaatgttgggtctttcactaatcaaatgacacccgagaagcatttaaattctttgggaaacctcgcaaaatcactcgacgccgaacaggatactacaaaccctaagcccttctggaatatgggcgagaattccaaacaactccccggacctcagaaatgttcagaccctcgtctgctgcaggaaagtttttggaaaaattacagccagctgttctggggactcccctccctgcattccgaatctctggtggcaaacgcatgggttaccgaccgctcttataccttgcagtccccaccctttttgttcaacgaaatgtctaatgtctgccctatacagagggagacgaccatgagccccctgctcttccaggcgcagcccctgtctcataggcaaccatttatatcttcaacaccacaattcctgcccactccgatggcgcaggccgaggcccaggcccacctgcagagctctttccccgtcctcagtcctgcctttccctccttgatcaagaacacaggtgtagcatgtcccgcctcacagaataaggttcaggcgctgagtcttcccgagacacagcatccggagtggcctttgttacgcaaacagttggaagggaggctcgccctgccctctagagtacagaagtcgcaagatgtgttctcagtttcaacccctaacctgccccaggaatccctcacctccatcctgccagagaatttccctgtgtcccccgaattaagacgtcaacttgagcagcatatcaagaagtggataatacagcattggggaaatttagggcgtattcaagagagcttggatcttatgcagctgcgagacgagtccccagggacatcccaggccaaggggaaaccctctccatggcagagcagtacctcaactggggagagcagtaaggaagctcaaaaagtgaaattccaacttgaaagagatctctgtccacacctgggacagatattgggagagaccccacagaatttgagtagggacatgaagagctttccccgtaaagtgttgggtgtcacaagcgaagagagcgaaaggaacctacgaaagcccctcagatccgactcgggttcggatctgttacgttgtactgaaagaactcacatcgagaacatccttaaagctcacatgggcaggaatctaggccagaccaatgagggactcatccctgtgcgcgtgcggcgtagctggctggccgtgaaccaggcactgccagtgagtaatacacacgtgaagacaagtaacttagcagcacccaaaagcggcaaggcctgcgtgaatactgcccaggttctgtcgtttctggagccatgcactcaacaaggcctgggcgcacatattgtcaggttctgggccaagcaccggtggggcttgcccttacgcgtgttaaagccgatccagtgcttcaagctcgagaaggtgtccagtctgagcctgacccaactggcgggcccgtcatcagccacatgtgagtccggggccggatccgaggtggaagttgacatgtttctgcggaagccccccatggcgtctctcaggaagcaggtgctcacaaaagccagcgaccacatgccggaatcattgctcgcctcttcccctgcatggaagcagtttcaacgggcaccccgagggatcccatcgtggaatgaccacggtccattgaagcccccacctgccggccaggaaggacggtggccttctaaacctctcacctacagcctgaccggatcaacacagcagtcgaggtcacttggtgcccagtcttcgaaggccggagagactcgcgaagcagtgccacagtgtcgcgtcccgctggagacctgtatgttggccaatctgcaggcaacgagcgaagatgttcatggctttgaagcaccaggaacttcaaaatcatcactgcaccctcgagtgtccgtgtcgcaagaccctcgcaaactgtgtctgatggaggaggtggtctctgaatttgaacccggaatggcaacaaagtcagagacccagcctcaggtgtgcgcagccgtggtgctacttcctgatggtcaagcctcagtggtaccgcatgcgagcgagaacctagtcagccaggttccacagggtcatcttcagtccatgcctaccggtaacatgcgtgcttctcaggagctgcatgacctgatggctgctcgaagatctaaactcgtgcaagaggagcctcgcaatcccaactgtcaagggtcttgcaagtctcagcggcctatgtttcctccaatccacaagtcagaaaagagccgaaagcctaatctggagaagcatgaagaacggctggaaggcctacggacaccccagctaacccctgttcggaaaacggaagacactcaccaagatgagggcgtccagcttctcccgtccaaaaagcagccccctagtgtgagccattttggtgagaacattaaacaattcttccaatggatctttagcaaaaaaaagtccaagccagcacccgtgactgcagagtctcagaagacagttaagaatcgcagctgcgtgtactctagttctgccgaggcccagggactgatgaccgctgtgggacagatgctggataaaaagatgtccctgtgccacgcacaccatgcaagcaaagttaatcaacacaaacagaagttccaggcgcccgtatgcgggttcccctgcaaccaccgccatctgttctattctgagcatgggaggattctaagctatgccgcgtcatctcagcaggctacgcttaagagccaaggctgtcctaaccgtgatcgtcaaattagaaaccaacagccacttaaatctgtgcggtgcaataatgagcagtggggattgagacaccctcagatcctccatccaaagaaagctgtgtctcctgtgagcccaccacagcactggcctaagacatcgggagccagttctcaccaccaccactgtcccagacattgtctgctgtgggaagggatatag

SEQ ID NO: 26267 - DNA, 4044 bp, Artificial Sequence
  Description of Artificial Sequence: Synthetic coding sequence
atggagaacctgcccttccctctaaaactgctatccgctagttcactgaacgccccttcctctaccccttgggtcctcgatatctttttgacactggtctttgccctgggattcttctttctgctgttgccctatctgagctacttcagatgcgacgaccccccctctcctagccctggcaagcgcaagtgcccagtaggacgccggcgcagacctaggggtagaatgaaaaatcacagcctccgcgcgggtagagaatgtccccgcggtctggaggaaacttctgatctcctatctcagttgcagtcactcttaggacctcaccttgataagggtgacttcggacaactgagcggcccagatccccctggtgaagtgggtgaacgggccccagacggtgcctcacagtcatcccatgagcctatggaggatgccgcacccattctgtcaccgttggcaagcccagacccacaggctaagcatccgcaggaccttgcgagcaccccctctccaggcccaatgaccacctccgttagctctttgtccgcaagccaacctcccgagcccagccttcctctcgaacatccaagccccgagccgcctgcgctgttcccccacccccctcacacgccggatccactggcctgttcactcccaccacctaagggtttcacggccccaccattgcgagacagcaccctcattactcccagtcactgcgattccgtggcattccccctgggcactgtgccacagtccctcagcccacatgaggacctggtggcatccgtgcctgccatcagcggactcggcggaagcaactcacacgtatctgcctcttcaagatggcaggaaacagcgcggacgtcatgtgccttcaactcttccgtgcaacaggatcacctgtccagacatcccccagaaacttgccagatggaagctggaagtttgtttcttctctcttcggatgggcaaaatgtggtcggcattcaggtgacggagaccgccaaagtgaatatctgggaggaaaaggagaacgtgggcagcttcactaaccggatgactcccgagaagcatctgaactaccttcgaaatctggccaagagcttggacgctgagcaggacacaactaaccctaagccgttttggaacatgggcgaaaactccaaacagttgcctggaccacagaagttatctgatcccagactgtggcaggaatccttttggaaaaactacagtcagctgttttggggtctgccaagtctgcatagcgagagcttggtggccaacgcgtgggtcacggatcggagctatacattgcaatctccgcccttcctcttcaacgagatgagcaacgtgtgtcccatccaaagggagaccacaatgtctcccctcctctttcaggcccaacccctgtcccaccttggcccggaatgtcagcccttcatcagctccacaccgcagttccggcctactccaatggcccaagccgaagcccaggcccacctgcagtccagctttcctgtgctgtcacccgctttcccgagtttgatccaaaacacaggagtagcttgtccagcttctcagaataaggtacaggcactttctctgcctgagacacaacaccctgaatggccactcttgcggcggcagcttgaggggagactcgcattgcccagcagggtccagaagagccaggacgtgttttccgttagcactccgaacctgcctcaagagagcctgacatcgattcttccagaaaatttcccagtcagtccagagctccgcaggcagcttgaacaacatatcaagaaatggatcatccagcattggggtaatctagggagaatacaggagtccttggatcttatgcagctccgagatgagagcccaggcacgagtcaggcaaaaggtaagcctagtccatggcagagtagtatgtcgacgggcgagtcaagtaaagaggcccagaaagtgaaattccagctcgagcgtgatccctgccctcatctggggcagatactgggcgagaccccccaaaatctaagtcgcgatatgaaatcctttccacggaaggtcttgggcgtcactagcgaagagctggagaggaacctccgcaagcccctgaggagtgacagcggcagtgatttactaaggtgcacagaacgaacacacattgagaatattctgaaagcgcacatggggaggaatttgggtcaaaccaatgagggcctgattcctgtgtgtgtgcgtcggagctggctggctgtgaaccaggccttacctgtgtccaatactcatgttaagacctctaacctggctgctccaaagagcgggaaagcatgcgttaacaccgcccaggtcctgagttttttggagccttgcacgcagcaaggactaggcgcccacattgtgcgcttctgggcaaagcaccggtggggactgccactgcgggttctgaagccaatccaatgtttcaaactggagaaagtgtcctccctgtccctgacacagttggccggaccctccagtgccacatgcgaaagcggtgcaggttccgaggtggaggtggacatgttccttcgtaagcctccgatggcttccctcaggaagcaggttcttaccaaagcctccgatcacatgccagaatcactgctggcgtcctcacctgcatggaaacagtttcagcgcgctccacgcggaattccctcttggaacgaccacgagccgctgaaaccgcctccagccggccaggaaggcaggtggccaagtaaaccgctcacttattcccttaccggcagtattcagcagtcccggtctttgggcgctcagtcctcaaaggctggagagacccgggaggccgtcccacaatgccgggtccctctagagacttgcatgctcgctaatttgcaggcaacaagcgaggacgtgcacggatttgaagctccgggtacgtccaagtcctccctgcatccccgcgtgtccgtgagccaagatcctcggaaattgtgtctcatggaagaggtggtcaacgaattcgaacccggaatggcaactaaatccgagacgcaaccacaggtatgtgcggctgttgtgctgctgccagatggccaagcctccgttgtgccgcacgctagcgagaatctggtgtcacaagtcccccagggccacctccagtctatgcctactgggaacatgagagcaagccaggaactacatgatcttatggcagcccgccgtagcaaactcgtgcatgaggaaccaagaaatcctaattgccaaggaagctgcaaatcccagcgcccaatgtttccacccatacacaagagtgaaaaatccaggaaaccgaacctggaaaaacacgaggaacggctggaggggttaagaaccccccagctcaccccggtgcggaaaactgaggacacccaccaggatgagggtgtgcagctcttgccctcaaaaaaacagcccccgtccgtttcccccttcggagaaaacataaaacagattttccagtggatttttagcaagaagaaatcgaaacccgcccccgtaacggcagagtctcagaagaccgtgaaaaaccggtcccgggtgtactcaagttctgctgaggcccaaggactgatgaccgccgtggggcaaatgctcgatgagaaaatgtccctctgtcacgcccgacatgcctcaaaagtgaatcagcataaacagaaatttcaggctcccgtctgcgggtttccttgtaaccaccgccatctcttttacagtgagcacggccggatcctgagttacgcggcttcctctcagcaggccaccctcaagtcccaggggtgtccgaatagagacaggcagatacgcaatcagcagcccctgaagtcagtgcgttgtaataacgagcagtggggactgagacacccccagatccttcaccctaaaaaagctgtgtccccagtgagcccgccacagcattggccaaagacttcaggagccagttcccaccatcatcactgtcccagacactgtctcctgtgggagggaatttag

SEQ ID NO: 26268 - DNA, 4731 bp, Artificial Sequence
  Description of Artificial Sequence: Synthetic coding sequence
atggaaaatatcttatgcttcctgaacagttatactgagaccggcttgtctcctgacagtcactggctggacatcgatcctaacttcatttgcctctccggactgggtcttttcatcctgtacctcttctacgtggtgcttaccttgtattcttcacctactgagaagaacaatgatattcaaaagcaccaaggcagagcaaaaagacgcaggaaaggcggaacattcaaggggtttccggactggaagtcattccaacgagaggaggaggaagaacgcaagttactgagcttattgaagtcattcgggcccccagtctcttgttccccccgggggcagcatcacgatacaaatcacttcagacgattactgtgccccgacccagtgtgtcgggtctgtaagcgagcaacagcagatatccagcagcttttgtcctgggaaagtctgaaagacgctgccccttcggtcagccccctggcaagtagcgcctccgccaccgaatcctcctttacgctagcttcgaccccttctgccactcccccggaagaccttatcctttcacccaggccaaaagcctcgccaccaccacctttaatcctgtcccctgacttaattaccaccctcgcagacctctttagcccatcccctctccgagaccccttgccaccacagcccgtgagcccgctggactccaagtttccaatagatcattcacccccccaacagcttcctttcccattactgccgccccatcacatcgaaagggtggaatctagcctacaacctgaagccagcctgtcgctcaacactatcttctctttcggtagtaccctgtgccaggacatctcccaggcaatgaaccccatcgacagttgtgcccggcatcatgggccacctattccctcagcactacctcccgaggactgcacagtgacacagtcgaagagcagcctgactattctgaaaaccttccccgagatgctgagcttggggggaagcggagggtcctcaactagcgcccccaccatcaagggcatcgatcactcgcacttggcaagttccgaatttacctggtggcagcctcatgcaaaggacagctttagctcaaatttcgtgccaagcgatttcatggaggaactccttactctccatagtagtgaagcgtttctgggcggacactcggtcgctaatctcatagagcctgtgaatatctccttcttgagtcacgacatcctggcactgctcgagaggcaggtcaaaaaaaggggagattttttaatgtggaaagaaaatgggaagaaacctggcagtttcccaaaacagttacgccccaattaccaattgaattccagtaggaacatgctgactagcatcgccgtcaaacatgatctcgcagaatcttttccattttgggcctccaaagggaaactggagtggcagcacattcaccaacaaccaccacattccaagtgtttcgaagaccatttggaacaaaagtacgtccagttattctggggattgcccagcctgcattctgagtccctgcaccccactgtgctcgtgcagcgagggcattcatccatgttcgtattcttcaacgggattaccaatacatcaatttcccatgaaagcccggtcctaccaccaccccaacccctttctctcccttctacgcagcccctgcctttgcctcagacactccctcagggtcagtcgccacacctgacgcaggtgaaaagtctggcccaaccccagtcaccttttcgggcattgctcccctctccactattcttaatcagaatttgtggtgtttgtttccatcgtccacagaatgaggctaggtctctcttgccgtccgaaattaaccacctcgagtggaatgtgctgcaaaaggtgcaggaatccctctggggattgccatccgtcgtgcaaaagtcccaggaggacttttgcccaccagcccctaaccctgagttggtcaggaaatcctttaaagtccatgtgccgatctccataattccaggggactttcctttgtctagtgaggtgagaaagaagttagagcaacacattcgtagaaggttaatccagcggaggtggggcttgccccggaggattcacgagagtttgagtctgctccgtccacaatctaagatttccgagctctctgtttccgagaggattcatggtcccctgaacatatcgttggttgagggccagcgatgtaacgtgctgaagaaaagtgcaagctcatttcctcgctccttccatgagcgttccagcaacatgctctccatggaaaatgttgggaactaccagggttattctcaggaaacagtacccaaggaccatctactccacggtccagaaaccagtagcgataaggatttgagatccaattcggaacgcgacctggagacacacatgatgcatcttagcgggaacgattctggtgtaagactaggacaaaaacagctcgagaacgccctaacagtccgcctctctaagaaatttgaagaaataaatgagggcaggatgcccggaactgtacactccagctggcacagcgttaagcagacaatgtcactgcccgagaaaagccatagccaaatcaagcataggaacttggttaccctggtcagtgaagaccactgcgtggacacgtcacaagagatttcattcctgtcctccaacaagcagaaaatgctcgaggcccacattaagacattccggatgagaatgttgtggggactgcctctgaaggtgctcgaatcgatcgaaatattcaaaagcaaagccgatctctctacatcgttctcccactttgatcttccatcctcagccacattcatttctcaaggggactcaaaggatggcgttagcaaaagccgttcccggtccacattccaaggggaaaaactgggaacgacatcctctgtacctattctcgatcgccctcatccagtgagctctcccgtggtccaagaggggcagggtacgctgcgcagacagttttcagacaccgatcatgacttgatcgaaacagactccaaagatggcgcatcaacttctctgcggagaggcacaacagacttccaaagcgagaaactggactctactagtagcttccctatacttggccattcatatctggtgacatcaccagtcaatcaggaaaagcagggtacgctgaggagagaattctctgacacggacaatgaccttacagagtcagtgaggacaactgaagatggaagacagacattcctgccaccaccccatagcatcgtggatgaagtcagccagaaacaaactgtgttagctagtcgttgttcagcggaactgcctattatgcaggccggcgccggctgcgaaagttgggataagcgcaagagttccttccataacgtggatagactccagggctcaaggaaaacttttcctgttactaacgcactgcagagtcagaccaggaacaacctcactactagcaaaagcggcagctgtagcctaacgaacgttaaagcatctacaagtaatgaaactgagatcttcccgccaagaatctcagtgcctcaggatcccaagtcctcctatttaaagaatcagatgctctcacagctcaaactagtgcagagaaaacattctcagccccagtcccatttcacagacatgagcttcgcattggataacttgagttccaaggatttactgacaaatagccaaggcatctcaagtggcgacatgggaacctctcaggtagtccacgttcatctggaggattccggcatcagggtcgcgcaaaagcaagaaccacgagtgccgacatgcgtcttacagaagtgtcaagtgacgaactttccacctgccgttaatagggttagccccgtgagaccaaaaggcggcgaattagatggaggcgatgccggcctcgggaccagccagcggaggagaaagtccctgcctgtgcacaataagactagcggcgaagttctgggctcaaagagctcccctactctcaagacccagccacctccagagaatctgttccgaaagtggatgaagacctccctacagtggttcaataaaccatcaatttcctatgaggagcaggagtcctcatgggaaaaggggtcctcgctatccagttgtgtgcagaatatagggcgagtgattagagcagcatttactgggacgactgaggcacaaaagatccggaaagacactcgcgagtttctggaggagaagctaggccaccgtcacggaatcgatatcacatgccctcaagaaccactatcattccccgtgggcttaggcaaggcccagcacaacccagaagtgcatgtgagagcagagcccgtccaaggctgcccctgtaattacagagctccatcatgtaaggtgactagaacaaagtcctgctcccaacaggcaatcttcgttggtcaaaactatcccactcggatccgacaaatcatcgacaaggacaggcagccccagaaagtggaggccttcaaggggaagattctgtgccagtctcatccccagtcgatgcctcacaggaaaccggtgcctcacccaaatccgacatgcagacgccaagtctctctggtgtgcccagccgtgccaacatcggctaagtcccctgtgttcagcgacgtgccattcctcaccggtcaaaagatgctcccaaagcatctacaggggggcaagttccctccaacaaaatag

SEQ ID NO: 26269 - DNA, 1242 bp, Artificial Sequence
  Description of Artificial Sequence: Synthetic coding sequence
atggccgaaggaccagaagaagcacgcggtcaccccccaggacaggatgatgggggtggtgatcacgagccagttcctagcctccgaggtccaccgaccaccgccgtgccgtgtcctagggacgacccacaagcagagccccaggcaccaggccgccccactgcgcctggacttgctgccgctgcagccgctgacaaattggaaccccccagggaactgaggaagcggggagaggctgcttccggtagcggtgcggaactgcaagaacaagccgggtgcgaggctccagaagcagccgccccacgggagagaccagcacgtctgtctgcgagagaatacagtcgtcaggtgcatgaatggctctggcaaagctactgtggctacttaacgtggcattccgggctagcagcctttcccgcgtactgttctccccagccgtcccctcagagctttccctcaggcggagccgctgtgccccaagccgccgcccccccaccaccacagttgggctattataatcctttttactttctaagccccggcgccgcgggccctgacccaagaacggcggctgggattagtacacctgctccagtcgctggactagggcctagagcaccccacgtccaagcctctgttagggctacacccgtgacccgagtgggaagtgcagctccatctagaagtcccagcgagacaggaaggcaggccggaagagaatacgttatacccagtttagcgcacagatttatggccgagatggtagactttttcatcctgtttttcatcaaagcaactatcgtgctgagtatcatgcacttatcgggcattaaagacatttccaaatttgccatgcactatataatcgaggaaatagatgaggataccagcatggaggaccttcagaaaatgatggtggtcgctctgatatacagattgctggtgtgtttttatgagataatttgtatctggggggctggtggcgccactcctggcaagttcctgcttggccttcgggtagttacctgcgacacttccgtgctgatcgcccctagccgagtgttagtgattccgtcctcaaacgtgagtatcactacctctacaatcagagcgttgataaaaaatttttccattgcatcatttttcccggccttcattacccttcttttttttcagcataatcgcacagcttatgatattgttgctggaacaatcgtggttaagaggaacggggttcgttag

SEQ ID NO: 26270 - DNA, 492 bp, Artificial Sequence
  Description of Artificial Sequence: Synthetic coding sequence
atggctgaaatggtagacttttttattcttttttttattaaagccaccatcgtgttgtctataatgcaccttagcggaataaaggatatatcaaagtttgctatgcactatatcattgaggagatcgacgaggacacaagcatggaagatcttcagaaaatgatggtggttgctttaatttaccgactgctggtgtgcttttatgagatcatatgcatttggggcgctggcggcgccaccccaggtaagttcctgttaggcctgagggtggttacttgtgatacgtctgtgctgatcgcgccctcccgagtacttgtgattcccagctctaacgtttcaatcactaccagtactatcagggctctgattaagaacttctctatcgcttctttttttcctgctttcatcaccctcctgtttttccagcacaataggaccgcatatgacattgtcgctggcacaatagtggtgaaacgtaacggcgtgcgttag

SEQ ID NO: 26271 - DNA, 915 bp, Artificial Sequence
  Description of Artificial Sequence: Synthetic coding sequence
atgaacattgtctttagtcgagattcgcaggttagggtgatggaaaatacagtcgccaacactgagaaatacttcggacaattctgctcactgctggccgcctacacgagaaaaaccgcacggctccgcgataaggccgaccagttggtaaaacagctcatcgactttgcgaattcagaaaatccagagttgcgcgctaccatgaggggtttcgccgaagatctggcgaaagtccaggactacagacaagcccaggtggaaaggttggagactaaggttgtcaacccactaaagctatacggagcacagattaaacagacccgggccgagataaaaaagttcaaacacgtgcagaaccatgaaatcaaacagcttgagaagctcgaaaagcttcgccagaaaagtccaagcgaccagcagatgattggccaagccgaaacccgcgtccagagagccgctgtcgactctagtcgaaccactttacagctggaggaaactgtcgacggattccagcgtcaaaaactcaaggacctgcaaaagttcttctgtgactttgtaactatagagatggtatttcatgcgaaggccgtcgaagtctatagttccgcatttcagaccctcgagaaatacgacctggaacgagatctgttggattttagggctaagatgcagggagtgtatgggcattacgatacgagattgttggctaacaccagccctcctccctctgtattacagtccctggcctcccagggcaccttgcaggtccagctcagtcgggctaatgaagatcctgagcaccctcacgcgaaccatggccgcttcagtctatgcgaatgggtggtgaaggggcaaccggcacactgcgtatgtgggcaaggcggccatctgatgcttccaggccacagcctgtag

SEQ ID NO: 26272 - DNA, 915 bp, Artificial Sequence
  Description of Artificial Sequence: Synthetic coding sequence
atgaatattgttttctctcgggactctcaagtgcgcgtcatggaaaacactgtggccaacactgagaaatattttggacagttctgtagcttgctagcggcgtacacccggaagacagctcgccttcgagacaaggctgaccagttggtgaagcagttgatagactttgccaactccgaaaacccagagctgcgcgccactatgcgtggcttcgcagaagacctagccaaggtccaggattatagacaagcacaggtcgaacgtctggagacaaaggtggtgaatccacttaagctgtacggcgcccagatcaaacaaacacgggccgagatcaagaaattcaagcacgtgcagaaccatgaaatcaaacagcttgagaaactggaaaagctgcgccaaaaatcccccagcgatcagcagatgatttcacaggctgagacacgcgtgcagcgagccgctgtagactccagccgcacaacacttcagcttgaggagacggtcgatggtttccagcgccaaaagctgaaggatctacagaaattcttctgtgactttgtgacaatcgagatggtcttccacgccaaggccgtggaggtgtactcttcagcatttcagaccctggaaaagtacgatctcgagcgcgatctgctggacttcagggctaaaatgcagggtgtgtacggccactatgatacccggctattagcgaacacctcacccccccccagcgtgttacagtctctggcctcacagggcacactccaggttcaattgtccagagccaacgaagatcctgaacacccacacgctaatcatgggaggttcagtctctgtgagtgggttgtcaagggccagccagctcattgtgtttgcggacagggcggtcacttgatgttgcccggacacagtctctag

SEQ ID NO: 26273 - DNA, 3402 bp, Artificial Sequence
  Description of Artificial Sequence: Synthetic coding sequence
atggctcccaaaactaaaaaaggctgtaaagtaaccctgcctgagaagcctgttaagctggctagccacacacgtgacaccaccggcgtctcgcagatgttccctagcagtaaggctagaaccaagtccctgctcggagacgacgtgttctctactatggcagggctggaggaggccgacgccgaagtgagtgggattagtgaagctgatccccaagcactactccaggcaatgaaggatctggacgggatggacgcagacatcctcggcctgaaaaagagcaactcagcaccgtcaaagaaggctgctaaggatcctggtaagggagagctcccaaaccacccgaagcccgctggaggcgcaattcctacgaagaagtcactgcctagcccctcatcttctggccatcagaataggagattttcttctgaggatctggaagatcccctgagaggactgctgagttacgacgagggaggtattactaaacagcccccagtaactcagagcaagacagcctccgataagagcccgtccacagtgagagaccagggcccttccattccacttactccaggcgacacacccatcagaaagaaggaagaactgctctttgacgacggcgacgatattatggccactctcggctttggagactctcccaaggctgaaaagagacagatcggcgaccaggagggcccgcgcccagcacgatctaccctagatgaactcttgggcagaggcatggcaactaaattgctcgctaggccgggtactggggagcaccgtgaattcaaattggacaaaaagtaccagcggccgcaagactctgaagatatgtggggagacgaggattttacgttcggcgcctatcagcccaccgtagtgtcaagcgagggccgccaaagcaggagacaatcagtacggttcttcgctgacagtggggccgatcccaaaggggagcccggttccaagcagagcccacctatggctagctcccccatccagcctaggaaagggggcgctgactggttgggcctgaaggatgaagatcttgacctcttccccgctagtccaactagggaagcccacagagagagctctgttcctgtcactccatccgttcccccaccagctagtcaacattccacaccggccggcctcccccccagtcgggcaaaaccccctacagaaggggcaggttcacctgccaaggcttcacaggcttcgaagctcagagcctccaaagaggagaaggaggactggctgtcccacgcgttgtctaggaaaaagtcacagggcctggcccgggagcagcatgccggcaccagtgagggcctgcacctggccgggacagctggacacccacctagcggaagccagcctctgacctccactcagggactggagcacgcagccgctggaggatcgtctggcacgaccgcacgggagcggccctgcgtccggccgggggtgtctggtagtcctgtgacccaaaaccacgctgcaagcgccctgcctacagggtccccgaaaaggggtactgcacctggggacctcagtgccaccgaacccgcgacctgtttcccttcaacacaaaagccaaccgagccatcagttcctgttcagcccctgttacccgagtcacttgcaagaagcctgctcccatcaacagaatatcaaaaacagctactggcagctcaggtgcaactgcagtgtagccccgcggaactacaggccgaactgctgcacagtcaggcacgccttgcggagctggaagcccaggtgcgtaagctggagctcgaacgggcacagcacgagctgcttctggggtccctgcagcagcagcatcaggccgacttggaactgattgagtccgcgcataggagccgtatcaaggtgctggaaacatcctatcaacagagggaggagagacttcggcgtgaaaatgaagagctctctgcgaggtatctgtcccagtgtcaggaggcagaacaggcccgcgccgagctgacagcccagcaccagaggagactagctgccatagcccaggagaaagaccaggagatggagaggctacgagagctgcagcgcgcgtctattctggatatgcgtagagaccacgaagaacagctgcaacggctgaaactcttgaaggaccgggaggtggacgctgccacttctgcaacaagccacacgcgctccctgaattccatcatccaccagatggagaagttttccagctcactgcacgaactctcatcccgcgtggaggcctctcatctgaccacaagtcaggagcgggagctcggtatccgtcagcgcgatgagcagctgagggctctgcaggagagacttggccagcaacagagggatatggaggaggagaggagcaggcaacaagaagtcatcgggaagatggaggcccggcttaatgaacagtcaagactgctggagcaggaaaggtggcgggtgactgccgagcagtccaaagcggagagtatgcaacgggctctggaagaacagagaaaagtgaccgcccagcagatggcaatggaacgggccgagttagagcgggccaagagcgctctgctcgaagaacaaaagagcgtgatgttgaaatgtggagaagagcggcgacggttggccgccgagtgggccgagttctcagctcagcagaaactgtccaaggaacgggccgagagagaggccgagagggccttacaggttgacactcagagagaaggaactctaatcagcctcgcaaaagagcaagctgaactgaagatccgcgctagtgagctgcgcgccgaggaaaagcagctagccgctgagagagccgcattggagcaggagcgccaagaattgcgccttgagaaagaaagaatcaatgccactgccttacgtgtgaagctccgcgccgaggaggtcgaaagcatgtcaaaggttgcgtccgaaaagtatgaagagggcgaacgcgcgctgcgagaggctcagcaagtgcaggcagaacagcaggcccgccttcaggcagtgcaacagcagcaggagaggctccgcaaacaggagcaacacatgcaccaggagcatctgagcctggcccagcagaggctgcagttggaccgtgccagacaggacctgccttcttcgctggtcggactattccctcgcgctcagggcccagctgccagcagccagagtgcactgatgcctcctgcccccactaccaggtggtgtagccaaccccccacaggcttggacccatcacccctgcacttgcacgcacgcctcgccctcttgcgtcacatggctgaacaggatcgggatttcctggagaatgagcaatttttccttgagacattgaaaaaaggctcttataatcttacgtcacattccgcctag

SEQ ID NO: 26274 - DNA, 2493 bp, Artificial Sequence
  Description of Artificial Sequence: Synthetic coding sequence
atggctccaaaaaccaagaaaggttgcaaggtgacactcccggaaaagcccgtaaagttagcatcccatacacgggacaccaccggggtgtcccaaatgtttccttccagtaaagccagaaccaagagtttattgggggacgatgtgttttctaccatggcggggctggaagaagctgacgccgaggtgtctggcatatcagaagccgacccccaggcgctcctccaggcaatgaaagatctcgacggtatggacgcagatatcttaggacttaaaaagagtaattccgccccttccaaaaaggccgctaaagaccccggcaaaggagagctccctaaccatccaaagcccgctggcggggcaatccctactaaaaagagcctaccaagtccatcttcctccggtcaccagaaccgtagattttccagcgaagatttagaagacccattgagagggctgctcagttacgatgagggaggcattaccaagcagccccccgttacacagagcaagactgcttctgataaatccccatctaccgtccgagatcagggcccctccattccgctaacacccggtgataccccgattagaaaaaaggaagagctgctgtttgacgacggcgatgatattatggcaacactgggctttggcgactcacctaaggccgagaagagacagattggcgaccaggaagggcctaggcccgccaggtctaccctggatgagttgcttggacgcggaatggcgaccaagcttttggctcgccccggcaccggcgaacaccgcgagtttaagttagacaaaaaataccagagaccccaggattcggaagacatgtggggtgatgaggatttcacttttggagcttatcagcctacggtcgttagttctgagggaaggcaatccaggaggcagagcgtatcccgcttctttgcggactctggcgccgaccctaaaggcgaacccggaagcaagcagtccccccctatggcaagcagccctatccagccaaggaaggggggtgccgattggctgggcctcaaggatgaagacttggatttgttccctgctagtcccacacgtgaggctcatagggaaagctctgtgccggtaaccccatcggtgccaccccctgccagtcaacactcgacccctgcagggctgccgccgagccgcgctaaaccacctaccgagggtgctgggagtcccgccaaggctagccaggcgtcaaagttgcgggcttccaaagaggaaaaggaggactggctgagccacgctttaagccgtaagaaaagccagggcctggcaagggagcagcatgcagggacatccgagggactgcatttggccggcacggcaggccatcctccgagcggtagccagcctttgacttctacccagggcctagaacatgctgctgccggagggagttccggaaccactgctcgcgagcgcccctgcgtacgacccggtgtttctgggagccccgtgacacaaaaccatgccgcttccgccctacctacagggtcccccaaacgcggaaccgcccctggagatctcagtgccaccgaaccggccacatgctttccctctacccagaaacccaccgagccttccgttcctgtacagcctctgctccccgaaagtctggctagaagcttgttgccttcaactgaatatcaaaagcagttgctagcagcccaagtccagctccagtgcagcccggccgaactgcaggcggaacttcttcacagtcaagccaggctggctgagctcgaggcccaagtgagaaagttggaactggagagagcccagcatgagctgttacttgggtctctgcaacagcagcaccaggcagatctggagctaatcgaaagcgcccatcggtcccggattaaggtacttgaaacatcttaccagcagcgtgaggagagactgagacgggagaacgaggagctgtccgcacgttacttaagtcagtgccaggaggccgaacaggccagggcggaattgaccgctcagcatcagaggcgacttgctgcaatcgcccaggagaaagatcaggagatggagcgtctgagagagctccagagggcctcaatcttagacatgcggcgtgaccacgaggagcagctgcaaaggctgaaacttttgaaggatagagaagttgacgccgctacttccgcaacaagccacacaagatcactcaacagcattatccatcaaatggaaaagttttcctcatctctgcacgagctgtcctcgcgcgtcgaggcatcacatttgactacttcccaggaacgagaactcggtatcaggcagagagatgaacagttgcgggctctgcaagaacgcctgggccaacaacaacgcgacatggggcgggatgaagagggatctctttgcgcagcgcatctgcctaaggcccagcttagcggatacgcggttgaggcaacccggaatcagtctcagctccagagatttctgtag

SEQ ID NO: 26275 - DNA, 3405 bp, Artificial Sequence
  Description of Artificial Sequence: Synthetic coding sequence
atggcccccaagactaaaaagggatgcaaggtcacccttcccgagaagccggtcaagttggcgtcacacacccgcgacacaacaggagtgtcccagatgtttccctcaagcaaggcaagaacgaagtcactcctcggcgatgacgtgttctccaccatggccggtctggaggaggccgacgccgaggtcagcggcatatccgaggcggatccacaagcgctcttgcaagcaatgaaggacttggatggaatggacgctgacatcctcggcttaaagaagtctaactcggcacctagcaagaaggcggccaaggaccccggcaagggagaactcccaaatcatcccaaaccagctggcggagctatacccacaaagaagagtcttccctccccttcatcatctggacaccagaaccgtagattttcgtccgaggacctagaggatcccctaagagggctgttaagctacgacgaggggggcatcacaaaacaaccccccgttactcagagtaaaacagcaagtgacaagtctccctctaccgtgcgcgatcagggcccgtccatcccactcacccctggggacacgcccatcagaaagaaagaagagttactattcgacgatggggatgacattatggcaactctcggcttcggagattccccaaaggctgaaaaaagacagatcggtgatcaggaggggcctcgacctgctcgtagcactctagacgaattgctgggaaggggcatggctaccaagttgctggcgcgccctggcaccggcgaacaccgcgagtttaagctcgataaaaagtaccaaagaccgcaggactcagaagacatgtggggtgacgaggactttacttttggcgcataccaacccacagtggtgtctagcgaggggcggcagtcgcggcgccagtcggtgtcacgcttttttgcggattcgggggccgatcctaagggggaacccggatctaagcaatccccccccatggcttccagtcctatccagcctagaaaagggggcgccgattggctcggactcaaagacgaagacctggacctattcccagcctcaccaaccagagaagcccatagagagtcatccgtccctgtcactccgagcgtccctcctccagcctcccagcactcaacacctgcagggcttccccccagccgagcgaagcccccaaccgagggggccgggagcccagctaaggccagccaggcttcaaagctgcgggccagcaaggaagagaaagaggattggctgtcgcacgcattatcccgcaagaagtcccaggggctggccagagaacagcatgcaggtacaagcgagggattacacttagccggaaccgctggtcacccaccctctggctcccagcctctgacatcaacgcaaggtttagaacatgccgccgctggcggcagcagtggcacaaccgcgagagagcggccctgtgtccggcctggggtttcaggctcacctgtgactcagaaccacgccgccagcgcattgccaacaggcagtcctaagcggggtaccgccccgggcgacctgagcgccacagagccggccacatgctttccctccacccaaaagccaaccgagccgtctgttccagtgcaacctctgttacccgagagtttagctcgttctttattgccttccaccgagtatcagaagcaactcttggcggcgcaggtccagctgcagtgtagcccagccgagctgcaggctgaactgctgcactctcaggctcgactagccgaacttgaagcacaggtgaggaagctggaactggagcgggctcaacacgaattgttattgggcagcctgcaacaacaacaccaagcagacttagagctgatcgaaagcgctcacaggtctcgcattaaggtgctagagacttcctatcaacagagagaggagagactccggcgggaaaatgaggaattgagcgctcgctatttatctcagtgccaggaagcagagcaggcacgcgcggagctgaccgctcaacaccagcggcggctagccgccatcgctcaggaaaaagatcaagagatggagaggctcagagaactgcaacgggccagcatcctcgacatgaggcgcgaccacgaggagcagctgcagaggctgaagctgctcaaagatagggaagtggatgcagccacttccgccacttcccacacacggagcctgaattcgataatccatcaaatggagaagtttagcagcagccttcacgagctctcttctagagtcgaagcctcccatctaaccacttcacaggaaagagagctggggatccggcaacgagatgagcagcttagggctcttcaggagaggcttggccagcagcagcgcgacatggaggaggagcgctcaagacaacaggaagttataggtaagatggaggccaggctgaatgagcagtcccgcctgctagagcaggagagatggagggtgacagctgaacagtccaaagccgaatccatgcaaagggcgctcgaagagcagcgaaaagtgacagcccagcaaatggccatggagagagccgagctggagagagctaagagcgctctgctggaagagcaaaaatccgtaatgctcaagtgcggtgaagagcggcggagactggcagccgagtgggctgagttcagcgcgcagcaaaagttatctaaagagagggcggagagggaggccgagagggctctgcaggtggacactcagagggagggaaccctgatttctctggctaaggagcaggccgaattaaaaatcagggccagtgagctccgcgcagaggaaaagcagcttgctgccgaacgggccgcccttgagcaggagaggcaagaactgcgtctcgaaaaggaacgtataaacgcaactgctctgagggtcaaactccgtgcggaggaggtcgagtcaatgtcaaaagtggccagtgaaaagtatgaagaaggggaaagagcattacgggaggcccaacaagttcaggccgaacagcaggctagactgcaggcagtccagcagcaacaagagcgtctgcgcaagcaggagcagcatatgcaccaagagcatctgtctctcgcgcagcagagactccagctggatagggccagacaggaccttccatcctcactggtgggactcttccccagagctcagggacctgccgcttcgtcccaatcagccttgatgcctcccgctccgaccactcgctggtgcagccagcctcctacaggtttggatccttcaccactccatttacacgctagacttgccctgctacgccacatggccgaacaagatcgcgatttcctcgagaatgagcaattcttcttagaaaccctaaagaagggctcatataatcttacttcacacagcgcctag

SEQ ID NO: 26276 - DNA, 3444 bp, Artificial Sequence
  Description of Artificial Sequence: Synthetic coding sequence
gccccaaaaacaaaaaaaggttgtaaaggcagcatcgatgactttctgggggatctcctgggcgacgacatgaccttacctgaaaaacccgtcaagctggccagtcatacaagggataccaccggggtgagccaaatgtttcctagcagtaaagcgaggaccaagtctttactcggtgacgacgtgtttagcactatggcaggactagaggaagctgacgccgaggtgtccgggatcagcgaagccgatccgcaggctctgctgcaggctatgaaagacctggatggtatggatgccgatatcctggggctgaagaaatccaactcagctcccagcaagaaagccgccaaggatccagggaagggagaactgcccaatcaccccaaaccagcgggcggagctatccccactaagaaatccctgccctctccgagcagtagcgggcaccaaaaccgccggttctcctcggaggatctggaagatccactgagagggcttctcagctatgacgaaggaggcatcactaaacagcctccggttactcagtctaagacagcatccgacaagtcaccttctacagtcagggatcaggggccttccatccccctgactcctggagacactccgatccgaaaaaaagaagaattactgttcgacgacggcgacgacataatggctactctgggctttggcgattctcctaaggccgaaaaacgccagatcggtgaccaagaggggccccgacccgctcgctctacattggacgagttgctcggcagaggcatggcaacaaagctgctagctcgcccaggcacaggcgaacacagggagttcaagctcgataaaaagtaccaaagaccccaggatagcgaggacatgtggggtgatgaggacttcacctttggcgcataccagccaacagtagtttcctcagagggaaggcagtcccggaggcagagcgtttcgagattcttcgcagactccggagccgatcccaagggtgagcccggctctaagcagagcccccccatggccagctctccaatccagcctaggaaaggtggcgctgattggctgggcttgaaggatgaggacctagatctgttcccagcgtcacctaccagagaagctcaccgggagagtagtgtgcctgtcaccccatcagtgcccccccctgcctcccagcattccacaccggctgggctgcctcccagtcgggccaagcctcccacagagggcgctggtagccccgccaaggcatcgcaagccagcaaactacgggcttccaaggaggagaaggaagactggttatcccacgccttgtctcgaaagaaatcccaaggactcgcgcgcgagcaacatgcaggaacttccgaaggattgcatctcgcaggaaccgccggtcacccgccttcaggttctcaacctctaacctctacccaagggctggagcacgccgcagctggggggagcagcggtactacggcacgcgagcgcccatgtgtgaggccgggggtgtctgggtcacccgtgactcagaatcacgctgcctctgctctgccaaccggttcaccaaagagaggcaccgccccaggcgacctaagcgcaacagagccagccacatgttttccaagcacgcagaaacccacggaacccagcgttccggtgcagccactgctgcctgaatccttagccagatctcttcttcccagcacggagtaccagaaacagttgcttgccgcccaagtccaactgcagtgctctccagcggagctccaggctgagctcctgcattcacaggccagactggccgaactcgaagcccaggtccggaagttagagctggagcgagctcagcatgaactactgttgggatcattgcaacagcagcatcaagccgatctcgagctaattgagtctgcccacaggtcacgcatcaaagtgctggaaacttcgtaccagcagagagaagaaagactccgcagggaaaatgaggaactgtctgctagatacctgtctcagtgccaggaggctgagcaggctcgggcagaactgaccgctcaacaccagagacggctggcagctatcgcccaggagaaggaccaagagatggagcgcctccgcgagttacagagagccagtatcctggatatgcgcagagaccatgaagaacaactacagcgactgaagctcctgaaggacagggaagtggatgccgcaaccagcgccacctctcacacacgctcgctcaatagcatcatccaccagatggagaagttcagctcgtccttacatgaactgagctctagagtggaggcctcacaccttaccacatctcaagagagggagctaggcatcagacagcgggatgagcagcttagagccttgcaagagcggctggggcagcagcagagggatatggaggaagagagatcccgccagcaagaggtcatcggtaaaatggaggctcggctcaacgagcagagtagactgctcgaacaggagaggtggagagttactgcagagcaatctaaggcggaatccatgcagcgcgctctggaggagcagcgcaaggtcaccgcccagcagatggctatggagcgggcggaactggaaagagctaagtctgcgctccttgaggaacagaaatcggtcatgctgaaatgtggagaggaaagacgccggcttgccgccgaatgggctgaatttagcgcccagcagaagctctcaaaggagcgcgctgagcgggaggcagagcgggccctgcaggtagacacacaacgcgagggtaccttgatcagcctggctaaagagcaagccgagttgaaaatccgcgcctccgagctcagagccgaggagaagcaactggctgcggagagggccgcccttgagcaagaacgccaggagctgcgattggagaaggagaggattaatgcaacagcgctgagagttaaactgcgggcagaagaggtggaatcaatgtctaaagtggccagtgagaagtacgaagaaggcgagcgcgcactccgagaggctcaacaggtgcaggcagagcagcaggccaggcttcaagcagtccagcaacagcaggagagactccggaagcaggaacaacatatgcatcaggaacacttgtcactcgcacagcagaggctccagttagacagagccagacaggatttaccatccagtctggtgggcctgtttccccgagcacagggacccgccgcatcctcgcaatctgcactcatgccaccagccccaaccacacggtggtgctctcagcctcctaccggtctggacccatcacccctgcatttgcacgcccggctcgccctgctccggcacatggccgagcaggaccgagattttctcgagaatgagcagttcttcctcgagaccctaaagaagggatcatacaaccttacgtcccacagtgcatag

SEQ ID NO: 26277 - DNA, 831 bp, Artificial Sequence
  Description of Artificial Sequence: Synthetic coding sequence
atgaagaaaaccccagtgtttctagaaagtttggtgactaatatgctacgattgcgagccatatgtccctttagctggagggtttttcagttccgacctattagctgcgaaccactgataatccagatgaataagtgtactgatgaagagcagatgtttggtttcatcgaacggaataaagccattctttctgagaagcaagtgggctgcgctttcgacatgttatggaaactccagaaacagaagacctcgctgttgaagaatgctgagtacgtgagagaccaccctcagtttctgacattgcataatctggcgactaacaaatttaagctcatgaacgatgacacacttgttaatgtcttgtacgtcactcaacagtttgccggggaggcccatgaccctctggttgaggcgctggttaccgaggcatggcgacgcctcgaaagattcgacatcaagctgttaagtgaattttcttcgtgtttagcagaccaacatctgtatttctcaccactgatggggaagatcgccgacattgtacacagaaacctggaaaccacacaggacctgtcctcattgagcgttctcatggtcaacatcagttccttgatcagccggcacttccagcagcagctggtgaataagaccgaactcctctttgatacaatagattccagcgaggtcaacgtcgctaaatctatcgctaagttcctgcgaaacgtacgttacaggtaccagcctcttctggagaggtgcaacaatgtattcctgtctaacgtggatcatctggatctggactcgatcagcaagattctcagtgtgtataaatag

SEQ ID NO: 26278 - DNA, 2544 bp, Artificial Sequence
  Description of Artificial Sequence: Synthetic coding sequence
atgaaaaagactccagtttttctggagtcactagtgacaaacatgctacggcttagagcaatttgcccgttttcctggcgggtcttccagtttagaccgatctcttgcgaaccccttattattcagatgaataagtgtacagatgaagagcagatgttcggttttatcgagagaaataaagctatcctgtccgagaagcaagtgggctgtgcattcgacatgctgtggaagctccagaagcagaagacaagcttgctgaagaatgctgagtatgtgagggaccaccctcaatttttgacactgcacaacctcgctacaaataaatttaaactgatgaacgacgatacgctggtgaatgtgctgtatgtgacccaacaattcgcaggtgaggcccatgacccgctggtggaagcactggttaccgaggcctggcgacgactggaacgattcgatataaagctgttatctgagttctcttcctgcctcgcagatcaacatctttacttttcgcccctgatgggaaaaatagctgacatagtccatcgcaacctggaaactacccaggatcttagttcactgagcgtactaatggttaatattagcagtctgatttctcgccactttcagcagcaactcgtcaacaaaaccgagctgctcttcgatactatcgacagctccgaggtgaacgttgctaaatctattgccaaattcctgcggaacgtgcgctataggtaccagcccctccttgagcgttgcaacaatgtgttcctgtctaacgtcgatcatttggatttagattctatcagtaaaatcctgtctgtgtataaattccttcaatttaactcttttgaatttatcattatggcaaagaagaaactgactgaaatgatacccctttgtaaccacccggcctctttcgtgaagctgttcgtggctttgggccctatcgcgggcccggaagagaagaagcaacttaaatctaccatgcttctcatgagcgaagacctcaccggcgaacaggccctggcagtgctaggagctatgggcgacatggaatcaagaaattcatgcctaataaagagggtcacgagcgtgctgcacaagcatcttgacgggtataaacccctggaacttctgaagatcacacaagaactcacgtttctacatttccagcgtaaggagttttttgccaagctgagggaactcttgctttcgtacctaaaaaacagttttattccaactgaggtgagcgtacttgttcgggccatttctctcctcccatcccctcacctcgacgaagtcgggatcagccgcatagaagctgtgcttccacagtgtgatctgaacaacctgagctcattcgctaccagcgttctgagatggatacagcacgaccatatgtatctggataacatgacagctaagcagttgaagctgctgcagaaactggatcactacggtcgccagcgattgcagcacagcaactctttggacttgctcagaaaggaactcaaatctctcaaagggaacaccttcccggaaagcctgctggaagagatgatcgccaccctccagcacttcatggacgacattaactacataaacgtaggtgagattgccagtttcatttccagtaccgattatctgagtactctgctcctggacaggattgcctcagtggcagtgcagcaaattgaaaagattcaccccttcacaatccctgccattattcggcctttttcggtccttaattacgaccccccccagcgcgatgagtttctaggaacctgcgtgcagcacttaaactcttatctgggaattctggacccattcatcctcgtcttcttggggttttccctggctactctcgaatactttcctgaggacctactcaaggctatttttaatattaaattcctcgctcgtctcgactcacagttggagatcctctctccctcccggagtgcgagagttcagttccacctgatggagctgaacaggagcgtgtgcctggaatgtccagagttccagatcccatggttccatgaccgattttgccagcaatataacaagggcatcggaggcatggacggcacacaacagcaaatttttaaaatgttagcggaggtgctgggcgggataaattgcgtaaaggcatctgtcctcactccctactatcataaggtggactttgagtgcatactcgacaagcgcaaaaagccccttccttatggcagccacaatatcgcactgggccagctgcctgagatgccctgggagagtaatattgagattgtaggaagtcgccttccccccggcgccgagcgaatagcattagaattcctagattccaaggcgctgtgcaggaacattcctcacatgaaagggaagagcgcaatgaagaaacgccatcttgaaattttgggataccgggtgatccaaatttcacagttcgagtggaatagcatggccctcagtaccaaggatgctagaatggattatttgcgggaatgtatattcggcgaggtcaagtcctgtctctag

SEQ ID NO: 26279 - DNA, 2415 bp, Artificial Sequence
  Description of Artificial Sequence: Synthetic coding sequence
atgaagaaaaccccggtttttttggagtctctcgtgacgaatatgcttagactccgcgcgatttgtcctttcagctggagggtatttcagttcagacccataagttgtgagcccttgatcattcagatgaacaagtgcaccgacgaagaacaaatgtttgggttcattgaacgcaataaggccattctgagcgagaaacaggttgggtgcgcgttcgatatgctgtggaaactgcagaaacaaaaaactagtttgctcaagaacgccgaatatgttagggaccatccgcagttcctcactctacacaatctggccacgaataaatttaagctgatgaatgatgatacactcgtgaatgttctctacgtaacacagcagttcgccggcgaggcccacgatccgctggtcgaggccttggtaaccgaagcatggcgcagactggaacgatttgatattaagctcctgtctgagttctcttcatgcctggccgatcaacacctctacttcagtccattaatgggcaaaattgccgacattgtacacaggaacttggagactacacaagatcttagttcactttctgtgctaatggtcaatatctccagcctcatctctcggcactttcagcagcagcttgtgaacaagacagagctgctgtttgacacgatagatagttccgaggtgaacgtagcgaaaagtatcgctaagttcctgagaaacgtcaggtacagatatcagcctctgctggaacgctgtaacaatgtctttctctccaacgtcgaccacctggatctggacagcatttctaaaatcctctccgtgtataagtttctgcagtttaacagctttgagttcattatcatggccaaaaagaaattgaccgaaatgatccctttgtgcaaccatcccgcgagttttgtgaaattattcgtagccctaggaccaattgcaggccccgaggaaaaaaagcagctgaagtccaccatgcttctgatgagtgaagacctgaccggcgagcaggccctcgccgtgcttggagccatgggcgacatggaatctagaaattcttgcctgatcaagcgtgtgacatccgtgctgcacaagcacctagacggctataagccacttgaactcttgaagattacccaggagctgacattcttacatttccagagaaaagaattttttgcaaaactgagagaactgctgctcagctatctgaaaaacagttttatccctactgaggtcagtgtgcttgtgagagctatttctctgcttccctcaccccatcttgatgaagtgggcatctcacggattgaggcagtgctgccccagtgcgatctcaacaacctgtccagcttcgctacgagtgtgctccgctggatacagcacgaccacatgtatttagataatatgaccgccaagcagctgaaattgctgcagaaactggatcactacggccggcagaggcttcaacatagcaactcccttgacctgttgagaaaggagttaaagtccctgaagggcaataccttccctgagtctctattagaggaaatgattgcaacgctccagcactttatggatgatattaattacattaacgtcggtgagattgccagcttcatctcgagtacagattacctctcgaccctactgctggacagaattgcatctgtggcagtgcagcagatcgaaaagattcatccctttaccatccccgcaattatccgccccttcagtgtactgaactacgaccccccgcagagggatgagtttctcggcacctgcgtccagcacttgaattcttacttaggaattctggatccttttatcctcgtgtttctgggctttagcctcgcaactctagagtacttcccagaagacctactgaaggccatatttaacatcaaatttttggcccgtctagactctcaacttgaaagcatcggaggcatggacgggactcagcaacaaatctttaaaatgctggccgaagtcctcggcggcatcaattgtgtgaaagcatccgtgctcaccccctactaccataaggttgactttgagtgcattctggacaaacgcaagaagcctctcccttatggctcacataacatagctctgggccagctccctgagatgccatgggagagtaatatagagatagtaggttcacgactcccccctggtgccgaaagaatagccttagaatttctggattctaaagcactgtgcaggaacataccacatatgaaaggcaaatccgcaatgaagaaacgccacttggagatcttgggttatagagttattcagatcagtcagttcgagtggaacagcatggcgctgagtactaaagacgcccgtatggactacctgagagagtgtatcttcggcgaagtcaagtcatgcctttag

SEQ ID NO: 26280 - DNA, 1989 bp, Artificial Sequence
  Description of Artificial Sequence: Synthetic coding sequence
atggccctgattaccctcagaaagaatctgtacagactgtcagatttccagatgcaccgcgccctggcagctctgaagaacaaacctctaaatcatgttcacaaggttgtcaaagagagactgtgtccttggctgtgttctaggcagcccgaaccgtttggcgtgaagttccatcacgctcactgcaagaagtttcattccaaaaatggcaatgacctccatcctctcggcggacccgtgttctcacaggttagtgactgtgaccggctggaacagaatgtcaaaaacgaagagtctcagatgttctatcgaagactgtcaaatctgaccagctctgaggaggtgctcagctttatatctaccatggagaccctccccgatacaatggcagccggggctctacagaggatttgcgaggttgagaagaaagacggtgatcagggactgcctaaagagatattggaaaattccatcttccaggcactttgcttccaattcgagaaggaaccatctcagctgagcaatacttctctcgtgactgcgctgcaggcgctgatcttattacacgttgatcctcaatcatccttgctcctcaatttggtcgccgagtgccagaaccggctgcgtaaaggagggatggaagtccgaaacttatgcattctgggcgaaagcttgattaccctccacagcagcggctgcgtcacactcgagctgatcatcaaccaactccagggtgagaaactcgaaacatttacaccagaagatatagtggcactctatagaattctgcaggcctgtaccgaaaaggtggacgagcatcaaacgttcttaaacaagattaacaacttctcattatccattgtctccaatctgtctccaaagctcatctcacagatgctcaccgcacttgtggttctcgaccagagtcaggccttccctttgatcattaagcttggcaagtatgtagttcgacatgtgccccactttaccaacgaggagttgaggagagtgttggaagccttcatatatttcggacatcacgacactttttttaccaaggctttagaacaccgagtcgctgccgtttgccttactctggaccccgaggtggtgtgccgcgtgatggaatactgctccagggagctcatcctatccaaaccgatactcaacgccgtggcagaaacctttgtttgtcagacagagaaattctcaccaaggcagatttcggcccttatggagccattcggtaagctgaactacctgccccctaatgccagcgcgctctttaggaagctcgagaacgttttgttcacccattttaactacttcccccccaaaagcttgctgaaacttctacacagttgtagtcttaatgaatgtcaccccgtgaactttttggctaagatctttaagccactgttcctccagcgactccagggcaaagagtctcacttggacacgctcagcagagcccagctcactcagttatttttggcctcagtgttggagtgcccattttataaaggccccaagctcctgcccaagtatcaggtcaaaagctttctgactccttgttgtagcctggaaacccctgtggattcccagttgtaccgatatgttaaaataggactgacaaatctacttggcgccaggctttatttcgctcctaaagtcctcacgccctactgttacacgatcgacgtggagattaagctggatgaagaaggatttgtcctaccaagcactgccaacgaagatatccataagcgcatcgccctatgtatcgatggcccaaaacgcttttgctctaactctaagcacctactcggtaaggaagcgatcaagcagcggcacttgcagctactgggctaccaagtggtccaaataccctaccatgagatcggtatgctaaaatcaagacgggagttggtagaatacctccagcggaagctgttcagccagaatactgtgcattggctgcaggagtag

SEQ ID NO: 26281 - DNA, 738 bp, Artificial Sequence
  Description of Artificial Sequence: Synthetic coding sequence
atggcacttatcacccttaggaaaaacttgtatcgactgtccgacttccaaatgcatcgggctctggctgccctgaagaataaaccattgaaccatgtgcataaagtggtaaaagaaaggctatgtccatggctgtgcagcagacagcctgaacccttcggggtcaaatttcaccacgcccactgcaaaaagtttcacagcaagaatggtaacgatttacacccactgggcggccctgtcttttctcaggtgagtgattgcgataggttggagcagaacgttaagaacgaagagtcacagatgttctatagaagattgtcgaacctgacctcaagcgaagaagtgctgtcctttatcagcacaatggaaactctgcccgatactatggctgctggggccctgcagcggatttgtgaagtcgaaaaaaaggatggcgaccaaggtttacctaaagagattctcgagaacagcatctttcaggctctgtgcttccagtttgagaaggagccaagccagctgtctaacacatcactggtcaccgctcttcaagccctgatcctgctgcacgtggatccccaaagctctctgctcctgaatctggtggcagagtgtcagaacagactgcggaagggtgggatggaagtccgcaatctatgtattctgggagagtcactaataaccctgcatagcagcgggtgcgtgactctggaactcatcatcaaccaactgcaaggctag

SEQ ID NO: 26282 - DNA, 879 bp, Artificial Sequence
  Description of Artificial Sequence: Synthetic coding sequence
atggagagagggcctgtggtgggggctggattgggagcaggtgcccgcattcaagccctactgggctgtttgctgaaggtccttttatgggtcgcatccgcactgttgtattttggcagtgagcaagctgcgcgccttcttggaagcccttgtctacggagactataccacgcgtggctcgcggccgtggtcattttcggccctctgctccagtttcacgtgaacccgaggacgattttcgcctctcatggtaacttctttaatatcaaattcgtgaactctgcttggggctggacctgcaccttccttggtggcttcgtgctgctcgtagtgtttctggccacacggcgtgtggcggttacagctagacatctcagtcggctagtggtcggcgcggcagtttggaggggcgcgggccgcgcctttttgctgattgaggacctgaccggttcctgcttcgagccactgccccaaggactgctcttgcatgaattgcccgaccgtcgatcgtgcctcgccgcaggccaccagtggaggggatatacagtctcatcacacaccttccttctgactttctgctgcctgttgatggcagaagaagcagcagtgttcgcaaaatacttggctcatggactgcctgctggagccccattgcgccttgtcttcctgctgaatgttctccttctgggactctggaacttcttactgctctgtaccgtgatttacttccatcagtacacacacaaggtggtgggcgctgcagtaggcacctttgcctggtaccttacctatgggagctggtaccatcagccctggtctccggggtcaccaggacatggattgtttccccgccctcacagttcccggaaacacaactag

SEQ ID NO: 26283 - DNA, 789 bp, Artificial Sequence
  Description of Artificial Sequence: Synthetic coding sequence
atggaacacctcgaacgttgtgagtggttgttaaggggcacactggtgcgtgcagccgtgaggcgctacctaccctgggcactcgtagcgtcaatgctggccggatcactccttaaagaactgtcacccctccccgaaagctacctgagcaataagcgaaacgttctgaacgtatactttgtgaaagtggcttgggcctggacattctgtctgctccttccctttattgctctgaccaactaccacttaaccgggaaagccggccttgtcctcagacgtctgtcaacgctgctcgtgggaacggcaatatggtacatttgcacttccatcttttccaacattgagcactacacaggctcttgctatcagtcccctgcccttgaaggcgtgaggaaagagcaccaaagtaagcagcaatgtcatcaagaaggcggattttggcatggttttgatatttccggacactccttcttactgaccttctgtgctctgatgatcgtggaagagatgagcgtgctgcacgaggtgaaaaccgatcgcagccattgtctgcacactgccatcaccactctggtggtggcccttggtatcctgacgttcatttgggttcttatgttcctctgcaccgccgtgtactttcacaacctctcccagaaggtcttcggtacactgttcgggctgctctcctggtacggtacatacggattctggtatccaaaagccttttctcccggattaccacctcagtcttgctcacttaatctgaaacaggatagctacaaaaagtag

SEQ ID NO: 26284 - DNA, 1053 bp, Artificial Sequence
  Description of Artificial Sequence: Synthetic coding sequence
atggagcccacagagccaatggaaccgactgaaccgatggagccagcccgctctgcccatcggggcggagaagccctgctgagggagctcgaagtgctggtgcaagacgtcgtgcggacctcaagctggtgggagaggcacggggttgattgtgctatattggcactgagtttgttcgcgctgccagccggctttctttgcctccggtgggagaacgctctcgtgttcgcttctggaatcactattctgggggtgtgccattacactttgacggtaaagggatcccatcttgccactcatggggccctgactgagagtaagaggtggtccaaaatctggttgttgttctttgtagaggtgtgcacggcttttacagccgagcacgccacacacggacatgtgaaaatgcatcacgcatataccaatgtggtcggcttgggtgatagctctacgtggaggctgccctgcctgaatcgttacgtctatatgtttttggcccctttcctgctgccaattgctacccctttggtggccgtggagcggctgaggaaggttgagctggggacagccctgagaactttagctctgatttccctcggactctacagccactactggttgctgttaaatgtgtccggtttcaagaacccaagctccgcgctcggctgtatgttcttgaccaggtccctccttgctcatccttacctacacgttaatatctttcagcacatcgggctacccatgttcagccgggataacaaaccacgcagaatccatatgatgagtctgggcgtcctgaacttggctaggctgcccgtcctggactgggcgttcgggcattctataatatcctgtcacgtggagcatcatctgtttcctcggctgtctgacaatatgtgcttgaaggtgaaaccagtcgtaagccagttcctcagagagaagcagctaccttacaatgaggattcttatttagcgcgatttcaattgtttctcagaagatacgaggagttcatggtacaggcccctcccatcacagagcttgttggcctctag

SEQ ID NO: 26285 - DNA, 615 bp, Artificial Sequence
  Description of Artificial Sequence: Synthetic coding sequence
atgcaggggctgcggcgatgggggtgcagccctggtagtcaacgttcctgcatagcacagttgtgcttgactggtacgccggttagttttctcgtgccttcatcacgctgtgcacagccgtctctgcagagcaccccaagaatgggcacttccagatgtacaatgcccacccccacttggtgggcctggggcacacctgcccggggaggctgtttggctagcaccgccatgtccacatgttccctcctgctttcaagctctcctagtcctcttcactggtggctctcccatatcggcctcccaatgttcagccgggacaataaacctcgtcgcatccacatgatgtccctcggcgtgttaaatctagcgagactacctgttttggactgggcattcggacacagtattatatcttgccacgtggagcaccacctgttccctcgcctgtccgacaacatgtgtctgaaggtaaagcctgtggttagtcaatttctcagagagaaacagctaccgtataacgaggattcatacctggcccgatttcagctattcctgaggcgttacgaagagtttatggttcaggccccacccattactgaacttgtgggcttgtag

SEQ ID NO: 26286 - DNA, 1548 bp, Artificial Sequence
  Description of Artificial Sequence: Synthetic coding sequence
atggtttctatccccgagtattatgagggcaaaaacgttctgcttacaggtgcaaccggatttctgggaaaagtactcctggaaaaactgctgaggtcatgtccaaaagtgaactctgtgtacgtgttagtccgacagaaagccggacaaacgcctcaagaaagagtagaggaggtgcttagtggcaagctctttgatcggctgagggacgagaacccagattttagggagaaaataatcgccatcaactctgagcttacccaacctaagttagccttatctgaggaagataaggaagtgattatcgactctacaaacatcatttttcactgcgcggctactgttcgatttaatgaaaacctccgggatgctgttcaactcaatgtcatcgccaccaggcagttaatcctcctggcgcagcagatgaagaacttggaggtcttcatgcacgtcagcaccgcatacgcgtactgcaatagaaaacatatcgacgaagtggtgtaccccccacctgtggaccctaagaagctgatcgactccctggaatggatggacgatggcctggttaatgatatcacacctaagcttataggagacaggcccaatacgtacatatacactaaagcactggctgaatacgtggtgcagcaggagggtgcaaagctcaacgtagctattgtgcggccttccattgtgggggcctcctggaaggagccgttcccagggtggatcgacaactttaatggccctagcgggctgtttattgctgcaggaaaagggattttacgcacgatccgggcgtccaacaatgctctggccgacctagtgcccgtggacgtcgtggtcaatatgtcacttgccgccgcttggtatagcggtgttaataggcctcgaaatatcatggtgtataactgcaccactggcagcacaaaccctttccattggggagaggtagaatatcacgtcatttcaacgtttaagcggaaccccttggagcaggcatttagacggcctaacgttaatctaacatccaatcacctgctgtatcactattggatcgccgtgtcacacaaagcccccgcctttctgtacgacatctatttgcgaatgactggtcgcagccccagaatgatgaaaactattactcgcctccacaaagcaatggtattcctcgaatattttactagcaactcctgggtatggaatacagaaaatgtcaacatgttaatgaatcagctcaatcccgaggacaagaagacatttaacatcgatgtgcggcagcttcactgggcggaatacatagagaattactgtttgggtaccaagaaatacgtactcaacgaggaaatgagcggcctcccggccgctagaaaacatttaaacaaactgagaaacatcagatatggatttaacaccatactggtaattctgatctggcggatcttcatcgcccgctcccagatggcacgcaacatatggtactttgtggtgagcttatgttataaattcctgtcctactttcgagccagctctactatgcgctattag

SEQ ID NO: 26287 - DNA, 1029 bp, Artificial Sequence
  Description of Artificial Sequence: Synthetic coding sequence
atggtgtccatccctgagtattatgagggcaaaaatgtgcttctgacaggcgccacaggctttctcggcaaggttctgttagagaagcttcttaggagctgtcccaaggtgaattcagtgtacgttttagtcaggcagaaagccggccaaaccccacaggagcgggttgaggaagtactctccggcaaactgttcgacagacttcgcgatgaaaaccctgattttagagaaaagattatagcaatcaactctgaactgacacagcctaagttagccctcagtgaggaggataaagaagtcattattgatagtacaaacattatttttcactgcgccgcaaccgtgcgcttcaacgagaacctcagagatgctgtccaactgaatgtaatcgctacccgtcagctgatactgttagcacagcaaatgaaaaatctggaggtgtttatgcatgtctctaccgcatatgcatactgtaatcgcaagcacatcgatgaggtggtctacccacctcctgtggaccccaagaaactaatcgactcattggagtggatggatgacggactcgtgaatgacattaccccgaagctgattggcgaccggcctaacacatatatctatactaaagccttggctgagtacgtggtgcagcaggaaggggcaaagctcaacgttgcaattgtccgcccgtcaattgtcggtgcctcatggaaagagccgttccccggttggatcgacaactttaacggaccttctggtttattcatcgctgctggcaaaggaatacttcggaccatccgcgcatccaataatgcccttgccgacttggtgccagtcgacgtggtggtgaacatgtcccttgcagctgcatggtacagtggcgtgaataggcctcgcaatatcatggtgtataactgcaccacagggtccaccaatccgttccactggggagaagtcggcatgatcttacctgtgtttctgaacgtccggatcaacctcaaggagcctcgaaagaagaaaaagaagaagtag

SEQ ID NO: 26288 - DNA, 1548 bp, Artificial Sequence
  Description of Artificial Sequence: Synthetic coding sequence
atgagcacaatcgccgctttttatgggggcaagagtattcttataactggggccactgggttcttagggaaggttctcatggagaaactgtttcgtacctctcctgacttaaaggtgatatacattctcgttcggcccaaagccgggcaaacgcttcagcagcgcgtattccaaattctggactccaagctttttgaaaaggtgaaagaggtttgtccaaacgtgcacgaaaagatccgcgcgatttacgcagacttgaatcagaatgatttcgcaatctcgaaagaagacatgcaggagcttcttagttgtaccaacatcatctttcactgcgcagctaccgtccggttcgacgataccttgaggcacgcggttcagctcaatgtgacggccacaaggcagttgctgcttatggcatctcagatgcctaaattggaggctttcatccatatcagcacagcatattcgaactgcaacctgaagcacatcgacgaggtgatctatccatgcccagtggagccaaagaagataatcgattcccttgagtggctcgacgacgcaattatagatgagatcaccccaaaactcattcgtgattggcccaatatctatacatacaccaaagcattgggagaaatggtggtccagcaggagagtagaaatcttaatattgctattatacgccccagtatcgtaggcgctacatggcaggagccctttccgggttgggtcgataacattaacggcccaaatggaattatcatcgccacgggaaaaggattcctgcgggccattaaggccactcccatggccgtggccgacgtgatccccgtggatacggtggttaatttgatgctggccgtcggatggtacacagccgtacatcggccgaaatcgacattggtgtatcacataacatcaggaaacatgaatccatgtaactggcacaaaatgggcgtccaggtgcttgctacctttgagaagatccctttcgaacgacccttcaggcgcccaaacgctaacttcaccagtaactccttcacctcacagtattggaatgccgtgagtcaccgagcccccgccatcatctacgactgttatctgaggcttactggtcggaagcctcgcatgactaaacttatgaatcgcctcctgcgaacagttagcatgctggaatactttattaaccgtagttgggagtggtcaacatataacacagagatgctaatgagcgagctctccccggaggaccaacgggtctttaacttcgacgtaaggcagcttaattggttggagtatattgagaactatgtgttaggcgtgaaaaaatacttgcttaaggaggatatggccggtatccctaaagccaagcagagactaaagcgcctgcggaacatccactacctgtttaatacagctctctttctcatcgcctggcggttgctcatcgcccggagccagatggcgcggaacgtgtggttcttcatcgtgtccttctgttacaaattcctgtcctatttcagggcctcatcaaccttgaaagtatag

SEQ ID NO: 26289 - DNA, 1548 bp, Artificial Sequence
  Description of Artificial Sequence: Synthetic coding sequence
atgtctacaatagctgccttctacggaggcaagagtatactgattaccggcgccaccgggtttctcggtaaagtgctcatggagaaattgttccgcactagccctgatctgaaagtgatttacattctggttcgtcctaaggctggccagacactgcaacaacgcgtcttccagatccttgatagcaaattgtttgaaaaggtgaaagaggtgtgccctaatgttcacgaaaagatcagggccatctacgccgatctgaaccaaaatgacttcgctatcagcaaggaagacatgcaagagttactgtcttgtactaatatcatcttccattgcgcagccacagtgcggtttgatgacactctcaggcatgctgtacagctgaatgttactgcgacacgacagctcctgttgatggcgtcacagatgcccaagctggaagccttcattcatatctccaccgcctattcaaattgcaacttaaagcacattgatgaggtgatctatccctgtccggtcgagcccaagaagattattgattctctcgagtggctggacgacgcaatcatcgacgaaataacccctaagctgattcgcgattggcctaatatatacacatacacaaaggccctgggcgagatggtggtgcaacaggagtctcgtaatctgaacattgctatcatccgccccagcatcgtgggggccacatggcaggaaccgtttccaggctgggtggacaatatcaatggtccaaacggtatcattatcgccactggcaagggatttttgcgcgctataaaggctacgcctatggccgtggccgatgtcataccagttgacactgttgtgaacctgatgcttgcagtggggtggtacaccgccgtacatcgccctaaaagcacattagtttaccacatcacttcaggcaatatgaatccatgcaattggcacaaaatgggggtgcaagtgcttgccaccttcgaaaaaatccccttcgagcgaccctttaggcggcccaacgctaatttcaccagtaactcattcacaagtcaatactggaacgcagtctcccaccgagcgccggccattatctatgattgctatctaagactcactggtaggaagccacgcatgaccaagctgatgaacaggctgctcagaacagtttctatgctcgaatacttcataaatcgctcctgggagtggtctacctacaatactgaaatgcttatgtccgagttgagtccggaggatcagcgggtgttcaactttgacgtgagacaactgaactggttggagtacattgagaattacgtactgggagtcaaaaagtatctcttgaaagaagacatggccgggattccaaaggcgaaacagagactaaagcgtcttaggaatatccactacctattcaataccgctctttttctcatcgcatggagactcctgattgctcgctcccagatggctcggaatgtctggttcttcatcgtttccttttgttataagtttctgtcatatttccgtgcttcttcgactctcaaggtgtag

SEQ ID NO: 26290 - DNA, 609 bp, Artificial Sequence
  Description of Artificial Sequence: Synthetic coding sequence
atgttactgtggtcgcttctggtgatcttcgagagggttagggagaatctagatagcctaactctggttgcaccgagctctgtgttcgagggagattctatcgtgctgaagtgccagggggaacagaattggaagattcagaaaatggcataccacaaagacaacaaggaactcagtgtgttcaagaagtttagtgattttttgattcagagcgcagtcttatccgattctggtaattatttctgctccaccaagggccagctgttcttgtgggacaaaacctctaacatcgtgaaaataaaggtgcagggtcctgatgggtaccgcagggatcttatgactgccggtgttctttggggcctgttcggcgtactgggatttacaggcgtagccttattgctgtacgccttgttccacaagataagcggagaatcgtccgccaccaacgagccccgcggggctagcaggcctaacccccaagagttcacttacagcagtcctacccctgacatggaggagctgcagccggtatacgtaaatgcaaatataaggactctgctcgagaataaggactctcaggtgatttattcttccgtcaagaaatcctag

SEQ ID NO: 26291 - DNA, 1527 bp, Artificial Sequence
  Description of Artificial Sequence: Synthetic coding sequence
atgctcctgtggagcctgcttgtaatcttcgatgcagtgaccgaacaagcagacagcttaacattagtggctccctcctcagtgttcgaaggcgattctattgtgctcaaatgccagggcgagcagaattggaagattcagaagatggcctaccacaaagataacaaagagctctcagtctttaaaaagttctccgatttcctgattcagagcgctgttctgagtgattcaggcaattacttttgctcgacaaaaggacagctgtttttatgggacaagacctctaatatagtgaagattaaagttcaggagctattccagcgccccgtgctcacagcttctagcttccagcctattgaaggaggacctgtatccctcaaatgtgagactaggctaagtcctcaacggctcgacgtccagctccaattctgttttttccgggagaatcaggtgttggggtccggctggtccagctcacctgagcttcagatcagcgctgtatggagcgaagatacgggtagctactggtgtaaagctgaaaccgtaacccaccggatccgtaagcagtccttacagtcccagattcacgttcaacgtatccccatttcgaacgtcagcctcgagattcgggcgccgggaggccaggtcacggagggacaaaagctgatcctcttgtgctcagtggccggcgggacaggaaatgtaacattttcatggtacagggaggcaacaggaacaagcatgggtaagaaaacacagcggtctctgagtgcagagctggagatcccagcggtgaaggagagtgatgccggaaaatattactgtcgtgccgacaacggccacgtgcctattcagtcaaaagtagtgaatatacccgtaagaattcccgtaagcagacccgtgttaactttaagaagccccggcgcacaggcagctgtgggggacttactggaattgcactgcgaggcccttcggggatctccgcctatcctctaccagttctaccacgaagacgtcactctcggaaactccagtgccccttccggcggaggcgccagctttaaccttagtctgactgccgaacacagcggcaactattcttgtgaagctaacaatggactcggagctcagtgtagcgaagctgtccctgtgtctatcagtgggcccgacggttacagacgcgatctgatgacagcgggagtgctgtggggactcttcggtgttcttgggttcacaggagtggcccttctcttgtacgcacttttccacaaaatctccggcgagagctccgccaccaatgaaccacgtggcgccagccggcccaacccacaggaatttacctacagttcccctacacccgacatggaggagttgcagccagtttacgttaatgtgggttcggtcgatgtggatgtggtttactcccaagtgtggtccatgcagcagcccgaatcttccgctaatatcagaacgctgttggaaaataaggattcccaagtgatatacagctcggtaaagaagagctag

SEQ ID NO: 26292 - DNA, 609 bp, Artificial Sequence
  Description of Artificial Sequence: Synthetic coding sequence
atgttactgtggtcgctcttagtcatttttgacgccgttacagagcaagcggatagcctgaccctcgtggccccatcctctgtgtttgaaggagacagcattgtgcttaagtgccaaggtgagcagaattggaaaatccagaagatggcatatcataaagacaacaaggagctttccgtttttaagaaattcagcgactttctaatccagtcagcagttttgtcagactccggtaattatttttgcagcacaaaggggcagctgtttctgtgggataagaccagtaatatagttaaaatcaaagtgcaaggccccgatggctaccgtcgcgacctgatgactgcgggggtcctgtggggactgttcggggtactcggctttacaggagtggccttgctgctgtacgcgctttttcacaaaattagcggcgaatcctctgcaactaacgagccccgaggagcatcacgccccaatccccaggaatttacgtactccagccccaccccagatatggaagaacttcagcccgtctatgtcaacgcaaatattaggacactcctggagaacaaggactcacaagtaatctactcctccgtgaaaaaatcatag

SEQ ID NO: 26293 - DNA, 1335 bp, Artificial Sequence
  Description of Artificial Sequence: Synthetic coding sequence
atgctcctgtggagcctgctagtgatctttgatgctgttacagagcaggccgactctctgaccttggttgcaccgtcaagcgtgttcgaaggtgatagcatcgtgttgaaatgccagggtgaacagaactggaagatccagaagatggcctaccataaagacaacaaagagctgtctgtgttcaaaaagttcagcgatttccttatccagtcagccgtgctgagtgatagcgggaactatttctgttctacgaaaggtcagctctttctgtgggataagacatcaaatatcgtcaagatcaaagtgcaagaattattccaacggccagtgctgacagctagctcatttcagccgattgaaggaggtcctgttagtctgaagtgcgagacacgcctttctccccaacgcttggacgtgcagctgcagttctgcttttttcgggagaaccaagtcctaggcagcgggtggtcaagctctccggagctgcaaatctccgccgtgtggtcggaggatacaggctcctactggtgtaaagctgagaccgtgactcatcggatccggaaacagtcactgcagtcgcagatacacgtgcagaggatccccattagcaatgtttcgttagagatcagggcgccagggggccaggtgacagagggacagaagctgatactcctgtgctccgtcgccggcgggacaggcaacgtcacgtttagttggtatcgcgaggcaactggaacgtccatggggaaaaagacccagagaagcctgtccgctgagctggagattcccgctgtcaaggagtccgacgccggtaagtattactgccgcgcggacaatggtcacgtacccattcagagcaaagttgtcaatattcctgtgcgaataccagtctcaagacctgtgctgacgctgcggtcccccggggcacaggccgctgtaggcgatctgctagagctgcattgtgaagcgctgcgtgggtcgcctcccattctgtatcagttctatcacgaggatgtgactctggggaattctagtgccccgtccgggggtggagctagtttcaacctttccctgaccgccgagcactcaggaaactatagttgcgaagcaaacaacgggctgggtgcccaatgcagtgaggcggttcctgtgagcataagtggccccgatggataccgacgggatctgatgactgccggcgtgctgtggggcctctttggggtgctgggattcacgggcgtggccctgctgctctatgccctttttcataaaattagcggcgaaagtagcgctaccaacgagcccaggacaccgaaaagcagcacccttctatag

SEQ ID NO: 26294 - DNA, 579 bp, Artificial Sequence
  Description of Artificial Sequence: Synthetic coding sequence
atgtgggagtggaaaatttgtaactctcacggggcccggccattcgcagaacccgctgggtgggagtttgtgaacctccttcgacaccacaagtccttcctcatagctcctctgtgcctatcagtgccagtcagccgacccgtgttgactctgcgcagccctggggcgcaggccgcagttggtgacttacttgagttacattgtgaggcactacggggaagcccgccaatactgtatcagttttatcacgaggatgtgactctgggaaattcaagcgccccctcaggggggggtgcatcattcaatctaagcctgaccgccgagcactccggaaattattcctgtgaggcgaataatggcctaggggcccagtgtagcgaggccgttccagtaagcatcagcggtcccgacggatatagacgggacctcatgaccgcaggggtgttgtggggattgttcggggttcttgggttcacaggtgtggctcttttgctgtacgctctgttccacaagatctctgggtgcatctaccatctggattctccatactttgcgatgaccttccctctgctcatttag

SEQ ID NO: 26295 - DNA, 2124 bp, Artificial Sequence
  Description of Artificial Sequence: Synthetic coding sequence
atgttactttggctgttgctgctgatattgacacctggcagggagcaatctggcgtggctccaaaagccgtcctgctgctgaatcctccctggagtactgccttcaaaggggagaaagtggccctgatctgctcctccatatcccactcattagctcagggggatacgtactggtatcacgatgaaaaactgctcaagatcaagcatgataaaattcagatcacagagccagggaattaccaatgcaaaacccggggtagctctttgagcgatgctgttcatgtggagttttctccagattggttgatcctacaggcactgcacccggtcttcgagggcgataatgtgatcctgcgctgtcagggcaaggacaacaaaaatacccatcagaaggtctactataaagatggaaagcagctcccgaacagctacaatctggagaagatcacagttaattcagtctcccgagacaactccaaatatcattgtacggcgtataggaagttctatattctggacattgaggtgacaagcaagccccttaatatccaggtgcaggagcttttcttacaccccgtgttaagggcatcttcttcaactcccattgaggggagtcccatgaccctgacttgcgaaacacagctgagtccccagaggcctgacgttcagcttcagttctccctgttcagagactcccagactttgggacttgggtggtccagaagtccccggctccaaatcccagctatgtggaccgaggattcaggctcatactggtgtgaagtcgagaccgtcactcacagcatcaaaaagcgatccttacgctctcagattagagtccagcgggtgccagtgagtaacgttaaccttgagatcaggcctactgggggacagttgatcgaaggtgaaaacatggtcctgatttgttcagttgcacaggggtcagggaccgtcacgttttcgtggcacaaagaaggcagagtgagaagcttgggacgaaagacccagaggtccctgctagcagagctacatgtcctcactgtgaaggagagtgacgctggacgctactactgtgctgccgataacgtccatagccccatactctctacatggatcagagttacggtccgtatcccagtttcccaccccgtgctgactttcagagcccctagggcacacacagtcgttggcgacctgctcgagttacactgtgagtctttgaggggatctccccccatcctctatagattctaccatgaggacgtgactcttggcaattccagcgccccatcgggcggtggggcatcatttaacctgagtctgaccgccgagcactcgggaaattactcttgcgacgccgacaatgggcttggggcgcagcattctcacggcgtgtctcttagagtgacagtgcccgtctcaagacccgtgcttacgctgcgtgccccaggagctcaggcggttgttggggacctgctggagctgcactgtgagtctctgaggggatcttttcccattctttattggttttatcacgaggatgatacacttggtaacatctctgcccacagcggaggaggcgcctcttttaacctttccctcaccacagaacatagtgggaactattcatgcgaggcggacaatggactcggggcccagcactccaaagtggtgacgctgaacgtgaccgggacgagtcggaacaggactggcctgaccgccgcggggatcactggactcgtgctcagtattcttgtgctggccgccgccgcagccctgctccactatgccagagcaagacgaaagcccggcgggctgtctgcaactgggacttcatcacactccccgtcagaatgtcaggagccgagctcatctcggccctctcggattgaccctcaggagcctacacatagtaagcccctggcccccatggagctcgaacccatgtactcaaatgttaaccccggcgacagtaaccccatatatagccagatatggagtatccagcacacaaaagagaactctgcaaactgcccaatgatgcaccaggagcacgaggagctcactgtactctactcggagctgaaaaaggagcagtcttctcgattcagtatgagtctatag

SEQ ID NO: 26296 - DNA, 2205 bp, Artificial Sequence
  Description of Artificial Sequence: Synthetic coding sequence
atgttgctttggctcctactcctcattctcactcccggcagagagcagagcggtgtcgcccccaaagccgtcctcctactgaaccctccttggagtacagccttcaagggcgaaaaggtcgcactcatatgttcatctatttctcacagcctggcccagggggatacctactggtatcacgatgaaaagctgctcaaaattaaacacgacaagattcagataacagagcccggcaattaccagtgtaagacaagaggaagctctctgtccgacgctgtccatgtagagttttcccccgattggttgattttgcaggccctccaccccgtgttcgagggagataatgtcatcctccggtgccagggcaaggataacaaaaacactcaccagaaggtgtattacaaggatggaaagcagctgcccaatagctataacttggagaaaatcacggtgaacagcgtgagccgagataactcaaagtaccactgcacagcctaccgaaaattctacattttggatattgaggtgactagtaaaccacttaacatccaagtgcaggagctgttccttcaccctgtattacgcgcatcatccagtactcctatcgaaggttcccccatgaccctgacttgtgagacacagctgtctccccagcggcccgatgtccagctccagttctcactttttcgcgactcacaaacacttggccttggttggagccgatccccacgcctccagatccccgcaatgtggacagaagactccggctcatactggtgtgaggtcgaaaccgtcactcatagcattaagaaacggtctctaagaagtcagattcgggttcagagggtgccagtctccaatgtgaacctggaaattaggcccactgggggccaattaatcgaaggcgaaaacatggtgttgatctgctccgtggcgcaggggagtgggactgtgacattctcatggcacaaggagggacgggtccgctcactaggccgtaagacacagagaagtctgctcgccgagctgcacgtactgacggtaaaagagagcgacgctggtcggtattactgcgccgcagataacgtccattccccgattctgtccacctggatccgggtgactgtacgcatccccgtcagtcacccggtgctgaccttcagggcgcctcgggcacacaccgtagtgggggacttgcttgaactgcattgtgagagcctgaggggcagtccacccattttgtaccgtttttaccatgaggatgttaccttgggaaactcatcggccccatcagggggtggtgccagtttcaatctgagtcttaccgcagagcactctggcaattattcttgcgacgccgacaatgggttgggcgcgcaacacagccatggagtgtccctcagggtgactgtccctgttagccgccctgttctgacactccgggcacccggggcccaggccgtcgtgggcgatctactggagttacattgtgagtcattaagagggagctttcccatcctgtactggttctaccatgaggacgacacactgggcaacatctccgcgcattctggtgggggagcttcctttaatctatctctgaccacagagcacagcggtaattattcctgcgaagcggataatgggctcggagcccagcactccaaagtggttaccttgaatgtgaccggcacaagccggaatcgaactggcctgacggccgcggggataaccggtctagtgctttccattctcgtgttggccgccgccgcggctctgctgcattatgcacgagcaaggcgaaagcccggcgggctgagtgctaccggaaccagttcccattctccgagcgaatgccaggaaccgagctccagtcgacctagcaggatcgatccccaagagcccacgcatagcaagcccctggcgccaatggagcttgaacctatgtacagcaatgtcaaccctggagactcgaaccccatttacagtcagatctggtccatccaacatacaaaggaaaattccgctaattgcccgatgatgcaccaggaacatgaggagctcactgttctctatagtgagctgaagaagactcatcctgatgactcagcaggcgaagcatcttctcggggtcgcgcccatgaagaagacgacgaagagaactatgagaatgtgcccagggtgcttctggcatcagaccattag

SEQ ID NO: 26297 - DNA, 2229 bp, Artificial Sequence
  Description of Artificial Sequence: Synthetic coding sequence
atgttgctttggcttctgcttttaattctcacacctggccgagaacagagtggggtcgcccccaaagcagttttactccttaacccaccttggtcaacggccttcaagggcgaaaaggtcgcattgatctgcagctctatttctcactctctggcacaaggcgacacatattggtaccacgatgagaagctgctgaagattaaacacgacaagattcaaatcacagagcccgggaactatcagtgtaagaccagaggcagtagtttatcggatgcagtgcacgtagaatttagtcccgactggttgattctccaagccctgcatcctgtgttcgagggcgacaacgtaattcttagatgccagggcaaagataacaagaatactcaccaaaaggtgtactacaaggacggaaagcagctgccaaactcttacaacttggagaaaattaccgtcaactctgtcagtcgtgataatagtaagtaccactgtaccgcgtacaggaaattctacatcctcgatatcgaagtaacctctaagcctctaaacattcaggtgcaggaactttttctgcaccctgtgctgagagcgagctcctctactcccattgaggggagtcccatgactctaacgtgtgagactcagctgagcccacaaagacctgacgtccagttgcagtttagcctttttcgcgactcccagaccctcgggctcggctggagcagatcaccgcggctccaaattcccgctatgtggacggaggacagtgggtcctattggtgtgaggtggagacggtgacccactccattaaaaaaagatctctccgcagtcagatccgcgttcagcgcgtgcccgtgagtaacgtgaatcttgagattagaccgaccggcggacaactcatcgagggagagaatatggtcctcatatgttcggtggcacaaggctccgggacagttaccttctcctggcacaaggagggccgcgtcaggagtctcgggaggaaaacccagcgctctttactggcagaactccatgtgcttaccgtgaaggagagcgatgcaggacgctactactgtgcagcagataacgttcactcacccattctctctacatggattagagtgaccgtccggattcctgtgtcccacccagtcctgacctttcgggccccacgggctcacacagtggtgggagatctgctcgaactccattgcgagagccttagaggctccccgcccatcctgtacagattctaccacgaagacgttaccctgggcaattcctcagccccttctggcggtggcgcctcattcaacttaagcctaacagccgaacattccgggaactactcttgtgacgctgacaatggtctcggggcacagcatagtcacggcgtgagcttaagggttaccgttccggtttctcggcctgtgttgactcttagggctcctggcgcacaggccgtggtgggtgacctcttggagctgcattgcgaatcactgagggggagcttccccatactatactggttttaccatgaggatgacacattaggcaatattagcgctcattcagggggcggcgcctctttcaacctgtcccttaccacagagcattctgggaattattcgtgcgaagccgacaatggcctcggcgcacagcactctaaggtagtgactttgaacgtgaccggcaccagtcgcaaccgcaccggcttgacggctgcaggcattacaggcttagtgctgtcgatcctggtactggcagctgcagctgccctgctgcactatgccagagccagacgtaaacctgggggcttgtcggcaaccggcaccagtagccactcaccgagcgaatgccaggagcccagctcttctaggccctctcggattgacccccaggagcccacccacagcaagcctctcgcgccaatggaactcgaaccaatgtacagtaatgtgaatcctggggattcaaaccccatctatagccaaatctggtccattcaacacaccaaggaaaacagcgctaattgtcctatgatgcaccaggagcacgaggaattaacagtgctgtattccgaattaaaaaaaactcacccagatgactccgccggcgaggcctccagcaggggtcgagcgcatgaagaggacgacgaagaaaattacgaaaacatattgaacccgaggaaaaacaaagtacaagatttcccatgcctctgtaatacctag

SEQ ID NO: 26298 - DNA, 2205 bp, Artificial Sequence
  Description of Artificial Sequence: Synthetic coding sequence
atgttattgtggttgctcctgcttatcctaactcccggacgggaacagtctggagtggcacctaaagctgttctgttactaaaccccccttggagcacagctttcaaaggcgaaaaggttgcactgatttgcagctcaatttcccacagtttagcgcaaggggacacctattggtaccacgatgagaaactgctgaaaatcaaacacgataaaatccagattactgaaccaggaaattaccagtgcaaaacccgggggtcttcgttaagtgatgccgtccatgttgagttctcccctgactggttgatactccaggcgcttcatcctgtgttcgaaggcgataacgtgatactgcggtgccaggggaaggataacaaaaatacccatcagaaggtatattataaagatgggaagcaacttccaaatagctataacctggagaagattaccgtgaactctgtctccagggacaattctaaataccactgcactgcctaccggaagttctacattttggacatcgaagtcacgagcaagccgttgaacattcaggtgcaggagctttttctgcaccctgtcctgcgggcttcaagcagtaccccaatcgagggcagccccatgactctgacctgtgagacacagctgtccccccagcggcctgatgtccagctccaattcagtctcttccgcgactcacagacgctcggtctggggtggtcccgttctcctagactccagatccctgccatgtggacagaggatagcggctcctactggtgcgaggtggagactgtgacccattcgatcaagaagcggtcccttaggagccagatccgggtgcagcgggttcccgtctctaatgtgaatctggagatcagacctaccggcgggcaactgatagaaggtgaaaacatggtgttgatttgcagcgtggcacaaggtagtggtacagtgacattttcatggcataaggaggggagagtgaggagcctggggcggaagactcaaagatccctattggctgagttgcatgttcttactgtcaaggagtctgatgctggcagatactactgcgcagcagataacgtgcacagccctatactctccacttggatccgagtgacagtccgaatccccgtctcacatccagtgctgacctttagagctcctagggctcacactgttgttggcgatttgttggaattacactgcgaatctctgaggggtagccctcccattttgtaccgcttctaccacgaagacgtcacgctggggaatagctcagctccctctggagggggcgcctcgttcaacctgtccctgactgcggaacactctgggaactattcctgtgacgcagacaatggtctcggggcacagcatagccacggtgtaagccttcgggtcacagtcccggtctctagacccgttctgactctcagggctcctggcgcccaggcggtggtgggagacttactggaacttcattgcgagtccctgcgcggcagctttccaattctctattggttttaccatgaggacgataccctgggcaatataagcgcccatagcggaggaggggcatctttcaatcttagcctgacgacagagcattccggcaactactcatgcgaggcagataatggcctgggagcacagcactctaaagtcgtgaccctaaacgttactggaacttcacgtaataggacaggactgaccgccgctggtatcacaggcttggtgctgagcattctggttctggctgccgctgcagcattactgcattacgcaagggcaagacgaaaacccggtggactcagtgccaccggcacgtctagccatagcccttccgagtgtcaggagccctcctcttccagaccatctaggatcgatcctcaggagccaactcactcaaagccactggcacctatggagctggagccaatgtactctaacgtgaatcccggtgattccaaccccatttactcccaaatctggagtatacaacacactaaggagaacagtgccaattgtccaatgatgcatcaggaacacgaggagctgacggtgctgtactcagaattaaagaagacccacccagatgacagtgcaggggaggctagttcccgcggacgcgcgcacgaggaagacgacgaggagaattatgagaatgtgcctagggttctgctggcaagtgatcattag

SEQ ID NO: 26299 - DNA, 1548 bp, Artificial Sequence
  Description of Artificial Sequence: Synthetic coding sequence
atgctactttgggccagtctgttagcttttgcgcccgtgtgcgggcagagcgcagccgctcacaaaccagttatcagcgtgcatcctccttggacgaccttttttaagggagagcgcgttaccctgacatgcaatggctttcagttttacgcaacagaaaagacgacttggtatcacaggcattactggggcgagaagcttacgcttacccctggaaacaccctggaggtgagagagtccggcttataccggtgccaggcgagaggctccccgcggagcaatccagtgaggctgctgttcagcagcgactctcttatcctgcaagcaccatactcagtgtttgagggcgataccttagtactaagatgccaccggcggcggaaggaaaaactcaccgctgttaagtatacctggaacgggaatatcctgtccatctctaacaaatcatgggacttactaataccccaggcgagtagtaataacaatggcaattatcgatgtatcggctacggggacgagaatgacgtctttcgatccaacttcaagatcattaagattcaggagctgtttccccatccggaactcaaggccacagatagccaaccaactgagggtaatagcgtaaatttatcttgtgagacgcagctgcccccagaacgctcagacaccccacttcattttaatttctttcgcgatggggaagtgatcctgtcagactggtccacctaccctgagttgcagttgcccaccgtttggcgggaaaattcaggcagctactggtgtggagccgagacggtgcgcgggaatattcacaaacatagcccaagccttcagatacacgtgcagcgcattcccgttagcggcgtgctcctggagacccagccatccggtggccaagcggtggaaggtgaaatgctggtgctggtgtgtagcgttgccgaggggacaggcgacaccacctttagttggcatcgggaggacatgcaggaaagtttgggtaggaagacccaaagatcgctccgagctgagctggaattaccggctattcgacagtcccacgccggtggttactactgcaccgcagacaactcatacggtcctgtgcagtccatggtgttgaacgtgacagttcgggaaacgccaggtaacagagacgggctcgtcgctgctggtgcaaccggggggctcctgtctgccctgcttctcgctgtggccctgctctttcattgttggcgccggaggaaatccggtgtgggattcctcggggacgagacgcgtctcccccccgcacctggccctggggagtcctcgcattcgatttgccccgcacaagtggaactgcagtccctgtacgtcgacgttcaccctaagaaaggtgacctggtttattcggagatccagaccactcagctgggcgaggaagaggaggccaacacgagtcgaacactcctggaagacaaagatgtttctgtcgtctactccgaggtgaagacccaacatcctgataacagtgccggaaaaatttcctcaaaggacgaggagagttag

SEQ ID NO: 26300 - DNA, 2934 bp, Artificial Sequence
  Description of Artificial Sequence: Synthetic coding sequence
atgctcctttgggttattctgctagtgcttgtgcctagtcctggacagttccctcgcaccccaagacccataatctttctgcagcccccctggaccacggtgttccaaggcgagcgagtaacccttacctgcaaaggattccgtttctatagtccacagaagactaagtggtaccacagataccttggaaaagaaattctacgagaaactcctgataacattttggaagtgcaggaaagtggtgagtaccgctgccaggctcaaggctcccctctctccagccccgtgcacttagatttctcctctgccagcctcatcctgcaggcgcctctttcggtgtttgagggcgactctgtagtgctccgttgcagagctaaggccgaggttacactaaacaatactatttacaagaacgacaacgtactcgcctttctaaacaaacgaacggacttccacatacctcacgcctgtctgaaagataacggagcttaccggtgcaccggctacaaggaatcctgctgccccgtgtcttccaacaccgtgaagattcaagtgcaggaaccatttaccaggccggtgcttcgggcttcgtccttccaaccaatatccggaaaccccgtcacacttacgtgtgaaacgcagctatctctagagagatctgatgtcccacttcgctttcggttcttccgggatgatcagactcttggccttggctggagtctctcccccaatttccagattacagcaatgtggagcaaagattcagggttctactggtgtaaagccgcaacaatgccttattccgtgatttcagatagtccacgatcctggatccaggtgcagatccctgcctcacacccagtactcacgctaagcccagaaaaggcactaaattttgaaggcacaaaggtcacccttcactgcgaaacacaggaagactctctccgtacgctgtaccggttctaccatgagggcgtccccctccggcacaagagcgttcgctgtgaacgtggcgcctccatttccttctcgctaaccactgaaaattccggcaactactactgtaccgctgacaacggccttggcgctaagccctctaaagctgtaagtctcagcgtcaccgtgccggtctcccatccagtgctgaacctgtcttcgccggaagacttgatcttcgagggagcaaaagtaactctgcactgcgaagcccaacggggcagccttcctattctttatcagttccatcatgagggggccgcccttgagaggcgctcagctaattccgccggtggagtggctatcagtttctctctgactgccgagcacagcgggaattactactgtacagccgataacggcttcggcccccaaagatctaaagctgtgtccttgagcgtgacagtgcccgtgtcccaccccgtcctgaccttatctagcgccgaagccctgacatttgagggcgctacagtcactttgcactgcgaagtccagaggggttctcctcagattctgtaccaattttatcacgaggacatgccactgtggagtagttcaaccccttccgtgggtagggtctctttctcatttagccttaccgagggtcatagcgggaattactactgtaccgcagataacggattcggaccacagaggtctgaagtggtgtccctttttgtcactgttcccgtcagccgcccgatcctgaccctgagagtacccagagcccaagccgtcgtaggtgacctgttggaactgcactgtgaagcaccgcgcggaagtcccccaattctttactggttttaccacgaagacgtgaccttgggctcttcatccgccccctcagggggtgaagcctcatttaacttgagcctgacagccgagcactctggtaattacagttgtgaagcaaataatggcttggtcgcacagcactcggacacgataagcctgagcgttattgttccagtgagccgtccgattctgacgttccgcgcccctcgtgcgcaagctgtggtgggcgacttgctggagctccactgtgaggctttgagaggcagcagtcccattttatactggttctaccacgaagatgttacactggggaagatttccgcgccctccggcggcggcgcttcttttaatctgtccctgaccacggagcacagtggcatttactcttgcgaggctgataatgggcttgaagcccagcgtagtgaaatggttacgctgaaggtagcagtgcctgtctcacgcccagtgctgactctgcgagcccctggaacacacgccgccgtgggcgatctgttggaactgcattgcgaagcattgcgcggatccccgcttattctgtacagattcttccatgaagatgttacactgggtaacaggtcctccccatctggaggggcatcccttaatttgtcactgaccgctgagcatagtggcaattatagttgcgaagctgataacgggcttggcgcccaaaggagcgaaaccgtaacactgtacatcaccggcctgaccgcaaaccgcagcggcccatttgccacaggcgtagccggagggctgctatctatcgcaggtttagccgctggtgcactcctgctttattgttggttgtccaggaaagccgggaggaagccagcctctgatcccgcacgttctccaagtgatagtgactctcaggagcccacttaccacaacgttccagcatgggaggaactgcagccagtatacactaacgcgaatccacggggggagaacgtggtgtattcagaagtgagaatcatccaagaaaagaagaagcacgctgtggcctcagaccccaggcatttgcgcaataaaggcagcccgattatttactccgaggttaaggtggcttcaacacccgtctccggctctctgttcctggcctcttctgccccacacaggtag

SEQ ID NO: 26301 - DNA, 2934 bp, Artificial Sequence
  Description of Artificial Sequence: Synthetic coding sequence
atgttgttgtgggttatcctgttggtactggccccggtctccgggcagttcgctcgtacaccgagaccgattattttcctgcagccaccatggacaactgtgtttcaaggcgaacgagtgacactgacttgtaagggtttcagattttactcaccgcagaagacaaaatggtatcacagatacttgggtaaggagattctgagggaaacgccggataacatcctggaagtgcaagagtccggcgaatatagatgtcaagctcaggggagccccctcagttcaccagtgcatcttgatttctctagtgcttccctgatcctgcaggctcccctaagtgtctttgagggtgattccgttgttctccgctgtcgggctaaagccgaagtaacccttaacaataccatatacaaaaacgacaatgttctcgccttcctcaataagcgaaccgattttcacattccccacgcttgtttgaaagacaacggcgcctaccgatgtaccggctacaaagagagctgttgccctgtgagctccaacaccgtgaagatccaggtgcaagaacccttcacacgacccgtgctccgagcatcgtccttccaacccatcagcggaaatcctgtcactttaacatgcgagacgcagctgagcttggaaaggagcgacgtgcctttgcgcttccggttctttagagacgaccagactctggggttggggtggtcactgagtcctaacttccagatcactgcaatgtggagcaaagatagtggcttctattggtgtaaggcagcaactatgccttattctgtgatttccgattcaccgagatcctggatccaagtacagatacccgcgtcgcacccggttctgacattgtctcccgagaaggcactgaactttgaggggacaaaggtgacgctccactgcgaaacacaagaggactcacttcgaactctgtataggttctatcatgagggagtgcccctgcggcacaaatccgtgcgctgtgagcgaggcgcaagtattagtttcagtcttactaccgaaaatagtggcaattactattgtaccgccgacaacggcctgggtgcaaagccgagcaaagccgtgagcctatctgtgacagtgcccgtttctcatcccgtgctaaatctctcttctccagaagacctcatctttgaaggggcaaaggtcaccctgcattgcgaagcccagcgtggatcactgccaattttgtaccaatttcaccacgagggcgccgccctggaacgaagaagcgccaattcagccgggggtgtggctatctcctttagcctgacagctgaacatagcggcaattactactgtactgcagacaatggcttcggcccacagagaagcaaggctgtatcgctgagcgtaacagtaccagtcagtcaccccgtgctgactctgagctctgcggaggccctgacgttcgagggggcgacggtaacgctccattgtgaggtgcagcggggctccccacagatcctttaccaattctatcacgaggatatgcctctgtggagttcatctacaccaagcgtcgggagggtgagcttcagcttttcactaaccgagggccactctgggaattattactgtactgcagacaacggatttggcccccaacggtctgaggtcgtttctctattcgtgactgtgcctgtctcccgtcctatccttaccctacgcgtgccccgggcccaagccgtcgtaggagacctgcttgaactgcactgcgaggccccgcgggggtccccccccattctttattggttctaccatgaggatgtgacgctgggatcaagttcagctccaagcggtggggaggcctcttttaatttgagcctgacggcagagcatagcggaaactactcctgtgaagccaacaatggtttagtcgctcagcactctgatacaatctcactgagcgtgattgtgccagtcagcaggccaatcttaacttttcgggccccaagagctcaggccgtggtcggtgacttgttggagctccactgcgaggctttaagaggctctagccctattctctattggttttatcatgaagacgtaactctcggtaaaatctctgcaccaagtggcggaggggccagcttcaatttaagtctgacaaccgaacactccggtatttattcgtgtgaggcagataacgggctcgaggctcagcgctcggagatggtcactctgaaagtggctgtgcctgtttctcgccccgtgcttactctcagagcgccagggacccacgctgcagtgggtgacctcctggagctgcactgtgaggccctgagaggctctcccctcatcctgtaccgatttttccatgaggacgtgaccttaggcaacagaagttctccaagcggtggagcctccctgaatctcagtctgacagccgaacatagcggcaactacagctgcgaagctgacaacggtttaggtgctcagagatctgagactgtcaccctttatattactggtctaaccgccaacaggtcaggcccatttgccactggcgtggcgggcggcttgctgagcatcgcagggctggcggcgggcgcgctgctgttatactgctggctgagccgtaaagcaggccgaaagccagccagcgaccctgcacgtagtcctagcgactctgactcacaagagcccacctaccataatgtgccagcttgggaagaactccagcccgtgtacaccaacgctaacccaaggggagagaatgttgtctacagcgaggtgaggataatccaggagaagaaaaaacacgccgtggctagtgatccacggcatttgagaaacaagggaagccctatcatttattctgaagtcaaagtggcgtccacgcccgtgagcggtagtctgtttctggcatctagcgctccacatagatag

SEQ ID NO: 26302 - DNA, 375 bp, Artificial Sequence
  Description of Artificial Sequence: Synthetic coding sequence
atgctcctgtgggtgatcttgctggtgctggcccctgtttctggccagtttgccagaacaccccggcccataattttcctacagccaccctggaccacggtctttcaaggggaaagagtgaccttaacctgtaaaggatttcgattctattctccccagaagaccaagtggtaccaccggtatctcggtaaggagatactgcgggagacgcctgataacattttggaggtgcaggagtctggagagtaccgctgtcaggcacagggctctccattaagctcccccgttcaccttgacttcagctctgagatgggcttcccacatgccgctcaggcaaacgtggaactactgggaagtagtgacttgctcacctag

SEQ ID NO: 26303 - DNA, 1779 bp, Artificial Sequence
  Description of Artificial Sequence: Synthetic coding sequence
atgctcctgtgggttattcttctcgtgctggctcccgtgtctggccaattcgcccggacaccacgccccataatattccttcaaccgccttggactactgtgttccagggtgagcgggtgactttgacctgtaagggctttagattttatagtccccagaagactaaatggtaccatcgatacctcggcaaagagatactacgtgaaactcctgacaacatcctggaagtgcaagagtccggggagtataggtgccaggcacagggtagcccattgtccagcccagttcacttggatttcagcagcgctagtctgattcttcaggcccctctgagtgtttttgaaggtgattctgtggtcctgcgctgcagggctaaggcagaagtgacgctgaacaatacaatctacaagaacgacaatgttctagcctttcttaacaagcgtaccgattttcatataccgcatgcatgtctcaaagacaacggggcgtatcgttgcacggggtataaggaatcttgctgtccagtgtcatcaaataccgtcaaaatccaagtccaggagccctttaccagacccgtgctgcgagcctctagttttcagcctattagcgggaaccctgtcacattgacttgcgaaacccagctatccctcgagagatccgacgtgcctctgcggtttagattctttcgcgacgaccaaacactcggcctcgggtggtctctcagcccaaattttcagatcacggctatgtggtccaaagatagtggattttattggtgtaaagccgccacaatgccttattcagtgatctccgattcacctaggagctggatacaggttcaaatcccagcctcccacccagtcctcactctctctccagagaaagctctgaactttgagggtactaaggtgacccttcattgtgagacacaggaggattccctcaggactctgtataggttttaccatgaaggcgtgcctctgcgccacaaaagtgtgcggtgtgagcggggcgcatccattagcttttccctaacaactgagaactccgggaactactactgtacagccgataacggactaggggccaagccctctaaggctgtctcgctaagcgtcactgtgcctgtttctcatcccgtactaaacctgtcgagtccagaagatctgatctttgagggtgcaaaagtgaccctgcattgtgaagcccagcgtggctccctgcctattctctaccaatttcatcatgaaggggctgccttagaaaggcgctctgctaacagcgcgggaggcgtagcaatatccttttctctcactgcggaacattccggcaattactactgcactgccgacaacggatttggcccgcagcgatctaaggccgtgagtctgagcgtgacagtgcccgtgtctcatccagttcttaccctgtcaagtgccgaggcactcacatttgagggggcgaccgttactctgcactgcgaggtacagaggggtagtccccagattctttaccaattctaccatgaagatatgccactctggagctcatccacaccaagtgtgggccgcgtgtccttctctttttccttaacagaagggcacagtggcaactactattgtaccgccgacaacggatttggcccccagaggagcgaggtggtgtctctcttcgtaacaggaaaatgctgggtattggcatcacatccacccttggctgagttttccctgacacactcctttaaaaatctgttcgccctttcttcttttctgccatag

SEQ ID NO: 26304 - DNA, 2280 bp, Artificial Sequence
  Description of Artificial Sequence: Synthetic coding sequence
atgctgttgtgggtgatcctcctggtgttagcgcccgtgtcaggacagttcgccagaacgccacggcccatcattttccttcagcccccttggacaactgtattccagggcgagcgggtgacactgacatgtaaaggtttcagattttattcaccccagaaaactaagtggtatcaccgatatctcggtaaggagattctgcgcgaaaccccagacaatattctggaagtgcaggaaagcggggagtataggtgtcaggcacaaggcagcccactgagctctccagtccatcttgacttctccagcgcctccctgatcctgcaggctccattgagcgtgttcgagggcgatagcgtggtgctcagatgccgggcgaaggcggaggtcacactgaacaacacaatttacaaaaatgataacgtcctcgctttccttaataaacgtacagattttcacattcctcatgcatgccttaaagacaatggcgcttaccgctgtaccggttacaaggagtcatgttgccccgtgtcatctaataccgtgaagatccaggttcaagaaccgttcacacgaccagtactgcgtgctagctccttccagcctatttctgggaatccagtcacactcacctgtgagacacagttgtcccttgaaaggtcagatgtgcctttgagattcagattttttcgagatgatcagacattagggctgggatggtcactgtctcctaacttccagattaccgccatgtggtctaaagattcgggcttttattggtgcaaagccgcaacaatgccgtatagcgtaatcagcgattcacccaggtcttggatacaagtccaaataccagcaagccatccagtgctcactctctctcctgaaaaggctctgaacttcgaaggcactaaggtaacgttacactgcgaaacgcaggaggacagcttgcggacactgtatcggttttaccatgagggtgtgcccttgaggcacaagtccgttcgatgcgagagaggggccagtatctccttttctctgaccactgagaattcgggcaactattattgcacggcagacaacggactgggggccaagcctagcaaagccgtgagtttatccgtgacagtccctgtctcacaccctgtcctgaacctttcaagtcccgaggatctaatcttcgaaggcgccaaggtgaccctgcactgcgaggcccagcgtgggtcgctgccgattttgtatcaattccaccacgagggtgcagccctagagagaagaagcgccaactccgcaggcggagtcgctatatccttcagtctgactgcagagcatagcggtaactactactgtactgccgacaatgggttcggcccgcagaggtctaaggcagtgtcactgagtgtgaccgtcccggtctcacaccccgttctgaccctgagctcagccgaggcgcttacgtttgaaggagcaacagtaacactccattgcgaagtgcagaggggatcaccacagatactatatcagttctatcacgaggacatgcccctctggtcttcctcaaccccttctgtgggtcgggtttcgtttagtttctcattgacggagggccacagcggtaattactattgtactgcagacaacggcttcgggccgcagcggagcgaggtggtgagtctatttgtcaccgttccagtatcgagaccgatcttgaccttacgtgtgccaagggcccaagcagtggtgggcgacttgcttgagcttcattgcgaggcgccccgcggatcaccaccgatactatactggttttaccacgaggatgtcactcttgggagcagttccgcccccagtgggggcgaggcatcctttaacctcagcctgacagctgagcatagcggcaactattcttgtgaagctaacaacggcttagtggcacagcactctgatacgatcagcctgtcggtgatcgtgccggtatcgaggccaatcttaacattccgcgcgccccgcgctcaggcagtggtaggcgaccttctggaattgcattgcgaggctctgcggggctcttctcctatcctgtactggttctaccatgaggacgttaccttgggcaagatatccgcgccctccgggggcggcgccagttttaacctgtcgctcactactgaacactcgggcatatattcctgcgaggctgacaacggcctcgaagctcagaggtccgaaatggttaccctgaaggtggctggcgaatgggcactgccaacttctagcacatcagagaactag

SEQ ID NO: 26305 - DNA, 2025 bp, Artificial Sequence
  Description of Artificial Sequence: Synthetic coding sequence
atgttgctttgggtgatcctgctcgtccttgcacccgtctcagggcagtttgcgtccctgatcttgcaagcgccactctccgtcttcgaaggagacagcgttgttctgcgctgccgggcaaaagcagaggtgacgctgaataatactatctataagaacgacaacgtgctggctttcctcaataaaagaactgactttcatatcccgcacgcatgtttaaaggataacggcgcctacagatgcacaggttacaaggagagctgttgccccgtgagctccaacaccgtgaaaatccaggtgcaagagcccttcacaaggcctgtccttagagcctcttcctttcaaccaatatcaggcaatcccgtcaccctgacctgtgaaacccagctgtccctggagcggtccgacgtgcccctgcgctttcggttttttcgggacgatcagaccctggggctcggttggtctctctcccccaacttccaaatcacggccatgtggtcaaaggactccggtttttattggtgtaaagccgccacgatgccctactcagttatctcagacagccctcgcagctggattcaggtgcagattcctgcctcgcacccggtgcttaccttgagtccagagaaggccctcaatttcgaggggaccaaggtaactctgcattgtgaaactcaggaagactctctgaggactctgtatcgcttctatcacgagggagttccactgagacataaatccgttcggtgtgaaagaggtgctagtatatctttcagcctgactacagagaattccgggaattactactgcacagccgacaacgggctgggggccaaaccttcaaaagctgtgtcgttaagtgtgactgtgcccgtgagccaccccgttctcaacctgagttctcccgaggatctaatttttgagggggcaaaggtcacactacactgtgaggcacaacgtggctccctgccgatcctgtaccagtttcaccacgaaggcgccgccctggagcgccggtcagcaaatagcgccggcggtgttgccatctcattctctctcacagcagaacacagcggcaattattattgcactgctgacaacgggttcggccctcaacgcagcaaggctgtgagcctgagtgtcacggtacccgtgtcacacccggttctgaccctcagtagcgcggaggcactgactttcgagggagctactgtaactcttcactgcgaggttcagagaggaagcccccagattctgtaccaattctaccatgaggacatgcctctgtggtcgtcaagcacacctagcgtgggtagggtgtcatttagcttctccctcacggaggggcactccggcaattactattgtaccgctgacaacggattcgggccacaacgatcagaggtcgtatcactgttcgttaccgtgcccgtgtcccggcccatactgacgcttcgtgtgccccgagctcaggcggtggttggcgatctgctcgaactacattgcgaggcccccaggggatccccacccatcttgtattggttctaccatgaagacgtaacgctgggtagtagttccgctccctcaggcggagaagccagtttcaacttatctcttaccgccgaacactctgggaattactcttgcgaagcaaacaatggtttggtggcgcagcacagtgacacgatcagcttatccgtgatcgtgcctgtgtcacggcccatactaacgttccgtgctccccgagcgcaggccgtggtgggagacctcctggagctacactgcgaggcgttgcggggaagctcccccattctgtactggttctaccatgaggatgttacgttggggaagatttcagcaccgtcggggggcggcgcctcgttcaacctcagtctgacaaccgagcacagcggtatatactcctgcgaggcagacaacgggctggaagctcagaggagcgaaatggtaacgttgaaggtagctggtgaatgggccctacctaccagcagtacatctgaaaactag

SEQ ID NO: 26306 - DNA, 1194 bp, Artificial Sequence
  Description of Artificial Sequence: Synthetic coding sequence
atgctgctgtggaccgccgtgttgctcttcgtcccctgtgtgggaaagaccgtgtggttgtatctccaggcttggccaaatcccgtattcgagggcgacgcccttactctgcgctgccagggatggaagaacactcccttgtcccaggtgaagttttaccgggacggaaagtttctgcacttctccaaggagaaccagacattgtcaatgggggcagccaccgtccagagtcgcggacagtattcatgctctgggcaagttatgtatatcccgcagacttttacccaaactagcgagacagccatggtgcaagtgcaggaactctttcctccgccagttctttcagccattccctcccccgagccaagggaaggatctctcgtcaccctcagatgccaaacaaagctccacccactgagaagcgccctgcgcctcctgttttctttccataaggatggccatacgctccaagatcggggccctcacccggagctctgtattcccggcgctaaagagggggacagcggcttgtattggtgcgaagtagctcctgaaggagggcaggttcagaaacaaagtcctcagttagaagtgagagttcaggcccccgtcagccgccccgttctaaccttacatcacggccccgccgacccagccgttggagacatggtccaactgctatgtgaagcccagcgtggcagcccaccaatcctatactctttttaccttgatgaaaaaatagtgggcaatcactcagcaccgtgcggaggcacaacatcactgctgtttccagtgaagagcgagcaggatgctggaaactattcttgtgaggccgagaattctgtttccagggaacgcagtgagcccaagaagttgagcctgaaaggttctcaggtcctgttcacccctgcgagtaattggctggtgccttggcttcctgcttctttgctgggtctgatggtcatcgccgcagctctcctggtgtacgtgcgtagttggaggaaggccgggccactgccttctcagattcctcccactgcccctggaggagagcagtgtccgctgtatgcaaatgtgcatcaccagaagggcaaggatgaaggcgtagtgtactctgttgtacacaggacttcgaagcgaagcgaaggccagttttatcatttatgtgggggcgaaatgcccgccgcccagtag

SEQ ID NO: 26307 - DNA, 1305 bp, Artificial Sequence
  Description of Artificial Sequence: Synthetic coding sequence
atgctcctgtggactgcagtcctcctcttcgtgccctgtgtggggaaaaccgtttggctgtacctgcaggcttggccaaatcctgtcttcgaaggggatgccctcaccctgcggtgccagggctggaagaatacaccgctctcccaggtgaagttctatcgggacgggaaatttctccacttctctaaagaaaaccaaaccctaagcatgggggctgctaccgtacagtctagggggcagtactcttgttcaggacaggtcatgtacatccctcagactttcacacaaaccagtgaaaccgccatggtccaagtccaggagctgtttccgccccctgttctgtctgctatcccatcgcctgagccgcgagaggggtcgcttgtgaccctgcggtgccaaacgaagctgcatcctctgcggtctgcccttaggctccttttcagttttcataaggatggccataccctgcaggaccgtggtcctcatccagaactttgtataccaggcgcgaaggaaggtgattcaggtctgtactggtgtgaggtggcccccgagggcgggcaggttcagaaacagtccccacagctcgaggtgcgcgttcaagccccagtatcgcgacctgtcctcacactgcaccacggccccgcagatcccgccgttggggacatggtgcagctcttatgcgaagctcagaggggctcacctccgattctgtacagtttctaccttgacgagaagatcgttggcaatcatagcgcgccatgcggaggcacaacgagcctgttattcccagtgaagtctgagcaagatgctgggaactactcttgtgaagcagagaactctgtctctcgcgagcgatccgagcctaagaaactttcactcaaagggagtcaggtcctcttcacccctgccagcaactggctcgtgccctggctgccggctagcttgttaggtctgatggtgatcgctgcagccctccttgtgtatgtcagatcctggagaaaggccggccccctgcctagccagattcccccgactgcaccagggggtgaacagtgcccactatacgcaaatgtccatcatcagaagggcaaagatgaaggggttgtgtactctgtggtccataggacctccaagcgatctgaggcccgctctgccgagttcactgttgggcggaaggatagttccatcatctgcgccgaagtgcgatgcctccagccttctgaggtgagcagtacagaggtgaatatgaggtccagaaccctacaggagcccctttccgactgcgaggaagtcctctgttag

SEQ ID NO: 26308 - DNA, 936 bp, Artificial Sequence
  Description of Artificial Sequence: Synthetic coding sequence
atgttgctttggacagctgtgcttctgtttgtgccttgcgtagggaaaactgtatggctgtatctgcaggcttggcccaatcccgttttcgagggcgacgccctgactctgcgctgtcagggctggaagaacacacctctctcgcaggttaagttctacagggacggaaaattcctgcacttcagcaaagagaatcagaccctctccatgggcgccgcaacggttcagtctcgtggccagtactcctgttctggacaagtaatgtatatcccacagacgttcacacagacgtcagagacggccatggtacaggttcaggcccccgtctcccggcctgtcctcacactgcatcacgggccagctgaccctgcagtcggagatatggtgcagttgctgtgcgaggcccagagagggagcccacctatcctctatagtttctaccttgatgaaaagatcgtggggaatcactccgccccctgtggcggcaccacgagcttactgtttccagtgaagtccgagcaggatgccggcaactatagttgtgaagccgagaattctgtctcccgggagcgatctgaacctaagaaactgtctttgaaagggagccaggtcctgtttacacccgcctctaattggctagtgccctggctcccagcatcacttctcggattgatggtcattgccgccgcactgctcgtgtatgtgaggtcttggagaaaggcgggtccattgccatcccagattccaccgacggctccgggaggagagcaatgtcctctttacgccaacgtccaccatcagaagggtaaggacgaaggtgtggtatattccgtagtccaccgcacttctaagaggtcagaagcaagaagcgccgagttcacagtaggcaggaagttttaccatttgtgcggaggcgaaatgccagccgctcagtag

SEQ ID NO: 26309 - DNA, 1581 bp, Artificial Sequence
  Description of Artificial Sequence: Synthetic coding sequence
atggttaatgaggggccaaaccaggaagagtccgacgatacccctgttccggagtccgctctacaggcagacccgagtgtgagcgtccacccaagcgtgagcgtccaccctagtgtgtccatcaatccttcagtgtccgtgcatcctagttcgtccgcccacccctctgcccttgcccaaccatctggactggcccacccgtcgagctcgggaccagaggacctcagtgtgattaaggtgagccgcaggcgctgggccgtggttctcgtgttctcctgttactcgatgtgtaattccttccagtggatacagtatggcagtatcaataacatcttcatgcacttttacggcgtaagcgcatttgcgatcgattggttatccatgtgctatatgctgacatatatcccattgcttttacccgttgcttggctgttagagaaatttggactgcgcacaatcgcccttaccgggtctgcccttaattgtcttggcgcctgggtgaagttaggatccctaaaaccccatctgtttcctgtaactgtagtgggacagctcatttgcagtgtcgctcaggtcttcatcctaggtatgccatcccggattgcatccgtgtggttcggcgcaaatgaggtgagtaccgcatgttctgttgccgtattcggtaaccagctcggcatagccatcggctttctggtgcccccagtcctagtccccaacattgaggacagggacgagttggcgtatcacatctcaataatgttctatattatcggcggagtcgctactctgctgctgattctcgtgatcatcgtgtttaaagagaagcccaagtatcccccttccagagcccagtcattatcatacgccctcactagtccagacgctagctacctgggaagtatcgctaggttgtttaagaatctcaacttcgtcttgctcgtgataacgtatggactgaacgccggtgccttctacgctttgagcacactactgaatcggatggttatctggcactacccaggcgaggaggttaatgccgggcgaattggcctgacgatcgtcattgccggcatgctgggcgccgttatctctggcatttggctggataggagtaaaacctacaaggagacaactctcgtggtatatatcatgaccctggtggggatggttgtctacactttcacactcaacctgggacacctgtgggtcgttttcatcaccgccggcaccatgggtttcttcatgacgggctacctccccctggggttcgagtttgcagtggagctaacctaccccgaaagtgaaggaattagttccggcctactgaacataagtgctcaggtctttggtattatttttacaatttcacaaggacagattatagacaattatgggaccaagccggggaacatttttctttgcgtgttcctcaccctcggggctgccctgaccgccttcatcaaagcggacctcagacggcagaaagccaataaggagacattggaaaacaaactccaggaggaggaagaagaaagcaacacctctaaggttcccaccgctgtgagcgaagaccacctctag

SEQ ID NO: 26310 - DNA, 966 bp, Artificial Sequence
  Description of Artificial Sequence: Synthetic coding sequence
atgtcagctgacaacagctcgacaatttgcgtgtgtcgctctgtgcgccaggaactcgggatcgccatcggcttcctagttccgcccgtgttagtccctaatatcgaggaccgggacgaactagcctaccacatttcaatcatgttttacataattggcggagtggcaaccttactgttaatcctagtgatcattgtgttcaaagagaaaccgaaatatccaccttctcgggcccagtcattatcctatgcccttacctctcctgacgcttcatacctgggctcaatcgctaggctgtttaagaacctgaacttcgtgctgctggtgattacctatggcctcaacgccggagccttttacgctctttcgaccctcctgaacaggatggtgatctggcattaccccggtgaggaagttaacgctggccggatagggctgacaattgtcatagcaggaatgcttggtgccgttataagcgggatttggttagacagatccaaaacatacaaggaaacgacactggttgtctatataatgactctcgtaggcatggtggtttataccttcactcttaatctcggacatctctgggtcgtattcatcaccgccggaacaatggggttcttcatgactgggtatctcccactcggcttcgagtttgcagttgagctgacctacccagagtcggaggggatctcctctggcctcctcaatatctccgcacaggtgttcggtatcatattcacaatttcccaagggcagataatcgacaattatggcaccaaacctggtaacatctttctttgcgtgttcctgactctcggcgctgccctaactgcatttatcaaggccgacctccgaagacagaaagcgaataaggagaccctggagaataaactccaggaagaagaagaggagagtaatacatctaaggtgcccaccgctgtcagcgaggaccacctttag

SEQ ID NO: 26311 - DNA, 5574 bp, Artificial Sequence
  Description of Artificial Sequence: Synthetic coding sequence
atgttcgggttgaaggtgaagaagaagagaaataaagccgagaagggattgattctagccaataaagcggctaaggattcacagggcgacactgaggcactccaggaagaaccctcgcatcaagaaggccccagaggtgacctagtgcacgacgatgcttctatatttccagtaccctcagcgtcccccaagaggaggtctaaactgctcacgaagatccatgatggtgaagtgaggagccagaattatcagattgcgatcaccattacagaggcacgccagctggtcggggagaatatcgatcccgtggtgacaatcgagatcggggacgagaaaaaacaatcaaccgtcaaagaaggaacaaattcgcccttctataatgagtactttgtattcgactttatcggccctcaagtgcacctgttcgacaagattattaagataagcgtatttcaccacaagctgatcggttctgtactgattggaagtttcaaagtggaccttgggaccgtgtataatcagcctggacaccagttctgcaacaaatgggctctcctaacagacccaggcgacatacgaaccggaacgaaaggttacctgaagtgtgacattagtgtgatggggaaaggagacgttctgaaaacaagccctaagaccagcgacaccgaggaacctatcgaaaaaaacctcctgatccccaacggcttccccctggaacgtccttgggcccgtttctatgtcagactgtacaaagccgaaggcctcccaaaaatgaattcttcaatcatggcaaacgtgactaaggcgtttgtgggcgactcaaaagacctggtcgaccccttcgtggaagtgagtttcgccggtcagatggggcgaacaactgtccagaagaactgcgctgatccagtgtggcacgagcaggtgatttttaaggagatgttcccacctctgtgtaggagagtgaagatacaagtgtgggacgagggctccatgaacgatgtggccctagcgacgcactttatagatctgaaaaagatctcaaacgaacaggacggtgataaaggctttctccccacctttggccccgcctggattaacctttatggtagccccaggaatcattcacttatggacgattaccaagaaatgaacgaaggctttggtgaaggggtttcatttcgaggccggatcttagtggaaatcgcggtggagatcttatctggtcgcgctcaagagtccaaattctccaaggcactgaaagaactgaagctcccctcgaaagacaaggactcgaaatcatccaaaggtaaggataaagccgataagaccgaagatggcaagtcacagcaagcctccaacaagactaacagcaccgaagttgaagttgagtcattcgacgtacccccagaaatcgtgccagaaaagaatgaggagtttctgctgttcggggccttcttcgaggctactatgatagataggaagataggggataaacccatttctttcgaggtttctatcggaaattttggcaacctgatcgatggcggatctcaccacggaagcaaaaagtctgcagaatcagctgaggaagatctactgccacttctgcatgagggccagggcgacgtcgcacacgatgtgccgatcccaatggcgtccactacacatcccgagaaaccactggtgacagaaggcaatcgcaattacaactacctccctttcgaagccaagaaaccctgcgtttactttatatccagttggggcgatcaaacctttcgacttcactggagcaatatgctcgagaagatggccgattttctcgaggaaagcattgaggaggtcagggagctgatcaaaatatcccaggaagcgccggaagagaagatgaaaactgtcttgtctgactttatttcacgcagcagcgcatttatctctgaagcagagaagaagcctaagatgctcaaccagactactctggataaaaagcgcttaacattgtgctggcaggaacttgaggcgatgtgcaaagaggccaaaggcattattcagcagcagaagaagaaactctctgttgacgaaatgatccatgaagcccagaattttgtggaaaagattaggtttttggtggacgaacctcagcataccatcccagatgtattcatctggatgctcagtaacaataggcgagtggcctacgcacgaatcgccagtaaagacctgttatatagccctgtcgccggccagatggggaagcattgcggaaagatcaagacccacttcctcaaaccacccggaaagagacctgctggatggagtgtgcaagcgaaggtcgacgtgtacctttggttggggtccattaagcacgcatctgccatcctggataatctgcctgtaggatacgaggcagagatgtccagcaagggcgccggcaccaatcatcccccctctaatcttctataccaggagcaacacgtgttccagctgagagctcacatgtaccaggctcgcggtttgattgcagccgatagcaatggcttgtccgatccattcgcaaaggttactttcctttcccactgccagaccaccaaaataattagccaaaccttatcacctacttggaaccagatgcttctttttaatgatcttgtactccacggagatgtaaaggagctcgctgaaagcccccctctggtcgtagtcgaactgtacgatagtgacgctgttgggaaacctgagtaccttggagcaaccgtggctgccccggtcgtgaagctggcagatcaagattatgagccgcctcgactctgttatcatcctatcttctgtggcaacttgagcgggggtgacctgctcgctgtgttcgagctgcttcaagtaccgccttctggcctgcagggtctgcctccagtcgagcctcctgacatcacacagatatatccagtcccagcaaacattagaccagtcctgtcaaaataccgcgtggaggtgttgttttggggggtgagagagatgaagaaggtgcagcttctatcagtagaccgccctcaagccctcattgagtgcggcggacagggtgtgaagtcatgtgtgattcagtcctacaagaataacccaaactttagtatccaggccgacgctttcgaggtggaattacctgaaaacgagctgctccacccgccactgagtatttgtgtcgtggactggcgagcgtttggtagaagcaccctggtcggaacgtatactattaactacctgaagcagttcctgtgtaaactaagagaaccactggctcctattacacaggtggatgggacacagccaggccacgacataagcgatagtttgactgctaccgagtccagtggtgcccactccagtagccaggatccacccgccgatcacatatatgtggatgtggagccgccccctacggttgtacccgactccgcccaggctcagccagcaatcttggtcgacgtcccagatagcagccctatgctagagccagagcatacacctgtcgcccaggagcctcccaaagatggcaagcctaaagaccctcggaaaccttcccgtcggtctaccaagcgcagaaaaagaactattgcagacgagtcagcggaaaacgtcatcgactggtggtcaaagtactacgccagtctgaaaaaggcccaaaaggctaaggagaggaatcctaagggcaagaaaggtaacacagaggctaagcctgatgaagttgtcgtcgatatcgaagatggacctaagaaaaagaaagataagatgctgaaaaagaaacctaaagacgacggcatccctaacctggctatcttgcagatttacgacggagacttagagtcagagttcaacaacttcgaggattgggtgaaaacctttgagctgttccgaggtaaaagcactgaggacgaccatggcctggatggagaccgtgtcattggaaagttcaaggggagtttctgtatttacaaatcaccccaggacagttcatctgaggatagcggccagctgaggattcagcagggaatcccacctaatcatccagtcaccgtgctgattagagtgtatattgttgccgcgttcaaccttagccccgcagaccccgatggcaagtctgacccttacatcgtgatcaagctgggcaagacagagatcaaagacagggacaaatacatccccaagcaactcaacccagtcttcggcaggtcttttgagatccaggctacctttcctaaagagtccctgctgtcgatcctgatatacgatcacgacatgatagggacggatgatctgattggagaaactaaaatagatctggagaacaggttctactcaaaacatagggccatctgtgggttacaaagccagtatgaaattgaggggtataacgcatggcgtgacacctccaaacctacagagattctaaccaagctgtgcaaggataataaactcgacgggccctacttccacccgggcaaaatccagattggcaatcaggtgtttagtggcaaaaccatctttacagaagaggacaccgacgagacggtcgagtcatacgagcacttggccctgaaagtactgcatagctgggaagacatcccagaggtggggtgtaggttggtacccgaacacattgagaccaggcctctataccacaaagataagccaggaatggagcaggggaggctccagatgtgggtcgacatgtttcctaaggatatgccacagccgggccctcccgtagacatttccccccggagaccaaagggatatgaactgagggtaactatttggaatacagaggacgtgatactcgaagacgagaacatcttcacgggccagaaaagcagtgatatttatgtgaagggatggctaaaggggctggaagatgataagcaggagaccgacgtccactataacagccttactggggagggcaacttcaactggcgctttctgttcccttttcaatatcttccagctgaaaaacagatggttataactaagagagagaacatctttagcctggaaaagatggagtgtaaaactccagctgtacttgtgttgcaagtgtgggatttcgagcgtctcagctcagatgattttttaggcaccctcgaaatgaacctgaacagtttcccaagggctgcgaaatcagcaaaggcgtgcgaccttgccaaatttgagaacgccagcgaggaaacaaaaatttctatttttcagcaaaaaagggtaagaggatggtggccatttagtaaatctaaggagcttacaggcaaggtggaagccgagttccatctcgtgaccgcggaagaggccgaaaagaatccagtcggcaaggccaggaaagagccagaaccacttgcaaaacctaatcgccccgacacttcttttagttggttcatgagccctttcaagtgtctctactatttgatctggaagaattacaaaaagtacatcattattgcgttcattctaataattttgatcatatttctcgtcctgttcatctacactctccccggcgcaatcagccgccgaatcgtggtagggagttag

SEQ ID NO: 26312 - DNA, 5574 bp, Artificial Sequence
  Description of Artificial Sequence: Synthetic coding sequence
atgttcgggttgaaagtgaagaaaaagcgcaataaagctgagaaaggcctgattctggctaataaagcagccaaggactcccagggggataccgaagctttgcaggaggagccgagtcaccaagagggtcctagaggcgacttggtgcacgatgatgcgagcattttcccagtcccatcggcctctcccaaaaggcggtctaaactcctcacgaaaatacacgatggagaagtgcggtcgcagaactaccagattgccataaccattactgaggctcgccagctagtgggtgagaacatcgacccagtggtgactattgagatcggtgatgagaaaaaacagtccactgtgaaagaagggaccaattccccgttctacaatgaatactttgtctttgactttatcggaccacaggtgcacctcttcgataagatcatcaagatcagcgtgttccaccataagctgattggctcggttctcattggaagctttaaggtcgacctgggaactgtatacaatcagccgggacatcaattttgcaataagtgggcccttttaaccgatcctggcgacatccggacaggtaccaagggttatctgaagtgcgacatctctgtaatggggaagggcgacgttcttaagacctctccgaagactagcgacaccgaagaacccatcgagaaaaacctcctgatcccaaacggctttcctctagaaagaccatgggctcggttttatgtgcgcctgtacaaagccgagggattgcccaagatgaattcatcgattatggccaatgtcaccaaagcctttgttggagattcaaaagatctcgtcgacccttttgttgaggtctcttttgcaggtcagatgggccgtaccacagtccagaaaaattgcgctgaccctgtgtggcacgagcaggtcattttcaaggaaatgtttccacctctgtgcagaagagtcaagatccaggtctgggacgagggctccatgaacgacgtcgccctcgcaacacactttatagatctgaaaaaaatcagtaatgagcaggatggcgataaagggttcctgccgaccttcggccccgcatggattaacctctacggttccccacgcaatcattccctcatggatgattaccaggaaatgaatgagggattcggagaaggcgtctcgttccgtgggcggatattggtggagattgctgtagaaatcctctctggccgcgctcaggagtcgaagtttagtaaggccctaaaggaactcaagctgccatctaaggacaaagattccaagtcgtcaaagggcaaagacaaggccgacaagaccgaagatggcaagagccagcaggcctcgaacaagaccaactccactgaagtcgaagtcgagtcatttgacgtcccccctgagattgtacctgaaaagaacgaggaatttctgctcttcggagcgttctttgaggccaccatgatcgatcggaaaattggagataagccaatctcattcgaagtgagcattggaaacttcggtaatttaatagacggcggctcccaccacggatctaagaagtccgccgaatcggctgaggaggacctcttgcccctcctgcacgaagggcagggagacgtggctcacgacgtgccaattcccatggcctctacgactcacccggagaaacctctggtgaccgaggggaacaggaattacaactatctgccgttcgaagctaaaaaaccatgcgtgtatttcataagctcatggggcgatcagacctttcgcttacactggagcaatatgctggaaaagatggcagatttcctggaagaaagcatcgaagaggtcagagagctaattaagatatcccaggaggcacctgaagagaaaatgaagaccgtgctgagcgattttattagtcgctcttctgctttcataagtgaggctgagaagaagccaaagatgttgaatcaaaccacactggacaagaagaggctcacattgtgttggcaggagctggaggccatgtgcaaagaagccaaaggcattatacaacagcagaaaaagaaactgtcagtggatgagatgattcacgaggctcaaaacttcgttgaaaaaattcgctttttagtcgatgagccacagcacaccatacccgatgtctttatttggatgctgagtaacaaccgaagggttgcgtacgcgcgtatcgcctctaaagatcttctttacagcccagtcgcgggtcaaatgggaaaacactgtgggaagatcaaaacccacttcctaaagcctcctggaaagcgcccagctggctggtcagttcaggccaaggttgatgtgtatttatggcttggctcaatcaagcacgcctcggccattttggataatctgccagtggggtacgaggccgagatgtcgtcgaaaggagccggcaccaaccacccaccctccaacctcctctaccaggaacagcatgtcttccagctcagagcccacatgtaccaggcccgaggtctcatagctgcggattctaacggattatccgacccttttgcgaaggtaaccttcttaagtcactgccagaccaccaagatcatttctcaaactctgtcccccacctggaaccagatgcttctcttcaatgacttggttttgcacggagacgtgaaggaattagccgagagcccaccactcgtggtggtagagctgtacgattcagatgccgtgggaaagcctgagtacctgggggcaacagtagcagcccccgttgtgaagctggccgatcaagactacgagcctccccgcctctgctatcatcctatattttgcggaaacttgagcgggggagatttgctcgccgtcttcgaactgctgcaagtccctcctagtgggctccagggtctgccacccgtggagccccccgacatcacacagatctatccagtgccggccaacataaggcccgtcctgtccaaatacagggtcgaggtactattttggggcgttcgggagatgaaaaaggttcagttgctgagcgtcgatcggcctcaggccctcattgagtgtggtgggcagggggtgaagagttgcgtaatacagagctataagaataaccctaacttttctatccaagcagatgcattcgaggtggagttgccagagaacgagctcttgcaccctccgctctctatatgtgtagttgattggcgtgcctttggacggtccaccctggtggggacttacaccatcaattacctaaaacaattcctgtgtaaacttagagaacctttggcacctatcactcaagtggacgggacacagccaggtcacgacatttccgatagcttgaccgccactgagtcctccggcgcccattccagctcacaggatcctccggctgaccatatttatgtggatgtcgagccacccccgactgttgtgcccgattccgcccaggctcagcccgctatattggtcgatgtgccggacagctctcccatgctggaaccagaacatactcccgtggcacaggaaccccctaaagatggcaagcccaaggaccctcgcaagcccagtcggcggagcacgaaacgtcgcaagcggactatagctgacgagtccgccgagaatgtcattgactggtggagcaagtactacgcttctttaaaaaaagctcagaaagccaaggagcgcaacccgaagggaaaaaagggaaacaccgaagccaaaccagatgaagtggtcgtagatatagaggacggacccaagaagaagaaggataagatgctcaaaaagaaacccaaagacgatggtataccaaatctagccattttacagatttacgatggcgatctggagagcgagttcaataacttcgaagactgggtgaaaacctttgagctattccgtggcaagtcaacagaagacgaccacggtctggatggtgaccgcgtgatcgggaaatttaaaggatcattttgcatctataaatcaccccaggatagttcatccgaagattccggccaattgcggattcagcagggaatccccccaaaccaccctgtaacggtcctcatacgtgtgtacatcgtggctgcatttaatctgagccctgcagatcctgatggtaaatctgacccatatattgtaataaagttgggtaagactgagatcaaagatagagacaagtatatccccaaacaactgaatcccgtgttcggacggagttttgaaatccaggcaacgttccccaaagagtccttattgtcgattttgatttacgatcacgatatgatcgggaccgacgaccttattggggaaacgaagatcgatttggagaacagattttactcaaagcatagagccatatgcgggttgcagtcccaatacgagatcgagggttataatgcttggagggatacttccaagcctacagagattttgacaaagctgtgtaaggacaataagctggacggcccctacttccatcctgggaagatccagatcgggaaccaggtcttttccgggaaaacaatcttcaccgaggaggataccgacgaaaccgtcgagagctacgagcacctcgcactaaaagtactgcatagctgggaggacattcctgaggttggatgccgactggtgccagagcacattgaaactagacctctgtaccacaaggataaaccgggtatggagcaggggaggctgcagatgtgggtagacatgttcccaaaagatatgcctcagcccggcccccctgtggacataagcccgaggcggcctaaaggatacgagctgagggtgaccatttggaatacagaagacgtcatcctggaagatgaaaatatattcacgggacaaaaatcatcagacatctatgtgaaaggttggctgaaaggcctagaggacgacaagcaggaaacagatgtgcattacaattcccttactggggagggtaacttcaactggcgatttctgttcccgttccaatatctgcctgcagaaaaacagatggttataacaaagcgggaaaatatctttagcctggagaaaatggagtgtaaaacccctgccgtgctggtccttcaggtctgggatttcgaaaggctgagttcagacgatttcctgggcactcttgagatgaacctgaacagcttcccacgtgccgcaaaatctgccaaagcttgcgacctagctaagtttgaaaacgcttccgaagagacaaaaatctctatcttccagcagaaacgcgtcaggggctggtggccatttagcaaaagcaaggagctaactgggaaagtggaagctgaatttcacctagtcaccgcagaagaggcagaaaagaatccagtgggtaaggcgcgcaaggagcctgaacctctggcgaaaccaaatcggcccgacacatccttctcttggttcatgagtccctttaagtgcctgtattacttaatctggaagaactacaaaaagtacatcattatcgccttcattttgataattcttatcattttcttagtcctgttcatatatactctgccaggcgcaatctcccgaaggatcgtagtcggatcctag

SEQ ID NO: 26313 - DNA, 189 bp, Artificial Sequence
  Description of Artificial Sequence: Synthetic coding sequence
atggaagagttagagacaagcctttttcagaccaggaaggcgcataggatcgagcagatggtggcaaggtggttaagacggagcagggattcttcagcaagagccaaggttgcagcagccgacgggccagctcggaacccgacccagacccttatccctgttagacatacggtcaagatcgacaagtag

SEQ ID NO: 26314 - DNA, 4737 bp, Artificial Sequence
  Description of Artificial Sequence: Synthetic coding sequence
atggaggaactcgaaactagcctgttccaaacacgaaaggcacatcgaattgagcaaatggtggccaggtggctgcgacggagcagggactcctctgccagagcaaaagtagcagcagctgacgggcctgcacgcaatccaacacagaccctgatcccggtgcggcacaccgtgaagatcgataaagatactctactgcaggactacgggtttcacataagcgagagtcttcccctcactgtggtagcggtcacagcaggcgggtccgcacacgggaagctgtttcccggagatcagatcctgcaaatgaacaatgaacctgccgaggacttgtcttgggagagagcagtcgacatcctgcgggaagcagaggactcgctgagcataacagtcgtccgctgcacttccggggtgcctaaatcttccttcttgactgaggagaaacgggctcgacttaagaccaaccctgtcaaggtgcatttcgcagaagaggttttgatctccggccattcacaggggaacagtctcctctgcatgcctaatgtgctgaagctctacttagagaatggccagacaaaagccttcaaatttgaagccaatactacggtcaaagacattatcctcacggtgaaagaaaaactcagcattcgctccattgagtatttcgctctggcgctggaagagcagtactctatttcacggttgcacctgctgcacgaagaggagctcatccagcaggtcgtcgaaagagaggagtcccacgactatcggtgcctgtttcgagtctgcttcgtgccaaaggatcctctcgatctcctgaaggaggacccggtggcatttgaatacctgtacttgcagtcatgcagcgacgttcttcaggagagattcgccgtggaaatgaagtgtagctccgccttgcggctcgcagcccttcatatccaggaaaggatctacgcctgcgcccaaccacagaagatttctctcaagtacatcgaaaaggactggggcatagagaatttcatttctcctacactgcttaggaatatgaagggaaaagacattaaaaaggctattagctttcatatgaaacgcaaccaaaatctgttggaacctagacagaaacagctgatctccgctgcccagctccggctcaattacctacaaatattgggggaactgaaaacctatggcggtcgaattttcaatgccaccttaatgctgcaggacagggaatcttacatcgccctgctggtgggtgcaaagtatggaatctcccaagtcattaactctaagttgaacataatgagtactttggcagagtttgctaacatatctagagtggaactgactgaggaaagcgagaaggtctccgtggtcaaggtctacctgcaggacgtgaaagtgcttaccctgcttctggaaagcaattccgctaaagacctggcctgcctgattgccgggtattatagactgcttgttgatcccgtcacctcaattttcttgtggcccggaaacaagcagcaggctcacagggtgagtgcggaagaaggttatgagagccgggcctgctcggattccgaagagtcaagcgaggtcgattgtgtgctggagcccttgtccgatcgaaggttggtcaaacttgcaccatgccgctctctcataaaagaagagcagccccccggaaattcacctacaccggaggtcgcaagaaggggcccttcgacctgtggagcctcatctacaacagatagtgcggagtctgaggcgagcgacagtgccaataccgagagtcgcggttaccgcacaagtggcagctcagagtcaatggacgcgttggaggaggatgaccttgatacatgtagctcatcccgctctaccttttttcatttcggcagccctgggctagcagaaagtatcgattctgactcccaagaagagcgttccgggatcgaaacgagcgggtttttgtgtctgctggacctagcacagagagcgaacccccagtgtcagaagactgaattttctgaaagcgcagccctggagactttcggatgggcacctgaattatctaccgtaaggttggatccaagactttacgaagggtcccacgcagactattactctctatgttcttccgtaagtccagcctcctacctgtccgatagcagtgaatctaccgcctcacggcagggcggagctccccctgcctggggccagcagggatggaccgaagcccaacccagttcaatgcttgagccactggcccttcatccccccctggcctttgaggacgggtcctctgacgaagagtactacgacgcagcagacaagctcacccctcctggaccccccagtggccccagggatgtgagcaccgcagaacccagcgctacttcgttacagaataaagcctcaactagtagccccgagaacagcctcccctgcgggccagacgggcgccaacccagcaggagagggggagtaaagaaatacgcgaagacactgcggaaaagacgtagttttctgcaaactgactataccagccaggtttcctttcccctagttccaagcgcctcccttgaatcggtggatgatgtttgttattacgatcgtgagccataccttgccctgggagctccttctcccactgtgtcctccctacaggacatgcagggggagcccggattgctggaaactaaggccctgggactactggcaccactccgagaaactaaaagtacgaatccggcttcaagagtgatggagatggagcccgaaactatggagacaaaaagtgtgatagattctcgcgtgtcaagcatctccgccatccggttcagaatcgatccaaacaataaggaaaacagcggggtggtacctgcagctagttcctcagcgagtaccccccactgctctaaccctggttcgtctgggccagacacagctcaggctcgtcctagccagatactccccctctcacaagacttagacgggattgccccgaaggagccaacgattgaacatggcgattcctccttttccctttcgagcggcgatcctaatcccgacagagcctgtcttgcttccaatcctggcctcaacaatgtgtcgcagggtgataccctggaactgcagttggagccccacgttcagcttgaaatgggcttggagagcttctgcactaatcacattcaagaaactgccccaaagtacacagaaccccttttgtctccacgggatgagccccggagtgacgaatgcgggatcaaccctggcgagaagatcgcctcaattccgactaaggaggagccccagggccaactatccctggagagggatcgcgaagttaccaataagaatggtaccaatgtctttcaagaggagtcccgcaaggactcaggcgactcacccggcgatgtatccaacaacgtttcgcagacgttggacatctccagccctgccggtaaaatcgtgacctctctgagcctggatgcccctgtcactgggactgaacagattcccccccaccccccaagggatcctcaggggcaatcaagggagcccccgggccagggctgccaggcccaggaacaaaagctctttgtggagcttgacctcgaccccgacttctttctgggaaaacaaactgtctcccccgccgtgcccccagaaggcatcaaagctgaagcccccaaccacgtgacaggccaggatattgcaccgcgcgactcgccagagtgggtgtgcttcaaccccgaacccagcctccccgaacccttgccttgccctcaggaggatccgcatctggagacaagcaaccattgtctgctgagcgaagggaagagcgactccagcagcatctgcttatccgctgagaagagcttcctgtgcttcgcccccgaatcccaccctgaggtgagcgcaagcctccgagtggcgaccagtctaggatttgccgggatgaacgaaatggttgcaccgcgcattggcatggatcagtgtagttgccagtttagctatgccacttgcttccgcggcccacagcctgagaccgaagaggaagatagagatctcgaggctcatccaatggcccccctgactagccctccaagtgctgggagcccagtcgttctcccttggcgccctgctcgcgcccattcctgtaccactgctcccctctctcggaaatcgcacatctggccagaatattgtagccgggcactgcgccagctgaaggctactccggcctctacaccagaaggatttatccagctaatggagtctctactggaactccaagacattctcgaaactagctggggtgtcggcaataagcacccaccagagaagtgcacctggcacttcacagaaagcaggagtagattgtgtatgggaagccagaaattactgtcttcctgtaggcacgtcatacgtatggatcagtccccggaggaaatgcaaggcgctgtccgcgacacctttcagcacctcgttcagctcgctggcctttgcttccagtttaccgattgcagccgatgttcagcccgacaccgggaagcggctgggaatctcagagacgttgtgtatacataccaccagtttattgaggccgccaagtcaacctgcgagcgcggctatcatgacctctccgtcaagcttttggcacggcaatgcactgctctgaccgcagccgttttctgtctcactcagaagttccgagcaagcacggctctctag

SEQ ID NO: 26315 - DNA, 1905 bp, Artificial Sequence
  Description of Artificial Sequence: Synthetic coding sequence
atgcctaacgtcctgaaattatacctagaaaacggccagacaaaggcctttaaatttgaggcgaataccacagtcaaggatatcattcttaccgtgaaggagaagttgtctatcagatccatcgaatacttcgccctagcattggaagaacagtatagcatctcacggttacatctgctgcatgaagaagagttaatccaacaagtggtcgagagagaggaaagtcacgactatcgctgtctgtttcgggtgtgcttcgtgcccaaggatcccctagatctgctgaaggaggatccggtcgccttcgaatatctctacctccagtcatgttccgatgtactgcaggagcgctttgccgtcgaaatgaagtgttcaagcgccctgcggctcgctgcgctccatatccaggagcgtatctacgcatgcgctcagccccagaagatttcattgaagtatattgaaaaggactggggcatcgagaacttcatttctcctacactcctccgcaatatgaagggcaaggacatcaagaaggccatatcctttcacatgaaacgtaatcaaaatttactggagccccgccagaagcagctaataagtgccgcgcagctgagattgaactatctgcagattttgggagagctcaagacatatggtggtaggattttcaacgccactctcatgttgcaggatcgtgagtcgtacattgccttattggttggcgccaagtacggaatttcccaggtgatcaactccaaactgaacatcatgtctaccctcgcggaatttgcaaacataagccgtgtggaactgacagaggagagcgaaaaagtctccgtggtgaaggtttacttacaggacgtgaaggtgttgacgctactgcttgagtctaactcggcaaaggacttggcctgcctgatcgcagggtattaccggctgctcgtggaccctgtcacttccatctttttgtggcccggcaacaaacagcaagctcaccgggtgagcgctgaggaggggtatgaatcacgggcttgctctgattccgaggaaagttctgaggtagactgtgtcctggaaccgctgtccgacagaagactggttaagctggcaccctgtcggagcctgattaaggaggaacaaccccctggtaattccccaaccccagaggtagctcgacggggcccgtccacctgcggtgcctcttctaccactgattctgcagagtctgaggcaagcgattctgctaacactgaaagccggggttaccggacctccggcagcagcgaaagcatggatgctctggaagaagatgacctcgacacgtgtagttcgtcaaggtcgactttctttcacttcggatcacctggcctggcagaaagcattgactcagactctcaggaagaaagatccggaatcgagaccagcggctttctgtgtttgctcgacttggcccagagagccaatccccagtgccaaaaaactgaattctctgaaagtgccgcattagagaccttcggctgggctcccgagttaagcactgtaagactcgaccctcggctctacgagggttcacacgccgactactatagtctctgttcctcagtctcccccgcctcatacctgagcgattccagcgaaagtaccgcaagtcggcagggaggcgccccacctgcttgggggcagcaaggctggacggaagcacagccctcaagcatgctcgagccactcgctctgcaccctcctcttgcttttgaggacgggtcttcagacgaggagtactacgacgcagctgacaaactgactccgcccggccccccctcgggggagccttcactcgcaggtcttcagacacggcaggccgctcccgagtgtctacccggtatcaaagcctggggccaggcttag

SEQ ID NO: 26316 - DNA, 4737 bp, Artificial Sequence
  Description of Artificial Sequence: Synthetic coding sequence
atggaggaactcgagacctccctatttcagacacgcaaggctcaccgaatcgagcagatggtggcccgctggctcaggcgtagtcgcgactcctcagccagagccaaagtcgcagccgccgacggccccgcacgcaatcccactcagacattaattcccgtgcgccatacagttaaaattgacaaggatacgcttctgcaagactacgggtttcacataagcgagagcttgcctctgaccgtggttgccgtgaccgcaggaggctccgctcatggcaagttgtttccaggcgaccagattttacagatgaacaacgaacctgccgaagacctgtcctgggagagggccgtggatattctgagggaagcagaagattcactaagcatcacagttgtacgatgtacaagtggagttcctaaatcctcctttctcaccgaggagaagcgggctaggttaaagacaaatccagtcaaggtccacttcgccgaagaggttctgataagcgggcatagccagggcaacagtcttctatgtatgcctaacgtcctgaagttataccttgagaacggacagactaaagcgttcaagttcgaggccaacaccacagtgaaggacattatcctgaccgtgaaagaaaaattatcgattaggagtattgaatactttgctctggcactggaagagcagtacagcatcagtaggctccatttgctccatgaggaagaactgatacaacaggtagtggagcgcgaggaaagccatgactataggtgcctttttcgcgtctgtttcgtccctaaggatccattggacctgttaaaagaggaccctgtcgcctttgaatacctctatcttcagtcgtgtagtgacgttctgcaagaacggttcgccgtcgagatgaaatgttctagcgcactgaggctggcagccctacatatacaggagagaatttatgcttgtgcccagccccagaaaatttcgcttaaatatatcgagaaggattggggtattgaaaatttcatttcacctacgctactgcgaaacatgaaggggaaagatataaagaaggcaatctcattccacatgaaacgcaaccagaacttactagagccccgtcaaaagcaattgatcagcgctgctcagctgaggctgaactacctgcagatccttggcgagttgaaaacttacggaggtcggattttcaacgccaccctgatgctccaagaccgtgaatcctacatcgctctcctggtgggtgccaaatacgggataagccaagtgattaactccaagctgaacattatgagtactctggccgagttcgctaacattagccgtgtggagctgacggaagagagcgaaaaggtgtctgtcgttaaggtttacctccaagacgtcaaagttttgaccttgctgcttgagtctaatagtgccaaagatctggcctgtttgatagcaggctactacaggcttctggtggacccagtcacctccatcttcttgtggccagggaataagcagcaggcacacagagtttcggccgaagagggctatgagtccagagcttgttcggactccgaagagtcctccgaggtagattgtgtgctggaacccctgagcgaccgccgactggtgaaactcgccccctgtcgatcattaataaaggaggagcagccgcctgggaactcgcccacccctgaagttgctcgcagggggccctcgacgtgcggcgcctcttcaactactgattccgcagagtcggaggctagtgactccgctaacacggagtctcgtggatacaggacatccggttctagtgaaagcatggacgcgctcgaagaagacgatctggatacatgcagtagctctagatctaccttcttccatttcgggtcacccggactggccgaatccatagacagtgattcacaagaggagagatcaggtatcgagactagcggattcttatgtctgcttgatctggcgcagcgtgcaaatccccagtgccaaaaaaccgagttctcagagtctgcagccctggaaacctttgggtgggctccagaattgtctactgtgcgtttggaccctcgcctgtacgagggttcccatgccgactattattccctgtgctcaagcgtgagccctgcttcttatctgagcgacagtagtgagtcaacagcgtcccgccaggggggagctcctccggcctggggccagcagggatggaccgaggcacagccgtcctctatgttggaaccactggccctccaccctccactagcattcgaggatgggagtagtgatgaggagtattacgatgccgccgataaactcacacctccaggcccgccatcaggccctcgagatgtgagtacagccgagccttccgctacgagcctgcagaataaagcttccacttcatcccccgaaaactctctgccctgcggccccgacggaaggcagccatcccggcgcggtggagtgaaaaaatacgctaagactctgcgaaaaagaaggtcctttctgcagactgactatacaagccaagttagcttcccgctggtgccaagcgcctcccttgagtccgttgacgatgtgtgctactacgaccgagagccataccttgctctgggcgccccaagccctaccgtctcatccctgcaggacatgcagggagaaccagggctcttggaaaccaaagctcttgggctgcttgcccccctgcgcgagacgaaaagtaccaatccggccagcagggtgatggaaatggaacctgagacgatggaaacaaagagcgtgattgactctcgcgtgtcctctattagcgccataaggttccgaatcgatccgaacaacaaggaaaattctggcgttgtccccgctgcctcttcctctgcatctacccctcactgtagtaaccccggaagttccggccccgatacggcacaagcgagaccctcacagattctgccgctgtcccaggatctggacgggatcgcacccaaggagcccaccattgagcacggggactcaagtttttctctctcctcgggcgaccccaatcctgatagggcttgcctggccagcaatccaggccttaataatgtttctcagggggatacgttggagctgcagcttgaacctcatgtgcagttagagatgggacttgaatcattctgtaccaaccatatccaagagaccgcccctaagtacactgagcccttactgtcgcctagagatgagccccggtccgatgaatgtggaattaaccccggtgagaagattgcatccatacccacaaaggaagaaccccaaggccagctatctctcgaaagggatcgcgaggtcacaaataaaaacggcaccaacgtattccaggaagagtcaagaaaggactctggtgactcgcctggtgacgtgagcaacaacgtttcacaaaccttggacatcagttcccccgcaggtaagatcgtgacctccctctcactggacgcccctgtcaccggcacagagcaaattcccccgcatcctccccgtgacccccagggccagtctcgggaaccccctggacagggatgccaggcacaggagcagaaattgtttgtcgagctggatcttgatcccgacttctttctgggcaaacagacggtgtcacccgccgtgcctccggagggcatcaaggccgaggctccaaaccacgtaacaggtcaggacatcgcgcctagagacagtcctgaatgggtgtgctttaatccagagcccagcctcccagaacctctcccctgtccccaggaggaccctcaccttgagacttcaaaccactgcctcctgagtgaaggcaagagtgacagctcctcaatttgtttgtccgctgaaaagtcatttctgtgctttgcgcctgaatcccatcccgaggtctcagcatccctgcgcgttgccacatccctgggcttcgccgggatgaacgaaatggtggctcctcggatcggcatggatcagtgctcttgtcagttttcttacgccacctgtttcagaggaccacagccagagacagaagaggaggaccgggatctagaggcccaccccatggctcctctcacttcaccaccatccgctggcagtccagtggtcttgccctggcgaccggcgcgcgcccacagctgtacaactgcacccctctctcgtaagtcacatatttggcccgaatactgcagccgggccttgagacaactgaaagccacccccgctagcacaccagagggcttcattcagttgatggagtcactgcttgagcttcaggatatccttgagacaagttggggtgttgggaataagcatccccccgagaagtgtacctggcactttactgagagtcggtcgagactgtgcatgggctcccagaagctcctgagttcttgcaggcatgtcatacgcatggatcaatctccagaggagatgcaaggggccgttcgagatacattccagcacttagtgcagttagctggactttgttttcaattcaccgactgttcaagatgtagcgcacgccatagagaggccgccggtaatctgcgtgacgtggtctacacgtaccaccagtttatcgaggccgcaaagtctacatgtgagcgcggctaccatgatctgtctgttaagttgctggcaaggcaatgtaccgcattaacagccgctgttttctgccttacccagaagtttcgagccagcactgcattgtag

SEQ ID NO: 26317 - DNA, 2046 bp, Artificial Sequence
  Description of Artificial Sequence: Synthetic coding sequence
atggcagaggtgggcggggtcccaaagtcttcgtttctgaccgaggagaaacgcgccagattaaagacaaatcctgttaaagtgcacttcgctgaagaagtgttgatatcgggacactcccaagggaacagcctcctctgcatgcctaatgtgctgaaattatatctcgaaaatggtcagactaaagccttcaagttcgaggccaacaccacagtgaaagacattatcctcaccgtgaaggagaagctgagcatccggtccattgagtactttgcattggccctggaggagcagtactcaatctcccggcttcatctgttgcatgaagaagaacttattcagcaggtagttgaacgcgaggagagccacgactaccgctgtctgttccgggtgtgctttgtgcctaaagacccactggacttgctaaaagaggatcctgtggctttcgagtacttgtatctgcagtcttgtagtgacgttctgcaagaaaggttcgccgtagaaatgaaatgcagcagcgctttgaggctggccgccctacatattcaggagagaatctatgcttgtgcgcaaccacagaaaattagcttaaaatacatagaaaaggactggggcatcgaaaatttcatctcaccaaccctgctgcgaaatatgaagggaaaggacatcaaaaaagcaataagttttcatatgaagaggaatcagaatctcctagaacctcgacaaaaacagctgatctccgctgcccaactgcgcttgaactatctgcaaatactgggtgaactcaagacctacggagggcgaattttcaacgcgacactgatgcttcaagacagagagtcctacattgccctgctggtgggggcaaaatacgggatttcccaagtaattaacagtaaattgaatataatgtcaactctggctgaattcgccaatatttctagggtggagctcaccgaggagtctgagaaggtgtctgtggtgaaagtctaccttcaggacgttaaggtactgaccctcttgctggaatccaattctgctaaggacttggcctgtctcattgcagggtactatcggctcctggtggacccagtgacatcaatttttctgtggcctggtaataagcaacaagctcacagagttagtgccgaggaagggtacgagagtagagcctgttccgacagcgaagagtcgtcggaggtggattgtgttctcgagcctctcagtgaccggcgactcgtgaaactagccccttgccgctcattaattaaagaggagcaacctccaggaaattcgccaaccccagaggtagcgcgtcggggaccaagcacttgtggcgccagctccaccacagacagcgccgagtcagaggcgtctgactccgccaataccgaaagtagaggctataggactagcgggtcatccgaaagcatggacgccctggaagaggatgatctcgatacgtgttcatcctcccggtcaacctttttccattttggtagtcctgggctggccgagtccatcgatagcgacagtcaggaggaaaggtccggtatagaaacatcgggcttcctatgtttgttagatctggcccagcgggcaaatccccagtgccaaaagaccgagttctcagagtctgcagccctggaaacctttggctgggccccggagctgagcactgtgcgacttgatccccgactgtatgagggctcacacgctgattattactccctgtgctctagcgtctcacctgccagctatctgagcgatagttcggagtctactgcctctagacaagggggtgcccctcctgcgtggggtcagcagggctggaccgaggcccagccctcctcaatgctggagccactggctctgcacccgccgttggcttttgaagacggatccagcgacgaggaatactatgacgcagccgataagctgacgccaccaggacccccaagcggcgaaccctcactcgcaggccttcaaacaagacaggctgccccagaatgtcttcctggcatcaaggcatggggccaggcttag

SEQ ID NO: 26318 - DNA, 1713 bp, Artificial Sequence
  Description of Artificial Sequence: Synthetic coding sequence
atgctctcccggctcatgtctggaagcagcaggagcctcgaaagagagtactcttgtactgttcgcttgttagacgattccgaatatacgtgtacgatccagcgggatgcaaaaggccagtatctcttcgatctgctttgccatcatctcaacttgctggaaaaggattattttggaataaggtttgtggatccagacaaacaaaggcattggctggaattcactaagagcgtcgtgaagcagttaaggtcacagccccccttcactatgtgcttccgggtgaagttttacccagcagaccccgcggctctcaaggaagagatcacccgatatctcgtgttcctgcagattaagcgagacctgtatcatgggcgactcttgtgcaaaacaagcgatgctgccttactggctgcttacatcctgcaggccgaaataggcgattatgattccgggaaacatccagaagggtattccagtaaatttcagttttttccaaaacattccgagaaactcgaacgaaaaatcgcagagatccacaaaacagaactgtccgggcaaactccagccacatcagaattaaacttcctgcggaaagcccaaacactcgagacctatggcgtcgacccccatccgtgtaaagacgtgtctggtaatgctgccttcctggcttttactccttttggcttcgttgtgctgcaggggaacaaacgcgtccacttcatcaagtggaatgaggtgaccaaattaaaatttgagggcaaaacgttctatctgtacgtgtcacagaaggaagagaagaagatcatactgacttactttgccccaacccccgaagcttgtaagcacctctggaaatgtggaatcgagaatcaggcattttataaacttgagaagagctcccaggttcggacagttagctctagcaatctgttttttaagggctctcgctttagatatagcggaagggtggccaaagaagtgatggaatcatctgcaaaaattaagagagaaccacccgagatacaccgggctggcatggtgccgtcgagatcctgtccctcaatcacccacggccccaggctgtcttcagtgccacgaacccggaggcgcgccgtccacatctcaataatggagggcttggagagcctgcgcgattctgcgcactctactccagtcagatccacatcacacggagatactttccttccccacgtaagatccagcaggactgactcaaacgagagagtcgcagttatagcagacgaagcctactctccggcggattctgtgctgccaacccccgtggcagagcattccctagagctcatgctgctctcccgccagataaacggggctacttgcagcattgaggaagagaaagaatccgaggcatctacaccaacagccactgaggtggaggccctgggaggagaattgcgggcactatgccagggtcattctggcccagaggaggaacaagtaaataagttcgtactatctgtgctgcggctcctgctcgttaccatggggctgttgttcgtactgttactgttacttataatactcacggagtctgatctagacatcgccttctttcgagacatcagacagacacctgaattcgaacagttccactatcaatacttctgcccattgcggcgctggttcgcttgcaaaatccgttcggttgtgtcactgctgattgacacgtag

SEQ ID NO: 26319 - DNA, 1245 bp, Artificial Sequence
  Description of Artificial Sequence: Synthetic coding sequence
atgtgctttcgcgtgaaattctaccctgccgatccagccgcgctcaaggaagaaattaccaggtacctggtattcctgcagattaagcgggatctgtaccacggtcgcttactgtgtaagacctccgacgccgctctgttagcagcgtacatcctgcaggcggaaataggcgattacgattcgggtaagcaccccgagggctacagcagcaagttccagttctttccaaaacacagtgaaaaattggaaaggaaaatcgcagagattcacaagaccgagctttcaggtcagacacctgccacatctgagctgaactttcttaggaaagctcagactctggagacttatggcgtcgatcctcacccgtgcaaggatgtgagcggtaacgccgcatttctggccttcactccattcggatttgtggtgctccagggcaataaacgcgtacacttcataaaatggaacgaggttacaaagctcaaatttgaaggaaaaactttctacttgtacgaaaaaaagattattttgacctacttcgcgccaaccccagaagcttgtaagcatctctggaagtgtgggattgaaaaccaggcgttttataagctggagaaatcctcacaggttaggaccgtttcaagttcaaatttattctttaagggcagcaggtttaggtattccggacgggtggcgaaggaggtgatggagagtagcgcaaaaatcaaacgcgagccgccggaaatccatagagccggaatggtgcccagccggagctgtccatcaatcacacatggtcctaggttatcctctgtgcctcgcacccgtcgaagggctgtgcacatctctataatggaaggcctggagtccttgagggactccgcccactctacacccgtgagatcaacctcccatggagatacatttctgccacacgtccgtagcagtagaaccgattctaacgagagggtagccgttatcgcagacgaagcctatagtcccgcggactctgttttgcctaccccagtggctgagcatagcctggagctcatgcttctatcacgccagatcaatggcgccacctgcagtatcgaggaagaaaaagaatccgaggcatctaccccaaccgcaactgaagttgaggctctggggggagaactgcgggccctgtgccagggacattcggggcctgaggaagagcaggcaatggtttgcttacagaatccgcttagcggagaacctgcacattag

SEQ ID NO: 26320 - DNA, 1869 bp, Artificial Sequence
  Description of Artificial Sequence: Synthetic coding sequence
atgaacaagcttaattttcacaataatagagtgatgcaggatcgaagaagcgtatgcatattcttacctaacgacgagtcattaaacatcattataaatgtgaagatcctctgtcaccagctgctggtccaggtttgtgatcttctgcggctaaaggattgccatctattcgggttgagcgtgattcaaaacaatgagcacgtttacatggagctgagtcagaaattgtacaaatattgtcccaaagagtggaagaaggaggcctccaaagtgaggcagtatgaggtgacctgggggatcgatcagttcggcccacccatgatcatccatttcagggtgcagtattatgtggagaacggccgtctcatttctgatcgggccgcccgatattactattactggcaccttcgcaagcaggttctgcacagccagtgtgttttgcgtgaggaggcctatttcctcctggctgcgttcgcgctccaggctgacctaggcaatttcaaaagaaacaaacactatggcaagtacttcgagcccgaggcttacttcccaagctgggttgtgtctaaacgagggaaggattacattctaaaacacatccctaacatgcacaaagatcagtttgcgctgactgcaagcgaagcccacctgaaatacattaaggaagccgtgagattggatgatgttgcagtgcactattacaggctttacaaggataagagggagattgaagcgagtcttacgctgggccttaccatgaggggcattcaaatttttcagaaccttgacgaagaaaaacagttactctacgacttcccctggacgaatgtggggaagctggtattcgttggcaaaaagttcgagatcttgccggatgggctcccatctgcccggaagctaatatactataccgggtgccccatgcggtctcgtcatttgttgcagctgctgagcaattctcacaggctgtacatgaacttgcaacccgtgctccgccacattaggaaacttgaagagaatgaggagaaaaagcagtacagagagtcctacattagcgataacctagacctggacatggatcagttggagaagcgatcgagggccagcgggagctctgccggctcgatgaagcacaagcgactctccaggcatagtacagcgagccactcttcttctcatacttctgggatagaagccgatacaaaaccgcgcgacacgggccctgaggattcttactctagttccgctatccatcgcaagctgaagacctgctccagcatgacctctcatgggagttcacacaccagcggggtcgaatctgggggaaaggacaggctggaagaagacctgcaggacgatgaaatagagatgttagtagacgacccccgagacttggaacaaatgaatgaggaaagcttggaagtgtcacctgatatgtgtatctatattaccgaggacatgctcatgtcgcgcaaactgaacggccactcagggctaattgtaaaggaaatcggcagctccacaagctccagttccgagactgttgtgaagctgagagggcagtcgacagacagcttgccccagaccatttgtcgcaaacctaagacatcaacggataggcatagtctgagtctagacgatatcagactgtatcaaaaagacttcttgaggattgcgggcctctgtcaggacactgcacaaagttacacctttgggtgtgggcatgagctcgatgaggagggactgtattgtaatagttgtttggcgcaacaatgcatcaatatccaggacgccttcccagtgaagaggactagtaagtacttctctttagacctgactcatgacgaggtacccgaattcgtcgtgtag

SEQ ID NO: 26321 - DNA, 1845 bp, Artificial Sequence
  Description of Artificial Sequence: Synthetic coding sequence
atgaataaactgaacttccacaacaatcgggttatgcaggaccgtaggtcagtctgtatattcctccctaatgacgaaagcctcaacatcatcatcaatgtgaaaatcctatgccaccagctgttggtccaagtctgcgatttattgcggctcaaggactgtcacctattcggcctgtcggtcatacagaataacgagcacgtgtatatggagctgagccaaaaattgtataaatactgtccaaaggaatggaaaaaggaagccagcaaaggaatagatcagttcggtccacctatgattattcattttcgcgtgcaatactatgtggaaaatggcaggctgatttctgacagagcagcacggtactactattactggcacctgcgaaaacaggtgctgcatagtcaatgcgtgttaagagaagaggcttatttcctgttagcggcgttcgcactgcaggctgacctgggtaatttcaagagaaacaaacactatgggaagtattttgaacccgaggcgtatttcccttcctgggtagtcagcaaacgtggcaaagactatatactgaaacatattcctaatatgcacaaagatcaattcgcgctgacagctagtgaagctcaccttaaatacatcaaggaggccgtacgcctggatgacgtggcagttcactactatagactctataaggacaaacgagaaattgaagcatcactgaccctgggactcaccatgcgcggaatacagatctttcaaaatctcgatgaagaaaagcagcttctatatgatttcccctggacgaatgtcggcaagttggtgtttgttggcaaaaagttcgaaatcctccccgacggacttcctagcgcacgtaagctgatctactatactgggtgtcctatgagatctcgtcatctacttcagctactatctaatagtcatcgcctttacatgaacctccagcctgtgctgagacacattcgcaagttggaggaaaacgaggagaaaaaacagtatcgcgagtcctacattagcgataatctcgacctggacatggatcaactggaaaagcggagccgcgcttcaggctcttctgcaggaagtatgaaacataaaaggttaagccgacactctactgcttcacactctagtagccacacgagcgggatagaggcagatacgaaaccccgcgatactgggcccgaggacagctattctagttccgccattcataggaaactcaagacatgctcatcaatgacatctcacggatcgtctcatacatcgggagtcgaatcaggcggaaaggataggctcgaggaggacttacaggacgatgagatcgaaatgctcgttgatgacccgcgggatctggagcagatgaatgaggaaagcttggaggtcagccctgacatgtgcatatatattaccgaggatatgctgatgtctagaaagctgaacggtcattcaggacttatcgtaaaagaaattggcagtagcacctctagctcctcagaaacagtggtgaagctgaggggccagagtacagattcattgccccagacgatttgtcgcaagcctaaaacttccaccgaccgacatagcctatcccttgatgatattcggctataccagaaagatttcctgcgaatcgcaggtctgtgccaggacaccgctcagtcatacaccttcgggtgcggccacgagttagacgaggaaggattgtactgcaactcatgccttgctcagcaatgcatcaatatacaggacgctttccccgttaaaaggacatccaaatacttctctttagatctgactcacgacgaagtgccggagttcgttgtatag

SEQ ID NO: 26322 - DNA, 1845 bp, Artificial Sequence
  Description of Artificial Sequence: Synthetic coding sequence
atgaataaactgaacttccataacaatcgagtgatgcaggacaggaggtccgtgtgcatctttctacccaatgacgagagcctgaatattattataaatgttaagattctgtgccaccagcttcttgtgcaggtgtgcgacttgctgaggctcaaggactgccacctgttcggactgagcgttatacaaaacaacgaacacgtctacatggaattgtcccaaaaattatacaagtactgtcctaaggagtggaaaaaggaggcttctaagggaatcgatcagtttgggcctcccatgataatccatttcagggtgcagtactatgtggagaatgggcggctaatctctgatagggctgccagatactattattattggcacctgagaaaacaggtgctccactctcagtgtgtactcagggaggaggcatatttcttgctggcggcctttgccctgcaggcggatctggggaattttaagcgcaacaagcactatgggaaatacttcgaacccgaggcttacttcccgagttgggttgtttctaagaggggcaaagactatatactcaagcacatcccgaacatgcacaaagatcagtttgcattaaccgcttcggaggctcatctgaagtacattaaagaagctgttagattggacgacgtagcagtccattactatagactgtataaggataagagggagatagaggcgagtcttacgctcgggctcacaatgcgtgggatccagatatttcaaaatctcgacgaagagaagcaactcctgtatgattttccctggactaacgtggggaaactggttttcgtcggtaaaaaattcgaaatcttgccggacggcctgccctcagcccggaaactgatttactacacaggatgtccgatgcggagcagacacctgctgcagttgctgagcaactcccacagattatacatgaatctgcagccagttctgcgacacatcaggaaactggaggagaacgaggagaagaaacaatatcgggagtcttacatttcggataatctggatttggacatggaccagctcgaaaagagatctcgcgcctctggatccagcgctgggtctatgaagcacaagaggcttagcagacactccacagcatcacatagtagtagccacacctcaggcatcgaggctgatacgaagcctagagatactggaccagaggactcctattcctctagcgctatacatcggaagttaaagacatgctcgtcaatgacctcgcatggctccagccataccagcggtgtcgagagcggtggaaaggataggctggaggaggacctccaagacgacgaaattgagatgttggtagatgaccccagggacctggaacagatgaacgaagaaagtttggaagtgagtccggatatgtgtatctatataaccgaggacatgctgatgagccggaagcttaacggacatagcggacttatcgtgaaggaaatcgggtcctcaacgagtagttcaagtgagactgtggttaagctccggggccagtcaacagatagtttgccccagacaatatgtaggaagccaaaaacatcaactgaccggcactccctaagtctggacgacataagactttaccagaaagattttcttcggatcgccgggttgtgccaagatactgcccaatcctacacgttcgggtgcggccacgagttggacgaggaaggcctctattgcaacagttgtcttgcccaacagtgcattaacatccaggacgcattccctgtgaaacgtacatccaagtatttcagtctggacctgacccacgatgaggtgccagagttcgttgtctag

SEQ ID NO: 26323 - DNA, 795 bp, Artificial Sequence
  Description of Artificial Sequence: Synthetic coding sequence
atggatcagcttgagaaacgctctagagcctccggcagctcggcaggatccatgaaacacaaaagactctctagacactccacagcgtctcattcctcttcccacaccagtggaattgaagctgacaccaagccacgtgatacaggacctgaggactcctactccagtagcgctatccatcgtaagttgaaaacatgcagttccatgacctcacatggtagtagtcacaccagtggtgtcgagtccggcggcaaagacaggctcgaagaagatctgcaagacgacgaaattgaaatgctggttgatgatccacgcgatcttgagcagatgaacgaggagagtcttgaagtgtcccctgacatgtgtatctacatcactgaagacatgctcatgtcccgtaagctgaacggccattcaggccttatcgtgaaggagatagggtccagtacaagttcttcttccgagaccgttgttaaattaagaggccaatcaactgactcccttccacaaacgatttgtcggaagcccaaaacttctacagacaggcacagtctctccctggacgacattcgcctctatcaaaaggacttccttaggattgctggactctgtcaggacacagcccaaagctatacatttgggtgcggccacgaactggacgaagaaggtttgtattgcaactcatgcttggcccaacagtgcatcaatattcaggatgcttttccagtcaagcggaccagcaaatacttctctctcgacttgactcacgacgaagtccccgagttcgtggtgtag

SEQ ID NO: 26324 - DNA, 186 bp, Artificial Sequence
  Description of Artificial Sequence: Synthetic coding sequence
atgaacaagttaaacttccacaataacagagtaatgcaagaccggcggagtgtatgtattttcctccctaacgacgaaagtctgaatatcataatcaacgtaaagatcctctgtcatcagttattagtgcaagtgtgcgacctgctaagattgaaggattgtcatttgtttgggctgtccgtatag

SEQ ID NO: 26325 - DNA, 3138 bp, Artificial Sequence
  Description of Artificial Sequence: Synthetic coding sequence
atgggcgaaattgagcagaggcccacaccaggttcgaggctgggagcaccggaaaattccggcatcagcacgctggagagaggccagaagccccccccaacgccaagtggaaagctagtgtccatcaagattcagatgctggacgacactcaggaggcattcgaagtgccccaacgggccccaggcaaggtgctcttggatgcggtttgtaaccatcttaatctggtagaaggcgattatttcggacttgagttcccagatcacaaaaagattaccgtatggctcgaccttctgaaaccaatcgtcaagcagattcgtcgtccaaaacacgtagttgtgaaattcgtggtgaaattctttccacccgaccatacccagctgcaggaggagctgacccggtatctctttgcacttcaggtgaagcaggacttggctcagggaaggctgacctgtaacgacacttcagccgccctgttgattagccatatcgtgcaatcagaaatcggagactttgacgaagcccttgatagagaacatctggccaaaaacaagtatatacctcaacaggacgcactcgaggacaagattgtggagttccaccataatcacatagggcaaaccccggccgaatccgattttcaacttctggagatcgcacggcgcttggaaatgtatggcatccggcttcaccctgccaaggatcgcgaggggactaaaatcaacctagccgtagcaaatactggcatattagtgttccagggattcacaaaaatcaacgcattcaactgggccaaggtgagaaagctgtcattcaagagaaagcgattccttattaagctaaggccagacgcaaatagcgcctaccaggataccttggagttcttaatggcgagccgcgatttttgtaagagtttctggaagatctgcgtggaacaccacgccttcttcagactgtttgaagaaccgaagccaaaacccaaacccgtgctgttttcccgaggatcctccttccgattttctgggcgtacccagaagcaggtgctcgattatgtcaaggaaggtgggcacaaaaaggtgcagtttgagcgaaagcacagtaaaattcacagtatcaggagcctcgccagccaacccaccgagttgaacagcgaggtgctagaacagtcacagcagagcactagtctgacattcggagaaggagctgaatcccccggtggtcagtcctgccgccggggaaaggaaccaaaggtcagtgctggcgaaccaggctcacacccctctcccgccccacggagaagcccagctggaaataagcaggctgacggggcagcatcagccccaaccgaagaagaggaagaggtggtaaaggatcgcacccagcagtcaaagccccagccgccccagccttcaacaggaagccttacgggctccccccatctctccgaactgagtgtgaatagtcagggcggagtagctccagctaacgttacactgtcccctaatctctcgcctgacaccaagcaggcatcccccttaatctcacctttgctcaatgatcaggcgtgtccaagaacagatgacgaagacgaagggaggcggaagcggttcccaaccgacaaagcctacttcatcgccaaagaggtaagcactactgaacgtacctacttgaaagatctcgaggtaattactagctggtttcagagcacggtatcgaaggaggacgctatgcctgaggctctcaagagcctgatctttccgaattttgagccactccacaagttccacaccaactttctcaaagagattgagcagcgactggctctctgggaagggagaagcaacgcgcaaattcgagactatcagcgcatcggcgacgtaatgctgaaaaacatccagggaatgaagcacttggcagctcatctgtggaagcacagcgaggctctggaagcccttgaaaatggcataaagagctcccggagactcgaaaatttctgccgcgatttcgagctgcagaaagtgtgctacctccccctcaacacctttcttttaaggccgcttcatcgacttatgcattataaacaggtgctggaaagactgtgtaagcatcatcccccatctcatgcagatttccgggactgtagagctgctctggccgaaatcacggaaatggtagctcagctgcacgggaccatgatcaaaatggagaacttccagaagctccacgagctgaaaaaagacctaatcggcattgacaatctggtggtgccaggccgcgaattcatacgcctgggatccctgagcaagctgtctggaaaaggcctccaacagcgaatgttctttttgtttaacgatgtgttactttacaccagtcgcggtcttacggcgagcaaccagtttaaggtccacggccaactccctctctacggcatgacaattgaagagagtgaggatgaatggggtgtgccgcattgtttgacattgcgggggcagcggcagtctataatcgtagcagctagctccagatcagagatggagaagtgggtcgaagatattcagatggccatcgatctcgccgagaaaagctctagtccagcaccggagtttctggcttcctcgcccccagataacaagtcgccggacgaggctacagctgccgatcaggaatctgaggatgacctcagtgcctcacggactagcctcgaaagacaagcaccccacagaggtaataccatggtccatgtctgctggcacagaaacaccagtgtctctatggtagactttagcatagctgttgaaaatcagctgagcggaaacctgctgcggaagtttaaaaactcaaacggatggcagaagctttgggtggtgttcactaacttctgcctgtttttttacaagtcacaccaggataatcatcccctcgcttcgctgccactgcttggatacagtctcaccatcccatcagagtcagagaacatccagaaggattacgtgtttaaactacacttcaaaagtcatgtgtactacttcagagctgaaagcgaatacacatttgagaggtggatggaggtgatccgctccgctacgtctagtgcatctcggcctcatgtactgtctcataaggaatccctcgtctattag

SEQ ID NO: 26326 - DNA, 390 bp, Artificial Sequence
  Description of Artificial Sequence: Synthetic coding sequence
atgggagagattgaacagagacccactcccggttcaaggttaggtgcccctgaaaattccggcatatcaacgctcgagcgcgggcaaaagccgccccccacaccgtctggcaagctcgtaagcataaaaatacaaatgctggacgatacacaggaggctttcgaagttccaatggttagctcttcctcttttcttaaagccacaggcagtagctggaccgggtgggtgctgcgatgttccatgaagccgaaacaccactcccacctcatcgagaagttcggcgaggatagaatcctgactcatctgaccggctctatcagctatactaattgggccggatcccggtccctggcagtgacagtgacagaggagttgttgaatctcttctag

SEQ ID NO: 26327 - DNA, 1083 bp, Artificial Sequence
  Description of Artificial Sequence: Synthetic coding sequence
atggccagccgcgatttctgcaaaagcttctggaaaatctgcgttgaacatcacgctttctttcgcctgtttgaagaacccaaacccaaacccaagcccgtgttgttcagcagggggtcttcatttagattttccggccgtacccagaaacaagtgctggattacgtgaaggagggaggtcacaagaaggtccagttcgaacgcaagcattccaaaatccacagcattcgctccttggctagccagcctaccgaactgaacagcgaagtgctcgagcagtcccaacaatcaacttctttgactttcggcgaaggtgctgagagccctggaggacagtcatgtaggcgcggtaaggagccaaaagtaagtgctggcgagcccggaagccacccctccccagctcctcggcgcagccctgctggcaataagcaggccgatggagccgccagtgctccgaccgaagaggaagaagaggtagtgaaggatcggacccagcagtcaaagcctcagcctccacagccatcaacaggctccttgactgggtcccctcatctatccgagctgtctgtcaactcacagggcggggtggccccagccaatgtgaccctgagccccaacttgagcccagataccaagcaagcctctccgttgatttctccccttctgaatgatcaggcctgtcccagaaccgacgacgaggacgaagggcggcgaaaaagatttccgacggataaggcctatttcattgcaaaagaggtgagcacaaccgaacggacttacctcaaggatctcgaggtgatcacttcgtggtttcagagcaccgtgtccaaggaagacgccatgcccgaagccctaaagtccctcatctttcccaattttgagcccttacataagttccatacaaatttcctcaaggagattgaacagcgactcgccctctgggaaggaaggtcgaatgctcaaataagagattaccagcggattggtgacgtcatgttgaaaaatatccagggaatgaaggccggcgtccagtggcgcgatctcggatctttgcagccgcccccacctcgctttaagccatag

SEQ ID NO: 26328 - DNA, 3231 bp, Artificial Sequence
  Description of Artificial Sequence: Synthetic coding sequence
atgggtgagatcgaacaaagacctacccccggatcaagactaggagctcccgaaaacagcggcatctccaccctcgaacggggacaaaaaccacctcccaccccgagtggcaagcttgtgtctatcaagattcaaatgctggacgacacacaggaggcctttgaggtcccacagcgggcccctggcaaagtgctcctggacgcagtctgtaaccacctgaatctggtggagggggactattttggactcgagttccctgatcacaagaaaatcaccgtatggctggacctcttgaaacccatagtaaagcagataagacgccctaaacacgtggtcgtgaagttcgtcgttaagttctttcctcctgatcacacccaactgcaagaagaactgactagatacctgttcgccttacaggtgaagcaggatctggcacagggccgcctgacttgtaatgacacaagcgcagcactgctgatttcgcatatagtgcagagcgagataggggacttcgacgaagcactcgacagggagcacctggcaaagaataagtatataccccaacaggacgccctggaagataaaatcgtggagtttcatcacaatcatataggccaaacaccagccgaatctgactttcagttgctggagatcgctagacgcctagaaatgtatgggattagactgcaccccgcaaaggaccgtgagggaacgaagatcaacctggctgtggcgaatactggaatcctggttttccaaggattcacaaagatcaacgccttcaattgggcaaaagtgcgcaaactgtcctttaagcgcaaacggtttctgatcaagctgcgacccgatgctaactccgcctaccaagataccttggaatttttaatggcttcccgggatttctgcaagtccttctggaagatctgcgtagaacaccatgcatttttccgattgttcgaagagcctaaacccaagcctaaaccagtgctcttttctcgtggctcctcatttcggttctccggcagaacccagaagcaggtgctcgattacgttaaagaaggcggtcacaaaaaggtgcagttcgagagaaagcactctaaaatacacagcatcagaagcctagcaagccaacccacagaattgaacagcgaagtgctcgaacagtcacagcagtctacatctctcacatttggtgaaggggccgagtcacccgggggacagagctgtagaaggggaaaagagccgaaggtctccgctggggagccaggcagccaccccagcccggcacctcgccgctcacccgctgggaataaacaggctgatggggccgcttctgccccaactgaagaggaggaggaggtcgtaaaagataggactcagcagtccaagccacagcccccacagccctctacaggatccttgaccggaagtccacacctttccgagctcagtgttaactcccaggggggggtagcccctgctaacgtgaccctgtccccaaatctctcccctgacacgaagcaggcatcccctctgattagcccactcttgaacgaccaagcgtgtccccgcaccgacgatgaggatgaaggacgccggaaaagatttcctactgataaggcttacttcattgctaaagaagtgtcaactactgagaggacttacctgaaggacttagaggtgataacctcttggttccaaagcaccgtgtcaaaagaggacgctatgccggaggctctgaagtcgctgatttttccgaatttcgaaccactgcacaagtttcacaccaactttctgaaggaaattgagcagcggcttgcactgtgggaaggtcgcagcaacgcccagataagggattatcagcgcatcggagatgtaatgttgaagaacatccaaggtatgaaacatttagctgctcatctctggaaacacagtgaggccttagaagccctggaaaatggaatcaaaagcagtcgtcggctcgagaatttttgcagagatttcgaactgcagaaggtatgctacctcccactcaatacattcctccttcgtcccctgcaccgtctgatgcactataaacaggttctcgagcggttgtgtaagcatcatccaccatcgcatgcagatttccgggactgcagagctgctctggccgaaatcaccgagatggtggctcagcttcacggtaccatgatcaaaatggagaacttccagaagctgcatgaactgaaaaaggatctcattggcatagataatctggtggtgccgggccggcctggaagcttcagcctgattagaacccctcacctcggccaagcacgaagaattccctgcgcccccgagaggagaccgctgttgctcgtcaaagaatttatcagattgggaagcttgtctaagctcagcggaaaggggctgcagcaaaggatgttttttttgtttaacgacgtactgctctacacatctcgtggactgaccgccagtaatcagtttaaagtccacggccaactgcccctctatggaatgacaatagaagaaagtgaggacgagtggggtgtgccacactgtttgactctccggggccaaagacagtccattattgtcgcagcctcgtcccggtctgagatggagaagtgggttgaggacatccagatggcgattgatctggccgagaagtctagttcacccgcccctgagttcctcgcctcctcccctccagataacaaatcaccagacgaagctactgcagccgatcaggagagcgaggacgatctaagtgcatccagaacttcccttgaaaggcaggcacctcaccgcgggaacacaatggtccatgtatgttggcatcggaacactagcgttagcatggtggacttcagtatcgccgtggagaaccagcttagcggaaatttactgcgtaagttcaaaaattccaatggctggcaaaaactgtgggtagtttttactaatttctgtctttttttctataagagtcaccaggacaatcatccacttgcttctttacccctcttggggtattctctgaccatccccagtgagagcgagaatatccagaaagattatgtttttaagctgcattttaaatcccacgtgtactacttccgtgctgagtcggagtacactttcgaacggtggatggaggtcattcgatcggcaacatcttccgcttcaagaccccatgttctgtctcacaaggagtcactcgtgtattag

SEQ ID NO: 26329 - DNA, 462 bp, Artificial Sequence
  Description of Artificial Sequence: Synthetic coding sequence
taactgtgtaagcaccatcctccctcccacgccgatttccgtgattgcagggccgccctggctgaaataacggaaatggtggcgcagctgcacggaactatgataaaaatggagaatttccagaaactgcacgaattaaagaaagatcttattggtattgataatctggttgtcccaggccgggtctcttcctccggcttaacgatgcactgtgccggtagccgtaaggaagcgtccgaaggtctaacttttgaacctttcgaggagagacctttgcaatcgaagatgtcctcctttcacccaccaggccgccaactggagaaacacaattcagtggtctcctccgagtctttgtgttctgaagagattaaacagtcctcagatcttatcttctgttttttttccttacggggagattctctgctctatcttttcccatatcacataccgcaaaaaatttag

SEQ ID NO: 26330 - DNA, 555 bp, Artificial Sequence
  Description of Artificial Sequence: Synthetic coding sequence
taaagcctgactggcagccctcatctgtccgaactcagcgtgaattcacagggaggcgtggctccggcaaatgtgactcttagccctaatttgtccccagacacaaagcaggccagtcctctgatctctcctctactgaacgatcaggcctgtcccaggacggatgacgaagacgagggccggagaaagcgcttccctacagacaaagcttactttatcgccaaggaggtgtctacgaccgaaagaacctatctgaaggacctggaagtgataacgtcgtggtttcagagtactgtgtctaaagaagacgccatgccagaagcactaaaaagtctcatctttcctaactttgagccattacacaagtttcataccaacttcctcaaggaaatcgaacaaagactggctctctgggaaggcagatccaatgcgcagatcagggactaccaacgaatcggtgatgtgatgctgaaaaatattcagggaatgaaggctggagtgcagtggcgggacttggggtccctacagccgccaccaccacggttcaagccctag

SEQ ID NO: 26331 - DNA, 3165 bp, Artificial Sequence
  Description of Artificial Sequence: Synthetic coding sequence
atgggggagatcgagggaacgtaccgggtgttgcagactgcaggaatgaggctcggcgcccaaacgcctgtgggcgtctccacactcgagccgggtcaaaccctactaccgaggatgcaggagaagcatctgcatctccgggttaaactgctcgataatacaatggagattttcgatatcgaacccaagtgcgacggccaggtgctgcttactcaagtatggaagcggttgaacttggtcgagtgtgattacttcggcatggagttccagaacacccagtcgtattggatttggttagagccgatgaaaccaattattcggcagatcaggaggcccaaaaatgttgtgctgcgcctcgcagtcaaatttttcccacccgatccaggacagctgcaggaggaatacaccagatacctgttcgcgctacaactgaagagggacctcctggaggagcgccttacatgtgcggacacaaccgccgctttgctaaccagtcatcttctgcagagcgaaattggagattatgacgaaacccttgatagagagcacctcaaagtgaacgagtatctgcccgggcagcaacattgtctggaaaagatcctggagtttcaccagaaacacgtaggacagaccccagcagagtccgatttccaggtgctagaaattgcccgcaaattggagatgtatggaattcgattccatatggctagtgacagggaaggcacaaaaatacaactagctgtatctcatatgggagtgctggtgttccagggaaccacaaaaatcaacacttttaactggagtaaagtccggaagctgtcctttaaacggaagcgcttcctgatcaagctgcatccagaggtgcatggcccatatcaagatactttagagttcctgctggggagtagggatgagtgcaagaatttttggaagatttgtgtggaataccacacattctttcggctgttggatcagccaaagcccaaggcaaaggctgtgttctttagtaggggctcctctttcagatactccggacgtacacagaagcagctcgtcgattattttaaggacagcggaatgaaacggatcccgtacgaacggcgccatagtaagacacacaccagcgtgcgagctctgacggctgacctgcctaaacagagcatcagcttccctgaaggtctccgcacgcctgcttccccttcatcagccaatgcattttattccctctccccttccactttggtgccctctgggctgcccgagttcaaagacagctcaagctcactgaccgacccacaggtgtcttacgtaaagtcaccagcagccgagcgccggtcaggagcagtcgctggcggacctgacaccccttccgcacagccactaggcccgcccgcgcttcagcccgggccaggattaagtactaaatcccctcagccttcaccttcgtcaaggaagtcccccttgtccctgagccccgcgtttcaagttcctctaggccctgccgaacaaggatcatccccgctgctcagtccggtgctgtctgatgccggcggagcaggtatggactgcgaagagccccgccataaaagagtgccagccgacgaggcatattttatcgtgaaagaaattctggccactgagaggacctatctgaaagaccttgaggtcattaccgtctggtttaggtcagccgttgtgaaagaggacgccatgcctgcgaccctgatgaccctcctctttagcaatatagaccctatttacgagttccacagagggttcctccgcgaagtggaacaacggctggcactgtgggaaggcccaagtaaagcccacacaaagggtagccaccagcggatcggcgatattttgttgagaaatatgcggcagttgaaggagttcacgtcctactttcaacgtcacgatgaagtactgaccgagctcgaaaaggccacaaaaagatgtaaaaaactcgaggcggtgtacaaggagttcgaacttcagaaggtgtgctatctgcctttgaacacctttctgctgaaaccaatccagaggcttttacactaccggctgcttctgcgcaggctttgcggacactactcccctgggcaccacgattacgccgattgtcacgacgccctgaaggctattaccgaagtgacaactactctccagcacattctgataagactcgagaatttacagaagctcaccgaattgcaacgcgatttagtgggcatcgaaaatctaattgcccctggacgcgagttcataagagagggttgccttcacaaactaactaagaagggcctgcagcaaagaatgttcttccttttcagcgatatgctcctctatacctccaagggcgtggctgggaccagccatttcaggattcgcggcctgctgccactccagggcatgctggttgaggaaagcgataatgagtggagtgtgccccactgcttcaccatctatgccgcccagaaaacaatcgttgtggccgcctcaacacgccttgagaaagaaaaatggatgctggatttaaatagcgccatacaagcggcaaagtccgggggcgataccgctcctgccctgcctggtagaacagtctgcactagaccccctaggagccccaatgaagtgagcctggaacaggagagtgaggacgatgcccggggcgttaggagtagcctggaaggccatggacaacatcgggccaatactacgatgcacgtttgctggtatcggaatacctctgtaagccgggccgaccactcagcagccgttgagaaccaattaagtggctacttgcttaggaaattcaagaactcccatgggtggcagaaactgtgggttgtcttcactaacttttgcctgttcttttacaagacacatcaagacgattaccctctggctagtctgcctctgctgggatactccgtgagtatccccagggaggccgacgggattcacaaggattatgtgtttaagttgcaattcaagagtcacgtgtacttcttccgggccgagtccaagtatacctttgagcggtggatggaagtgattcagggtgcttctagttctgcgggtagagccccaagcatcgtacaggacggaccccagccctcctctggtctggagggcatggtcagaggtaaggaagagtag

SEQ ID NO: 26332 - DNA, 1944 bp, Artificial Sequence
  Description of Artificial Sequence: Synthetic coding sequence
atgggcgaaatcgaaggcacatatcgcgtgctgcagacggcagggatgaggctaggagcacaaacacccgtcggagtctcaactctggagcctggacagacattattaccccggatgcaggagaagcatttacatctgcgcgtgaaactgctagacaataccatggagatctttgacatcgagcccaagtgcgacgggcaggtcctcctgacacaggtgtggaaaagactgaacctggtagagtgtgactattttgggatggaatttcagaatacccagtcatattggatctggctggagccgatgaagccaatcatcaggcagatcaggcgccccaaaaacgtagtccttagattggcagtcaagttcttccccccagaccccggccagctgcaggaggaatataccagatacctgtttgccctccagcttaagcgcgacctgctcgaggaaagactcacttgtgccgacacgaccgcagcactcctgacaagtcacctgctgcagtccgagatcggggactacgacgaaacacttgatcgtgaacaccttaaagtgaacgagtatctgcccggccagcagcattgcttggagaaaattttggaatttcaccagaaacacgtgggacaaaccccggcagaatccgatttccaggtcctggagatagccaggaaattagagatgtatgggattcgcttccacatggcttctgaccgcgaggggacaaaaatccagctcgccgttagccatatgggcgtcctggtgtttcagggcactacgaaaatcaatacatttaactggtcaaaggtgcgcaaattgtcattcaagcgtaagcggttccttataaaacttcatcctgaagtccacggcccttatcaggacaccctggaattcctgctgggctcacgggacgagtgcaaaaatttctggaagatctgcgttgaatatcatacattctttcgcctgctcgatcagcccaagccgaaggccaaagcagtgttcttcagtaggggcagttcttttaggtactctgggcggacccagaagcagttggtggactacttcaaggactctggaatgaagcgcatcccatacgagcgtaggcactctaagacacatacttcagtgagggcactaaccgcggacttaccgaagcagagtatctcatttcctgagggcctgagaacgccagcttccccttctagcgctaacgctttttatagcttgtcgccatctacgctggtcccatccggtctacccgaattcaaagactccagcagttctctaaccgatcctcaagtgagctatgtcaagtcaccagcggcagaacgccggtcaggagcagtggctggcgggccagacaccccctctgcgcagcccctagggcccccagcactgcagcctgggccaggtctgtcgactaaaagcccacagcctagcccaagttcaagaaagtcacctctgtcattgtcccctgccttccaggtgcccctcggtcccgcggagcaggggtcttctccattactatcacctgtgctgagcgatgcagggggagccggaatggattgtgaggagccaagacataagcgagtgcccgctgatgaagcctactttatcgtgaaggagattttagctacggagcggacgtatttaaaggacttagaggtaatcactgtctggttcagatcggccgtggtgaaagaagatgcaatgcctgcaaccctgatgacacttttgttttctaatatcgatccaatatatgaattccaccggggattcttgcgggaagtcgagcagcggttagcactttgggaaggaccaagtaaagcccacacaaaggggagccaccagagaatcggcgacattcttctgaggaatatgaggcagctaaaagttttccaactgcatgagggccacgtggcaggggtcacaaaaatggagtag

SEQ ID NO: 26333 - DNA, 171 bp, Artificial Sequence
  Description of Artificial Sequence: Synthetic coding sequence
tgaaagtcacatgtgtacttttttcgagctgagagtaagtatacctttgaacgatggatggaggttatccagggggcaagttcctccgccggccgggctccaagcatagttcaggatggaccacaaccaagctcgggtcttgagggaatggttagagggaaggaagagtag

SEQ ID NO: 26334 - DNA, 405 bp, Artificial Sequence
  Description of Artificial Sequence: Synthetic coding sequence
atgggagagattgaaggaacttacagagtgctccagacagccggcatgcggctgggcgcacaaacacctgttggagtttcaacactcgagcccggacagaccctcctgcctaggatgcaggagaagcatctccatctgcgcgtgaaacttctggacaacaccatggagattttcgacatcgaacccaaatgcgatggacaagtactgctgacacaggtctggaaaagactgaatctcgtcgagtgcgattatttcgggatggaattccaaaatacacaaagctactggatctggcttgaaccgatgaaacccattattcgtcagatccgaagacccaaaaacgttgttttgcgactagctgtcaagttctttcctcccgatcccggacagttgcaagaagagtag

SEQ ID NO: 26335 - DNA, 282 bp, Artificial Sequence
  Description of Artificial Sequence: Synthetic coding sequence
atgggagagattgagggcacgtaccgcgtgctgcaaacagcaggcatgcggctgggcgcacagacccctgttggtgtcagtaccttggagcccggacagaccttattgccccggatgcaagagaagcaccttcatctgcgagtgaaactgctggacaatactatggaaatttttgatatcgagcctaaatgcgacggtcaagttctgctcacgcaagtttggaaacgcctgaatttggtggagtgcgactactttgggatggaatttcagaacacacagtag

SEQ ID NO: 26336 - DNA, 1917 bp, Artificial Sequence
  Description of Artificial Sequence: Synthetic coding sequence
atgggggaaattgagggaacttatagggtcctgcagactgccgggatgcgtctcggagcccagacacccgtcggggtgtccaccctggagcctggtcaaacactgctaccaaggatgcaggaaaagcatctacacctgagggtgaagctgttggacaataccatggagatctttgacatcgagccaaagtgcgacggccaggtgttgctgacccaggtctggaagaggttaaacctcgtggaatgcgattacttcggcatggagttccaaaatactcagagctactggatctggctggagcctatgaagcccattattcgccagattagaagaccaaaaaatgtcgtgcttcgactggccgtgaagttttttccgcccgaccctgggcaactgcaagaagaatatacccgatacctgtttgctctgcaactgaagagagatctgctggaggagaggctgacatgcgcagacaccacggccgccctcctaacatctcacctactgcagagcgagatcggcgactatgacgagaccttagatcgtgagcatctaaaggtgaatgagtatctccctggacagcagcactgtctcgagaagattcttgagttccaccaaaaacatgtggggcagacaccagccgaaagtgattttcaggtgctggaaattgcccgcaagctggagatgtacggcattaggttccacatggcttccgacagggaggggaccaagatacagctggcagtcagccacatgggcgtgttggtcttccagggcacaacaaagatcaacacctttaactggtcaaaggtaaggaagctgtccttcaagcgcaaacgatttctgattaagcttcacccagaggtgcatggcccgtatcaggatactctagaattcctcctgggctcccgcgacgaatgcaagaacttctggaaaatatgtgtagagtatcacaccttcttccgcctactggaccagcccaagcccaaggccaaagccgtgttcttctcacgaggatcgtctttccgctatagcggtcggacacaaaaacagttggttgactactttaaggacagtggaatgaaacgcatcccatatgagcgcagacattctaagacacacacatcagttagagcactgacagctgacttaccaaaacagagcataagtttccccgagggactgaggactccggccagcccatcatccgccaacgcattttacagtctatctcccagcacattagtcccatcaggcctgcccgagttcaaggattcgtcttcgtcactgacggaccctcaagtttcctacgttaagtcgcctgccgcagagcgacgctctggagcggtggccggggggcccgacacaccaagtgcccagcccctgggccctccggctctgcagccaggtcctgggctgtccaccaagtcaccccagccgtcaccttcatcacggaaatccccattgtcactgtcacctgcattccaggtacccttaggccctgccgaacagggatcctcacccctgctgtcgcctgtgctgagcgatgccggaggggccgggatggattgtgaagaacctcgccacaaacgcgtccccgctgacgaagcctacttcattgtcaaggaaatactggctacggaaagaacgtacttaaaggatctcgaggtgatcacagtatggttcagatcggctgtcgtcaaggaagatgctatgcccgcaacgctgatgacactgttgtttagcaatattgatccgatctatgaatttcaccgcggatttctgagggaagtagagcagagactcgctctgtgggaaggcccaagtaaagcgcacaccaaaggctcccatcagagaatcggtgatattctgctgagaaacatgagacaactgaaagcggctcatgaatttacgacttag

SEQ ID NO: 26337 - DNA, 1155 bp, Artificial Sequence
  Description of Artificial Sequence: Synthetic coding sequence
atggcagcacagaacgggaacacctcttttacacccaatttcaatcctcctcaggatcacgcgtcctctctttcattcaatttctcgtatggtgattacgatctgcctatggatgaagatgaagacatgacgaaaactcggaccttttttgccgcgaagatagtgataggtattgctctagctggaattatgctggtgtgcggcataggcaattttgtgttcattgcagcactcactaggtataagaagctccgtaacctgactaacctgctgatcgccaatctcgctatcagcgactttctcgtagctatcatttgctgtcccttcgagatggattactacgtagtgcgtcaactgtcgtgggagcatgggcatgtcctctgcgccagcgtgaattacctgagaactgtcagcctgtacgtatctactaatgccctcttagcaatcgcaatagaccggtacctagctatagtgcatcctctcaagccccgaatgaattatcagactgcaagttttctgatagccctggtttggatggttagcatcctgatcgcaattcccagcgcatactttgcaaccgaaacagtgctgttcattgtgaagtcccaggagaaaatcttttgtggccaaatctggccagtcgaccaacagttatactataaatcctacttcctgttcatttttggagtagagttcgtcgggccggtggtcacaatgacgctttgttacgcacgcatctccagggaactctggttcaaggcagtccctggtttccagactgaacagatacgaaaacggctaagatgccgaaggaagacggtgttagtgctcatgtgtatattgacagcttacgtcctatgttgggcccccttctatgggttcaccatcgtgagagatttcttcccgaccgtgttcgtaaaggaaaaacactatcttaccgctttttatgtggtcgagtgcatagccatgtcaaactccatgattaacactgtttgcttcgttaccgttaaaaacaacacaatgaagtattttaaaaaaatgatgctgcttcattggagaccttcccaacggggctccaagtccagtgctgacttagacctgcggaccaacggagtgccaactaccgaagaggtggattgtattaggctaaaatag

SEQ ID NO: 26338 - DNA, 1668 bp, Artificial Sequence
  Description of Artificial Sequence: Synthetic coding sequence
atgttgagcagcacagactttacctttgcatcgtgggagctggtggttcgggtggatcaccctaacgaggagcagcaaaaagacgtcacactccgcgtttcaggcgacctgcacgtaggaggagtcatgctcaaattagtcgagcaaattaacataagccaggattggagtgattttgccctttggtgggagcagaaacactgttggctactcaaaacccattggacactcgataaatacggagtgcaggctgacgccaagctgttgttcacgccccagcacaagatgttgaggttgcgactaccaaatctgaagatggtgcgtttacgggtttcatttagcgctgtcgtgttcaaggccgttagcgacatatgcaaaatcttgaacatccgcaggtccgaggagctgtcactgcttaaacccagcggagattattttaaaaagaaaaagaaaaaagacaaaaataataaagaacctatcatagaggacattcttaatttagagtcctcaccaacagcttccggtagctcggtgtctcctggtctttattcaaagaccatgactccaatctatgaccccattaatggcacccctgctagctcgaccatgacttggtttagtgatagcccactcaccgagcagaattgctctatcctggctttctcccaacctccccagagtcctgaggctttagctgacatgtatcagcctaggtccctggtcgataaagccaagctgaacgccggctggctggattctagcaggtcactgatggagcaaggtatccaggaagacgagcagttactgttacgttttaagtactatagtttttttgacctgaacccgaagtatgatgccgtgcggatcaaccaactttacgagcaggctaggtgggctatcttacttgaggagatcgactgtaccgaggaggagatgctgatatttgccgcgctccagtaccatatcagcaagctttcccttagtgcagagacgcaggactttgctggagaatcagaggtggacgaaattgaagcggcattgtctaatctggaggtcactctcgaggggggaaaagctgattcacttttagaagacattaccgatattcccaagttagcagataatttaaagcttttccgccccaaaaagctccttcccaaagcgtttaagcagtattggtttattttcaaggacacaagtatcgcttacttcaagaataaggagttggaacaaggcgagcctttggaaaaactgaaccttagggggtgcgaggtggtgccagatgtaaatgttgccggaagaaagttcggaattaaattattaatcccagttgccgatggaatgaacgaaatgtacctacgatgtgatcatgagaatcagtatgcccagtggatggcggcatgcatgcttgcttctaaagggaaaacgatggctgactccagctaccagccggaggtgttgaacattctgagcttcctccgcatgaagaacaggaacagcgccagccaggtagcctcatcgcttgagaatatggacatgaacccagagtgttttgtgagtccccgctgcgccaaaagacataagagcaaacaactggccgcccgtatactcgaagcccatcaccttcaggctccatttcactcttatcggtcactgtcccacctctag

SEQ ID NO: 26339 - DNA, 441 bp, Artificial Sequence
  Description of Artificial Sequence: Synthetic coding sequence
atgctgagtagtaccgacttcaccttcgcatcttgggaattggtggtccgagtcgaccaccctaacgaggaacaacaaaaagatgtgacactgagggtgtctggggacttgcatgtgggcggcgtcatgctgaaactcgtggagcagattaacattagtcaggattggtcagacttcgccctgtggtgggagcagaaacattgttggctccttaaaacacactggactctggacaagtacggtgtgcaagccgacgccaagcttcttttcactccccaacacaaaatgctgcgcctacgacttccaaatctcaaaatggtgcggctccgagtgagcttcagtgcagtggtcttcaaagctgtgtccgacatctgcaagatcctcaacatcaggagatccgaggaattatctttgctgaaacccagcggagactatttctag

SEQ ID NO: 26340 - DNA, 1263 bp, Artificial Sequence
  Description of Artificial Sequence: Synthetic coding sequence
atggaacagggcattcaagaggacgagcagcttctgcttcgcttcaaatactactctttctttgacctcaatcctaaatatgatgcagtgagaataaatcagctgtatgagcaggcccgatgggcgatcctgctcgaagagatagactgtactgaggaagagatgctaatattcgccgccttgcagtatcacatatctaagctgagcctgagtgcggaaacccaagatttcgctggagagtctgaagttgacgagatcgaggccgctctttctaatctggaagtgacattagaggggggcaaggcggacagcctgctcgaggacattactgatataccaaagttagccgacaatctgaagctcttcagacctaaaaaactgttaccaaaagccttcaagcagtactggttcatttttaaagacaccagtatcgcttattttaaaaataaggaactagaacagggggagccgctggagaagctgaacctgcgcggctgcgaggtggtccctgatgtgaacgtggcaggaagaaaatttggcatcaagctcctgatccctgtcgctgacggcatgaatgagatgtacctccgatgcgatcatgagaaccagtacgcgcaatggatggccgcttgtatgctggctagtaaaggaaagaccatggccgattcaagctatcagcccgaggtgctaaatatcctttcattcctccgcatgaagaaccgcaacagcgcctcccaagtcgccagttcattggagaacatggacatgaaccccgaatgctttgtttcaccccggtgtgctaagcgccacaaatctaaacagctagctgccagaatcctcgaggctcaccagaatgttgctcagatgcccctggtcgaagcaaaactgcgtttcatacaggcctggcagagtctccctgagttcggactgacgtattacctcgtcagattcaaagggtctaagaaagatgatattctgggagtgagctacaatcggttaattaaaattgatgccgctaccggaatcccggtaacgacctggcggtttaccaatatcaaacagtggaatgtaaactgggagactcggcaagtcgtaatagagttcgatcaaaacgtgttcactgcctttacctgcttatctgctgattgcaaaatcgtgcacgagtatattggcggctacatctttcttagtaccaggtccaaagatcaaaatgagacactcgacgaggacctattccataagttgacagggggccaggattag

SEQ ID NO: 26341 - DNA, 552 bp, Artificial Sequence
  Description of Artificial Sequence: Synthetic coding sequence
atggcagcctctatggctcgggggggtgtatcagccagagtgctgcttcaggcggctagaggcacatggtggaataggcctggcggaacaagtggtagcggtgagggcgttgcactggggacaactaggaagttccaggccacaggctcacggcccgcaggcgaggaggatgctggcgggccagaacggccaggcgatgtcgtgaacgtggtgtttgtagatagatcaggtcagcgtatccctgtaagcggacgcgtgggcgataacgttctccaccttgcccagcgccacggcgtggacctggaaggggcatgcgaggcaagcctagcatgtagcacatgtcacgtgtatgttagtgaagaccacctagatcttttgccgcccccggaggagcgcgaggatgacatgctggatatggcaccacttttgcaggaaaatagccggctgggctgccaaatagtgctgactcccgaactggaaggcgcggaatttactctgcctaagataacacggaacttctacgtggacgggcatgtcccaaaaccccattag

SEQ ID NO: 26342 - DNA, 438 bp, Artificial Sequence
  Description of Artificial Sequence: Synthetic coding sequence
atgcacgtcatggccgcctcgatggcgaggggcggagtttcagcacgcgtgttgcttcaggcagcccggggtacttggtggaatcggccagggggaactagtggatcaggggaaggcgtcgcactaggaactaccaggaagtttcaggcgacaggaagcagaccggcaggcgaggaggacgccggcggccccgagcggcctggggacgtggtcaacgttgtgttcgtagatcgatccgggcagagaattcctgtgtctggcagagtgggcgataatgttctccatctagcacaacggcacggagtggatttagaaggggcatgtgaagcaagtttagcatgctcaacatgtcatgtctatgtatcagaagaccaccttgaccttctaccaccacctgaggagcggcggaccaggggatgggcagccaggctgtgttag

SEQ ID NO: 26343 - DNA, 552 bp, Artificial Sequence
  Description of Artificial Sequence: Synthetic coding sequence
atggctggtggaccaccaaatacaaaggctgagatggagatgtctttggcagaagagctgaatcatggcaggcaaggggaaaaccaggagcatctggttattgccgagatgatggaactgggctcaaggtctcgcggtgcctctcagaagaaacagaagctcgaacagaaggcggccggatctgcctccgcaaagcgagtttggaatatgacggccaccaggcccaagaaaatggggtcccagctgccgaagcctagaatgcttagagagtcaggccacggtgacgcccaccttcaggaatacgcgggcaacttccagggcataaggtttcattatgaccgcaaccccgggacagacgccgttgctcagacctcgctagaggaattcaacgtgcttgaaatggaagtgatgagacgccagctgtacgcagttaaccgccgattaagagctctggaggagcaaggagccacttggcgtcatcgcgaaacgctcatcatagcagtcctggtgtcagcaagcattgcaaacctgtggctttggatgaaccagtag

SEQ ID NO: 26344 - DNA, 1527 bp, Artificial Sequence
  Description of Artificial Sequence: Synthetic coding sequence
atgggaagttgctgttcctgtccagacaaggacacagtgccggacaaccacagaaataagttcaaagtgatcaatgttgatgacgacgggaacgagcttgggagcggaatcatggagctgacagataccgaactgatcctttatacacgtaaaagagattctgtgaaatggcactacctctgtctcaggaggtacggttacgactctaacctgttcagcttcgagtctggaaggagatgccaaactggccagggaatctttgcatttaagtgcgccagagcggaggaattattcaacatgttgcaggagatcatgcagaataactctatcaacgtagtcgaggagccagtggtggagcggaataatcaccagaccgaactggaggttccccggaccccacggacaccgaccacacctggcttcgccgcccagaacctgcccaacggctatcctaggtacccaagctttggggatgcctcgagccatccatcaagtagacatccatcggtcggctctgccaggttgccaagcgtgggcgaagagagcactcaccctctgttggtcgcagaagaacaagtgcacacctacgttaatacaactggggtgcaggaagaacgaaagaatcgcacaagcgtccatgtgccactggaagcacgggtgagtaatgctgaaagcagtacgcccaaagaagagcctagctcaatcgaggacagggatcctcagatcctgttggagccggagggagtaaagttcgtcctcggaccaacacctgtgcagaaacaacttatggaaaaagagaaactcgagcaactgggaagggatcaggttagcgggagtggcgcgaataatacagagtgggataccggatacgattcagatgagaggcgggacgccccgtccgtgaataaactcgtctacgaaaacatcaatgggctgtccatcccctccgcttccggcgtgcgccgaggacggcttaccagtacatctacctctgatacccaaaatatcaataatagcgctcaaagaaggacagccctcctgaattatgagaaccttcctagtctccctcccgtttgggaggccagaaagctcagccgagacgaggatgacaatctcggccctaaaaccccttctttgaacggctaccacaacaaccttgatccaatgcataattatgtcaatactgagaatgttacagtgccagcttccgcccacaagattgaatactcaaggcgacgggattgcacccctactgtgttcaatttcgacatacgcagaccctctttggagcataggcaactgaactacatccaggtggacctagaaggcggcagcgatagcgacaatccccaaacacccaagacacccacaaccccgctgcctcagacgccaacccggcgaaccgagctgtatgctgtcatcgacattgaaaggactgctgccatgtccaatctgcaaaaggccctcccacgcgacgacgggacaagccgcaaaacgagacacaatagcacagacctccccatgtag

SEQ ID NO: 26345 - DNA, 1527 bp, Artificial Sequence
  Description of Artificial Sequence: Synthetic coding sequence
atgggttcctgttgttcgtgcccagataaagacaccgtgcccgacaaccatcggaataaatttaaagtcatcaatgtggacgacgatgggaacgagctaggctccggcatcatggaactcacagatactgaattgatcctgtacacccgcaagagagactctgtgaagtggcactacctttgtctgcggcggtacggctacgattccaacctctttagcttcgagagcgggagaaggtgccagactggtcagggtatcttcgcctttaagtgcgccagagccgaagaactgttcaacatgctgcaagagattatgcagaataattcgatcaacgtcgtcgaggagcctgttgtcgagaggaacaatcaccaaaccgaactagaggtcccacgaacacctcgtacacccaccacaccgggtttcgcagctcaaaatctacccaacggatatcctagatacccttcatttggagatgcgtctagtcatccgagctcgaggcatccttctgttggcagcgccaggctgcctagtgtgggggaagagagtactcatcctcttctggtggccgaagagcaggtccatacctacgtcaataccacaggagtgcaagaggaacggaagaatcggactagcgtccatgtgccattagaagcccgcgttagcaacgcagaatcatctaccccaaaggaggaaccctcctcgattgaggaccgcgatccgcagatcttgctagaacccgagggcgtgaaatttgttttggggccgacccctgttcagaagcagctgatggagaaggaaaagctggaacaattgggacgggaccaggtgagtgggagcggtgccaacaacactgaatgggacacaggatacgattcggacgaacgaagggatgccccttccgtgaacaagcttgtgtatgaaaatatcaacggactgagcattccatctgcctccggcgtgcgcaggggccggcttacttcaacaagtaccagcgatacccaaaacattaacaactcggcacaacgtcgcacggcactgctgaactacgaaaatcttccatcccttccccccgtgtgggaggccaggaaactgtccagggacgaggacgataacctaggccctaagaccccatccttgaacggctatcacaacaatcttgacccaatgcataactatgtgaataccgaaaacgttactgttccagcaagcgcacacaaaatcgagtactcaagaaggcgcgattgcacccccacggtgttcaatttcgacatcagaaggccgtctctggagcaccggcaactgaattacattcaggtggacctagaaggcgggtctgattcagacaacccacaaacccctaagacccccacaacaccactgccacagactcccactaggcgcactgagctgtacgctgtcattgatatcgagcggactgcggcaatgagcaatttgcagaaagcactgcctagggatgacggcacatctcgcaaaaccaggcacaactctactgatttaccaatgtag

SEQ ID NO: 26346 - DNA, 111 bp, Artificial Sequence
  Description of Artificial Sequence: Synthetic coding sequence
atggggtcttgctgctcctgcccagacaaagatactgtgcctgataaccatagaaataaattcaaggtgatcaatgtggacgacgatggaaatgaactggggtctggatag

SEQ ID NO: 26347 - DNA, 123 bp, Artificial Sequence
  Description of Artificial Sequence: Synthetic coding sequence
atgggctcttgctgctcttgtccagacaaggacactgtgccagataaccacagaaataagttcaaagtgattaatgtagatgatgacgggaatgagctgggctcaggcattatggaactctag

SEQ ID NO: 26348 - DNA, 102 bp, Artificial Sequence
  Description of Artificial Sequence: Synthetic coding sequence
atgggaagttgctgttcgtgccctgacaaggatactgtgcctgataatcatcgtaataagtttaaagtgatcaacgtggatgatgacgggaatgagttgtag

SEQ ID NO: 26349 - DNA, 1527 bp, Artificial Sequence
  Description of Artificial Sequence: Synthetic coding sequence
atgggctcctgttgctcctgccctgacaaggatacagttcctgataatcaccgaaacaagtttaaggtgattaatgtggatgatgacggaaacgagctcggcagcggtattatggagcttactgatacagagctcatactgtacacccggaaacgtgactctgtaaagtggcattacctgtgcctccggcgttacggttacgactccaacctattctcttttgaatctggacgtagatgccagacggggcaaggtatattcgctttcaaatgtgcgagagccgaagagttgtttaacatgctgcaggagattatgcaaaacaactcaatcaacgtggttgaagagcctgttgttgaacgcaacaaccatcagactgagcttgaggtaccgcgaactccacgtacaccaacaacaccaggattcgccgcacagaacctaccaaatgggtaccctcggtacccctcatttggtgacgcctcgtctcacccctcttctcgtcacccctcagtcgggtcagcccggctgccttcagtaggggaagagagcacgcatcccctgctggttgccgaagagcaagtacacacgtatgtgaacaccacaggtgtgcaggaggagcgaaagaacagaacatccgtgcacgtccccctggaggctagggtcagcaacgccgagagcagcactccaaaggaggaacctagcagtatcgaggaccgcgatccgcaaatcctcctggagcctgagggagtcaagttcgtcctcggacctaccccagttcagaaacagttaatggagaaagagaaactggaacagctcgggagagatcaagtgtctggctcgggagccaacaacaccgagtgggacactggatacgactcggatgaacgtagagacgcacccagcgtgaataagctggtttacgagaacatcaatgggctctctatcccttcagcttcaggtgttcgtcggggccggctgacatcaacttccactagcgacactcaaaatattaacaacagcgctcaaagacgaacagcactgctcaactacgagaatctaccttcacttccccctgtttgggaggccaggaagctgtctagagatgaggatgacaacctgggccccaaaaccccgtccctgaacggctatcacaacaacctggaccctatgcataactacgtaaacacggaaaacgtgactgtacccgcgtccgctcacaagatcgagtacagcaggcgccgtgattgtacaccaactgtgtttaactttgacatccggcgaccaagcctagaacaccggcagctgaactacatccaggtggatctcgagggaggcagcgacagcgacaatccccagacgccaaaaactcccaccacgccacttccacagaccccaacacggagaacagagctgtacgccgtcatagatatcgaaagaaccgccgccatgtcaaacctgcaaaaagcactgccacgcgacgatggcacctcaaggaaaacccggcataatagcaccgacctccctatgtag

SEQ ID NO: 26350 - DNA, 33 bp, Artificial Sequence
  Description of Artificial Sequence: Synthetic coding sequence
atggggtcctgttgcagttgtccagataaatag

SEQ ID NO: 26351 - DNA, 39 bp, Artificial Sequence
  Description of Artificial Sequence: Synthetic coding sequence
atgggctcatgttgttcttgcccagataaagacacatag

SEQ ID NO: 26352 - DNA, 1527 bp, Artificial Sequence
  Description of Artificial Sequence: Synthetic coding sequence
atgggtagctgctgttcatgcccagacaaagacacggtgcccgacaaccacagaaacaagtttaaggttatcaatgttgacgatgacggcaacgagctcgggtcaggcatcatggaactgacagatacagaactgatcctgtatacccgtaagcgggacagcgtaaagtggcactatctgtgccttcgccggtatggatacgattcaaacctgttctcctttgaatccggtcgaagatgccaaactggtcaggggatttttgccttcaagtgtgccagggcagaggaactattcaatatgctccaggagatcatgcaaaataattcaataaatgttgtggaggagcccgtagtcgaaagaaacaatcatcagaccgagcttgaggtccctaggacacctaggacccctactacccccggcttcgccgctcaaaatctgccgaacgggtatccaaggtatccctcattcggcgacgcctcctcgcacccctccagccgtcatccctcagttggaagtgccagactgccatctgtgggcgaagaaagtacccacccgctgctcgtagctgaagaacaagtgcacacctacgttaacacaaccggtgtgcaggaagagaggaaaaaccggacgtctgtgcacgtgcctctggaagcgcgggtctccaatgcagagtctagcacccctaaggaggagccttcttctattgaggaccgcgacccacagatactcttagagcctgaaggcgtcaaattcgtacttggccccacccccgtgcagaagcaattgatggagaaggaaaagctggagcaactggggagagaccaggtgagtggctcaggggctaacaacaccgaatgggacaccggatacgattcagatgagcgccgtgacgctccatcagtcaacaagctggtatacgagaatatcaatggcctatcaattccttcagctagcggcgttaggcggggccgtctgacaagcacctccacttcagatacacagaacattaataattcagcgcagagacgcaccgctcttctgaactacgagaatctaccttccctcccgccagtgtgggaagcacgcaagctctcccgtgacgaggacgacaatttgggccccaagaccccttccctgaatgggtaccacaacaacctggatcccatgcacaactatgtgaacaccgagaatgtcactgtacccgccagtgctcacaagattgaatactctcggaggcgggattgtaccccgaccgtgttcaacttcgatatacgccgcccctctctagagcaccggcagctgaactatattcaggtggatctcgagggaggtagcgattccgacaacccccagacccctaaaacacccactactccactcccccagacgcctacgcgcaggactgaactgtacgccgttattgacattgagagaactgccgcaatgtcaaacctgcagaaggccctccccagggacgatggaacttcgcgaaaaactcgtcataacagcacggaccttcctatgtag

SEQ ID NO: 26353 - DNA, 276 bp, Artificial Sequence
  Description of Artificial Sequence: Synthetic coding sequence
atgggcagttgttgctcatgtccagacaaggataccgtgcccgacaatcaccgaaataaatttaaggtgattaatgtggatgacgacggcaacgagctggggtccggtattatggaattaactgatacagagctaatcctgtatacacgtaaaagggacagtgtgaagtggcactacttgtgtctgcgccgatacggatatgattccaatcttttttcttttgaaagtggtcggcggtgccagactggacagggcatcttcgccttcaagtgctag

SEQ ID NO: 26354 - DNA, 552 bp, Artificial Sequence
  Description of Artificial Sequence: Synthetic coding sequence
atgggaagctgctgctcctgcccagacaaggataccgttcctgacaatcaccgaaacaagttcaaggtcatcaatgtggatgatgatggaaatgagctggggagtggaatcatggagctcactgacacagagctcattctatatactagaaagagagatagcgtcaaatggcattatctttgcctgcgccgctacggatacgactctaatctgttctcttttgagtcaggtaggcggtgtcagacgggccaaggtattttcgcctttaaatgcgcccgcgctgaagaactcttcaatatgctgcaggaaattatgcagaataattccatcaacgttgtggaagagccggtcgtcgaacgtaataatcaccagactgaactggaagttcctcgcacacccagaacgcctacaacaccaggatttgctgcccaaaacctgcccaatggctatcctaggtatccttcgttcggtgacgcaagctcccatccatctagcagacacccaagtgtggggtctgcacgccttccatccgtgggcgaagagtctacatag

SEQ ID NO: 26355 - DNA, 1479 bp, Artificial Sequence
  Description of Artificial Sequence: Synthetic coding sequence
atgggttcctgttgctcttgtctgaaccgcgatagtgtgcctgacaaccaccccacaaagtttaaggttacgaacgtggacgacgagggagtagagctgggcagtggagtcatggagcttactcagagtgagctggtgcttcatctgcatagacgggaggcagtccgatggccttacctgtgtctgcggaggtatggctacgactctaacttatttagcttcgagagtggcagaaggtgccaaactggccaagggatctttgctttcaagtgtagcagggccgaagaaatttttaacctgctccaagatctcatgcagtgcaattctataaatgtgatggaagaacctgtcataatcactcgtaactcccacccagccgaattggacttaccccgcgcgcctcaaccccctaacgcgcttggatatacagtttctagcttctctaacgggtgccctggagagggacccagattcagtgctccaaggagactgtccacatcatcactgaggcatcccagcttaggcgaggagtccactcacgctctgatcgcacctgatgaacagtcgcatacttacgttaacacccccgcttctgaggacgatcacaggagaggtcggcactgcttacagccactccctgaagggcaagctcctttcctgccccaggctagagggcctgatcagagagatccacaagtcttcctgcagcctggtcaggtcaagttcgtgctcgggccgacaccggcgcggcgacatatggtaaaatgccaaggcctttgcccatcactgcacgatcccccccatcataataacaacaacgaagccccaagcgagtgtccagcacagcccaaatgcacctacgagaacgtgaccggcgggttatggaggggcgctggttggcggctcagccccgaggaacctggctggaatggcctggcgcaccggagggcagcgctcctgcactacgagaatctcccacccttaccacctgtgtgggagtcccaggcacagcagctgggcggcgaggcaggggacgatggggactcccgagacgggttaaccccttctagcaacgggttcccagacggtgaggaagatgaaactccactgcagaagccaacctctacccgggccgccattcgctcccacggcagtttccccgtcccactgacaaggcgacggggcagcccgcgggtgttcaacttcgactttcggaggcctggcccagagccgcccagacagttgaactatatccaagtggagttaaagggatggggcggcgaccggcccaaggggccccagaacccttcgagtccccaagcacctatgcccaccacacaccccgcccggagtagcgatagctacgcagtgatcgacctcaaaaaaacagtggccatgtcaaatttgcagcgggcactgcctagagatgatgggactgctagaaagactcgtcataattctacagatctgcctctctag

SEQ ID NO: 26356 - DNA, 1479 bp, Artificial Sequence
  Description of Artificial Sequence: Synthetic coding sequence
atggggagttgctgctcttgcttgaaccgcgattccgttccggataaccacccaactaaatttaaagtaaccaatgtggatgacgaaggagtcgaattgggatccggtgttatggaactgactcagtctgaactagtacttcacctccaccggagagaggctgtccgatggccctacttgtgcctccgtcggtatggctatgacagtaatctcttttctttcgaaagcggccggaggtgtcagaccgggcagggcatcttcgccttcaagtgttctagggccgaagaaattttcaacttactccaggatctgatgcagtgtaatagcatcaacgttatggaggagcctgtcatcataactaggaactctcaccccgcagaactggatctgccacgggctcctcagccgccaaatgcccttgggtacacagtttcttctttcagtaatgggtgtcccggtgagggacctcggttttcagccccgcggagactcagcacgtcaagtctgagacatccttccctcggggaggaaagcacccacgctctgatcgcgccagacgaacagagtcacacgtatgtcaacacccccgcctctgaggacgaccatagaagaggaagacattgccttcagcccctgccggagggacaggcaccctttctccctcaggcccgcggccccgatcaaagagacccccaggtgtttctgcagcctggacaggtgaagtttgtcctgggccccacccctgccaggaggcacatggtcaaatgtcaaggcttatgcccctcgctgcacgaccccccacatcacaataataataatgaggccccctcggaatgccccgcccagccgaaatgtacttacgaaaatgttaccgggggcctgtggcggggagctggctggcggctgagccccgaggaacccggctggaatggtctcgcacacaggagagctgctctcctacactacgaaaacctgcctccgctcccacctgtctgggagagccaggcccagcaattaggaggcgaggctggagatgacggtgacagcagagatggcttaacccccagcagtaacggtttccccgatggcgaagaggacgagaccccactgcagaaacctacctcaacgcgtgccgccatcagaagtcacgggagttttccggtaccccttaccaggcgtagaggtagccccagagtattcaatttcgatttcaggcgaccaggtcccgaaccgcccagacaacttaattacattcaggtggagctaaagggttggggtggagaccgacccaagggcccccaaaatccctcaagcccgcaagccccaatgccgacgacccatccagccagaagtagtgattcttatgctgtaattgatttaaagaaaactgttgccatgtctaatctacaacgtgcactgcctcgtgacgacggcaccgcaaggaagacaagacataactccaccgatcttccattatag

SEQ ID NO: 26357 - DNA, 111 bp, Artificial Sequence
  Description of Artificial Sequence: Synthetic coding sequence
atgggctcatgttgctcttgcttgaaccgagatagcgtgccagacaaccacccgactaagttcaaggtgaccaacgtggacgacgaaggagtggaactgggcagtggctag

SEQ ID NO: 26358 - DNA, 444 bp, Artificial Sequence
  Description of Artificial Sequence: Synthetic coding sequence
atggagacaccccgacgggcccgaagccccgtttctccacaatttccggggcaagctggttgcagtgacaccatgggctcttgctgtagctgtctgaacagggactctgtgcctgacaaccatcctaccaagttcaaggtgaccaatgtggatgatgagggagtcgagcttggatctggtgtcatggagctgacacagtccgagttagtactgcacctccacagacgggaagcagtgcgatggccctatctctgtctgagaagatatggttatgatagcaaccttttttcattcgagagcggtagacggtgccagactggacagggtatttttgcattcaaatgtagccgcgccgaggagatttttaatttgttgcaagaccttatgcagtgtaattctataaacgtcatggaagagcctgtaattatcacccgcaactcctag

SEQ ID NO: 26359 - DNA, 3405 bp, Artificial Sequence
  Description of Artificial Sequence: Synthetic coding sequence
atgatgtcccccaatgggagcgtacccccaatttatgtgcctcctggatatgcacctcaggtcatcgaagacaatggggtgcgacgggtcgttgttgtgcctcaggcacctgagtttcatcctggtagccacaccgtgcttcatcggtcgcctcacccacccttgccaggttttattcctgttcccactatgatgccccctcccccaagacatatgtattcccccgttacaggcgccggcgacatgactactcaatatatgcctcagtaccagtcctcccaagtgtatggagacgttgatgcccattccactcacggcagaagcaacttccgagatgagcgctcttctaagacctacgagagattgcagaagaaattgaaggacaggcaggggacccagaaggataaaatgagctctcccccctcctctccacagaagtgtccatcccctatcaatgaacacaatggacttattaaaggccagattgccggcggcatcaatacaggatctgccaaaatcaagtcaggcaaggggaaaggaggcacacaggtggatacggaaatcgaggaaaaggatgaggaaacgaaggctttcgaggccctgttaagtaatatcgtgaaacccgtcgcctccgatatacaggcacgaacagtcgtactcacctggagccccccttccagcttgatcaacggtgaaactgatgaatccagcgtgcctgagctgtacggctacgaggttctaatctcgtcgactggtaaagacggcaaatacaaaagcgtttatgtcggggaggagaccaacatcactctcaatgatctaaaaccagctatggactatcatgccaaagtgcaggctgagtacaactccattaaaggtactccaagcgaagctgaaatattcacaacattgagctgcgagcctgacatccccaaccccccaagaattgccaacaggacaaaaaatagtctgacactccagtggaaggcaccttcagacaatggatcaaagatccagaatttcgtactggagtgggacgagggtaaggggaacggtgagttttgtcagtgctatatggggtcacagaagcagtttaaaatcacaaaactgagtcctgccatgggctgcaaattccggctatccgccagaaatgactacgggacaagcggcttttcagaggaagtgctttactatacatccggatgtgctccgtctatgccagcttcaccggtgctgacgaaagccggaataacctggctgagcctgcagtggagcaaaccttcaggaaccccaagcgacgaaggaatctcttatatcctcgagatggaagaagagaccagcggatacggattcaagccgaagtacgatggtgaggacctggcgtacacagtcaagaacctcagaagaagtacgaaatataagttcaaggtgattgcatataactcggaggggaaatccaaccccagtgaggtcgtcgagttcacgacctgtcctgacaaacccggaattcccgttaagcccagcgtcaaagggaagatccattctcactcctttaagattacttgggacccaccaaaagacaacggtggggctacaatcaataagtacgtggttgagatggctgaaggttccaacggcaataaatgggaaatgatctattcgggagctacacgtgaacatctctgtgacagactgaaccctggatgtttttacagactccgagtgtattgtatcagtgacggaggccagtctgcggtgagcgaatccctgttggtccagactccagctgtcccccccggaccatgtctccctccaagattgcaaggcagacctaaagccaaagagatccagctgagatgggggcctccacttgtcgatggcggatcacctatctcatgttactcggttgaaatgtcgcctatagagaaggatgaaccaagggaagtgtaccaagggtctgaagtcgaatgcaccgtgtcctcgctgcttcccggcaaaacctattcgtttaggctccgggctgcaaacaaaatggggttcggtcctttcagcgagaaatgcgacataaccactgctcccggcccgccagaccagtgtaaacctccgcaggtcacatgcaggtccgctacgtgcgcccaggtcaattgggaagtgccactctcaaacggcactgacgttacagaatataggcttgaatggggaggcgtggaaggctcaatgcagatctgctactgcggtcctggcctgtcttacgaaatcaaggggttgtctcccgccacgacatactactgtcgggtgcaggccctctctgtcgtcggtgcgggcccgtttagcgaagtcgtggcctgcgttactccacctagcgtgcctgggatcgttacgtgcctgcaggagatttccgatgatgaaattgagaacccacattattcgcctagtacctgcttggccatcagctgggagaagccatgcgatcatggctctgaaatcctggcgtatagtatcgactttggcgataagcagagcctgacggtgggaaaggtcacctcttacataattaacaacctgcagcctgacacaacttacagaatccgaatccaggcactgaattctctgggcgcagggcccttcagtcacatgatcaagctaaaaactaaacccctaccccccgaccctccccgcctcgagtgcgtggcttttagtcatcagaatctgaagctgaaatggggggagggaacacccaagacgctcagtactgattcaatccaataccacctccagatggaagacaagaatggccgatttgtgtccttatacagaggaccctgccacacctataaggtgcaacggctgaatgaatctacttcatataaattctgtattcaggcatgtaacgaagctggcgagggaccgctctcccaggagtacatctttactacacccaaaagcgtgcccgctgcccttaaggcgccgaaaattgagaaagttaacgaccatatatgcgagattacttgggaatgtctgcagccaatgaagggcgatcccgtgatatactctcttcaagtaatgcttggcaaagatagcgagtttaagcagatctacaaagggcctgacagcagcttccgctattctagcctccaattgaattgtgagtatagattcagggtttgcgccatccggcagtgccaggatagtctcggacaccaggacttagtcggcccctattctacaacagttctgtttatctctcagcgtaccgaaccgccggccagcactaaccgggacaccgtggagagcactcgtacaaggcgcgctctatccgatgagcagtgtgctgcggtgattctcgttctctttgccttcttttccatcctcattgctttcattattcagtattttgtgatcaagtag

SEQ ID NO: 26360 - DNA, 3429 bp, Artificial Sequence
  Description of Artificial Sequence: Synthetic coding sequence
atgagcggacctgcacaggtccccatgatgtctcctaatggaagcgtgccccctatttacgtgcctcccggttatgcaccgcaagtcattgaggataatggagtccggagggtagtggtcgtgccccaggctcccgaattccatccaggatcacatactgtactgcacagaagcccccatccacctttgccaggttttattcctgtgccgacaatgatgcctccaccgcctcgacacatgtatagccctgtgacaggagccggcgacatgactactcagtacatgccgcagtaccaaagcagccaggtctacggcgacgtcgacgctcactcgacacacggccgttcaaatttcagggatgagagaagctctaagacatacgagagactacagaagaagttgaaagaccgtcaaggcactcagaaggacaagatgagctccccgccctcatctcctcagaagtgcccctcgccaatcaatgaacacaacgggttaatcaagggacagatcgccggagggataaacactgggtctgctaaaattaagagtggaaaaggcaaggggggaacacaggtggacaccgagatcgaggaaaaggatgaggaaacgaaagctttcgaggctctgctttccaacattgtgaagcccgtggcatccgacattcaagccaggacggttgtactcacttggtcaccacctagttcactgattaatggagagaccgacgaaagttctgtgcccgagctctacggctatgaagtcctcatctccagcaccggtaaggatggaaagtataagtctgtgtatgtgggagaagagacaaatatcacacttaatgacttgaaaccggcaatggattatcatgccaaagtgcaagctgagtataacagcataaagggcaccccgtcagaggctgagatctttacaaccctgagttgtgaacccgatatccctaacccaccccggatcgccaatcgcacaaagaactccctcaccctacagtggaaagctccctctgacaacgggagcaaaatccagaactttgtactggagtgggacgagggaaaggggaacggggaattttgccagtgttacatggggtctcaaaagcagttcaaaatcacaaaactgagtcctgcgatggggtgtaaatttcgactgagtgctcgcaacgattatggcactagcggcttcagtgaggaagtcttgtactacaccagcggctgcgcaccctcgatgccagccagtcccgttttgactaaagctggaataacctggcttagcctgcagtggagcaagccgtcaggaacaccctctgacgagggaatctcctatattctcgagatggaggaggagacttccgggtacggatttaaacctaagtacgacggtgaagacttagcatataccgtaaaaaacctcagacgctccactaagtataaattcaaggtcatcgcttataatagcgagggcaaatctaatccttccgaggttgtggagttcactacctgtccagataagcccggcatcccagtaaagccctcagtaaagggcaaaatacattcgcacagttttaagataacatgggatccaccaaaagacaacggaggagctaccatcaacaagtatgtcgtcgagatggcggaggggtccaatggcaataaatgggaaatgatttatagtggagccactagggagcatttgtgtgaccgtcttaaccctggttgtttctatcgattgcgggtttattgcattagtgacggcggtcagagcgccgtgagcgagtcactcctggtgcagacacctgccgtcccccccggtccttgtctcccaccacgcctccaggggcgccccaaggctaaggagatacaactgaggtggggaccacccctggtggacgggggcagtccaatttcctgttactctgtcgaaatgagccctattgaaaaagatgagccgagggaagtctaccaagggtccgaagtcgaatgtacggtgtcatcgctattacctggaaagacatatagcttcagactgagggctgcaaacaagatgggctttgggcccttcagcgagaaatgtgatatcaccacggccccgggtccgccggaccagtgcaagcccccccaggtgacgtgccgctctgccacttgcgcccaggtgaactgggaggttccgctgtcgaatggaacggatgtgactgagtacagattggagtggggcggtgtcgagggatcaatgcagatctgctactgcggcccaggcctgagctatgaaatcaaaggccttagcccagcgacgacctattactgtagggtgcaggctctcagcgtcgtgggtgcaggcccttttagcgaggtcgtggcctgcgtcacacccccatcggtgccgggcatcgttacctgtctgcaagagatatccgacgatgaaattgagaacccgcactacagtccatccacctgtcttgcaattagttgggaaaaaccttgtgaccatggctcggagatccttgcatacagtatcgacttcggtgataagcagtccctgaccgtgggcaaggtcactagctatataataaacaacctgcagcctgatacgacttaccgaataaggatccaggcattaaattctctcggcgcaggtcctttctcccacatgataaaactgaaaaccaaaccattgcccccagatccacccaggcttgagtgtgtcgcctttagccatcagaacctgaagctgaagtggggtgaaggaacccctaagaccctgtcaacagacagcatccagtatcacctgcagatggaggataagaatggacgctttgtgagtctgtaccgcggcccctgtcatacatacaaggttcagcgcctaaacgagtcgactagttataagttctgcatccaggcatgtaatgaagccggagaaggtcctctctcccaggagtacatttttacgacccctaagtccgttcccgctgcactgaaggctcctaaaatcgaaaaagtgaatgaccacatatgtgagatcacctgggaatgtctccagcctatgaagggtgatccagtcatctactctctgcaggtgatgttgggtaaggacagcgaatttaagcaaatctacaaggggcctgattcttcattccgttattcctccctgcaactgaattgcgagtaccgatttagggtgtgcgccatcagacaatgccaggactctctgggtcaccaagatttagtaggaccatactcaaccactgtgttgttcatctcacaacgcactgaacctcccgcttctaccaacagggatacggtggaatctacacgcactagaagagccctgtctgacgagcagtgcgcagctgtgatcctggtgctgtttgcgttcttctcaatcctgattgcattcatcatccagtacttcgtcatcaaatag

SEQ ID NO: 26361 - DNA, 3597 bp, Artificial Sequence
  Description of Artificial Sequence: Synthetic coding sequence
atggctgaacatccaccactgctggatacaacacagatcctttctagcgatatctctctattgagcgcccccatagtatcggcagatggtacacagcaagtaatcctcgtccaggtcaatccaggtgaagcgttcaccatacggcgcgaagatggccaatttcagtgtatcacgggccccgcacaagtgcctatgatgagtcccaatggatcggtacctcctatctacgtgccccccggctacgcccctcaggtcatcgaggataacggtgtgcgtcgagttgtggtagtccctcaggccccggagtttcatcctgggtcacacaccgtactgcaccggtctccacacccaccgcttcctgggtttataccggtccctacaatgatgccccctcctcccagacatatgtactcccctgtcacaggcgctggcgatatgacaacccagtacatgccacaatatcagagctcacaggtctacggcgacgtggatgcgcatagcacacatggccgcagcaattttagggacgagcgatcgagtaaaacctacgaaagactacagaagaaattgaaggaccgccagggtacgcagaaagataagatgagctctcctccgagttcaccacagaaatgcccgtcgcctatcaatgagcacaatggactgattaaaggccaaattgctggaggtattaataccggaagcgctaaaataaaaagtggcaagggtaagggcggaactcaggtcgatacagagatcgaggagaaagatgaagagacaaaggcgttcgaagcgttactgtcaaatattgtgaagcctgtcgcctcagatatacaggctagaacggtcgtgcttacatggtcaccgccatcatccctgataaacggcgaaaccgatgagagctccgttccagagttatacggctatgaagtactcattagctcaaccgggaaggatggaaagtataaatctgtctatgtgggggaggagacgaacataacactgaacgacttgaagccagcgatggactaccacgcgaaagtccaggccgagtataactcaatcaagggcactccctccgaagctgaaatatttaccacgctgtcatgtgagcctgacatacccaatcctccaaggattgccaacagaacgaaaaactcgctgacactgcagtggaaggctccaagcgataatggaagtaagattcagaattttgtgctggagtgggatgaaggtaaggggaatggcgagttctgtcagtgctatatgggctcccagaagcagtttaagatcactaaactctctccagcaatgggttgcaaattccggctcagcgctcgcaacgattacggtacctccggatttagtgaggaggtcttgtactatacgtctggatgtgccccatcaatgcctgcctcacccgtgcttacaaaggcggggataacatggctgtctctgcagtggtctaaacccagtggaaccccctcggatgagggtataagttatattctcgaaatggaagaggaaactagtggctacggcttcaagccaaaatacgacggggaggacctggcgtataccgtgaaaaatctaaggaggtccacaaagtacaagtttaaagtgatagcctacaactcagagggaaaatcaaacccttctgaggtggtggagttcacgacctgcccagataaacctggaatccctgtcaaaccttccgtcaaggggaagattcacagccatagctttaagatcacttgggatccgccaaaagacaacggaggagccaccatcaacaagtacgttgtagagatggctgaggggagcaatggcaataaatgggagatgatctatagtggagcgaccagggagcatttatgcgatcgtctaaaccccggatgtttctatcggttaagagtgtactgtattagcgacggcggccagtctgccgtctcagagagcctccttgtacagactcctgcagtcccccccggaccttgtttgccacctcgccttcaaggcaggccaaaggccaaggaaatacagctacggtggggaccacctctggttgatggtgggtcccctatatcttgctatagtgtagagatgtctcctattgagaaggacgagccccgcgaggtttatcaggggtccgaggtggaatgtactgtctcctccctgctcccaggtaaaacctatagcttccgcctgagagcagcaaacaagatgggcttcggtccgttttctgaaaaatgcgacatcacaaccgcccctggtccccctgaccagtgtaaaccacctcaggttacctgccgatccgctacctgtgctcaggtgaattgggaggtgcccctgtcaaatggcaccgatgtgactgagtaccgacttgaatggggtggagttgaaggatcgatgcaaatctgttactgcgggcctggattgagttatgaaatcaagggactgagcccggcgactacgtattactgtagagtgcaagccctgtctgttgtaggggccggacccttttccgaggtggtggcctgtgtgacacctccttctgttcccggaatcgtaacgtgtctacaggagatctcggacgatgagattgaaaaccctcattatagcccatccacatgcttggccatatcgtgggaaaagccctgtgaccacggaagtgaaatcctggcatacagcatagacttcggagacaagcaatcactcaccgtcgggaaggtcacgagttacataataaataatctgcagccggatacgacctaccgtatcaggattcaggctctgaactctcttggagccggtcctttttctcatatgatcaaactgaagacaaagccacttccacctgaccctcctagacttgaatgcgtggctttctctcaccagaatctgaagctgaaatggggggaaggcacccctaaaaccttgtccaccgactctatccagtaccatctgcaaatggaggataagaatggccggttcgtttcgctctacagagggccttgccatacatataaagtacaaagactaaatgagtccacctcatacaagttttgtattcaggcctgcaacgaggctggagaaggcccattatcccaagagtatatctttacgaccccgaagtctgtcccagccgccctcaaagccccaaaaattgaaaaggttaatgaccatatctgcgaaatcacctgggagtgtctacaacctatgaagggtgatccggtgatttatagcttgcaagtcatgctgggtaaggactccgaattcaaacagatatacaaggggcctgattcctcatttaggtatagctctctgcagctgaattgtgagtaccgcttccgggtgtgcgcaatcaggcagtgtcaagactcattggggcaccaggatctggtcgggccttactccaccacggtgctctttatttcacagcggaccgagccccccgcatccactaatagagacacggtggagtctacccgaactcgccgcgcgttaagtgatgagcaatgcgccgcagtgattctggtgctgttcgcattcttttccatactcattgctttcattatacagtactttgtaatcaagtag

SEQ ID NO: 26362 - DNA, 3597 bp, Artificial Sequence
  Description of Artificial Sequence: Synthetic coding sequence
atggccgagcatcctccattactggacactacacagattctatcttcagacatttctctgctgtctgctcccatcgtgagtgccgacggcacacagcaggtgatcctcgtgcaggtcaaccctggcgaggccttcacaataagacgggaggatgggcagttccagtgcatcacgggacctgcacaggtgccgatgatgagccctaacgggagcgtgccacctatttatgtccccccaggctatgccccgcaggtgatagaagataacggggtgaggagggtggttgttgtgcctcaggcgccagagtttcatcctggcagccacaccgtgcttcaccgatccccacatcctccattgcctggtttcatcccggtgccaacaatgatgccccctccacctagacacatgtactcaccagttaccggcgccggcgacatgaccacacagtacatgccccaataccagagctcacaagtctacggtgatgttgacgcccactccacacacggacgaagcaattttcgcgatgagagatccagcaaaacctatgaacgcctgcaaaagaaattaaaggatcggcagggcacacagaaggataaaatgagctcaccgccttcgtcacctcagaagtgtcctagtccaattaatgaacacaacggactgatcaaggggcagattgcaggcggcatcaataccggttccgcaaagattaagagcgggaaaggtaaaggggggacccaagtcgacaccgagatcgaggaaaaagacgaagagacaaaggcctttgaggccctcttgagtaatattgtcaagcccgttgctagtgatatccaggcccggacagtagtgctgacctggagccctccctcctcactcattaatggcgagaccgatgagtccagtgttccagagctgtacgggtacgaggttctgatcagctctactggaaaggatggtaagtacaagtcagtctatgtaggagaagaaacaaatataacactgaacgatttgaagccggccatggactatcatgcaaaggttcaagctgagtacaacagcatcaagggcacaccctctgaggctgagatttttaccaccctctcatgcgaaccggatattccgaatcctcccagaatcgcaaaccgtaccaaaaatagcttgaccttacagtggaaagctccatccgacaatggcagcaaaattcagaatttcgtgctggagtgggacgaaggtaagggaaacggggaattctgtcagtgctatatggggtcacaaaagcagttcaagataactaagttgagccccgccatggggtgtaagtttaggctctccgctagaaatgattatgggaccagcgggttcagcgaggaggttttgtattacacaagtggctgcgcgccaagtatgcctgcctccccagtactgacaaaggccggaattacttggctctctctccagtggtccaaaccctcaggaacccccagtgacgagggaatttcctatatcttggagatggaggaggagacaagtggttacgggtttaagcctaagtatgacggtgaagatctggcatacaccgtcaagaacttaaggaggtcaacaaagtacaagttcaaggtgattgcgtataatagcgaagggaagtccaatccatccgaggtagtggagtttacaacatgccctgacaagccagggattccagtcaagccgtcagttaagggcaagatccacagccatagcttcaaaatcacctgggaccccccaaaagataatggcggggctaccattaataagtatgtcgtggagatggccgagggatctaacggaaataagtgggagatgatctactcaggagctacccgggaacacctatgtgaccgattgaatccgggatgcttttaccgcctgagggtttactgtataagcgacggcggccagtccgctgtttccgagtctctgcttgtccaaacaccagcggtgccaccaggcccctgtctgccccccaggctgcaggggcggcccaaagccaaggaaatccagctccgctggggccctcctctagtggatgggggatcacccatttcatgttactcagtcgagatgtcccctatcgagaaagacgaaccccgggaggtctatcaggggtctgaggttgagtgcactgttagctcactgctgccaggtaagacctacagctttaggttgcgcgccgcaaacaaaatggggttcgggccttttagcgaaaagtgcgatattacaacggcaccaggaccccccgatcagtgtaaaccccctcaagttacctgcagaagcgcaacctgcgcccaggtcaattgggaagtaccccttagtaacggcactgatgtaactgaataccgtctggagtggggtggcgtcgaaggctccatgcaaatctgttactgtggtcccggactgtcttacgagattaagggtctctcaccagccacaacgtactactgtagagtgcaggcactgagcgtcgtgggcgctggacccttttctgaggtggttgcctgtgtgaccccaccatccgtgccagggatcgtaacttgcctgcaggagatctcagacgatgagattgaaaacccccattactctcccagtacttgcctagcaatctcttgggagaaaccttgtgatcatggaagtgaaatccttgcctactccatcgacttcggtgacaagcagtcccttaccgtgggcaaagtaacaagttatatcatcaataatttgcagcctgatacaacctacagaattcggatacaggccctgaattctctgggagccggccccttctcccatatgattaagctcaagactaaacccttgcccccagacccaccacgacttgaatgtgtggctttcagccaccagaacttgaagttgaagtggggtgaggggacaccaaaaacattgagcacagattctatccagtatcatctacagatggaagacaaaaacggtcgcttcgtgtctctgtaccgcggaccttgccacacctacaaggtacagcgtctgaatgagagtacctcttacaaattttgtattcaagcctgcaacgaagccggagagggaccactcagccaggagtatatctttactacccctaaatcagtgccagctgcccttaaagctcccaagatcgaaaaagtcaacgaccatatatgcgaaattacttgggaatgccttcaacctatgaaaggcgacccggtgatatacagtctgcaggtcatgctgggcaaagattcagagttcaaacagatatataaaggaccagactcttcttttcgatatagcagcttacagttgaactgcgagtaccgtttccgggtctgcgcgatacggcagtgccaggatagcctagggcaccaagatctggtggggccttacagcacaacagtgctttttatatcccagcgaacagagccgcctgcctctaccaatcgggatactgtcgagagcacacggacccgacgggccttgtctgatgaacagtgcgctgctgtcatcctggtgctattcgcctttttctcgatcctgattgcctttatcattcagtacttcgtgataaagtag

SEQ ID NO: 26363 - DNA, 2055 bp, Artificial Sequence
  Description of Artificial Sequence: Synthetic coding sequence
atggctgagcacccaccccttcttgatacaacacaaatccttagttcagatatctctctcctgtccgctcccatcgttagcgcggacggaactcagcaggtaatcctggtccaggttaacccaggagaagccttcaccattcgacgagaggatgggcagttccaatgcattacagggcccgctcaggtgcctatgatgagccccaatgggtctgtacctccaatttacgttcccccgggttatgctcctcaggtgatcgaggacaatggcgttcggagggtggtcgttgtcccacaggctcccgaatttcaccctggcagtcacacagtgctgcaccggtcaccccacccccctctaccaggtttcattcccgtccccactatgatgccacccccgcctagacacatgtactcaccagtgacgggcgctggggatatgactacacagtacatgccacagtaccagtcctcccaggtttatggagatgtcgatgcacactctacacatggacgatcaaacttccgagacgagcgatcgtcgaagacctatgagcggttgcagaaaaaacttaaggacagacagggcacccagaaggataagatgtcttcgccccctagcagtcctcaaaaatgcccatccccaatcaacgaacataacggactaatcaagggtcagatcgccggtggtatcaacacaggatcggcaaaaataaagagcgggaagggcaagggagggacccaggtggatacagagatcgaggagaaagacgaagaaaccaaggcattcgaggccttactgagtaatatagtgaagcccgtcgcatccgatatacaagcacggacagtagtgttgacctggagtccaccatcaagccttatcaatggcgaaacagatgagtccagtgtgccagagctgtatggatacgaggtgctgatttcaagcaccggcaaggatggaaaatacaagagcgtgtacgtgggcgaggagaccaacataacattgaatgatttgaagccggccatggactatcacgccaaagtacaggctgagtataatagcatcaaaggtacaccgtccgaagcagagatattcacgaccctgagttgtgagcccgacatccccaatccacctaggatcgcaaaccggactaagaatagcttgactttacaatggaaagcgcctagtgataatggatcaaaaattcaaaactttgtacttgagtgggacgaggggaagggcaatggagagttttgtcaatgttacatggggtcccagaagcaatttaaaataaccaaattgtccccagccatgggctgcaaattccggctgagcgccagaaacgactacggcacatcgggtttctctgaggaagtcctgtattacacttcaggctgtgcccccagcatgccagcatctccagtcctgacgaaagcgggcatcacttggcttagcctgcagtggtcaaagccatcaggcaccccgagcgacgagggtattagctacatccttgagatggaggaggagacaagcggatatggcttcaaacccaagtacgatggcgaggaccttgcctataccgtgaaaaacctgagacggtccaccaaatataagtttaaggtgattgcctataattcagagggaaaaagtaatccctccgaggtggtcgagttcacaacgtgtccagacaagcccgggatcccagtaaagccaagcgtcaaaggtaaaatacactctcatagctttaaaattacatgggacccacccaaagataatggcggagcaactattaataagtacgtagtggagatggctgaaggctccaacggtaacaaatgggagatgatttattcaggagccacaagggagcatctctgtgatagactcaatcctgggtgtttctacagacttcgggtgtattgtatcagcgacggaggtcagtcagcagtgtccgagtcgctccttgttcagactcctgcagttcctcctggaccgtgcctcccacccaggctgcaggggcgacctaaagccaaggagattcagacgcccagcggatag

SEQ ID NO: 26364 - DNA, 675 bp, Artificial Sequence
  Description of Artificial Sequence: Synthetic coding sequence
atgaacattgaggtcgggaatatctcttataccggtgcgatcatttcttggtcttccagcgagccttgcctggaggactactatcatatcatgtacagacctaactggaattctattttctctggctatctccgctactcattccaccacgaggagaaggtgccaaggacgataagctcggtagtgctcgagcacctcgcccccagcacactgtattttctgtgtatcagctgtaagaaagcggcattcccataccgtcactactgtacaatgtttcatacattagacaagagtcccctggctcccggttcatccttagtggacccacagatctcactgtgggtccttatggccattctactggcttgctttactgcagtgctggcttttatctgccttcagttctggtgcgtgcggtgtcacgaacctcgctggagctaccgtgccgggcacatggaagaagctaatggcttggtgagatggcccgaagaggccccggatctaggccagcgggaagaggatctgcagggcttacccctggtggaaatgcctcgtaagaactccagggacggcgcagaactagatcctgaggccaatcaggatgcaccggatgccggtgccctgcaaagaggaggtggggatccaccagcgatcttgccacattgcggcgagtag

SEQ ID NO: 26365 - DNA, 543 bp, Artificial Sequence
  Description of Artificial Sequence: Synthetic coding sequence
atgaacattgaagtcggcaacatttcctacaccggtgccatcatcagctggtcctcctcggagccctgtcttgaagactactatcacattatgtacaggcctaactggaatagtatcttcagtggatatctccgctactcctttcatcacgaggagaaagttcctaggacgatttctagcgtggtgttggagcacctggctccgtcaaccctgtattttctgtgtatctcctgcaagaaggctgccttcccatacaggcactactgcaccatgtttcacacattggataaatctccattggcgcccggctccagtctggtggacccccagatatctctatgggtgcttatggcaatattgctcgcttgctttactgccgttctggcattcatatgcttacaattctggtgcgtgcggtgccatgaaccccgctggtcttacagagccggtcacatggaagaggccaatgggctggtcagatggccggaggaggcgccggatctcgggcaaagggaggaagacctgcagggcctgccattgtag

SEQ ID NO: 26366 - DNA, 10401 bp, Artificial Sequence
  Description of Artificial Sequence: Synthetic coding sequence
atggagctgtatctcggagcatgttctaagccagccaaggtggccgtgacgaagaccgtggcgtccgtcttagccgcagatacccagcagtgccgcgacggggtgcacaagacccattttgccggcgttggtccagctcaactgttggacctccccctgggggtgaaattaccagtcattccggggtctaatgcggtgttctatacaaccaattttggggagaagttgtttcgtccaagctatggcttcaatttgacagacccgtactgtcggttgctggagaatcaatataagtcgctgcacgacccacaccttaaagcatactacaagcggaaagatattttaaagaggttgaagaaagggggttacatcacatccaacaacaaggttgtgtgcacccttcgcgagctcaacaaatacaggcaatacctcacctccctgaaattggactttgagcggaattatatcaaggaacagcgcattttagctaagcaattgcataacattccagagaacaaccagattccccagcattgcgacgtggcacaggttcagaattggctcctcaaggagggaactgagtccattaaagatcaggagcgcctgatgagacacagatatttagatatgatctcaagaaaactggagcagcttgaaagaaccgcagaagagcagcggctctttctgatggaccgggaagagcggcgccaacgcgaacacacacgcagaaagttgaccctccgcaggaagattgaggaagagtggaagactaaggagatgttgctcctaacacgcatggcggaggacgtgaagagagaagaaaggatcgaagaacaacagcacagaaacagagaggagtcggatcgtaagaagcaagatcttttggaaaaaaagatggcataccaccttcagaaaatgcaagacactggctttaacggcgaggacattggcaagaataccttcaaatacagggggcaggatggaactcacgcgagtcctaaaaataaaaagaagacaagcgaagatattatgctagtgtaccccgccggcgaccagaacacatacaaagaaactcacggacacaccgccaacgctgcgcaccagcggcagaacagctctaacaatttcactaagaaaaatagcgcatccgttgtgtaccaggccgacgtgcaggacaatggcataaatcagaaaagagacggaatggtgtccaaaaattcctccatctttgatgatcgaggaggcattaacatttctggacagggttctattatttccgcacaggtgtccccgactagaaactttagcagagtctcccaagctttcctagacccaagtaaagaagagaaggaaaccaacgctgactgggatggtcgtccgaccaaaagatctagctatctctgcgagtccggtccacaggcgcatgcaaccgatcctggaatcttctcctctccagtctacaccaatatgcaacagaatctgctccagaattgtcttcaggaaaaggtcacttctgaggagctaaacatcatcatccagaatgtgatgacctgggtggtggcaacagtgacctcaattctttaccccgcaattaccaaatatgagaagcgattgcagaataatacctatcctgtcagtgacgactccatcctcagttcagattcgagtagtttttgctccacctgctcagaggacttcacgtaccggtcttacaccagcgcgaccacaaaaacttttcaggcagaaccctgtgcttttgtggttgatacttcagttcggcggcctacaacccctatcaaaccaccacccgcgcacgtggagaaaactgtggtcgggaagacctgtcacattaaggggcagtccataatctctaagcacaagtacaacaagaccaatctgttgtattcgtaccctaaactgagatcttgcaagtccgattctcacttgctggcctcgtttgagaccggaactaagaaatcaaaggatgccacaacagagaccgactctcttgggtcaagtctccactgcgataagacggctaaagccatggacgagatgaagaacctcaagaatgtcttcgtgaattttaagtgctatctcaaaggcgagacagaagtgatcttggagtccattctgagggaaatcatgtccgatttgacgcaggctatacctagccttagctccgtgaccgctgaagtcttcgttgagcagtgcgaacgagagaaggagatcctgctctcaaacgcccatatcccatcggtggctagcgaaatcgttgaaaacatgctggagaaattagaatctgctgtggaaaagaagtgtgttgagatgttttctcaggacttgtccgttgatattaaacctagccttgcggcttctgatgagctgttaacaagctccaatggcaaaccccttaaaaacagcatgccacatacccttgaccctatgtgtgacatcgctgaggatatggtgcatgccattttagaaaagttgatgactttagtaagcttcaagcagaacgaattcctgcatctgaaagatactaacaaactgtcctgccaacagcataaaaccgacccaatttgcatgtttttacagagggcgggcaagaacaagtcttccctagaatcagatgaggctagtctgatagtgaacgaggaggtgcagaacctgatcagcaacatattctcccagagtagcctcgttgcttacatcgaagaagctataaacgccatcctgggctatatccagacagaactaaacaatgagcggattattgcatcagaagagacagtcgtcctcctccagctgctggaagacatcctgttccagttgcaccaggagcctgtaaacgagtctttccagaaatccaggcagccacgcatctcttcaccttcagatactaaggaaaagtatcggctcactgggacacggctttccaactcccctagatctggtcggccgttccctcctatcaacgtccccggcatggttctgtatagtgacgacgaaaacgaggaaatcgacaatattgtgaagaatgttcttgattctacctttaaggacgaaaaagtgaagagccaggagcagatccccaatcactggttcaccaagggtaacacctgctttgagtgtaaaagaaacataaagccaccgaccaagcccgggtcccgcagcaaggccgctttccacgactgggaactcaaaactgagccgcccagcaccaaccacgaggatattctaaaaaagaaattatctagcaataaagacataagtacgttctcacaggaccagaaacaccaaatcgagaaggcatctgagaacatcgttacatcgatattaaaggaaatgttgaaggacatctctagtgtgccctttgggcatctggattctaaaaccggcagtgaggctagtgtgctggtcagtgaaaagcctcaaggcctcagtcaccaggaatggatagatcaaatgttctccgtttcagagattagtactgtggcacaggaaataacagatagcgttttgaacatactgcataaggcaagcaattacatctcaaacaccaccaaatccagtatcagttctagtgttcatcagatttcccttcataacagtgacacagaacacatcgtcaaagaggctcctaacaaatatccacttaagacttggttcgattctgaaaaaaagatgaagtacttgtcgctgttcgacgtcgatcctgagaaacccccatggttaaagtccggaaagtcggaacccaaacctgtggacgatatcaacgataagatcatcagaactattttcaagcgactcaaatcattcatatgtccaaaactgcatatggggtttaaatcctcgctgcggtctcagttgtcaaagtatacagcaaaaatcgtgaacatagtactgtgcgcaatccaaaatgagctagagctgcataaagagaacctgaatctgcgcgaaatcgatcacacaaagagcctaaccgacaagggcttcttcgcaaataccgacaagaaattggagagcctggtgacttccatagacgatgatatcctcgcaagccccctgctgacctgtatctatgacatgctgctgagctccgagaacgctcaccagaggtccattagcctcagctccaggaagccaaaatcagccactgacagcgttgatgtacagtcaattttacccaaccgccaggacaagaagtccttccataaatacctggcaactccgtgcacgcaccactcagtgaatggcgggaaccacatcaaagagaatgccaaactgcaggtgctggaaaggattggagaaactctgcacgaaatgctaagtaaactcttagggacccatcttcactcacagctgagttgtagccagcagtctagagagatgacgaacaagaaccagaaaatggctgctgctctacagagtaatatccaattaataagtaaggccattctagattacatcctggcaaagctttgcggagttgacatggacacctctttcgcctcctgtggcttgaaagctatcagcgagagtctggatatcgataacccctcatttgcctccatcatcgagaaaatggccaagagtaccaaaatcatatcatccatagtgtcccggcgcgtgcaggaagataataaggaagaaacaaaaagcaaagccaaacctgttgcacccgtctcttccaaaaccccctctaccaaggagatgcacccaaacaagctgaaggctgtggcctccgacattcttaatatggtctttgctaaactggaaggttttgctaatggacatttggagatcctcggagccattaatgatgggaacaaaaagtcgaacaaaatcggctgggagtacgagtcgactaatatctctagagacacccacgaggccagctttctttcagccctctacatgcatgccaagaaggtttcctctgcaattttgaaggtgattcaaactgaactgaacgtcacatcatccgatttgaaaactagcgttgaaaatcctcctccagagacacagattctgaagtacgttgtgaagctcatcttagacgccgttagctcagacatgtttaacgaaatggaaagcgagggcggcggcatagagacttacagatatagaccaacgtatggctccctccccggaggtgcagagagtgacagcttcctggaggacgacgcgtacacagcaaaaaaaatcatcgacgagaggagccctcaacgcgaggaagtgaagactcgatcgctgaaacagtgggctttagagaaaactctgaacaagatagaagtgaagctgaaggaaccacacatatcgccaattgcccctatcatacgcaacattcttaacgagatctttcagtctaccctgatcaatcagctcaatgtcctgtctctctcccactccaattttaatgggatgccccacaatgtggacgaacccactccacagacatcggtgcagttcatggacaagatgatggaccctctgctcagtgaggctgatattacaatcgtcactgacaacattgtgcgaaccgtgtttcacaaactgtactctgctgcgatgactgagcggaatgtgagggaaaaccggtacaagacaatcaccttttctgctaacgtctcgagtcacgaacatacatacaaggggaaatcaagtgtcaccgcgctggatgaaaatccctgtactttccaaagccggttctccgtagcagataaggagacaaaggtcaacctggccgaggacattgtgcaggcaatcctgaccaacttagagaccttcgctacttcaaaggtgaaatcactgttttactcacaggtcaattttacggtaccagtggccttgcccatccagcaggatcattcgactctgtcaaaggcactgtcagcgaaagattcatattcggacgagcagtttagttgttgtagcgtggatcacactaagtcagggaagaccaacttgtgtcagcttagtcttagtaaactgaacacttatgccctccaggtcgctcggagaaatctgcagggcattaagcaggaattagacaaagagcgcgagaacccatttctgactcacgacatagggatcagcgagtccattgcctcgcagattgtcaacgcactgctcgacatcataagcaggaaggggaagtgcgacaagaattcaagcgacaaagaaatcgacctggatcagcagaagggggttatcgagaagttgcttaacgagaccaaatatcgaaaggtcctgcagctgcaaatacaggacacaattgagggcatcctgtgtgatatatatgagaaaacactttttcagaacaatctgtcttttgcaacccccaccttgaagtgcagcatcgcagataagcactctgaggagaattctgaaatgttcatggagggagctaacaagatcataccaaaactttcagtaccaaaaagtgacgtgattttaatcagtaatgacattgtaaatattgtgctgcacaatctgtcttcagcagccacgctggttatcaatgccaaaaacccgacttccgcccgactccctcttaccttctgcgatactttccctaagatcgattgccagcagcctttgaaaggatctaagacagaaagaaaaactgagcggtttagttacagccgcaaccagaagtccgcatatgcagatgataaccaaattaccgtggtcgagaaggaggatactcaaaagagtgcaacagattcctgcgaggagaatgccaacttcattacaaaaaccatcttcaagcgcctagaatctttcgccacggagaggattgatagcttgattaccctggcctttcagagtaaggagaagagctttgtgatcccggagcttgagaactgcaaacagaatgactccattttctacgattcctcccaggtggaaagtgacgtgaacgtgctcaagattagcgcaaccgagaccatcctgtctcaagaacttacagacttcacctttgtaggccggcgggaaaaattgggttcgaccatccacctaagtcaagctagactgaaaacctacgccgatgtgatagcttcagccatccttaagttaatcaagaacgatctggatctggaaatacagaaaatttacccgtaccaaaacaatatcctgttccaggaaaatataatcgtgagtgagatcgtggatagcatgcttaagatgctcgatgacaaaagaagcgttaaggaaatttgttttaatagcaaagaaaatagcaactttagccagctggccctgtccaacgaaattctgctgggacacaaagaaaaggaaagatccaccaaacagagcctctttacaaagtatcctcttgaacagaatcagatgattctggagaataagagacagatcatagtgctggaagagatcttcatgaggaacggtgaaagcaagaacaaagagaaaggagagcttctgattgctgttgaggagctccttaacaagctgtaccagagggtccgggaggtgactggacaccttcctcctctgaatgagactgccaactttatctctaactccaaaatcaagacatcagacactacacaaaagaattctttccaatcccatatcaattccgtggccaatgacatagtggagtccgtgcttggtaagatgtatctggtagtagtaactagcctatacgagaacaataagtctcgtacggaagtcgagatcagcgatcataacgatagtctgctcatgaagcccctgaggtttagggagacgaagcaggccggaaaaatctccaattcaccacgctatgcgatctcgcaggcctatagctacgtggattcacaaaatatcagcgtgatggagaacaccctgcttccttacctccccttgcaagtcaagaaagacctgattcagatggtgctgaataaaattactaatttcgtgtcactgcccctcaaagtatctcccaaagacaaccccaagccttgctttaaggcacatctgaagacaaggtctaagatcacaacactccctaaatttactaaaaagacccacctgggtctctccgcagctaaagcgaaaagcaagactaaactcgggccaggtgaaaaaacactgaaggactccagatctaagactgcaattgggctctcccatattatgtcagcaggcgacgccaagaacctgcttgacacaaagttgcccaccagcgagttgaagatttacgccaaggatattattattaacatcctggagaccattgtgaaggaattcggcaaagtgaagcaaactaaggccctgccctctgaccagatcattgccgccggcaagatcgtgaatacagtcctgcaagagctttatgtaacaaataactgtaatcttgcctatccgatgaaatcatcccatttaagacttagccaaggcaatatcggtaccggctcgttacccaaacagcaggcatgtttctacctggagaacgtgagctctcagctggaacatatattcccgagagaagggatctttaagaaactgttcgacaagtggcagactgaatctaatgataaagagaacgaaaagtgtaagcttctcatgatagccgagaacgtacttactgagattagcatcaaagcaaaggagctggaatacagcttatctcttctcaacctacctcctcttgagaactgtgagtctcgtttctacaaccactttaagggggcctctacacgggccgaggatactaaggcgcagatcaacatgtttggaagggagattgtagaaatgctgctggagaagctgcaactctgcttcctcagccagatacccacacctgacagcgaggagacattgagcaattccaaggagcatattaccgccaaatctaagtacggatttcctaataagcatagtttgtcatccctcccaatctacaacacaaaaaccaaagaccagatttccgtcggctcatcaaaccagattgtgcaagagattgttgaaacagttttgaacatgctcgaaagcttcgtcgacctacagtttaagcacatctccaagtacgagttttccgaaatcgtcaagatgcctattgagaacttatctagtatccagcagaaacttctaaataagaagatgcttcctaagctccagccacttaagatgttttctgacaagtcagaaagtaataccattaatttcaaggagaatatccagaacatcttacttcgcgtgcactcttttcacagccagctacttacatacgcagtgaacataatttctgacatgctggcagtgattaagaacaaactggataacgagattagccagatggagccgtcttctatttccatactgaaagaaaatattgtcgcgtcggagatcattggcaccctgatggatcagtgcacctatttcaacgaatcacttatccagaacctgtcccgggagtccctcttccagggcgccgaaaatgcctacaccgtgaaccaggtagagttggccaccaacatgaaaatgtttactagcaaattgaaagaggggtcgcttggaatcaatccctcccaggtctccaagactggttttgtcttttgtagcgatgaggacatgaaggaaaagtaccgtgtcagtagcgatctgcccaccagcgtgagaagcagtgttgaggatacagtcaagaattcagaaccaacaaagcgccccgactcagaaacaatgccttcctgctctaccaggaacaaggtccaagaccatcgtcctcgagagagcaatttcgggtcttttgatcagaccatgaaggggaacagctacctgcccgagggatcctttcttcagaagctcctccgcaaagcctccgatagcactgaagccgccctgaagcaggtcctgtccttcatagaaatgggaaaaggagagaacctccgggtattccattacgagaacctcaaacccgtggtagaacctaaccagatccagactacaatctcacccctgaagatttgtttggcagcagaaaatattgtgaatacagtcctctcgtcatgcgggttcccctctcaaccccatacaaacgagaacagggagatcatgaagcccttcttcatcagtaaacagtcttccctgtccgaggtgtccggcggccagaaagataacgagaaatcattactgcgcatgcaggacaaaaaaattaattacatcccagaggaggagaacgagaacctagaagcttctagggaagatagttccttcctccagaaattgaaaaagaaggaatatccgaagatcgaaacagtgaaggaagtggaggctttcacctttgcagaccacgagatgggaagcaatgaagtgcatctgatcgcacgccatgtcaccacctctgtagtgacctacctcaaaaattttgaaacaaccgggaaatgttag

SEQ ID NO: 26367 - DNA, 20991 bp, Artificial Sequence
  Description of Artificial Sequence: Synthetic coding sequence
atgaagttccagctgtggtcaagccagatccggccgctgggccctatttttcctgcactgagggcactgtatgccctcgctagagcagctccacaggaagctacagctctattggggccactacccctcgaggcctggaacgctggggggggtgcagaggtggtgggcttatggcctttcctcgttagatccggccagagggataacggcgtacttgagaaggagagcggtgcgggagaagaaggcgccgagggggccgttcctgctatggaactgtatcttggcgcatgtagtaaacccgcaaaagtcgctgtgaccaagaccgttgcttccgtgctcgccgctgacacccagcagtgccgtgacggtgtacacaaaacacacttcgccggtgttgggcctgcccagctcctggacctccccttaggagtgaagctgcctgtaatcccaggctccaacgccgtcttctatactacaaacttcggggaaaaattgttccgccccagctacggtttcaatctgacagatccctattgccggttactcgaaaatcaatacaaatctctgcatgatccccatctcaaagcttactataaaagaaaggacattctaaagaggctaaaaaagggcgggtatattacctccaacaataaagtggtgtgtacgttgagggagctgaataaatacaggcagtacctcacatcacttaaactggattttgagcggaattacatcaaagagcagcgtatcctggcgaagcagctgcataacattcccgaaaataatcagatcccccagcactgcgacgtggctcaggttcagaactggctgttaaaggagggcaccgagtccattaaagaccaagagcgtttgatgcggcacagatatctcgacatgatttccagaaaactggagcagctagagagaaccgctgaggaacaaagattgtttctgatggaccgggaagagcggaggcaaagagaacatacaaggaggaaactgactctccgacggaaaatcgaagaggaatggaagaccaaagaaatgctgctgctcaccaggatggcggaggacgtgaagagggaagagcgcatagaggagcagcagcataggaaccgagaggagtcggacagaaaaaaacaggaccttctcgagaagaagatggcttaccacctgcaaaagatgcaagacaccggttttaacggagaggacataggtaagaacacctttaaatatcgtggtcaggatggcacccacgccagtccaaagaacaaaaagaaaacctcggaagacatcatgcttgtttatcctgctggtgaccagaacacatataaagagacccatgggcacacagccaatgcggctcatcagaggcagaatagctcaaataactttactaagaaaaactccgcttctgtggtgtaccaagcagacgtccaggacaatggtattaaccaaaaaagggacgggatggtgtccaagaacagctctatctttgatgaccgcggtggaattaatattagcggacagggttccataatctctgcccaggtgtctcctacccgtaatttttccagagtgagtcaggcctttcttgatccaagtaaagaagagaaagaaaccaacgcagactgggatggcaggcccactaagcgctcttcttacctgtgcgagtcgggcccacaggcccacgccaccgatcccggcatcttctcatccccggtgtacaccaacatgcagcagaacctgctacagaattgtttgcaggaaaaagtgacttctgaggagctaaacataatcattcagaacgtcatgacatgggtcgttgctactgtgacatcaatactgtaccccgccatcaccaagtacgagaagcgcctacagaataacacttatcccgttagcgatgattcaatccttagttcagactctagcagtttctgcagtacttgcagcgaagatttcacatataggtcctacaccagcgccacgactaagacctttcaggcagaaccttgcgcttttgtggtcgacaccagcgttcgcagaccaacgaccccgattaagcctccaccagcacatgttgagaagaccgtagtcggcaaaacatgccacataaaaggacagagcatcatcagcaagcacaaatataacaagaccaaccttctatacagctaccccaaactgagatcctgtaagagtgattcgcacctgctcgcttcttttgagacgggcactaaaaagtcaaaggatgccaccactgagaccgattctttggggagctcattgcactgtgataagaccgccaaggctatggacgaaatgaagaacctgaaaaatgtattcgtgaactttaagtgttacctgaaaggggagacagaagttatcttggagagtatcctcagggagatcatgtccgaccttacccaggctatcccatccctcagtagtgtcacagccgaggtgttcgtggagcagtgcgaacgcgaaaaggaaatcctactcagtaatgcccacatccccagcgtggcctccgagattgtcgagaacatgttggagaagctggagtccgcagtggagaaaaaatgtgtagagatgttttctcaggatttgagtgttgacattaaaccttctcttgctgcgagcgatgaacttctaactagctccaacggaaagcccctgaagaacagcatgccccacacccttgatccaatgtgcgatatagccgaagatatggtgcacgctatcctggagaagcttatgactctcgtcagctttaagcagaatgaatttctgcacctcaaagatactaataagctgtcatgccagcaacacaagacagatccaatctgcatgttcttgcagagagcaggaaagaacaagtcgtccctggaaagtgatgaagcaagcctgattgtaaatgaggaggtacagaacctgatcagcaacattttctcacagagttcactggtcgcctatattgaggaggctatcaacgccattctgggctatatccaaacggaactaaacaatgagagaattattgcttccgaagagacggtggttctactgcagctcctggaggatattctttttcagctccatcaggagccggttaacgagtccttccaaaaatctcgtcagccaaggatctctagtccgagcgataccaaggagaagtacagactcaccggaacgaggctttctaactctccgagaagcggccgaccattcccacctattaatgtgccgggaatggtgctttactcagatgatgaaaacgaagagattgataatatagttaagaatgtgctggactctacattcaaagacgagaaggtgaaaagccaagagcaaatcccgaaccactggtttacaaaaggaaacacatgctttgagtgtaaaaggaatattaagcctccgacgaagcccgggtcccgatccaaggccgccttccacgattgggagttgaagactgagccgccaagcaccaatcatgaggacattctgaagaagaaattatctagcaacaaagatatctctactttcagccaggatcagaagcatcaaatagagaaggcctcggagaacatcgtcacctctatactgaaagaaatgttgaaggatatatctagcgtgccatttgggcatttagattccaagaccggaagcgaggcctcggtactagtgtcagagaaacctcaggggctgtcgcatcaagagtggatcgatcagatgtttagtgtgtcagagatttctaccgtcgctcaggaaatcactgatagcgtcctgaatattcttcacaaggcttccaattatatttctaacaccactaagagctcgattagtagctctgttcaccagatttctttgcataattcagatacagagcatatagtcaaggaagcccctaacaaatatccgctgaagacatggtttgattctgagaagaaaatgaagtacctctcactgttcgatgtggaccctgagaaacccccatggctgaaaagcggcaagtctgaaccgaaacctgtggatgatattaacgataagatcatacggaccatttttaagagactcaaatcttttatttgtcctaagttacacatggggttcaagtcctctctgcgatctcagctgtcaaaatacacggcaaagatcgtaaatattgtcctgtgcgctatccagaacgagctggaattgcataaagaaaatctgaatctgcgagagattgatcacaccaagagcttaaccgataaggggttcttcgccaacactgataaaaagctcgaaagcctggtcactagtatcgacgacgatatattggcgtcccctctgcttacctgcatatatgacatgttattaagctccgagaatgctcatcagcgaagcatcagtctgtcaagtaggaaacctaagagtgctaccgacagcgtcgacgtacagagcattctgccaaatagacaagataagaagtccttccataagtatctggctaccccgtgcactcatcatagcgtaaacggtggaaaccatataaaggagaatgctaagctgcaggtgctggagcgtataggcgagaccctgcatgagatgttgtccaaattacttggaacacacctgcacagccagctaagttgctcccagcaatcgagggagatgaccaacaaaaaccaaaagatggctgcagcactgcaatctaacatacagctcatatcgaaagccatcttggattatatattggccaagctttgtggtgtagacatggatacatcctttgcgtcttgcggactcaaggcaatatcagagagcctagatattgacaatcccagctttgcctccattatagaaaaaatggctaagtctaccaaaatcatatctagcatcgtgtccaggagagtgcaggaagacaacaaagaggaaacaaagagtaaagccaaacccgttgcccctgttagctcgaaaacgccatcaacaaaggaaatgcatcccaataagttgaaggctgttgcctcagatattctgaacatggtctttgccaaactggaaggtttcgcaaacggacacctggagatattgggggcgatcaatgacggaaacaagaaatctaacaaaatagggtgggagtacgaatcaaccaatatttctcgcgatacgcatgaggcctcattcctgagtgctctctacatgcacgcaaagaaggtttcctctgcaattctgaaagtcatccagactgaactcaacgtaacgagcagcgatctcaagaccagtgtcgagaacccccctcccgagacccaaattttgaagtatgtagtcaagttaatattggacgccgtctcatccgatatgttcaatgaaatggagagtgagggtggtggaattgagacatacaggtaccggccaacatatgggtcgcttcctggaggggccgaatccgattctttccttgaagacgacgcgtacaccgcgaagaagatcattgatgaacgtagcccccagagagaggaggtcaaaacacgatccttgaagcagtgggctttagaaaaaactctgaacaaaattgaggtcaaattaaaagaaccccacatctcccccatcgcacccatcatccgcaatatcctgaatgagattttccagtctaccttgattaatcagctcaacgtcctgagcttgtcacacagcaacttcaacggaatgccccacaatgtagatgaaccaacacctcaaaccagcgtgcagttcatggacaagatgatggatcccttactgagcgaggctgacataacaattgtgacagacaatatcgtaaggactgtgttccacaagctgtactctgccgcaatgacagaaagaaatgtcagagaaaacagatataagacgatcacatttagcgcaaacgtgtcatctcacgagcacacatacaagggcaagtcgtcggtaactgcgttggatgagaatccatgtacgttccagagcaggttttccgtcgctgataaagaaacaaaagtgaacctcgcagaggacatcgttcaagccatcctgaccaatttggagacgtttgctacatcaaaggttaagagtctgttctatagccaggtcaatttcactgtgccagtggccctcccaattcagcaggatcatagcactctgagtaaagccctgtccgccaaagacagctactccgacgagcagtttagttgttgttcggtcgaccacaccaaatccggtaaaactaacctgtgccaacttagtctgtccaagctcaatacttatgccttgcaggtagctcgacggaacctccaaggcatcaagcaggagctggacaaagagcgagagaatcccttcttgacgcacgacattgggatcagtgagtctatcgcctcccagatcgtgaacgcgctcttggatataatcagccgcaaaggcaagtgcgacaaaaattcatccgacaaagaaattgacctggatcagcagaaaggggtcatcgagaagcttctgaatgagacgaagtataggaaggtgcttcagctccagattcaggacaccatcgaggggatactctgcgacatctacgagaaaacactcttccaaaataatcttagctttgcaacacccacactgaaatgcagtattgccgataagcattcagaagagaattcagagatgtttatggagggcgccaacaaaattatccctaaacttagtgtgcctaaatccgatgtaattctgatttcaaatgatatcgtgaatattgtcttgcacaatctgtctagtgctgccacactggtcattaatgccaaaaaccctacctctgctaggcttccgctcacgttttgcgacacttttcccaagattgattgtcaacagcctctgaaaggcagcaagacagagcgaaagactgaaaggttctcctattctagaaaccaaaagagcgcttatgctgatgacaaccagataaccgtcgtcgaaaaggaggacactcagaagtcagcaactgatagttgtgaggaaaacgccaatttcatcacaaaaacaatctttaagcggctcgagagcttcgcaaccgaacgaattgattccctcataaccctggcgttccagtctaaagagaagagtttcgtcataccagagctggagaactgtaaacagaacgactctattttctatgatagttcccaggtggagagtgacgtaaacgtgttgaaaatctccgcaaccgagaccattttgtcccaagagttgaccgactttaccttcgttggtcgtcgggagaagcttggctcgactatccacctctctcaggcacgattgaagacctacgcggatgtaattgcttccgccattttaaagctgatcaagaatgatttggatctggagattcagaagatctacccctatcagaataatatcctctttcaagagaacataatagtcagcgaaatcgtggattctatgttgaaaatgcttgatgataaacggagcgtgaaagagatctgtttcaactccaaggaaaattctaacttctcccagttagccctgtcaaacgaaattctgttgggacacaaggaaaaggagcggagcactaagcagagcctgtttacaaagtatcccttggaacagaaccagatgatcttggaaaacaagcgccagatcatagtgctggaggaaatcttcatgagaaatggcgagagtaagaataaagagaagggagaactgctgatcgcagttgaggaattgctcaacaaactgtatcagcgcgtgagggaggtcactggccatctgcctcctctgaacgagactgctaattttatttccaacagtaagataaaaactagtgataccacccagaaaaattccttccagtcccacatcaactctgttgctaacgacatcgtggaatctgtattgggtaagatgtacctggtcgtggtcacatctctttacgagaacaataaaagccgaacagaggttgaaattagcgaccacaatgacagtttactaatgaagcctcttcggttcagggagacaaagcaagcaggcaaaatctcaaacagtcccagatatgctatctcccaggcatactcttatgtggatagtcagaatatcagcgttatggaaaatactctgctaccctacctgccactccaggtgaagaaggacctgattcagatggtcctcaacaaaataactaatttcgtgtctctacctttaaaggttagtcctaaggataacccgaagccatgttttaaggcccatttgaagacccgaagcaaaatcactactttgcccaaatttactaagaaaactcacctggggctcagcgccgccaaagccaaaagcaagacaaaattgggccctggggaaaagacactcaaagactcccgaagcaagacggccatcgggctgagccacattatgtctgccggcgacgccaaaaacctactggataccaaactgccaacttctgaactcaagatatacgcaaaagacatcatcattaatattttagaaacaatagtcaaggagtttggaaaggttaagcagactaaggcactgcccagtgatcagattatagccgctggcaagatcgtgaatacggtgcttcaagagttgtatgtcactaataactgcaaccttgcctatccaatgaaatccagccatctgcgcctgtcgcaggggaacatcgggaccggcagcttgcccaagcagcaggcctgcttctatttggagaatgtgtcctcgcagctggagcacattttcccacgagagggaatcttcaagaagttgttcgacaagtggcagacggaatccaatgacaaagaaaacgagaagtgcaaactgttgatgatcgccgaaaatgtgctgacggagatatccattaaggccaaagagctggagtattcactgagcctgctcaaccttccccccctcgaaaattgtgagtccaggttttacaatcattttaagggagccagtactcgggctgaggacaccaaagcccagataaacatgttcgggagagagatagttgagatgctactggaaaagctgcagctctgttttctgtcccagatccccacacccgactcagaagaaacgcttagtaatagcaaggagcatatcaccgctaagagcaagtacgggttcccaaataagcacagcctatccagcctccccatctataacacaaagacaaaagaccagatctcagtgggaagcagtaaccagatagtgcaagagatcgtagaaactgttctaaacatgctggagtcttttgtcgaccttcagttcaaacatatcagcaaatacgagttttcggagattgtgaagatgcccatcgaaaatctatcatcaatccagcagaagctacttaacaagaagatgctccctaaactccagcctctcaaaatgttctccgacaaatccgaatccaataccattaattttaaagagaatatccaaaacatcctcttgagagtgcactccttccattcacagctgctcacttacgcggtgaatatcatatccgacatgctcgctgtgattaagaacaaattagacaacgagatcagccagatggagccatccagcatctcaatcctgaaggaaaacatcgtcgcaagtgagatcataggtactctcatggaccagtgcacatatttcaacgagagcttgatccaaaatctctctcgggaatccctgttccagggagcagaaaacgcttatactgtgaatcaggttgaacttgctactaacatgaaaatgttcacaagcaagcttaaagaggggagcttgggtattaacccctcacaggttagcaaaacaggcttcgtcttttgttctgacgaggatatgaaagaaaagtaccgcgtgtcttcggatctaccaacctctgttcgatcttctgtggaggatactgttaaaaatagtgagccaaccaagaggccagactccgagacaatgcctagttgttccacaagaaataaagtccaggatcacaggccacgggagagtaactttggcagctttgaccaaacaatgaagggcaacagctacctgccagagggatcattcttgcagaaacttttaagaaaagcttcagactcgaccgaggctgctctgaagcaggtgctgagcttcatcgagatggggaaaggggagaacctcagggtcttccactatgagaaccttaaacctgtagtggagcctaaccagatacagaccactatctcgccgctgaagatttgcttagccgccgaaaatatcgtcaacacagtgttgagcagctgcggtttcccctcccagcctcacacaaatgagaaccgggaaatcatgaaacctttcttcatcagcaagcagtcctccctcagcgaagtcagcggcggacagaaggacaatgagaagtccctgctcagaatgcaggacaagaaaatcaattacatcccggaagaggaaaatgagaatttggaagcatccagggaagactccagtttcttgcaaaaactgaaaaagaaagagtaccccaagatcgaaacagttaaggaagttgaagcatttacctttgccgatcacgaaatgggcagtaatgaggtgcatctgatcgcaaggcacgtgactaccagcgttgtcacatatctgaaaaacttcgagactactgtgttttctgaggagaaaatgagcgtgagcacttggtcccggaaaaagtacgaaagcaaacagtttcttcggaatatctacgacgacagctctatttatcagtgctgtgaacacctcacagagagcgtgctgtatcacctgacgagttccatctccgacgggaccaaaaaaggtcgggagaaggaaaaggcttgggagatccaagaggccacgttttccaagattatctctatccattcacaggttttcgaatcacgttcaatctctattggcgagctggccctatgcatcagtgaaattattattaaaattctcttcaacaacaagatcatccaagcggacattgcccagaaaatggttgctattcccacaaaatacacctactgtccaggcatcgtatcgggcggttttgatgatctctttcaagatcttctggtaggggtgattcatgtgctttcaaaggagatcgaggtggattatcatttcgaatccaatgtgagaaacaaatcattcagcatgcatcgtaacaattccgtgccgctgtgtaacaaaattaaccggcaggcctccccaagggactggcagtttagcacccagcagatcggccagttgtttcagaaaaacaaactttcctaccttgcgtgcaagctgaacagcttggtgggcaacttgaaaacatccgaatcaaaggaggtcgtgaacaaagttttcaacatagtaagcgatttattctcaccagacgagtgtctggacacggggatggacagtggcaaaatccagaggacatacttctactcatctaataacgaacaacccaattccattctcacaaataatctgcagctgtccagcaagagcgtgttcctgcttaacgtagtatgcgaaaaactaattaggatcttactggaagagtgtacctcaaccgcctttcctgacaaggggtcagttagtgaggaaacctccgccgaagagtgccagctgctgaagatgctgcaatcggtggaggacggaaagtccgactatcgaaagggggggatggattgcgagtgcttacaggttgattatatgtctgatttgcttgagaatgtggcggaaatagaccaggatttgctgacatccgacagtatgctgaccatcatctctcattccctggttaaatcacttatggataagctctctcacagcatccaacaggccccggagtctttgcccttcgcaaacaaacatctgaactaccgaactcgcgaaatccagtcttcctttattaaagctcgtaagtccgagctcattgagctgggccaaagcaagtcctcacttgaactcagaagctatgacagcaactccctgaccgtgtccctcaacaatcccagcgtcgtgtcatcgaagatccaggccccctttaacaagcattgcgccgtgaaatcctcatcagtgagtccttttgaacgtcaaagaaccaaagaaatggataaggttgcaatccacaacaaactgcaccaggagggtatatatgcaggggtgtacagcgctacctttctcgaaggaataatcagcgagctgttcttcaacttgtctatgtcactgtggggcaaaaacaagaacatcactgttagctggctcaatgaaatgaatacattattcgtgaataacgtagtaaatgaatttaataacgcccaggtgacggtgttacgcaatgctgaagagagactgtgcttcccacccgtccacactgaaacagtgtctaagatcgtggattccgtgtactacgacgtcttgcagcagtacgagctcaaggttgcctgcgggaataaccccgtttatgacaacgcgagtatcgccgagcagatcacaaacggcatcctgctcgaaatactggactataaactacccagctgctttaaggaacatcttatcccacattcttattatcctctcaagcccgaaatcatccttcaaaagctgcaatcgaaccttaccgaattcaccagtcttccacggagcagctctgattactctaccatgctcagccattcatttttggaagatgtgattagaagacttctgagtcaattaatacccccacctattacttgttcctctttaggcaaaaaatacctgatgtcatccgatttcaacgaaatgtccacatgcatcattaataaggttatgtccgcgataagtaagcacaaaatctggtttacaatctacgacaatcaatatttgtacacgggcaaaaatttacaaaaaatggtggattctgtgtattgtaacattctgcagatgagcgactccctcgtttctattcagaagtcaattgtctcccgcagtcccattatgattgatcagatcgcgtccttcattattcaggaaatcatcgaaaaccacttgcaacccttcctcagcggggaggtcctgtgtcatccccgcaccccactggatcctgtttcaacaatcgtgacccaggtcctgagcgaagtcatcgagtcccacagacctcaaaagcagtccccactcgatattcacctggactcatttgtcagagagatcgttgctcggttgctgtcgaaaatcttcagccctaagcacaacactgagattgagcttaaaaacatgacccaacgcatagtgaatagcataaaccgacactttaataaagccaaaatccacatattatacgatgataaagagcaggctttcttcagctttaataccgatatcgttgacgaactggcaaccagcgtttaccgtaacgctctcaaacaacacggacttgatcttgcggtagacaaggaaagcgaagacagtggcatttttgtggagaacattactaacctcattgtcgcagccatttcggactacctgcttcatcctctttttagcggagacttctcggcctctacatacagtaattcagtggccgagaatatagtccaggatatcctctcaaatatctccaaatcaacggagccatctcaatccgtccccctgtataatacccttctgccatataccttcctggaggatatgatcagagtcctactgagtaaactgttcagctctgcatcctcacttgtcttgaacagagacacccagaaagacatctctagggtgaatttcaacgacattgcaagcaatctggtgtctgatattaggatgaaggtgtcccagcacgagatcagattttccaaggaggaagaagaaacgaagttcatatattccgaggatgacatacagcatctcgtagactctgtgttcgccaatgtagtacagaccagcggaagtcaggagtctgccgtccagaacatcacgagctctaatgacatcctgatcgatagaattgccggtttcatcatcaagcatatttgtcagaaacacctccagccttttgttagcggcaaatccctttcctctagtgacacctattttgacgacgaacgtcggcaacttttctacacttctgtctattcttccacattcttggaagatgtgataagcggagtgctgcgcaaaatctttcatagagtagtgggaatcgtgcaaacaaagtcaattagggactcagaagacgagctgtttgaaaaggcagaagagctcatacatctgatcactggggagttctctaaagcgcaggtgagcattattgacaatacagaagaaagattgtgcctacccccggttgaacgcgatgtagtcaagaccatcgtggacatggtgtattcaaaggttttgcaagaatatgaaatggaggtggtgcccaataaggacttcctgaacgatactaagacattggctgccaggattaccaatattattctcgctgagattttcgactttcaaatccaccctgatttgattgcaaacctgcctttcaagtcccatagtaagctctcagccaatgtccttatccagcgggttcagtatgatatctctaaatctagatttcagagacaggcctccaccatgtacaccactatgctctcccacagtcatctggaaaagatcgtaactcagttaacttcccagatctcaccactgaacactagtgccgagcagtccgacacgacaaaatccgacctcagtaataccgttatcaaactcatcaacgaaatcatgtcaattatttctaagcacgagatttgtattataaaatacggcaataaaaagcagtctatgatctcagcaaaggatatacagtccatggtggattctatctatgcagacttgtcacattcaaatatctaccagagtattacaaaagataagaagtccattagtgatatcccagtcagtaaaattgccagctttattatcaaagagatttttaaccatcatatccagagcttcctctctgaagacaagaccctcctgctggctgctgtcgatcagacatataaactgaaagccatagaccctaaacagcgagaactgagcttcatcgtaaattctagtgtgtttctggaggaggtgatttctgagttgctgtgcaaaattctgtatgcctttagccacaacatgctggtcacagagaaccctgatcgcgttaaacttaaacttacccggattgttacaaccttggtgaatagtattgtcctcgaatttacgacatctgagatcctggtggccgacaacttcgacaaaaatctgtgttttagtgaaagatacaaagaaatggttcaaaaaatcgttaactccgtgtacggtaaagtcctggaccaatacaagagccttatccagatccaccgcgtcatacagtcagatacaatctgtttcggtcgaaagatctactatctgttacttgaggagatatacgattaccaggtacagtcactcgtgagtggggaactggagtcaagttcctacagttacccacaagctgataacattatccgcaacgtgctgaatatcattacaaaagactcgcacgctttgcccccttacatcactgtgttgccgcattcacttttggaggacatggtctaccgcttgttggggcatgtattcccaagtacccacacagaaaatgagctcaaagaaaaaaaattcccacctgatgatgagtttgttgaagcggcgtcaaagctgaccgatgagattataaaggaaatcagtgaacacgaaatcaggctcagtatggcagaggataacgctgaaagcatgcaactggaacctatcgagaacctcgttgattccatctgcaacaacattctcaagacaagcgaatttcaggccgaagtgcagaaggatgctgataaaaaggggtgttccttcttgtccaagctggccggattcattatgaaagaaatcatgtaccaccatctccaaccctttcttcatggcgaggagtctagcttctccgacctctctgattatgatcatgtgtcagaactggctaagtccgggaaggagaaaacacagccgagcttgtacagtgctactttcttagaggatataattatagacttggtgcataaattctgcagcctgttgattattactgaggactccaagaaaaacgagatggcggagttagacatcatggggctggcactgaagctagccaacagcctaattcgcgagttcaagaagagcgatataaaggtcttgccgaacgcagagaagatgttctcattcccgcctattgataaggagaccgtcgacaaaatttctaactttgtttatgaacagtttatagaaaaatgcactagccacgatatacagaaaggcgatgagtccaacatcgcaattggcatgatcgcggccctgactcaaaaagccatctccgctttccggatccaacctctgttttcgggggattggagcagcaccttcttctcctttcttaaccctgacaacattacgcagcgggttcaacatttgccacagaatactttcactcagatctcccgctgtgccaaggaaaatcaactgagcctgccagaccaaagctataaggacacgtcatccacacccgattgtaagaacatgatgagcaccctggagatcaaccgaggcacgatgaaccgcaaaaaaagtttcaaaacaaaggatacttctgtcaaaaagggagacatccagaaccccgttctgtctagcattaacgccataatgaagagtgggatgattaatctcaccagcggcttggcgactggggttaccaacaagaaggaggtcgatgagaataaggttggcatttgcacacaaaaacactcagagaacgtgtccaaggtgacatccactacaacagtaaagtccaaggacacacaggaaccaaacctctctgagaccttcaataacaatgagatagagaagaagcgtaacctgattcccactgacaaaaaaggcaaggacgacgaaatatacacgcacttctcactcataatagacgacaccgaatatgaaaaggaggtgctcggctctgacagtgaaataggctacaaaaaaaagatcgacaacgcccgtgagtccagcttcaaaaaagatgataaactgttccagctttctagtctcaaatctaagaggaaccttggcaccactaccgatactctggaaatccgcataaggacatcgtctaatgaggggcgacgtgattctccaacccaaacctgcagagatgaggaacaccactcagattacgaacacgtccagaacgtcatcgaaaatatctttgaggacgtgcttgaactgagctcaagccctgaacctgcatactattcgaaactcagctacgaccaatcccccccaggagataatgtactaaatgtgatccaagagatctcgcgggacagcgcccagtccgtgacaactaagaaagtgtcttcctctaccaataagaacataagcgcaaaggagaaagaagaggaagagcgagagaaagaaaaggtccgcgaagagatcaaatctgaacctagcaagcctgacgacccacaaaaccagagggaatccaaaccaggaattttcccagccaaattcttggaagatgtcattacagaaatggtcaagcagcttattttttcctccattcctgagactcagatccaggaccggtgtcagaacgtctccgataaacagaaccaggccaaactgtatgacaccgcaatgaaactcatcaactccttgctgaaggagtttagtgatgctcagatcaaggtattccggccagataaggggaaccaattccccggcggaaaggtgtcgagcgtgcctaaggttccaccgcggtacaaagagcccacaaccgatgaagccccctctagtatcaaaatcaaaagcgccgataaaatgccacccatgcacaaaatgatgcgaaagccttccagcgataaaattcctagcatcgataagaccctggtgaataaggtagtgcacagttcagtttgtaatatcctgaatgattacggcagccaggatagtatctggaagaatattaattctaatggggagaacctcgcccggcggctgacttctgccgtgattaacgagatctttcaacggcaggttaacctgatcttttgcgatgaagttagcgtgagtgcatgccttcctctggagtccaaggacgttgttaagaaagtgcaaaagctagcgcaaactgcctctaaagagtgccagacatccagcccctacacaatcattttgccgcataaatttctggaaaatgtgatttccgctctgttctccaagatttttagtacgattagcagcactaaaactaaggagcccgaagataatctgagcactgaacttaactttctacaaatgaaattagtttccgcggtcgctactgagattagtcaagacaaatatatgaccatccagtacgtggagacactccagtctgatgacgatgagattattcagctggtggttcaatccgtctacaacaacttgcttccccagtttggcagccaggagattatccagaattgtgttaccagcgggtgtaagatcctgagtgaaaacattgtggatttggtattacgagaggtcgcttccaatcagttgcagtcttacttctgtggtgaactgacccctcaccagtgtgtcgaagttgagaacatagttgaaaagattctcaaagatgtctttcaaaccaccgacgtgcctctcccaaaacccagccacgctgacaagctctcttacaatatcattgaggagatcgcagtgaagtttctctctaaacttctgtccatctttcctaaggtgcataaagaaaggactaagagcctggaaacagatatgcaaaagataacatcaaaagttttgaactccgtgcaggagttcattagcaagagtaagattaaactagtgccacctacaaaagagagccccacggtccctgtagccgacaacgcaacaattgagaatattgtgaactccatttatacaagtgtgctgaagcacagtgggagttatacgtcagtttttaaggatctcatggggaagtccaatgtgctttctgatacgatcggatttctcatggtgaatgcaatctcaaattctgaatttcagccacaggtcgaggaggaggtgtctaactccgagctggtccttgaggcagtgaagatcatggagaaggtaattaaaataatagatgagctgaaaagcaaggagaaatcatccagtcgaaaggggcttacccttgacgctaagcttctcgaagaggttctggccctctttctagctaaattaatccgactaccgtcttctagcagcaaagatgagaagaacctaagtaaaaccgagcttaacaaaatcgcgagccagctgagcaagctcgtcacagctgaaatttcccgaagtagcattagcctcatcgcttcggatcctgaggaacattgcctcaatccagagaatacggaacgcatttaccaggttgtcgactcagtgtactcgaacatactccaacaatcgggtaccaataaggagttctattatgacattaaggataccaatactgcttttcccaagaaggtcgcgagcctgattatagacggtgtctcatcctttcccctagacacaatcaactccacaatttctaatgctgatctgtcgggagaactggacgtcaatagaattgtacagaaggcacaggagcatgccttcaatgtgatccctgagcttgagcaggaaaagctcgaccagaatttgtcagaggaggagagccccatcaagatcgtcccccatgtgggcaagaaaccggtcaagatcgaccccaagatcatttccgagcatctggccgttattagcattaaaactcagcccctcgagaagctgaagcaggagtgtttgaaaagaacagggcattccatcgccgaactgcgtcgcgcgtctatctctggacggaattattccctgggctctcccgatctggaaaagagaaagacagaaaggagaacgtcacttgataagaccgggcgcctggacgtgaaaccgctggaagcagtcgcccgcaacagctttcagaatatacggaagcctgatattacaaaagtcgagctcctgaaagacgtgcaaagtaaaaacgacttaattgtcagacttgtggcacacgatattgaccaggtctatctggaaaattacataaaggaggagcgagacagtgacgaggatgaggtggtcctgacacagacattcgctaaagaggagggaatcaaggtatttgaagaccaggttaaagaggtgaagaagccgatacagtcgaagctgtcaccgaagagtaccttgtccacgagtagtctcaagaagttcctcagcctttcaaagtgctgccagacaactgctagtgccaacattgaatcaacggaagccatttccaaccaggttatagaaagcaaagaaacacacgtaaaacgcgcggtggcggaactcgacatggccacgccaaagactatgccggagacagccagttcctcctgggaagagaagccacaatgcaaaaaggaggaaaagaaccttgtgaccgagccaactcactacttcatccatcgaattatgtcttctagctcttataaccaagaggacctcattagtagcactggggaagccgaagactgtcacagtgacccttctgcaaaaatcttggaggaaagttcacaggaacagaaacccgagcacggtaactccgtgaaattcatcacgatattcgagcgctcaaaagacgtgctcgggagtgccaatcccagcaaggaagtgatctccgaaacacctaaaccggacgtcagcaagcagggaagcaagatgttaaccaagatgtcatctacactgagcaaggtgttctcccagtgtaatacaaatatcagcagatcatctagtcccgcccaccaagacgaacactag

SEQ ID NO: 26368 - DNA, 20724 bp, Artificial Sequence
  Description of Artificial Sequence: Synthetic coding sequence
atggaattgtacttaggggcctgtagtaagcctgccaaagtggccgttaccaagacagttgcctccgtcctcgctgcagacacacaacagtgccgcgacggggtgcacaagactcatttcgcgggggtaggacccgcccagctgttggacctgccactgggcgttaagctacccgtaatccccggcagcaacgctgtcttctacactaccaatttcggtgaaaagctgttcagaccaagttatggtttcaacctgacagacccttactgccgcctgcttgagaaccaatacaaaagcctccatgacccccacctaaaggcatactacaagcgcaaggatattttaaagcgattgaaaaaaggggggtacattacatctaacaataaggtggtctgcacactgcgcgagctgaacaagtaccggcagtatctcaccagcctcaagctagacttcgaacgtaactatattaaggaacagcggatcctggccaaacaattgcataatataccagaaaacaaccagattcctcagcactgcgacgtggctcaagtgcagaactggttactgaaagaaggaacggagtccatcaaagatcaggaacgcttgatgcggcacagatatttagatatgatctcacggaagctcgaacagctggagcggactgctgaagagcaacggctgttcttgatggacagggaggagaggcggcagagggaacatactcgtcgcaagcttaccctccgtcgcaagattgaagaggaatggaaaacaaaagaaatgctgctcttaacaaggatggcggaggatgtgaaacgggaagaaagaattgaggaacagcagcataggaaccgcgaagagagcgatcgtaaaaaacaggacctcctggaaaagaagatggcttaccatctccagaaaatgcaggacacagggtttaacggagaggatatcggcaagaacaccttcaagtaccggggtcaggacgggacacacgcctcccccaagaataagaaaaaaacctctgaagatatcatgttagtctaccctgctggggatcagaacacctataaggagactcacgggcatactgcaaacgcagctcatcagagacagaactcatctaataacttcacaaaaaaaaactctgcctccgttgtgtaccaggccgacgtccaggataatggaatcaatcaaaagagggatggcatggtgagtaagaattcctccatctttgacgataggggaggtattaatataagtgggcagggatctattatctccgcccaagtgagccctacacgcaacttttcacgagtatctcaagcttttctggatccaagcaaagaggagaaagagacaaacgccgattgggacgggagacctaccaaacggtcaagctacttatgtgagtctgggcctcaagcccacgctaccgatcccggtatcttctcaagccctgtgtacaccaatatgcagcaaaatctactgcagaattgcctccaggagaaggtcacatcagaagagttaaacatcataattcagaacgtgatgacttgggtggtggccactgtgacatccatcctttatccagcaattacgaaatacgaaaaacggctgcagaacaacacctatccggtgtcagacgatagtatactaagcagtgatagctcatccttctgttccacatgctctgaagacttcacctacaggagttacaccagtgccaccaccaagactttccaggcagagccatgtgctttcgtcgtggatacttcagtacgccgaccaaccacccctatcaagccacccccagcacatgtcgagaagacagtggtgggtaagacctgccacattaaggggcagagcatcatcagcaaacacaaatacaataaaaccaacttgctctatagttaccctaagttaaggagctgcaaatctgatagccacctcctggcttctttcgagactggaacgaagaagagtaaggacgcaactaccgagaccgactcccttggcagctcactccattgtgataagaccgccaaagcgatggacgaaatgaagaacctgaaaaatgtgtttgtgaacttcaaatgctacctgaagggggaaacggaagtaattctcgagagcatccttagggagataatgagcgacctaactcaggcgataccttctctcagttccgtcacagccgaggtgttcgtggagcaatgcgaacgcgaaaaggagatcctcctaagcaatgcacatataccttccgtggcttccgaaatcgtggagaacatgctcgagaaattggaatctgcagtggagaaaaagtgtgtggagatgttctcgcaagatcttagtgtggatattaagccaagcctggccgcttcagatgagttactgacctcatccaacggcaagccacttaaaaactccatgccgcatactctcgacccaatgtgtgacattgccgaggacatggtccacgcgattctagaaaagctgatgaccctggtctctttcaagcagaatgagttcctacacctgaaagacaccaataagctgtcttgccaacagcacaagacagatcccatttgcatgtttcttcagcgcgcggggaaaaataagagcagcctggagtccgatgaggccagcctgattgtaaatgaggaagtacagaacctcatatctaacattttctcacagagctccctcgttgcatacatagaggaagcgattaacgcaatcctcggctacattcagaccgaattaaacaacgagaggatcatcgcaagtgaagagaccgtggtactgctgcagctcctcgaggatattctgttccagttgcatcaggagccagttaatgagtcctttcagaaaagccgacagccacgcatttcttctccaagcgataccaaggagaagtatcgccttaccggaacgcggctgagtaattcccccagaagcggtcgccctttcccccccattaacgttccagggatggtactctacagcgatgatgagaatgaggaaatcgacaatattgtcaaaaacgttctggactcaactttcaaagacgagaaggtgaagtcccaggagcaaatacccaaccactggtttactaaagggaatacatgctttgagtgtaaaagaaatattaagccgccgacaaagcctggctccagatctaaagcagccttccacgattgggaactcaaaactgagccaccctcaacaaaccatgaggacattctcaaaaagaagctgtcctctaacaaggacatttcaaccttttctcaggatcagaaacatcagatagaaaaagcttccgaaaatatcgtaaccagtattttgaaggagatgctcaaagacatcagttccgtacccttcggacacctggattctaaaactgggagtgaggcaagcgttctggtcagcgaaaaaccacaggggctgagccatcaggaatggattgaccagatgttcagtgtgagcgaaattagtacagtagcccaggagatcaccgactccgtgcttaacatcctgcacaaagcgtccaattacatcagtaacacaacgaaaagcagcatttcgagttcggtgcaccagattagcctacataatagcgacactgagcacatcgtgaaggaggctcccaataaatatccccttaaaacatggtttgactctgagaagaaaatgaaatatctcagtctgtttgatgtggatcctgagaagcctccctggttaaagtccggcaagtccgagcccaagccggtcgacgatatcaatgataaaatcattaggacaatatttaagcgcctgaagtcgttcatctgccccaaattacatatgggtttcaaatctagtctgcgttcccagctgtccaaatataccgccaaaattgtgaatattgtgctgtgcgctatacaaaacgagctggagctccacaaggaaaatctaaatctcagggagattgaccatacaaagagcctcaccgacaagggttttttcgcaaacacagacaaaaaactggaatcactcgtcactagcatcgacgatgacattctggcatcccccctacttacatgcatctacgatatgctcctgtcatcagaaaatgctcaccagaggagcatttctctctccagtagaaagcccaaaagtgccactgactctgtggacgtgcagagtatcctgcctaataggcaggataaaaaaagctttcataagtacttagcaaccccctgtactcaccatagtgttaatggaggaaatcatatcaaagaaaatgctaaactgcaagtactagaaaggattggtgagaccctgcacgaaatgttaagcaagctgttaggcacacacttgcactcacagctatcttgctcacagcagtctcgcgaaatgaccaataagaaccagaaaatggcagctgctctgcaaagtaacatccagttaatttcaaaggctatcctagattacattctggcgaagctctgtggagtggatatggacacttcgttcgcctcttgtggcctgaaggccatcagtgagtccttggacattgacaaccctagctttgcaagcatcatagagaagatggccaaaagcacaaagataatctcaagcatagtgtctcgcagggtgcaggaagacaacaaagaggaaacgaaaagcaaagcaaaaccagttgctccggtgtcttccaaaaccccatctacgaaagaaatgcatcccaataagctgaaagcggtcgcgagcgatatattgaatatggtttttgccaaattggaaggtttcgccaacggacacctagaaatcctcggagccattaatgacggtaataaaaaatcaaacaaaattggctgggaatatgagagcaccaacatcagtagggatactcacgaggcaagcttcctttctgctctgtatatgcatgccaaaaaagtatctagcgctatactgaaggtgattcagactgagttaaatgtcacatcttctgacctgaaaacaagcgtagaaaatcctccacctgaaacccagatcttaaagtatgtcgtgaagcttattttggacgctgtgtccagcgatatgttcaatgagatggagtccgaaggcggaggcatcgaaacctaccggtatcggcccacatacggatcccttcccgggggcgcagaatcggatagttttctagaagatgacgcttacacagccaaaaaaattattgatgagcggagccctcagagagaagaagtcaaaacccgcagcttaaagcagtgggccttagaaaagactctgaacaagattgaggtcaaattgaaggaaccacacatcagtccaattgctcctatcatccgtaatatcctcaatgagatcttccagtccacactgataaaccagctcaacgtactgagtctatcacattctaacttcaatggaatgccgcataacgtagatgagcctacgccacagacctcagtccagttcatggataagatgatggacccactcctatcagaagcagatatcacaatagttactgacaatattgtgcggacggtcttccataaactatactcagccgccatgacagagagaaacgtgcgggagaatcggtataaaaccattactttctctgccaatgtgagcagtcacgagcatacttataaaggtaagtccagtgtcaccgcattagacgagaatccctgtaccttccagtctcggttcagcgtcgctgataaggaaacgaaggtgaatctcgctgaagatatcgttcaggctattttgacaaacttggagaccttcgctacaagcaaagtcaagtccctgttttactcccaggtcaacttcacagtccctgtagctctacccattcaacaggaccattctacactctccaaggccctgtccgctaaggatagttacagtgatgagcagttctcctgttgcagcgtggaccataccaaatccgggaagaccaacctgtgccagttgtcgttgtctaaattaaacacttatgcgctgcaagttgccaggcgcaacttacagggcattaagcaggagctggacaaagagagggaaaaccccttcttgacacacgacattgggatttccgaatctattgctagccagattgtgaacgcacttctggatatcatcagcagaaaaggtaagtgtgacaagaactcgagtgataaagaaattgacttggaccagcagaagggtgtgatagaaaagttgctcaacgagacaaagtatagaaaggtcctgcagctgcagattcaggacaccatcgaaggaattttatgtgacatatacgaaaagacactgtttcagaacaatctcagcttcgccacacccactcttaaatgcagcatcgcagataaacactccgaggagaattcagagatgtttatggagggggcaaacaagatcataccaaaactctcggttcccaaatcggacgtgatattgatatcaaacgatatagtgaacattgtgctccataacctctccagtgctgccacactagtgattaatgcaaagaaccccacatctgcgaggctgcccctgacattctgcgatacattccccaaaatcgattgccagcaacctctcaagggatcgaagacggaaaggaaaaccgaaaggttttcatatagccgcaaccagaaatccgcgtacgccgacgataaccagatcactgtggtggagaaagaagatactcaaaaatcagcaacagactcatgtgaggagaacgccaactttataaccaagacaatctttaagaggctggaatcctttgccacagagcgtattgattcccttatcactctggccttccaaagcaaagaaaagagcttcgtgatccctgagttagaaaactgcaaacaaaatgatagcatcttttacgattcctcccaggttgagtcagatgttaatgtcctcaaaatctcagccactgagaccattctcagccaagagttgacggatttcaccttcgtgggcagaagagagaagttgggatcaaccatccacctctcccaggcaagactgaaaacttacgccgacgttatcgctagtgccatcctgaaacttattaagaacgacttggacctggagatccagaaaatttacccttatcaaaacaacatcctgttccaagaaaatatcatcgtgagcgagattgtggacagcatgctgaagatgctggatgacaaacggtcagtcaaagagatctgcttcaactccaaggagaatagcaactttagccagctcgcacttagtaatgaaattctgctgggccataaggagaaagaaaggtctacaaagcaatcacttttcaccaagtaccctctcgaacagaaccagatgatacttgagaacaagagacagataattgtgctggaggagattttcatgcggaatggagaaagcaagaacaaggaaaaaggcgaactcctgattgccgtggaagagctgttaaacaagctttatcaaagggttcgggaggttacaggacatttaccccccctaaacgaaacggcgaatttcatctcaaactccaagatcaagacatctgacactacacagaaaaattctttccaatctcacataaattctgtggcaaatgacattgtcgaatccgtcctggggaagatgtatctggtcgtggtgacatccctgtacgagaataacaaaagtagaactgaggtggagatttccgaccacaatgactcactattaatgaaaccccttagattcagagaaacaaaacaagcgggtaagatatcaaactctccacgatatgcaatttcccaggcttactcatacgtggactctcaaaatatctccgtgatggaaaacacactgctgccatatctgccccttcaagtgaagaaggatctgatccagatggtgctgaataaaatcacgaacttcgtgtccttaccactgaaggtgagccctaaagacaaccctaaaccttgttttaaagcgcatcttaaaactagaagcaagattactaccctccctaaatttaccaagaaaacccatctgggcctctccgccgcaaaggccaagagcaaaactaagcttggcccaggagagaagactttgaaggactccaggtctaaaactgccatcgggctgtcacatataatgagtgcaggcgatgccaagaacctcttagataccaaactgcctaccagcgagctaaaaatctatgctaaagatatcattatcaacattctggagactattgtaaaggagttcggaaaggtgaaacagaccaaggctctcccttcggaccagattattgccgctggaaagatcgtgaacacagtactacaggaactgtacgtcaccaacaactgcaacttggcctaccccatgaaatcttcgcatctccggctgagccaaggtaacatcggcacaggcagccttcctaaacagcaggcctgcttctatttagaaaatgtgagttcccagttagaacacatctttccccgggagggaatttttaagaagctatttgataaatggcagaccgagagtaacgacaaggagaacgagaaatgcaagcttttgatgattgcagaaaatgttctgaccgaaatatccatcaaggcaaaggaactggagtacagcctgtcactcttgaacctgccgccgctcgaaaactgtgagtccagattctacaatcatttcaagggggcaagcactcgagctgaagatacaaaggctcaaattaacatgttcgggcgagaaatcgtggagatgctgctggagaagctgcagctgtgctttctcagtcagatacctacccctgactcggaggagaccctcagtaactccaaggagcatatcacagcaaagagcaagtacggcttccccaataaacatagtcttagctcactacccatttataatactaagactaaagatcaaatctccgtcggttcttctaaccagatcgtgcaggaaattgtagagacagttctcaatatgctggagagttttgtggatctgcagttcaaacatatttctaaatatgagtttagcgaaattgttaagatgcctatcgaaaacttgtcctctatccagcagaaactgctgaacaaaaagatgctgccaaagcttcaacccttgaaaatgttcagtgataaaagcgagtctaataccattaacttcaaagagaatatccagaatattcttctgagggtccatagttttcatagtcagttactcacatatgccgttaatatcatctcagatatgttggcagtcatcaagaataagcttgacaatgaaatatctcaaatggagccaagtagcattagcattctgaaggagaacatagtagctagcgagataatcgggactctgatggatcagtgtacctattttaatgagtctctgatacagaatctgagtcgcgagagtctttttcagggagccgaaaacgcgtacacagtcaaccaagtggaacttgccaccaacatgaaaatgtttacctccaagctgaaggaagggtcactgggaatcaacccgtcccaagtgtcaaagaccgggtttgtcttctgcagcgatgaggacatgaaagagaagtatcgcgtctcttcagacctccctacaagtgtgcggtcgtccgtagaagacacggtcaaaaatagcgaaccaactaaacgaccggacagcgaaacaatgcctagttgttccacgagaaataaggtccaagatcacagaccacgggagtctaatttcggcagtttcgatcagacgatgaagggaaatagttaccttccagaaggtagctttctccaaaagctgctgcggaaagcaagtgactctacagaggccgctcttaagcaggtcctatccttcattgagatggggaagggcgaaaacctgagggtgtttcactacgagaacctcaagccggtcgtcgaacctaaccaaattcagactacaatctccccgctgaagatctgtctggcagccgagaacattgtaaatacggttctctcgtcttgtggcttcccctcccagcctcacacaaatgaaaatagggagataatgaagccgttttttatctccaagcagagctcactaagtgaagtctccggagggcaaaaggataacgagaaatccttacttcggatgcaggacaaaaaaataaattacattcccgaggaagagaacgaaaacctggaggcctcacgggaagatagctctttccttcaaaaactcaagaaaaaagaatatccgaagattgagacagttaaggaagtcgaagcttttaccttcgccgatcacgaaatgggttcgaacgaagtccaccttattgcaagacacgtcaccacaagcgtggtcacatacttgaagaacttcgagactacggtgttctcagaagagaagatgtcagtcagcacctggagccgaaagaagtacgagagcaagcaatttctccgaaacatttacgatgactcctccatctaccaatgctgtgaacatctaaccgaatctgtcctgtaccaccttaccagctctataagtgatggcaccaagaaggggcgtgaaaaagagaaggcatgggagattcaggaggctaccttctcaaaaatcatcagtatccattcccaagtcttcgaatctcggagcatctctatcggcgaattggcactctgtatctccgagatcatcattaagatcctcttcaataataaaatcattcaagcagatatcgcgcagaaaatggtggccatacctaccaaatacacatactgtcccgggatagtgtccggcgggttcgacgatctcttccaagatctgctggtcggcgtcatccatgtcctcagcaaggaaatcgaggtggattaccatttcgaatctaacgtacggaataaaagctttagcatgcaccgcaacaatagcgtgcctctgtgtaataagattaatagacaggcctctcccagagattggcagttttcaactcaacaaatcggacagctgttccaaaaaaataagctctcctacttagcctgcaagctgaattctttggtagggaacctgaaaacctctgagtccaaggaagtggttaataaagtgtttaatattgtctccgatcttttctcacccgatgagtgtctggacacaggcatggactcgggaaagatccagcggacgtacttttattcttctaacaacgaacagcccaattctattctaactaacaatctccagttgtcttcaaaatctgtgttcctccttaacgtggtgtgtgagaaattgatccgcatactactcgaagagtgcacgagtactgccttcccagataaggggtccgtgtccgaagaaacatccgcagaggaatgccagctgctaaaaatgctgcagtccgtcgaagatggaaagagcgattacaggaagggcggtatggattgtgagtgcctccaggtagattacatgagcgacctgctcgaaaatgtcgccgagattgatcaggacctgttgacaagtgactccatgctgacaatcatcagtcactctctcgtgaagagcctgatggacaaactgtcccattctatccagcaggcacctgagagtcttccatttgcgaataagcacctgaactatagaacgagggaaatccaatcaagcttcattaaagcaagaaaaagcgagctgattgagctgggtcaatctaagtcttcgctggagctgagatcatatgattctaattccctgactgtatctctcaataatccttccgtggtgagctccaagatacaagcacctttcaataaacattgtgctgtcaagtcctccagcgtctcccctttcgagcggcagcgcactaaggaaatggacaaagtggccatccataataaactgcaccaagagggaatctacgcgggcgtctattcggcgacttttctcgagggaattattagtgaactgtttttcaacctgagcatgtctctgtggggcaagaataagaacattacggtgagttggctcaacgagatgaacaccctgttcgtaaacaacgttgtgaacgagtttaacaacgcgcaggtaacggtgctgaggaatgcagaggagcggttgtgcttccctccagtccacactgagactgttagtaagattgtggactcggtgtactatgacgtcttgcagcagtacgagctgaaagtagcctgtggcaacaatcctgtgtacgataatgcctctatcgcagaacagatcactaacggtatattgctggaaatcctcgattacaaacttccatcctgcttcaaagaacatcttataccccatagttactatcctttgaagccggagatcatcctgcagaaactgcagagcaacctcactgagttcactagcctcccacggagcagctcagactactccactatgcttagccacagtttcttggaggatgtcatccgtcgcctgctgagccagttgatccctccacccattacgtgcagttctctcgggaagaagtatttgatgtcctccgactttaacgaaatgagtacttgcatcatcaacaaggtgatgtcagctataagtaaacataaaatttggttcacaatctacgacaatcagtatctgtatacgggaaagaatctgcagaaaatggttgattcggtgtattgcaacattctacaaatgagcgactccctcgtatctatccagaaatctattgtgtccagaagtcccatcatgattgaccagatcgcgtccttcatcatccaagaaataattgaaaatcatctgcagcccttcctatccggagaagtgttatgccacccacggacacctctggatcccgtgtctaccatcgtcacccaagtgctgtccgaggtcatagagtctcatcgaccccagaagcagagtcccctcgacattcacttggacagtttcgtcagggagatcgtggctcgtctgctgtctaagattttttcccctaaacataataccgagatagaactgaagaacatgacccagcgcatcgtgaactctatcaaccggcactttaataaggccaaaattcatattctctacgatgacaaggagcaggcctttttcagttttaatacagacatagtggatgaactagccacatctgtgtatagaaacgcactcaaacagcacggtttggacctggccgtcgataaagagtccgaggactctggaatctttgtggagaacatcactaatcttatcgtggccgccattagtgactatctattacatccccttttctcgggagatttctccgccagtacatactccaattctgttgccgaaaacatagttcaggacatacttagcaatatttctaaatccactgagccgtcacagtcggtgcccctgtacaacacactactgccctacacctttctggaggacatgatccgggtcctgttatccaagctgtttagctccgctagcagccttgtgctcaatcgggacacacagaaggatatctcccgggtgaacttcaatgatatcgcctctaatctcgtgtcggacatcagaatgaaagtgagccagcatgaaattcggttttctaaggaggaagaagaaacgaaatttatatacagcgaggatgatatccagcacctagtagactccgtatttgccaatgttgtccagacatccggttcgcaggaatcggccgtgcagaatatcacctcctcaaacgacatactcatagacaggattgctgggtttataatcaagcacatttgtcaaaagcatttgcagcctttcgtgagcgggaagtctttatctagctcagacacgtattttgacgatgagcggcgacagctgttttatacctcggtgtactcctccacatttttggaggatgtgatctccggcgttcttcgtaaaatctttcatcgggttgttggcatcgtgcaaacaaagtcaatcagagatagtgaggatgagctttttgaaaaggcagaggaattaattcacttgattactggagagttctcaaaggcccaagtgtccatcatcgacaatactgaggagagactatgccttccccccgtggaacgagatgtcgttaaaaccatcgttgacatggtgtacagtaaggttctgcaagagtatgagatggaagtcgtgccaaacaaagacttcctgaatgacaccaagacattagccgcgaggattaccaacattatcctggccgagatatttgatttccagattcatcctgacctcatcgccaacctaccatttaaatcacatagcaagctgtcagccaatgtgttaatacaacgcgtgcagtacgacatcagcaaaagcagatttcaacgccaggcttccactatgtatacaaccatgctctctcacagccacctagagaagatcgtgacccagttaacctcccagatctccccgctgaatacatcagccgaacagtcggacacaactaaatcagatctgtcaaacactgtgattaagctgatcaatgaaatcatgtcaatcatttcaaaacacgaaatttgcataattaagtacggaaataagaaacagagcatgatttcagcaaaggacattcagagtatggtggatagtatctacgctgatctcagccactcaaacatttaccagtctatcactaaggacaaaaagtcaatctcagacatccccgtcagtaagatcgcctcctttatcattaaggaaattttcaaccatcacatacagagctttctgagcgaagataaaactctacttctggctgcagtcgatcagacatataagttaaaggctattgatccgaagcagagggaattatcctttatcgttaacagctctgtgtttctggaagaagtgattagcgaattgctctgcaaaatcctgtacgccttcagtcataatatgttagtgacagaaaacccggatagagtgaagctgaaattaacccgtatcgtgactacactcgtcaacagcattgtgctcgagtttactacaagtgagatcctagttgcagacaacttcgataaaaatctgtgcttcagcgagcgctacaaagagatggttcaaaagatagtaaattccgtgtacggaaaggtgctcgaccagtacaagtcccttattcagattcaccgggtgattcaaagcgacacgatctgtttcggacggaaaatctactacctgctgctcgaagaaatctatgactaccaagttcagtctttggtcagtggcgaactggaatcgagctcttactcgtacccccaggccgataatatcatacgtaatgtgctcaatattatcacaaaggactctcatgctttacccccatacatcaccgtgttaccgcatagcttgttggaagacatggtttatcgactcttggggcacgttttcccttcaactcacaccgagaatgaactcaaggagaagaagttcccaccagacgacgagttcgtcgaggccgcctccaaactgactgacgaaataatcaaggagatctcggagcatgagatacgactctcaatggctgaagacaatgcagaatctatgcagctcgagcctattgaaaatctggtcgactctatttgcaataatattctgaaaacctctgagttccaggcagaggtccaaaaagatgctgataaaaagggctgtagctttctgagcaagctggcagggtttattatgaaggagattatgtatcaccatttgcagccatttcttcacggagaggaatccagcttcagtgacctctccgactacgaccatgtctcggaactggcaaagtccggaaaagagaagacgcagccttcgctgtattctgcgacgttcctggaagacatcatcattgatctggtacacaagttttgcagcttgctgataatcaccgaagacagtaagaagaacgaaatggccgaacttgatattatggggctcgctttgaaacttgccaactcgctgattcgggagttcaaaaagtccgacatcaaggtgctcccaaatgctgagaagatgtttagctttccacctatagacaaggagacggtggataaaatcagcaactttgtctacgagcagttcattgagaagtgtacgtctcatgacatacagaaaggagacgagtccaatattgctatcggaatgattgctgctctcactcagaaggccatcagcgctttccggatacagcccctattctccggagattggtctagcacgttcttcagtttcttaaatccggataacattacccaaagagtgcaacatctgcctcagaatacatttacccagattagcagatgcgcgaaggaaaatcaactgtctttaccagaccagagctacaaagacaccagcagtactcccgattgcaaaaatatgatgagtacactggagattaaccgaggaactatgaatcgtaagaagtcttttaaaacgaaggacacaagcgttaaaaagggcgatatccagaatcccgtattatccagcatcaacgcaatcatgaagagcgggatgatcaacttgacatctggacttgcgactggtgtgacaaataagaaagaagtggacgagaacaaggttgggatttgcacgcaaaagcattcagaaaacgtctctaaagtgacctccaccaccactgtgaagagcaaagatactcaggaacccaatcttagtgaaacttttaataataatgagatagagaagaaaaggaatctcattccgactgacaagaaaggaaaagacgacgagatatatacacacttctccctgatcatcgacgacacagagtatgagaaagaagtgctaggctccgatagtgagatcgggtacaaaaaaaaaatagacaacgcacgggaatcctcatttaagaaggacgacaagctgtttcagctgagcagcctgaaaagcaaacgtaatctgggaaccacaaccgacacactggagatccggattagaacaagctcaaatgaaggcagacgggatagcccaacgcagacgtgcagggatgaagagcaccactcagactatgagcacgtgcagaacgtcattgagaacatctttgaggatgtcctggaactctcctccagtcccgagccagcatactactctaaactctcatatgatcaatctccacccggcgataatgtgctgaacgttatccaagagattagtagagacagtgcacagtccgttacaacaaaaaaagtaagctcatccacaaataaaaacattagcgccaaagaaaaggaagaagaggagcgcgagaaagagaaagtgagggaagaaattaaatctgagccatctaagccggatgatcctcagaaccagcgcgaatccaaaccaggaatcttcccagctaaattccttgaagacgtgattacagaaatggtgaagcagctgatcttctccagtattcctgagacacaaatccaggaccggtgccaaaatgtcagcgacaaacaaaatcaggcaaagctctacgacaccgctatgaagctgatcaactctcttttaaaagaatttagcgatgcccaaataaaggtgttcaggccagataaaggcaatcaattccctggagggaaggtgtcttctgtgcctaaagtgccccctaggtacaaagagcccactacagacgaggctcccagctccatcaagataaaaagtgcagacaagatgccaccgatgcacaaaatgatgagaaaaccctccagcgacaaaatcccttccatagataaaacgttggtgaacaaggtggtgcactcatcggtgtgtaacattctaaatgattacggaagccaggatagcatttggaaaaatattaattctaatggggaaaacctagcccgcaggttgaccagtgcggtcatcaacgagattttccagcggcaggtgaacctgatcttttgtgacgaggtttcagtgtctgcctgcctgcccctagagagtaaggacgtggttaagaaggttcagaagctggcgcagacagccagcaaagaatgccagacctcctcaccctatacaatcatactccctcacaaattcttggagaacgtcatcagtgccctgttttccaaaatattttctacaatcagctccacaaagacaaaggaaccagaggacaacctctctaccgagctgaatttcctccagatgaaattggtctccgcagtagccacagaaatcagccaggacaaatacatgaccatccagtacgtggaaaccctgcaaagtgacgacgacgagatcattcagctcgtagtgcagtccgtgtacaataatctgctgcctcagttcgggtcacaggaaatcatccagaactgtgtgactagtggttgcaagatcctgtctgagaacatcgtggatctggttctccgggaggtggcttcaaatcagttgcaatcatatttctgcggcgagctgaccccccatcagtgcgttgaggtggagaatattgtagaaaaaattcttaaggacgtgtttcaaacaacagatgtccccctcccaaagccttctcacgccgacaagcttagctataacatcatcgaagaaatcgcagttaaattcctcagtaaactgctaagcatctttccaaaggtccacaaagagcgcacgaaatcacttgaaacagacatgcagaaaattacctctaaagtactgaatagcgtccaggagttcataagtaaaagtaagattaagctggtgccccccaccaaggaatcacccaccgtgccggtggctgacaacgctaccatcgaaaacatcgtgaattcaatctacactagtgtgttaaagcacagtggatcctatacgtccgtcttcaaggatctgatggggaagagcaacgtgctgagtgacaccatcggcttcctgatggtgaacgctatctcaaattctgaatttcagccccaagtggaagaggaggtgtctaattccgagcttgtattggaggccgttaaaataatggagaaagtcatcaagattatagacgagctgaaaagcaaagaaaaatcaagcagtcgcaagggcctcactctggacgcaaaactgctggaggaagtgctggctctgttcttagccaagctcatccgccttccgtccagctctagcaaggacgaaaaaaatttatcaaagacagaactgaacaaaatcgccagccagttgtccaaactcgttactgcagaaatttctagaagctctatttcccttatagcaagcgatccagaagaacactgtctgaacccagagaatacagagcgcatttatcaggttgtggactctgtatactcaaacatcttacagcagtcaggcaccaacaaagagttctactacgatatcaaagacacaaatacagcctttcccaagaaggtcgctagcctgatcattgacggggtgtcttcctttcccttggacacgataaattcaactatatcgaatgcagacctaagtggggagctcgatgtgaatagaattgtgcagaaagcccaagagcacgcgttcaatgtcattcctgagctggagcaggagaaactcgaccagaacctcagtgaggaggagtctcctattaaaatcgtgccacacgtgggtaagaagcctgtgaagatagatccgaaaatcatctcagagcacctcgcggttattagcataaaaacccaaccactcgaaaagttaaaacaggagtgcttgaaacgcactggccacagcatcgcagagctgaggcgcgcttcaatctcagggcgtaattatagcctggggagtcccgaccttgagaaaaggaagaccgaacggcgcacatccttagataaaactggacgtctggatgtgaaaccgctggaagccgtggccaggaatagttttcagaatatccgcaagccagacatcacgaaggtggagcttctgaaagacgtgcaaagcaagaacgacctaattgtgaggttggtggcccacgacatagaccaggtgtaccttgagaattacatcaaagaggagcgggacagcgatgaggatgaggtggtgctgacacagacctttgcgaaagaagagggaatcaaagtatttgaggatcaggtgaaggaagtgaaaaagccaatacagtcaaaactgtcacccaagtccacgttaagcactagctctctaaaaaagttcctgagtctgtcaaaatgctgtcagacaacagcttcggctaacatcgaaagtactgaagctatcagcaaccaggttatagaatcaaaagaaacacatgttaagagggccgttgccgaattggacatggcgacccccaagaccatgccagagaccgctagctcatcatgggaagagaagccacagtgtaagaaggaagagaaaaatttggtcacggaaccgacccattactttattcacagaatcatgtcctcttccagctacaaccaggaagacctgatttcctccacgggcgaagccgaggactgtcattctgacccctccgctaagattcttgaggagagcagccaggaacagaagcccgaacatggaaattcagttaaattcatcactatcttcgagagatctaaagatgtgttgggaagtgcgaacccctcgaaggaggtgatttcggaaacacccaagcctgacgtcagcaagcaagggtctaagatgctgacaaagatgtcgtccacactgagtaaggtgtttagccagtgcaatacgaacatcagtaggtccagctcccccgcccaccaggacgaacattag

SEQ ID NO: 26369 - DNA, 411 bp, Artificial Sequence
  Description of Artificial Sequence: Synthetic coding sequence
aaagatcaagagaggctgatgcggcatcgctatcttgacatgattagccgcaaactggaacagctggaaaggacagccgaggagcagcggctcttcctcatggatagggaggaaagacgacagcgggagcatacgcgtaggaagttgaccctgagaagaaaaatcgaagaagagtggaaaactaaagagatgctccttttaacccgcatggcagaggatgttaaaagggaggaacgaattgaggagcagcagcatcgtaaccgggaggaaagcgatcgcaagaagcaagacctgctcgaaaaaaagatggcatatcatttgcagaaaatgcaggatacagggtttaatggcgaagacatcggcaagaatacctttaaatatcggggccaggatggcactcatggggaatag

SEQ ID NO: 26370 - DNA, 393 bp, Artificial Sequence
  Description of Artificial Sequence: Synthetic coding sequence
atgaggcacaggtatttggatatgatctctaggaaacttgagcagctggagcgtacagctgaggagcaacgcctgtttcttatggaccgcgaagagcggagacaacgggagcacacccgaagaaagcttacacttaggaggaaaatagaagaggagtggaagaccaaagagatgctcttactaactcgcatggctgaagacgtcaagcgtgaagagaggatcgaggaacagcaacataggaacagagaagaatccgatcggaagaaacaggaccttctcgagaaaaaaatggcctaccacctccagaaaatgcaggataccggattcaatggcgaggatatcgggaaaaacacgtttaagtataggggccaggacggtacacatggcgaatag

SEQ ID NO: 26371 - DNA, 1377 bp, Artificial Sequence
  Description of Artificial Sequence: Synthetic coding sequence
atgatgctgatccccatggcgtctgtgatggcagttacagagcccaagtgggtgtcagtgtggagccgcttcctctgggtgactctgctgagtatggtcctgggcagcctactggccctgttactgcccctcggagctgttgaggagcaatgtctggctgtcctgaagggactctatctgctccggtccaaaccagaccgtgcccaacacgcggctactaagtgtacttccccttctacagaattgtccatcacttctagaggagcgacactgctagtggcaaagaccaaggcgtccccagcaggtaagctggaggcacgggcagctttgaatcaggccctggagatgaagcgccaggggaagcgggagaaggcacagaaactattcatgcatgcacttaagatggacccagatttcgtggacgccctcacagaatttggtatattctccgaggaggacaaggacattatccaggccgattacttgtacacgagggcactgaccatttcgccttaccacgagaaagctctggtgaacagagaccgaacactgcccctcgtagaggaaattgaccagaggtacttttcaataattgatagcaaagttaagaaggtgatgtcaattcccaagggtaattccgcccttcgacgtgtgatggaggaaacatactatcaccatatctaccacacagtggcaattgaagggaatacccttacactcagcgagattcggcatattttggagactaggtacgcagtgcctggcaaaagccttgaagagcagaatgaggtgataggcatgcacgccgcaatgaagtacataaacacgacattggtttctcgcattggcagcgtcactataagtgacgtcctcgagatccataggcgcgtgttgggttacgtggatcccgtcgaggctgggaggttccgtactacgcaggtgttggtgggacatcacattccacctcacccacaggatgttgagaagcaaatgcaagagtttgtgcagtggcttaattccgaggaggctatgaacctgcatccagtggaattcgctgctttagctcactataagctggtatatattcaccctttcatagacggaaatggaagaactagcaggctgctcatgaacctcattttgatgcaggctggctacccaccaattacaattcggaaggagcagcgtagcgattattatcatgttctggaggccgccaatgaaggcgatgtccggccgttcatcaggttcattgctaagtgcaccgaaacaactctagacaccttgctgtttgcgacgaccgaatattccgtcgctctgcccgaggcacaaccaaaccactccggtttcaaagagacattgcccgttaaaccttag

SEQ ID NO: 26372 - DNA, 831 bp, Artificial Sequence
  Description of Artificial Sequence: Synthetic coding sequence
atggcatccaagcccgagaagagggttgcctcaagtgtattcattactcttgcccccccacgccgcgacgtagcagtggcggaggaagtgcgccaggcagtctgtgaagctcggaggggccgcccctgggaggcacccgcgcctatgaaaacccctgaagcgggactcgcaggccgcccaagtccatggactacgccggggcgggccgccgcgacagtgccggctgcccccatgcagctgttcaatggagacatatgtgccttctgccacaagactgtatcaccccgggagctggcggtggaagctatgaagagacagtaccacgctcagtgttttacctgcagaacatgcaggagacaactcgctggccagtctttctaccagaaagatggtaggcccctctgtgaaccatgttaccaggataccctggaaagatgcggcaagtgtggcgaggtggtgagggatcacatcatcagggccttgggacaggcatttcaccctagctgtttcacctgcgtgacatgcgccaggtgcatcggagatgaatcgttcgccttaggtagtcagaatgaagtctactgcctggatgacttctacagaaaatttgcccctgtgtgttctatctgcgaaaatcctatcatccctagggacgggaaggacgcgtttaagattgagtgcatgggccgcaactttcacgaaaactgttaccgctgcgaagactgcaggattctgctttctgtggagccaactgatcagggctgttatcccttgaataatcacctgttctgcaaaccatgtcacgtgaagcgctctgccgctggatgctgttag

SEQ ID NO: 26373 - DNA, 1122 bp, Artificial Sequence
  Description of Artificial Sequence: Synthetic coding sequence
atggccagtaagccagagaaacgagtcgccagcagcgtgtttattaccctggccccaccgaggagagacgtggctgtggcggaagaggtgaggcaagcagtatgcgaggcacgcagaggcagaccatgggaggcacccgcccccatgaaaactccagaggcgggcctggcgggccgcccttcgccatggacaacccccggaagagccgccgcaactgtaccagccgccccgatgcagttgtttaatggcgggtgtccgccccccccccccgtattagatggagaagacgtgcttccagatctggacctcctcccgccccctcccccccctccccccgtgctgctgccctccgaagaggaagcccccgcacccatgggcgcgagcctgatcgcagatctagagcagctccacttgtctccacctccccccccacctcaggcacctgctgaaggcccgtctgtgcagcccgggccgctgagaccaatggaggaggagctgccacccccaccggcagagcctgtcgagaagggcgcaagtactgatatatgcgctttctgtcataagaccgtgagtccacgagagttagccgtagaagcaatgaagcgacagtaccacgctcagtgttttacttgcagaacttgccgccgtcagctagctggtcagagcttctatcagaaagatgggcggccattgtgcgagccctgttaccaggacactctagagcggtgtggcaaatgtggcgaggtcgtgcgcgatcacatcataagagccctgggccaggctttccatccttcttgtttcacatgcgtcacatgcgcacggtgcatcggcgacgagagcttcgccctaggttcccaaaacgaagtctactgtttggatgacttctatcggaagttcgcgcccgtgtgtagtatatgcgagaaccctatcatccctcgcgatgggaaggatgccttcaagatcgaatgtatgggcagaaatttccacgagaactgctatcgctgtgaggattgccgcatcctgctgtctgtagaacccaccgatcagggctgttatccactgaataaccacctgttctgcaagccatgccacgttaagaggtcagctgccggctgctgctag

SEQ ID NO: 26374 - DNA, 1122 bp, Artificial Sequence
  Description of Artificial Sequence: Synthetic coding sequence
atggcttccaagcccgaaaaaagagtggccagttctgtatttatcacactggcgcccccacgcagggacgtggccgtggccgaggaggttagacaggccgtttgtgaggcgcgacggggccgcccctgggaggcccccgcacctatgaaaacaccggaagccggcctggccggacgaccctcaccgtggacgactcccggtcgagccgccgccacagttcctgctgccccaatgcaactctttaacgggggctgccccccacctcctcctgttctcgatggggaggatgtgctccctgatctggaccttctgcccccccctcctccgcctcccccagtgcttctcccctctgaggaagaggctccagccccaatgggggcctctttgattgcagatctcgagcagctacacctcagcccaccacctccccctccccaagctcccgccgaggggcctagcgtccagcccggtccactgagaccgatggaagaggagctgccgcctccccctgctgagccggtggaaaaaggcgcttccaccgatatttgcgccttttgccataagacagtgtcccccagggagctggccgtcgaagctatgaagcgacagtatcatgcacagtgttttacgtgccggacctgcagacgccaactggctggacaaagtttctaccaaaaagacggacgccccctctgcgaaccttgctatcaggatacactagaaaggtgtggtaaatgcggggaagtggtgcgggatcacattatccgagccctgggccaggcctttcacccttcttgcttcacctgtgtgacatgcgcaagatgtattggtgacgaaagcttcgctctgggctcccagaacgaagtttactgccttgatgacttctaccggaaatttgctcccgtgtgcagcatctgcgagaacccaataatccccagagacggcaaagacgcctttaaaattgagtgcatgggtcggaattttcatgagaattgctaccgttgtgaagactgccgcatcttgctgtctgtggaaccaactgatcaaggctgttaccccctgaataaccacctcttctgtaaaccatgccacgttaagaggagtgcagctggatgttgttag

SEQ ID NO: 26375 - DNA, 831 bp, Artificial Sequence
  Description of Artificial Sequence: Synthetic coding sequence
atggctagcaaacccgagaagagggtcgccagctctgtgttcatcaccctagcaccccccagacgggatgtagctgtagcggaggaggtgcgacaggccgtgtgtgaagctcgacgtgggcggccttgggaagctccagcccctatgaagactccagaggccgggctcgctgggagaccatctccctggaccacaccaggccgcgccgctgccacagttcctgccgcccctatgcagctcttcaacggcgacatctgcgctttctgccataagaccgtgtcccctcgagagctggctgtcgaagccatgaagcgccaatatcatgcccagtgctttacctgcagaacctgtcgaagacagctggccgggcagagtttttatcaaaaggacgggcggccactctgtgaaccatgctaccaggatacactcgaaaggtgtgggaaatgcggcgaagtcgtccgggaccatatcattcgcgcacttggccaagcatttcacccatcatgttttacatgcgtcacgtgtgctagatgtatcggcgacgaatcatttgccctgggctcccagaatgaggtgtactgtctagacgacttttatagaaagtttgcacctgtgtgctctatttgcgagaacccgattatcccaagagacggcaaagacgcttttaagatcgaatgtatgggcaggaacttccatgagaattgctaccgttgcgaggactgtcggatactgctgagtgtagaaccaaccgaccagggctgctaccctctaaacaatcatttattctgcaagccctgtcacgtgaagaggtccgccgctggatgttgttag

SEQ ID NO: 26376 - DNA, 54 bp, Artificial Sequence
  Description of Artificial Sequence: Synthetic coding sequence
atggcatccaaacccgaaaagcgcgttgcatcttcagtgtttattaccttgtag

SEQ ID NO: 26377 - DNA, 315 bp, Artificial Sequence
  Description of Artificial Sequence: Synthetic coding sequence
atggccagcaagcccgaaaagagggttgcctcgtctgtgttcattaccttggcccctccacgccgggatgtagcagttgccgaggaggtgcgacaggctgtctgtgaagctcggaggggtcggccctgggaggcacctgcccctatgaaaacaccagaggccggattagctggccgccccagcccatggaccacgccgggtagagcggcagctacggtaccagctgctcctatgcagctttttaatggaggctgccccccgcctccgcccgtgcttgatggggaggatgtgctgccagacctggatctgctgtag

SEQ ID NO: 26378 - DNA, 1125 bp, Artificial Sequence
  Description of Artificial Sequence: Synthetic coding sequence
atggcaagcaagcctgagaaacgggtggcttcctccgtatttataacattggcaccaccacgacgagacgtggcggtcgcggaagaggtccggcaggccgtgtgtgaggcccgcagggggaggccctgggaagcacctgcacccatgaaaaccccagaagcaggtttggccgggcggcccagtccatggacgactcccggccgcgccgcggctaccgtgcccgccgcaccgatgcagctgttcaacggaggctgtccccccccccctcccgtcctagacggagaggacgtgcttccggacctcgatcttttacctcccccccctccccccccacccgtgctcctgcccagcgaggaggaagcgcccgccccaatgggagcgagcttgatcgcagacctggagcaactgcatctgagccctcccccccctccacctcaggcccccgcggaaggtccatctgtgcagccagggcccctccgccctatggaagaggaactgccacccccaccagctgagcctgtagagaaaggcgcgtccactgacatttgtgccttctgccacaagacagttagtccccgcgagctcgccgtggaagccatgaagcggcagtatcacgcccaatgcttcacctgcagaacctgtagaagacaactggccggccagagcttctaccaaaaggacggaaggcccctgtgtgaaccatgttaccaggatacactggagcggtgcggaaaatgtggagaagtcgttagggatcatattattcgggcccttgggcaggcatttcacccaagttgttttacttgcgtcacctgtgcccgctgtatcggcgatgaaagctttgctctgggctctcagaacgaagtgtactgcctggacgatttttaccgctatgagaaaggactgtgcacaggttggggggccgggactgggcgtgatccatctcgcgtcaaggaactcagcctgtcccccggctgctgggctcgagtcagctgcctgctggtttactacaaggagtattatcgggcagggctcggagccgtagctcatgcctgtaacccaagtacactgggggggcgcggggggtggattacccggtccggtgatcgtgaccaccccggctag

SEQ ID NO: 26379 - DNA, 438 bp, Artificial Sequence
  Description of Artificial Sequence: Synthetic coding sequence
atggcctccaagcctgaaaaacgcgtagctagtagtgttttcattaccctggccccacctcggcgagacgtagctgtggccgaggaggttcggcaggccgtttgcgaagctaggagaggaagaccgtgggaggcacccgcccctatgaaaacgcccgaagcagggctggctgggcgaccctcgccgtggactacaccagggagggctgctgcaacggtccccgcggcacccatgcagctttttaacggtggctgtccccctccgcctccggttctggatggagaagacgttctgcccgacctcgatctgcttcctcctccaccgccccccccaccagtgctgcttccttccgaggaagaggccccagcaccaatgggggcaagcttaatcgccgatctcgagcaattgcacctatcacccccacccccccccccctag

SEQ ID NO: 26380 - DNA, 93 bp, Artificial Sequence
  Description of Artificial Sequence: Synthetic coding sequence
atggcttcaaagccggaaaagagagtggcttcatccgtattcatcactttagctcctcctcgccgggatgtggccgtggcagaggaggtttag

SEQ ID NO: 26381 - DNA, 96 bp, Artificial Sequence
  Description of Artificial Sequence: Synthetic coding sequence
atggcctcaaaacctgaaaagagggtggccagcagcgtctttattactctcgcgccgccccgccgcgacgttgctgtcgcagaggaagttcggtag

SEQ ID NO: 26382 - DNA, 435 bp, Artificial Sequence
  Description of Artificial Sequence: Synthetic coding sequence
atggcctccaaaccagagaaaagagttgccagctctgtgttcattacactggccccaccacgtcgcgacgtggcagtcgctgaagaggtgaggcaggcagtgtgtgaagctcggagaggccgcccctgggaagcaccggcccctatgaaaacccctgaagctggcctggccggcaggccaagtccttggaccacccctggacgggcggctgcaacagtgcctgccgctccaatgcagctgtttaatggagacatatgcgccttttgtcataaaactgtgtcgcctagagaactggcggtagaggccatgaagcgccagtatcacgcacagtgctttacttgtagaacctgtcggagacagttagcggggcagagcttctaccagaaagacgggcgccccctctgcgaaccttgttaccaggacactttggagtag

SEQ ID NO: 26383 - DNA, 105 bp, Artificial Sequence
  Description of Artificial Sequence: Synthetic coding sequence
atggcttcaaagcctgagaaaagagtagccagcagtgtgttcatcacactggctccgccaaggcgggatgtcgccgtagcggaggaagtcagacaggcggtgtag

SEQ ID NO: 26384 - DNA, 237 bp, Artificial Sequence
  Description of Artificial Sequence: Synthetic coding sequence
atggcttcgaagccggagaaacgggtggcatccagcgtgttcattacccttgctccaccccgcagagatgtcgccgtcgcggaagaagtgcgtcaagcagtgtgtgaggcccggcgcggccggccctgggaagccccggcccccatgaagacgccagaggccgggcttgccggtagaccctctccatggaccacaccaggccgagcagccgccaccgtacccgcagcccccatgtag

SEQ ID NO: 26385 - DNA, 45 bp, Artificial Sequence
  Description of Artificial Sequence: Synthetic coding sequence
atggctagtaaaccggagaaacgggtcgcgtcctcggtgttttag

SEQ ID NO: 26386 - DNA, 300 bp, Artificial Sequence
  Description of Artificial Sequence: Synthetic coding sequence
atgtgtgtgggtgaaaagaggagggcaataatccccagccatctggcttatggcaagaggggcttccctccctccgtccccgcggatgccgtcgtgcagtacgatgtcgaacttattgctctgattcgcgctaactactggctcaaactagttaaagggatcttgcccctggtggggatggcaatggttccagcccttctggggctgataggctaccatttatatcgcaaagcaaacaggccgaaagtatcgaaaaagaagcttaaggaagagaagcgcaacaagtcaaaaaagaagtag

SEQ ID NO: 26387 - DNA, 441 bp, Artificial Sequence
  Description of Artificial Sequence: Synthetic coding sequence
atgactttgcggccaagcctgctccccctgcacctgctattgctcctgctgctgagcgcggccgtctgcagagccgaggctggtctggagaccgagagcccagtgcgaactctccaagtcgagactttggttgagccaccagagccttgcgcagaacccgctgccttcggagataccctgcatatccactatacaggctctctggtggacggcagaatcattgatacatccctgacccgcgatcccttagtaatcgagctgggccagaagcaggtgattcccggactggaacagagcctgctggacatgtgtgtgggtgaaaagaggcgtgccattatcccatcacatctggcgtacggtaaacgtggtttcccgccttcagtgcccggaacaaaggataatctgatgcgcccaccaggaatgacctcctcctcccaatag

SEQ ID NO: 26388 - DNA, 606 bp, Artificial Sequence
  Description of Artificial Sequence: Synthetic coding sequence
atgaccctgagaccgagcctgcttccactgcatttgctgctgcttctgctgctgtctgcagccgtttgtagggccgaggccggcttggagaccgaaagcccagtgaggactctgcaggttgagacccttgtggagcctcctgaaccttgcgccgaacctgctgcttttggtgacacactgcacattcactacactggctctctggtggatggcagaatcatcgacacatctctgaccagagaccccctggtcattgaactgggccagaaacaggtgatccccggcctggagcaatcattgctcgacatgtgcgtcggcgagaagcggagagcaattattccatctcacctagcatacggcaagaggggctttcctccgagcgtccctgctgacgcagtggtccaatatgatgtggaactaatcgcactgatacgcgccaactattggctgaagcttgtcaaggggatcttgcctctggtgggcatggccatggttccagccttactggggctgatcgggtatcatctataccgcaaagccaacaggcctaaggtcagtaaaaagaagctgaaggaagagaaacgcaataaatcaaaaaagaaatag

SEQ ID NO: 26389 - DNA, 948 bp, Artificial Sequence
  Description of Artificial Sequence: Synthetic coding sequence
atgagggccggccagcaactggcatcaatgttacgttggactcgtgcctggcggttgccacgcgagggacttggtccacatggacctagcttcgcccgcgtgccagtcgccccatcaagttcttcagggggaagagggggagccgaaccaaggcctttgccgctttcctaccgcctactggatggggaggcagcccttcccgctgtcgtgttccttcacggactgtttgggagtaagacgaactttaacagcatcgctaagattctggcccaacaaacgggtaggcgcgtacttacagtggacgcccggaaccatggcgactccccccactctccagacatgtcatacgaaatcatgagccaggatcttcaggatcttctcccccagcttgggctcgtgccgtgcgtagtggtgggccactccatgggtggtaaaaccgctatgcttctggcgttgcagcgccccgaattggtggagcgtctcatcgccgtggacatttcccctgtagagtccaccggcgtgtctcattttgccacttacgttgctgcaatgcgggcaattaatatcgccgacgagctgccacgttcacgggcgaggaagctggctgatgagcagctgtcaagcgttatccaggacatggccgtccggcagcaccttctgacaaaccttgtggaggtggatgggaggttcgtgtggcgagtaaatttagatgctctcacacaacacctggacaagattttagcttttccacagcgacaagaaagctacttaggacctacgcttttcctgttgggcggtaactcccagtttgttcatcccagtcatcatccagagatcatgagacttttccctagagctcagatgcagactgtaccaaacgctggacattggatacatgccgatcgtccccaagacttcatcgccgccatcagggggttcctggtgtag

SEQ ID NO: 26390 - DNA, 1713 bp, Artificial Sequence
  Description of Artificial Sequence: Synthetic coding sequence
atggcgtttcgggggtggagacccccacctcccccactcttgttgctgctgctctgggtcactggacaagccgcccccgtcgccggtctggggtcagatgctgaacttcagattgaaagaaggttcgtgcccgacgaatgccctaggacggtgcgcagtggcgactttgtccgttaccactatgtggggaccttccctgatggccaaaagttcgactcatcctacgacagagactctactttcaacgtctttgtgggaaagggtcagttgattaccgggatggatcaggcactggtggggatgtgtgtgaacgaaagaaggttcgtgaaaattccccctaaactggcttatgggaacgaaggagtttctggagtcattcccccaaactctgtgctccattttgacgttctgttgatggacatctggaactccgaggaccaggtacagatacatacttatttcaagcccccaagttgccctagaacaattcaggtttctgactttgtgaggtaccattacaatggtaccttcctcgacggcactcttttcgactcttcccacaacagaatgaaaacttacgacacatacgtaggcataggttggctgatcccaggcatggataagggtttattgggcatgtgcgtcggagaaaagcgtatcatcaccatccctccctttctggcctatggagaggatggagatgggaaagacattccaggtcaggcaagcctggtatttgacgtggccttgcttgacctgcacaatcccaaggactccataagcatcgagaataaggtcgtgccagaaaactgtgagcggatttctcaatccggggattttttgcgctatcactacaatggaaccctcctggacggcaccctgtttgattctagttacagcagaaatagaacattcgacacctatattgggcagggatatgttattccgggtatggacgaaggccttttgggagtttgcatcggtgagaagcgccgcattgtcgtgcctccacatctgggctatggcgaagaggggagaggaaacatacccggttccgccgtgctcgtgttcgacattcatgtgatcgattttcacaaccccagcgactcaatttcgattacatcacattacaagcccccagactgtagcgtgctatccaaaaaaggggactacttgaaataccactataatgcctcactgctcgatgggacgctgctggactcaacatggaatcttggcaagacttacaatattgtgctcggttcgggtcaggttgtgctaggcatggacatgggactccgggagatgtgtgttggcgagaaacgtacggtgatcataccccctcatttggggtacggcgaggcgggtgtggacggggaggtgcccgggagtgcagttcttgtattcgacatagagcttttagagctggttgccgggctgcccgagggatatatgttcatctggaacggcgaggtgagccccaacttgttcgaggaaattgacaaagacggcaacggggaggtgctgttggaagagttctccgagtacatccatgcacaagtggcatcaggcaaaggcaaactggcccccggtttcgacgccgagctaattgtgaagaacatgttcactaatcaagaccgtaacggagatggcaaggttacggcagaggaatttaaactgaaagatcaagaggcaaagcacgatgagttgtag

SEQ ID NO: 26391 - DNA, 1017 bp, Artificial Sequence
  Description of Artificial Sequence: Synthetic coding sequence
atggccggaaaagatattcctgggcaggcttcactagtatttgatgtggccctcttagatctgcataatcctaaagattctatttcgatcgagaacaaagttgtccctgagaattgtgagagaatttcacagagtggcgacttcctgcggtaccattacaatgggacgctgttggacggtactctgttcgatagctcctactctagaaaccgaacattcgatacctatataggtcagggatatgtcattccagggatggacgaaggcctgctgggcgtttgcattggggaaaagcgacgcattgttgttcccccgcatctgggctacggggaagagggacgggggaatatccctggttcagcagtcttagtgtttgatatccatgtcatagacttccataatccaagtgattcaatatctatcacctctcactataaaccgcccgactgttccgttctgagcaagaagggtgattaccttaaataccattataacgcgtctctcctggacggaacactactcgacagtacttggaatctgggcaaaacttataatatcgttctagggtctggccaagttgtcctagggatggacatgggtttgcgggaaatgtgtgttggcgagaagagaacagtgatcatcccgcctcatctggggtacggtgaggcaggagtcgacggggaggttccaggatctgctgtgctggtgttcgacattgagctgctggagcttgtggctggcctgcctgaaggttatatgttcatatggaatggagaggtgtcaccaaacctgtttgaggagattgacaaggacggcaatggggaagtgctgctcgaggaattttcggagtacatccatgcccaggtggcttccggcaagggcaagctcgcacccgggttcgacgcagaactgatcgtgaagaatatgttcactaatcaggaccgaaatggtgatggcaaggtgaccgccgaggagttcaagctgaaagaccaggaggctaaacacgacgaactttag

SEQ ID NO: 26392 - DNA, 1872 bp, Artificial Sequence
  Description of Artificial Sequence: Synthetic coding sequence
atggccttccgtggttggcggccccctcctcctcccctacttctcctccttctctgggttacgggccaggccgcgcctgttgccgggctgggctctgacgctgagcttcagatagaacggagattcgttccggatgagtgcccccgaactgtgagaagcggcgattttgtccgatatcactacgtcggcacctttcctgacgggcagaaattcgattctaggtattgggatacagctgaggacaaagccgacaagagtccatgcccccaggtacgcgttggggtcaatacaagtccttcatgtcgcctgaaacagaaaggcgttgggatatattggaaggacctacagtttttggtgagagtgcagaatcacgggttgtcttacgatagagatagcacattcaacgtgttcgtgggaaaaggtcaactaattacaggcatggatcaagcgcttgtgggaatgtgtgtgaatgaacgccgcttcgtcaaaattccgcccaagctcgcgtatggaaacgaaggggttagcggggttataccccccaatagtgtgctccatttcgatgtgctcctgatggatatatggaatagcgaagatcaggtgcaaatccacacttatttcaaaccccctagctgcccacggactatccaagtctccgacttcgtcaggtatcattataatggcacttttctagacgggaccttattcgatagttcacacaatcggatgaagacatacgatacatatgtcgggatcggttggttaattcccgggatggataaaggattgctgggaatgtgcgtgggcgaaaaacgcattattacgattccgcctttcctcgcctatggtgaagatggcgacggcaaggacattcctggacaggcttctctcgtttttgatgtagcactgctcgacctgcacaatcctaaggactctataagcatagaaaataaggtggttccagagaactgcgagagaatttctcaatctggtgactttctccggtaccactataatggcacgctgctcgacgggactcttttcgattcatcgtattcacgaaaccgcacctttgacacctacatcggccagggctatgtgatcccaggtatggatgagggattgctgggcgtttgtattggagagaagcgccggatcgtagtgccacctcacctcggatacggagaagaaggacgcggaaacatccccggatccgccgtcctagtgttcgacattcatgttatagatttccacaaccccagtgactctatctctattacgagccattataagccgccagactgtagcgtcttgtccaagaagggagactatcttaaataccactacaacgcctctctgcttgacggcactctgcttgacagcacctggaacctggggaaaacatataacatcgtcttggggtcagggcaggtagttctggggatggacatggggctcagagagatgtgcgtgggggagaaaaggactgttatcattcccccacacctgggttatggagaggccggtgtcgacggggaggtaccaggaagcgctgtgctggtcttcgatatagagctcctggaactggtcgcagggctgcctgaaggatatatgtttatctggaatggagaagtctccccaaacctttttgaggagatcgacaaagacggcaatggcgaggtgttgctcgaagaattctctgaatatatccacgcccaggtggcctcagggaaaggaaagctggcacctggcttcgacgccgagcttatcgtgaagaacatgttcaccaaccaggacaggaatggcgacggcaaggtgaccgccgaggaatttaagctgaaggaccaagaggctaagcacgacgagctatag

SEQ ID NO: 26393 - DNA, 1299 bp, Artificial Sequence
  Description of Artificial Sequence: Synthetic coding sequence
atggatatctggaactcagaagatcaggtgcagatccatacatacttcaaacccccgagctgtccccgaactattcaggtcagcgatttcgtcagataccattataacggcacgttcctggacggcaccctctttgatagcagtcacaatagaatgaaaacctatgacacttacgtcgggatcgggtggctgatccctggcatggacaagggcttgctcggaatgtgtgtcggggaaaaacggataattacaatcccaccatttttagcttatggggaggatggcgacggaaaagatatcccaggccaggcctcgctcgtgtttgatgttgccctgctggatctgcataatcctaaggattccatttccattgagaataaagttgttccagagaactgtgagcgcatcagccagtctggggacttcctgaggtatcactacaacggcactctcttggacggaaccctctttgattctagttattctcgcaacagaacttttgatacctacatcggccagggttatgtgattccgggcatggatgaggggctgctgggggtgtgtatcggtgagaagcgaaggattgtggtaccgccacatctgggatatggtgaagagggccggggaaacatacccggctccgcggtgttggtgttcgatatccatgtcattgattttcacaacccatctgattccatatccattacgagccactacaagccgcctgactgctccgtgctctcgaaaaagggcgattacctgaaatatcattacaacgccagcctgttggatggtaccttgctggatagtacgtggaatctcgggaagacatacaatatagtgttagggagcggccaggtcgttctcggtatggacatgggactcagggaaatgtgcgttggcgaaaaacggacagtcatcatccccccacatctggggtatggagaagcaggagtcgatggggaagttcccggatctgccgttctcgtgttcgacatagagttgttggaactagtggccggtctccccgagggttacatgtttatctggaacggcgaggtctctccaaatctgtttgaggagatagacaaggatggcaatggcgaagtgctcctggaagaattcagcgaatacatccatgcccaggtggcttcaggtaaaggcaaactggcacccggctttgatgccgagctgattgtcaagaatatgttcaccaaccaggaccggaacggcgatggaaaggtgacggccgaggagttcaagctaaaagaccaagaagcgaaacatgatgagctatag

SEQ ID NO: 26394 - DNA, 1989 bp, Artificial Sequence
  Description of Artificial Sequence: Synthetic coding sequence
atggaagggacgcattgcacactgcagctgcataaacctattacggaactgtgctatatctcattctgtctgcctaaaggtgaggtgcgtggcttctcctacaaaggaacagtcactctggacaggagcaacaaagggttccacaactgttatcaagtgagggaggaaagcgacattattagcctgtcccaggagccagacgaacatcctggagacattttcttcaagcagactccaacaaaagatatccttacagagctgtataagctgaccaccgagcgggaacggctgctgactaatctgttatcctcagaccatatcctggggattacaatgggcaaccaagaagggaagctacaggagctcagcgtgagtctggcccctgaagatgattgcttccagagtgctggggattggcaaggagagctgcctgtggggcctctcaataagagatcaacccatgggaataagaaacccaggagatcaagcggacggcgtgaaagctttggggcccttccccaaaagcgcaccaagcggaagggaaggggcggcagagagtccgctcccttaatgggaaaggacaagatctgtagtagtcactctctcccactgagcaggactcggcctaacttgtgggtccttgaagaaaagggcaatctgttgccgaatggggccctcgcgtgctcactgcaaagaagagagagctgtccaccggacattccaaagactcctgacacggatctgggtttcgggtcgttcgaaacagcttttaaggataccggtcttggtcgtgaagtgcttcccccggactgttcatctacagaggcaggaggggacggaattcgccggccgccaagcggactagagcatcagcagacgggcctttcagaatcacatcaggaccctgaaaaacacccagaagccgagaaggatgagatggagaagcccgccaagcggacttgtaagcagaaacccgtgagtaaagtggtggccaaggtgcaggacctgagctcgcaggtgcagagggtcgtcaaaacccacagtaaaggaaaggagacaatagccatacggccagctgctcacgccgagtttgttcccaaggccgatttgctgaccttgcctggcgccgaagccggggctcatgggagtaggcggcagggcaaagagcggcaaggggatcgctcgagtcagagtccagctggggaaaccgcctctatatcatccgtgagcgctagtgctgaaggagccgtgaataaagtcccattaaaagtcatagagtccgagaaactcgacgaagccccagaggggaaaagactggggttcccagtgcataccagcgtcccacatacccgaccggagacccgcaacaagcgccgcgccgggctcccattgggcgggcacaaatctctgttcttggacctccctcacaaggtcgggcctgactcctcccagcccaggggcgacaaaaagaaacctagcccccccgcaccagccgccctcggaaaggtattcaacaatagcgcctcacaatcctcgacgcataagcagacatccccagttccaagccctctctcgcctaggcttccaagcccccagcaacaccaccgtattctccgacttcccgccttgccgggcgaacgggaagccgccctgaatgacagcccctgccgcaagagccgcgtgttcagtggctgcgtctccgctgacaccttggagccccctagcagcgctaaggtgactgagacgaagggggccagccctgctttcttacgggctgggcagccgagactcgttcccggggagacgctggagaagagcctggggcctgggaaaaccactgccgagccccagcatcaatcccccccggcctttcattgggatcttcagcagcacttccaagaaccagttattaggacagtcagtattagctgtgcttccaatctgatcaaagaagaggctggcaagggaaaggaaagcagaagcggatag

SEQ ID NO: 26395 - DNA, 3591 bp, Artificial Sequence
  Description of Artificial Sequence: Synthetic coding sequence
atggagaacgtggataatagccttgacggaagcgacgtttcagagccagcgaaacctgaagctggactggaggtggcgcagtcgatactgtcaaagttcagtatgaagtctttgtttggattcacttccaaattggagtcagtgaatcctgaggaggaagacgctgtcttgaaagcattccactccctggacgtcaatcccacatcccagcaagacgactcttccaatggcctggacccacaggaggcaggaagccgggttagcccagacctgggtaacgacgaaaagatcgctagcgtcgagaccgagtccgaagggtcgcagaggaaagaggcaggtaccagccttctcgctcaagaactgctgcccttaagtactttgaaaggtactaaagatgacgtcatctgtgtgaggggaaccctggtccataccacaagcgattcagacagcgatgacggaggccaggagcctgaggaaggcagcagcactaacggacccaagtctcctagtggggtgctatccgaaccatcgcaggagtcaaaagagaatcctggggggttccgcgagaacactgtcaccggtgagatgaacggggcagaattatgcgcggaggatccccagaggatacctccagagatgtcctccaagctggaggctggcaacggggggcttcagaccgaaaggcggccaagccaagatcaggtcggggaagagggttctcaggatctgccagcagtgacaaatcagaactctagcgtcggcatcactgaatctgcaagctctaaaaaagaagtttcaggcgagaaaagctttcagcttcccgcctttttctctggactaagggtgctaaaaaaaggcgccacagctgaagggggagagaccatcaccgagataaaacccaaggacggggatctagcacttctaaaacttacacagccagtgcagaagtccctggtacaagcaggcctacagactgtgaaaagcgaaaagaaggccaccgacccaaaagccaccccaacgctgctcgaacagctttccttattgctcaatattgacatgccaaaaacagaacctaaaggagcggatccggaaagccccaggcgcgaggagatgggatgtaatgcagatcaagaatctcagtccgggccaggggtaccgcagacacagggaggcgaagtcaagcccaagtctcccgagacagccttagaggctttcaaggcgctctttatccgaccccctcgcaagggcaccactgctgataccagtgaacttgaagcgctgaaaagaaagatgcgacacgaaaaggaatccctccgggccgtgtttgaaaggagtaattctaaacctgcagacggcccatccgatagtaagagtcccgatcacagcctgacagaacaggacgaccgaactcccggacggctgcaagcagtatggcctccgcccaagaccaaagacactgaagaaaaagtcggtctgaaatatacggaggccgagtaccaggccgcaattctgcacctcaaacgagaacataaggaggagattgaaaacctgcaggcccagttcgagctgagagcatttcacattcgcggcgaacacgccatgataaccgcccgcctagaagaaactatcgagaatctcaaacacgaattggagcatcgatggcgtggcggctgtgaagagagaaaggacgtttgtatttcaacggacgatgactgccctccaaaaactttcagaaacgtatgcgttcagaccgatcgcgagaccttcttgaagccttgtgagagcgagtcaaaaactacacggagcaaccagctagttccaaagaaactcaacatatcgtcactgtctcaactcagcccgcctaacgaccacaaggatatccacgcggccttacagccaatggaggggatggcatcaaaccaacagaaagcattacccccacctccggcatccatacccccacctcccccactgccaagcggcttgggtagcctatcccccgcgccccctatgccgcccgtatctgccggtccacctctccccccacccccaccaccaccaccacctctgcccccgcccagttccgctggtcctccaccccctccccctccacctcccctgccaaacagtcctgctccccctaatccgggcggcccaccccccgcccctcctcctccaggtctggcccctccacctccacccggactgttcttcggccttggttcatcttcatcacaatgcccccgaaagccagcaatagagccgagctgcccgatgaagcctctgtactggacacggatacagatctcagacagaagtcagaacgccacacctaccctatgggattccctcgaagagcccgatatcagggacccatctgagtttgagtatctgttctccaaagacactacacagcagaagaagaagccgctaagcgaaacatacgagaaaaaaaacaaagttaagaagattatcaagctattagacggcaagcggagtcagacagtggggatcttgattagcagccttcaccttgaaatgaaagatatacagcaggcaatcttcaacgtggatgacagcgtggtggacctcgaaacactggcggccctctatgagaatagagctcaggaagacgaactggtgaaaatcagaaagtattatgaaaccagcaaggaggaagaattaaagctccttgacaaacctgagcagttcctgcatgaactagcacagattcctaactttgcggaaagggcccaatgcatcatatttcgatcagtcttcagcgagggaatcacatccctacacagaaaggtggagatcatcacccgagcgagtaaggaccttcttcacgttaagtcagtaaaggacatacttgctctgatattggcattcgggaactacatgaatggaggtaataggacaagaggccaggccgatggctacagtcttgagatcctcccgaaattaaaggatgtgaaaagccgggataacggaattaatttggtagactatgtcgtaaagtactatctccggtactatgaccaggaggcagggaccgagaagagcgtgtttccactgccagagccacaggatttcttcctcgcttcacaggtgaagttcgaggacttgataaaggacctccggaagctcaagagacagctggaggcatcagagaaacagatggtggtggtgtgcaaggagtcccccaaggagtacctccagccttttaaggacaagctcgaggaatttttccagaaagcgaaaaaagaacacaaaatggaggaaagccacctcgagaatgcacagaagtccttcgaaaccaccgttcggtatttcgggatgaaacccaagtccggagagaaggaaattacgccaagctatgttttcatggtgtggtacgaattttgttctgactttaagaccatctggaagcgtgaatccaaaaatataagcaaagagcgactcaagatggcccaagagtccgtctcgaaactaacctctgagaaaaaggtggaaacaaagaagatcaacccaacagcgagcctgaaggagagactgaggcagaaggaggcctccgtgacgaccaactag

SEQ ID NO: 26396 - DNA, 1512 bp, Artificial Sequence
  Description of Artificial Sequence: Synthetic coding sequence
atggaaaacgtcgataactcgctggacggttccgatgtgtcagaaccagcaaagcccgaagccgggcttgaggtggcacaaagcattttaagtaagttttctatgaagagtctgttcggttttaccagcaagctggaatcagtgaaccccgaggaagaagatgcagtgttgaaggccttccacagcctggatgtgaatcctacatcacagcaggacgacagcagcaacggtctggaccctcaggaagccggctctagagtcagtcctgatctcggcaacgatgagaaaatcgcatccgtcgaaactgagtctgagggctcacagaggaaagaggccggaacgagtctgttagctcaggagctgcttcctttatctaccttaaagggtacgaaggatgatgtcatctgcgtgcgaggcacattagtgcacaccacttctgactccgattcagacgacggaggccaggagcctgaagagggttcctccacaaacggtcctaagtctccttcgggggtgctgtcggaaccttcccaggaatctaaagagaacccaggaggctttcgtgagaacaccgtgaccggcgaaatgaatggagcagagttgtgtgccgaggacccccagcgcatcccacccgaaatgtcttccaagttggaggcgggtaacgggggcctgcagactgaaaggcgacccagtcaggatcaagtgggggaggaagggtcccaggacctgcctgcggtgacaaaccaaaacagttctgtcggtatcaccgagtcggcgagctctaagaaggaggtgtctggcgagaagtcttttcagttaccagccttcttctcagggttacgggtcctcaagaagggcgcgacagcagaaggaggagaaactatcactgagattaagcctaaggacggcgacttagccctgctgaaacttacccagcccgtgcagaagtccttggtccaggccggcctgcagaccgttaagagcgaaaaaaaggccacagatcctaaggctactcccactctattggaacaactgtcactgctgcttaacatcgatatgcccaagactgagccaaaaggggccgatcccgaatcacctcggagggaggaaatggggtgcaatgcagaccaggaaagccagagcggccctggagtgccccagacccaaggaggggaggtgaaaccaaaatcaccagaaacggctttggaggcttttaaggctctcttcatccgtcccccccgaaaagggacaaccgccgacactagcgagctggaggcattaaagagaaaaatgaggcacgagaaagagtcacttagagcggtgtttgagcggtccaacagcaaacctgctgacggcccaagtgactcgaaatccccagatcattcattgaccgaacaggacgaccgcactcccggccgtctgcaagctgtgtggccacctcctaagaccaaggataccgaggaaaaagtggggctgaagtacacggaagcaggcaatgtcaaaggtagctag

SEQ ID NO: 26397 - DNA, 4260 bp, Artificial Sequence
  Description of Artificial Sequence: Synthetic coding sequence
atggagggcacccactgcaccttgcagttacacaaaccgattaccgaactgtgctacatatccttttgtttacctaaaggtgaggtgcgtggatttagctacaaaggaactgtgacccttgacagatccaataagggctttcataattgctatcaggtgagagaagaatcagacataatctctctgtcccaagagcccgatgagcatcctggagacattttcttcaagcagacacctaccaaggatattttgacagagctgtacaaactaacaacagaacgggaaagattgctcactaacctcttaagtagcgatcacattctagggatcactatgggcaatcaggaggggaagttacaggaactgagcgttagccttgcccctgaagatgactgctttcagtcggcaggggactggcaaggcgagcttccagtgggccccctcaacaaacggtcaacgcatggtaacaagaaacctagacgaagctccgggcggcgggagtccttcggcgctctaccccagaaacgcacaaagcgcaaaggaaggggaggtcgggaaagcgctccacttatgggcaaagataagatctgtagcagccactctttaccactcagcaggactcggcccaatctgtgggtgctggaggagaaaggcaatctgttgccaaatggcgcccttgcctgtagcttgcagcgccgggagtcatgccctccggacattccgaagacacccgacacggatctcggctttggttctttcgaaacagcatttaaagacaccggtctgggtcgcgaggtgttgccgcccgattgttccagcactgaagctggcggggacgggatccggcgtcctccatcggggctggaacaccagcagaccggcttatccgagagccatcaagatcccgaaaagcatcctgaggcagagaaggatgaaatggaaaaaccggcaaagcgaacctgcaaacagaaaccagtcagtaaggtcgttgcgaaggtacaagatctgagctctcaagttcaacgagtcgttaagactcactccaagggcaaagaaaccattgccatcaggccagccgcccacgcagagttcgttcccaaggcagatctgctgacattgccaggggctgaagctggcgcgcacggctcacgccggcagggcaaagaacgccagggagaccgctcgtctcaatcccccgccggcgaaacagcaagcatatcgagcgtcagtgcaagtgcagaaggcgctgtcaataaggtgcccctgaaggtaatagagagtgaaaaactcgatgaagctcctgaaggaaagcggctggggtttcctgtgcacacatccgttccccacaccagacctgaaactcgcaacaagcggagagcaggactgccactcgggggccataagtcactgtttctcgacttacctcacaaggtcgggcccgatagcagtcaaccacggggcgacaagaagaagccatcgcccccggccccggccgccctgggaaaggtgtttaataactccgcctctcagagctccacgcataagcagaccagccccgtgccttcgccactctcaccacgtctgccatccccccagcagcatcacagaatcctgcgcctcccagctctgcctggggagcgcgaggcagccctgaacgacagcccgtgtcgaaagtctagagtgttctccggctgcgtgtccgccgacactctagaacccccctcttcagctaaagtaacagaaactaaaggggcttctcccgcctttttaagggccggtcaaccacgcctggtgccaggcgagacactggaaaagtccctgggccctggaaagaccacagccgagccccaacatcagtctccccctggtatttcatcagaaggcttcccatgggacggatttaacgaacagactcccaaggatctccccaatagagatggcggagcctgggttctgggataccgggcgggtccagcatgcccattcctcttgcacgaagagcgggaaaaaagtaacagaagtgagctatacttggacctccaccccgatcacagcctgacagaacaggacgataggacaccaggtcgccttcaggctgtttggcctccacctaaaaccaaagataccgaggagaaggtggggcttaagtatacggaagctgaataccaggcggccatcctccacctgaagcgagaacacaaggaagagatcgagaacctgcaggcacagttcgagttgcgggctttccacatcaggggagaacatgccatgataacggcccggctggaggagacgatcgaaaatcttaagcacgagcttgagcacaggtggcgtgggggctgcgaggagcgaaaggatgtgtgcatttctaccgatgacgattgccccccaaaaacttttaggaacgtgtgtgtccagaccgatagggagaccttcttaaagccctgtgaatctgagagcaagacaacccggtctaaccagctagtaccaaagaagctgaatatttccagcctgtcccagttgtctccccctaacgaccacaaagatatccacgccgcgttacagcccatggaaggcatggcatctaaccagcagaaggccctcccgcctcctcctgcctcaataccaccacccccaccactgccgtcaggactcgggagtctgagcccagccccccctatgccacctgtctcggcgggaccgcccttgcccccgccacccccacccccacctccacttccgcctccaagctctgccggcccacctcccccccctccgccaccccctctgccaaattcacccgccccccctaacccagggggaccaccccctgcacctccaccacctggcctcgccccacccccaccccctggcttatttttcgggttgggttctagctcttcccaatgccccagaaagcctgccattgagccgagctgtcctatgaagcctctttactggactcggatccagatctcagacaggagtcagaatgccaccccgaccttatgggactcgctggaagagccggatattcgggatcccagcgagttcgaatatctgttctccaaagacactacccagcagaagaaaaagccacttagcgagacatacgaaaagaagaacaaggtgaaaaagatcatcaagttgctggacggaaaacgcagccagacagttgggattctgatctcatccctgcacttggaaatgaaagatatccagcaggccattttcaatgttgacgactctgtagtggacctggagactcttgccgccctttacgagaatcgcgctcaggaggacgaactcgtgaagataagaaagtactacgagacctctaaagaggaggagctcaagctgctcgataaacctgagcagttcctgcacgagctggcccagatcccaaacttcgctgaaagggcccagtgcatcatctttaggtctgttttttccgagggcataacctcactccacaggaaagtagagataatcaccagggcaagtaaagacctgctccacgtgaaaagtgtaaaagacatcttggcactcatccttgcatttggaaactacatgaacgggggcaatcggactcggggccaggctgacggttattccctggagatcctgcctaagctgaaggatgtgaagtccagggataatggaattaatctcgtcgattacgttgttaagtattacctgagatactatgatcaagaggctggcaccgagaaaagtgtgttcccgctgcctgagccccaagatttctttctggcttctcaagtcaaatttgaggacctgatcaaggatctgcggaagcttaaaagacaactcgaggcctctgaaaaacaaatggtggtggtctgcaaggagtctcctaaagaatatctacagccgtttaaagacaagctcgaggaatttttccagaaagcaaaaaaagagcacaaaatggaggaaagccatctggagaatgcacaaaaatccttcgagacaactgtgagatattttggcatgaagccaaaatccggagaaaaggaaattacaccttcttacgtcttcatggtgtggtacgagttttgctctgatttcaagactatttggaagcgggaaagtaaaaatatctctaaagagagacttaagatggcccaggagtcggtgtctaagctgaccagtgaaaagaaggtcgagacgaagaagataaaccccacagccagtttgaaagagcgcttacgccagaaggaggctagcgttactaccaattag

SEQ ID NO: 26398 - DNA, 768 bp, Artificial Sequence
  Description of Artificial Sequence: Synthetic coding sequence
atgtcatctcaccgcaggaaggctaaaggaagaaatagacgcagtcaccgagccatgagagtggcgcacttggagctcgcgacatacgaactcgcagctacggaatccaatcctgagtcgtcccacccagggtacgaggcagccatggcagaccgcccccagcccgggtggagggagtctttgaagatgcgggttagcaagccatttggaatgctaatgcttagcatctggatactgctgttcgtatgctactaccttagctattatctgtgctccgggtcaagctatttcgttttggcaaatggccatatcctccccaactcagagaatgcccacggacagtcgctggaggaagacagtgccctggaagctctgctaaactttttctttccaacaacttgcaatctgagagagaaccaggtggccaaaccttgtaacgaactccaggacctgagcgagtcggagtgcttgagacacaagtgttgctttagctcctctggcaccacgtcattcaagtgctttgcaccatttagagacgtgcctaaacagatgatgcagatgtttggactgggagccatttctctaatcctggtttgtctcccaatttactgccggagcttgttttggagaagcgagcccgccgatgacctgcaacgacaggacaatcgtgttgttactgggcttaagaaacagcgacggaaacgcaaaagaaaatcagagatgctgcagaaagctgccaggggcagggaggaacatggcgatgagtag

SEQ ID NO: 26399 - DNA, 903 bp, Artificial Sequence
  Description of Artificial Sequence: Synthetic coding sequence
atggatttgcctccacagttatcttttggcttgtacgtagcggctttcgctctcggcttccccttgaacgtactcgccattcggggcgctaccgctcatgcgaggttacgactgacgccttcactggtttatgcccttaacttagggtgctcagaccttctgctgacagtttccctgccactcaaggcggtggaagctctggcctccggcgcttggccacttcccgcatcactttgtcctgtctttgccgtcgctcatttctttcctctgtacgcaggtggtgggtttctggccgccctctcagctggtagatacttgggagccgccttcccactcggctaccaagctttcaggaggccatgctacagttggggagtatgcgccgcgatttgggccctggtcctgtgccacctgggcttggtcttcggcctggaggcccccggtgggtggttagaccacagtaacacctctcttggaattaataccccagtgaacgggtctcctgtctgtctagaggcctgggacccggccagtgctggacccgcacgattctcgttgagcttactgttgttttttttgcccctcgctattaccgctttttgttatgtgggatgtctccgagctttagcccgatccgggctgacacaccgacgaaaactcagggccgcctgggtggccggaggcgccctgctgacccttctcttgtgtgttggcccctacaatgcttcaaacgttgcgagttttctgtacccaaacctcggaggatcttggagaaaactcggcctcatcactggcgcttggtcagtggtgctgaaccccttagttacagggtatctgggccgggggcccggactaaaaactgtgtgtgctgccaggacccaagggggcaaatcccagaagtag

SEQ ID NO: 26400 - DNA, 993 bp, Artificial Sequence
  Description of Artificial Sequence: Synthetic coding sequence
atgttgccagattggaaatcttctctgatcctgatggcttatattattatattcctgactggactccctgcaaatttactcgcactgcgcgcctttgtgggaagaatcagacaaccacagcctgctccagttcacatcctgctgctgtccctaacactggcagatctgctgcttctcctgctgttaccttttaaaattatcgaggcggcaagcaactttcgctggtacctacccaaagttgtttgtgcacttacttctttcggtttctactcatccatttattgttccacctggctcctcgctggcatctctatcgaacgctacctcggggtagctttccctgtgcagtacaagctgtccaggcgcccgctatacggtgtcattgccgccctggttgcctgggtgatgtcatttggacattgcacaattgtgattatcgtgcaatacctgaacacgaccgaacaggtgagatcgggcaacgaaatcacttgttatgaaaatttcacggacaatcaattggatgtcgttctgccagtcaggctcgagttatgcctagtcctattttttatcccaatggcagtgactatcttttgctattggaggttcgtgtggatcatgctaagtcagccactggtgggcgcccaaaggcgcaggcgcgctgtcggccttgctgtcgtcacccttctgaactttttggtgtgcttcggaccctacaacgtaagccatcttgtgggctaccaccagcggaaatccccgtggtggcgaagtattgccgtcgtcttcagttcccttaacgcttctttggatcccttactgttctacttcagtagctcggttgtgcgcagggcatttggcaggggactccaggttcttaggaaccagggcagttcacttctggggcgccgaggcaaggataccgccgaaggtactaacgaggaccgcggagtgggccagggagagggaatgccctcttccgatttcaccaccgagtag

SEQ ID NO: 26401 - DNA, 1041 bp, Artificial Sequence
  Description of Artificial Sequence: Synthetic coding sequence
atggatactggaccggaccagtcatacttctctggaaaccattggttcgtttttagcgtgtacttgttaactttcctcgtgggcctcccactaaatctactggctcttgttgtgttcgtgggtaaactccaaagacgcccagttgcggtcgacgtattactgctcaacctgactgcctcagacctgttactgttactctttcttccctttcgcatggtggaggccgccaatggaatgcattggcccttgccttttattctgtgtcccctgtcgggcttcattttcttcacaacaatatacctgaccgccttgtttctcgcggccgtcagcatagagcgctttctctcggtcgctcaccccttgtggtataagactaggccaagactcggtcaggccggactcgtgagcgtggcatgttggctgctggcctctgctcactgttcagtggtgtatgttatcgagttctctggtgacatctctcacagtcagggaacgaatggaacttgttacctggaattcaggaaggaccagctggcgattttgctgcccgtgagactggagatggccgtggtcctgtttgttgtgcctcttataatcacaagctactgttacagtcgccttgtatggatcctaggaagaggagggtcgcatcgtagacagcggcgcgtggccggacttctcgcagcaacgttgctgaacttcctggtttgcttcgggccatacaacgttagccatgtggttgggtatatctgcggggagtcccccgcctggcgcatctatgtcacccttctgtccacgctgaattcctgtgtggatccgttcgtgtactattttagcagcagtggtttccaggccgacttccacgaattactgaggcgcctatgcgggctatggggccagtggcagcaggagagttccatggaattgaaggaacaaaaaggaggggaagagcagagagccgaccgcccagccgagaggaagacaagcgaacactctcagggctgcgggacaggtggccaagtggcttgtgccgagtcctag

SEQ ID NO: 26402 - DNA, 1758 bp, Artificial Sequence
  Description of Artificial Sequence: Synthetic coding sequence
atggcgaggcctgacccttctgccccaccctcattgctcctactgttgctcgcacagctggtcgggagagccgcagcggcctcaaaggccccagtgtgccaggaaattactgttcccatgtgtcgcggcattggctataacttgactcacatgcctaatcagtttaatcacgacacacaggacgaagcaggattggaagtgcaccagttttggccgctggtggagattcagtgctcgccagatctgaggtttttcttatgttccatgtacacacccatctgtctgcccgattaccacaaacctttgcctccttgcagatctgtttgcgagcgggccaaagccggctgctctccacttatgagacaatacggcttcgcctggccagaacgtatgagttgtgacaggctgcccgtgctcggccgtgacgctgaagtcttgtgcatggactataatcggtcggaagctactactgcgccacctaggccctttcctgctaaacccactctgcctgggccccccggggccccggccagtggtggcgagtgccctgccggtgggccttttgtctgtaaatgtcgggagcctttcgtgccaattctaaaggagagtcatcctctctacaataaggtgcgcactggtcaggtccctaactgtgctgtcccatgctatcagccgtctttcagcgcagacgaacggacgttcgcaaccttttggattggtctttggtctgtactgtgcttcattagtacctctacaaccgtggccactttcctgatagatatggaaaggtttagatatcccgagagacctattatcttcttgagcgcctgttatctatgtgtcagccttggctttctagttaggctcgttgttggtcatgcctccgtcgcatgtagtcgggaacataatcatattcattacgaaacaacaggcccggcactgtgcaccatcgtgttcctcctggtatattttttcggcatggcatcttctatatggtgggtgatactgtcgctgacctggtttctagcagcgggtatgaagtgggggaacgaggctatcgcgggctatgcccagtacttccacttagctgcctggttaataccctctgtaaagtccattactgctctggccctgtcctcagtagacggcgatcctgtggctggaatctgctatgtgggaaatcaaaatctaaacagccttaggggctttgtgctgggacctctcgttctctatttacttgtgggcactctgttcctcttggcagggtttgttagtcttttccgtatcagatctgtgatcaaacagggagggaccaaaactgacaaacttgagaagctgatgattaggatcggcatctttactctgctgtacactgtgcccgctagtatcgtcgttgcttgttacctctatgaacagcactaccgggagtcctgggaggctgcattgacatgcgcatgtcctggccacgacactgggcagccccgcgctaagccggaatactgggttctcatgcttaaatactttatgtgtctggtggtgggaatcacatctggggtgtggatctggagtggaaaaactgtcgagtcctggagacgctttacgagccgttgctgttgcaggcccaggaggggacataagagtggcggcgccatggccgctggtgactatcccgaagctagcgcggccctgaccggccggaccggtccgcccggaccagcagctacttatcacaaacaagtgtcattaagccatgtgtag

SEQ ID NO: 26403 - DNA, 2313 bp, Artificial Sequence
  Description of Artificial Sequence: Synthetic coding sequence
atgagtaaatgcaggaaaacacctgtgcagcagctggctagccccgcatctttttccccggatattttagcagatattttcgaactgtttgcaaagaatttcagctacggaaagccactgaataacgagtggcaactacccgacccgagtgagatcttcacatgtgatcacacggagctgaatgcgttcctggatcttaagaatagcctgaacgaggtgaagaacttactaagtgataagaagttggacgaatggcacgaacacacagccttcaccaataaggctggcaagatcatcagccatgtaagaaaatcagttaacgccgagctgtgcacgcaagcctggtgtaagttccatgaaattctgtgtagttttccactcattccacaggaggcatttcagaacgggaagctgaactccttgcacctttgtgaggcgccaggcgctttcatcgcatctctgaatcactacctcaaatcccaccggttcccttgtcattggtcttgggtcgcgaacacacttaacccctatcatgaggctaatgacgacctcatgatgattatggatgatcggctaattgctaatactctgcactggtggtacttcggacctgacaatacgggagatattatgacacttaagtttctgacagggctccagaattttataagttccatggccaccgttcatttagttacagctgacgggtcctttgactgtcaaggcaacccaggggagcaggaggcgctagtaagctccctgcattattgcgaggtggtaactgctctgaccaccctgggaaacgggggctcctttgtgctcaaaatgttcaccatgttcgaacactgtagtattaacctaatgtaccttctgaattgttgcttcgatcaggtccatgtgtttaagccagccacctcaaaggctggaaactcagaggtctatgtggtctgcctccactacaaagggagagaagcaatacacccacttttgtccaaaatgaccctaaactttggcacagagatgaagagaaaggcgctgttcccccatcatgttattccagactcttttctgaaaagacacgaagaatgctgtgtcttcttccataaatatcagctggagactatcagtgagaacattcgcctattcgagtgcatgggcaaggctgagcaggaaaaactaaacaatctccgtgattgcgcaatccagtatttcatgcagaagttccagctgaagcacctgtctcgtaacaactggctggtgaagaagagtagcattgggtgttccaccaataccaagtggtttggacaacgcaacaagtacttcaaaacctataatgaaaggaagatgctcgaagcactcagctggaaagacaaagtcgcgaaaggctactttaatagttgggctgaggagcatggtgtctaccatcctggacaatctagtattctggaggggaccgcgagcaacctggagtgccacctctggcatatactcgagggaaagaagctgccaaaggtgaagtgctcacccttttgtaacggggaaattctgaaaactctgaatgaggctatcgagaaaagcctgggtggagcttttaatctggattccaaatttcggccaaaacagcagtatagttgcagttgtcacgtttttagtgaggaattaattttttctgaactctgttcactgaccgaatgtcttcaagacgagcaagtggtggtaccgagcaaccaaataaagtgtctcctggtaggattttccaccctgagaaacatcaagatgcacattcccctagaagtccggcttctagaatccgcagagcttaccacattctcttgctccctgttgcacgacggcgacccaacctatcagcggctgtttctggactgcctgctgcactcccttagggagctccacactggcgacgtcatgatcttaccagtcttgagttgctttacccggtttatggctggactgattttcgtgctgcattcatgctttagattcattaccttcgtttgcccaaccagctctgatcctctgcgtacatgtgctgtgctcttgtgtgttggctatcaggatcttccaaacccagtcttcaggtatctgcaatccgtcaacgagttattgtctacattgcttaattccgatagcccccagcaggtgttgcagttcgttcctatggaggtgctccttaaaggcgcactcctggactttctctgggatctgaatgcagctatagctaagcggcacttacacttcattatccaacgcgaaagggaagaaattattaatagcctgcaacttcagaattag

SEQ ID NO: 26404 - DNA, 2313 bp, Artificial Sequence
  Description of Artificial Sequence: Synthetic coding sequence
atgtctaaatgccggaaaaccccagtacagcagctcgctagccctgcttcattttcacccgatatcctggccgacattttcgaactgtttgcgaaaaactttagttacggtaaacctctgaacaacgagtggcaactccccgatcctagcgagatctttacctgcgaccacactgaattaaacgcatttctggatcttaagaacagcctgaacgaagtcaaaaatctgttgtccgacaagaagttagatgaatggcacgagcacactgccttcaccaacaaggccgggaagataatcagtcatgtgaggaagtcagtcaatgccgagttatgtacccaagcgtggtgcaagttccacgagatcctgtgttccttcccacttatccctcaagaggcctttcagaacggtaagctgaacagtttacatctttgcgaggccccgggggcatttatcgccagcctgaaccattatctgaaaagtcatcgctttccttgtcactggagttgggttgccaatacactgaacccatatcacgaggcgaatgatgatctgatgatgatcatggacgatagactgatcgccaatacgcttcattggtggtactttggtcccgacaacacaggtgatatcatgacgctgaagtttcttacgggcctgcaaaacttcatcagctcaatggctaccgtccatctggtaaccgccgacggctcatttgactgccaggggaaccctggggaacaggaggcactggtgagctctttgcactactgtgaggtcgtgaccgctctgaccacgctcggtaacggcggcagctttgtcttgaagatgtttaccatgtttgaacattgttcaattaatctgatgtacctattgaattgctgcttcgaccaggtgcatgtattcaaacctgccaccagtaaggcaggaaattctgaggtatacgtcgtctgtctgcactataagggacgcgaggcaatccaccccttattgtcaaagatgacgctgaactttggtaccgaaatgaagagaaaggcactgttcccacatcatgtcattcctgatagttttctcaaacggcacgaggagtgctgtgtgttcttccacaagtatcagctagaaacaataagcgaaaatattcgtctatttgagtgcatgggaaaggccgaacaggaaaagctgaacaatcttagagattgtgccatacagtacttcatgcagaaattccagttaaaacacctctccagaaacaattggctggtgaagaaaagttcaattggttgctcaaccaatacaaaatggtttgggcagcgtaacaagtacttcaagacctacaatgaaagaaagatgttggaggccctctcatggaaggacaaggtggctaagggctattttaactcctgggcagaggagcatggtgtgtatcaccccggacaatcatctatacttgagggaacagcgtccaatctggagtgccacctgtggcatattctggaggggaagaaattgcctaaggtcaagtgctccccgttttgcaatggcgagattctcaagactttaaacgaagcaatagaaaagtctctgggaggggccttcaatttagattccaaatttaggcccaagcagcagtacagttgctcttgtcacgtcttttccgaggagcttattttttctgaactgtgcagtctcaccgagtgccttcaggatgagcaggtggtggttcctagtaaccagattaaatgtcttctggttggtttcagcacgctccgtaacattaaaatgcacatccctctggaagtgcgcctgttggagagtgccgaactcactacctttagttgctccctcctgcacgacggcgaccctacttaccaaagattattcctggattgcctactccacagccttagggaactccacacaggcgacgtgatgatcctgcccgtccttagctgctttactagattcatggctgggctcatttttgtgctacacagttgttttcgctttataacattcgtttgcccaacctcatcagacccgttgcgcacttgtgctgtgttattgtgtgtcggataccaggacttacccaatccagtgttccgctaccttcagagcgtgaacgagttgctctctacacttcttaactcagatagtcctcaacaggtactgcagtttgtcccaatggaagttctcctcaaaggcgcactgctcgacttcctgtgggaccttaatgctgcgattgctaagcggcaccttcacttcataattcaacgagagcgagaagagataattaactctttgcaactgcagaattag

SEQ ID NO: 26405 - DNA, 1440 bp, Artificial Sequence
  Description of Artificial Sequence: Synthetic coding sequence
atggtgcggatccagagaaggaagctcctggcctcctgcttatgcgtgacggctacagtgtttctgttggtcaccctgcaggtaatggtggaattggggaaatttgaacgcaaagagttcaaatcatcttcactgcaggatggccacacgaaaatggaggaggcccctacccatctgaattcctttcttaagaaggaaggcctcacattcaatcgtaagcgcaagtgggagctggactcgtacccgattatgctgtggtggagcccattaaccggagaaactggaaggctgggtcaatgtggcgcagatgcatgtttcttcacaattaataggacatatctacaccaccacatgactaaggcttttttattctacggcaccgacttcaacatcgattccctacccctgccccggaaagctcatcatgactgggccgtgtttcatgaggagagtcctaagaataactacaaactgtttcacaagcctgtgattacgctatttaactacaccgctaccttttctaggcactcccaccttcctttgactacacagtacctcgaaagtattgaggtcctgaagtccctccgttacctggtccctctgcagagtaaaaacaaactgcgcaagcgccttgcccctctggtgtacgtgcaaagtgattgtgatcctccttctgaccgtgatagctatgtgcgcgagcttatgacatacatcgaggtggatagttacggggaatgtctccgtaacaaggatctgcctcagcagctgaagaacccggcatccatggatgcagacggattctatagaatcattgcacagtacaagttcattctggctttcgaaaatgctgtctgcgatgactatataactgaaaaattttggcgcccattgaagctgggggtagtgccggtctactatggaagtccttctatcaccgattggttaccgtctaataaaagcgccatcctggtctcagaattttcccatccaagagaactggcatcctacatcagacggctagatagcgatgataggctctacgaagcgtatgtggagtggaaactgaagggggaaatttctaaccagagactcctgacagccctgagggaaaggaaatggggtgtccaagacgtgaatcaagacaattacatagatgcatttgagtgcatggtttgtacaaaagtgtgggctaacattaggctgcaggaaaagggactgcccccaaagcgatgggaggctgaggacacccatctttcatgtcccgaacctactgtgttcgccttttcccctcttagaacgcctccgctgagtagccttcgggaaatgtggatcagttctttcgagcagtccaagaaagaagcacaggcgttgaggtggctggttgatcgcaatcagaactttagctctcaggagttctggggcctggtgtttaaggattag

SEQ ID NO: 26406 - DNA, 1074 bp, Artificial Sequence
  Description of Artificial Sequence: Synthetic coding sequence
atgggcatcggacagctgccccactatgcacttgtggtccctgcagacggtggggactgggaagtgcgtccaatgtggagtaggtgtctctttctgcatcatcagcccgatctaccaccctcatcgcacgatcagtcgatcccattattgtggagtcaggaggaatctccacctttggccgaaaacgatggcaccgatttcaatatcgacagtctgcccttacccaggaaagcccatcacgactgggctgtgtttcacgaggagtctcctaagaataactacaagctatttcacaaacccgttattaccctgtttaattacacggcgaccttcagccggcactcccacctccccttgaccacccagtatcttgagtctatcgaggtcctgaagtctctgcggtacttggtccccttacaaagcaagaataaactgcgcaagcggctcgctcctctggtttacgtgcagtcagattgcgatccacctagtgaccgggatagttacgtccgtgagctgatgacctacatagaggttgatagttacggagaatgcttgaggaacaaggatctgccacagcagctaaagaaccctgcttcaatggatgctgacggcttttaccgtatcatagcacaatataagtttattcttgctttcgagaatgccgtctgcgacgactatattacagaaaagttttggcggcccctgaagttgggtgttgtgcccgtgtattatggcagtcctagcattactgattggcttccttccaacaaatctgctatcctggtgagtgaattctcccaccctagagagcttgcaagctacatccgcaggttggactcagacgatcgcctgtacgaggcctatgttgaatggaaattgaagggcgagatttctaatcagcgcctcctaactgctctgcgggaaaggaagtggggtgtgcaagatgttaatcaagataactatatcgatgcttttgagtgtatggtatgtactaaggtgtgggccaatatacgtctgcaggagaaggtgagtaaatccaaagtaggcatcgagccagccggatggccatcttag

SEQ ID NO: 26407 - DNA, 1566 bp, Artificial Sequence
  Description of Artificial Sequence: Synthetic coding sequence
atggtgaggatccagaggcgaaagttgctcgcaagctgcctctgcgtcacagcaacagtgtttctgctggtgactctgcaagccctcgacacggtggaaaatctgatgaaggtcactggtccaccacaaggagtgacagacagcatgcagtgcttcaatgatcagcgtcccttgtctaacacacggagctccgagcatattaaggaggttatggtggaactgggtaagtttgagagaaaggaatttaagtcttctagtctgcaggatggccacaccaagatggaggaagctcccactcatcttaactcgttcctgaaaaaagaaggccttacgttcaacaggaagagaaagtgggaactagacagctaccctatcatgttgtggtggagtcctttgacaggcgaaaccgggagacttggccaatgcggagctgatgcctgtttcttcacaattaatcggacatacctacaccaccatatgaccaaggcctttctgttttacggcactgattttaacatcgactccctccctctgcctagaaaggcacatcatgactgggccgtgtttcatgaggagtcgccaaaaaataactataaactgttccacaaacccgttatcaccctgttcaattatacggctactttctccagacactctcatctccctctgactacccagtacttggagagcatagaagtgctgaaatcccttcggtaccttgtgccgctgcagagtaaaaacaagctcaggaagagactggcccccctggtttacgtgcagagcgattgcgacccaccttcagaccgggactcttacgtgcgggaactcatgacatacattgaagtggactcctacggtgagtgtctacgcaacaaggatctgcctcaacagctcaagaaccctgctagcatggacgccgacggattttacaggattatcgctcagtacaagttcattctggctttcgagaacgccgtatgtgatgactacattactgaaaaattttggcgtcccctcaaactgggcgtggtgccagtctattacggatctccatccatcacggactggctgcctagcaataagtctgcaattctcgtgtcagagttctctcacccacgggagctagcttcctacattagacggctggactctgacgatcgactgtacgaagcatacgtggaatggaaactgaagggcgaaatctccaaccaaagacttctcactgcgctccgcgagcggaaatggggtgtccaggatgtgaaccaggacaactatatcgacgccttcgaatgcatggtgtgtacgaaggtgtgggctaatatcagattgcaagagaaggggctccctccaaagaggtgggaagcagaagacacccatctgagctgccccgaaccaaccgtattcgccttctcccctttgagaacacctcctctctctagcctccgggagatgtggataagtagcttcgagcagtctaaaaaggaggcacaagcactgcgctggctagtggatcgtaaccagaatttctcatcccaggagttctgggggttagtcttcaaggattag

SEQ ID NO: 26408 - DNA, 1479 bp, Artificial Sequence
  Description of Artificial Sequence: Synthetic coding sequence
atggccgctggtcctataagggtcgtgttagttttgcttggcgtgctatccgtctgcgccgcgagcggacatggtagcgtggccgagcgcgaagccggcggcgaagcagagtgggcagaaccatgggacggcgcggtcttccggccaccgagcgctctaggcgcagtcggagtgacgaggagtagcggcaccccgagacccggaagggaagaagcgggggatctgcccgtcctcctctggtggtcccccggactgtttccgcacttccctggggactcggaaagaattgaatgcgcgcgcggagcatgcgtcgcctcacggaatcggcgcgctctgagggactcccgcaccagagcattgctgttttatgggaccgattttcgagctagcgccgctcctctgcctagactggcccaccagagttgggcactgctgcacgaagaaagccccctgaataattttctgttgagtcacggcccaggaatacgtctgtttaaccttacctctacattctcgcggcacagtgattaccccctgagtttacagtggctccccggaaccgcgtaccttaggcgccccgttcctccgcctatggagcgggcagaatggcggcgtagagggtacgccccgctgctttacttgcaaagccactgcgatgtgcccgccgacagggacagatatgtccgagagttgatgcggcatatccccgtggactcatacggtaagtgcctgcagaatagggagctgcccacagctcggcttcaagacacagccacagcgacaacagaggatcctgagcttctggctttcctttctaggtacaagttccatctcgcccttgaaaatgctatatgtaatgattacatgactgagaaattatggcgtcccatgcatctaggcgccgtgcccgtatacagggggtctcctagtgtcagagattggatgccaaacaaccactcagtgatcctgatcgacgacttcgaatcacctcagaagctggcggagtttatcgacttcctggacaaaaatgacgaagaatacatgaaatacctcgcttacaaacagccaggggggattactaaccagttcctcctcgacagtttgaagcaccgggaatggggcgtgaacgaccctcttctacctaattatctaaatggcttcgaatgctttgtatgcgattatgagttggcaagactggatgcagagaaggcacacgcagcctcccccggggactctcccgtcttcgagccccatatagcccagccatctcatatggattgtccggttcccactcccggttttggaaacgttgaagaaatacccgaaaacgatagctggaaggagatgtggctgcaagattactggcagggtctcgaccagggtgaggctctgaccgccatgatccataataacgaaacagagcaaaccaagttctgggattacctgcatgagattttcatgaaacggcagcacctgtag

SEQ ID NO: 26409 - DNA, 1431 bp, Artificial Sequence
  Description of Artificial Sequence: Synthetic coding sequence
atggctgctggccctattagagtagtgcttgttctgcttggcgtgttgagcgtttgtgctgcctccggccatgggagtgttgcggagcgcgaagccggtggcgaagccgagtgggcagaaccttgggatggcgccgtatttcgacccccaagtgctctgggggccgtgggagttacccgctcttcagggacacctcggcctggccgtgaagaagcaggtgacctccctgtgttactttggtggtctccagggctgtttccacactttcccggagattctgagcgcatcgaatgcgccaggggagcatgtgtcgcttctagaaacagaagagccctgcgggatagtaggactcgcgccctgttgttctatggtactgactttcgcgccagcgctgcacctttaccaaggcttgctcatcagtcatgggccttgctgcacgaggaaagcccactgaataattttctgttatctcatgggccaggaattcggctgttcaacctcacatctactttttcgcggcactcagactatcccttgagcctgcagtggctgcccggcactgcttacctccgaagaccagtgcccccaccaatggaacgagcggaatggcgaaggcggggttatgcccccctcctctatttgcagtcacactgcgatgtgccagctgacagagaccgatatgtccgcgaactcatgagacatattcccgtggatagttatgggaagtgtctccagaaccgtgaattgcctacagcgcgcctgcaggataccgccactgccactacagaggatcctgagctgctcgctttcctgtctcgctacaagttccacctcgcacttgaaaatgccatctgcaatgactatatgactgaaaagctgtggcggcccatgcatctgggcgcagtccctgtctatcgaggcagtccaagcgtgcgagattggatgcctaacaatcacagtgtcatcctcattgacgattttgagagccctcagaaactggcggaattcattgatttcctcgataaaaatgatgaagaatacatgaaatatttggcctataagcagccaggcgggatcactaaccagtttttgttagatagcctgaagcatcgggagtggggcgtgaacgaccccctgttgcccaactacctcaacggctttgagtgttttgtgtgtgactatgagctggccaggctggatgcggaaaaagcacacgccgcctcccccggggattcccctgtgttcgagccccacatcgctcaaccttctcacatggattgccctgtgcccacccccggatttgggaacgtggaagaaatcccagagaatgattcctcactggtgcaagtacgagatcattgcatctgcttacggttcctctggcctcattccgaaaaaggccgaacccataactatgccgccgttccatag

SEQ ID NO: 26410 - DNA, 570 bp, Artificial Sequence
  Description of Artificial Sequence: Synthetic coding sequence
atggagacatcagctccacgcgctggaagtcaggttgttgccaccaccgcccgccattcagccgcctaccgggcggacccactcagagtgtcaagcagggacaaactaacagaaatggccgcctctagtcagggaaactttgaagggaactttgaaagcctggatctggccgaattcgctaaaaagcagccctggtggagaaagctgtttggtcaggaatcagggccgtctgccgagaaatatagcgtggccactcagctatttatcggcggggttaccggctggtgtactggcttcatcttccagaaggtgggaaaactggctgccaccgctgtcggaggcgggttttttctgttacagcttgctaaccacacggggtatataaaagtggattggcaacgggtagagaaggacatgaaaaaagctaaagaacagctgaagatacgcaagtccaaccaaattcccaccgaggtccgaagcaaagccgaagaagtggttagcttcgtcaagaagaacgtcttggtgacagggggcttctttggagggtttctcttagggatggcctcctag

SEQ ID NO: 26411 - DNA, 1569 bp, Artificial Sequence
  Description of Artificial Sequence: Synthetic coding sequence
atggctttgaccgagacccaaccccagttgctgagcgccgacctggttctggcactgcaggtactcatgctctgggagatgacagaggctaacaaggtattaaagagacgccagcatccccaaaggagccattgtatttctagtaagatcctggagtcctacccaggggagaagccactgactaaaagcctgcagaggggagaggacccacagttcgatcaggtcattagcagcatgagctcactctccgagtactgtctcccttctattctgcgcactttattcgactgcgatgagcagcagagagactacttaatggagagaagagacctcgccatcgactttattttcagtctcgtgctgatcgaggtgctaaagcagggcagcttgacgtgcctcataatcccctacttggggacactggtccctaccctggccatttgtatcctgtggcaaacctgtatgcaaaagtcactggagtgttggcataagccaagcaagttcccggcggtcaagaaaaaatttatggcagagctcaaggagctgcgccataaagaacagaacccatacgtcgtccagtccattatttcattaattatgggaatgaagttctttagaatcaaaatgtacccagttgaagatttcgaggccagcctgcagttcatgcaggagtgcgctcattattttctcgaggtgaaagacaaagacatcaaacatgccttggcaggtctttttgttgagatcctcgtgccagtcgccgcagccgtaaagaacgaggttaatgtcccatgtttgaggaacttcgtggaatctctatatgatactactctggagcttagctctcgtaaaaaacacagcctagctctataccccctggtgacttgtctcctatgcgtaagccagaaacaactatttctgaacaggtggcacatcttcctgaataactgtctgtccaacctgaaaaacaaagacccaaaaatggcccgagtggcactcgaatcactgtaccggctgttatgggtgtacatgatccggattaagtgcgaaagcaatacagcaactcaatctcgactcatcaccattattacaactctatttcctaagggcagccgcggcgtcgtgcctcgagacatgccgttgaacattttcgtaaaaatcatccagtttatcgctcaggagcgtttggacttcgctatgaaggagatcattttcgatttcctttgtgtgggcaaaccggccaaggcgttttctctaaatcccgaacgaatgaacatagggctcagagccttcttagtcatcgccgactctctgcagcagaaggatggcgagccaccaatgccagtgaccggagccgttctgccatcaggcaacacactgcgcgttaagaaaacatatctctccaagaccctgactgaagaagaggccaaaatgatcgggatgagtctttattactcccaggtgagaaaagccgtagacaatattctgcgccatcttgacaaggaagtcggccgctgtatgatgctcacaaatgtacagatgctcaataaggagccagaggacatgatttag

SEQ ID NO: 26412 - DNA, 588 bp, Artificial Sequence
  Description of Artificial Sequence: Synthetic coding sequence
atggagtccctggcccaattggagttgtgtcagcgcctgtataagctccacttccagctgcttctactctttcagagttactgcaaattgattggacaggttcacgaagttagcagcatgcccgagctgttaaatatgagtcgagagctgtccgatctcaagaaacacctgaaagaagcatcagctgtgattgccgccgacccattgtactccgatggggcctggtctgagccaacctttacatccaccgaagctgccattcagtccatgctggagtgcctgaagaacaatgagttaggcaaggccttacggcagatccgcgagtgccgatctctctggccgaatgacatttttggcagttcaagcgacgacgaggtccagacgctgctgaatatatactttagacatcagaccttgggccagaccgggacatacgcgttggtggggtcaaatcagtccttgacggagatttgtacaaaactcatggagctgaatatggagatccgagacatgatacgaagagcgcagtcataccgggtcttaacgaccttcttgccagacagctctgtaagtggcacatcgctctag

SEQ ID NO: 26413 - DNA, 1278 bp, Artificial Sequence
  Description of Artificial Sequence: Synthetic coding sequence
atggcagttacccgcagcacttcatctacgagctcaggcagcaatagcaacgtcctggtgcccgtcagctggaaacgtccccagtactcacagaagaggacgaaagagaaattggtgcacgtgttgagtctttgcggacaggaagttgggctgagcaaaaatccgtcagtgatcttctccagctgcggagacctcgatctcttggaacaccaaacttcactggtgtcctcagaagacggggcgcgggaacaggaaaatatggacgacactaacagcgaacagcagtttcgggtgtttagagactttgattttctggacgtcgagctggaggacggggagggactgagaggcgaaagcatggacaacttcaactggggtgtacgccgcagatctttagattctctggacaaatgtgacatgcaaattctagaagaacgtcagctatcgggctccactcctagtttgaataaaatgcaccacgaagactccgatgagtcgagtgaagaggaggatctaaccgcatcacagatcctggaacactctgacctcattatgactctgagtcccagcgaggagaccaatcctatggagctcctgacaactgcatgcgacagtactccagcggagcctcactcctttaatacacgaatgtcctcattcgatgcctcattgcctgacatgaacaacttgcagatttccgaaggttccaaagcagaggccgtaagggaagaagaagacacgacagttcacgaggacgatctgtcctcatccatcaatgagctgcctgctgcttttgaatgcagcgattcctttagcctggacatgaccgagggtgaggaaaagggcaatcgagctctggatcagtttacactggctagttttggcgagggtgatcgaggcgtatccccaccgccatccccttttttcagcgccattctggcggccttccagcccgcagcctgtgacgatgccgaagaggcttggagaagtcacataaatcagctgatgtgtgatagcgacggctcctgtgcagtgtatacctttcacgtgttttcttctctatttaaaaatattcaaaagaggttctgtttccttacttgcgatgccgcttcctacctcggtgacaatcttcgcggcattggctcaaagttcgtgtccagctcacagatgctgacatcttgctctgagtgccgcgcccaggtgcaatgcgtaaggactgccagaatctttgggtatcttcaacagcaggagagaggccatactctctgtaaactctag

SEQ ID NO: 26414 - DNA, 9042 bp, Artificial Sequence
  Description of Artificial Sequence: Synthetic coding sequence
atggccagtcaacaggatagtggctttttcgaaatctccatcaaatatctcctaaagagctggagcaataccagtccggttggcaacggctacatcaagcctcctgtaccacctgccagcggaacacaccgggagaagggtcccccaaccatgctgccaatcaacgtggatccggattctaaaccaggcgagtacgtgctgaaatccttgtttgtgaattttactacccaggccgagcgaaaaattcggataataatggccgagcctctcgaaaagcccctgacaaaatccctgcagcggggcgaggatccccagttcgaccaggtgatttcatccatgtcatccttgagtgaatattgtctgcctagtattttgcgaacactgtttgactggtataaacgccagaacggcatagaggacgagtcacacgaatatcgccctaggaccagcaataagtccaagagcgatgagcagcagagggactatctcatggaacgtcgagatctggcaatcgacttcattttcagtttagtgctaattgaggtgctcaaacagatacccttgcatcctgtgattgatagcttaattcacgacgtgatcaatctggccttcaaacacttcaagtataaagaaggctacctaggaccaaatacgggaaacatgcacattgtagctgatctgtacgccgaggtgatcggtgtgctggctcaggcaaaatttcccgcagtgaagaaaaagttcatggcggagcttaaagagttgcgccataaagaacaaaacccttacgtcgtgcagtctataatcagtctgattatgggtatgaagtttttccgaatcaagatgtatcctgttgaggacttcgaggcctctctgcagtttatgcaggagtgtgcccattactttcttgaagttaaggacaaagacattaagcacgcccttgcgggactctttgttgagatcttagtaccagttgccgccgcagtcaagaacgaggtaaacgtcccctgcctcaggaattttgtcgaatcactgtacgacactactttggagctatcatcccgcaagaagcatagcctagctctgtacccgcttgttacctgcctgttgtgcgtgagccagaagcagctgtttttaaaccggtggcatattttcttgaataactgcctctccaacttaaaaaacaaggatcctaagatggcccgcgtggctctggagtctctctaccgccttctgtgggtgtacatgatcagaattaaatgtgagagtaatacggcaactcagtctcggctgattacaatcatcaccaccctctttcccaagggtagccgcggagttgttccaagggacatgcccctgaacatcttcgtgaaaatcattcagttcattgcccaggagcgattggacttcgccatgaaggaaataatatttgattttttgtgcgtcggcaagcctgccaaggccttttctcttaatccagagcgtatgaacatcggcctcagggcctttttagtaatagcggacagcctccaacaaaaagatggagagccgccaatgccagtgaccggggccgtgttaccttccggcaacaccctgcgggtgaagaagacttatttgtccaagaccctgactgaagaggaggcgaaaatgataggaatgtcactttactactcccaggtaagaaaggccgtagataacatcctgcgtcatctggacaaggaggtgggacgctgcatgatgctcactaatgttcaaatgctcaataaggagccagaagacatgattaccggagagagaaaacctaaaattgatctgttcaggacatgcgtcgccgctatccctaggctcctccctgacgggatgtccaagttggagctgatcgatcttttagccagactttccattcacatggacgatgaactcagacatattgcacagaatagtttgcaggggctactggtcgatttctcagactggagagaagatgtgctatttggcttcacaaactttttgctgagagaagttaatgacatgcaccataccctgcttgacagttccctcaagctgttattgcagttgcttacacagtggaagctggtgatccagacccagggcaaggtgtacgaacaagcgaacaaaattagaaactctgaactgatagcaaacggctcaagccaccggattcagtctgaaagggggcctcactgttctgtgttgcacgcagtcgagggtttcgctctcgtgctgctgtgttcattccaggtggcaaccaggaagctttcggtactcatcttgaaagaaattcgcgccttatttattgcactcggccaacctgaagacgatgaccgcccaatgatcgatgttatggaccagcttagctcgagcattttggagagctttatccatgtggcggtgagtgattcagccacacttcccttaacacataacgtggacctgcagtggctagtagagtggaatgccgtgctggttaatagccactatgacgttaagtccccatctcacgtgtggattttcgctcaaagtgttaaggacccatgggtcctttgtctcttttccttcctgcgccaggaaaatctccccaagcactgcccaaccgctttgtcttacgcctggccctacgccttcacacgactacaatccgttatgcccctggtagaccccaactcaccaataaacgcaaaaaaaactagcacagccgggagtggggataattacgtgacattgtggaggaattacctgattctctgctttggcgtggcgaagcctagcattatgtctccggggcacttaagagcctcaacacccgaaataatggccaccacacccgatggtactgtgagctacgataacaaagctatcggcacaccctccgtgggtgttctgctgaagcagctcgttcctcttatgaggcttgagtcgatcgaaatcaccgagtccctggttcttggcttcggcagaaccaactctctcgtcttccgggaactggttgaagagttgcatcccctgatgaaagaggcgctggagcggagacctgaaaacaagaaaagacgcgagagacgtgacctgctacgactgcagctcttgcgtatctttgagctgttagccgacgctggcgtaattagcgattccaccaatggtgccttggagagggatacactggcactcggcgcactctttctggaatacgtcgatctcactcgcatgctacttgaggccgagaacgataaggaggtagagatactgaaagatattcgcgcgcacttttccgccatggtcgccaatctgatccagtgtgtgccagtgcaccacagaaggtttctgttcccccagcagtcactgcgccaccaccttttcatcctttttagccagtgggccggacctttctcgatcatgttcacacccctggatcggtatagtgataggaatcaccagataacgcgataccagtattgtgccctgaaagccatgtcagccgtgctgtgctgtggcccagtgttcgataatgtcggcctatccccggacgggtacttatacaagtggcttgacaatattttggcctgccaggacctgcgcgttcaccagctgggctgtgaagtcgtggtgctcctgcttgaactcaaccctgatcaaatcaacctttttaactgggctatcgataggtgctataccggcagttaccagttggcctcgggctgcttcaaagccatcgccaccgtatgcgggtcgaggaactatcctttcgatatcgtgaccttgctcaacctcgtgctttttaaggcatccgatacaaaccgcgagatctatgaaatctccatgcagctaatgcagatcctggaggccaagctcttcgtttacagtaagaaagtagctgaacagcgccccgggtctatcttgtacgggacccatggacccctgcctcccctgtactcagtgtctctggccctcctatcttgcgagctggccagaatgtatccagaactgacattaccactgttctcagaggtgagtcaacgttttcctacgacccaccctaacgggcggcagattatgctgacatacctcctcccatggctgcacaacatcgaacttgtggacagccggctgctcctgcccggttctagtccaagcagtcccgaggacgaggtgaaagacagggaaggggacgtgactgcgtcacatgggttaagaggaaacgggtggggatcgccagaggccacctccctcgttctgaataacctgatgtacatgaccgcaaaatatggagatgaggtgccagggcccgaaatggagaacgcctggaatgcccttgctaataacgagaaatggagtaacaacctgcgcattacgttgcagtttctcatttctctgtgtggtgtttcatccgacacagtgctgctcccttacatcaaaaaggtcgcaatctatctttgccggaataacaccatacaaactatggaggagttgctcttcgagctgcaacaaacggagcccgtcaaccccatcgtgcagcattgcgataaccctccgttttacagattcacggcaagttctaaggcaagtgcagcggctagtgggacaaccagttccagtaatactgtggtggctgggcaggaaaattttcccgacgcagaagagaacaagattctcaaagaatcagatgagagattctccaacgtgataagagcacacacgcgcctagagtctcgatattccaactcatcaggggggtcctacgatgaagacaagaacgacccaattagcccttataccggatggctcctgacaatcacagaaaccaagcagccccagccactacctatgccatgcactgggggctgctgggcaccgttggttgactaccttcccgagactattacccctaggggtcccctccacagatgtaatatagccgtcatctttatgacagagatggtcgtggaccactcagttcgcgaggattgggccctgcatttgcccctgctgcttcacgctgtattcctcggcctcgaccattataggccagaagtattcgagcactcgaaaaaactgctcctacacctgctgatcgccctatcgtgtaattcgaatttccattctatcgcgagcgtcctgctccagaccagagagatgggggaggcaaaaacgctgactgttcagccagcataccagcctgagtatctttacacaggcggcttcgatttcctccgtgaggatcaaagctcacccgtgccggatagtgggctctcatcaagttcgacgtctagtagcattagtctcggaggatccagcgggaaccttcctcagatgacgcaagaagtcgaggatgtcgacacggcggccgaaactgatgaaaaggctaataagcttatagaatttctcactacgcgagcctttggtcccctgtggtgccatgaggacatcactccaaagaatcagaattctaagtcagccgaacagttgacaaatttcttgcggcatgtggtctccgtgttcaaggatagcaagagcggcttccatctggagcaccagcttagcgaagtggcattacagacagcacttgcttcctcgtcacgccattatgcggggagatctttccagatcttccgagcactgaagcaacccctgagcgctcacgctctgtctgacttgctaagccgtctggtagaggtgattggcgagcatggcgacgagattcaaggatacgttatggaagctctgctgacacttgaagccgctgtggacaatctaagcgattgtctcaaaaatagtgatctccttactgtcctgtcccgttccagctcaccagacttatcttcatccagtaaattaaccgcgagtcgcaagtcgaccggccagcttaacatgaacccgggcactaccagcggtaacacggccaccgctgaacgaagcagacaccaaagatctttctctgtccctaaaaaatttggagttatcgatcgcagctcagacccgccacggagcgctacacttgaccgcatacaggcctgcacccagcagggcctaagctcaaaaactaggtccagcagcagccttaaagactccctgaccgatccttcccacatcaatcacccaaccaacctcctcgctacgatattctgggtgactgtggctctgatggagtcggacttcgaatttgaatatctgatggcgctcaggttgctgagtaggcttctggcccacatgcccctggacaaggccgagaaccgagagaagctggaaaagctccaagctcagcttaaatgggcagatttttcagggctgcagcagttgctcctgaagggatttacgagcctgaccaccaccgatctgactctacagctgttctcattgctgacccccgtgtccaaaatcagcatggtggatgctagccacgccatcggcttccccctcaacgtactgtgtctcctgccacagctgatccagcactttgagaacccaaatcagttttgtaaggacattgctgagcgaatcgctcaagtctgtctcgaggaaaagaatccgaaactttctaatctagcgcacgttatgacactatataagacccattcatacacccgcgattgcgcgacatgggtgaacgtcgtgtgccggtacctgcacgaagcatacgccgatatcactctgaatatggtgacctacctggctgagcttctggaaaagggattgccaagtgtacaacaaccattattgcaagtcatttattcattacttagctatatggacctcagcgtcgtaccagtgaaacagttcaacgtagaagtcctgaagacgattgaaaaatatgttcaaagcgtccactggcgcgaggccctgaatatacttaaactggtcgtgtcccgttccgcttccttagtgctgccctcatatcagcattctgacctgtccaagatcgagatccacagagtttggacgtcggctagtaaagaactacctggaaagaccctcgactttcatttcgatatctctgaaactccaatcattggaaggagatatgacgaattgcagaactcctcaggtcgcgatggaaagccccgcgctatggctgtcactagatctacctcttctacctcaagtgggtccaattcaaacgtgttggtccctgtgtcatggaagcggccacagtactctcaaaaacgcactaaagagaaactagtgcacgtactatcactgtgcggacaagaagtgggcctgtcaaaaaacccttcggtgatcttctccagctgtggagacttggatttgctggagcatcagacctccttggtgtcgtccgaggacggtgcgcgggaacaggaaaatatggatgacacaaattcagaacagcagttccgcgtgtttcgcgactttgactttctggatgtggagctcgaagatggcgaaggcgaaagtatggataacttcaattggggcgtgagacgacgttcactggacagcctggacaagtgcgacatgcagattctcgaagagcgacagctgtccggaagtaccccctcgctcaacaaaatgcaccatgaagatagcgacgagagcagtgaggaggaggatcttacggcgagccagattctcgaacacagtgatttaatcatgaccctctcaccatcggaggagacaaacccaatggagttgctgaccaccgcgtgtgactccacccccgccgaaccccatagcttcaataccagaatgagctcctttgatgcctccctgcccgacatgaacaatctacaaatttctgagggctccaaagctgaggctgttcgagaggaggaagacacaacagtgcacgaagatgatctatccagcagcatcaacgagctgcccgctgccttcgaatgctcagattcattctctcttgatatgacggagggggaagagaagggcaacagagccctcgatcaattcacgctggcaagtttcggcgagggtgataggggagtctccccaccaccaagcccgttcttttcagcaatcttggccgcatttcagcccgcagcctgcgacgacgccgaggaggcttggcgatctcacattaatcaacttatgtgtgacagcgacggttcctgtgccgtctacacttttcacgtgtttagctcactcttcaagaacattcaaaagagattttgcttcctgacatgcgatgctgcttcttacttgggagacaatctgcgcggtatcgggagcaaattcgtgtcctcttcacagatgttgacgtcttgtagcgaatgccctacactgtttgtggatgcggaaactctcctctcttgtggccttctggacaagcttaagttttccgtgttggagttgcaggaatacctggacacctataacaaccggaaggaggctactctgagctggctggcaaactgtaaggcaacttttgcaggcgggtctagggacggagtgataacatgccaacccggcgactctgaggaaaaacagttagagctgtgtcaaaggctgtacaaactccacttccagctgttgctgttgtttcagagctattgtaagctgatcggtcaggtgcatgaggtgagtagcatgcctgagctgctgaacatgagccgggagctttcggatttaaagaaacatctgaaagaggcaagtgctgtgattgcagccgatccgctgtactcagatggagcttggtccgagcctacttttacttccactgaggcagccattcaatcgatgttggagtgcttaaaaaataatgagctaggcaaagcactgcgccaaatccgggaatgccgctctttgtggcccaatgatatcttcgggtctagtagtgatgatgaggttcagaccctgctaaatatatatttccggcatcagacccttggacagactggaacatacgcactggttggtagcaaccagtcactgactgagatctgcaccaaattaatggagctgaatatggaaatccgggatatgatacgaagggcacagtcgtatcgcgtgttgactactttcctcccagactctagcgtctcagggacgtccctatag

SEQ ID NO: 26415 - DNA, 3849 bp, Artificial Sequence
  Description of Artificial Sequence: Synthetic coding sequence
atgagcgctgttctatgctgcggcccagtgttcgataatgttggcctgtcaccagacggttacctctataagtggctggacaatatccttgcgtgccaggaccttcgcgtccaccaactgggctgcgaggtggttgtcctgcttctggagctgaaccctgatcagatcaacttatttaactgggctattgacagatgctacacaggcagttatcagctcgcgagtggctgcttcaaggccatcgcaaccgtatgtggcagtcgtaactatccttttgacattgtcacgctcctgaacttggtactttttaaggcatcggacactaaccgcgagatctatgagatttcaatgcaactcatgcagatcttagaggccaaattgtttgtgtactctaaaaaagtggcagagcagcgtcctgggtccatcctttacggaacacatggtcctctgcctccactctacagcgtgtcccttgcgcttctttcatgtgagttggcacgcatgtacccagaattgactctccctctcttttcaggaaagcctgcaatccctcataatacaccacagagggcacccgatcacgcctacctcccagccgcactggccgcccagcacagggcaggtgggcaacaggctccacctccagggtccccatcttccccggaggatgaggttaaggatagagagggcgatgttaccgccagccacggccttaggggcaacgggtggggcagtcccgaggctacatcgcttgtgcttaacaatttaatgtacatgacagcaaagtacggtgacgaagtgccagggccggagatggagaacgcctggaatgcattagctaataacgagaagtggagcaacaatcttcgaattacactgcagtttctcatctccctgtgcggcgtctcatcagatacagttttactgccgtatatcaagaaggtggccatctatctgtgcagaaataacactattcagactatggaggagctgctattcgagctgcaacagaccgaaccggtcaatcctattgttcagcactgtgacaatccccctttttatcgtttcacggctagttccaaggcaagtgcagcagcttctgggacaaccagctcctctaacacagtcgtcgccgggcaggaaaattttcccgatgccgaggaaaataaaattctaaaggaatcggatgaacgctttagtaacgtaattagagcacataccaggctggaatcccggtactctaactcttctggaggctcctacgacgaagacaagaatgaccccatcagtccttataccggatggcttctgacgataacagagaccaaacagccacagcctcttccaatgccatgcaccggcgggtgctgggctcctctcgttgactatctcccagaaactattactcccagaggaccactgcaccgttgtaatattgcggtaatcttcatgaccgagatggtcgttgaccactctgttcgggaagactgggccctccatctgccattgttgctccacgctgtgtttctggggttagaccactaccgccctgaggtgtttgaacactcaaagaaactgttacttcaccttctcatcgcactttcctgtaattcaaatttccacagcatcgcttcagtgttactgcagaccagggaaatgggtgaggctaagactcttacggtccagccagcataccagcccgagtacttgtacactgggggctttgactttttgcgagaggaccagagcagccctgttcccgactctggactatccagctcctctacctcttctagcatatctcttggtgggtcaagtgggaacttgcctcaaatgactcaggaggtggaagatgtcgacacagccgccgagaccgatgagaaagcgaacaagcttattgagtttcttaccacacgagctttcggcccgttgtggtgtcacgaggacattacgcctaaaaaccagaacagcaagagcgccgaacagctcacgaacttcctgcgacatgtggtctcagtttttaaggattccaagagtggatttcatctagaacatcagctgagtgaggttgcactgcaaacagcgttagcatccagctctcggcactacgctggacgctccttccagatctttcgcgctctgaagcagcctttgtcagcccacgctcttagcgatctcctctctagactggtggaagtgatcggcgagcacggcgacgaaatccaggggtatgtcatggaggccctactgaccttggaagccgccgtcgataacctttccgattgccttaagaactccgatttgctcacggtccttagtagatcttccagcccggacctttcgagcagctcaaagttgaccgcctcccgaaagtctactgggcagttgaacatgaatccagggacgacctcaggaaataccgctacagcagagaggtcgcggcaccagcgatctttctcagtgccaaaaaagtttggagtgattgatcggtcgagcgatcccccgagatctgccactctggatagaatccaggcatgtacacagcaaggtttgtcctccaagacccgctcaagctcctcgctgaaagacagcctgaccgatcccagtcatattaaccacccgacgaacctgctcgccaccatcttttgggtgacagtcgctctgatggagagcgactttgaatttgaatacctcatggcactaaggctcctgtcaagattactggctcacatgcctctagataaggctgaaaacagggagaagctggagaagctgcaagcccaacttaaatgggccgacttcagcgggctgcaacagttgctgctcaaaggcttcacatcactcactaccactgacctcactttacagctgttcagtctcttaacgccagtctctaagatcagtatggtggacgcttcacacgctattgggttccctctgaatgtcctgtgtttactcccgcagttgatccagcattttgaaaatcccaatcagttttgtaaagacattgccgaaagaattgcccaggtatgcctcgaggaaaaaaatcccaaattgagcaatctggcgcatgtgatgacgctgtacaagactcatagctacacaagagactgcgcaacatgggtcaacgtcgtttgtaggtatcttcacgaggcatatgccgatattactctcaatatggttacttacttggcagagctgctggagaagggcctcccctcagtccagcagcccctgctgcaggtgatctatagtttactttcttacatggacctctctgtggtcccagtgaaacaattcaatgtggaagtccttaagactattgagaaatatgtccagcacagcgatttgtctaagattgagatacacagagtgtggacctcggccagtaaggagctgcctggcaaaactttggactttcatttcgatatatccgagaccccgatcatcggcaggcggtacgacgaattacagaattcctcaggacgcgacgggaagcctagggccatggccgtcacgcgctccacatcaagcacctcatccgggagtaatagtaacgttctcgttcctgtttcctggaaacgaccccagtactcacagaaaagaacaaaggagaagctcgtgcatgtgctgtcactctgcggccaggaggtgggccttagcaagaatccctccgtgatctttagtagttgcggcgatctggacctgttggagcaccagacgagtctcgtgtcctcggaggatggtgcgagggaacaggagaatatggatgatacgaactctgaacagcaattcagggtatttagggattttgactttctagacgtcgaattggaagatggggaatag

SEQ ID NO: 26416 - DNA, 453 bp, Artificial Sequence
  Description of Artificial Sequence: Synthetic coding sequence
atggaaatcacaactgcatgctggcggcggtcttgtgtgatttcttttatcaaagggctagccagccccgttgggaatggatacattaagcctcctgttccacccgcatctggcacgcatcgtgaaaaggggccgcccaccatgctgcctatcaacgtcgatcccgattccaagcccggcgaatacgtgctgaaatcactctttgtcaacttcactacacaggccgaacggaagatcaggatcataatggccgagcccctcgaaaaacccctcacaaagagcctccagcgcggcgaagacccccagttcgaccaagtgataagctccatgagctcactgagcgaatactgcctgccaagcattctgcgcactctgtttgattggtataaacgccagaacgggatcgaggacgagtctcacgaatataggcctaggacctctaataaatcctag

SEQ ID NO: 26417 - DNA, 1152 bp, Artificial Sequence
  Description of Artificial Sequence: Synthetic coding sequence
atgaccgagggggaggagaaagggaaccgcgccctggatcagttcaccctggcaagttttggtgagggagatcgcggagtgtcaccacctcctagtcctttctttagtgcaattctggcagcctttcagcctgcggcatgcgatgacgctgaggaagcctggcgctcccatataaatcagctgatgtgcgactctgacggatcttgcgcagtatatactttccatgtattttctagcctttttaagaacatccagaaacggttttgctttctgacatgtgacgcagcttcctaccttggcgacaatctgcgcgggatcggtagcaagtttgtgagctcaagccaaatgctcacgtcttgctctgaatgccccacgcttttcgtcgatgcagagactctgttatcctgtggcctgctggacaagctgaagttctccgttctggagctgcaggaatacttggatacctacaacaataggaaggaggctacgctcagctggctggctaattgtaaggccacttttgcgggcggctctcgcgatggcgtgatcacttgtcaaccgggcgatagtgaagaaaaacagctagagttgtgtcagagattatacaagctgcactttcagcttctcctcctatttcagagttattgcaaactgattgggcaggtacacgaggtgagttccatgcccgaactcctgaacatgtcacgggaactgtctgatctgaagaaacacctgaaggaagctagtgctgttatcgcagcggaccccctgtacagcgatggggcctggtctgagccaactttcacatccactgaggctgccattcaaagcatgctggagtgtctgaagaataacgagcttggaaaggctctgaggcagataagggaatgccgctccttgtggcccaatgacatctttggatcctcaagcgatgacgaagttcagactcttttgaacatctactttagacaccaaactctgggtcagacgggaacttacgcactggtcggaagtaaccagagcctgaccgagatctgcaccaagctcatggagctcaatatggagatacgggacatgattcggcgtgcgcagtcatacagagtgctgacgacatttctgcctgacagttcggtgtcggggacatcgctatag

SEQ ID NO: 26418 - DNA, 270 bp, Artificial Sequence
  Description of Artificial Sequence: Synthetic coding sequence
atggagcgcgttactttagcgctcctcctcctggcgggacttactgcccttgaagccaatgacccttttgcgaacaaggacgacccattctattatgactggaaaaacctacaactgagcggtctcatttgcggaggcttgcttgccatcgccgggattgccgccgttctgagcgggaagtgtaaatgcaaaagtagtcagaagcagcactccccagtccctgagaaagctatacctctgatcacacccggctccgcaaccacttgctag

SEQ ID NO: 26419 - DNA, 270 bp, Artificial Sequence
  Description of Artificial Sequence: Synthetic coding sequence
atggaacgggtcactttggccctcctcctcctggctggcctgactgcgttggaagcaaacgaccccttcgccaacaaagacgacccattttactacgactggaaaaacctccagttatccggactgatttgcgggggcctgttagcaattgctggaatcgccgccgtgctttctggaaaatgcaaatgtaagagctctcagaagcaacacagccccgtgcctgagaaagctatcccactcataactcctggatctgctacaacctgttag

SEQ ID NO: 26420 - DNA, 2340 bp, Artificial Sequence
  Description of Artificial Sequence: Synthetic coding sequence
atgctgactaaccttcggatctttgcaatgtcacatcagacaataccctccgtctacatcaacaatatttgctgctacaaaatccgggcttcattaaagcggctcaaaccccacgtacctcttggtaggaattgctctagcctgccaggcctgataggaaacgatatcaagtcactgcactccatcattaaccccccgattgccaaaatccgcaatatcgggattatggctcatatagacgccggtaaaacgaccaccactgagcggatactttattacagcgggtatactcgtagcctcggcgacgtggacgacggcgacactgtgacagattttatggcacaggaaagggaaagaggtataactatccagtcagcagcggtgacattcgattggaaaggttatagagtgaatttgattgatacaccaggtcacgtggacttcaccttggaagttgaacgctgcctacgcgtactggacggagccgtagccgtgtttgacgcgagtgctggagttgaggcccaaacacttactgtctggaggcaggcggataagcataacatccccagaatctgtttcttgaacaagatggacaagacaggggcgagcttcaaatatgccgtggagagcattcgagagaagttgaaggctaaacccctcctgttacaactgccaatcggtgaggctaagaccttcaagggagttgtggacgtcgttatgaaagagaaattactgtggaactgcaactcaaatgacgggaaggacttcgaaagaaagccactgttggaaatgaacgatccagagttactgaaggaaacaaccgaggcgagaaatgcactaatagagcaggtggccgacctcgatgacgagttcgcagacttggtgctcgaagagttcagcgagaacttcgatctccttcctgcagagaaactgcagaccgcaatccatcgggtgaccctcgcgcagactgcagttccagtcctctgtggttcagccctaaaaaacaaggggatacagccactgctggacgctgtcactatgtatctgcccagtcctgaagaaaggaattatgaatttctccagtggtacaaagatgacttatgtgcacttgcatttaaggtactgcatgataaacagcgaggcccattggttttcatgcgtatctattcgggcacaatcaagccacagctggcaatccataacatcaatggcaattgcaccgaaaggatcagccgccttctgttgccttttgctgatcagcacgtggagatcccgagtctgactgctgggaatatcgcactgacagtcggtctgaaacatacagcaactggtgatactatcgtctcctcgaagtcctcagccctggcggctgccaggagagctgaacgcgagggggaaaagaagcaccgccagaacaatgaagcggaaagactcctcctggcaggcgtggagattccggaacccgtgtttttttgcaccatcgagcctccgtcactgagtaaacagccagatttggaacatgctttgaaatgcctgcagcgggaagaccccagtctgaaggtgagactggaccccgattctggccagacagtgctgtgtggcatgggtgagctccacatcgaaatcattcacgacagaatcaagagagagtacggcttagagacatacttaggtcctctgcaggtggcctacagggaaaccatcctgaatagcgtgagagctaccgacactctggatagaactcttggggacaaacgacacttggtgacggtcgaggtagaggcaagacccatcgaaacctcctctgtcatgcccgtcatcgaatttgagtatgctgaatccatcaacgagggattgctgaaggtttcacaggaggccatcgagaacggtatccactcggcatgcctccagggccctctgctcgggagccctatacaggacgtagctattacgctgcactctcttaccattcaccctggaacctctacaactatgatttctgcatgcgtgtcccggtgtgtgcagaaagctctgaagaaggccgataaacaagtgctggagcctctgatgaatctggaagttacagtcgcccgggattacctttcacctgtgctggcggatctggcacagcgacggggaaatattcaggagattcaaactcggcaggacaataaagtcgttataggctttgttccattggctgagataatggggtactccaccgtactcagaacattaacatcaggcagcgcgacatttgccctggagctctcaacttaccaagccatgaatcctcaggatcagaacacgttgctcaaccgaaggtcaggtctgacgtag

SEQ ID NO: 26421 - DNA, 2199 bp, Artificial Sequence
  Description of Artificial Sequence: Synthetic coding sequence
atgcttaccaatcttcggatatttgccatgagtcatcaaacaattccatcagtgtatatcaacaatatttgctgttacaagattcgggcgtccttgaagaggctcaagcctcatgtgcccctgggccgcaactgcagttcactccctggactgattggcaatgatatcaagagcctacactccatcataaatccacccattgctaagatacggaacatcggcatcatggcacacatcgatgccggtaagacaacaactactgaacgaatcctctattacagtgggtacacacggtcacttggggatgtcgatgatggagacacagtcactgattttatggcccaggagagagaaagagggataaccatccagtccgctgccgtcacttttgactggaagggctacagagtcaatttgattgacacgcctggacacgtggactttactctggaagtagagcgctgtctccgagtattggacggagctgtagctgtttttgacgcctctgccggggtggaggctcaaaccctcacggtgtggcgccaggccgacaagcataacattccacggatctgtttccttaataagatggacaaaacaggagcctcattcaaatacgccgtagagtccatccgagagaagttgaaagccaagcctctgctgttgcagctgcccattggtgaagctaagacctttaaaggtgtcgtagatgtggtgatgaaagaaaagctactctggaactgcaattcaaatgacgggaaggatttcgaaaggaagcctctgctggagatgaatgaccccgagcttctgaaggagaccaccgaggctcgaaatgcactcatcgagcaggttgcagatctagatgacgaatttgccgatcttgtcctagaggagttcagcgagaatttcgatttgctgccagccgaaaagctgcagactgcaatccatagagttaccttagcccagactgcagtaccagtcctgtgcgggtctgctttgaaaaacaaagggatccagcctctcttagacgccgtaaccatgtatctgcccagtcctgaggagcggaattacgaattcctagaaaggatctcccggttattattaccgttcgccgaccagcacgtggaaatcccctccttaaccgccggcaacatcgccttgactgtgggactgaaacacacagcaaccggagacacaattgtgtcttccaagtctagcgccctcgcggctgcacggcgtgccgaacgcgaaggggaaaaaaaacaccgccaaaacaacgaagcagagaggcttttgctggctggggtagagattccagaaccagtctttttctgcactattgaacccccttccctgagcaaacaacctgatctagaacacgcactgaaatgcctccagagggaagacccaagcctgaaggtcaggttagacccggatagcggccagaccgtgctgtgcggcatgggcgagctccatatagaaattattcatgaccgcatcaaacgggagtatgggcttgagacctacctgggacctctacaggtggcctacagggaaaccatcctgaattcagtaagggccactgatacccttgaccggaccttgggcgataaaaggcatctagtgactgtcgaagtggaggcccgcccaatcgaaacatctagcgttatgccagtgattgaattcgaatacgccgagagcataaacgagggccttctgaaggtaagccaggaggctatcgaaaacggcatccatagcgcatgtctccagggccccctcctaggatctccaatccaggacgtcgccattactctccactcccttaccatccaccctgggacatcaactactatgatcagcgcatgtgtgagccgctgcgtgcagaaagctcttaaaaaagcggataagcaagtccttgaacccttaatgaatcttgaagtgacagtggctagggattatctctcacctgtcctcgccgatcttgcgcaacggcggggcaacatacaagagatccagacaagacaagacaataaggtggtgattggattcgtccctttagctgagatcatgggatattcaaccgttttgaggactctgaccagcggatcagctacattcgcactggagctgtcaacctatcaggcgatgaacccccaggaccaaaataccttgctgaaccggagaagcggactgacttag

SEQ ID NO: 26422 - DNA, 1542 bp, Artificial Sequence
  Description of Artificial Sequence: Synthetic coding sequence
atgctgacaaaccttagaattttcgcaatgtctcaccaaaccatcccgtcagtctatattaacaacatctgctgctataagatccgcgcctcactgaagcggctcaagcctcacgttcctctgggcaggaattgctcctcacttcctggcttgatcggcaacgatatcaaaagtcttcacagcataatcaaccctccgatagcaaagatcaggaatatcggcatcatggcgcacattgacgctggtaaaacgaccactaccgagcggatcctgtactatagcggatacacgcgctcccttggcgatgtggacgatggagataccgtcacagactttatggcccaggagagagaacgcgggattaccatacagtccgctgcagtaactttcgactggaagggctacagggtgaacctcattgatacccccgggcacgtcgactttaccctggaggtggagcgctgtttgcgagtcctggatggcgcagtggcggtctttgatgcctcggctggtgtcgaagcacagacccttacagtctggagacaggctgataaacacaacatccccagaatttgctttctcaataagatggataaaacaggtgcaagctttaaatacgccgtcgagagtatcagagagaagttgaaggctaaaccccttcttcttcagctgcccatcggggaggcaaagaccttcaaaggcgttgtagatgtggttatgaaagaaaaactgctgtggaattgcaatagcaacgacggtaaagattttgagcgcaagccactcctcgaaatgaacgatcccgagctgcttaaagagacaaccgaagccaggaacgcccttattgagcaggttgcagaccttgatgacgagttcgctgatctggttctggaagagttcagcgaaaattttgacctgctgcccgcagaaaaattgcagactgcgatccatagagtcacactggcccaaacagcagtgccagtcctctgtggcagcgcccttaaaaacaaggggatccagcctctgctggacgcggtcactatgtaccttccaagccccgaagagcggaattacgaattcctgcagtggtacaaggatgacctttgtgcccttgctttcaaagtactacatgacaaacagaggggccctctggtgttcatgcgtatctatagtggtacaatcaagccacagctagccatccataatattaatgggaattgtactgaacgtatctccaggctgctgctgcccttcgcggatcagcacgtggaaatacccagcctgacagcgggcaacatcgccctcaccgtgggcctaaagcatactgctaccggcgataccatcgtttcatcgaagagctccgctctggcagccgcgaggagggccgagcgagaaggtgaaaagaagcacagacagaacaatgaggctgaacgcctcctcctggcgggcgtcgaaatccctgaaccagtattcttttgtacaattgaaccccctagtctctctaaacagcccgggatcaatggtctgtccgtctccaccaactag

SEQ ID NO: 26423 - DNA, 2340 bp, Artificial Sequence
  Description of Artificial Sequence: Synthetic coding sequence
atgctaacgaatctcagaatcttcgctatgtctcaccagaccatcccctcagtgtatatcaataacatttgttgttacaagatcagggctagtttgaaacgcctcaagccccacgtgccgcttggcaggaactgtagttctttgcccggactgatagggaacgatattaagtccttgcatagcatcatcaatccccctattgccaagattaggaatattggaattatggctcatatcgacgcaggaaagactacaacaaccgagcggattctctactactctggatataccagatcgctgggcgacgttgatgacggagacacagtaacagattttatggcacaggagcgtgaacgagggatcaccattcagtctgccgctgtcaccttcgattggaaaggctaccgcgttaatttgatagacaccccggggcacgtggattttactcttgaggtggagagatgtctccgcgtactagacggggccgttgccgtgtttgatgccagtgctggcgtagaggcccagaccttgactgtgtggaggcaggccgataagcataacattccacggatatgcttcctgaacaagatggataaaacaggagcttcctttaagtacgccgttgagagcatcagagaaaaactgaaggccaaaccgctgctgctccaactccctatcggcgaggctaagacattcaagggagttgtggacgttgtaatgaaggagaagctgttgtggaattgtaatagcaacgacggaaaggatttcgaacggaaaccactgctagagatgaacgacccggagctgttaaaagagaccaccgaggcacggaacgccctgatcgaacaggtcgccgacctcgatgatgagttcgctgatcttgtgttggaggaattcagcgaaaattttgacctgctcccagccgaaaaactccagaccgccatccaccgggtgacactcgcacagacagcagtgccggtgttgtgtggcagtgcactcaagaataagggaattcagcctctgctggacgctgttaccatgtacctcccctctcccgaagaacgaaactatgaattcttacagtggtataaggacgatctctgcgccctagcttttaaagtgctgcacgataagcagagaggcccactggtgttcatgaggatctatagtggcactatcaagccccagctggctattcacaatattaatggcaattgtactgagaggatctctagactgcttttgccctttgccgaccaacacgtagaaataccaagcctgacggccggaaatattgcgctgacagtaggattgaagcacaccgctaccggcgatactattgtgtcatctaagtcaagcgccctcgcagccgctcgccgcgcggaaagagagggggagaagaagcaccgccaaaataacgaggcagaacgcctcttgttagccggtgtcgaaattccagaaccagtgtttttctgcacaattgagccccccagcctgagcaaacagccagacttagaacatgctctgaagtgcctgcagcgagaggatccatccctgaaagtgcgcctggacccggatagcggccagacggtcctgtgtggtatgggagagctccatattgagatcatccatgaccggatcaaacgcgaatacggcctagaaacttatttggggcccttacaggtggcctacagagagactatcctgaacagtgtgcgggccacagacactctggaccggacactgggtgataaaagacatctcgtgaccgtcgaggttgaggcccgccccatcgagacctccagtgttatgcctgttatcgagttcgaatatgccgagagcattaatgagggactcctcaaagtatcgcaagaggcgattgaaaacgggattcacagcgcctgcctccagggtcccttgttaggatcaccaatccaggatgtggccatcactcttcactctttgactattcatcctggcacaagtactaccatgatttcagcatgcgtctcaagatgcgtgcagaaggccctgaaaaaggcggacaagcaggtgctcgaaccgttgatgaatctggaggtcaccgtggcacgagattacctaagcccagtattagccgacctcgctcagaggcgtgggaacatacaggagatccagactcgacaggataataaagtggtgattgggttcgtcccactggctgagatcatgggctactctacagtgctgagaacactgacctcaggaagcgcaacatttgccctcgagttatccacgtaccaggccatgaatcctcaggatcagaatacgctcttgaaccggcgatcaggtctgacgtag

SEQ ID NO: 26424 - DNA, 1806 bp, Artificial Sequence
  Description of Artificial Sequence: Synthetic coding sequence
atgctgactaatttgcgcattttcgccatgagccaccagactatcccttccgtgtacattaacaacatctgttgttacaagattagggccagtctcaaacgcctgaagccacatgtgcctctcggccgaaactgtagctctctgccaggcctgattggtaacgacattaagtcgctgcatagcatcattaaccctcctatcgccaagattagaaacataggaatcatggctcatatcgatgcgggcaaaactactacaactgagaggattctgtactactctggttacacgcggtcgctcggagacgtcgacgacggtgatacagttacagactttatggcgcaggaacgtgaaaggggaatcacaattcaatcagctgccgtcacatttgactggaaagggtaccgagtgaatctgatagataccccgggacacgtggatttcactctggaggtcgaaaggtgtctgcgcgtcctcgatggggccgtggccgttttcgacgccagcgccggggttgaggctcagacgctgacagtgtggcgccaggctgataagcacaatattccccggatctgtttcctaaacaaaatggacaagaccggcgcgagttttaaatacgcggttgaaagcatccgagagaagcttaaggccaagcccctgttgctgcaactgccaataggcgaagccaagacatttaagggggtggtggacgtagttatgaaggagaagttgttgtggaattgcaatagcaacgacggcaaggacttcgaacggaagccgcttctggaaatgaatgaccccgagctgcttaaggagacgaccgaagcacggaacgctctgatcgagcaggttgcggacttagacgatgagtttgcggatctggttctcgaagagttctctgagaatttcgatttgctccctgccgaaaaattacagactgccattcatagagttaccctcgctcagaccgctgtccccgtcctatgcggaagtgccctgaagaacaaaggcatccagcccctgctagatgccgtcacgatgtatctcccctcgcccgaggagagaaactacgaattcctgcagtggtacaaggacgacctgtgcgccttagcctttaaagtcctgcatgacaaacaacggggaccgcttgtgtttatgagaatttattctgggactattaagccacagttggcaatccacaatatcaacgggaattgcacggaaaggatctcgaggctacttctcccatttgccgatcagcatgtggagattccctcactcacggccggcaatatcgctcttaccgtgggactcaaacacacagcgactggagatacaatcgttagcagcaagtctagcgcactggctgctgctcgaagagcagagcgagagggcgaaaagaagcaccgccagaataatgaggccgagcggttgctactggcaggggtggagatccccgagccagtgttcttctgcactatcgaaccgccatccctcagtaagcagccagatctagagcacgctcttaaatgcctgcaaagggaggatccttctctgaaagtccggctggatcccgactcgggccaggtggcgcagaggaggggtaatatccaggagatccagacaaggcaagataataaagtggtgattggttttgtcccattagcagaaatcatgggctactccaccgtcctgcgcacactgacttccgggagcgccactttcgccctggagctctcgacgtaccaagctatgaatccccaggatcaaaatacgctgcttaaccggcggagcggtcttacgtag

SEQ ID NO: 26425 - DNA, 948 bp, Artificial Sequence
  Description of Artificial Sequence: Synthetic coding sequence
atggcatccgccgtattgtctagtgtacccacaaccgcaagcagattcgcactgctacaggtagactctgggtcaggtagcgactctgaaccaggcaaggggaaaggtagaaacactggaaagtcccaaaccctggggagtaagtctaccaccaatgagaagaagagagagaagcgccgcaagaagaaagagcagcagcagtccgaggccaacgagctccgtaacctggcttttaaaaagatcccacagaagtccagtcacgctgtgtgcaatgcccagcacgatcttccgctttcaaatcctgtacaaaaagactcccgcgaggagaactggcaggaatggcgccagagggacgaacagctcacaagcgaaatgttcgaagccgatctagagaaagcattacttctgagcaagttggaatacgaggaacacaagaaagagtacgaagacgccgagaacacctccactcagtccaaggtgatgaacaaaaaggacaaacggaagaaccatcaggggaaagacagaccactaacagtgagcctgaaggatttccatagcgaagaccacatctctaagaagacagaggaggtcgtgctcaaggacggaagaatcgaacgtttgaagctcgagttggagcgcaaggacgcagaaattcaaaaactgaagaatgtaatcacccaatgggaggccaagtacaaagaggtcaaggcccggaacgctcaactgctgaaaatgttgcaggaaggcgaaatgaaggataaagcagaaattctcctgcaggtcgacgagagccagtcaattaagaacgagctgacgatacaagtgacatcactgcacgctgctctggagcaggagagatctaaggtcaaagtcctgcaggctgagttggccaaataccagggaggtagaaaaggaaaacgaaactccgaaagcgatcagtgcaggtag

SEQ ID NO: 26426 - DNA, 1101 bp, Artificial Sequence
  Description of Artificial Sequence: Synthetic coding sequence
atggcttctgcggtactgtcctctgttcccacgacagcttcacggtttgccttgctccaggtggacagcggctccggctcagatagtgagcctggaaaagggaaaggcaggaatacgggtaagtcccagactttgggctccaagtctaccaccaacgaaaagaagcgcgaaaagaggcgcaagaagaaggagcagcaacaatcggaagctaacgagctgagaaatttggcattcaagaagatacctcagaaatctagtcatgccgtgtgcaatgcccaacacgacctgccactgtccaatccagtgcaaaaggactctagggaggagaattggcaggaatggagacaaagggacgaacagctgaccagcgaaatgttcgaagcggacctagaaaaggcgctgctgctttcaaagctggagtacgaagagcacaaaaaagagtatgaggatgccgagaacacttctacacagtcaaaggtgatgaacaagaaagacaagcggaagaaccaccagggcaaggacaggccgctgaccgtgagcctgaaggactttcactccgaggaccatatttcaaagaaaaccgaggagctatcaagttcacagacactgtcccacgatgggggattcttcaaccgtcttgaagatgatgtccacaagatactcattcgcgagaaacgccgggagcagcttaccgaatacaatgggaccgataactgtaccgcccacgagcacaaccaagaggtcgttctgaaggacggcaggatagaacgactgaagctggaattagagcgtaaagacgctgagatccagaaattgaaaaacgtgatcacgcaatgggaggcgaagtataaggaggtcaaagcgcgtaatgcccagctactcaagatgttgcaggagggcgagatgaaggataaggctgagattcttctgcaggtcgacgagagtcaatcaattaaaaacgaactgacaatccaggtgaccagtttacacgccgcactggagcaagagagatctaaggtcaaggtgcttcaggctgagctcgccaagtaccagggaggccgaaaaggcaagcggaatagcgaatccgaccagtgccgctag

SEQ ID NO: 26427 - DNA, 381 bp, Artificial Sequence
  Description of Artificial Sequence: Synthetic coding sequence
atggcctctgctgtactgagctccgtgcccacaactgccagtaggttcgctctgcttcaggtcgacagtgggagtggaagcgactctgaacctggtaaagggaaaggaaggaacacagggaagtcacagacgctgggtagcaaatccaccaccaacgagaagaaaagggagaaacgtagaaaaaagaaagagcagcaacagtctgaagctaacgagctgaggaacttagcattcaagaagattcctcagaagagctcccacgccgtttgcaatgctcagcatgatctgccattgtccaatcccgttcagaaggatagtcgcgaagagaattggcaggaatggcggcagagggatgagcagatgggcagccggcggcaatag

SEQ ID NO: 26428 - DNA, 165 bp, Artificial Sequence
  Description of Artificial Sequence: Synthetic coding sequence
atggcgtcagccgttctgtcctccgtccctacaactgcctcaaggttcgctctcctgcaagtcgacagcggaagcgggagcgactcggagcccggtaaaggaaaaggtcggaacaccggtaaaagtcagacgctggggagtaaatccacaactaatgagaagtag

SEQ ID NO: 26429 - DNA, 3027 bp, Artificial Sequence
  Description of Artificial Sequence: Synthetic coding sequence
atggacaccgccgaagaccctgcctggctgcagctgctccagaaagactcttcccctcctggacctaggcccaccgccttcttctgtccacaggatggatccctgggagctggatcctcagcaatgagggactactgcccctcacagcagaaagcatcaccagcccccccgcgacacaccccagatcagagcccaggcatggaaagtaggcatcgcagtccctcaggcgcaggggaaggtgcctcctgttcagacggacctagaggaagcctggcatgcccatccccgacatgtttctcaccgcaggagtctcccagcaaggagactttagaggcccatggtgccagcatcagcggaacgcctgaggcaacgaccagcgggaagccggaaccagtcagttctgtcaaaacagagccaaagtcctcagatgaccgaaatcctatgttcctggagaaaatggatttcaaaagttccaaacaagccgattccacctcaatcgggaaagaagacccaggatcatcccgaaaggcagacccaatgttcaccgggaaagccgagcctgaaattttgggtaaaggagacccggtggcccccgggcgaatggacccgatgaccgtcagaaaagaggacctggggtcactgggaaaagtggatcccctgtgctcatctaaaacatataccgtgtcccctcgtaaagaggacccaggatctctccggaaggtggaccctgtaagtagcgacaaggtggaccccgtgttcccgaggaaagaagaacctaggtacagtgggaaagaacacccagttagcagcgaaaaggtggctcccacatcggcagagaaagtggatctggtactgtctgggaagagagacccaggcccatcaggaaaagccgaccccatgccccttgaaagtatggattctgcttccacaggcaagactgagcccgggcttctcggaaagttaatacctgggtcctcgggcaagaatgggccagtgtctagtggcacgggagccccaggaagcctcggaagactggatccgacgtgtttaggcatggctgatccggcctccgtgggcaatgtggagaccgtgcctgcgaccaaagaggactcacgatttctgggcaaaatggatccggcctcctctggagagggaagacccgtgtccggccatacagacaccacggcctccgcaaagacagatctcacaagtctcaaaaatgtggaccctatgagctctggtaaggtggatccagtgtctctggggaaaatggaccccatgtgcagcggcaaaccagaattgttgagccccggccaggccgagagggtgagcgtaggaaaagcaggtacggtctctcctggaaaggaagaccctgtgagctcccgcagagaggaccccatctctgcaggaagccgcaaaacctccagcgaaaaagtgaaccctgagagcagcggtaaaaccaatcctgtctcaagtggtcccggagatcctcggagcctgggaacagcaggacctccctccgccgttaaagcagaacccgctacaggggggaaaggcgaccctctcagctctgagaaggcgggcctggtggcctcaggcaaggccgctcccacagcatcaggaaaggctgagcccctcgccgtaggcaaggaggatcctgtgtcaaagggcaaagccgatgcaggcccctccggccagggggacagcgtgagcataggaaaagttgtgtcgactcccggcaagaccgtcccggtgcccagcggaaaagtcgatcctgtgtcgctagggaaagcagaagctatccccgaaggcaaagttggatccctgccacttgagaaaggaagccctgtaactactactaaagcggacccacgcgcttctggcaaagcccaaccgcagagcggcggaaaggccgagacaaagctccctggtcaggagggggctgcagcccctggggaagcaggagcagtgtgtcttaaaaaagaaacacctcaggcttctgaaaaagtggacccgggtagttgccgtaaggcggagcccttagcaagcggtaaaggtgaacccgtgtcactggggaaagcggactccgcgccatccaggaagacagagtctccgtctctcggcaaagtggtgccgctgagcctcgaaaagaccaagccttccagttcatcacggcaactcgatagaaaggcccttggatccgcacggagccctgaaggggcccggggctctgaaggccgagtcgagccaaaagccgagcccgtcagcagcactgaggcatctagcttagggcagaaagacctggaagctgctggggcagaacgctcaccatgtcctgaagcagctgctcccccaccaggcccaaggactcgtgataatttcacgaaggcaccctcatgggaggcctcagccccgccccccccacgggaagacgcaggcacacaagccggagctcaagcctgcgtgtcagtggccgtatcccccatgagtccccaagacggtgcaggcggctctgcgttcagtttccaggccgcccccagagccccatcgccacctagcagaagggacgctggcctgcaggtaagtttgggggctgccgagactaggagcgtagcaacaggccccatgacgccacaagccgcagcaccgcccgccttccccgaagtcagagtgcggcccgggtccgctctggcggcagctgtggcaccccctgagccagcagagccggtgcgcgacgtgtcttgggacgaaaaagggatgacttgggaggtttacggagcggcaatggaggtcgaggtgctcggcatggccattcagaagcaccttgagagacaaatagaggagcatggaagacaaggtgcccctgcccccccacccgcagctcgggccggccctggcagatccggcagtgtccgaaccgcaccccctgacggcgccgccaagaggcctcccggactgttcagggccctgctacagagcgtacgaagacctagatgttgctctagagccgggccaacagctgagtag

SEQ ID NO: 26430 - DNA, 2397 bp, Artificial Sequence
  Description of Artificial Sequence: Synthetic coding sequence
atggatacagccgaagacccagcctggttgcagctgctacaaaaagatagcagcccgccagggccccggccaactgccttcttttgcccgcaggacgggagtttaggcgcgggctctagtgctatgcgggattactgtccctcccagcagaaagcgtctcctgctccaccaagacatacaccggaccagagtcccggcatggaatcccggcataggtcaccgtcaggggctggggagggcgcgagttgcagcgatggtccaagaggtagcctggcctgtccctcacctacatgctttagcccccaggaaagcccctcaaaggagaccttggaggcccacggggcttctatcagcggcactcccgaggcaactaccagcggcaagccagagccagtgtcctccgtcaaaacagagccaaaaagcagtgacgatagaaacccaatgtttctggaaaaaatggatttcaaaagtagcaagcaggccgattccacatccatcgggaaggaggatccaggatcttctcgcaaagccgacccgatgtttacaggaaaagccgagcctgagattctgggaaaaggagatcctgttgcccctgggaggatggaccccatgacagtacgcaaagaggatctaggctcgctcggtaaggtggaccctctatgcagctccaagacatatactgtcagcccaaggaaagaagatcccggaagtcttaggaaggtggaccccgtaagttcggacaaggtagatcccgttttccctaggaaggaagagcccagatattccggaaaggagcaccccgtgtcttccgagaaagttgcccccaccagcgctgaaaaagtggaccttgtgctttcagggaagcgcgaccccggacccagcgggaaggctgaccctatgccactggagagcatggactctgctagtacagggaagaccgagccagggcttctcggcaagctcattcctgggagttctggcaaaaacggtcctgtgtctagcggtactggagcaccgggttcactgggcagactggacccaacatgtcttggtatggctgatcccgcctccgtcggaaatgtggaaacagtgcctgcgacaaaggaagactcaagattcctggggaaaatggacccagccagcagcggcgagggacgcccggtatccgggcacaccgacaccaccgcctctgccaaaacagacctcacctccctaaagaatgtcgaccccatgtcgtccgggaaggtggatcctgtttcacttggcaagatggatccgatgtgttcgggaaagccagaactgctgtcaccagggcaggcagagcgggtctcagtgggaaaggcaggaaccgtttcccctggcaaggaggaccctgtgtccagtcgacgcgaggacccaatctccgcggggagtaggaagaccagctcagagaaggtcaaccccgagagtagcgggaagactaatcctgtgtctagtggccccggcgacccacggagtttggggactgcaggaccacccagcgcagtcaaggctgagcctgcaaccgggggtaagggagatcctctgtcttctgaaaaagctggattagttgccagcgggaaagctgcacctacagcctctggcaaagccgagccgctggctgttggcaaggaggaccccgtgtctaaaggtaaggccgacgctggcccctctgggcagggcgactctgtcagcataggaaaggtggtttcaactcctggcaagaccgtgcctgtgccttcaggcaaagtggatcctgtaagccttggaaaggcagaagccatccccgaaggtaaggtaggttctttgcccctggagaagggctccccagtgacaacaaccaaagcggacccccgtgcttctgggaaggctcagccacagagcggaggaaaagctgagacgaagctgcctggccaagaaggcgccgctgcccccggtgaagcaggtgccgtgtgtctgaagaaagagacccctcaggcttccgagaaggtagatcctgggtcctgtagaaaggccgagccacttgctagcggcaagggcgaacctgtgagcctgggtaaagcggattccgccccctccaggaagaccgaaagtccttcgctcggaaaggtggtgcccctctccctggagaaaactaaacccagttcctcctctaggcagttggatagaaaagctctcgggagcgcaagatctcctgagggggcccgggggtcggaaggtcgccaggccagtgcccggcctgtgccacgcgccgctgcagaatgtgcacctgctgccgtgttactggccggcggcacccatggacgcgtgatttgtccgcacttcgttcggccttccttccggcctagccaggccccatttctgatcaccggaccttag

SEQ ID NO: 26431 - DNA, 1659 bp, Artificial Sequence
  Description of Artificial Sequence: Synthetic coding sequence
atggcggccctggctcctgtcgggagccctgcaagccgaggccctcgactagctgccggattgaggctcctaccaatgctgggcctactccaactgttggccgaacccggtctcggacgggtgcatcatctggcattgaaggacgatgtgcgccataaggtgcacctcaacaccttcgggttctttaaggatggatacatggtggtgaatgtttcaagcctgtccttgaacgaaccagaagataaggatgtaactatcggtttctctctcgataggaccaaaaatgatggcttctcatcctatctggatgaggacgttaattactgcattcttaagaaacagtcagtgtcagtaaccctgctgatactcgatatcagcaggtcagaggtcagagttaaaagtccgccagaagctgggacacagctaccaaagatcatatttagtcgcgacgagaaagtactgggacaaagtcaggagcccaatgtcaatcctgctagcgccgggaaccagacacagaaaacacaagacggcggcaaatcgaaaaggtctacggtggactcaaaggctatgggtgagaagagtttctccgtccacaacaatggtggagccgtatcttttcaatttttttttaatatctcaaccgatgaccaagagggcctatactccctctatttccataagtgtttgggcaaagagcttccaagtgataaatttacattttccctcgacattgagattacagagaaaaatccagatagctatttatcagctggagaaatccctcttcctaagctatacatctctatggcgttcttcttttttctgtctggaacaatctggatacatatcctgagaaaaaggagaaacgatgtatttaagatccactggttgatggccgccctacccttcaccaaatctttatcgctcgtgtttcatgccatcgattaccactatatttcgtctcaaggatttccaatcgagggctgggcggtggtgtactacatcacacacttacttaagggtgccctgctgtttattactattgcccttattgggaccgggtgggccttcatcaaacatatcttgtcagacaaggacaaaaagatttttatgatcgtgattcccctgcaggtgttagcaaatgtagcctacataatcatcgaatcgactgaggagggaactacagagtatggactctggaaggactccctgttcctggttgatctcctttgttgcggggccatcctgtttcccgtcgtatggagtattcgacatctgcaggaagcgtctgcaaccgacggcaaagcagcgattaatttggccaagctgaaattgttcaggcactactacgtcctcatagtgtgctacatctacttcacacggatcatcgctttcctcctgaagctggccgtgccgttccagtggaagtggctgtaccaactgttagacgagaccgccacacttgtcttcttcgtcctcaccggctacaaatttagacccgcctctgataatccctatttacaactgtcacaagaggaggaagacttggagatggagagcgtggtaacaaccagtggagttatggaaagcatgaagaaagtgaagaaggttactaatggtagcgtggagccccagggagaatgggaaggcgccgtgtag

SEQ ID NO: 26432 - DNA, 1803 bp, Artificial Sequence
  Description of Artificial Sequence: Synthetic coding sequence
atggcagctcttgccccagttggatcgccagccagtaggggaccaaggctggccgctggcctccggctcctgcctatgctaggcttactacagttacttgcggagcctggcctgggtagagttcaccatctcgctttgaaggatgacgtccgccataaagtgcacctgaacacgtttgggttcttcaaggacgggtacatggtggtaaacgtttcctctctgtctctgaacgaaccggaagacaaggacgttacaattggcttttctcttgaccgcacaaagaacgatggctttagtagctatctggacgaagacgtgaactactgcattctaaagaaacagtccgtcagcgtgacactgctgattcttgacattagtcgatccgaagtgcgcgtcaaatcgccccccgaagcagggacccagctgcccaaaatcatttttagcagagacgagaaggtgctggggcagtcacaggagcccaacgtcaaccccgcgagcgcggggaaccagacacagaagacccaggatggagggaagtccaaaagaagcaccgtggattcgaaggccatgggcgagaagtcgttttcagtccacaacaatggaggagccgttagcttccagttcttttttaacatctctacagacgatcaggaggggctctactctctgtacttccacaaatgtctggggaaggaactgccgtcagacaaattcaccttttctttggatatcgaaatcaccgaaaagaacccagatagttatctttccgccggggagatccccctccctaaactttacatttccatggctttctttttctttctgagcggaaccatatggattcacatcctgaggaagcgcaggaacgatgtctttaagatccactggcttatggccgcattgcccttcactaaatcactctccctcgtcttccatgccatcgattaccattatatttcttcccagggattccctatcgaagggtgggctgttgtttactatataacacacctgctgaagggcgcattattgttcatcacaatcgcactcatcggtacagggtgggcgtttattaagcatattctctctgataaagacaagaaaatatttatgatcgtgattccattgcaagttctggcgaacgtagcatacattattatcgaatccacggaggaaggaacaactgaatacgggctctggaaggactctttattcctagtggacctgctttgctgcggtgctatccttttccccgtcgtgtggtctatacgtcatctccaagaagccagcgcaaccgacggaaaaggggactctatgggcccgttgcaacagagggccaacctcagggccggatccagaattgagtctcatcacttcgcgcaggccgatcttgaactgttggccagcagttgcccaccagcctctgttagccagagggccggtatcaccgcagcaattaacctagctaagctgaaacttttcagacactattacgtgcttatcgtgtgctacatttactttacgcgcattatcgcgtttcttcttaagctggctgttcctttccagtggaagtggttgtaccagctgctggacgaaacagcgactctggtgttcttcgttctcaccggatacaaattccggccagcctctgacaatccctatttgcagctcagccaagaggaggaagacctcgaaatggaatcggtggtcacgacctccggggtgatggagtctatgaagaaagttaagaaggtaactaacggcagtgttgaaccccagggagagtgggagggcgccgtttag

SEQ ID NO: 26433 - DNA, 1716 bp, Artificial Sequence
  Description of Artificial Sequence: Synthetic coding sequence
atggctgcacttgcgccggttgggagccccgccagtagaggccccaggctcgccgcaggactccgcctactccccatgctaggcctcttacaacttttggcggagcctggcctggggcgcgtgcaccaccttgctctaaaagatgacgtccgtcataaggtgcatttgaacacattcggatttttcaaagatgggtacatggttgtgaatgttagtagtttatctctcaacgagcccgaggacaaggacgttacgatcggattttctctggaccgtacaaagaatgacggctttagctcctacttagatgaggacgtgaattattgcattctcaagaagcagagtgtcagtgtaactctactgatactggatatctcaaggtccgaagtgcgggtcaaatctccaccagaagccggaactcagttgcccaaaatcatattttcaagagacgagaaggtgctgggacaaagtcaggaaccaaatgtaaacccagcaagtgccggcaaccagacacaaaagacacaagacggaggtaagtctaagaggtcgaccgtggattctaaggctatgggcgaaaaatctttcagcgtacacaataatggtggtgccgtgtctttccagttttttttcaacatctcgacagatgaccaagagggactttactcgctctatttccacaagtgcttgggcaaagagctgcccagcgataaattcactttcagtctggatatcgagataactgaaaagaaccccgacagctacctctctgctggtgagattccattgcccaaactgtatattagtatggccttcttcttcttcctgtccggaacaatttggattcacatcctacgaaaaaggaggaatgatgtttttaaaatccactggctcatggccgccttgccgtttactaagagcctgtctttagtcttccatgcaatcgactaccattacatcagctcacagggctttcctatcgagggctgggctgtggtctattatatcactcacttgctcaagggcgctttgctgtttatcacaatcgctctgataggaacagggtgggctttcatcaaacacatcttgtcggacaaggataaaaaaatatttatgatcgtcataccactgcaagtcctggccaacgtggcatatattatcattgagtctaccgaagagggtacaacagagtatggcctgtggaaagactcgttgtttttggtagacctgctgtgctgcggcgcgatcctgttcccagtcgtgtggtctattcgtcacctgcaagaagccagcgcaacggatggaaagggcgacagcatggggccactgcaacaacgagcgaacctgagagccggatctcggatcgcagccatcaatctagccaagctgaaactattcaggcactactacgttctgatcgtgtgctatatctactttacgcgtattatagcgttcttgcttaaactggccgttccttttcaatggaagtggctgtatcagctgctcgacgagaccgccactttagttttttttgtgctcaccgggtataagttccgaccagcatcagacaatccctatttgcagctgtcccaggaggaagaggatctcgagatggaaagcgttgtgacaacttctggggtgatggaatccatgaaaaaagttaaaaaagttactaacggatctgtggaaccacagggggaatgggaaggcgctgtgtag

SEQ ID NO: 26434 - DNA, 1140 bp, Artificial Sequence
  Description of Artificial Sequence: Synthetic coding sequence
atggccgcacttgcccccgttggcagcccagcctcacggggtccccgactggctgcaggcctacgactgctgcccatgcttggcctcttgcagctgcttgcggaacctgggctcgggcgtgttcaccacttagcactgaaagatgacgtgcggcataaggtccatctgaacacttttggttttttcaaggacggatacatggtggtgaacgtatcctccctgtcacttaacgagcccgaagacaaagatgtgaccattggctttagcctggaccgaacaaaaaacgacggctttagcagctatctggacgaagatgtcaattactgcatcctaaagaagcaaagcgtgtcagtcactttactgatcctggatatcagtcggagcgaggttcgcgtaaaatctccccctgaggcgggaacccagctgcccaagatcatcttttcacgggatgaaaaggtgctgggacagagtcaggagccaaacgtcaacccggcctctgctggcaatcagacccagaagacccaggacggaggtaaaagcaaaagatcaacagtagacagtaaggctatgggtgagaagtcattctccgtgcacaataacgggggtgccgtgagtttccagttcttcttcaacatcagcaccgacgaccaagagggtctgtacagcctatacttccataagtgtcttggtaaagagctgccctccgataaattcacatttagtctggatatcgaaattacagagaagaaccctgacagctacctcagcgccggggagatcccattgcccaagctgtatataagtatggcgttctttttctttctgtcgggtaccatttggattcacatactccggaagagacgcaacgacgtctttaagatccactggttgatggccgcactcccgttcacgaaatctcttagcttagtctttcacgcaatagactatcactacatttccagtcaggggttccccatagaaggatgggcagtagtgtattacattactcacttgctgaagggagccctgttatttatcacaattgccttgatcgggaccggatgggccttcatcaagcacatcctgtctgacaaagacaaaaaaatcttcatgattgtcattccactacaggttctctag

SEQ ID NO: 26435 - DNA, 1632 bp, Artificial Sequence
  Description of Artificial Sequence: Synthetic coding sequence
atggctgtgtcggaaagacgagggctcggccgcgggagtccagctgaatggggtcagcgactcctgctcgtgctgctgttaggtggttgctcggggagaatccaccagctggccttgactggagaaaaacgggctgacatacagctgaactcattcggtttttacaccaatggctcattggaggtagaactctccgtattgcgcctgggcttgcgggaagctgaagagaaaagcctcttggtcggattcagtctctcccgagtgcggtccggtcgcgtgaggtcctattcaacccgcgactttcaggattgtcccctccagaaaaacagtagttcgttcctggtgctctttctaattaacactaaggacttgcaggtccaggttagaaagtatggagagcagaagactctcttcatttttcctggcctgctacctgaagcaccatcaaagcctggcctaccaaaacctcaggcaactgtgccccgcaaagtggacggcggggggacctcagccgcgtctaagcccaaatctacaccagctgtgatacagggaccctctggaaaagataaggatcttgtgctcggtctgtcccacttgaataattcttacaactttagtttccacgtagtgattggctcccaggccgaagaagggcagtactctcttaacttccataattgcaataacagcgtaccaggcaaagagcatccctttgacattaccgttatgattcgcgaaaaaaatccagatggcttcctgtcagccgccgagatgccactttttaaactgtacatggtcatgtccgcgtgcttcctcgccgcaggcatattctgggttagtatcctgtgccgcaacacctattcggttttcaaaatccattggttgatggccgccctagcgtttaccaagtcaataagtctcttatttcactcaattaattactatttcataaacagccaagggcatcccatagagggcctcgccgtgatgtattatatcgcccatcttttaaagggagccctgctctttatcacaatcgccctgatcggatctggatgggcctttattaagtacgttctatcggataaagaaaagaaggtgtttggaatcgtgattcctatgcaggtcctcgcgaatgtggcctacatcatcatcgagtctcgggaggaaggggcttcagactacgttctgtggaaggagattctgttcttagtcgacctgatttgctgtggggctatcctcttccccgtcgtgtggagtatccgacacctgcaggatgcttcaggaacggatggcaaagttgcagtgaatctagccaaactgaagcttttccggcattactacgtgatggtgatatgctacgtgtatttcaccagaattatagcgatcctgctgcaggtggccgtccctttccagtggcagtggctctaccagctgctcgtggagggtagtacactcgcatttttcgtgctgacgggctacaagttccagcccaccggaaataatccgtaccttcaactgccccaagaagacgaagaggacgtgcagatggaacaagtgatgactgatagcggcttcagggagggtctctctaaggtcaacaagactgctagcggaagagagctgctctag

SEQ ID NO: 26436 - DNA, 906 bp, Artificial Sequence
  Description of Artificial Sequence: Synthetic coding sequence
atgattagagaaaaaaatcccgatggtttcctcagcgctgcggagatgcccctgttcaagctgtatatggtcatgtcggcctgtttcttagccgcgggcatcttctgggtcagtattctgtgcagaaacacctactcagtgtttaaaattcactggctgatggctgcgctcgcatttactaagagtatcagcctgctttttcactctatcaattactacttcatcaactcacaaggccacccaattgaaggcctggccgtgatgtattacatcgcacacttgttgaagggtgccctgctctttatcacaatagctttaattggatctgggtgggcatttattaagtacgtattgagtgacaaggagaagaaagtgttcggaatagtcattcccatgcaggtcctggcaaacgtggcttatataataattgagagtagggaggagggggcgagtgactacgtcctctggaaagaaatactctttctagtggatctgatctgctgtggggccatcctgttcccagtggtgtggagtatcaggcacttgcaggacgcgagtgggaccgacggcaaagtcgccgtgaacctggctaagctgaagctgtttagacattattacgtgatggtgatttgctatgtgtacttcacaagaattatcgccatactgttacaggtagccgtcccctttcagtggcagtggctataccaactcctcgtggagggctccacactcgcatttttcgtcctgaccggttacaagttccagcccacaggcaacaatccgtacctgcagctgcctcaggaggacgaggaggacgtgcagatggagcaggtaatgacggacagtgggttccgagagggactgtccaaggtaaataaaacagcctcaggaagagagctcctctag

SEQ ID NO: 26437 - DNA, 2142 bp, Artificial Sequence
  Description of Artificial Sequence: Synthetic coding sequence
atggatatctcgattcaacggaatgggtcaatcgtggccggttatgaggtggtaggttcaagttccgcaagcgagttactgagcgcgatcgaacatgtcgcagagaaggcaaaaacggcgctccacaagttgtttccattagaggatgggagttttcgcgtcttcgggaaagcacaatgcaacgatatcgtgtttggattcgggagtaaggacgatgagtatacgcttccttgttcgtcagggtatcgtggcaacatcaccgccaagtgcgagtctagcgggtggcaggttattcgagagacctgtgtcttgagccttctcgaggaactgaacaagaacttttcgatgatcgtcggcaacgcaacagaggccgcggtgagcagcttcgtgcaaaacctttctgtgattatccgccaaaatccaagcaccaccgtgggaaatctcgcaagcgtcgtctctatactctccaacatttcatcgttgtcacttgcttcacatttccgtgtgagtaattcgacgatggaggatgtgatcagcatcgctgacaacattctcaacagcgcctctgttactaactggaccgtcttgctgcgggaggagaaatatgccagcagcagactgctcgagactctggaaaatatctccactctagttccccccacagctctaccgctcaatttttctcggaaattcatcgattggaagggaatcccagtgaacaaatctcaattaaagagaggctatagctaccagataaaaatgtgccctcaaaacacctcgatcccgattcgagggcgggtactcattgggagtgatcagttccagcgatcactgcccgaaacaataatctccatggcatcactgactttagggaatatcctgcctgtttcaaagaacggtaacgcacaggttaacggaccagtgatcagtacagtaattcagaattactccattaacgaagtcttccttttcttttcaaagattgaaagtaatctttcccaaccgcattgtgtgttttgggacttctcccatctgcagtggaacgacgccggatgccacttagtcaacgaaacacaggatatagtgacatgccaatgcacacacctaacaagtttcagtattctaatgtcaccctttgtcccttccactatcttccccgtcgtgaaatggattacctatgtgggcttgggaataagtatcggttccctaatactgtgccttataattgaggcgcttttctggaaacaaatcaagaagagccagacaagccacacacgtaggatctgcatggttaatatagccctgtctctactgatcgctgatgtctggttcattgttggggccactgttgatactacggtaaatccctcaggcgtttgcacagcggcagtattttttacacacttcttctatcttagtctgttcttttggatgctcatgctcggtatactgcttgcgtatagaatcatactggtgtttcaccacatggcccagcacctcatgatggccgtgggattttgtctgggctacggatgccctttgatcataagcgtaatcacaattgccgtgacgcaaccatccaacacctataagcgtaaggatgtgtgctggttgaactggtccaacggctctaagccattgcttgctttcgtggtgcctgcactcgccattgttgctgttaacttcgtcgtggtgctgttggtgctgaccaagctttggagacctaccgtcggcgagaggctgagtcgggacgataaagccaccatcattagggtggggaagtctctcctgatcctcaccccacttttaggcctcacatggggctttggtatcggaacaatagtcgatagtcaaaatctggcatggcatgtgatattcgctctgcttaatgccttccaaggctttttcatattgtgctttggcatactgctggactctaagctccgccagctcctgtttaacaagctgtcggctctgagctcctggaaacagaccgagaagcagaactcaagcgatcttagcgcaaagcctaaattctcgaagccctttaatccactacagaataaaggccattatgccttcagccacacgggagacagctctgataacattatgctaacccaattcgtttcaaacgaatag

SEQ ID NO: 26438 - DNA, 657 bp, Artificial Sequence
  Description of Artificial Sequence: Synthetic coding sequence
atgaaagtgggggttctatggctgatcagcttttttaccttcacagatggacatggagggtttctcggaaaaaatgatgggatcaagaccaaaaaggaactcattgtgaataaaaaaaagcatttggggcccgtagaagaatatcagctgttgctgcaggtgacttatcgcgatagtaaagaaaagcgcgacctccgtaactttctgaagttactcaagcccccgctactctggtcacatggcttaatcagaatcattagagcaaaggctaccaccgactgcaactccctcaatggggtcctccagtgcacatgtgaagacagttatacttggtttcctccttcctgtcttgaccctcaaaactgctatttgcacacagccggggctctcccgtcttgcgagtgtcatctgaacaacctcagccaaagcgtaaacttttgcgaacgtactaaaatttgggggactttcaaaatcaacgagcgctttacaaatgatttgctgaattcgtcttccgccatttacagtaagtatgccaacggtatcgagattcaattgaagaaggcctatgaacggatacagggctttgagagcgtgcaggtgacacagtttagaatgagcctgctaagcccaaagctcgagtgcaatgggactatatag

SEQ ID NO: 26439 - DNA, 1890 bp, Artificial Sequence
  Description of Artificial Sequence: Synthetic coding sequence
atgaaagtcggggtgctatggctgatcagtttctttacgtttaccgacgggcacggggggtttctcggcaaaaacgacggtatcaagaccaaaaaagaattgatcgtgaacaagaagaagcatctgggccctgtggaagaataccagctgttgctgcaggttacataccgcgactccaaagagaagcgggatctgagaaactttctgaagttgctgaagcctccgctgctttggtcgcacggactcataaggataatacgggcaaaggcgacaaccgactgtaatagccttaacggcgtcctacagtgtacttgtgaggatagttacacttggttcccaccgtcttgcttagacccccagaactgttatctccacacagccggggcgctgccttcatgtgaatgtcacctgaacaacctgtctcagagcgtcaacttttgtgaaagaactaaaatttggggaacgtttaaaattaatgagcgattcacaaatgatcttctaaattcctcatctgcaatttacagcaaatacgctaacggcatcgaaatccagctgaagaaggcttacgagcgcatccagggattcgagtccgtgcaggtgactcagttcagaaatgggtccatagtggccggttacgaagtcgtcggatcaagcagcgcctcagagttactgagcgccattgaacacgtcgcggaaaaggccaaaacagcgcttcacaagctctttcccctggaggatggttcgttcagggtgttcgggaaagctcagtgcaatgacatcgttttcggctttggttcaaaagacgacgaatacacccttccctgctctagtggttataggggtaatattacagccaagtgcgagagtagcggatggcaggtgattcgggagacctgtgtgttgtctttattggaagagcttaacaaaaatttcagcatgattgtggggaacgccacagaggccgctgtctcctccttcgtgcagaacctatcagtgatcattcggcaaaatccgtcgacaactgtgggtaacttggcttctgtcgtgtctatactcagcaacataagcagccttagcctggccagccatttcagggtgtccaactccactatggaagatgttattagtattgccgataatatcttaaacagcgcttcagtcaccaattggacagtgctgcttcgggaggaaaagtacgctagtagtagattgctggaaactctggaaaacataagtactcttgtgcccccaaccgccctccctttaaatttttcaagaaaatttatagattggaagggcatccctgtcaacaagtcacagctgaagcgaggctattcctatcagatcaaaatgtgccctcagaacacgtcaatcccaatcagggggagggttctgatcgggagtgaccaattccagcgtagcctgcccgaaaccatcatttccatggcaagtttgacactgggcaatatcctcccagtctccaagaacgggaacgcgcaggtgaacgggcccgtcatcagcacagtgatccagaattactcgatcaacgaagtgtttcttttcttcagtaagatcgagtccaacttatcccagcctcattgcgtgttttgggattttagccatcttcaatggaacgacgcaggctgtcatctggtgaacgagactcaagacatcgtgacctgccagtgcacgcatctgacctcctttagcatcctgatgagccccttcgtgccaagcaccatcttccccgtcgtgaagtggataacatatgtgggcttgggtattagcatcggatcacttatactgtgccttatcatagaagccttattctggaaacaaattaagaagagccaaacctctcatactcgccagagaaagaagaaacaatag

SEQ ID NO: 26440 - DNA, 2733 bp, Artificial Sequence
  Description of Artificial Sequence: Synthetic coding sequence
atgaaggtcggagttctctggctcatttccttttttacttttacagacggtcatgggggattcctcggcaaaaacgacgggatcaagacaaagaaagagctcatagtcaacaagaagaagcacctgggccctgtggaggaatatcaactgctgctccaggtcacctaccgggactcaaaagaaaaaagggacctgagaaatttcttgaagttactcaagcctccactcctctggagccacggtctcatcaggatcattcgcgcgaaggctacgaccgattgcaatagcctgaatggtgtcctccagtgtacttgtgaagactcgtacacatggttcccacctagttgcttggatccccagaactgttatttacacaccgccggcgcactcccatcctgtgagtgccacctgaataatctgtcgcaaagtgtcaacttctgtgagcgcaccaagatctggggcaccttcaaaatcaacgaaaggtttaccaatgacctcttaaacagctcgtctgctatttacagtaagtacgcaaacggaatcgaaatacagctcaagaaagcatacgaaaggatccagggattcgagtctgtgcaggttacacagttcagaaacggaagtatcgtcgccggttacgaggtggtgggtagttctagcgcctctgaactcttaagcgctatcgagcatgttgcagagaaagccaagactgccttgcacaaactgtttcctctcgaagacggttcctttcgggtcttcggcaaggctcaatgcaacgatattgtcttcggctttggaagcaaggacgacgagtacactctgccctgctccagtggctaccgcggtaatatcactgccaaatgcgaatcctctggttggcaagtgatcagggaaacttgtgtgctgtccctcctggaagaacttaacaaaaactttagcatgattgtgggaaacgctactgaggctgcagtctcatcatttgtacagaatttatctgtgattattaggcaaaacccgtccactacagtgggtaatcttgcctcggtcgtgagcatactgtccaacatttcgtctctgtcattggcatcccacttccgtgtgtccaattctacaatggaggacgtgatttcgattgctgataacatcttgaactctgcctccgtcacaaactggacagtgctactgcgggaagaaaagtacgcatcttcacgtctcctggagaccctcgagaacatctcgacgctggtgccacccactgctctgcctctcaatttctccaggaaatttatagactggaagggtatccctgtgaacaagtcacaactaaagcggggttactcctatcagattaagatgtgccctcagaataccagcattcctattcgcggacgagtcttgattggatcagaccagttccagcgaagtctgcctgagacaatcattagcatggcatcactgactctaggtaatatcctccccgtcagcaaaaacgggaacgcacaagtgaacggcccggtgatatccaccgtgatccagaattacagcattaacgaggtgtttctatttttctccaagatcgagagcaacctgtcacaacctcattgtgtgttctgggatttctcacacttgcagtggaatgatgctgggtgtcacctggttaatgagacgcaggacatcgttacctgtcagtgcacgcatctcacgagttttagtatcctgatgtcaccctttgtgcccagtaccatttttcccgtggtaaaatggatcacatacgtgggactcggcattagcatagggtctttaatcctctgcttaatcatcgaggctctgttctggaaacagatcaaaaagagtcagacgtcgcacacgcggaggatctgcatggttaacattgctctgagtcttttaattgctgacgtgtggttcatagtcggggccactgtggacaccactgtgaacccgagcggcgtgtgtaccgcagcagtgttttttacccacttcttctatctgtcgctattcttttggatgctcatgctcggtattcttcttgcttacagaattatcctggttttccaccatatggctcagcatttgatgatggcagtgggattttgcctaggttatgggtgccctctgattatctcagtaatcaccattgccgttacccaaccttccaatacatacaaacgaaaagacgtgtgttggctgaactggtcaaacgggtccaagccactgctcgctttcgtagttcccgcccttgccatcgtggctgtaaacttcgtagtagtgctgcttgtgcttacgaagctgtggcgtcctacagtaggcgagaggctgtccagagatgacaaggcgacaatcattagggtggggaaaagtctgctgatcctgacccccttactgggtctgacgtggggcttcggaatcggtacaattgttgatagccagaatctggcatggcacgttatctttgccctgcttaatgcctttcaaggattcttcatcctgtgtttcgggattctattggactctaaattaagacagctgctatttaataagctatctgcactgtctagctggaagcaaaccgagaaacagaactctagtgacctttcagcaaagcccaaattcagcaagccgttcaatccactccaaaacaaaggccattatgccttctcgcacactggcgacagcagtgacaacattatgctgacccagttcgtaagcaacgagtag

SEQ ID NO: 26441 - DNA, 2127 bp, Artificial Sequence
  Description of Artificial Sequence: Synthetic coding sequence
atggggctgaccgcctacggaaatagacgggttcagcctggggagctcccttttggtgccaatctcacgctcatccatactagggcccagcccgtgatctgtagcaagctgcttctaacaaagcgagtctccccaatttcattttttctgtccaagtttcagaactcatggggagaggacggttgggttcagctggaccagctccccagtcctaatgccgtcagtagcgatcaggtgcattgctcagctggatgtacgcataggaaatgtgggtgggctgcgtcaaagtctaaagagaaagtgccggcacggccacacggagtttgcgatggggtgtgtacagactatagtcagtgtacacagccttgcccccctgacacacaagggaatatgggtttttcttgtcgccagaagacatggcacaagatcacggacacctgtcagaccctgaatgctctcaacatttttgaagaagattctaggctcgtgcagccatttgaggataatattaaaatatccgtatatactggtaaaagtgaaacgattacggatatgctgcttcagaaatgtcccaccgatctgtcgtgcgtaatacgcaatatccagcaaagcccgtggatcccaggaaacattgccgtaatcgtgcagctcctgcacaatatctcaacggccatttggaccggagtggatgaggccaagatgcagagctacagtactatagctaaccacatcttgaatagcaagagtatcagtaactggacatttatccccgataggaattcctcatacatcctgctacactccgttaattctttcgctaggcgcctgtttatcgacaagcaccccgttgatatttccgatgttttcattcataccatgggaactactatcagcggcgacaacatcggcaaaaacttcacattctctatgcgcataaacgatacatcaaacgaagttacaggccgggtgctgatttcccgcgacgagcttaggaaagtgcctagccctagccaagtcatcagcattgccttcccgacaatcggggccattctggaggccagtttgcttgagaacgtgaccgtcaatgggttggtcttatcggctatcctgcctaaagagctgaaaagaatctcactgattttcgagaagatctctaagagtgaggagaggaggacacagtgtgtgggatggcactcagtggagaatagatgggaccaacaggcgtgtaagatgatccaagagaactcccagcaagctgtgtgtaaatgtcgacccagtaaactgttcacaagctttagcattctgatgtccccgcatattctggagtctctgatcctgacctatattacatatgtgggcttaggcatcagtatttgttcacttatcctttgcctgagcatcgaagttctcgtctggagtcaggtgaccaagacagagattacatatcttcggcacgtgtgcattgtgaacatagccgctactctgttgatggccgacgtatggtttattgtagcgtccttcctcagtggaccaattacacaccataagggatgtgtcgctgccacttttttcgtgcatttcttctatttgtcagtgttcttctggatgctcgccaaggcgctccttatactgtacggaataatgattgtcttccatactctaccgaagtccgtgctggtagcttccctcttttcggtcggatacggttgtccactcgctatcgctgctatcacagtggccgctaccgagcccggaaagggataccttcggcccgaaatctgctggctaaattgggacatgacgaaggccttgctggcttttgtgatacctgctttagctattgtagtggtcaatctgatcacagtgaccttggtaatcgtgaaaactcagcgcgccgcaatcggcaacagcatgtttcaggaggtaagggccattgttagaatttccaagaacattgctatcctgacccccctgctagggctaacgtgggggttcggggtggctacagtcatcgacgatcgcagcttggcatttcatatcattttcagtctcctgaatgcatttcaggtttctcccgatgccagcgatcaggtgcagagcgagaggatccacgaggacgtgctgtag

SEQ ID NO: 26442 - DNA, 1929 bp, Artificial Sequence
  Description of Artificial Sequence: Synthetic coding sequence
atgactcacattctcctgctctactatttggtgtttctgctacctaccgagtcttgtaggacgctgtaccaggcagctagtaaatctaaagagaaagtgccagcacgcccccacggggtttgtgatggagtctgtacagactattcccagtgtacccagccttgtcccccggatactcaaggcaacatgggcttctcctgtagacagaagacctggcataagatcactgacacatgccagacactgaatgcgcttaacattttcgaggaagattcccgactggtccaacccttcgaggataacataaaaatctctgtctataccggaaaaagtgaaacaatcacagacatgctcctgcaaaagtgccccacagacttgtcttgtgtgatccggaacattcaacagtccccttggattcccggcaatattgccgttattgtgcagttactgcacaatatatcgaccgctatttggacgggtgtggatgaagccaagatgcagagttactctactattgccaaccatatcctcaacagtaaatcgatcagcaactggacattcatccctgatcgcaactcatcctacatcttgttacactctgtgaattcgtttgctcgccggttgtttatcgacaagcatccagtcgacatttctgatgttttcattcacactatgggtaccacgatatctggcgataacatcgggaagaactttaccttctctatgagaatcaacgataccagtaatgaggtcaccgggagggtcttgatttcaagggacgaactgagaaaggtgcccagcccaagtcaagtgattagtatcgcctttccgaccattggagccatcctcgaggcttctctgctggagaatgtgactgtaaatggtctggtgctatccgccattctgccgaaagaattaaaacggatttctctgattttcgagaaaatctccaagagcgaggagagacggacccagtgcgtgggctggcattctgttgagaatcggtgggatcagcaggcttgtaagatgatacaggagaatagccaacaagctgtgtgcaagtgtagacctagtaagctcttcaccagctttagcattctgatgagtccacatatcctggagtccctgatcttaacttatattacctacgtggggctgggaatttctatctgcagcttgatcctgtgcttgtctatcgaagtcctcgtgtggtcccaggtgacaaagaccgagataacctacctgcgccatgtgtgtatcgtgaacatagccgcaaccttgttgatggcagatgtctggttcatcgtcgcatctttcctttcagggcctattacgcatcataaaggttgcgtggccgccacgttcttcgtgcattttttctatctaagtgttttcttttggatgctagcgaaggccctgctgattctctatggtataatgatagtgttccacaccctgcctaagtctgttctggttgcttcacttttcagcgtaggctacggctgtcccctggcaatcgcagccatcaccgtggccgctacagagccaggcaaagggtatctccggcccgagatatgttggctcaattgggatatgacgaaagccttgctcgccttcgtgattcccgccctcgccattgtggtggtcaatctgatcacggtgactctggtcatcgttaagacacagcgagccgccattggcaatagtatgtttcaggaagtccgggccatagtacgcatctctaagaatatagcaatactgacaccccttttggggcttacttggggttttggcgtcgctaccgtgatcgacgaccggtccctggccttccacatcatcttctccctgctgaatgccttccaggggttcttcattcttgttttcggtacaattctggacccgaagatccgcgaggccctgaaggggtag

SEQ ID NO: 26443 - DNA, 1929 bp, Artificial Sequence
  Description of Artificial Sequence: Synthetic coding sequence
atgacacacattctgctgctgtactaccttgtgttccttctgccgaccgaaagctgtcggactttgtaccaggccgcatccaagtccaaagagaaagtcccagctcgacctcacggagtttgtgatggagtgtgtacagattactctcagtgtacccagccatgcccccctgatacacaggggaacatgggtttctcctgccgccaaaagacttggcacaaaataaccgatacttgtcagacgttgaacgctcttaatatctttgaggaagatagcaggctggttcagccattcgaggacaatatcaagatatcagtttacactgggaagtccgaaaccatcacggatatgttgttgcagaaatgccctacggatctttcctgtgtcatccgcaatatccagcagtcgccttggatccctggcaacattgctgttatcgtgcagctccttcataacatttcgaccgcgatctggaccggagtggatgaagcgaagatgcagtcttacagcacgattgccaatcatatcctgaattcaaagagcatttccaactggacgtttataccagatcgaaattctagctacattttgctgcacagtgttaattcttttgctagaagactgttcatcgacaaacaccctgtggacatcagcgacgtattcatacacactatgggcaccacaattagcggcgacaacattggtaagaacttcacattctccatgaggatcaatgatacttcaaatgaagtgacgggcagggtcctgatcagcagagacgagctcagaaaggtacccagcccatcccaggtcatctcaattgcttttccaaccatcggagcaatcctcgaggctagcctgctggagaatgtgactgtgaatggtttggttttatccgcaattctgccaaaagaacttaagcggatctccttgattttcgaaaaaatcagtaaatcggaggaacggagaacacagtgcgtcggctggcacagcgtggagaatcggtgggaccagcaggcatgtaagatgattcaggaaaattcacagcaggccgtctgtaaatgcaggccatcaaagctctttactagtttctctatactgatgagtcctcatatcctcgaatcactgatcttgacttacattacctacgtcgggctgggcatcagtatttgctctctgatactctgtctctccatcgaggtgctggtgtggagccaagttactaagaccgaaatcacctatttacggcatgtctgtatcgttaacatcgctgcaaccctgctgatggcagacgtttggtttattgttgctagcttcctgagtggccctatcacacaccacaaaggatgcgtggccgccactttcttcgttcacttcttttacctgtctgttttcttctggatgcttgcaaaggctctgctgatattgtatgggattatgatcgttttccatacacttcccaagtccgtactcgtcgccagtctgttcagtgtcggctatggatgccccttagccatcgccgcaatcaccgtggccgcaaccgagcctgggaaaggatacctgcggccggaaatatgctggcttaactgggatatgacaaaagctctgcttgcctttgtgattcctgccctcgcaatagtcgtggtcaacctaataacagtaaccctggtaatcgttaagacacagcgtgcagccatcgggaacagcatgttccaggaggtgagggcaattgtgcgaatatcgaagaatattgccatcttgacccctcttctgggcttgacttggggctttggcgttgccacagtgatcgatgaccggtccctcgctttccacattattttttctcttctcaacgcgttccaaggattctttattttggtctttgggacaatcctagaccccaaaataagggaggctctgaaagggtag

SEQ ID NO: 26444 - DNA, 8415 bp, Artificial Sequence
  Description of Artificial Sequence: Synthetic coding sequence
atggacgataattctcgctactggatggcattttcttacatcaccaataacgcgctcctgggccgcgaggacatagacctaggtttggctggggaccatcagcagctgatcctttaccgactgggaaagacattcagcatccggcaccatttggcttcttttcagtggcacacaatctgcctgatctgggacggggttaaaggtaaactcgagcttttcctgaataaggagcgaattttagaagtgaccgatcagccacataatctgacaccccacggcacgctatttctgggccactttctgaagaatgaaagcagcgaggtcaagagcatgatgcgttccttccccggaagtctctattacttccaactttgggaccacatcctggagaatgaagagttcatgaagtgcttggacggtaacattgtctcgtgggaggaggacgtttggcttgttaacaagatcatcccaaccgtggatcggacattgcggtgtttcgtccccgaaaatatgacgatacaagagaagtctaccaccgtgtctcagcaaatagatatgacgacaccttcccaaatcacgggagtaaagccacagaataccgcccactcctctacgttgctgtctcagagcatccccattttcgcaacagattacaccaccatatcttactccaacacaacatcaccccccctcgagactatgacagctcagaaaatactaaaaacactggtggatgagacggcaacatttgcggtggacgtgctctcaactagcagtgcaatctccctgcccacccaatccatctccatcgacaatacgaccaactccatgaagaaaaccaaaagcccctcctctgagagcaccaagaccaccaaaatggttgaagccatggcaaccgagatcttccaacctcccacacctagcaactttttatctacctcccgcttcactaaaaattctgtcgtttccaccactagcgcgatcaagagccaatccgcggtgactaagacaacctccctatttagcaccatcgagtcaacttccatgtctacaacaccctgcctgaagcagaaaagcacgaacacaggagcccttccgatttctacggccggccaagaattcattgaatcaactgccgcggggacagtgccgtggttcacagtggaaaaaacatcccctgcaagtacacatgtcggcaccgccagctccttcccaccagaaccagtgttgatttccaccgccgctcctgtggacagtgtcttccctcgaaaccagaccgcctttccactcgcaactacagacatgaagattgctttcacagtgcacagcctgaccctgcccactcggcttatcgagacaactccggcgccaaggacagccgaaacagagctgaccagtacaaattttcaggatgttagtcttccgagggtagaggatgcaatgtcaacaagtatgagcaaagagacatccagcaaaacgttttcttttctgacatccttcagtttcaccgggaccgagagcgtgcaaacagtcatcgatgctgaggctacccggaccgccctcacacccgagattacgctcgctagcaccgtcgccgagactatgctctcttcaacaataaccggcagagtatacacccagaacacccctaccgccgatggccaccttctcacgctgatgtcgactcgttcagccagtacctccaaggctcctgaaagcggcccaaccagtacaactgacgaagctgcacatctgttctcctctaacgaaacaatttggacgagcagacctgaccaagctctgctggctagtatgaacactacaaccatcctgacctttgttccgaacgaaaactttacctccgcttttcatgagaacacaacttatactgaatacctgagtgctactactaacatcacaccacttaaggcgtcccccgaaggcaagggaactactgctaatgacgctaccactgctcgttataccacagcagtttctaaactgacatccccttggttcgccaatttttcaatcgtgtcaggcacgacaagcatcacaaatatgcctgagttcaagctgaccacattgctactgaagaccataccaatgagcaccaagcccgccaatgagctgcctctgacgcctcgagagaccgtcgtgccctccgtcgacattatatcgaccctggcctgtatccagcccaactttagcaccgaggagagcgctagcgagaccacacaaaccgagataaatggggctatcgtgttcgggggaactactacgcctgtcccaaaatcagccactactcagcgactcaacgctactgtcacccgtaaggaggcaacttctcactatctgatgcggaaatcgacaatcgcagccgtagccgaagtctcacctttttctaccatgctggaggtgacggatgagagtgcgcaaagggtgacagcctcggtaactgtgtcgagctttcctgatatcgagaaactttccactccacttgacaataagaccgccacaacagaagtgcgggagtcttggctcttgaccaaactggtaaaaaccacacccaggtcaagctacaacgaaatgaccgagatgtttaacttcaatcacacctacgtggcccactggactagtgagacttcagaaggaatctccgccggttctcctacaagtgggagtacacacatctttggggagcctctgggcgccagcacaactcgaatctcagaaacctctttctcaaccacgcctaccgaccgaacagccacttctctcagcgacggaatcctaccaccacagcccacggccgcccatagttctgctacacccgtccccgttacgcacatgttctctctgcccgtgaatggcagctcggtggtggccgaggagacggaggtcactatgtcagagcccagtactttagccagggctttctctacatccgtacttagtgacgtctctaatctgtccagcacaactatgacaaccgcacttgtacctccattggaccagactgcttcaactaccatcgtgattgtgcccacccacggagacctgatccggaccacatccgaggctacggttatctctgtccggaaaacatcgatggccgtgccaagtctcactgaaactccatttcactctctgcggctgagcacacctgtcactgcaaaagcagagaccacgctgtttagtactagcgtggacacggtcaccccctctactcacacgctggtgtgtagtaagccaccaccagacaacatcccccctgcctcaagtacccacgtgatcagcaccacctccactcctgaggccacacagcctatctcacaggtggaggagacttcgacatacgctctctcgttcccatatacgtttagtggaggcggcgttgtggcatccttggccactggcactactgaaacatccgtggtggacgagaccaccccaagccacatatcagccaataagctgaccacttccgtcaattcacatatttcctcttcagccacatatagggttcatactccagtgtcaatacaactggtgacaagcactagtgttctaagctccgacaaggaccaaatgactatttccttaggcaaaacccctagaacaatggaggtgaccgagatgagcccatccaaaaactctttcatctcctatagtcggggtactccttctttagagatgaccgacacaggcttccctgaaacgaccaaaatcagttcccatcagacacactcccccagtgagatcccccttggtactccaagcgatgggaatctggcttcatcacctaccagcgggagcacccagattaccccaaccctcacatccagtaacactgtaggcgtccacattccagaaatgtccacgagtctgggtaagacagctctgccgtcacaggcactcactattacgacttttctgtgcccagagaaggagagcaccagtgctctgcccgcgtatactcctcggacagtggagatgatagtcaactcaacttacgttacacatagtgtatcatacggtcaagacaccagcttcgtggacacaaccacgagcagctctaccagaatctctaaccccatggacattaacactaccttttcgcacctgcactcactccgcacccagccggaggtgacgagtgtggcctcctttatctccgagagcactcaaacattccctgagtcacttagtctctccactgccggcttgtataacgacggcttcaccgtgctctccgaccggattaccaccgccttttccgtgcccaatgttcctacaatgctccctagagagtcttctatggctacttcaacacctatttatcagatgagcagcttgccggtgaacgtgacggctttcaccagcaagaaagtttctgatactcctccaattgtcattacaaagagttcgaaaaccatgcaccctggatgcttaaagagtccctgtacagctaccagcggccctatgtctgaaatgagcagtattccagtgaataacagtgccttcacacccgcaactgtgtcatccgatacaagcacgagagtcggactgttttccactctgctgagttccgtgacaccgcggaccacgatgacgatgcagacaagcacgctcgacgtgactcccgtgatctatgccggagctaccagcaaaaacaagatggtgagcagcgcatttaccactgaaatgatagaagcccccagtcgcataacccctaccactttcctatcgcctacggaaccgaccttaccttttgttaaaaccgtgcctactacaatcatggcagggattgtgactccctttgtgggcaccacagcctttagccctctgtctagcaagtccactggcgccatatccagtattccaaagactaccttcagcccctttctgagcgccacccagcagagcagtcaggcagacgaagccacaaccttgggtatcttaagcgggattactaatcggtctctgagtaccgtgaattcaggtaccggcgttgccctcactgatacatactcacgtatcacggtgccagaaaatatgctgagtcctacacatgcagactccctccacacatcctttaatattcaggttagcccctccctgacaagttttaagagcgcctccggacctacaaaaaacgttaaaacaaccacgaattgtttctcctcaaatacacgcaaaatgacctcgctgttggagaagaccagccttacaaactacgcaacctccctcaatacccctgtgtcctatccgccatggacgccaagcagcgccactctgccctctctgacaagctttgtgtattccccgcactctaccgaagcagaaatttccaccccgaagactagccctcctcctacttcacagatggtggaatttccagtgttggggacaaggatgacttcttccaacacccagccactgctcatgacctcatggaacattcccacagcggaaggcagtcagtttcccatctcaaccacaataaacgtccccacctctaacgaaatggaaaccgaaactctgcatttagttcctggtcctctgagcacgtttacggcaagccagacgggcctagtgtctaaggatgttatggctatgagctctatccctatgtcgggcattctgcccaatcacggtttgtcggaaaaccccagtctctccacatccctccgagctataacaagtactctggccgatgtgaaacacacttttgagaagatgacaactagcgtcacgccaggaaccactctcccgtcgatactatctggcgccaccagtggctctgtcattagtaagtccccaatcctgacttggttgctgtcgtctctgccctctggatcaccccctgccacagtttcgaatgccccccacgtgatgaccagcagcacggtcgaagtgtcaaagtctaccttcctgaccagtgacatgatctctgcgcacccatttaccaatctgactacgctgccttctgctaccatgtctaccatcttgacccgcacaatccctacccctacgctaggggggattaccaccggctttccgactagcctgcccatgtccatcaatgtaacagatgatattgtctacatttctacccacccggaggcaagcagcagaaccactatcactgcaaatccgaggacggtgtcccacccgtcttcctttagtaggaagactatgagtccatctacaacagaccacacactgagcgtaggcgctatgccgctcccgagttctacaataaccagtagttggaacagaatacctaccgccagcagtcccagtacgctgattatacccaagcccaccctggacagtctgttaaacatcatgaccaccacatccacagtacctggagcctcttttcccctcatctcaaccggtgtcacttatccattcaccgccacggttagtagcccgatcagctcattttttgaaacgacatggctggattctacaccaagttttctgtcaacagaggcgtctacctctcccaccgcaactaaaagtactgagcccggaaattgcaaggcggatgaaaccgcttccaaatataaaggaacctacaagtggctgctgactaacccaactgaaacggctcagacacgctgcattaaaaatgaagacgggaatgccacgcgcttttgcagtatcagcatcaacacagggaagtcgcagtgggaaaaacccaagtttaagcagtgtaaactattgcaggaattaccagataaaatagtggatttggctaatatcacaatatcggatgagaacgccgaagacgttgccgaacacattttgaacctaatcaacgaatctccagccctaggtaaggaagagacaaagattattgtcagcaaaataagtgatatttctcagtgtgatgaaattagcatgaatctcacacatgtcatgctccagattattaatgtggtcctcgagaaacagaataactcagcaagcgatttgcacgagattagcaatgaaatactcagaattattgagaggacgggccacaaaatggaattttcaggtcagatcgcaaatcttacggttgccgggctagctttggcagttctcagaggagatcatacttttgatggcatggcattcagcatccactcttacgaagaagggactgaccccgagaccaagaatgtgacaaaagctcttacgacttacgtggtgagcgccagcatcagtgacgacatgtttattcagaacctggctgacccagtggtcatcactttgcagcatatcggaggaaatcagaactatgggcaagtgcattgcgccttctgggacttcgagaacaacaatggtctgggcggctggaacagttctgggtgcaaagtcaaggaaaccaatgtgaattataccatttgtcaatgcgaccacctgacacattttggagtgctcatggatttgagccgtagtaccgtggactcagtcaatgagcagattctcgccctgattacttacacagggtgcggcatttcaagcattttcctgggagtggcggtggttacatacatagcatttcataagttacgcaaagactaccctgccaaaatcctaatcaacctgtgtacggcacttctgatgctgaacttggtctttttaatcaacagctggctaagttcgttccaaaaagttggcgtgtgtatcacagctgccgttgctttgcactactttctactggtgtcctttacttggatgggcctggaagctgtgcatatgtatcttgcactggtaaaggtgtttaacatctatattcctaactatattcttaaattttgtttggttggatgggggatccctgctattatggtggcaattacagtgtctgtgaaaaaggacctatacgggactctcagcccaacgacacccttctgttggattaaagacgatagtattttctacataagtgtggtggcctacttttgtctcatctttcttatgaacttgagcatgttttgtactgtcctcgtgcagttaaattctgtaaagtctcaaatccagaagacgcgcaggaaaatgattctccacgatctgaagggaaccatgagcctgacattcctgctcgggctgacctgggggtttgccttctttgcctggggccctatgaggaatttttttctttatctcttcgccatttttaataccctgcaggacggttcctcaaggtgccagataaaagtgggttataaacaggaaggcttgaagaagattttcgaacataagctgttgacgccctccctaaaaagcaccgcgacctcctccaccttcaagtcgttggggtccgcccagggcaccccgtcagagattagtttccccaatgctcccgagctcagtgccctccacgtcgtagctagcgaacctactactggatag

SEQ ID NO: 26445 - DNA, 9243 bp, Artificial Sequence
  Description of Artificial Sequence: Synthetic coding sequence
atgaaggagcatattatttaccagaagctctacgggctgatcctgatgtcctcctttatttttctgagtgacacactcagcctgaaggggaagaaactggacttcttcggccggggagatacgtatgtgtcacttatcgatacaattcccgagctgtctcgtttcacggcttgtattgaccttgttttcatggatgacaattccaggtactggatggcattcagctatatcacaaacaacgcactgttgggccgagaggacatagacttggggctcgctggcgatcaccagcagctcattctgtatagacttgggaagaccttttccattagacaccacctggcctctttccagtggcatacgatatgtttaatctgggatggtgtgaaaggcaaattagagctttttctgaacaaagagcggatcctggaggtgaccgatcagccacacaacctcactcctcacggaactctgttcctcgggcacttcctgaagaatgaatcttcggaggttaagtctatgatgcggagctttcccgggtccctttactactttcagctgtgggaccacattttggagaatgaagaatttatgaaatgcctggacgggaatattgtttcatgggaggaggacgtttggcttgtgaataagatcattcctacggtggaccggaccctgcgctgcttcgtgcccgaaaatatgacaattcaggaaaagtctacaacggtctcacaacagatcgacatgactaccccatctcagataacaggggtaaaacctcaaaacacggctcacagttctacattactttcacagtccatccccatctttgccaccgactacaccactatctcgtacagcaacacaacatctccaccccttgaaaccatgactgcccaaaagattctgaagaccctggttgatgaaaccgcaacgttcgctgtggacgtgttgtctacctccagcgccatctcactgcctacacaatcaatcagcatcgacaatacgacaaattctatgaagaaaactaaatcaccttcctccgagagcacaaagaccaccaagatggtcgaagcaatggctactgaaatttttcagccacctaccccgagcaacttcctcagcacttctcggtttaccaagaactctgtggtatcaacaacctcggccatcaaatcccagagtgcagtgacaaaaaccacttcgctgttctctaccatcgagtccacaagtatgtctaccactccgtgccttaagcaaaagagcactaacacaggagccctgccaattagcactgctggccaggagtttatcgaaagtactgctgccggcacagtgccgtggttcactgtggagaagacatcaccagcatccacgcacgtgggcacggccagcagcttcccccctgagcctgtcctgatctccactgcggccccagtagactccgtgttcccaagaaatcagacagcatttcctctcgccaccacggatatgaaaatcgcttttaccgtccatagtctgacattgccgactcgcctgatcgagactacccccgccccacgtaccgctgagaccgagctgaccagcaccaactttcaggacgtatctctccctagggtcgaagacgccatgtccacatccatgtccaaagagactagctccaagacctttagtttcctcacgagctttagttttactggcaccgagagtgtgcagacagttatcgacgctgaggcgacccgtacagcactgacacccgaaatcacgctggcaagtaccgtggctgaaaccatgttaagctccaccatcacagggagagtgtatacccagaacacaccaaccgctgacggacatctactcacccttatgtcaacccgctcagccagtacttctaaggcccctgagtccggaccaacctccacaaccgacgaagcagctcatctctttagctcaaatgagacgatctggacctcccggccggatcaggccctgctggcctccatgaacacgacgaccatccttacatttgtgcccaacgaaaactttacgtctgcttttcacgagaacacaacgtatacagagtacttgagtgccacaaccaatatcacccccctgaaggcgagccccgaaggaaaaggcacgacggcaaatgacgccacaacagcaagatatacgactgccgtgtctaagttgacctctccttggttcgctaatttttcaatcgtttccggcaccaccagcatcaccaatatgcctgagttcaagttgaccaccttactgctgaaaactatcccaatgtctactaagccggctaacgaactacctcttacaccacgtgaaacagtagtgccctctgtagacattattagcaccctcgcctgcattcagcctaatttctctacagaggagagtgcctcagagacaacacagacggaaataaacggtgctatcgtgttcggcgggacaactacaccagttcccaagtctgctactactcagcggctaaatgcaactgtgacacgcaaagaggctaccagtcattatctaatgagaaaatcaacgatcgccgcagtggccgaggtgtcacctttttctacaatgctggaagtgacagacgagagtgctcaaagggtgacagcaagcgtgaccgtttctagtttccctgatattgagaaactgtcaacaccgctagacaacaagacagccaccaccgaggttcgagaaagctggctgctaacgaaactggtgaaaactacaccccgcagtagctataatgagatgaccgagatgttcaacttcaaccatacttatgtcgcacactggacgtcagaaacctcagagggcatctccgctggtagccccacctccggatctacccatattttcggagaacctctgggcgcaagtaccacacgcatcagcgagacatccttttctactactcctaccgaccgcactgcaacttcactaagcgacggaattctgccaccgcagcctacggctgcacatagttcagcaactcccgtaccagttacacatatgttctcattaccagttaatggtagttccgtggtggccgaagaaacagaagtgaccatgtcagaaccgtcaactctggctagagcttttagcaccagcgtgttgagcgatgtaagcaacttgagttcgactacaatgactaccgctctggtgcctccgttggaccaaacagcttcaactaccattgtaattgtgccaacgcacggtgaccttattaggaccacttctgaggcaacagtgatctcggtgagaaagaccagcatggccgtccccagtcttacagaaacaccattccacagtctccgcctctctactcctgtgactgctaaggctgaaactacactgttctcaacgtctgtcgacaccgtgactccttcaacccatacactggtgtgcagcaaaccaccgcctgataacattccccccgcatccagcactcatgtcatcagcactacttccacccccgaagccacccagcctatttcccaagttgaggagacttccacttatgccctgagttttccctacactttcagtggtggtggcgtagtcgccagcctcgccacaggaacaaccgaaacaagcgtcgtggatgagaccactccctcacatatttccgcaaacaaactgactacatctgtcaacagtcacatttcctcttccgccacatatcgcgtacatacacctgtgtctattcagcttgtcacttctacatccgtgctgtcctcagataaggaccagatgaccatcagtctgggtaagacaccaaggacaatggaggtaactgagatgtccccatctaagaactctttcatcagctactctcggggcactccgtccctggagatgacagacaccggcttccccgagacaaccaagatctctagccatcagacccactccccaagcgagattccgctaggcactccttcagatggaaatctcgcgtcatctcctacaagcgggtccacccagataactcccacgttgaccagctctaacactgtcggcgtgcacatccccgaaatgagtacaagcctcggaaaaaccgccctcccatcccaagctcttacgatcaccactttcctatgcccagaaaaagaatccacaagtgctttacccgcatataccccgcggaccgttgagatgatagttaactctacatacgtgacccactcggtgagctatggacaggatacatcctttgtcgataccactaccagcagcagcacaagaatcagcaatcccatggacataaacaccacgttttctcacctccatagcctgcggacccaacctgaagtcaccagcgtcgccagcttcatttccgaaagcacccagacctttcctgaatctctcagcctgtccaccgccggcctttataatgatggattcacagtgctgtcggatcgaatcacgaccgctttttctgtcccaaatgttccgacaatgctaccacgcgagagctcaatggccacttctacacccatatatcagatgagctccctgccagttaacgtgacagccttcactagcaagaaagtgtccgacactcccccaatcgtgataactaagtcctccaaaactatgcatcctggctgtttgaagagtccatgcacagccactagtgggccaatgtccgagatgtcaagcatccctgtgaacaactccgcattcactccagctaccgtgtcatccgacacttctaccagagttgggctcttctccactctcttgagttccgtaacacctcgcaccactatgacgatgcagacgagtacactggacgtcacccccgtaatatacgcaggcgccactagcaaaaacaaaatggtcagcagcgccttcactacagaaatgatagaagccccttcccggattactcccacgacattcctcagccccacggagcctacactcccattcgttaagaccgtgcctactacaatcatggcgggaatcgtgacccccttcgtgggaacaaccgccttttcccccttgagctcaaagtccacgggcgctattagcagcattcccaagactaccttcagcccctttcttagtgcaacacaacagtccagccaggccgacgaggcgactactctcggaatcctgtctgggatcacaaaccggtcactttctactgtcaacagcgggacaggggtggccctgactgacacatattcccgaattacagttcctgaaaacatgctgagtcccacgcacgcagacagcctgcatacttcattcaatattcaggtcagcccttcactgacgtctttcaagagtgcatctggccctaccaagaacgtaaagacgacaaccaactgtttcagtagcaacactcggaagatgacgtctctcctcgaaaaaacatccttaacgaactatgccacatcactcaacaccccagtatcttatcccccctggacccctagctctgcaaccttaccatcactaactagttttgtgtacagtccccacagcacagaggcagagatctccactccgaagacatcaccccctccaaccagccagatggtcgagttccccgtgcttgggactaggatgactagctccaacactcagcctcttttaatgacatcctggaatatacctaccgccgaggggagccagtttcccatatctactacaatcaatgtgccaacctcaaatgaaatggaaacggaaactctccaccttgtgcccggtcccctgtccactttcacggctagccagacgggtctagtttcaaaggatgtcatggctatgagttcaatccctatgtcagggatccttcccaatcatggcctgagtgaaaatccctcactatcaacctcccttagggccatcacatctaccttggccgacgttaaacacacttttgaaaagatgacgacctccgtaacccccgggacaactctgccctctatcctgtcgggcgctacttctggctcagtcatttcgaagagtccaatcctgacatggctgttgtcctccctcccctcgggttcccctcctgcaacagtgagcaacgcgcctcatgtcatgactagctcaaccgtcgaggtctccaagtcaacttttttaactagcgacatgatctcagcacatcccttcaccaatctgactacgctacctagtgctactatgagtactatactgaccaggaccattcccacccccacattagggggaattacgaccggattcccaacttctttacccatgtcaattaacgtgaccgacgacatagtttacatctccacacatcccgaggcaagttctcgcacaaccataactgccaacccccgcacagtttcacacccctcatcgttctccaggaagacaatgagtccatctactacggaccatacactttctgtgggagcaatgcccttaccttccagcacaattacctccagctggaataggattccaactgctagcagtccttcaacactaattatcccgaagcctacccttgacagcctcctaaacattatgacaaccacctctacagtaccaggggcttccttcccactgatttcaaccggggtgacctaccccttcacagccactgtaagttccccaatctcaagttttttcgagaccacatggctcgacagcactccctcttttctctccacggaggctagcacttcgccaacagcgaccaagtcaacagtgtcattttataacgtggagatgagtttctcggtgtttgtggaggagcctcggatcccgatcacctcagtcatcaacgagtttacggaaaactccctaaactcaatattccagaactctgagttcagtcttgccaccttggaaacgcagatcaaatcacgggatatcagcgaggaggagatggttatggaccgtgcaatattggagcagcgggaaggccaagagatggccactattagttatgtgccctactcctgtgtgtgccaggtcatcatcaaggcgtcttcaagtctggccagctcagagctcatgcgcaagattaaatccaagatccacgggaacttcacacacgggaactttacacaggatcagcttactctgctggtcaattgcgaacacgtcgctgtgaagaaactcgagccagggaattgtaaggctgatgagaccgcatctaagtataagggcacatataaatggctgctgacaaatcccacagagaccgcccagaccaggtgtattaaaaatgaagacggcaatgctacacgcttctgttcgatctctatcaacaccggaaagagtcagtgggagaaaccaaagtttaagcagtgcaagctgttacaggagctgccagacaagatcgtcgacctcgctaatatcacgatctcagacgaaaatgctgaggacgtggccgagcacatcttgaacctgattaacgagtcgccggccctcgggaaagaagaaacgaaaatcattgtcagtaagatttcggatatcagccagtgcgatgaaatttctatgaatctgacccatgtaatgctgcagatcatcaacgtggtgttggagaagcaaaacaacagtgcttccgaccttcacgaaatcagcaacgagatcttgaggattatcgagcgcaccggacacaagatggagtttagtggtcaaatcgcgaacttgacagtggcaggcctggccctggcagtcctgaggggtgaccacacttttgatggcatggcttttagcatccactcctacgaggagggtactgaccccgaaatttttctgggcaacgtccccgtgggaggtattctggcgtctatctacttgcccaaatccctaacggaaaggattccactttccaatctccagaccatcctgtttaatttcttcggtcagactagtctcttcaagacaaagaatgtgacaaaagctctgacaacgtatgtggtttctgcaagcatttctgacgatatgttcatccaaaatctcgctgacccagtcgtgattaccctgcagcacattggtgggaaccagaactacgggcaggtgcactgtgcattctgggatttcgaaaacaataacgggctgggtggctggaattcctccggctgtaaagtcaaagagaccaacgtgaattatacgatctgccagtgcgaccatctcacacacttcggagtcttgatggacttgtctagatctaccgtcgattcagtgaacgaacagatcttggcgctgatcacttatacagggtgcggcatctcatctatctttttgggcgtcgcagtcgtgacctacattgcctttcacaagttacgcaaagattacccagcaaagattctgattaatctgtgtacggctttgctaatgctgaatttggtgtttctcatcaactcctggttaagctctttccagaaggtaggggtctgtattacagcagccgttgcccttcactatttcctcctagtgagctttacatggatgggccttgaggccgtgcatatgtacctcgcccttgttaaggtatttaatatttacatcccgaattatattctgaaattctgcttggtgggctggggtatcccggccattatggtcgcgatcacagttagcgtcaagaaggacctgtacggaaccttgtctcctaccactccattctgttggataaaagacgattcgatattctatatctcagtggtggcctatttctgcctgatctttctgatgaacttgagtatgttctgcacagttctggtgcagctcaacagcgtgaagagtcagatacagaaaactcgcaggaagatgatccttcacgacctgaagggtacaatgtcattgaccttcttactgggtttgacatggggctttgccttcttcgcctgggggccaatgcgcaacttcttcctgtacctgtttgccatcttcaataccctgcagggcttcttcatctttgtgtttcactgtgttatgaaggagtccgttagagaacaatggcaaatccacctgtgttgtggttggttgcgtttggataattcctctgacggtagttcaagatgccaaataaaagtgggttataaacaagagggcttgaaaaaaatctttgagcacaaactgctaactccctctttaaagtctaccgctacctcgtctactttcaagtccctggggtccgcccaggggacccccagcgagatcagttttcccaacgacgatttcgataaggacccctactgtagttctccatag

SEQ ID NO: 26446 - DNA, 9243 bp, Artificial Sequence
  Description of Artificial Sequence: Synthetic coding sequence
atgaaagaacacatcatataccagaaactgtacggcctgatcctgatgtcttcattcatctttcttagcgacacactgtcacttaagggaaagaagttagatttcttcgggaggggcgacacttacgtatccctgatagacacaatccctgagctcagccgatttacagcctgcatcgaccttgtgttcatggacgacaacagccgatactggatggccttttcttatatcactaataatgcactgctagggcgagaggatatcgatctgggccttgctggtgaccatcagcaactgatcctttatcgtttaggcaagaccttctccatcaggcatcacctggcatcctttcagtggcacactatttgcctaatttgggatggggtgaaaggcaagctggaactgttcctgaataaggaacgcatcctggaggtgacggaccagccacacaatcttaccccacacggcaccctgttcctcggacatttcctgaaaaatgagtcatccgaggtcaagagtatgatgcgctcatttcccgggtccctatattatttccagctgtgggaccatattttagagaacgaggagtttatgaaatgcctggacggcaacatcgtaagctgggaagaggatgtatggctggtaaacaagatcatccctacagtcgatagaaccctgcggtgttttgtaccagagaatatgactatccaggagaagtcgaccacagtcagccagcagattgacatgacaaccccgagccagataacaggcgtgaaaccccaaaatacggcccactcctcaactttactgtctcagtctattccaatctttgcaaccgattataccaccatttcgtactccaacacaacttcacctcctctggaaaccatgactgcacagaagattcttaagacactggtagacgagaccgctacgtttgctgtggatgtcctatctacctctagcgctatcagccttcccactcagtccatctctattgacaacaccacaaattctatgaagaagacgaagtcaccaagctctgaatccacgaagactaccaagatggtggaagccatggcaactgagatatttcagccacccactccctctaactttctgtccacctcccgttttaccaaaaacagcgttgtgtcaaccaccagtgccataaaaagccaaagcgcggtaaccaaaacaaccagtctgttttccacaattgaatccacctcgatgagtacaaccccttgcttgaagcagaagtccactaacactggtgcactgccaatctccacagccggccaggagttcattgaaagcacagcagcagggactgttccgtggttcaccgttgagaaaactagtccagcctccacccacgtaggtacagccagtagctttccacccgagcccgtccttatttctacagccgctcctgttgacagcgtttttcctaggaatcagactgcctttccccttgctactacagatatgaagatcgctttcaccgtgcactctctgaccctgcccacaaggctcatagaaacaacacccgcccctcgtaccgctgagactgagcttacgtcaacgaacttccaggatgtgtctttgccaagagtggaagacgccatgagtaccagcatgagcaaggaaactagttcaaaaacattctcattccttactagtttctccttcactggtactgagtcggtacagacagtaattgacgcagaagccacacgaaccgccctgacgcctgaaattactctggcatcaaccgtagctgaaactatgcttagttcaacgattaccgggagggtatatacccagaacacccccactgccgatggacacctgctgacattgatgtccacccgcagtgcaagcacttcgaaggcaccggaaagtgggcctacgtccaccacagacgaagctgcccatcttttcagcagcaacgaaactatctggacctcccggcctgaccaagcattactggcctccatgaatactacaacaatcctgacctttgtcccaaacgagaatttcacatccgcattccatgagaacaccacctatacagagtatctcagcgccaccactaacattacacctcttaaggccagccctgagggtaaggggaccaccgcgaatgacgccaccaccgcccggtatacaaccgcagtgagcaagctaacctctccttggtttgccaacttcagcatcgtgtctgggacaacctcaatcactaatatgcccgagtttaaattgaccaccttacttttaaagactatccctatgagcacaaaaccagctaatgaattgcctctcactccccgagagacagtggtaccatctgtggacatcatttctaccctcgcatgcattcaacctaactttagtacggaagagtccgcctccgaaacaacgcagacagaaatcaatggggccattgtcttcggaggaactactactccagttcctaagtcggctaccacccagaggttaaacgccaccgttactcgcaaggaggctacgtctcattacctcatgcgcaagagtaccatcgcagcagtggcggaggtgtctcctttctccacaatgctggaggtcaccgacgaatctgcacagcgcgtgacagcgagtgtgactgtttcttcgtttccagacattgaaaagcttagtacacctctggataacaagactgccacgacagaagtaagggaaagctggctcttgaccaaactggttaagactactccccgaagctcctacaacgaaatgaccgaaatgttcaattttaaccacacgtatgtcgcccactggacctcagaaacttctgagggcatttctgccggtagtcctacctccggatcaactcacattttcggagagcctctgggagcatctaccacacggatttcagagacttctttctcaactacaccaacggaccgaaccgccacaagcttaagtgacggaatcctgcccccccagcctacagctgctcacagcagcgctacacccgtccctgtaacgcacatgttttcgctaccagtcaatggctccagcgttgttgccgaggaaaccgaggttacaatgagcgaaccttcgacgctcgcacgggcattctccacaagcgtgctctctgatgtgagcaacctgagcagcacaacaatgacgaccgctctggtgccccccctggaccagacagcttcgactacgatcgtgatcgtgcccacacatggcgacctcattaggacaacttcagaagccacagtaatctctgtcagaaagacatcaatggcagtcccctcgctcaccgaaacaccattccactccttgcgcctttcgacgcccgtcaccgcaaaagccgagacaacacttttttctacaagtgtggataccgtgacaccttccacccataccttggtgtgcagcaaacccccccccgataatatacctccagcaagttctacccatgtgatttcaaccacttccaccccagaagccacacagcccatttctcaggttgaagaaacgagtacttacgccctctcttttccatatacattctcagggggaggtgtggtggccagcctggcaactggaaccactgaaaccagcgtcgtggacgagacaacccctagtcacatctctgccaataagctcacgacttcagtgaattcccacatctctagttccgccacttacagagttcacactcctgtgtctatccagctggtgacatcgacctccgtcctgagttccgataaggatcagatgacaattagcctaggtaagactccaaggacaatggaagtgaccgaaatgagtcccagtaagaattcctttatctcttattcgcgggggacaccctccctggagatgactgacaccgggtttcccgagacaacaaaaatttcctcgcaccagacgcattcaccctccgagattcctctggggacccccagtgacggaaaccttgcgtcatctccaacctctggttctacccagatcacccctaccttgacgtcctcaaatactgttggagtgcatattcctgaaatgagcacgtccctgggtaagactgccttaccatcacaggccctgacaatcaccacattcctgtgtcctgagaaggaaagtacctctgcactaccggcttatactcctaggactgtagagatgattgtcaattctacatacgtgacgcattctgtttcatacggccaggacacctcgttcgttgacactaccaccagctcatcaactcgaatcagcaaccctatggacattaacacaactttttcacatttgcactctctccggacccagcctgaggtcacctccgtggcatcctttatctctgagagcacacagaccttcccagaatctctgagcctaagtaccgctgggctgtacaatgatgggtttaccgtcttgtcagataggattactactgcttttagtgtgcctaatgtacctactatgctgccccgcgagagctccatggctacatctacacccatttatcaaatgtccagtctgcccgtcaatgtgacggctttcacgagtaagaaagtcagtgacaccccccccattgtgattaccaagagctccaagactatgcatcccggatgtctcaaatcaccatgcaccgcgacatctgggccgatgtccgaaatgagtagcattccagtaaacaattccgccttcactccggctaccgttagctctgacacttctactcgggtgggactgtttagcaccctgcttagctccgtcaccccgagaaccacaatgaccatgcagacctcaacactggacgtaacgccggtgatatacgctggagccacatccaagaataagatggtatctagtgcgttcacaactgagatgatcgaggctccttctcggattacgccaactacattcttatcacctactgagccgacccttccctttgttaagacagtccccactacaatcatggctggaattgtgactccgttcgtgggcactactgccttttctcccctctctagcaaatccacgggcgccattagttccatccctaaaaccacattcagcccatttctatccgccacccagcagagctcccaggccgacgaggccactaccttgggcattctcagcggcatcaccaaccgatctttgagcacagtgaactccggcactggtgtcgctctgacagacacatacagccgtatcaccgtcccggaaaatatgctcagccccacccatgccgactccctgcacactagctttaatatccaggtcagtccctcactaaccagtttcaagagcgcatctggccccactaagaacgtcaaaaccaccacaaattgcttctccagcaacaccagaaagatgacttccctgctggaaaagacatcactcacaaattatgccacgtccctgaatacaccagtgagttatcccccgtggacgccttctagcgccacacttccttccctgacttcatttgtttatagcccccacagcaccgaggcagagatcagcactcctaagacaagccccccgcccacatcacagatggttgaattccctgtgcttggcacaagaatgaccagctccaatacacagccgctcttaatgactagttggaacatcccgacagctgagggaagccagtttcccatttcgacaacgatcaacgtgccgacctcaaatgaaatggaaacggagactctccacctagtacccggcccattgtctaccttcacggctagccagacaggtctggtgtctaaagacgtgatggcgatgtcttccattccaatgtctggcatcctacccaaccatggactgtcagagaatccatctctgagcacatccctgcgcgctattacatctacactggccgacgtgaagcatacattcgagaaaatgacgacttcagtaacacccggaacgactctgccttcgatcctttcaggcgccacaagtggtagtgttatctctaagagccccatattgacttggctcctgtctagcttaccttcagggtcacccccggcgactgttagcaatgccccccacgtcatgaccagcagcacggtggaggtgagtaagagcacattccttacaagcgatatgatctctgctcatcccttcacaaacttgaccaccctcccttccgcaaccatgtccaccatactgacacgcaccatcccaacacccacactcggcggaatcacaacgggcttcccaacctctctgcccatgtccataaacgtaactgacgacatcgtctacatctccactcatcccgaagcttcatccaggacaaccatcacggccaacccccgtaccgtctctcacccatcttcctttagcagaaagactatgtcaccttctacaaccgaccacactctgtcagtgggcgccatgccgttgccttcaagcactatcacatcctcctggaacagaatccccacggcttcatcgccttctacactgattattcccaagcctacgttagatagccttctgaatattatgactacgacaagcaccgtgcctggcgcatcatttcccctgatatctaccggtgtcacgtatccttttacagccaccgtgtctagccccattagttcattcttcgagactacctggctggactctaccccaagtttccttagcacagaggcctccacctcacctactgccaccaaatcaaccgtgtccttctataatgttgagatgagcttctccgtctttgtcgaggaaccacgcatcccgataaccagcgtcatcaacgagttcacggaaaattccctcaacagtatcttccagaatagcgagttctcattggctaccctggagacgcagatcaaatcaagggatatatccgaagaagaaatggtgatggatagagcaattctggaacaaagagagggtcaggagatggcaaccatttcttatgtcccttattcatgtgtctgtcaagtgatcatcaaagcctcttcttcgctcgccagcagtgagttgatgaggaaaattaaaagtaagatccatggcaatttcacgcacggcaacttcacccaggaccagctgacactgctagtaaactgcgagcatgtcgccgtgaaaaagctggagcccggcaactgcaaggcagacgagactgctagcaaatacaagggcacctacaagtggctcctcacaaaccctacagagactgcccagacccggtgcataaaaaacgaggacgggaatgccactcgattttgctccatctcaattaataccgggaaatcacagtgggaaaaaccaaagtttaaacagtgtaaactccttcaggagctcccagataagatcgtggatcttgcaaacataaccatttccgatgagaacgctgaggacgttgctgagcacatcctcaatctgatcaatgaatcaccagctttggggaaggaggaaaccaagataatcgtttcaaaaatatccgatatttcacagtgcgacgagatcagtatgaatcttacacacgtgatgttgcaaattattaacgtcgtcctagaaaaacagaataactcagcctccgacctacatgaaatctctaatgagatcctccggatcatagaaagaacaggccataaaatggaattttccggacaaatagcaaatctcactgtggccgggctggcattagccgtgctcaggggagatcatacattcgacggtatggctttctctattcacagctacgaggaaggtacagatcctgagatctttcttggtaatgtccctgttggcggaatcttggcgagtatctatctcccaaagtctctcacagagcggattccactgtctaatcttcagacaattctcttcaacttcttcggccaaacaagcctcttcaaaaccaagaatgtcaccaaggccctcaccacctacgttgtaagcgcttcaatatctgacgatatgtttattcagaatttggccgatcccgtggtaatcactctgcagcacatcggcggcaaccagaattacgggcaggttcattgcgcgttctgggactttgagaataacaacggattgggcggctggaatagttcaggctgtaaggtaaaggaaactaatgttaattacactatctgccagtgcgatcacctgacacactttggcgttctcatggatctcagcagatccacggtggactctgtgaatgaacagatcctggccctaataacatacaccgggtgcggcataagcagcatctttctgggggtcgccgtggtgacctacattgcttttcacaagctccggaaggactatcccgccaagatactgatcaatctctgcacagcactgttgatgctaaatctcgtgttcctgatcaactcttggctgtctagtttccagaaggtcggcgtttgtatcaccgctgctgtggctctccattatttcttgctggtgagctttacctggatgggactggaggcagtacacatgtacctcgccctcgtcaaagttttcaatatttatatccctaactatatcctgaagttttgtcttgtgggctggggtatcccggctatcatggtggccatcaccgtctcggtcaagaaagacctatacgggacgctctctcccaccactccattttgttggattaaggacgatagtattttctacatctccgttgttgcatacttttgtctcatcttcctcatgaacctatctatgttctgtactgtgctcgtacagttgaactctgtcaaatctcagatccaaaaaacacgacgaaagatgatattacacgatctcaagggtaccatgtcacttacattccttctagggctgacctggggcttcgcctttttcgcatgggggccgatgcgcaatttctttctctatctgtttgctatattcaataccttgcagggtttcttcattttcgtattccattgtgtgatgaaggagtctgtgagagagcagtggcagatccatctatgctgtggatggcttcggctcgacaacagtagtgatggttcctcaaggtgccagattaaagtgggatacaagcaggaaggtcttaaaaaaattttcgaacataaactcctcaccccatccctgaaaagcaccgccacatccagcacttttaaatctctgggatctgcccaaggaaccccctccgagatatcctttcccaatgatgatttcgataaggatccatactgctcatctccttag

SEQ ID NO: 26447 - DNA, 8628 bp, Artificial Sequence
  Description of Artificial Sequence: Synthetic coding sequence
atgaaagaacatattatttaccagaagctttatggcctcatcctgatgtcctcgtttatcttcctgtccgtagttcccgaaaacatgacgatacaagaaaagagcacgaccgtttcgcaacagatcgatatgacaactcctagccagattacgggggttaaacctcaaaacacagcccactcttccacgttattatcccaatctatccccatcttcgcgacagactacactaccattagttactctaatactacatcccctccactggagaccatgacagcgcagaagatcctcaaaaccctggttgatgagaccgcgactttcgccgtggacgtgctgagtacaagctctgccatctccctacccacccaatctatcagcattgataacaccactaacagcatgaagaagacgaagtcaccaagttctgagagtacaaaaacgacaaagatggtggaagccatggcgactgagattttccagccaccaaccccctccaacttcctgtccaccagccggttcactaaaaatagcgtcgtgtccactacctcagccataaagtcgcagtccgcagttacaaaaacaacttctctgtttagcacaatcgagtctacctccatgagcaccaccccttgtcttaaacagaagtccaccaataccggggctctgccaattagcaccgctggtcaagaattcatcgagtcaacggccgctggcacagtgccttggttcacagtggagaagacctcccctgcctctacccatgtagggactgccagctcgttccctcccgagcccgtgctgatctccacagccgcacctgtggacagcgtgtttccacgaaaccaaaccgcgtttccactcgccaccaccgacatgaaaatcgccttcacggtacactcactcacactaccaacgaggctgatcgaaactactcctgctccaaggaccgccgaaactgagttaacgtccactaattttcaggatgtgtcacttccacgcgtggaagacgctatgtcaacgagtatgagcaaggagactagttcgaagactttctctttcctgacatcctttagcttcaccgggactgaatcagtacagaccgtcatagacgccgaggctacacgtacggccctgacacccgagatcacactcgctagcacagtggccgaaacaatgctgtccagcacgataaccggcagggtgtatacacagaacacacctactgccgacggacatctcttaacattgatgagtaccaggtccgcctccacgtccaaagcaccggaatctgggccaacttctacaactgacgaagctgcccatctgttcagctccaatgagacaatctggacgtctaggcccgaccaagctctcttagcaagtatgaataccactactatactaacatttgtgccaaacgaaaactttaccagcgcattccacgagaacacgacttatacagagtacttgtccgctactaccaacatcacccccctcaaggcatcccccgaaggcaaggggaccactgccaacgacgccactacagcccgatatactacggctgtgagcaagctgacgtccccctggtttgccaactttagtattgtaagtggaaccactagtataacaaatatgcccgagtttaagctgactaccctgctactgaaaactattccgatgagcaccaagcccgccaacgaactgccgttgactccacgcgagaccgtggtcccatcagtggatatcatctcaacgcttgcttgtattcagcccaacttcagcacagaagaaagcgcgtccgagacgacacaaactgagattaacggagccatcgtgttcggaggcactaccacaccagtgccgaagtctgctaccactcaacggctcaatgcaactgtgacccgtaaggaagccacatcccactacctgatgcgcaagtcaaccattgctgcagtcgctgaggtgtcacctttctctactatgctcgaagtgaccgacgagtcggcacagagggtgactgcctccgtgacagtgtcttcttttcccgacatcgagaaactgtcaacgcctcttgacaataaaaccgctactacagaggtgagggagtcctggctgctgacaaagttggtcaagaccacacctcgatcatcttataatgagatgacggaaatgttcaattttaaccatacctatgtggcacactggacttctgaaaccagcgagggaatttccgcaggatctcctacgtctggatctacacacattttcggggaacctcttggggcctctacaacacgcataagtgaaacatccttttctacgaccccaaccgaccgtaccgccacctctctgagtgatggcatcttgccccctcaaccaaccgccgctcattcctctgcgacacccgtgcccgtaacacacatgttttccctaccagtcaatgggtccagcgttgtggcggaagaaaccgaggtaacgatgtccgagccatccaccctggctcgggccttctctacgagtgttttgagtgatgtcagcaacctttcctctaccaccatgacgacagccctggtgccacccctggaccagaccgcaagcactaccatcgttatcgtcccaactcacggggacctgatccgaaccacatcagaagccacagtgatttcggtacgtaagacttccatggcagtgccatcgctgaccgaaacgcctttccacagccttaggttgtctaccccagttaccgccaaggcagagaccaccctgttctctacctcggtcgataccgtgacacccagcactcatacccttgtatgtagcaagcccccccccgacaatattccacctgcctcctcgactcacgttatcagtactacaagtacgccagaggccacccaacctatatctcaggtggaagagacctcaacctacgctcttagctttccctacaccttctccggaggtggggttgtcgctagcctggcgaccggaaccaccgagacctctgtggtcgatgagaccacaccgagccatatatctgcgaacaagttaaccacctctgtgaattcacacatttcctccagtgcaacttacagagtgcacactccagtgagtattcagctggttacctcaacctctgttctgagttctgataaggatcagatgactatttctctgggaaagaccccccgaacaatggaggtaacagaaatgtccccctctaagaatagcttcattagctatagccgcggcacaccctctctcgagatgaccgacactgggttccccgagacgactaaaatatccagccatcagacgcattccccttctgaaatacccctcgggacgccatcggatggaaacctcgccagcagccccacaagcggttcaactcagatcacgcccacactgacctcctctaatacagtgggagttcacatacccgaaatgtccacctccctcgggaagacagccctgcctagccaggcactcacaatcacaacttttctgtgtcctgagaaggagagcacgtccgctctgcctgcgtatacccctagaacggtcgagatgatcgtgaatagcacttacgtcacccactcagtgagctacggtcaggatacatccttcgtggatacaactaccagcagcagtacaaggatctctaatccaatggacatcaataccacattttctcatctccacagcctgcgaactcagcctgaagtaacctcggtggccagcttcatcagcgagtccacacaaacctttcccgagagcctcagcctgtcaactgccggcctctataatgatgggttcacagtattaagcgatcgaatcactactgcattttcagtgcctaacgttcccactatgttgcccagagaatcatccatggcaacaagcacacccatttatcagatgtcttcactaccagtgaacgtgacagcatttacatcgaagaaggtttccgatacacctccgatcgtgataaccaaaagtagcaaaactatgcatccaggttgccttaagtccccttgtactgccacatctggccctatgagcgagatgtcatcaatccctgtgaacaatagcgcatttactcctgccaccgtgagcagtgatacctccacccgtgtgggactcttctccaccctgctgagctcagtgactccaaggacaacaatgacgatgcagacctccaccctcgatgtgaccccagtgatatatgccggcgccaccagcaagaacaagatggtttcctccgcgttcaccactgaaatgattgaggcaccttccagaattacccctaccacattcctgtctcccaccgagcccacacttcctttcgttaaaacagtaccaacaacaataatggccggcatcgttacgccttttgttgggacaacagccttcagtccactgagctcgaagagtactggagccatctccagcatacccaagacaaccttctccccttttctcagcgctacccaacagtccagtcaagctgacgaggcaacgacactgggaatcctgtctgggataaccaatcgatctctaagcacggtgaactcaggcaccggcgtcgcacttaccgatacgtactcacggatcacagtgccagaaaacatgttgagccctacacacgctgactcattgcacacatctttcaacatccaagtgagccccagtcttacgtccttcaaaagcgcctcaggtcccactaaaaatgtaaaaaccacgaccaactgcttctcttccaacacgcggaagatgactagcctactggaaaaaactagtcttacaaattacgctacatcactcaacacaccggtgtcataccccccatggaccccatccagtgcgaccctaccgagtctcacaagttttgtgtattcgccacattccacggaggcggagatctccacacccaagacgagccctcctccaacttcccagatggttgaattcccagtgttaggaacaaggatgacctcaagtaatacacagcctctgctgatgacttcctggaacatccccacggcagaaggaagtcagttccctattagcaccacaatcaacgtcccgacttcgaacgagatggaaacagagaccctgcacctcgttcccggtccacttagtacttttactgcttcacagaccggcctggtgtcaaaggatgtgatggctatgtcttctatcccaatgagtggcatcctcccaaaccatggtctcagtgagaaccccagtttgagcaccagtctgagggccattacaagtaccttagcagatgtgaaacacacatttgagaagatgaccacctctgtaactccgggaaccacactgccctccattttgagcggggcaactagtggatctgtgatctcaaaaagcccaattcttacttggctcttaagtagtctgccatctggatccccgcccgcaactgtatccaatgcccctcacgtcatgacttcttcaactgtagaagtgtctaaatccaccttccttactagcgatatgatcagcgcacacccttttactaacctgactacactcccgtctgccaccatgagtacaatcttgaccaggacaattccaactcccactctgggcgggattaccactggctttcccacatcactacctatgtccatcaacgtgactgacgacatcgtgtatattagcacccatccggaggcttcttcccggactactattaccgccaatcccagaactgtgagccatcctagttctttttcacggaaaaccatgagcccatccactacggaccataccttatccgtcggggctatgcctctgcccagctcaactattacatcctcatggaaccggatccccaccgcctcatctccatccactcttatcatccctaagccaaccctggacagtctgcttaatatcatgaccacgacctccactgtccccggagcctcatttcctcttatttccactggtgttacctacccgttcacagcaaccgtctcatcccccatctccagtttttttgagaccacctggctagacagtactccgtccttcctctcaaccgaggcttcaactagtcccaccgccaccaagtctactgtttccttttacaatgtcgaaatgtcattctcagttttcgtggaggagccacgcattccaattacgagtgttatcaatgagtttaccgagaattccctgaatagcattttccaaaactctgagttttctcttgctaccttggagacccagatcaagtctcgggacataagtgaggaagaaatggtcatggatcgagctatcctagaacagcgggagggccaggaaatggccacaataagttacgtgccttactcctgtgtgtgtcaggtgatcatcaaagcctcctcatcccttgccagctctgagctcatgaggaaaatcaagtcgaagattcatggcaactttactcatggaaacttcacacaggaccagcttactttgttagtgaattgtgaacacgtggctgtaaaaaaactggaacctggtaactgcaaggccgacgagactgcgtcaaaatacaaggggacatataaatggctactgacaaatcccaccgagacagcccaaactagatgtataaagaacgaagacggcaatgccacgagattttgcagcattagtatcaatacaggaaagtcccagtgggagaagcccaagttcaagcagtgcaaactcctgcaggagttacccgacaagattgtcgatctcgctaatatcacaattagcgatgagaacgcagaagatgtggctgaacacattctgaacttgatcaacgaatcccctgcacttggcaaggaggagactaagattattgtctccaagattagcgatatttcccaatgtgacgaaatatccatgaacctgacccatgtgatgctgcaaattatcaatgtggttctcgagaaacagaataattccgcatctgacctgcacgagatctctaatgagattctgcgaatcatcgagcgcactgggcataaaatggagtttagcggacagatcgctaacctcaccgttgcaggcctggccctcgccgtgcttcgcggcgatcacacattcgacggcatggcctttagcatccactcctatgaagaggggaccgatcccgagatttttttaggaaatgtgccagtgggcggcatcctggcctccatctacctcccaaaaagtctaactgaacggatcccactgagcaacttgcagaccatccttttcaattttttcggtcagacttccttatttaaaacgaaaaatgtcactaaggcccttactacatacgtcgtaagtgcctccatttccgacgacatgttcattcaaaacctggcagatccagttgtgattactctacaacatatcggaggtaaccaaaattacgggcaggtccattgtgcattttgggactttgagaacaacaatgggctgggcggttggaactcctctggatgtaaggtgaaagagaccaacgtcaattacacaatttgccagtgcgaccatcttacccattttggcgtcctgatggatttatcccggtccactgttgactccgtgaatgagcaaatcctggccttgattacttacactggatgtgggatctcatctatcttcctgggggtggctgtagtgacttacatcgcttttcataaacttcgaaaagattaccccgctaagatactaattaatctttgcactgcactcttgatgctgaatctggtgtttctcataaacagctggctctcttcattccagaaggttggggtctgcatcacggccgctgttgctctacactactttctgctggtcagctttacgtggatgggcttagaagcggtgcacatgtacctggccctggtgaaggtattcaacatctacatacccaactatattctgaaattctgccttgtaggttggggtataccagccattatggtggccattacagtctctgtgaaaaaggatctctacggcactctgtcgccgaccacgccattctgttggatcaaggatgacagcatcttctacattagtgtagttgcttacttctgtctgattttcctcatgaatctctcgatgttttgcaccgtgctagttcaactcaacagcgtgaaatctcaaattcagaaaactaggaggaagatgattctacatgatctaaaaggaaccatgagcctgacttttctcttggggttgacttggggcttcgcattttttgcttgggggcctatgcggaactttttcctttatctgtttgccatttttaataccctacaggggttcttcatttttgtgttccactgtgtgatgaaggagtctgtcagggagcagtggcagatccatctctgttgcggctggctgaggttggacaatagttcagacgggtcttctcggtgccagattaaggtcgggtataagcaagagggactgaagaagatctttgaacacaagctgctgacacctagtcttaaatcaacagccacaagtagcaccttcaagtcccttgggtccgctcaaggcacaccatcagagatctcatttcctaacgacgacttcgacaaggatccttattgtagttctccgtag

SEQ ID NO: 26448 - DNA, 3240 bp, Artificial Sequence
  Description of Artificial Sequence: Synthetic coding sequence
atggtctgttccgcggctccactgctgctgctggctacaacactaccactcctcggaagtcccgttgcccaggcgtcccaacctgtgtcagaaaccggggttcggccccgagagggactgcagcgccgccagtgggggccactgatcgggcgcgacaaggcctggaacgagaggatcgaccggcctttcccggcttgtccaatacctttatccagcagcttcggaagatggccaaaggggcaaaccatgtgggcacaaacatccacgctgaccttgacggaagaggaactggggcagtctcaggccgggggcgagtcaggatctggccagcttctggaccaggagaatggagctggggagagcgcactggtaagtgtgtacgttcacctcgattttcctgacaagacttggcccccggagctgagtaggacactcacccttcccgctgcaagcgctagctcgtccccacggccgttgctcaccggattgagactcactactgagtgtaacgttaatcataagggcaacttctactgtgcctgcctctcaggctaccagtggaacacgtctatctgtctgcactacccaccctgtcaatctctgcacaatcaccagccttgtgggtgcctggtgttctcccaccctgagccaggctattgtcaactgctgcccccaggatcgccagtgacctgccttcccgccgtcccaggaatcctgaatcttaattctcagctccagatgcccggagatactctgtcgcttacacttcacctgagtcaagaagcaactaacttgagctggtttctcagacatcccgggagccctagccctatcttactgcaacctggcactcaggtatcagtgacttcatcacacggacaagcggccttgtctgtgagcaacatgtcccaccattgggcgggcgaatacatgtcctgtttcgaggcacaggggtttaagtggaatctgtatgaggtcgtgagagtcccattgaaggccaccgacgtggcgcggctgccttaccagctgtctatcagctgcgccacctccccaggattccaactcagttgctgcattccgtctacaaacctggcctacactgctgcatggagccccggcgaaggatccaaggcatccagcttcaatgaatctggcagtcagtgttttgtcctcgctgtacagcggtgtcctatggcagacacaacatacgcttgcgatcttcaatctctaggcctcgctcctctacgagtacccattagcatcaccatcattcaagatggcgacatcacatgtcccgaggacgcaagtgtgttgacctggaatgtgaccaaggcaggccatgtggcgcaggccccctgccccgagtccaagcgagggattgtcaggcgcctatgtggagctgatggagtctgggggcccgtgcactcttcatgtaccgatgccaggttgttggccctgtttacccgcactaagttacttcaggccgggcagggaagccccgcagaagaggtaccccagattcttgctcagctgcctggccaggccgcagaagcgagcagcccatcagatttgctcactcttctgtccaccatgaaatacgtcgctaaagtggtggcagaagcacgaatccagctcgacagacgcgctctgaagaaccttttaattgccaccgataaggtgctagatatggatacaaggagcctctggactctggctcaagcccgcaagccctgggcgggctcgactctgctgctcgccgtagagaccctggcttgtagcctttgtccccaggatcacccctttgcgttctcccttcctaacgtcctgttgcagagccagctatttggcccgaccttcccagcagattattctatctccttccctacgagacctcctcttcaggcccaaatcccaaggcattcattggctccgcttgtgaggaatggcaccgagatttcaattacctcgcttgtgctgaggaaactggaccacttgctgccttctaattacggtcaggggctgggggatagcctgtatgcaacccctgggttagttcttgttatctcaatcatggccggggacagagcgtttagccagggcgaggtgattatggatttcgggaacaccgacggaagtccccattgtgttttctgggaccatagtctgtttcaggggcgtggcgggtggtccaaggagggctgtcaagctcaagtagctagcgcctcacctactgctcagtgtctgtgccagcatctgaccgcattctctgtgctcatgtcccctcatacagtacccgaagaaccggccctcgccctgctgacccaggtgggcctgggtgccagcatcctggctctactcgtatgcctgggcgtgtactggctcgtctggcgcgtcgttgtcagaaacaaaatttcatatttcaggcacgcagccctgctcaatatggtgttttgtctcctcgcagcagatacctgttttttgggagcacccttcctcagtcccgggccccgttctccactgtgcctagcggctgcctttctttgccacttcctgtatctggccacgtttttctggatgctcgcacaggcgcttgtgctggcgcatcagctgttgttcgtgttccatcagcttgctaagcacagagtgctccccctgatggtgctcctgggttacttgtgccctctgggattagcaggcgtgaccttgggcttgtacctgccgcaaggacagtacttacgagagggcgagtgctggctggacggcaaagggggggcactgtacaccttcgtgggcccggtgctggccatcattggggtaaacggcctggtgctggcgatggccatgttgaagttactccggccctccctcagcgagggcccccccgccgaaaagaggcaggctttgttgggggtgataaaggcactcctgatactcacccccatattcggtttaacctggggactgggcctggcgacccttctggaggaagtgtccaccgtccctcattacatcttcacgattttaaacaccctgcagggggtgttcatattactttttggatgtttgatggaccgcaaaattcaggaggccctgaggaagcggttttgcagagctcaggccccttcgagcacgatttccctggtctcttgctgtctccagatccttagttgcgcctctaaatctatgagcgagggcattccgtggccctcatccgaggatatgggcacagcaaggagttag

SEQ ID NO: 26449 - DNA, 2622 bp, Artificial Sequence
  Description of Artificial Sequence: Synthetic coding sequence
atgactaccaggaagctgtctgcacactccgctgcaacgcccggatacaaagccgtgacacacaagcatcatactggatgggcaaggatggccaagacggggctccctgaaaaaggacagtcccaagcagggggcgagagcggcagcggtcagctgctggatcaagagaacggggccggcgagtcagccttagtgtccgtatatgtccacctggattttcccgataagacttggccacccgagcttagtcgaaccctgactctcccggcagcctcagcaagctcctctccgcgcccactgcttacgggtctgcggctgacgacaggggaatatatgagctgctttgaagcccagggtttcaagtggaacctttacgaagtggtccgagtgcctctaaaagcgactgatgtcgctcggctgccataccaactgtccattagctgcgcgacaagcccagggttccagctgtcctgctgtatcccctctacgaatcttgcatacacagctgcttggagcccaggggaggggtctaaggctagcagcttcaatgagtccgggtcccaatgctttgtgctggcagtgcagcggtgcccaatggccgatactacttacgcctgcgacctacaatcgcttgggctagctcctctccgggttcctataagtattacaattatccaagatggcgacattacttgccctgaagacgccagcgtgctgacgtggaacgtaacaaaggcaggacatgtggctcaagcaccttgtcctgaaagcaaacgcgggattgtccgcaggctttgcggggcagacggagtgtggggtcctgttcactcctcatgcaccgacgcgcggctgctcgccctgtttacacgtacgaaactgcttcaggcagggcaggggtcccctgcagaagaggtgccccagattctggcacagctcccaggacaggcagcagaggcttcttccccgagtgaccttttaacattgctgtccacgatgaagtacgtagccaaagtggtggccgaggcgcgaatccagcttgatcgccgagcactgaagaatcttctcatagccacggacaaagtcctggacatggacaccagaagcctgtggacactggctcaggcaaggaagccatgggcaggcagcactctgctgttagctgtcgagaccctggcctgtagtctttgccctcaggaccatcctttcgccttcagtcttcccaacgtcctgttacagtcacagctctttggcccaacgttccctgccgattacagtatttcattccctactaggccccctcttcaggctcagatcccccgccactccttggctcccctggtccgtaacggcaccgaaatcagcattacttcacttgtgttacgaaaattggaccacctgctaccatcaaattatggacagggattgggggacagtctttatgctactcccgggttagtattagtgatttcgattatggcaggagacagggccttttctcagggcgaagtgatcatggacttcggcaacactgacggcagccctcattgcgtcttctgggaccactcgctttttcaggggagggggggttggtcaaaagaggggtgtcaagcccaggtggcatccgcctcaccaactgctcagtgcctatgccaacaccttacggcattcagcgtactgatgtctccccacacagtccctgaggagcctgccctggccctcctgactcaggttggcctcggcgcatctattctcgctctgctggtgtgcctcggagtgtactggcttgtctggcgggtagtggtgcgaaacaagatctcttactttagacatgcggccctgctaaacatggtcttctgcctcctggcggctgacacctgcttcctcggcgcaccattcctatcccccggtcctagatcacccctttgtctggccgccgccttcctctgtcactttctgtacctcgccacgtttttctggatgcttgcacaggctttagtgctggctcatcaactcttgtttgtgttccaccagctggccaaacatagagtgctgcctctgatggtcctcttgggctatctgtgcccactcggactggcaggtgtcacactgggtctctaccttccccaggggcaataccttcgggagggcgagtgctggttagatggcaaagggggcgcgttgtatacatttgtgggacccgtcctcgctatcattggcgtgaacggcttagttctggcaatggctatgctaaagctgctgcggccttctctgtccgaaggaccacccgccgagaaaaggcaggccttactcggtgttatcaaggcactgctgatcctaactcccatttttggcctgacgtggggactgggacttgcgaccctgttggaggaagtgtctacagtcccacactacattttcactattctgaacaccctgcaaggcgtgtttatccttctattcggatgcctgatggatagaaagatccaggaggccctccggaaacgtttctgcagggcgcaagccccaagttcgacaatctccctggcgaccaacgagggatgtatcctggaacattcaaaaggcggctccgatacggccagaaaaaccgacgcatcggagtag

SEQ ID NO: 26450 - DNA, 2028 bp, Artificial Sequence
  Description of Artificial Sequence: Synthetic coding sequence
atggccgataccacctacgcatgtgatctgcaatccctggggctcgctcccttgcgcgtcccgatcagcatcacgatcatccaggacggggatattacatgcccagaagacgcctctgtactcacctggaatgtgactaaggcaggacatgtcgcccaagcaccttgcccagaaagcaagcgcggtatagtgcgaaggttgtgcggagccgacggcgtgtggggccctgtgcatagctcttgcacagatgctaggcttttagctctgttcacccggacaaagctccttcaagcaggtcagggatcccccgcagaggaggttcctcagattttggctcagctgcccgggcaggcagctgaggcctcatccccctcagatctactcactctgcttagcacgatgaagtacgttgccaaggtcgtggcagaggcaagaattcagctggatagacgcgcgctcaagaacttactgattgccaccgacaaagttcttgatatggacacaaggtccctatggacactggcccaggcaaggaagccctgggcaggaagtacgcttctgctggctgtggagaccctggcctgttctctgtgtccacaagatcacccgtttgccttttcccttcccaatgtgctcctgcaaagtcagttatttggacccacattcccggccgactactctatctcctttccgacccgacctcccttgcaggcacagattccccgacactctctggccccgctggtgcgtaacggcacagaaatatcaattacctctctcgtcctgagaaaactggatcacctgctcccgtctaactatggccaaggtctcggagattcgctctacgcgactcccggcctagtattggtaatttcaataatggcaggagatcgcgcgttcagtcagggcgaggtcatcatggacttcggtaacaccgacggcagccctcattgcgtgttttgggatcacagcctctttcagggaagaggcgggtggagcaaagagggctgtcaggcccaggttgcctctgcttcacctacagcacagtgcctgtgccagcatctcacagcctttagtgtcctgatgtcacctcataccgtccccgaggagcccgctcttgccctgctgacacaagtcggccttggagctagcattttggctctgttggtctgcctgggtgtgtactggttggtgtggagggtcgtcgtccgcaacaaaatctcctattttcgccacgcagcactgctgaacatggtgttctgtctcttggccgccgatacatgtttcctcggcgccccgttcttatctccgggacccagaagtcccctgtgtctggctgctgcatttctgtgccacttcctctatctagccacgttcttctggatgctggctcaggcactggttctcgctcaccagttgctatttgtattccatcagctggctaagcatcgcgtacttccacttatggtcctgcttggctatctgtgtcccttgggcctcgccggcgtgacactgggtctgtacctcccgcaagggcaatacctccgggagggcgaatgttggttggatggcaaggggggtgctctctacactttcgtaggacccgtgttggctataataggggtcaatgggctggtactcgctatggccatgctaaaacttcttcgcccctcgctgtctgaaggcccccctgccgagaagcggcaggcgttgttgggcgtgattaaagccctgctcatcttaacacctatcttcggcctgacgtggggcttggggcttgctaccctgctcgaggaggtctctaccgtgccccactatatttttactatcctcaataccttgcagggggtttttatcttgctgtttggctgcctgatggaccgcaagatccaggaagctctgcgtaagaggttttgcagagcccaggcccccagctcaaccataagcctggccaccaatgagggatgtattctagagcactccaagggaggatcagatacagcaagaaagacggacgccagcgaatag

SEQ ID NO: 26451 - DNA, 2994 bp, Artificial Sequence
  Description of Artificial Sequence: Synthetic coding sequence
atggtctgcagcgcagcaccactgctgctgctggctaccactcttcccctcctgggctcccccgtcgcccaagcatcccagccaggccaatctcaggctggtggagaatctggctccggtcaactgcttgatcaagagaacggcgcaggagagtcagccctagtaagcgtctatgtccacctagatttcccagacaagacctggccaccagaactaagtaggaccctgacattgccggctgcatccgcatcttccagcccgaggcctttgcttaccggtcttaggctcaccaccgagtgcaatgtgaaccacaaaggcaacttttattgtgcttgcttgtccggctatcagtggaacacctctatttgccttcattatcctccttgtcagtctttgcataatcatcaaccttgcggttgcctagttttcagtcacccagagccaggctactgtcagttgcttcctccaggctcgcctgttacatgcttgcccgcagtgcctggtatactgaacttgaacagccagttacagatgcccggtgatacactgtctctgacattgcacctgtcccaggaagctaccaatctgtcttggttcctgcggcaccccggaagtccgtctccaattcttctgcaacccggcactcaggtgtccgtgacctcctcacacggccaagctgcattgtccgtcagcaacatgtcgcaccactgggccggagaatacatgtcctgctttgaagctcaggggttcaagtggaacctctatgaggtcgtcagagtgcccctcaaagccacagatgtcgccagactcccttatcagttgtccattagctgtgctacgtcacctggcttccagctaagttgctgcattccttccaccaatcttgcgtacaccgctgcatggtctcccggggaggggagtaaggcgagtagctttaatgagtctgggtcccaatgctttgttctcgccgttcagagatgtccaatggccgatacgacctacgcttgcgatcttcagtccctaggcctcgccccgctccgggttccaatcagcatcaccatcattcaggatggcgacataacctgtccagaagacgccagcgtgctgacatggaatgttactaaagcggggcatgtggctcaagcaccatgccccgagtctaagagagggattgttagaagactctgtggtgccgatggcgtgtgggggcctgttcacagctcgtgtacagacgcgaggctgctcgcgcttttcacaaggaccaagctgctgcaagcaggccaaggctctccggccgaggaggttcctcagatcttggctcagctccctgggcaggctgccgaggcctcttcaccttcagacctgttgactctcctaagcactatgaagtacgtggcaaaggtggttgcggaggcacgaattcaactggaccggagagcattgaagaaccttttgatcgcaacagacaaggttctggacatggatactaggtcactctggacgctcgcccaggcacggaagccatgggccggctctaccctgctgctcgctgtcgagaccctggcctgcagcctctgcccacaggaccatccttttgctttttccctgcctaacgtgcttctgcagtcacagttattcggacctaccttccccgccgattactcaatatccttccccacacgcccccctttgcaggcgcagattccacggcattcccttgctccccttgttaggaatggaacggaaattagcatcacaagtttggtcctgaggaaactggatcacctcttacccagcaactatggccaggggttaggggattctctttatgctacacccggcttggtgctcgtcatttccattatggcgggagaccgtgctttcagccaaggagaggttattatggacttcggcaataccgacggctctccccattgtgtgttctgggatcatagcctctttcagggccgaggagggtggagcaaggaaggttgtcaagcgcaggtcgcctcggcatcccctacggctcagtgtctgtgtcagcatctgaccgctttctctgtcctgatgtccccacataccgttcctgaggaacctgctctggcactgctgacacaagttggtctgggggcctccatactggcacttcttgtctgtctgggagtttactggctggtctggagagtggtcgtgcgcaataaaatctcttacttccgtcacgccgctctcctaaatatggtcttctgccttttggcggccgacacttgttttcttggcgccccctttctaagtcctggccctagatctccactttgtttagcagccgccttcctttgccactttctctatctggctacattcttttggatgttggctcaggctttagttcttgcacatcaattgctgttcgtgttccaccaattggccaaacatcgcgtcctcccactgatggtgctgcttggatacctgtgtccccttggactcgcaggtgtgactctcggtctgtacctgcctcaggggcagtacctgagagaaggcgagtgctggctggacggcaaaggaggagccctatatacttttgtaggccccgtcctagcgattatcggggtgaatggcttggtccttgctatggccatgctcaagttattgagacctagtctgtccgagggccccccagccgaaaagcgccaagcactgctcggggtcatcaaggctctgcttatcctgactcccatcttcggcttgacttgggggcttggtctggccaccctcctggaagaagtttcaaccgtgcctcattatattttcaccattctgaacacacttcagggcgttttcatcctgttgttcggctgcctgatggatcgcaaaattcaagaggcactacgcaagcgattttgtcgggcacaggccccgtcatcaacaattagcctcgctaccaacgaagggtgcatcttggagcactctaagggaggcagtgataccgccaggtag

SEQ ID NO: 26452 - DNA, 1587 bp, Artificial Sequence
  Description of Artificial Sequence: Synthetic coding sequence
atggaccactgcggggccctgttcctgtgcttatgcttgcttacattgcaaaacgcaaccaccgaaacatgggaggagctcttgtcctacatggagaacatgcaggtctcccgggggcgtagtagtgtcttttccagcagacagctccaccagctcgaacagatgctgttaaacaccagcttcccagggtataatttaaccctgcagaccccaacgatccagagccttgccttcaagctttcctgtgacttttcgggactttcactgacttccgcgacgctgaaaagggtcccccaagctggtggccagcatgctagaggacaacatgctatgcagttcccagcggagttgacccgcgacgcatgtaagacgcgtccccgggagcttcggctgatctgcatatatttctccaacactcacttctttaaggatgagaataactcttccctgctgaacaattatgtgctgggagcccagctgtctcacggtcatgtgaataatttgcgtgatcccgtcaacataagcttttggcacaaccagagcctggaaggctacacattgacatgtgtgttctggaaggagggagctcggaagcagccttggggtggttggagccctgaagggtgccggacggagcagccttcccacagtcaggtgctctgccgctgtaatcatctcacatacttcgcagtgctaatgcagctctcccccgccctggtgccagctgagctcttagcccccctgacctacatcagcttagtcgggtgtagcatctcgattgtggcgtcactgattacagtgctgctgcattttcattttcgaaaacagtcagattccctgacccgcatccatatgaacctgcatgctagcgtgctgctgcttaatatcgcatttctgttgtcccctgccttcgcaatgtctcccgtacctggttcagcctgcacagctctggccgccgctttgcactatgcactgctgagctgtctgacatggatggccatcgaaggcttcaatttatatctgcttctcgggcgtgtttataatatttacatcaggcgctatgtctttaagctgggcgtcctagggtggggagcccccgcattgttagtgctactgtctctgtccgtcaagtctagcgtatatggcccatgcacaatccccgtgttcgactcctgggagaacggaaccggttttcagaatatgtcaatctgctgggttcgctctccggtcgtgcacagcgtgctggtgatgggttacggagggctgacctctctgtttaacctagtggtgcttgcatgggccctctggacactgcgacgcttgagggaacgggccgatgctcccagcgtgcgcgcgtgtcatgacacggtgaccgtgctgggtctgaccgtgttgctgggcacgacgtgggctttggcattcttttcgttcggagtctttctgctgccccagctgtttctcttcacaatcttaaattccctgtatggattctttctctttctgtggttctgtagtcagagatgcaggagtgaggctgaagccaaagctcagatcgaagccttctcttctagccaaacaacacagtag

SEQ ID NO: 26453 - DNA, 1713 bp, Artificial Sequence
  Description of Artificial Sequence: Synthetic coding sequence
atggaccattgtggcgccctttttctatgtttgtgcctgctgacactgcagaacgccaccacagaaacatgggaggagcttctttcttatatggagaatatgcaggtgtctagggggcgttcatccgtcttttcctctcgccagctgcatcagctcgaacaaatgctactaaatactagcttccccgggtacaatcttactctccaaaccccaactatccagagccttgctttcaaactgtcatgtgatttcagcggcctcagtttgacatctgccaccctcaagagagtgccacaagccggcggacaacacgcacggggtcagcacgcgatgcagtttccagctgagttgaccagggacgcttgtaaaacacgccctcgtgagctgagactgatttgtatctatttctctaatacccatttcttcaaggatgagaataactccagccttctgaataattacgtgctgggggctcagttgagtcacggtcacgtgaataatctgagagatcctgtcaatatctccttttggcataaccaaagtcttgaagggtacactctcacctgcgtattctggaaggaaggcgctcggaaacaaccttggggcggctggtccccagagggctgtcggactgaacagccgtctcactctcaggtgctatgccgatgtaaccatttgacctatttcgctgtgctgatgcagctcagcccagccctggtgccagctgagctcctggctccactgacatacatctctctggtgggatgcagcataagtattgtggctagcctgataacggtcctgctgcacttccactttcgaaagcaatctgactctttaacaagaatccacatgaacttgcacgcttcagtattgctgcttaacattgcttttctgcttagccccgcattcgccatgagcccggttcccggctcggcatgtacagcgctcgccgccgccctgcattatgcactattgtcctgcttaacttggatggctatcgaggggttcaacctgtatctgctgcttgggagggtgtacaatatctacatacggagatacgtgtttaagctgggggtacttggatggggggctccagctctgctcgtgctgttatcgctcagcgtgaagtcttcagtctacggcccctgcaccatacccgtctttgattcatgggagaacggcaccggctttcagaacatgtcaatctgttgggtaagaagccctgtcgtgcattctgtgctcgttatggggtatggcggcctgacgtccttgttcaacttggtggtcctggcttgggccctctggacattgagacgactgcgcgagagagcagatgcaccgagcgtccgcgcatgccatgataccgtcactgtattgggcttaacagtcctccttggaacaacctgggctcttgcattcttttcctttggcgtgtttttgttgccacaactcttcctcttcacaattcttaattccctgtatgggaagggtgggggaacagtaagcaagaagtccgatgatacaacagtgttcctgaagaacgatgagaccgcgtgggggaaactgttgtgcctcccttatagcggatttttttttagtaaaccaatctcgagcctggcgatgatacgggggaatactccagctcctgtaggaggtgatgacattcccgcaatctatgaggtggagcatttccagcaagagcaggtatag

SEQ ID NO: 26454 - DNA, 1356 bp, Artificial Sequence
  Description of Artificial Sequence: Synthetic coding sequence
atggatcactgcggggctctgttcctgtgtctctgcctccttaccctccaaaatgctactactgaaacctgggaggaattgctgtcttatatggagaatatgcaggtatctaggggacgatcatcggtcttcagttcacggcagctccaccagctggaacagatgctgctgaatacttcttttcccggatataatttgaccctgcaaacaccgaccatccaaagcctggcttttaaactgtcatgtgacttctccgggctgagtctgaccagtgccaccctcaagcgagtgccacaggctggaggacagcacgcacgcggtcaacacgctatgcaatttccggcggagcttactagggatgcttgtaaaacgagaccaagggagttacggctgatctgcatctacttttcaaacacccactttttcaaggatgaaaacaatagttccctgctcaataattatgtgctgggagcccagctgagtcatggacatgtcaacaatctgagagaccctgtgaatatctctttttggcacaaccagtccctggagggatacaccctgacctgcgtgttttggaaggagggagcgcgtaagcagccgtgggggggatggtcaccagaagggtgccggacagaacagccatcccacagtcaagttctctgccgctgtaaccatctgacatactttgccgtcctcatgcaactatccccagcactcgtaccggccgaattactggcccctctaacctatatttctctggtaggttgcagcatctctatcgtcgcatcactcattaccgtcctgttgcattttcactttagaaaacagtcggacagtctaacacgcatccacatgaacctgcacgcctcggtccttctgcttaacattgcctttttactcagtcccgccttcgccatgagtccggtccccggcagcgcctgtaccgccctcgctgccgcccttcactatgcactcctctcttgtttgacttggatggctatcgaggggttcaatctgtatttattgctggggcgggtctacaatatctacattcgtagatacgtattcaagctcggtgtgctgggatgggacgccggctgtggagcaccctggtgtaccgtttcctggtcttgggctacagccgcttcccgcccgtcttcgacttggtggtgctggccgggacgttgcggaccatgtgccggctgtgggtccggaagaatgcaccaggtgtcgggtcctgcaatgacattgtccctctgttgggcgtctccctgttgttgggaaccgcccggcccatggccatccttcctcctggccagctcttgttgcccatcctgttcatcttctccaagctag

SEQ ID NO: 26455 - DNA, 4041 bp, Artificial Sequence
  Description of Artificial Sequence: Synthetic coding sequence
atgaagtcgccgaggcgaacgaccctgtgcctgatgttcatcgttatatatagttcaaaagctgctcttaactggaattatgagagtacaattcatccactctctctacatgagcacgagcctgcaggagaggaagctctgagacagaaacgggcagtcgctacaaagagcccaacagctgaagaatataccgttaacattgaaatcagttttgaaaatgcgagcttcttagatcctattaaagcctacctgaatagtctcagcttcccaatacacgggaataacacagaccagatcacagatatcctgtctattaacgtgactaccgtgtgcaggcccgccggtaatgaaatctggtgttcctgtgaaacagggtatgggtggcctcgcgaaagatgcttgcacaacttaatctgtcaggaaagagacgttttcctgcctggccaccattgtagttgcctgaaagaacttcctccaaatgggccattctgcttattgcaggaagacgtcaccttaaacatgcgtgtcagactcaatgtcgggttccaggaggacctcatgaataccagtagcgctctgtaccgcagctacaagacagacctcgagactgcgttccgtaaggggtatggtatcctccccgggtttaaaggcgtgacagtcaccggctttaagtcaggaagcgttgtggtgacctatgaggtcaagactactcctcctagtttggaacttattcataaagccaacgaacaggtcgttcaatccctgaaccagacgtacaaaatggattataactcattccaggccgtgactatcaacgagagcaacttcttcgtgacccccgaaattatctttgagggagatactgtgtcccttgtctgtgagaaggaggtactcagctcaaatgtttcatggcgctatgaggaacaacagttagagatacagaattccagtagattcagcatctatacggcactcttcaataatatgaccagcgtctccaagttaacaattcataatatcacccccggggacgcgggcgaatacgtgtgtaagctaattctggatatctttgaatacgagtgcaagaagaaaatcgacgtaatgcccatccaaatccttgccaatgaggaaatgaaggtgatgtgcgataacaacccggtcagtttgaactgctgttcccaggggaatgtcaactggagtaaggtggaatggaagcaagaaggcaaaattaatattcccggaaccccggagaccgatatagactctagttgctctcggtacacattgaaggctgatgggacccaatgtccgtccgggtcgtcaggtaccacagttatctatacttgtgaattcatctccgcttatggcgcccggggctccgcaaatatcaaggttacattcatctccgtggccaatttgaccatcactccggatccgatctccgtcagtgagggtcaaaacttcagtataaagtgcatatcagatgtgagcaattacgatgaggtctactggaacacgtccgcgggaattaagatttatcagaggttctacacgacgaggcgctatcttgatggagccgaaagcgtactgaccgtcaagacaagtaccagagagtggaatggtacttatcattgtatcttccggtacaaaaactcctactctatagcaaccaaagatgttatcgtgcacccacttccgctcaaactgaacataatggtcgatcccctggaagccactgtgtcctgctctggctctcaccacattaagtgctgtatagaagaagacggcgattataaggttacgtttcatacaggctcgagttccttacccgcagctaaggaggtaaacaagaagcaggtgtgttacaaacataatttcaacgcgagttctgtgagctggtgctctaaaacagtggacgtttgttgtcacttcactaacgcagccaacaattcggtttggtctccctccatgaagctgaacctggttcccggtgagaatattacttgtcaagatcccgtgattggggtgggagaaccaggaaaggtaatccagaagctgtgccgcttttcgaatgttcccagcagccccgagtcaccaattggagggacgatcacctacaagtgtgtggggtctcagtgggaagagaagagaaatgattgcatctccgccccaatcaattctctgctgcagatggcgaaagcactgatcaaaagcccgtcacaggatgaaatgcttcctacctatctgaaagacctgtccatcagtatagataaggccgagcacgagatcagcagctcgccgggatcccttggagcgattattaacatcctggatctgctgagcactgtgccaacccaagtcaattccgagatgatgacccacgtgctttcaacagtgaacgtgatcctgggcaagcctgtgctgaacacctggaaggttctacagcagcagtggacaaatcagtcgtcccaactcctgcattcagtggagcggttttcccaggctctacagagcggcgatagccctcctctttccttcagtcagacgaatgtgcagatgtcaagtatggtcatcaagagctctcaccctgagacctatcagcagaggttcgtgttcccctactttgacctgtgggggaacgtagtcattgacaagtcatacctcgaaaacttacagagcgacagtagtatcgttacaatggcatttcctacgctgcaagctattttagcccaggacattcaggagaacaactttgctgagtcactggtcatgacaaccacagttagtcacaatacaacaatgccatttaggatcagcatgacctttaaaaataattcccccagtggaggggagaccaaatgtgtgttttggaactttcggctcgcaaataacactgggggttgggacagtagcggatgttacgttgaggaaggggacggtgataatgtgacctgtatatgtgatcatctgacaagtttttctatcctcatgagtcctgacagcccagatcccagctcgctgctcggaatcctgctggacataatttcctatgttggcgtgggatttagtattctgtcgctggcggcctgtctcgtggtcgaggctgtcgtatggaagtccgtgacaaagaaccgcacttcttacatgcgccatacatgcatcgtgaacattgcagcatctctgttggtggccaacacgtggtttatagtcgttgcagcaatccaggacaatagatacattctctgcaagactgcatgtgtagctgctaccttcttcatccactttttctacctgtcagtatttttttggatgctgactctaggattgatgctcttctaccgtctagtgttcattctccatgaaacatcaaggtcaacacagaaagctatcgcattctgcctcggctacggttgtcctctggccatcagcgtgatcaccctaggtgcaacccagccgagagaagtttacacacggaagaatgtgtgttggctgaattgggaggacacaaaagctttgcttgccttcgctatacccgccctgattattgtggtcgtcaatatcaccataaccattgtcgtgattactaagatattacggccatccatcggggataagccttgtaagcaagaaaaatcatcactgttccaaatctctaaatctataggcgttttgacacccctgctgggcttgacctgggggtttgggcttacaaccgtattccccgggacgaatttagtttttcatattattttcgcgattttgaatgttttccaggggctgtttattctgctgttcggctgtctctgggatcttaaagtacaagaggcactgctgaataaatttagcttgagccgctggagttctcagcattccaaatctacatccctcgggtccagcactcccgtcttttctatgtcatctccaatctcccgacgttttaacaatctgtttggaaaaaccggaacctataatgtttcaacaccagaggccacttcttcttcactggaaaacagctcttccgcgagttcactgctcaattag

SEQ ID NO: 26456 - DNA, 4041 bp, Artificial Sequence
  Description of Artificial Sequence: Synthetic coding sequence
atgaagagcccaagaaggactacactgtgcttgatgttcattgttatctactcgtccaaggcagccctgaactggaactatgagtctaccatacaccctttgtcactgcacgaacatgagcccgcaggcgaggaggctttacgacagaaaagagccgtggcaaccaaaagccccacagccgaagagtatacggtgaacatagagatctctttcgagaacgcttcttttctggaccccataaaagcttacctcaattcccttagcttccctatccacgggaacaacacggaccagattacagatatcctgagtatcaacgtgaccaccgtgtgccggcccgcggggaatgagatctggtgcagctgtgagacaggatacgggtggccacgggagcggtgtctgcacaatctcatttgccaggagcgtgatgtttttctgccaggccaccactgttcctgtctgaaggagttacctccgaacggacctttttgtctgctccaggaggacgtcactctgaacatgcgtgtgagattaaatgttggcttccaggaggacctaatgaacacttcctctgcactatatcgtagttacaagacagatttggagacagcgttccgcaagggctacgggatcctgcccggattcaagggcgttacagttacaggtttcaagtccggctccgtcgtggtcacctacgaggtgaagacaacgccgccaagcctggaattgattcacaaagccaatgagcaagtggtacagagccttaatcaaacatacaagatggattacaattctttccaagctgtaactattaatgagtctaactttttcgtgacacccgaaattattttcgagggagatacagtgagcctggtttgtgagaaggaagtgttgagcagcaacgtgagctggagatacgaagaacagcagctggagattcaaaactcaagtcgtttttccatatacacagccctgttcaataatatgacaagcgtatccaagctgacaatccacaatataacacccggtgacgccggagagtatgtttgtaaactcattctggatatcttcgagtatgaatgtaaaaaaaagatcgacgtcatgcctatccagatcttggcaaacgaggaaatgaaggttatgtgtgataacaatcctgtctcactcaactgttgcagtcagggaaacgtaaactggtccaaggtggaatggaaacaggagggcaaaatcaatattccaggtactcccgagacggacatcgattcttcctgttcaagatatacccttaaggcagacggaacgcagtgtccaagtggctccagcggtaccactgtaatatacacctgcgagttcattagtgcatatggagcgcggggatctgctaacatcaaagtgaccttcatttcagttgccaatctgacaattacaccggatccaatatctgtgagcgagggtcagaatttctccatcaagtgtatttccgatgtgtccaattacgatgaagtctactggaacacaagcgctgggattaagatctatcaaagattttataccacccggaggtacctcgacggagctgagagcgtattgactgttaagaccagcacccgcgagtggaacgggacttatcactgcatattcaggtataagaactcttatagtatagcaacgaaggatgtgattgtccacccgttgccgctgaagctgaatataatggtcgatcccctcgaggctacagtctcctgctccgggagccatcatattaagtgttgtatagaggaagacggcgactacaaagttacttttcacactgggagttcgtcactgccggccgcaaaggaggttaataaaaagcaggtgtgttacaagcataatttcaacgccagtagcgtttcctggtgtagtaagaccgtcgatgtttgctgtcactttactaatgctgctaataacagcgtatggagcccatctatgaaactgaatctggtgcctggagaaaacatcacctgtcaggatccagttataggtgtcggagagccgggaaaagtaatacaaaaactgtgtcggttttctaacgtgccctcctctccagagtcacccataggcggcactataacatacaaatgcgttggcagccagtgggaagagaagagaaacgattgcatttccgctcctattaactcgttacttcagatggctaaggctctgatcaagtccccctcacaagatgagatgctcccgacatacctgaaggatctgagcatcagtatcgacaaggccgaacacgaaattagttcttcccctggctcactgggagcaatcatcaatatccttgatttgctgtccacggtgcccactcaggtgaacagcgaaatgatgacgcatgtgttgagtactgttaacgttatcctaggcaaaccggtcctgaacacctggaaagtgcttcagcaacaatggacgaaccaatcttctcaattgctccacagtgtcgagaggttctcccaggccctgcagagcggtgattcgcctcccttatcgttctcccagacgaatgtccagatgagtagtatggttattaagagctcacaccccgagacataccagcaaaggttcgtttttccatattttgatctgtggggaaatgtggtgatcgataagagttatctggaaaatctgcagtccgactcctcgatcgtgactatggcatttcccaccctgcaggctattctggctcaggacatccaggagaacaactttgccgaaagcctggtgatgactacaaccgtgtctcacaacaccacaatgccctttcgaatttccatgactttcaaaaataactctccctccgggggagagaccaagtgcgtgttttggaactttagactggcaaataacacagggggttgggattcttctgggtgttacgtggaggaaggtgacggtgacaacgttacctgcatttgcgatcatctgacatccttcagtatcttaatgtccccagatagccccgacccgagcagcctgctcgggatcttgctagacattataagctatgtcggagtcggtttcagcattctgtctcttgctgcttgcctagtcgtggaagccgtggtttggaaatccgtcaccaagaaccggacgagctatatgaggcatacgtgtattgttaacatcgccgcctcactgctggttgcgaacacatggttcatcgtagtagcagctatccaagacaacaggtatatcctatgtaagaccgcctgtgtcgccgccacatttttcatccacttcttttatctatccgtttttttttggatgctgactctgggcctgatgcttttttatcgcctcgtatttattctccacgaaacctcccgttccacccagaaagccatcgcgttctgtctgggctatggatgccctctcgccataagcgtaattacactcggcgccacacagccaagggaggtctacactagaaaaaatgtttgttggctgaattgggaagatacaaaggcactgttagctttcgctatccccgccctcatcatcgttgttgtgaatatcaccattactatcgtggttatcactaaaatcctgcggccctcaatcggggataagccctgcaagcaagagaaaagctctttgttccagatatccaaatctatcggggtcctgacacctctgctggggctcacttggggttttggacttacgaccgtcttcccgggtacaaacctcgtgttccacattatcttcgcaattctgaatgttttccagggcctgttcatcctcctgttcgggtgtctgtgggacctcaaggtgcaggaggccctgcttaacaagttcagcctgtcaaggtggtcaagtcaacactctaagagcacctccctggggtcctcaacgcccgtgttcagtatgtcctctcccatttctaggaggtttaataatctgttcggcaaaactggtacttacaacgtgtccactccggaggccactagctcctccctggagaactcatctagtgctagttccctgctgaactag

SEQ ID NO: 26457 - DNA, 3981 bp, Artificial Sequence
  Description of Artificial Sequence: Synthetic coding sequence
atgaagagccctcgtcggacgacactctgcctgatgttcatcgtgatatactccagtaaggcggctcttaattggaattatgagtctactattcaccctttgagcctccatgagcacgaacctgccggcgaagaggcactgcgccaaaaaagggctgtggcgaccaagagtcccactgccgaggagtacacggtcaatattgagatctcctttgaaaatgcttcttttttggatccaataaaggcatatcttaacagcctctcctttcccatccacggcaataacacagaccagatcaccgacattttaagcatcaacgtgaccactgtatgccggccggccggtaatgaaatttggtgttcttgtgaaaccggctatggctggcctagggagcgttgcctacacaatctaatctgtcaggagagagatgtgttcctcccaggacatcattgtagttgtcttaaagaactaccgccaaacggccccttttgcttgctacaggaggacgttaccctgaacatgcgggttaggcttaacgtcgggttccaggaggacttgatgaacacttcatcagctctttacagatcttacaagaccgacctggagaccgcttttagaaaggggtatgggattttgcctgggtttaagggtgtgactgtgacggggtttaaatcagggtcagtggtggtaacgtacgaggtgaagaccacccctcccagcctggagctgatacataaagcgaacgagcaagtggtccagagcttgaatcagacgtacaaaatggactataatagcttccaggccgtgacaatcaatgaatcaaatttctttgtgactcctgaaattattttcgaaggcgatacggtgagtctggtctgtgaaaaagaagtgctgtcttcaaacgtgagctggaggtacgaagaacagcaactggagatccagaacagttcgcggttcagcatttacactgcattattcaacaacatgacatctgtgtccaagttgaccattcacaacataaccccaggcgacgcaggtgagtacgtgtgcaagctgattctcgatatcttcgagtatgagtgtaaaaagaaaatcgatgtgatgcctattcagattctggcaaacgaggaaatgaaggtgatgtgtgacaacaatccggtgagtctgaattgctgcagccagggcaacgtaaattggtccaaagtggaatggaagcaggagggcaaaattaatattccaggcactcccgagacggacattgacagctcgtgtagtcggtacacactcaaggctgatgggacccagtgtccaagtgggtcctctggcactaccgtgatttatacatgtgagttcatttcagcctatggcgctagaggttctgctaacattaaagtgacttttatttcggtcgcaaatcttacaataactccagaccctatcagcgtgtctgaagggcagaatttcagcatcaaatgcatcagcgacgtttcaaactatgacgaagtctactggaacacatcagctgggattaaaatataccagcgattctatactactcgccggtacctggacggcgcagagagcgtgctgaccgttaaaaccagtactcgagagtggaacggcacataccactgcatctttcggtataaaaattcctactctatcgccaccaaagacgttattgtacaccccctgcctcttaagctcaatatcatggttgacccactcgaagcaaccgtgtcctgttccggctctcatcacatcaaatgctgcattgaagaagacggcgactacaaggtgacatttcacacggggtcctcaagtttaccagcagccaaggaggttaataaaaaacaagtttgttataaacacaacttcaatgcctctagtgtgtcttggtgcagcaagacggtcgatgtttgttgccatttcaccaatgctgctaataatagcgtgtggagtccaagtatgaagctcaacttggtgcctggcgagaacattacgtgccaggaccccgtgatcggggtcggcgagccaggcaaagtcattcagaagttatgtcggttcagtaacgttccgtcctctcccgaatcacccattgggggcactatcacgtataagtgcgtgggctctcaatgggaggaaaagcgaaatgactgtatttcggcacccattaacagcttgttacagatggccaaggcactgattaagtcgccatcgcaggacgagatgctgccaacctatctgaaagacttgtcgatctccatagacaaagccgagcacgagatttcatccagcccaggatctctaggcgctatcatcaacatactggatctcctgagcaccgtccctacacaggttaacagcgagatgatgacccatgttctgtcgaccgttaatgtaattctgggcaagccagtgttgaatacttggaaagtcctgcagcagcaatggaccaaccagagctcccagttgttgcactcggtggaaagattctcacaagccctgcagtccggcgattctccaccgctctccttctcacagacaaacgtccagatgtcatccatggtcattaagagcagtcacccagaaacataccaacagagatttgtgtttccttactttgatctctggggtaacgtggtgatcgataagtcttacctcgagaatctgcaaagtgatagctctatcgtgaccatggctttcccgaccctgcaggccatcctggcccaggacatccaggaaaataacttcgcagagtccctcgtgatgactactacggtgtcccacaacaccaccatgccttttcgcatctctatgacctttaaaaacaacagcccttccggcggggagaccaaatgcgtgttttggaatttccggttggcgaataatactggcgggtgggacagtagcggttgctacgttgaggagggcgatggtgacaacgtcacctgcatctgcgaccatcttacctcatttagtattcttatgtctcccgactcacccgatccttcctctttactgggaatcttgctagacattatctcatacgtgggagtcggcttctcaatcttatctcttgctgcgtgtctcgtggtggaggcggtggtgtggaagagcgtgacaaagaatcgaacctcttatatgcgccacacctgcatcgtaaacatcgctgccagtctccttgtggccaacacatggtttattgttgttgctgctattcaggataatcgctacatcctgtgcaagaccgcatgcgtggccgcaacatttttcatacactttttttacctgtctgtttttttctggatgcttactcttggcttaatgctcttttaccgactggtgttcatcctgcatgagacatcgagatcgactcagaaggcgatcgcgttctgtctcggctacggctgtccattggcaattagtgttattaccctgggagctacccagcctcgggaagtgtacaccaggaagaacgtctgttggctcaattgggaagatacaaaggccctcttggcgtttgccattcctgctctgatcatcgttgtggtgaatattacgatcacgatcgtggtaattactaagatcctgcgtcctagtatcggggataaaccctgtaaacaggagaagtctagccttttccagatatcaaagagcatcggggtgctcactccccttctcggcctgacttggggatttggcctgaccacagtctttcccggtacaaaccttgtgttccacatcatcttcgcaatcctgaacgtctttcaggggcttttcattttgttatttggatgtttatgggatcttaaatccaccagcctgggatcctccactcctgtcttcagcatgtcttcccccatttccaggcgctttaacaatctattcgggaaaacaggcacttacaacgttagcacccccgaggcgacatcctcttctctggagaatagctcttccgcgagctccctgctcaactag

SEQ ID NO: 26458 - DNA, 4041 bp, Artificial Sequence
  Description of Artificial Sequence: Synthetic coding sequence
atgaaaagtcctcgacgcaccactttgtgcctgatgttcatcgtgatttacagtagcaaggccgcactgaactggaactacgagagcaccatccatccgttgagcctgcatgagcacgaacccgccggtgaggaggcgctgcgacagaagagagctgttgccactaaaagtccgacagctgaagagtacactgtgaacatcgaaatctctttcgagaacgctagctttctggaccccattaaggcctacctgaacagtttgtccttccccattcacggcaacaataccgaccagataactgatatcttgtctatcaacgtgacaacagtctgtagacccgcaggaaacgagatatggtgcagttgcgagacgggttatggttggcctcgggaacgctgtcttcacaacttgatttgccaagagcgggatgtcttcttgccgggacatcactgctcttgcctgaaagagttgccaccaaatggccctttctgtctcctgcaggaagacgtgacactgaacatgcgggtcagacttaacgtgggcttccaggaggacctcatgaatacttctagcgccctctacaggagttacaagaccgacctcgaaaccgcattccggaagggctacggaattcttcctggtttcaaaggggtgactgttaccggctttaaaagtgggtctgtagtggtcacctacgaggtcaagaccactcccccgagcctagaacttattcataaagcaaatgaacaggttgtgcagagtctaaatcagacttacaagatggactacaacagttttcaagcagtcaccatcaatgaatccaacttcttcgtgactccggagataatcttcgagggtgacaccgtctctctcgtgtgtgaaaaagaggtcctgagctccaacgtctcctggcggtatgaggaacagcagctcgagatccagaactctagccgcttcagtatctacaccgccctgttcaacaacatgacatccgtctcaaagctgacaattcataatattacacctggtgatgcgggtgagtacgtttgtaagttgatcttagacatctttgagtacgaatgcaaaaagaaaattgacgtgatgccgattcaaatcttagccaacgaggaaatgaaagtgatgtgcgataacaaccccgtgagcctaaactgttgcagccagggcaatgtcaactggtcaaaagttgagtggaagcaggagggaaaaatcaacatccccggaacccccgagacggatatcgattccagttgctctcggtatactcttaaggctgacggaacgcaatgccctagtggaagttcgggaacaaccgtcatttacacatgtgagttcatcagcgcctacggtgctcgtggctctgctaatattaaagttacattcatttctgtggcaaacctcacgatcacacccgacccaatctccgtgtcagagggccagaacttttcaatcaagtgtatctctgacgtgtcgaactacgacgaagtctactggaatacgtcagcagggattaagatttaccagcggttttacacgactagacgctacttggatggtgctgaatctgtattgaccgtgaagactagcacacgcgagtggaacggcacttatcactgtatcttccgctataagaatagctacagcatcgcgaccaaggacgtgattgtgcaccctctgcctttgaagctgaacattatggttgaccctcttgaggctaccgtgtcttgctccggatcccaccacatcaagtgctgtattgaggaagacggtgattataaagtcaccttccatacaggaagttccagtttgcctgccgctaaggaggtgaataaaaaacaggtctgttacaagcataacttcaacgcaagcagtgtcagctggtgctctaaaacagtggacgtctgctgccacttcaccaatgctgccaacaacagcgtctggagccctagcatgaaactgaacctagttcctggtgagaatattacttgtcaagaccctgtcatcggcgtgggcgagcctggaaaggtaattcagaagctctgcaggtttagtaacgttccttcctcccccgaaagcccaatcgggggcaccataacctacaaatgcgtaggtagccagtgggaagagaaacgtaacgactgtatctcggcgccgattaacagcttgttgcaaatggccaaagccctcatcaagtccccaagccaggacgaaatgctccccacatacctgaaagacttgagcattagtatagacaaggccgaacatgagatctcaagcagtccaggaagtctgggtgctattattaacatactggaccttttgagcaccgtgcccacacaggtgaacagcgaaatgatgacccacgtgctgtctacagtgaacgtgatcctcgggaagcctgtgctgaatacctggaaggtcctgcagcagcagtggacgaatcagagctctcaactgctccatagcgtcgaacgtttcagccaggcgctgcagagtggagacagtccgccactatcctttagtcagacaaatgtgcagatgtccagcatggtaatcaagtcttcccatcccgaaacgtatcaacagcgcttcgtatttccttattttgacctttggggaaatgtggtaatcgacaaaagctatcttgagaatctgcaatccgactcttcgatagtcacgatggcatttccgacactgcaagccattttagctcaagacattcaagagaacaacttcgccgaatctctcgtaatgaccacaaccgtcagtcacaatactacgatgccttttcggatctccatgacatttaagaacaatagcccatccggcggcgagactaagtgtgttttttggaattttcggctggcgaataataccggaggttgggactcttcagggtgctacgtggaggaaggggatggcgacaacgtaacatgcatctgtgatcatcttactagcttttctatcctgatgtctcccgattcaccggatccctccagcttgctcggcatattgctggatataatatcctatgtgggtgtcggcttttcgatcttgtcccttgccgcctgcttggtggtggaggcagtggtctggaagtcagtcaccaagaacagaacttcttacatgagacacacctgcatagtgaacatcgctgcttctctgcttgtggctaacacctggtttatcgtggtggccgcaattcaggataatcgatatattttatgcaaaactgcctgcgtcgcagccacatttttcatccattttttctatttgtcggtgtttttctggatgctcaccttaggtcttatgctcttttacagactcgtgtttatcctgcacgaaacttcaagatctacacagaaagctatcgctttctgtctcggctatggttgccccctagctatctcagtaataacactgggagccacacagcccagagaggtgtacacccgtaagaacgtgtgttggctaaattgggaggacacaaaagcactcctcgcgtttgcaattccggcactcatcatcgtggtggtaaacatcaccatcaccatcgtggtcataacaaaaatcttgcgtccttcaattggcgacaagccctgcaaacaggagaaatcatccctcttccaaatctcgaagtccataggcgtcctcactcccctgctgggactcacctggggatttggattgactaccgtgttccctggcaccaacctggtgttccacatcatctttgcaattcttaatgtcttccagggattattcatcctgctttttggatgtctctgggatctcaaggttcaggaagccctgcttaacaaattttctctgagccgctggagtagccagcattctaagtcaacatcactcggatcaagtaccccagtgttttctatgagtagccctatctcaagacggtttaataacctgtttggcaagactgggacctataacgtcagcactcctgaggccaccagcagctcgttggagaattcttcatctgcttccagtctgctgaattag

SEQ ID NO: 26459 - DNA, 3615 bp, Artificial Sequence
  Description of Artificial Sequence: Synthetic coding sequence
atgaaatccccgagaagaacaacactctgcctaatgtttatagtgatttattcatctaaagccgcattgaactggaattacgagagtacaattcaccccctttccctgcacgaacatgaacccgcaggagaagaggcattgcgccaaaaacgcgcggtagctactaagagcccgacggctgaggagtacactgtcaacatcgaaatctctttcgaaaacgcttctttcctggatcctatcaaagcttacctgaactctctctctttccccattcatgggaacaacaccgaccaaattacagacatccttagcattaatgtcactaccgtgtgccgacccgccgggaatgagatttggtgttcctgtgagacaggttacgggtggcctcgagaaagatgcctccataacttaatttgccaggagcgcgacgtgttcctacccgggcaccactgtagttgtctcaaggaactgccaccaaatggacctttttgtctgctgcaggaagatgtaacacttaatatgagagtgagactgaacgtgggtttccaagaagacttaatgaacacatcctccgccctgtataggtcttacaaaacagatctcgagactgccttccggaaggggtatggcatcctccctggatttaagggcgtcacagtgacaggttttaagagcggctcagtggtggtgacttatgaggttaagaccaccccacccagcctggaactgatccacaaggccaacgaacaggttgtacagtctctcaatcagacatataaaatggactacaattcattccaggcggtgacaatcaggacacccgagaccgacattgatagcagttgctcaaggtataccctgaaggcagatggcacacagtgtccctctggaagctctggcaccaccgtgatctacacttgcgaattcatttcagcctacggagcgcggggttccgccaacatcaaggtgacatttatttccgtggctaacctgactattacacccgatcctatctccgtgtccgaaggtcaaaacttctctattaaatgtataagcgatgtatccaattacgacgaggtctattggaataccagtgcgggcattaagatttaccagcggttttacactactcgtcgataccttgatggcgccgagagtgtattaaccgttaaaacctcaactagggagtggaatggaacttatcactgcatatttagatataaaaacagttattcaatcgcaacaaaggatgtgattgttcaccctctccctctgaaactcaatattatggtagaccccctcgaggcaacagtttcctgttcaggctcacatcatattaagtgctgtatagaggaagatggcgactacaaggtcactttccacactggctcctcctctctccccgctgcaaaggaagttaacaagaagcaggtctgctacaagcacaatttcaatgcttcgtcagtatcttggtgtagcaaaactgtcgacgtgtgctgccacttcacaaacgcagcgaataacagcgtctggtcccccagcatgaagctcaacctggtccctggcgaaaatatcacttgccaggatccagtcatcggagtgggcgaacccggcaaggtcattcagaagctgtgcaggtttagcaacgtgccttcctctccagagtccccgattggagggactatcacgtataagtgcgtgggatcccagtgggaagagaaaaggaatgactgtatctccgcacctataaactctctgttgcagatggccaaagcgctgatcaagtctccaagtcaagatgaaatgctccctacatatctcaaggacctctccataagcatcgacaaagcagagcatgagatttcttctagtccgggaagtttaggcgccattattaacattctggatctgctcagcactgtgccaacccaggttaattctgaaatgatgactcatgtcctttccaccgtgaatgtaattctcggaaaacctgtcctcaatacatggaaagtcttacagcagcaatggacaaaccaatcctctcagttgcttcactctgtcgagagattctcgcaggcattacaaagcggtgatagcccaccgctgtccttcagccagaccaacgtgcagatgagctctatggtcattaagtcttcgcaccctgaaacgtaccagcagcgattcgtgtttccctatttcgacctatggggcaatgtggtgattgataaaagctatctggaaaacttgcagtcagattcaagtatcgtcaccatggctttccctacactccaggccattctggcccaagatatccaggaaaacaacttcgccgagtcattggtgatgaccactaccgtctcccacaacaccaccatgccgttcaggatttccatgacatttaaaaataactcccctagcggtggcgagacgaaatgcgtattttggaactttagacttgccaataacactgggggatgggacagctccggctgttatgtagaagagggcgacggggacaacgtcacctgcatatgtgaccacctgacatctttctcaatcctcatgtcccccgacagtcctgacccctcgagcctacttgggatattgttagatataatctcttacgtcggagtgggattctcaatcttgtcgctggctgcgtgtcttgtggtggaggcggtggtatggaaaagcgtgaccaagaatcggacttcatacatgcgccatacgtgcatcgttaacatcgctgcctcactgctcgtggccaacacttggtttatcgtcgtagccgcaatccaggacaacagatatatcctgtgcaaaactgcctgcgtcgccgcaacatttttcatccatttcttctatctttctgtgtttttttggatgctgacgctaggtctgatgctattctatcggcttgtttttattctgcatgagacatcgagatcaactcagaaggctattgccttctgtctgggctacggttgtcccttagccatatccgtaatcaccctcggcgcaactcagcctcgggaggtgtatacaaggaaaaacgtatgctggctgaactgggaggacactaaagcactgctcgcttttgcaattcccgctctgattatcgttgtcgtcaacataaccattacaatcgtcgttataaccaaaatcctgcgcccaagtatcggcgacaagccctgcaagcaggagaagtcttccctgttccagattagcaaatccattggtgtcttgaccccgctcttgggactcacatggggatttggcctgaccactgtcttcccaggaacaaacctggtgtttcacattatctttgctatcctgaacgtgtttcagggcctctttatattgctgttcggctgtctgtgggaccttaaggtgcaggaggcccttctgaacaagttttccctgtccaggtggtccagccagcatagcaaaagtacgtcattaggatctagcacgcccgtgtttagcatgtcgtcacccatatcaaggaggttcaataatctttttggcaaaaccgggacatacaacgtgagcacaccggaggccactagcagttccctggagaattctagctctgcttcttcactgttgaattag

SEQ ID NO: 26460 - DNA, 2154 bp, Artificial Sequence
  Description of Artificial Sequence: Synthetic coding sequence
gattacagatcccaagtccacgttgagtccagagaaggactgtggaagatcaaagggaaaataaagaaacttggatcatcagagaaagttacagagtcgaagggagaaaacattacgtgccaagatcccgttatcggtgtgggggaaccaggcaaggtcattcagaagctctgtcgcttttccaacgtcccctcaagccctgaaagccccattggggggacaattacttataagtgcgtgggcagccaatgggaagaaaaaagaaacgactgcattagcgcaccaattaattcactgctccaaatggcaaaggcactgatcaagtcaccctcacaggacgagatgctccccacctacctgaaggatctgtccatctctattgataaggccgagcatgagatctcttcctcacctggctcactgggcgcaattattaatatactggatttactgtcgaccgtcccaacacaggtaaacagtgaaatgatgactcatgtcctgagtaccgtgaatgtgatactgggaaagccagtgctgaacacctggaaagttctgcaacaacagtggactaatcagagtagccagctgctgcacagcgtagagcggttttctcaggccttacagagtggggatagtccgcctttgagtttctctcaaacgaacgtgcagatgtcatcaatggtgattaagtcttctcaccccgagacctatcagcagagattcgtctttccttatttcgacctctggggtaacgttgtcatcgataagtcttatctcgaaaacctgcagtccgactcttccatagtgaccatggccttcccaaccttacaggccatactggcccaagatatccaggagaataactttgcagaaagtcttgtcatgacaacaaccgtctcacataataccactatgccttttaggatcagtatgacattcaagaataatagcccgtccggaggagagacaaagtgcgtgttttggaactttagactggccaataacaccggtgggtgggactcctctggctgttatgtggaggaaggcgatggggataacgtcacttgcatctgcgaccatctcacgagcttttcgatactcatgagccctgattcccccgatccatcatcgcttctcgggatcttactggatatcattagctatgtaggagtgggcttcagtatactcagtcttgcagcatgcctggtggtggaagcagtcgtgtggaagtcagtcacgaagaacaggacaagctacatgagacacacctgtattgtgaacatcgcggcctcattgcttgtggcaaatacatggttcatagtggtagccgcgatacaggataaccgctatatcctttgcaaaaccgcttgtgtcgccgctacattttttatccatttcttctatctttcagtgtttttttggatgcttaccttgggcctgatgctattttacaggctcgtctttattcttcatgagacgtcacgctctacacagaaagcaattgctttctgtctgggctacggttgcccgctcgcaatctctgtaatcacgttgggagccacgcagccacgcgaagtgtacacccggaagaatgtgtgttggttgaattgggaggacaccaaagccctgcttgcttttgccatacctgctcttatcatcgttgtagttaacattactatcaccattgttgtgataaccaagatactccgtccgagtattggagacaagccctgcaaacaggagaagagctccttgttccagatctctaagagcatcggcgtgcttactcctctgctcggcctgacctgggggtttgggctgacaactgtctttccggggacaaacctggttttccacatcatatttgcgattctgaacgtgttccaaggactcttcatactgctgttcgggtgtctgtgggatttgaaagtgcaggaggctctgctcaacaagtttagcctgtcacgctggagcagccaacactctaagagcacctcactggggagcagcaccccagtttttagtatgtctagccctatctccagaagattcaacaacttgttcggaaaaaccggcacttacaacgtcagtacacccgaagctacctcgagttctttggaaaactctagctctgcctcaagcctactaaactag

SEQ ID NO: 26461 - DNA, 2313 bp, Artificial Sequence
  Description of Artificial Sequence: Synthetic coding sequence
atggtcgatcctctcgaggccacagtctcatgctctggatcccatcatatcaagtgttgcattgaagaggatggtgattacaaggttacttttcacaccgggtctagctcactgcccgcggccaaagaagttaataagaagcaggtgtgctacaagcataactttaacgcctcctctgtctcctggtgctccaagaccgttgacgtctgctgccactttaccaatgccgccaataacagtgtttggagcccgagcatgaaactgaatctggtacccggcgagaatatcacatgccaggatccagttattggcgttggcgagcccggaaaggtgatacaaaagctctgcagattttccaacgtcccgtcttctcccgagagtcccatcgggggaacaattacctataagtgtgttggatctcagtgggaggaaaagagaaatgattgcatcagcgcccctattaacagcctgctgcagatggcaaaggcgttgataaaatccccctcacaggacgagatgctgcctacttaccttaaggacttgtccatctctatagacaaggcagagcacgaaattagcagttctccagggtctctgggtgccatcatcaacatcctggatctgttaagcaccgtgccaacccaggtgaatagcgaaatgatgacccacgtcctgtcaactgtgaatgtgatcctaggcaaacctgtcttgaatacttggaaagttctccaacagcagtggacgaaccaatcctcacagctcctccacagcgtagagcgtttttctcaagccctccagagtggagattccccaccactgtctttctctcaaactaatgtgcagatgagttcaatggtgatcaaatctagccatccggagacttatcagcagcgctttgtattcccgtacttcgacctttggggaaacgtggttatcgacaaaagttatttggagaacctccagtcggacagctccattgtgacgatggcttttcctactttacaggccatattggcccaggatatccaggagaacaactttgcagaatcactggttatgacaaccacggtttcccacaataccacaatgccttttaggataagtatgacattcaaaaacaattcgccctctggaggcgagaccaaatgtgtcttctggaactttagactggcgaacaacacaggagggtgggactcaagtggatgttatgtggaagaaggggacggcgacaatgttacgtgcatctgcgaccatctcacctccttttccattctgatgagccccgacagtcctgatccctcttccctgctcgggatcctgctcgacatcatttcttatgttggcgtggggttctctatcctttcactggctgcgtgtctggttgtcgaggcagtcgtatggaagtccgtgactaaaaacaggacctcctacatgaggcatacttgtatcgttaacatcgccgccagtcttttggtcgcaaatacatggtttattgtcgtggccgctatacaggataaccgctatatcctgtgcaaaaccgcttgcgtggctgctactttctttatacacttcttttatttgtccgtctttttctggatgctgacactgggattaatgctcttttaccggctggttttcatcctgcacgaaacctcacggtctacccagaaggcaatcgctttttgccttggctacggctgtcccttggccatctccgtgatcactctgggggccacccaacccagagaggtgtacaccagaaaaaacgtgtgttggctgaattgggaggatacgaaggccctgctagccttcgccatcccagccctcattatcgtagttgtcaacatcaccataaccattgttgtgattaccaagatcctgagaccttccataggggacaaaccatgcaaacaggaaaagtcctctctgttccaaatctccaagtccatcggggttctgacaccgctgctggggctaacatggggctttggactaacaacggtgtttcccggaacaaatttggtgtttcacatcatattcgccatcttgaatgtgtttcagggactttttatcttgctcttcgggtgcctgtgggatttaaaggtgcaagaggctctgttgaataagttttcattgagtcgttggtcttctcagcacagcaaatccacctcgctgggttcttccactccagttttcagcatgtcctcaccaataagtcgaagatttaacaaccttttcggcaagaccgccgctcctaaaatcccaccaggccacgacggaaacctggtgtccggagggagctcagctatctag

SEQ ID NO: 26462 - DNA, 1008 bp, Artificial Sequence
  Description of Artificial Sequence: Synthetic coding sequence
atggaatccagcttttctttcggcgttatcctggccgtcctggccagcttaattatcgctacaaacacgctcgtggctgttgccgtactgctgctgatccataagaatgacggcgtcagcctttgcttcactctgaacctggccgtcgctgacactctgatcggcgtcgctatctcaggcttgcttacagatcagttgtccagcccgtctaggcccacgcagaagaccctgtgttctctcaggatggcgttcgtcacttcaagtgcggccgcatctgtgcttacagtgatgctgattacctttgataggtacttggccataaaacaacctttcagatatttgaaaattatgtcaggattcgtcgcaggggcatgcattgccggactctggctcgtctcctatctgattggatttctgcctctggggatccccatgtttcagcaaaccgcgtacaaaggccagtgctcatttttcgcggtcttccacccacactttgttctcactctgagctgcgttggtttctttcctgctatgctgttgttcgtgtttttttattgtgacatgctgaaaatagcaagtatgcatagtcagcaaatccgaaagatggaacatgcaggcgctatggccggtgggtacagaagccccagaacaccatctgattttaaggccctccgcaccgtgtctgtgttgataggatcctttgctctgagttggacgcccttcttgattaccggtatagttcaggtcgcctgtcaggaatgtcatctgtacctagtgttagaacgctatctgtggttgctgggggtgggaaatagccttctgaatccgctgatctatgcttactggcaaaaggaggtgcggttgcagctgtaccatatggctttaggagtaaaaaaagtgctgaccagcttcctgctgttcctctcagcaagaaattgcggacccgaaagacccagggagtcatcctgtcacatcgtgaccatttcctccagcgagttcgatggctag

SEQ ID NO: 26463 - DNA, 1485 bp, Artificial Sequence
  Description of Artificial Sequence: Synthetic coding sequence
atggaagagccacaacccccaaggccacccgccagcatggctctcctcggctctcagcactccggagcccccagcgctgctggcccaccaggcgggacatcctccgctgcaaccgccgccgttctctccttttctaccgtagctacagcagctcttggaaaccttagcgatgccagcgggggcggcacagccgcggctcccggaggcgggggactcggcggttccggggctgcccgcgaagccggagcggcagtacggcgtccactcggacctgaggctgcccccctgctttcacacggagctgccgttgcggcccaggcacttgtattgctgttgatatttctgctctctagtttagggaattgcgcggtgatgggagtcatcgttaaacaccgacagctcagaacagtgaccaatgcgtttattctgagcctcagcctaagtgacctcctcaccgcactgctttgcctgccggctgcgtttctcgacctgttcacacctccaggcggatcagcgcccgcagctgccgcgggaccatggagaggcttttgtgctgcttcaagatttttttcatcctgcttcggcatcgttagcacactgtccgtggccctgatctctcttgataggtactgcgccattgtgcgacctccccgggagaagataggccggcggagagccttgcagttgctggctggtgcatggctcaccgccctggggttctcgctgccgtgggaattgctgggagccccaagagagctggccgctgcccaatcctttcatggctgcctatatcgtacatcaccggatcccgctcagttgggcgccgcattttcagttggtcttgtggttgcctgttatctcctcccttttctcttaatgtgcttttgtcactaccatatctgcaagacagtgagattatctgacgtcagggtgcggccagttaatacatacgctagggtgctgcgctttttttcagaggtaagaaccgcgactacagtgctgatcatgatcgtcttcgtgatttgctgttgggggccctactgctttcttgttctcttggcagctgcgcgccaggcgcagacaatgcaagcaccttctctcttgagtgtggtggccgtatggctgacctgggcaaacggggccattaaccctgtgatttatgctattcgaaacccaaatatctctatgctgctgggccgtaatcgggaggaaggctatagaacacgcaacgtggatgctttcctaccatcgcaagggcccggactgcaggccaggagtaggtcccggctccgcaatcgctatgccaaccggctcggagcctgtaatagaatgagttcatccaaccccgcaagtggcgtggcaggcgacgtggcaatgtgggcccggaagaacccagtggtcctgttttgcagggaggggccaccggaaccagtgactgccgtaactaagcagccaaaatctgaggctggcgatactagcctctag

SEQ ID NO: 26464 - DNA, 1485 bp, Artificial Sequence
  Description of Artificial Sequence: Synthetic coding sequence
atggaggaacctcagccccctagaccccccgccagcatggccttactaggatctcagcatagcggtgcaccatcagccgcaggaccaccagggggaactagctctgccgctacagccgcggtgttgagttttagtaccgttgcaaccgcagccctgggtaatttgtctgacgctagcggcgggggcactgccgccgcccctggcggtggcggcttgggtggctccggtgccgcaagggaggcaggcgccgccgtccgccgccctcttggccctgaggctgcgcccctcctgtctcatggagcagctgtggctgcccaggccttggtgctattgctgatcttcctgctctcatcgctgggcaattgcgccgtaatgggcgtgattgttaagcacagacagctgcgcacggttacgaacgcattcattttgtccctctctttgagcgatctcctgaccgctctcctctgtctgccagcggctttcctggacttgtttactcctccaggcgggtccgcgcctgcagccgctgcaggtccatggcgcgggttctgcgccgcttctaggttcttctccagctgcttcggtatcgtgagtaccttgtcagtggcattgatcagcttggatcggtactgcgccatcgtgagaccccctcgagaaaaaattggaagaagacgtgctctgcagttattagctggggcgtggctgactgctctggggttcagtcttccatgggaactgttaggggctccgcgcgagctagccgccgctcagtctttccacggatgcctttataggacgtcccctgatcctgcacaactgggggctgcattcagcgtggggctcgtggtcgcatgctatctacttccctttctgctgatgtgtttttgtcactaccacatctgtaagacagtgcggctgtccgatgtgcgtgtaagacctgttaatacctacgccagagttcttagatttttctcagaggttcggacagcgacaactgtcctgattatgattgtcttcgtcatatgctgctggggcccctactgttttctggtgctactggcagccgcccgccaagcccagaccatgcaggctccctccctcctgagcgttgtagccgtgtggctgacttgggcaaatggcgctatcaaccccgtcatctacgctatccgaaacccaaacatttcaatgctcttaggacgtaaccgtgaggaaggctaccgcacaagaaacgtggatgcttttcttcccagtcagggcccagggctccaggccagatctcggtcccgattgcgcaaccgttatgcgaaccgtctgggagcctgtaaccgaatgagcagctctaacccagccagtggcgttgcaggggacgtggcaatgtgggccagaaaaaacccagtcgtactgttttgtcgggaaggccccccagagcctgtgaccgctgttactaaacagccaaagtccgaggctggagacacctccctgtag

SEQ ID NO: 26465 - DNA, 969 bp, Artificial Sequence
  Description of Artificial Sequence: Synthetic coding sequence
atggccctcctgggcagccagcatagcggcgcaccgagtgccgcgggtccccccgggggaacttccagtgccgccaccgcggcagtgttgtcctttagcaccgtcgcgactgctgctctggggaacctgtccgacgctagtggaggtgggacggccgccgcgcctgggggaggggggctgggaggctccggtgcggccagggaggccggcgccgcagtgagaaggcccctaggccctgaagccgcccctctactgagtcatggtgccgctgttgcagcccaagctctagtcctgctgctaattttcctgctcagcagtctgggtaattgtgcagtgatgggggtgattgtaaagcaccgtcagttgcgcaccgtaacaaatgccttcattctgtcactgagcctgagcgacttgctcactgctttactgtgcctccctgctgcctttctggacctgttcacacccccaggggggtccgctcctgcagcggccgccggcccctggcgggggttctgcgctgcttctcggttcttcagttcatgcttcggaatcgtgcacgctcagcggggggcccatcttgtgggacccttgctgagatacaggcgcccccctagagaaaagatcggccgcaggagggcactccaactcctggcaggcgcttggctaaccgccctcggcttttccctgccatgggaactgctgggcgccccccgagagctggctgccgcccagagttttcacggctgcctatacagaacatcacctgaccctgctcagcttggggcagctttttctgtaggcctagtagtcgcctgttacctgctgcctttcttactgatgtgcttttgtcattaccacatttgtaaaacggtccggctgtcagatgtgagagtccggcccgtgaacacttacgcaagagtactgcgaagctccgcacgctgtgctcgaccccctccttccagctcatag

SEQ ID NO: 26466 - DNA, 1254 bp, Artificial Sequence
  Description of Artificial Sequence: Synthetic coding sequence
atggagtccaatttgagtggccttgtgcctgccgccggtctggtgcctgctttaccccctgctgtgactctcggactcaccgcagcgtacacgaccttgtacgccttgttgttcttttctgtttacgcccagctttggcttgtactcctgtatggccataagcgtttgagttaccagacagtctttttggctctgtgtttattgtgggcagcactcagaactactttgttcagtttctactttcgggacacccctagggctaacagacttggccccctacccttttggttgctgtattgctgtccagtgtgtctgcagttcttcactttaacacttatgaacctgtactttgctcaggtggtttttaaggcaaaggtcaagcgaagaccagaaatgtcccgcggtctgctggctgtccggggtgcttttgtaggtgcgagtctgctgttcctcctggtgaatgtactgtgtgccgtcctctcccataggcgcagagcccaaccatgggcactcctgctggtccgggtactcgtcagtgattctttatttgtcatatgcgccctgtctctggccgcttgcctgtgtttagttgctagaagagctccttccacatcgatctacttagaagccaagggaacctctgtgtgtcaggccgctgcaatgggcggcgccatggtcttgctgtacgcaagcagggcttgttataatttaactgccttagcgctagcaccacagtctaggttagacacctttgactacgactggtacaatgtgagcgaccaggcagatctggttaatgatctagggaacaaggggtatttggtcttcggtctgatcttgttcgtctgggagttgctcccgactacactgttggtgggatttttccgggtccaccgccccccgcaggacctgtccaccagccatattctgaatggacaggtctttgcatccagaagctatttttttgaccgcgctgggcattgcgaggatgagggatgttcctgggaacattcaaggggagaaagtacaaggtgtcaagaccaagccgccactaccactgtttccactccaccacatcgacgggaccctccaccgtctcccactgaatatccagggccaagtcctccacaccctcggcccctgtgtcaggtgtgtctgcctctgttggcccaggaccccggcgggaggggctatcccttactgtggccggctccttgttgctcatgtcactcagaattagtaccctcaccatag

SEQ ID NO: 26467 - DNA, 1041 bp, Artificial Sequence
  Description of Artificial Sequence: Synthetic coding sequence
atggaaagtaacttatcaggactggtgccggctgccggtctggtcccggcactgccgccagctgtaacattaggactgacagcagcttacacaacattatacgctctactcttctttagtgtttacgcccagctatggctggttctcctctatgggcacaagagactttcatatcagaccgtcttcctagccctatgccttctctgggctgccctgcggactacactgttttctttctacttccgggacacccctcgagctaatcgcctcgggccactacctttttggctcctctattgttgccccgtgtgcctgcagttttttacactgactttgatgaatctgtatttcgcacaagtcgtttttaaagcaaaagtgaagagacggcctgaaatgtcacggggcttgctcgcggtccgaggagcatttgtgggagctagcttgttgttcctcctcgtaaatgtcctatgtgccgtactaagccaccgacgccgcgcacaaccatgggcattactgctggtgcgggtgcttgtatcagactccctctttgttatctgcgcactctctttggccgcttgcctgtgccttgtcgctaggcgagcaccctctacgtctatttatttagaagctaaggctgatctggtcaacgatctgggaaataagggatacctggtgttcggactgattctgttcgtctgggagctgctgcccactacccttttagtcggcttctttcgggtccaccgtccaccacaagacctgagtacaagtcacatcctcaatggacaagtctttgcttcgcgctcgtactttttcgacagagccgggcattgcgaagatgagggctgttcatgggagcactctcgtggtgagtccactagcatgagcggaagtttggggagcggctcttggtacggggctatcggacgggagccaggatggtatggcggtagccagactaaaactacccctctcctgtttagccaagtgcctggccctggaggccaccatcacagcctgtattctactcctcagacatag

SEQ ID NO: 26468 - DNA, 1428 bp, Artificial Sequence
  Description of Artificial Sequence: Synthetic coding sequence
atgttatgggctgttcgaactaggtgctatgtcgttaaagctcagctggggccaaccgtagctctggagggaagagcccctcgtgctcccggcccgtcctgcttaggcaacggtaattgtcagcgcccgggccccatcacttcccgcaacgtgactcgggcaagtttacccgatatggaaagtaacctgagcggactggttccagccgccggccttgtcccagccttgcctccggccgttactctgggattgactgccgcctatactaccctctacgccctgctcttcttctccgtttatgctcagctgtggctcgtcctcctgtacggacataagaggctgagctaccagactgttttcctggctctctgtctgttatgggcagccttgagaacaactctgttctctttctatttcagagacacacctcgagccaataggcttggaccactccctttctggttattgtattgctgcccagtttgtctgcagttcttcacgctgactcttatgaacctctattttgcccaggtagtgttcaaggccaaggttaagcgtcgaccggaaatgtccagagggcttctcgccgttaggggtgcattcgttggggcttcgcttctgttcctcttggtaaacgtcctgtgtgcagtattgtcccacaggcggagagcacaaccgtgggctttacttctcgtgcgagtcctggtatctgatagtttatttgtgatttgcgccttgtcactagctgcctgtctttgcctggttgcgcggagggctccgagcacgtctatttacctagaagcaaaaggcacctccgtttgccaggcggctgccatggggggcgccatggttctcctttatgcgagccgcgcctgctataatttaacggcactggctctggcaccccagtctaggcttgatacatttgattatgattggtacaacgtgtccgatcaagccgatctagttaatgacctagggaacaaggggtacctggtgttcggtcttattctgtttgtctgggagctgctgccaactaccttgctcgtggggttttttagggtgcaccgcccaccacaggatctcagtacttcacacatcctgaacgggcaggtgttcgcatccaggagttacttctttgatcgggcgggtcattgtgaagacgaggggtgtagctgggaacacagccggggggaaagcacccgatgtcaggatcaggcggcaacgacaactgtcagcacacctcctcacaggcgtgacccacctccttcccccactgagtacccaggtccgtcacccccacacccaaggcctctttgccaggtctgtctcccattgctggcccaggatcccggtggcaggggttacccactcttgtggccagcaccttgttgctcctgtcatagcgaactggtaccaagtccctag

SEQ ID NO: 26469 - DNA, 1191 bp, Artificial Sequence
  Description of Artificial Sequence: Synthetic coding sequence
atggaatctaatctgtcagggttggtccctgccgccgggcttgtgcccgcgctgccaccggcagtgaccctcgggctgactgcagcctatactacactctatgccctgctcttttttagcgtctacgcccagttatggctggtcttgctctacggacataagaggttgtcgtaccagaccgtcttcctcgcgctgtgtcttctgtgggctgctctgaggacaaccctgttttccttttactttagggacaccccaagagcaaacagactgggccccttgcccttctggctactgtattgctgtcccgtttgtctccagtttttcacactgaccctcatgaacctttactttgcccaggttgtgtttaaggctaaagtgaaacgcaggcctgaaatgtctcgaggactgctcgcagtccggggcgcttttgtcggtgctagccttcttttcctattggtgaatgtgctatgcgccgtcctttcacatcgccgaagggcacaaccttgggcgctgctgctggtgcgggtgttagtgtcagatagcctctttgtaatctgcgcgttgtccctagctgcatgcctttgtcttgtggctcgtagagcaccatccacaagcatctacttggaagctaagggcacctctgtgtgccaggcagcagctatgggcggtgcaatggtactcttatacgctagtagagcctgctataacctgactgccctcgctctggctccccagtctcgcttagataccttcgactacgattggtataatgtgtccgaccaggctgacctcgtgaatgatctcggaaacaagggctatctggtatttggcctcattctgtttgtttgggagctgctccccactaccctcctggtagggtttttcagggtccaccggccacctcaggatctctccacttctcatatactcaacggacaggtgttcgcctccagaagttacttcttcgatcgcgctggccactgcgaggacgagggatgttcctgggagcactccagaggggaaagcacaagtatgtctgggagtttgggatcagggagctggtatggtgcaatcggcagagagccaggatggtacgggggttcccaaaccaagaccactcccctccttttttcccaagtcccgggtcctgggggtcaccatcatagtctatactccacgccccagacctag

SEQ ID NO: 26470 - DNA, 399 bp, Artificial Sequence
  Description of Artificial Sequence: Synthetic coding sequence
atggaatctaacctttccgggcttgtgcctgctgctgggctggtccctgctctgcctcctgccgttaccttgggtctaactgctgcatatacaactctgtatgcgctactcttcttctctgtttacgcacagctgtggctagtattactgtatgggcataagcggctatcttaccaaacagtcttcttggccctttgtcttctgtgggcagccttgaggaccacactcttcagtttttattttcgtgacaccccaagggccaatcgcctggggcctcttccattttggctgctttattgctgccccgtatgcctgcaattttttactctcacactgatgaacctgtacttcgctcaggttgtctttaaagccaaagttaaaagaaggcctgagatgtag

SEQ ID NO: 26471 - DNA, 504 bp, Artificial Sequence
  Description of Artificial Sequence: Synthetic coding sequence
atggaaagcaatctctcaggacttgtgccggccgcgggactggtgcccgccctgccacccgccgttacactgggcttgacagcggcatacacaactctgtacgcgttactgtttttctccgtttacgcacagctgtggctggtattgttatacggccacaagcggttgtcttaccagactgtgttccttgcactgtgcctcctgtgggcagcgctgagaaccactctgttttcattttacttcagagacacccccagagccaatcgtcttggtcctctgcccttctggttgttgtactgttgtccagtgtgcctacagttcttcactctgacgctgatgaatctgtactttgcgcaggtggtttttaaggctaaggtgaagagacgccccgagatgagccgggggctcctcgctgtgagaggcgctttcgtaggggcctcattgctgttcctcctagtcaacgtcctttgtgccgtgctctctcacaggagaagagctcagtag

SEQ ID NO: 26472 - DNA, 192 bp, Artificial Sequence
  Description of Artificial Sequence: Synthetic coding sequence
atggaaagtaacctctcaggcctggttcctgctgccggcctggtgccggctcttccgcctgctgttactttgggcttgacagctgcatacaccaccctgtacgcacttctctttttttctgtttatgcgcagctgtggctcgtgcttctgtacggccacaagcggcttagctaccagacagtgttcctatag

SEQ ID NO: 26473 - DNA, 663 bp, Artificial Sequence
  Description of Artificial Sequence: Synthetic coding sequence
atggaaagcaatctgtcaggcctggtcccggccgctggcctggttcccgccctgcctcccgccgtcactctgggcctgaccgccgcttacactaccttgtacgccctgctctttttctcagtatatgcacagctatggctggtgcttttgtatgggcacaaacggctgtcgtaccagaccgtctttttggccttatgcttactgtgggctgccctgcgcacgaccttgttcagtttctactttcgagacaccccacgcgccaatagactaggacccctacctttttggctgctgtactgctgccctgtctgccttcagttctttacccttactctcatgaatctctacttcgcacaggtggtgttcaaggccaaggtaaagcgcaggcccgagatgtcccgaggcttgctggccgttagaggagctttcgtcggagcatctctactctttctgctggtcaacgtgctgtgtgcagtgttgtctcacaggaggcgagcccaaccttgggccctgttgctcgttagagtactggtgagtgacagcttgttcgttatatgtgctctgtccctcgcggcttgtctatgcctggtcgctcggagggccccatctacgtctatctacctagaggctaaggggaccagcgtgtgccaggccgccgcctag

SEQ ID NO: 26474 - DNA, 963 bp, Artificial Sequence
  Description of Artificial Sequence: Synthetic coding sequence
atggaatcaaatttgagtggcctcgtgcctgccgccggcttggtgccagcccttccccccgcggttacactgggtctcacagcagcatataccacactttatgctttgctcttctttagtgtatacgcgcagttatggctagtgctgctgtatggccacaaacggctgtcatatcagacggtattcctggccctttgtctcctctgggcagccctgcgcacaacactgttctcattctatttccgggatacaccacgcgccaacagactaggccctctgccattctggctgctctactgctgccccgtttgtctgcagttttttaccctgacattaatgaacctgtacttcgctcaggttgtgtttaaagctaaagtcaagcgccggccagagatgtcccgaggactactggccgtgcggggcgccttcgtgggagccagtctgcttttcctcttggtgaatgttttgtgcgcggtactgtcccatcgaaggcgcgcacaaccttgggcactattgctggtgcgcgtattggtatcagactcactctttgttatatgcgccctttcccttgccgcttgcttatgcctggttgcacggcgggcacctagtacgtcaatctatttagaggcaaaaggaacaagtgtctgtcaagccgcagctatgggcggagccatggttctgctgtacgcgtcaagggcctgctacaacctgaccgcactcgcactggcgcctcagtcacggcttgataccttcgattatgattggtacaatgtctcggaccaggccgatctggttaatgacctcggtaataaaggctatctagtgtttgggctgattctatttgtatgggagttgctaccaacgaccttgctggtggggtttttccgcgtccaccgccccccacaagatctttatgtaggccaatccaggttgtgggaactggtgtggtgccacagggcatag

SEQ ID NO: 26475 - DNA, 237 bp, Artificial Sequence
  Description of Artificial Sequence: Synthetic coding sequence
atggagtccaacctctcgggtctggtgcccgcagccggcttggtgcccgccctaccaccagcagtcaccctgggtttgacagcagcgtatacgaccttatacgcactgttgttcttcagtgtgtacgcccagctctggctggttctactctacggtcacaagcgtctgtcatatcagaccgtgtttctggcgctgtgcctgctgtgggcggcacttaggaccacactattcagttag

SEQ ID NO: 26476 - DNA, 636 bp, Artificial Sequence
  Description of Artificial Sequence: Synthetic coding sequence
atggaatctaatctctcaggtctcgtgccagccgcgggcctggttcctgccttaccccctgccgtcacactgggattgacggcggcatacactaccctgtatgctctactgttcttctctgtctacgctcagctgtggttagtgttgctgtacggacataaacggctgtcatatcagaccgtgtttctcgccctatgtctcctgtgggctgctctacgcacaacacttttctctttttacttcagggacactcctagagccaacagactcgggcccctgccattttggctgctgtactgctgtcccgtgtgcctccagtttttcacgctgacattgatgaacctctattttgcccaggtcgttttcaaggccaaggtgaaaagacgacctgagatgtccagaggcctgctggcggtgaggggtgccttcgtcggcgcctccttattgttccttcttgtgaacgttttgtgcgccgtgctttcccaccggaggcgggctcagccctgggcattgctgttggtaagggttctggtcagtgatagcttgttcgtcatctgtgcattgagcctggccgcctgtctgtgtctggtcgcaggggggcggcctcctttagctagcacctggcgtcctcgctag

SEQ ID NO: 26477 - DNA, 723 bp, Artificial Sequence
  Description of Artificial Sequence: Synthetic coding sequence
atggagtcaaacctgagcggcctagtacctgcagctggattagtgcctgcactcccaccagccgtgacccttggcctgactgccgcgtatacgacactgtatgccctccttttctttagcgtctatgcccagctttggttggtgctgctttacggacataagaggctctcctaccagaccgtgttcctggcactgtgtctcttatgggctgcccttcgcaccactctattttcattctacttcagggacactcccagggctaatcgtttgggcccattgcctttctggctgctatattgttgtccagtttgcctacagttttttactttaaccctgatgaacttatacttcgcacaagttgtgtttaaggcaaaagtgaaacggagacctgaaatgagtaggggcctcctggcagtacggggggcattcgttggagcctcgctcctattcctgctcgttaacgtgctatgtgccgtgctatcgcacagacggcgagctcaaccatgggctctgctgctcgtacgggtcttggttagtgacagtctttttgtgatttgtgctctgagcctggcagcttgcctctgcctggtagcacgcagggccccgtccaccagtatctacctggaggccaagggaacgagcgtgtgccaggcagctgcaatgggtggcgctatggtcctactgtatgcctccagggcttgctataacttaacagccctgtag

SEQ ID NO: 26478 - DNA, 702 bp, Artificial Sequence
  Description of Artificial Sequence: Synthetic coding sequence
atgcgacctgagaggcccagaccgagggggtccgcgcctgggccaatggagacacctccctgggaccctgcccggaacgatagcctgccacccacactgacccctgccgttcccccctacgtcaagctgggattgaccgttgtttatacggtcttctatgccctgcttttcgtgtttatttatgtccagttgtggctggtccttagatataggcacaagcgcctctcgtaccagtccgtgtttttatttttgtgtctgttttgggccagtttgaggaccgtgctcttctctttttacttcaaagactttgtcgcagcaaatagtttgtcacctttcgtgttttggctcttatactgctttcctgtctgcctgcaatttttcacccttaccctaatgaacttatattttacacagggctccagcgtgtgtcaggtgactgctattggggttactgtgattttgctttatacgagtcgtgcatgttataacctgtttatcctgagtttctcccagaacaaatccgtacatagcttcgattatgactggtacaacgtctccgaccaggtatccggaggagccgaagaagtcagcccagaccaggggctcttagtttcgtctcgtcattggttccaagacccacggaagtaccaaaatctcgatgcacaggtccccgatatcaaatggtgctccatctgcatctag

SEQ ID NO: 26479 - DNA, 1200 bp, Artificial Sequence
  Description of Artificial Sequence: Synthetic coding sequence
atgaggccggagcgccccagacctaggggtagtgcccccggaccaatggaaacacctccctgggaccccgcaaggaacgattcattacctccgacactgactccagcagtcccgccatacgtaaaattggggctgaccgtcgtgtatacagtattttacgctctgctgtttgtgtttatctacgtgcaactgtggctggtgttgcggtaccgccacaagcgcctgagctaccagtcagttttcttgtttctgtgtcttttctgggcttctctcagaacagtcttgttctctttctacttcaaagatttcgttgctgcgaacagcctctctccatttgttttttggctgctgtactgtttcccagtatgtttacaattctttacgttgaccctgatgaacctttacttcacacaggtcatcttcaaggcaaaaagcaaatattcccccgagctgcttaaatacaggctgcccctctacctcgctagcctgttcatttctctggtgtttttgctcgtaaacctgacctgtgccgttcttgtgaaaacgggaaactgggagagaaaggtaatcgtgagtgttcgggtggctatcaacgacaccctgtttgttctgtgtgctgtgtctctctctatttgcttgtacaagatctcaaagatgtctttagctaacatctatctcgagagcaagggctcctccgtttgtcaggttacagctatcggggtcaccgtgattttgctctacacatctcgagcatgctataatctatttattttaagttttagtcaaaataagtcagtacactcctttgactacgattggtataatgtatccgaccaggctgacctcaaaaaccagctcggtgacgccggttacgtgttgttcggggtggtcttgtttgtgtgggagctgcttccaactaccctagtcgtatacttttttcgagtccgtaacccgactaaagatttaaccaatcccggcatggtgccctctcacggatttagccccaggtcctattttttcgataatccgagacgctatgacagtgacgacgacttagcttggaatatcgcccctcaggggctgcagggcggcttcgctcccgactattatgactggggacagcagacgaacagctttctagcccaggcaggaaccctgcaagattcaacgttggaccccgataaacctagcctgggctag

SEQ ID NO: 26480 - DNA, 1197 bp, Artificial Sequence
  Description of Artificial Sequence: Synthetic coding sequence
atgagaggagacccgcggccccgggggagcgcccccgggcccatggagacaccaccctgggaccccgcgcgaaacgatagtctcccacctacactgacccccgcggtgcctccatacgtcaaactcgggttgactgttgtctataccgttttttatgcactgctcttcgtattcatttacgtgcagttatggctcgttctgagatacaggcataagcgacttagttaccagagcgtcttcctcttcctctgcctcttctgggcatcgctgcggactgtgctttttagcttttatttcaaagatttcgtggccgctaactctctcagtccctttgtgttttggttgctgtactgctttcctgtttgtcttcagtttttcactctcactctcatgaatctgtactttactcaggtgatttttaaggctaaaagtaagtactcgccagagcttctcaagtatcggctgcccctgtacttggcctctctgttcatttcattggtcttcttactggtcaacctgacatgcgcagttcttgtaaaaaccggtaattgggagcgtaaggttatagttagtgtgagagtcgcaataaacgatactctcttcgtgctctgtgcagtgagcctctccatttgcctgtacaaaatttccaagatgagtctggctaacatatatctggagtcaaaaggaagctccgtctgccaagtgacagccatcggggtgaccgtcatactgctctatacatcacgggcttgctataacctgtttatcctttctttcagtcagaataaatccgtacattctttcgactatgattggtacaacgtctctgatcaggccgacctgaaaaatcagctgggggatgctgggtatgtcctttttggggtggtactattcgtgtgggaattgctgcccaccactctcgtcgtttactttttccgtgtgagaaatcccactaaggacttgactaatcctggcatggtgcccagtcatggcttcagcccccggagttatttttttgataaccctcgacggtacgacagcgatgatgatctcgcctggaacatcgctccccagggactgcaaggtggcttcgcgcccgattactacgattggggccagcaaactaactctttcctcgcacaggctggaaccctccaggacagcaccctcgatcccgataaaccctcgctcggatag

SEQ ID NO: 26481 - DNA, 387 bp, Artificial Sequence
  Description of Artificial Sequence: Synthetic coding sequence
atgagccttgccaacatctacctggagagcaaaggatcttcagtgtgtcaagtgacagcaatcggtgtcaccgtgatccttctgtacacttctcgagcatgctataacctgttcatcctgagcttttctcagaataagtctgtccactcgttcgattacgactggtacaacgtaagtgaccaagccgacctgaagaaccagctgggggatgccggctacgtcctgttcggagttgtgctgtttgtgtgggaattgctcccaactacacttgtcgtatatttcttccgagtgcggaacccgactaaagatctgaccaacccaggaatggtgccttcccacgggttcagtccccggtcctatttttttgacaaccccagaaggtattag

SEQ ID NO: 26482 - DNA, 693 bp, Artificial Sequence
  Description of Artificial Sequence: Synthetic coding sequence
taacaggtgatctttaaagccaagtcgaagtattcccccgaactactcaagtataggctccctctttatctggccagcctgtttataagccttgtgttcttgctggtgaacctcacctgtgctgtcctggtaaagacaggcaactgggaaaggaaggtcatcgtctctgttcgtgttgctatcaatgatactctatttgttctttgcgcagtgtccctatctatttgtctctacaaaattagcaagatgtctttggctaatatctatctggaaagtaaagggtcttctgtgtgccaagtgacagccatcggggtcacggtcatccttttgtataccagtagagcttgttacaatctatttatcctaagcttcagccagaacaaaagtgtccattcatttgactatgattggtacaacgtgtcagaccaggctgacctgaaaaatcagctcggcgacgctgggtacgtattgttcggagtggtgctctttgtatgggaactgcttcccaccacccttgtagtatatttttttagggtgcgtaatccgacaaaggacctcaccaatccgggtatggtgccctcgcatgggttttcccctaggtcctatttttttgataacccccggcgctatgactcagatgacgatctggcatggaacatcgcgcctcaggggctgcaagggggcctcctgtag

SEQ ID NO: 26483 - DNA, 1290 bp, Artificial Sequence
  Description of Artificial Sequence: Synthetic coding sequence
atgcgagtgtcagtccccggaccagccgccgctgctgcaccggccgctggccgggagccttcgacgccgggaggggggtccggcgggggaggggcagtagcagccgccagcggggcagcagtcccaggttctgttcaactggccctcagcgtcctacatgcactcctctacgcggctctgttcgcttttgcttacctgcagctgtggcgcttactgttatatcgcgagaggcgtctttcttatcagagtctatgcctgttcctgtgcctgttgtgggctgcactgcggactaccttattttcagccgccttctctctgtcaggctctcttcccttactgaggcctcccgcccacctgcacttcttccctcactggttactctattgttttccatcttgcctgcagttttctacactgtgcttgttgaacttgtacttggccgaggtcatctgcaaagttagatgcgccactgaacttgacagacacaagatacttttgcatctgggatttataatggccagtctcttattcctggtggtcaacctgacctgtgctatgctcgttcatggcgatgtgcccgagaatcaactaaaatggactgtgtttgtgagagctctcatcaatgactccttattcattctctgtgcaatctctctggtgtgttacatatgcaaaattacaaagatgagctcggccaatgtctacctggagagcaaaggtatgtccttgtgccagactgtggtcgtcggttctgttgtgatcctgctctactcttcgcgggcgtgctataatctggtcgtcgtgaccattagccaggatactctggagtcacctttcaattatggctgggacaacctctcagataaagcacacgtggaggatatcagcggcgaggaatacatagtgtttggcatggtgttatttctttgggagcatgtgcctgcttggtctgtcgttttgttctttagagcccagcgccttaaccagaatctggctcctgctggcatgattaacagccactcctactcttctcgggcatacttctttgacaacccacggcgatatgactctgacgatgacctccccagattggggagctcccgtgagggcagcctgccaaactcccaaagcttgggctggtacgggactatgaccggctgcgggtcctcctcctacactgtcactccacatttgaatggacccatgaccgatacagcccctctgttgtttacttgcagtaatctggatctgaacaaccatcactcactatacgtaaccccccagaactag

SEQ ID NO: 26484 - DNA, 1062 bp, Artificial Sequence
  Description of Artificial Sequence: Synthetic coding sequence
atggaacacacccatgcacatctggccgcaaacagctccttgtcctggtggtctcccggtagtgcttgcggcttgggttttgtgcccgtcgtgtactactctctattgctgtgtctcgggttgcctgccaacattcttacagtcataattctgtcacaattggtggcccggaggcagaagagtagttacaactaccttctggctttggctgcggccgacatcttggtcctattcttcattgtgtttgtcgacttcttgctagaggacttcatcctaaacatgcagatgccccaggtcccagacaagattatagaggtgctcgagttcagcagtatacacactagcatctggatcaccgtccctctgaccatcgacagatacattgctgtgtgccacccgctcaagtaccatacggtgagctatcccgcacggactagaaaggtgattgtatcagtgtatataacctgctttttgactagcattccatattactggtggccaaacatatggaccgaagactatattagcactagcgtgcaccacgtgctgatctggattcactgttttaccgtatatctagtcccctgctctatcttttttattctcaattccatcatagtgtacaagcttcgaagaaaaagtaactttcgcttacgtgggtactcaacaggcaaaaccaccgccatcctcttcaccatcaccagcatctttgccacattgtgggcccctcgcattataatgattctctatcatctgtacggagcccccattcaaaaccgatggctggttcacataatgagtgacatcgccaacatgttggctttgctcaacaccgcaataaattttttcttgtattgtttcatctccaagagatttcgcacaatggccgctgccacactcaaggcattctttaaatgtcagaagcaaccagtccagttctacaccaatcataatttctccattacctcgagtccctggatttctcctgcgaactcacactgcattaagatgttggtgtatcagtacgataaaaacggaaaacctatcaaagtctctccgtag

SEQ ID NO: 26485 - DNA, 1062 bp, Artificial Sequence
  Description of Artificial Sequence: Synthetic coding sequence
atggagcacactcacgcccatctcgccgcaaattcgagcctgtcctggtggtctcctgggagcgcttgcggccttggattcgttccagtagtctattactcactgcttctatgtctgggcctgcctgcaaacattttaaccgtcattatcctctcacaacttgttgcccggcgccagaagagttcatataattacctcttagctctggctgccgccgatatccttgtgctgttcttcatagtcttcgtcgatttcctccttgaggacttcatccttaatatgcagatgccccaagttcccgacaagatcattgaggtgctggagttcagctccatccacacttccatctggatcaccgttccactgactatcgacaggtacatcgctgtatgtcatccgctgaagtatcacacggtgtcctaccccgcccgcactcgtaaagtgattgtcagcgtctatattacctgctttctgacttccattccttattactggtggccaaatatctggaccgaagactacattagcactagcgtccatcacgtgctgatctggatccactgtttcaccgtgtatcttgtcccttgttctattttttttatcctgaattctattatcgtgtataaactcagaagaaaaagtaacttcaggctgaggggttacagcactggtaagaccaccgccattctgtttacaattaccagtatctttgcaaccctgtgggctccccgcatcattatgatactgtatcatctctacggcgcccccatccagaatcgctggctcgtacatattatgagtgacatcgcaaacatgctcgccttgctgaataccgccatcaatttcttcctgtactgctttattagtaagcggttccggacgatggccgccgcaaccctgaaggccttcttcaagtgtcagaagcagcccgttcagttctacactaaccataattttagtattacctcttcgccatggatctctcctgctaactcccactgtatcaaaatgctggtttaccagtacgacaagaacggcaaaccaatcaaagtgtccccgtag

SEQ ID NO: 26486 - DNA, 918 bp, Artificial Sequence
  Description of Artificial Sequence: Synthetic coding sequence
atgcccggacacaacaccagcaggaattcttcctgtgacccaatagtgacaccccatctgattagcctgtattttatagtgctgatcggcggcctggtgggcgttatcagtatcctgtttctattagtaaaaatgaacacgagaagcgtgacaaccatggccgtcatcaacttggttgtggtccacagcgtgtttctcctaacggtcccattcagactgacctacctaattaaaaagacttggatgttcggactcccattctgtaaattcgtgagtgccatgctgcatattcatatgtacctgacatttttattttatgttgtgatactggttaccaggtatctgatattcttcaagtgtaaagataaagtggagttttacagaaagctgcacgccgtagctgccagtgcgggcatgtggacattggtaattgtgattgtcgtccccctggtggtgagtcggtatggcatccatgaggagtataacgaagaacactgtttcaaattccacaaggagctggcgtatacctacgtcaagattataaactatatgatcgtcattttcgtgattgccgtcgccgtgattctgcttgtcttccaggtttttatcattatgctaatggtgcaaaagctccgccacagccttctgtcacaccaggagttctgggcccagctgaagaacttgttttttataggagtaattctggtgtgcttcctgccgtatcagttcttccggatctactatttaaatgttgtgactcacagcaatgcttgcaattccaaggtggctttctataatgagatcttcctcagtgtcacagccatttcctgctacgaccttctcttattcgtgtttggaggaagccattggtttaaacaaaaaattattggtctgtggaactgcgtcctgtgtagatag

SEQ ID NO: 26487 - DNA, 918 bp, Artificial Sequence
  Description of Artificial Sequence: Synthetic coding sequence
atgcctggccataatacatcacgaaatagctcatgtgatcccatcgtcactcctcatctgatttccctgtacttcatagtcttgatcggtggcttggtcggagtgatcagtattctgttcctcctggtgaagatgaacaccagatcagttacgacgatggcggtaattaacctggtcgttgtacattctgtctttctgttgaccgtgcccttccggctgacgtacctgatcaagaagacctggatgttcggtttgccattctgtaagtttgtttctgccatgctacatattcatatgtacttaacattcctgttttatgtggttatccttgtgactaggtacctcatcttctttaaatgtaaagacaaggtagagttctatagaaagctgcacgccgttgcagccagtgcgggaatgtggactctcgtcattgtgatcgtggttcccctcgttgtgagccggtacggaattcacgaggagtataacgaggagcattgtttcaaatttcataaggaattggcgtacacttacgtgaagattattaattatatgatcgtcatcttcgtgatcgctgtggctgtgattctcctcgtgtttcaggtatttataattatgcttatggtccagaagttaaggcattcgctactaagccatcaggagttttgggcccaactcaaaaatctgttctttatcggggtcattctcgtgtgcttcctgccataccagtttttcaggatttactatttgaacgttgtgacccacagtaatgcctgcaattcaaaagttgcgttttataacgaaatttttctaagcgtgaccgcgatctcttgttacgacctgttgctgtttgtcttcggcggctcccattggttcaaacagaaaatcattggcctctggaattgcgtactgtgcagatag

SEQ ID NO: 26488 - DNA, 315 bp, Artificial Sequence
  Description of Artificial Sequence: Synthetic coding sequence
atgcccggtcataacacttctagaaatagctcctgtgaccctatagtcaccccccacctgatatccctgtattttattgtgttgatcgggggtctcgtcggagtcatcagtattctattcctacttgtcaagatgaacactcgaagcgtgaccactatggccgtgattaatctagtggtggtgcacagtgtgttcctcctcaccgtgcccttccgcttgacctacttgattaagaaaacgtggatgttcgggctccctttctgtaaattcgtgtccgccatgctgcatattcatatgtatctgaccttcctttag

SEQ ID NO: 26489 - DNA, 1389 bp, Artificial Sequence
  Description of Artificial Sequence: Synthetic coding sequence
atgtcaatcatgatgcttcccatggagcagaagatccagtgggtccccacctccctgcaagatatcacagccgtcttgggcaccgaggcatacacggaggaggataagagtatggtgagccacgctcaaaagtcccaacacagttgcctctcccattcccgctggctccgcagcccacaggttacgggaggcagctgggacctccgaatcaggccctcaaaggactcatctagcttccggcaggctcagtgtctgaggaaggatcctggcgctaacaaccatctggagtcccagggggtgagaggcacggccggggacgctgaccgggaattgagaggccccagcgagaaggccaccgctggacagcctagggtgacccttctgcccacacctcacgtgtccggcttaagccaggagtttgagtcacattggccggagattgccgaacgcagcccctgcgtggcaggagtgatacccgtgatttattactcagtgctgctcggactgggactccccgtttctttactcaccgccgtagccctcgctcggctggctacacggacacggcgcccgtcgtattattacttgctggccttgacggctagcgacatcatcattcaagtggttatcgtgttcgcaggatttctcctgcagggcgccgtcctggctaggcaggtgcctcaggcagtcgtacggaccgctaatatccttgagtttgccgctaaccatgctagcgtctggatagcaatcctgctcacagtggatcggtacaccgctttgtgtcatccactacaccacagagctgcctcgagcccaggccggacccgaagagcaattgcggccgtgctctcggcagctttgctgactggtatccctttttattggtggcttgatatgtggcgtgacactgactcaccccggactctggacgaggtccttaaatgggcccactgtctgacagtttatttcatcccgtgtggcgtgtttctggttacaaacagtgccataattcacagacttagacgaagaggcaggtctgggctccaaccacgggtcggaaaaagtactgctattcttttgggcattactactctgttcaccttgttatgggcaccgcgggtgtttgtgatgctgtatcacatgtatgtcgcccccgtacatagagattggcgagtgcacctcgctctggacgtagcgaatatggtggccatgttgcacactgccgccaattttggcctgtactgctttgtgagtaagacgttccgtgcaacagtaaggcaggtaatccacgatgcttacttgccttgcaccctggcctcccaacccgagggaatggcagccaagcccgtgatggagccacctgggttacctaccggagccgaggtttag

SEQ ID NO: 26490 - DNA, 2892 bp, Artificial Sequence
  Description of Artificial Sequence: Synthetic coding sequence
atggacgctccctggggcgcaggcgagcgatggctgcatggcgccgccgttgatcggtcaggtgtgagccttggtccccctcctactccccaagtgaaccagggaaccttaggaccccaggtcgctcccgtagccgcaggagaagtggtgaagaccgccggaggggtgtgcaaatttagtggccagcggctcagctggtggcaggcccaggagtcttgtgaacagcagtttggccatttagctttgcagccgccggacggggttctggcaagcaggctccgggaccccgtgtgggtgggacagagggaagccccattacggagaccgccccagagaagggccagaactaccgcggtcctggtcttcgatgaacgcaccgcggatcgtgctgcccgattgcgatctcccctgccagagctcgccgccctgacagcttgcacccatgttcaatgggactgtgcctctcccgaccccgccgccctattcagtgtggccgcccctgcactgcctaatgctctgcaactgagagcgtttgccgagcccgggggagtggttagagccgcgcttgtcgtgcgagggcagcatgctcctttccttgccgcattcagagcagatggccggtggcatcacgtttgtgctacatgggagcaacgaggaggccgatgggcactgtttagcgatggaaggcggcgagcaggagcacgggggttgggtgcaggacatcccgtgccatcaggtggcatcctcgtgttaggccaggatcaggatagcctcggcgggggcttcagtgtgcgacatgccctgtcaggtaatctcacagattttcacctgtgggcgcgggctctctcacctgctcagttgcatcgggcaagggcttgtgctcctccgagcgaagggcttctcttcagatgggatccgggcgcactggacgtgacccccagtttactgcctaccgtttgggtgcggctcctgtgccccgtccctagcgaggagtgtcctacatggaatcctggcccaaggagcgaaggttctgagttgtgtttagaaccccagccgttcctttgttgctatcgcactgagccctatcggagactccaggatgcccaatcgtggcctgggcaagacgtgatcagccgagtgaacgctttagccaacgatatcgtgctgctgcctgatccactgtcagaggttcatggcgctctgagccctgccgaagccagtagttttctcggcttgctggagcacgtgcttgccatggaaatggctcctctgggacccgcagccctgctagcagtggtgcggttcctgaaacgggtggtggccctgggagccggtgatcctgagctccttttgaccggcccatgggagcagctatctcaaggtgtcgtctccgtagcgtccctggtgcttgaggagcaggtcgcagacacctggctctccctcagagaagttattggcgggccaatggccttagtggccagtgttcagcggcttgctcctctgctctccaccagcatgacttctgagcggcctcgcatgagaatccagcaccgccacgctggcttatccggcgtaaccgtaatccatagctggttcactagtcgcgtgtttcagcatactctggagggccccgacctcgaaccccaggcaccggcgtcttcagaggaagccaatagggttcagcgctttttgtctacacaggttgggtctgccatcatttcctctgaagtatgggacgtaactggggaggtgaacgttgctatgacttttcacctccagcacagagcgcagtccccactcttccccccacatcctccgtctccttacaccggcggagcatgggccacaacgggctgtagtgttgcggcgctatacctcgacagcactgcatgtttttgtaatcactccacgtcctttgctatcctgctccaaatctacgaggtccaacgcgggcctgaggaagagtctctgttgaggacgctgtcatttgtagggtgcggcgtttccttttgtgccctcacgacaacttttttgctgttccttgtcgctggggtgcccaagtccgaacgtacaacagtccacaaaaacttgactttttctcttgcctccgccgaagggtttctgatgacgtctgaatgggccaaggcaaatgaggtcgcctgtgtcgccgtgaccgttgccatgcactttctgtttctggttgctttcagctggatgctggtggaggggctactcctctggcgcaaggtagtggcagtgagcatgcaccccggccccggaatgagactgtaccacgcgactggctggggggtgccagtggggatagtcgctgtgactttggctatgcttccgcacgattatgtggctcctggtcactgctggttgaatgtgcatacaaacgcgatctgggcctttgtggggccagtactgtttgtcctcaccgctaatacctgtattctggcccgggtagtgatgattactgtgtcatccgcccgccgtagggctcgaatgctgtcgccccaaccatgcttgcaacagcagatctggacacagatatgggccaccgttaagcctgtgttggtgctgctccctgtcctcggcctaacctggctggcaggcatcctggtccacctttccccggcatgggcatacgcagctgttggcctgaactccatacaggggctgtacattttcctagtgtacgcagcctgcaacgaagaagtccgatctgccctgcagcggatggctgagaaaaaggtggcagaggtcctccgcgcattaggagtctggggaggggcagccaaggaacattccctgcctttttcggtgttgccattgtttctgccccctaagccttccactccacgacaccctcttaaagcacccgcctag

SEQ ID NO: 26491 - DNA, 1104 bp, Artificial Sequence
  Description of Artificial Sequence: Synthetic coding sequence
ttaaccgattttcatctctgggcccgtgccctgtctcctgcccagctgcacagggctcgggcctgcgccccccccagtgaaggcttactcttccgatgggatccaggcgccctggatgttacaccctcactcttgccaactgtgtgggtccgccttctgtgcccggaaccgtacaggaggctgcaggacgcccagagctggcctggccaggacgtaatctcaagggtaaacgccctggccaatgacatcgtactactccccgaccccctgagtgaggtacacggcgctctttcccctgccgaagcaagctcctttctaggtttgctcgaacacgtgttggctatggaaatggcccctctgggaccagcggcattactggctgtggtccgctttcttaaaagggtggtggcacttggcgcaggcgacccagagttactgctaacaggtccatgggagcagctgtctcagggagttgtctccgtagcttctttggtgttggaggagcaggtcatcggcggccccatggccttggtggcttcagtccagagattggccccgctgctgagcacttctatgacatctgaacgtccacggatgcgtatccaacaccgccacgccggactggaggtgcggagcctacggctccgcgaggcgtcaacacgcggctgtctttttacaatgccagggggacgcccagagggccctggtcatatccatatcccagcctctgaggtccggcgactgctgcgcaagggactgagtggcgtgaccgtgatccacagctggttcacatctagggtgttccagcatactctggagggcccagatctcgagccccaggccccagcgtccagcgaagaagccaacagagtccagcgcttcctcagcacccaggtaggcagtgccatcatcagttctgaggtgtgggatgtgacaggggaagtgaacgtggccatgacttttcacttgcagcaccgcgcacagcccatatacagaggatgcctcggccatcataggctgttgcgtgggtgtcctgtccctgggttacatcggttgttgctgcagccccaacatcaattatgccaccctgctgccaacctgtag

SEQ ID NO: 26492 - DNA, 393 bp, Artificial Sequence
  Description of Artificial Sequence: Synthetic coding sequence
agtggaggcattctgctggatgctgggggtggagctgccgcagtggaagaaggaggtagttgcgagcatgcccctggcccacggcacgcggcactcccgcggcaccgcctcggggctaccgttaaaccagttctggtacttctgcctgtgctggggttaacttggttagctggcatattggtacatctaagtcctgcatgggcctatgccgctgtgggtttgaattctattcagggcctatatattttccttgtgtatgctgcctgtaacgaagaagtgcgctctgctctgcaacggatggcagagaagaaagtagctgagggccccatggccctcgagttaccgcagcatagtccccctttgcagacgagacgtgacagactgtggaattag

SEQ ID NO: 26493 - DNA, 105 bp, Artificial Sequence
  Description of Artificial Sequence: Synthetic coding sequence
atgcaccctccgccaagcctgctatctttcctggcacccgttgctgccggcgaggtcgtgaagactgccgggggagtttgcaaatttagtggtcagcgcttgtag

SEQ ID NO: 26494 - DNA, 1002 bp, Artificial Sequence
  Description of Artificial Sequence: Synthetic coding sequence
atgtggtcatgttcttggtttaacggtactgggttagtcgaggaactgccagcatgtcaagatcttcaactagggctgtccttgctgagcctgctcgggttggtggtaggcgtccctgtgggcctttgctacaacgccctcttagttttggcaaacttgcactcaaaggctagtatgacaatgccggacgtgtacttcgttaatatggccgtcgccgggctcgtgctcagtgctttagcgcctgttcacttgctgggccccccctccagccgttgggccctctggtcggtgggtggtgaagttcacgtagcactgcaaattccgtttaatgtttctagcctggtcgccatgtattccacagcactcttatcactcgatcactatattgaacgcgcactccctaggacctacatggcaagcgtgtataataccaggcacgtgtgtggtttcgtgtgggggggcgctctgctgacatcgttcagctctttgttattctacatttgctcccatgtcagtacacgagcacttgaatgcgccaagatgcagaatgccgaggccgctgatgcgaccttggtctttatcggctacgtggttccggccctcgccactctctatgccctggtgcttctgtcccgggtgagacgcgaggacacacctctggaccgcgatacaggtagactcgaaccctctgcccaccggctcttggttgcgaccgtgtgcacgcagtttggactgtggactccacactacctgattcttctcggccacaccgtaatcatctcccgcggtaagccagtggatgcccattacctcggcctgctgcattttgtgaaagacttcagtaagttactcgctttctccagttctttcgtgaccccccttctctaccggtatatgaatcagtctttccccagtaagctacaaagactgatgaaaaaattgccatgtggcgatcgacattgctctcctgaccatatgggtgtgcagcaggttctggcctag

SEQ ID NO: 26495 - DNA, 1002 bp, Artificial Sequence
  Description of Artificial Sequence: Synthetic coding sequence
atgtggtcgtgttcttggttcaacggtacgggactggtggaggaactacctgcgtgccaggacctgcaactgggactaagtctgctgagcctcctgggcctcgtggttggcgttcctgttggtctatgctacaatgcacttttggtgctcgctaacctgcacagtaaggccagcatgaccatgcctgatgtgtatttcgtcaacatggctgtcgccggattagtcctgtccgcactcgcccctgtgcatttgctgggaccgccctccagccgttgggctctttggtccgtgggtggagaagtgcatgtagctttgcagataccattcaacgtctcttctctggtagcaatgtactccacagccctgttgagtctggatcattatatcgaaagagcgttacctcgaacttatatggcaagtgtctacaacacgaggcacgtatgtgggtttgtgtgggggggggctctattgacctccttctccagcctactgttctacatatgttctcacgtgtccactcgggccctcgagtgtgctaagatgcagaatgctgaggccgccgatgccactctcgtctttatcgggtacgttgtgcccgctctggctactctgtacgctttagttctgctgtccagggttagacgcgaagacactccccttgaccgcgatactggacggttggaaccaagtgcccacaggctgttggtcgctactgtctgcacacagttcggattatggaccccccactatttgatcctgctgggccataccgtgataatttcgaggggaaagcctgtcgacgctcattacttgggcctcctgcacttcgtgaaagatttcagtaaactcctggccttcagctccagcttcgtgactccactactgtaccggtatatgaatcagtcatttccgtccaagctccagcgtctcatgaagaagctcccttgtggagaccgtcactgttccccggatcacatgggagtgcaacaggttcttgcttag

SEQ ID NO: 26496 - DNA, 948 bp, Artificial Sequence
  Description of Artificial Sequence: Synthetic coding sequence
atgtggagctgctcatggttcaacgggacgggactggtggaggagctccctgcatgtcaagaccttcagctgggcctttccctcctcagcctgctggggctggtggttggcgtccctgtgggcttatgttataatgctctgcttgtgctggctaatttacactcgaaggcttccatgactatgcctgacgtatactttgtgaacatggccgtggcaggcttagtcctcagcgcacttgcccccgtgcacttgctgggaccccctagtagtcggtgggcactttggtccgtcggcggcgaagtgcatgttgcactgcaaatccctttcaacgtgagctctcttgtggcgatgtacagtacagctctcctgtccctcgaccactacatagagagggccctgccgcgcacatacatggcctctgtgtataacactcgccacgtttgcgggttcgtctggggaggcgctctcctgactagcttctcatcactcctgttttatatatgcagtcatgtgtccacaagagctctggagtgcgccaagatgcagaacgccgaggctgccgacgcaaccctcgtgtttatcggctacgtcgtacctgccctggccactctgtatgcactggttctgctgagtagggtgcgccgagaggacaccccactcgacagggacaccgggaggctcgaacctagcgcccaccgcttgctggtggctactgtttgtacccagttcggtctgtggacgccccattaccttatattattggggcatacagtcatcatttcccgaggaaaacccgtggatgcccactacctgggtctgctacatttcgtgaaagacttcagcaagctgttagcttttagctcaagcttcgtgaccccgctgctatatcggtatatgaatcagagttttccatccaagctacagcggctaatgaagaagctgccctag

SEQ ID NO: 26497 - DNA, 756 bp, Artificial Sequence
  Description of Artificial Sequence: Synthetic coding sequence
atgcttctggggcctccatccagcaggtgggcactgtggtccgtaggcggggaggtccatgtagccttgcagattcccttcaacgtatctagcttagtggcgatgtattccacagccctgctgtccttggaccactatatcgagagggcccttccaaggacttatatggcctccgtctataatactcggcatgtgtgtggatttgtgtgggggggggccctcctcacatcctttagctctttgctcttctatatatgttcgcatgtgagcaccagagctctggaatgtgcaaagatgcagaacgcggaagccgctgatgccacactggtgttcatcggttacgtagtgccggcgttagcgacactgtacgcactggtgttgctgagcagggtccgccgggaggatacacccctggaccgcgataccggtaggttggagccctcagctcaccggctcctggtggcaactgtttgtacacagttcggtctgtggacgccgcactacttgattctgctgggccataccgtgattatcagtcgtggaaagcccgtcgacgcgcactacctggggctcttacattttgtgaaggatttctctaagctgctggcctttagtagcagtttcgtgactccactgttatataggtacatgaaccagtcttttcctagtaaattgcagaggctcatgaagaagcttccttgtggggacaggcactgtagcccggatcacatgggggttcagcaggtgctggcttag

SEQ ID NO: 26498 - DNA, 1044 bp, Artificial Sequence
  Description of Artificial Sequence: Synthetic coding sequence
atgggagacgaacttgccccctgcccagtaggcaccaccgcctggcctgcactcatccagttaatctccaagactccttgtatgcctcaggcagcatccaatacctccctcggcctgggcgacttgcgcgttccctcctctatgttatactggctttttctgccatcctcactgctcgcagctgctacacttgcggtaagccctctgctgctcgtgactattctgaggaatcagaggctgagacaggagcctcattacctgcttccggctaatatattattgtctgacctcgcatacatcctgctgcatatgctcatcagtagtagctcacttggtgggtgggagctcggccgcatggcatgcggcattttgaccgacgccgtgttcgcggcttgtacgtcaacaatcctgtctttcacggctatcgtgttacatacttatcttgccgttatccacccactgagatatctctcattcatgtcccacggtgccgcctggaaagccgtggctctgatttggctcgtggcttgttgctttccaaccttcctcatctggctgagcaaatggcaggatgcccagctggaggaacagggagcatcctatatcctacccccctccatggggacacaacctggctgcggactactcgtcatagtgacttacacgagtattctttgtgtgttattcctgtgcaccgctctgatagcgaattgtttctggcgcatatatgcggaggctaaaacctccggcatttgggggcaggggtattcgagggcgcggggtacgctgctgatacattcagtgctaattaccctgtatgtatccacaggtgttgtgttttcccttgatatggttttgactagatatcatcacattgactccgggacccacacgtggcttttggcggctaactcagaggtcctcatgatgctgccacgagcaatgctgacttacctgtacctgttacgctaccgacagctcctgggtatggtgaggggacacctgccgtctcgccgccaccaggcaatatttacaatcagctag

SEQ ID NO: 26499 - DNA, 2196 bp, Artificial Sequence
  Description of Artificial Sequence: Synthetic coding sequence
atgtcgctgtttctgagtaacctctccactaacgattccagcctatggaaagagaatcacaacagcacagatctgctgaacccccccggtaccctaaacatatacttattctgtctcacatgccttatgacttttgctgccctggtaggcagcatctactcactgatcagccttctgaagatgcagaatcgaactgtggtctcaatgctcgtggcctcgtggagtgtggatgacctgatgtcagtcttatcggtaacaatcttcatgttcctgcagtggccaaatgaagtacccggctacttccagtttctctgtacaacgtccgcattgatgtacctttgtcaggggctgagcagcaatctgaaggccaccctgcttgtgtcctataacttctacacgatgcaccgcggagtgggctcacagactgctagtaggcgttcaggccaagtgctaggtgttgtgttaacagtctgggctgcttcgcttttgcttagtgctcttcctctctgcggttggggagctttcgttcgcacaccgtgggggtgtcttgtagactgctctagcagctatgtgctattccttagcatcgtgtacgctttggcctttggacttctcgttgggctttccgtgcctctaacacaccgactcttatgttcggaggaaccacccaggttgcactcaaattaccaggaaatatcaaggggagccagcatcccaggcactcctccaaccgctgggcgggtggttagtctgtcccctgaggatgctcccggtccatcgctcaggcgaagtgggggttgtagcccatcctccgataccgtgttcggcccaggcgccccggcggctgccggagccgaggcctgccggagagagaaccgtggcaccctgtatggcacaaggagctttaccgtttctgttgcccagaagcggttcgcgttaatccttgccctaaccaaggtcgttttatggcttcccatgatgatgcacatggtcgtacagaacgtggtcggctttcagtccctcccccttgaaaccttcagcttcttacttacactgctggccaccactgtaacaccagtgttcgtactgtccaaaagatggacacacctgccatgcggatgtataatcaactgccggcaaaatgcctacgcagtggccagtgatggcaaaaagataaagcggaagggatttgaattcaacctgagtttccagaagagctacggtatctacaagattgcccatgaggattactatgacgatgatgaaaattcgatcttctaccacaacctgatgaactcagaatgcgagacaaccaaagatccccagagagacaataggaatatttttaacgctatcaaggtcgaaatatccactacccctagtttggactcaagtacacaaagagggatcaacaagtgcacgaacaccgacattacagaagccaaacaagacagcaataataagaaggatgcatttagcgataaaaccgggggggacataaattacgaagaaaccactttctccgaggggcctgagaggcggctttcacacgaggagagccagaaacctgacctctcagactgggagtggtgcaggtccaaaagcgagcgcacacctcgccagagaagcggatatgccctcgctatcccgctgtgtgccttccagggaacagtgagcttacatgcaccaaccggaaaaaccctgagcctatcaacctacgaggtttctgccgaggggcagaaaatcacgccagcttccaaaaagattgaagtataccggtcaaaatcagttggtcacgaacctaattctgaggattcttcatctacattcgtcgacacatcagttaagatccaccttgaagtgcttgagatctgcgataatgaagaggctcttgacaccgtatctattatatccaatatctcacaaagcagtacacaggtcaggtcacctagcctgcgctactccagaaaggagaaccggttcgtctcttgtgacttgggtgagactgccagttactctctgtttttgcccactagtaaccctgacggcgacatcaacatttccattcctgataccgtggaggcacaccgtcagaacagcaaacgacaacaccaagaaagagacggctaccaagaagagatccaactgctgaataaagcttacaggaagcgcgaggaggagtccaaggggtcttag

SEQ ID NO: 26500 - DNA, 1305 bp, Artificial Sequence
  Description of Artificial Sequence: Synthetic coding sequence
atggaggatctcttcagcccgtctatactgccccctgccccaaacatttccgtgccaattcttttaggatgggggctcaacctgacactgggtcaaggggcccccgcgtccggccctccatcccggcgtgtccggctggttttccttggtgttattctggttgtggcagtggcaggaaataccactgtactatgtagattgtgcggcggaggaggcccttgggccgggcctaagcgaagaaaaatggacttcctactcgtgcagctggctctggcggacctgtatgcgtgcggcggtaccgccctgtctcagctagcctgggaacttttaggcgagccaagggctgccactggcgaccttgcatgtcggtttctccagctcttgcaggcgtcaggtcggggagcaagcgcacatctggtggtcctgattgccctcgaaaggcggcgggctgtccgcttgccgcatggtagaccattacctgcgagagccctcgccgccctcggttggcttctggcactgttactggctcttcctcccgcctttgtggtgcgcggtgattcgcccagtcccctgccccctccaccaccacctacatcactgcagcctggagccccccctgcagctagggcctggcccggagagaggcgttgtcacggtatttttgcccctctgcccagatggcatttgcaggtctatgctttttacgaagccgtagcgggcttcgtagctcccgtaaccgtgcttggcgttgcatgcggacacctcctgagtgtctggtggaggcacaggccgcaggcaccagctgctgccgccccttggtctgccagtcctggccgcgcaccggctccctccgctctgccacgcgccaaagtgcagagtttgaagatgagtctgttgttagcactcctcttcgtcgggtgtgaattgccatactttgcggccaggctggccgcagcatggtcgtctggacccgcgggcgattgggagggcgagggcctgtcagcggcattgcgcgtggttgccatggctaactcagcactaaatcccttcgtgtatctcttcttccaggctggggactgccgccttaggcgccaacttcgaaaacgtttgggaagtctgtgctgcgccccccagggcggggcggaggacgaggaaggccctcggggccaccaggcactctatcggcaacgatggccccatccacattaccaccatgcccggagagagcctctggatgaggggggcctcaggccacctccacccaggccccgccctttaccttgcagttgtgaatctgcattttag

SEQ ID NO: 26501 - DNA, 1260 bp, Artificial Sequence
  Description of Artificial Sequence: Synthetic coding sequence
atgctggcagccgccttcgccgattcaaactcctcttctatgaatgtctcttttgcccaccttcacttcgccggcggctatttaccttccgattctcaggactggcgaacgattatcccagccctgcttgtggcagtctgtctagtgggcttcgtcggaaatctgtgcgtcatcggcatactgctccataatgcctggaaggggaaaccctccatgattcactctcttatcctaaatctatccctcgctgatttgtcactgttgctgttctctgcaccaattcgcgccaccgcatactctaagagcgtctgggatctcggatggttcgtttgcaagagcagcgactggtttatccacacttgtatggcagcaaaatccctgaccatcgtagtcgttgctaaggtttgtttcatgtacgcctctgatcccgctaagcaggtatctatccacaattataccatctggtcggttcttgtcgcaatttggactgtagccagcctactccctctcccagagtggttctttagcaccatcaggcaccatgagggagtcgagatgtgtctggtagatgtcccagcagtcgccgaagagtttatgtcaatgttcggaaagttgtatcctctgctcgcctttgggctgcctctctttttcgctagcttctatttctggcgcgcctacgaccagtgcaaaaagcggggtacaaagacccagaacttgcgtaaccagatcaggagtaaacaggttactgtgatgctgttgagcattgcaatcatctcggcactcctgtggctccccgagtgggtggcatggctgtgggtatggcaccttaaggcagccggcccagctccccctcaaggatttattgccctgagtcaggttctgatgttctccatctcctctgcgaatcctttgatctttctagttatgtccgaagagtttcgtgaagggctaaaaggggtgtggaaatggatgattacaaagaaacccccaaccgtgagcgagagccaagagaccccggctggtaatagcgagggactacctgataaagtcccatctccggaatcaccagcctctatccccgaaaaagagaaaccatcgtccccttcaagcgggaagggaaagacagaaaaggcagaaataccaatcctccctgacgtcgaacaattttggcacgagcgcgacaccgtaccaagcgtgcaagataacgatcccattccttgggagcacgaagaccaagagaccggggagggtgtgaagtag

SEQ ID NO: 26502 - DNA, 1413 bp, Artificial Sequence
  Description of Artificial Sequence: Synthetic coding sequence
atggacacgacaatggaggccgatttaggagcaactggtcacaggccccggacggagctggacgatgaagattcctatccccagggtggttgggacaccgtcttcttggtggcactactgctgctgggattgcctgccaacggcctcatggcatggctcgctgggagtcaggcgcgccacggagctgggacaaggctcgccctgctgctcctgagcctcgccctcagtgactttctttttcttgctgcagctgccttccagatcctcgagatccgtcacggaggacactggccattgggcactgctgcatgccggttctactatttcttgtggggagtctcatactcctcaggtctgtttttactggccgccctatcattggaccgatgcttattagccctgtgcccacactggtaccccggtcatagaccagtcaggttacccctctgggtttgcgccggtgtctgggtcctggccacactttttagcgtgccctggttggtctttcctgaggctgcggtatggtggtacgacctcgtgatttgcctagatttctgggatagtgaagaactcagcttgagaatgctggaggtgctaggcggattcctgcctttcctgttgctgctggtatgtcacgtactaacacaggctactgcgtgcaggacttgccacagacagcagcaacccgccgcctgtagaggctttgcaagagtagcaagaaccattctttccgcttacgtggtgttaaggttgccatatcagttagcccagttgctgtatctggcgtttctatgggacgtgtattccgggtacttgctgtgggaggccctggtctactcagattatctgatactgttgaatagttgcctgtctccattcctgtgcctcatggcctcagctgacttacggaccttgctgcgcagtgtgctttcatcgttcgcggccgcattgtgcgaagaaagacctggctcattcacccctaccgaaccacaaacccagttagattccgagggacccactctccccgagcccatggctgaagcgcagtcgcagatggacccagtggcccagccgcaggtgaaccccacgctgcagcctcgctcagaccctaccgcacagccacagctgaaccctaccgcccagccgcaaagtgatcccacagcccagccacagctaaatctcatggcgcagccacaatcagactcagtggctcaaccccaagcggataccaacgtgcaaacaccagctcctgcagcctccagcgttccctctccctgcgatgaggccagccccactccgtctagccacccaacaccaggagcactggaggaccctgccacacctcctgcatctgagggcgagagtccatcctctactccccctgaagcagccccaggagctggtccgacatag

SEQ ID NO: 26503 - DNA, 2613 bp, Artificial Sequence
  Description of Artificial Sequence: Synthetic coding sequence
atgaactctaacttacccgccgagaatctcacaattgcggtcaacatgacaaagactttgccaacggccgtgacccatggttttaactccacaaatgaccccccctctatgtccattactcgcctgttccctgccctcctggaatgtttcgggatagtgctgtgtggatatattgccggccgggcaaatgtgattacctcaacccaggccaaaggtttaggcaattttgtgagcagattcgcattgcccgctttactgtttaagaacatggtggtcctgaacttttccaatgtggattggagcttcctttatagcatactgatcgccaaagcctcagtgttcttcatcgtgtgcgttctgacgctcttggtcgcatctcctgacagccggttctccaaggcgggcttgttcccaatattcgccactcaatccaacgacttcgctctggggtatcctatcgtggaagccctctaccaaaccacctaccctgagtatctccagtacatctatttggtggcacctatttccctaatgatgctaaaccctatcggatttatcttctgcgagatccagaagtggaaggacactcaaaacgccagccagaataaaattaaaatcgtgggcttggggctcctgcgagtcctacagaatccgatcgtgtttatggtgttcatagggattgcgttcaacttcatccttgaccgcaaagtgcccgtgtatgtcgaaaattttttagatggtctcggaaactcctttagcgggtctgctctgttctacctcgggctcactatggtgggtaaaatcaaacgccttaagaaaagtgcctttgtcgtactgatcctcctgattaccgccaaacttcttgtgctcccactgctgtgtcgtgaaatggtcgagctgctcgataaaggagactcagtggtgaatcacaccagcctgtctaactacgcctttctctacggggtgtttccagtcgctcctggagtcgccattttcgcaacacagtttaacatggaagtagaaatcattacctcgggtatggtcatttcaacttttgtgtccgccccaattatgtacgtaagcgcttggctgctcaccttccccactatggacccaaaacccttagcctatgctatccagaacgttagctttgacatctcaatcgtaagtctcatatcacttatttggagcttggccatcctgctcttgtctaaaaaatacaaacagctcccacatatgctgactactaacttgctgatcgctcagtcaatagtgtgtgccggcatgatgatatggaacttcgtaaaagagaagaatttcgtggggcagatcttagtattcgttctgctgtactctagtctttattctacctacttgtggaccggcttgctggccatttcactatttcttcttaagaagcgggagcgggtccagatcccagtcggaatcattatcatatccggctgggggatccctgcccttctggtgggtgtactgttaattactggtaagcacaacggcgactccatcgattctgcctttttctatggcaaggaacaaatgattactactgcggtgacattgttctgtagcatcctcatcgctggaatctctctaatgtgcatgaaccaaaccgctcaggcgggtagttatgagggatttgaccaatcacaatcccacaaagtcgttgagcccgggaataccgcgtttgaggaaagtccggcaccagtcaacgagcctgaactttttacatccagtatacctgagacctcttgttgtagttgtagcatgggtaatggcgagttgcactgtccttccatcgagcccattgctaacacttctaccagtgagccggtgatcccatccttcgaaaagaacaatcactgcgttagccgctgcaactcacagagctgcattcttgcccaggaggaagaacagtacctgcagtcaggagaccagcagctcactcgccacgtactgctctgtttgttgctgataattggactattcgccaatctttccagttgtctgtggtggcttttcaaccaagaaccgggccgtctctatgtcgagcttcaatttttctgtgcagtttttaacttcggccagggttttatcagcttcgggatcttcgggttggacaaacacctcataattttacccttcaaacgccggctggagtttctatggaataataaggatacagcagaaaacagagactcccccgtcagcgaagaaattaagatgacatgccagcagttcattcattatcatcgagatctgtgcattcgcaatatagtcaaggagcgacggtgcggcgccaaaacttctgccggaactttttgtggctgcgatctggtgagctggcttatcgaagtgggactggcctcagaccggggtgaggctgtgatctacggcgaccgtctggtgcaggggggagtgatccagcacatcacgaacgagtacgagttccgagatgaatatcttttctaccgctttctgcagaaatctcctgaacagtcacctcccgctattaacgccaataccctgcagcaggaacggtacaaagagatagaacactcaagcccaccgtcccacagtccaaagacttag

SEQ ID NO: 26504 - DNA, 2613 bp, Artificial Sequence
  Description of Artificial Sequence: Synthetic coding sequence
atgaattcaaacctgccggcagagaacctcaccatagctgttaacatgactaaaacccttccaacagctgttacccacggattcaactccacaaacgatccaccttcaatgtcgatcaccaggctcttccccgccctcctcgaatgctttgggatcgttctctgcggttacattgcaggtcgagctaacgtgattacgagcacccaggctaagggcttgggcaatttcgtgagcagattcgccctgcctgctctgctgttcaaaaatatggtggtcctcaatttttctaatgtagactggtcattcctttactcgattttaattgccaaagcaagcgtgtttttcattgtctgtgttctgaccctgctcgtggcatctccggattctcggtttagcaaagccggtctgttccctatcttcgctactcagtcaaatgattttgcccttggctatcccatcgtggaagccctgtatcaaacgacttacccagagtacctgcagtacatttacctggtggcccccatctccctgatgatgctgaatcccatagggtttattttttgtgagattcagaagtggaaagatacccaaaatgcctctcagaacaagattaagatcgtgggattaggccttttgcgcgtgttacagaatccgatagtgttcatggtcttcatcggaatcgcttttaacttcatactggacagaaaagtccctgtgtacgtcgaaaacttcctggacgggttgggcaattcgttctctgggtctgccctattctacttggggctcacaatggtggggaaaatcaagcgtctgaaaaaaagcgccttcgtggtactgattctcctgatcaccgccaaattgctagttctcccgctgttgtgtcgggaaatggtggaacttcttgataagggcgattctgtggtgaaccataccagcctgagtaactatgctttcctgtacggagtctttcccgtcgctcctggagtggcaatctttgctacacagtttaacatggaggtggagattatcacaagtggcatggtgattagtacttttgtgtctgctccaataatgtacgtctccgcatggctgctcaccttcccaacaatggatccaaaaccgttagcatacgccatacagaatgtgagcttcgatatttccatcgtttccctaatcagcctcatttggagccttgctattttactcctgagcaaaaagtacaagcagctcccccacatgttaacaacaaaccttctgattgcacaatccatcgtttgcgccggaatgatgatctggaatttcgtaaaagagaagaactttgtgggccagatcctggtgttcgtcctcctttattcttcactgtacagcacatatctgtggactggtctactagcaatttctctgttcctattgaagaagagagagcgcgttcagatacccgtggggatcattataatttcagggtggggcatccctgcattgcttgtgggcgttcttttgataaccgggaaacataatggtgattccatcgattcagcctttttttacggaaaggaacagatgatcacaacagccgtgactctcttttgttcaatactaatcgctggaatatctttgatgtgcatgaatcagacagctcaggcaggatcttatgaggggttcgatcaatcccagagtcataaagtcgtggaacccggaaatacagctttcgaggaatcgccggctcctgtgaacgagccggagctctttacttcttcaattcccgagactagctgttgctcctgctccatgggcaatggcgagctacattgccccagcattgagccaatagcgaacacgtctacttcggagccggtgatcccaagcttcgagaaaaacaaccactgtgtcagtcggtgtaacagccagtcctgtattcttgcacaggaagaggagcagtacttgcagtccggtgatcaacaactgacccgtcatgtgctgctctgtctattgctcatcatcgggcttttcgctaacctgagcagctgtttgtggtggctttttaaccaggagcctgggcggctgtacgttgagctgcagttcttttgtgccgtgttcaattttggacaaggatttatctcgttcgggatcttcgggttagacaagcacctgattattctgccctttaaacgaagactggaatttctctggaataacaaagacacggcggagaaccgagatagcccggtgtcggaagagattaaaatgacatgccaacagttcatacattaccatagggatctttgcatcaggaatatcgtgaaggaaagacgatgtggggcaaagacttctgccggcaccttctgcggatgcgatctggtcagctggttaatcgaagtggggttggccagcgatcgtggtgaggctgtcatctacggcgaccgcctggtgcagggcggcgtgatacagcatatcacgaatgaatatgaattccgcgacgaatacctgttttaccgcttcctccagaaatcaccggagcagtcccctccggccataaatgccaacacgctccagcaggaacggtataaagagatcgagcactcatctcccccgtcgcatagccccaagacttag

SEQ ID NO: 26505 - DNA, 2613 bp, Artificial Sequence
  Description of Artificial Sequence: Synthetic coding sequence
atgaattcaaacctgcccgccgaaaacctcactatcgcagtgaacatgacaaagactctgccgacggccgtgactcacggctttaacagcaccaatgacccgccttccatgtccattacaaggctgtttcccgcacttctcgaatgttttggcatagtgctctgtggatatatcgctggtcgagctaatgttattacttctacacaggccaagggcctgggcaactttgtgagcaggttcgcccttcccgccctgctcttcaagaacatggtcgtgctgaatttcagcaacgtagattggagtttcctttactccatcctgattgcaaaggcgagcgtttttttcatagtttgtgtcctcaccctgctcgtggccagccctgactcccgcttctcaaaggccggtctcttccccatcttcgctactcagtctaatgattttgccttgggatatcccattgtggaggcattgtatcagacgacatatcccgaatatttacaatatatttatctggtggcgcctattagtctgatgatgttgaatccaatcggcttcattttctgcgagatacagaagtggaaagacacccaaaacgcctcccagaacaaaataaagatcgttggactggggctcctgagagtgctccagaacccaatcgttttcatggtattcatcggaatagcatttaattttattctggatcgtaaggtgcctgtgtacgtcgaaaattttctggacggtctcggaaattcattcagtggctccgctctgttttatctggggcttacaatggtgggcaagatcaagagactcaagaaatccgcgtttgtggtcctgatcctgctgataaccgcaaagctcctggttctacccctcttatgccgagagatggtggaactgctggacaagggtgactccgtggtgaaccatacctcactgtcgaactatgcattcctgtacggagtgttcccagtcgcacctggagtggctatctttgctacgcagttcaacatggaggtcgaaatcatcacctcgggcatggtgatctcaaccttcgtgtctgcaccaatcatgtatgttagtgcctggctgcttactttccctacgatggatcccaaaccgttggcctacgccattcagaacgtctctttcgacatctctatcgtgtctcttattagtctgatatggagcctcgccatcctcctgttatccaaaaaatacaaacagctgcctcatatgctgacgaccaacttgctgatcgcccagagcatcgtctgtgcggggatgatgatttggaatttcgttaaggagaagaattttgtgggtcagatcctggtgttcgtgctgctctacagttcactgtactccacatacttgtggactgggctgctcgcaatctcactgttcctccttaaaaagcgcgaaagagtacagattcctgtggggattatcatcatttccggctgggggatccccgcactgttagtaggagtgctattaatcaccggcaagcacaatggtgattctattgattccgccttcttctacgggaaggaacaaatgatcacaactgcggtgacgttgttttgctcaatattaattgctgggatatctcttatgtgcatgaaccagaccgctcaggcaggatcgtacgaaggctttgatcagtcacagtcacacaaggtggttgagcccggtaataccgctttcgaggagtctccagcccccgttaacgagccagaattgttcacctcatccataccagagacaagctgttgcagctgctctatggggaacggcgaattgcattgtccttcgatcgaaccaattgctaatacgtcaacaagtgagcctgtgatcccctcgttcgaaaaaaataatcattgtgtctctagatgcaactctcaatcctgcattctcgcccaagaagaggagcaatacttacagagtggcgatcagcagctgacccggcatgtgcttctttgcctgttactgattatcggtctgttcgcaaacctgagctcttgtctgtggtggttgttcaaccaggagcccggacgtctgtatgtggagctccaattcttttgcgcagtgttcaatttcggccaaggattcatctcttttggtatattcggcctggacaaacacctaattattttgcctttcaagcgtcgccttgaattcctctggaataacaaggatactgctgaaaatcgtgatagccctgtgtcagaggaaataaaaatgacctgtcagcaattcatccactaccatcgtgatctctgcatccgaaatatcgtgaaggaaaggagatgcggcgcaaagaccagcgccggaactttttgtgggtgcgacctggtgtcttggctcatagaggtgggcttggcgtccgatcgaggcgaggccgtcatttacggagaccggttggtgcaggggggcgtgattcaacacatcaccaacgaatacgaattcagagacgaatatctgttctataggttcttacagaaatctcctgaacaaagtccacctgcgataaacgccaacacactgcagcaagagaggtacaaagagatagagcatagcagtcctccatcccacagtccgaagacatag

SEQ ID NO: 26506 - DNA, 795 bp, Artificial Sequence
  Description of Artificial Sequence: Synthetic coding sequence
atgatcaccactgcagtgacacttttctgttccatacttatcgccggaataagcctgatgtgcatgaaccaaactgcgcaggccgggtcttatgaagggttcgaccaatctcagtcccataaggtcgtggaacccggcaatactgccttcgaggagtctcctgccccagtgaacgaacctgagctctttacttcctccatcccagaaactagttgttgtagttgctctatgggcaacggtgagttgcattgcccaagtatcgagccaattgcaaacacatccacttcagagccagtgattcctagtttcgagaagaataaccactgcgtgtcccgctgcaactcgcaaagttgtatacttgcccaggaggaagagcagtacctgcagtcaggggatcagcagttaacgaggcacgtcctgctctgcctgttattgattatcggcttgtttgcaaacctttcatcctgcctttggtggctattcaaccaggagcccggacgtttatacgtggaactgcagtttttttgcgctgtgtttaactttggacagggcttcatcagtttcggcatcttcggattggataaacatctcattatactgccgtttaagaggcgcctcgagtttctttggaacaataaggacaccgcagaaaacagggacagccccgttagtgaggaaatcaagatgacttgtcagcagttcatccattatcatcgggatctgtgtatcaggaacatagtcaaagaacgccgttgcggggctaaaactagcgccggcacattctgcgggtgctag

SEQ ID NO: 26507 - DNA, 417 bp, Artificial Sequence
  Description of Artificial Sequence: Synthetic coding sequence
ttccgggcccgcggtcccgacgggcgaggttctggacgcacccgtgcaggacgggcacccgggagggagccgcgggcccctcgctgccctgacgggggaggcgtcgctgctcgcgccgccagactgctgtcctccagaagatctggcagctggcccccaacacacgccctgtggccagacttgcggtcaagagccaggagattactgctttttttatccctggcagacctcctgtcagcccgctgccctccctctccaacacccgccccgtctagcggcccttggccattgcgcagcacctgcacctctgctagtagcgcaccacgagccggcctggcccagatagcctgtttcggcccaagtatgtcaagcgcaggagggagtcgatggtcctcactgtggcagccctctccatag

SEQ ID NO: 26508 - DNA, 1008 bp, Artificial Sequence
  Description of Artificial Sequence: Synthetic coding sequence
atgcaacctagtccacccccaacagagcttgtcccttctgagcgagcagtagtcctcttatcctgtgcgctgtccgctctcggatccggattactggtggctacacacgctttgtggcccgacctccggtccagagcgcgcagactgctactcttccttagtctggctgacctgctgtctgctgcctcatatttttatggagtgctgcaaaatttcgccggaccaagctgggattgcgtcctgcagggtgctctgtctaccttcgcaaacactagctcattcttctggacggtcgctatcgccctctacctctaccttagcatcgttcgtgctgcccggggccctcgcaccgatcgcctcctgtgggcatttcacgtcgtatcatggggggtgcctctcgtgataacggtggcagccgtggcacttaagaaaatcgggtacgatgccagtgatgtgagtgtaggctggtgttggatcgatcttgaggcgaaagatcacgtgttgtggatgctgctgaccggcaagctgtgggaaatgctcgcatacgttttactgcccctgttgtatctgcttgtgcgcaagcatatcaatcgcgcccataccgctttaagcgagtacagaccgattctatctcaggagcatagactgcttcgccactctagcatggctgataaaaaactagtgctgataccattgatcttcatcgggctgcgtgtgtggtccaccgttcggtttgtcttaaccctgtgtggctccccagcagtgcaaacacccgtgcttgtggttcttcacggtatcgggaacactttccaaggaggcgctaactgtattatgttcgtgctgtgtactcgtgcagtgcggacgaggctgttcagtctttgttgttgctgttgtagcagtcagccccccacgaagagtcctgcgggcactccaaaggcgcctgcaccctccaaaccaggagagtcacaggagtcccaggggacgccgggcgaactcccaagcacgtag

SEQ ID NO: 26509 - DNA, 813 bp, Artificial Sequence
  Description of Artificial Sequence: Synthetic coding sequence
atgcaacccagcccaccccccaccgaactggtgccatcagaaagggccgtggtgcttctgtcatgtgcactatcagcgcttggttccggcttacttgtagccacccatgctctgtggcctgaccttcgtagtcgggctcgacgactcctgctgttcctttcgctggctgacctgctgagtgctgcatcatatttctacggagtgctacagaacttcgccggcccatcgtgggactgcgtgctgcaaggagccctctccaccttcgccaataccagcagcttcttttggactgttgcgattgctctctatctttatctgagcattgtgcgagctgccagaggcccccggacggaccgcctgctgtgggccttccacgtggtgagctggggcgtccctctggtcatcacagtggccgcagtcgcacttaagaagatcggatatgatgcatccgacgtcagcgtgggctggtgctggatcgacctcgaggccaaagatcatgtgttgtggatgttattaaccgggaagctgtgggagatgctcgcatacgtcttacttcccctcttatatcttctcgtaaggaagcacatcaacagagcaggaatcggtaataccttccagggaggggcaaattgtattatgttcgtgctgtgtacccgcgccgtgcggacgagactatttagcctgtgctgctgctgttgctcctcccagccccctactaaaagccctgcaggcacacccaaggctcctgctccatccaagcctggagagtcccaggagagccagggcacccccggcgaactcccctccacatag

SEQ ID NO: 26510 - DNA, 3648 bp, Artificial Sequence
  Description of Artificial Sequence: Synthetic coding sequence
atgggcgccatggcttaccctttgctgttatgcctgttattggcccagttgggcctgggcgctgtgggggcatctagggaccctcagggaagacccgattccccccgagagcgcacgcctaaaggtaagccacacgcccagcagccgggcagggctagtgctagcgattcttccgccccctggtcccggtccacggacggcacaattctggcccagaaacttgccgaagaggttcccatggacgtcgccagttatctctataccggcgactcgcaccagttaaaacgtgcgaactgctcaggccggtatgagctggccggcttacctggaaaatggccagcgttggcctccgctcatccaagcttacacagagcactcgacacgctcacgcacgcgacaaattttctaaacgtgatgttgcagtcaaacaagtctagggagcagaacctccaggacgatctggattggtatcaggctcttgtgtggtctttgttggagggtgaaccatcaatctcacgagccgccattaccttttccacggactcactgagcgctccagcgcctcaagtttttttgcaggctactcgcgaagagtcaagaattctcctgcaagatttaagttcaagcgctccgcacctggcaaatgccacactggagacagaatggtttcacgggctacggcgcaaatggagaccacatctccatcgccggggccccaaccagggccctcgcgggctcggtcactcctggcggcgaaaagacggtctgggtggggacaagagccacttcaaatggtctcccccatacctggaatgtgaaaacggttcctacaaaccaggttggctggttactttaagcagtgccatctatggacttcagcctaaccttgtccctgagttcaggggcgtcatgaaggtggacattaacctacagaaggtggacatcgatcagtgctcctctgacggctggttttccggtacacacaagtgccatctaaataatagcgaatgcatgcccatcaagggcctgggttttgtcctcggtgcctatgagtgcatttgtaaggctggtttttaccaccccggcgttctgccagtgaataactttagacgccggggccccgaccaacatatctcaggtagcaccaaagatgtcagcgaagaggcatacgtctgcctgccctgtcgggagggctgtccgttctgtgcggatgactcaccctgtttcgtccaggaagacaagtatctccgcttagctatcatcagcttccaagcgctctgcatgcttctcgatttcgtctcaatgctggtggtttaccattttagaaaggctaagagcataagagctagtggactgatcctcttggaaactattttattcggcagcctcctgctctattttcctgttgtaatattgtactttgagccttcaacctttcggtgtatcttgctgagatgggctcggctactgggctttgccactgtgtatggtactgtgaccctgaagcttcatcgagtgttgaaggtatttctgagcagaactgctcagagaattccatatatgacaggcgggcgcgtcatgcgaatgctagccgttattttgctagtagttttttggtttctgataggttggacctcctctgtgtgccagaacctggagaaacagatcagtctgatcgggcagggaaagaccagcgaccatctgatctttaatatgtgcctgattgatcgttgggattacatgactgccgtcgctgaattcctgttcctcttgtggggtgtgtacttatgctacgccgtgaggactgtgccatccgcatttcatgagcctaggtatatggctgtggctgtccacaatgagcttattatcagcgccatcttccatacaattcggttcgtgctggccagcaggctgcagagcgattggatgctcatgctctattttgctcacacccacctaaccgtgaccgttacaattggtctcctgttaatccctaagttcagccattctagcaacaaccctagagatgacatcgcgaccgaggcttacgaagacgagcttgacatgggaagatcagggtcgtacctgaactccagcataaatagcgcgtggagcgaacacagccttgacccagaagatattcgggatgagttgaagaaactttacgctcagctcgaaatctacaagcgtaagaagatgatcaccaacaatcctcacctacagaagaagagatgctccaagaaggggctcggacggtcgatcatgagaagaataaccgagatcccagaaaccgtgtccagacaatgctccaaagaggacaaggagggagcagaccatggaaccgcaaagggtacagctctcatacgaaaaaacccccccgaatcctctggcaataccggcaaaagcaaggaagagaccctgaagaacagagtttttagcctgaagaaatcacactcgacctacgaccacgtgagagaccaaacagaggagagttcctcactgcccaccgagagtcaggaagaggaaacaactgaaaattcaacactggagtccctgagcgggaaaaagcttacgcagaagctgaaggaagacagcgaagcagaaagcaccgagagcgtcccccttgtatgtaaaagtgcctcggcacacaacctctcctccgagaagaagaccggtcacccccgtacatcaatgcttcaaaagtccctgagtgtgatcgccagtgccaaggaaaaaacactgggcctggccggcaagactcaaacagccggcgtggaagagcgcaccaagtcccagaagcccttacctaaggacaaggagacgaataggaaccattcaaattccgacaacaccgaaaccaaggatcccgccccgcagaactctaatcctgctgaagagcctcgaaagcctcagaaatccggcattatgaaacagcagcgcgtgaaccccactacagcaaactcggacttgaaccccggcacgacccagatgaaagacaatttcgacatcggggaggtgtgtccttgggaagtctacgatctgacacctggacccgtgcccagcgaatccaaggtgcagaaacatgtgtcaatcgtcgccagcgaaatggagaaaaaccccaccttctctctgaaggagaagtcccaccataaacctaaggctgcggaagtttgccaacaatcaaaccagaagagaatcgataaggccgaggtctgcttgtgggaaagtcagggccaatctatactggaagatgagaaacttctgattagtaaaacgcccgtcttaccagaacgcgcgaaggaagagaatggcgggcaaccacgagccgccaatgtatgcgctggacagagcgaagagctccctccgaaggccgtggcgtcaaagacagagaacgaaaaccttaaccagatagggcaccaagaaaaaaagacctcttcttccgaggaaaacgtgcgcggttcgtacaattccagcaataatttccagcagccactgaccagccgtgcggaggtgtgcccatgggagtttgagactccagctcagccaaacgctggacggtctgtggcactgccagcatctagtgcccttagtgctaacaaaattgctggaccgcgcaaggaagaaatttgggattcgtttaaagtgtag

SEQ ID NO: 26511 - DNA, 1017 bp, Artificial Sequence
  Description of Artificial Sequence: Synthetic coding sequence
atgacggccctgagctcagagaattgtagttttcaataccagctgaggcagacaaaccagcccctggacgtgaactacttgctgtttctcattatactgggtaagattcttctcaacattctgaccctcggcatgcggcgcaagaacacatgccagaattttatggagtacttctgcattagtttagcgttcgttgatttgctactgctggtgaacatttccatcattctgtactttcgcgacttcgttctgcttagtatacggtttaccaaataccacatctgcctgttcacgcagattatctcttttacctatggattcttgcactatccggtatttctgactgcttgcattgactactgtcttaacttctctaaaacaaccaaacttagttttaagtgtcaaaagctgttttacttcttcactgtcatcctcatctggatttccgtgctggcatacgtactcggcgaccctgccatctaccagagtctgaaagcccagaacgcatacagtagacactgtcccttctatgtctcaattcagtcatactggttgagtttcttcatggtgatgatcctgtttgtggcattcattacctgctgggaggaggtgaccacactggtacaggccatccgcattacatcatatatgaatgagacaatcctctactttcccttttcaagccattctagttatacggttcgatctaaaaagatatttctgtccaagcttatcgtttgtttcctgtcaacctggcttccttttgtattgctccaggtgataatcgtgttactaaaggtgcaaattccagcatatattgaaatgaatattccgtggctgtacttcgttaacagcttcttgattgcgaccgtctactggtttaattgtcacaagctcaatctgaaagacattgggctcccactcgatccctttgtgaattggaagtgttgtttcattcctctgactattccaaacttagagcagatcgaaaaacctatttcgatcatgatttgctag

SEQ ID NO: 26512 - DNA, 432 bp, Artificial Sequence
  Description of Artificial Sequence: Synthetic coding sequence
atgacagccctatcatcagaaaactgttcctttcaatatcagctaaggcagacaaaccaaccacttgatgttaactatctgctattcctgattatcctcgggaaaatactgctgaacattttgactctggggatgcgccggaagaatacttgtcagaattttatggagtacttttgtatctctctggcttttgtggacctactgcttctggttaacatttcaatcatattatattttcgggattttgtcctattaagcatacggttcaccaaataccatatctgcctttttacgcagataattagcttcacttatggcttcttgcattatcctgttttccttacagcgtgcattgactattgcttaaacttcagtaagactacaaagctgtcgtttaagtgtcagaagctcttctacttttttaccgtttag

SEQ ID NO: 26513 - DNA, 267 bp, Artificial Sequence
  Description of Artificial Sequence: Synthetic coding sequence
atgacagctctgagcagcgaaaattgttccttccagtaccagttgcgccagactaaccagccactcgatgtgaactacctcctgttcctgataatcctcggtaagatcctcttaaacattcttacattgggaatgcggcgtaaaaatacctgtcagaactttatggaatatttctgcatcagcctggccttcgtcgatcttcttctgcttgtgaatatctcaattatcttgtattttcgtgacttcgtgctgctcagcatccgctag

SEQ ID NO: 26514 - DNA, 102 bp, Artificial Sequence
  Description of Artificial Sequence: Synthetic coding sequence
atgacagcactgtcctctgagaactgcagcttccagtaccaactcagacagacaaaccagccactggacgtcaactacttgcttttcctgatcatactgtag

SEQ ID NO: 26515 - DNA, 1767 bp, Artificial Sequence
  Description of Artificial Sequence: Synthetic coding sequence
atggccaggggcggcgcaggcgccgaggaagcatcactgcgctcaaacgctctgtcgtggcttgcctgtggtctgctagctctgcttgctaacgcatggattatcttgtccattagcgccaagcagcagaagcataagccactggaactgcttctctgctttcttgctgggacccacatactgatggctgccgtgcctctgactacgtttgcagtggtgcagcttcgcaggcaggctagcagtgactacgactggaatgagtcaatctgcaaagtatttgttagcacctattacacgctagccctggcaacctgttttacagtcgccagcctcagctaccatcgaatgtggatggtccgatggcccgtgaattatagactgagcaacgctaaaaaacaggcgttacacgctgtgatggggatctggatggttagcttcatattgagcacacttccttccattgggtggcataataacggcgagaggtattatgctaggggatgtcaattcatcgtgagcaaaatcgggcttggctttggggtgtgtttcagccttttgctgcttgggggaattgttatggggctagtgtgcgtggccataaccttctatcaaacactttgggcacggcctaggagagcccgccaggcccggcgcgttggtgggggcggaggaacaaaggctggggggccgggagccctcggaacccggcctgctttcgaagtccccgcaatagtcgttgaggatgcccgcgggaagcggcggtccagcttagatgggagtgagtcggccaagacctcacttcaagttacaaacttagtgtcggcgatcgtcttcttgtacgactccctcactggagtgccgattctggtcgtaagcttcttttcattgaagagcgattcggctccgccctggatggtgctggctgtgctctggtgttccatggcacagactctacttctcccatcattcatctggagttgtgaaaggtaccgagccgacgtgcgtacagtgtgggaacagtgtgtcgccattatgtctgaggaggacggcgacgacgacggaggctgcgatgactacgcagagggacgagtgtgtaaggtccggttcgacgcaaacggcgctacaggtcccgggtcacgcgaccctgcccaggtcaagctgctccccggccgacacatgttatttccaccattggagcgggtgcactacctccaggtccctctctccaggagattatctcatgacgaaactaatatttttagtacaccacgggaacctgggagtttcttacacaagtggagctcctcagacgacattcgcgttctgcctgcgcagtccagagccctgggaggccctcctgagtacctaggtcagcggcatcggctggaggacgaagaggacgaagaagaagctgaggggggtgggctcgccagcctccgccagttcctggaatccggtgtcctgggctctggaggcggacccccaagggggcctgggttctttcgggaggagatcaccactttcatcgacgagaccccgctgccttctcctactgcatcccctggccactcgccgagacgaccaagaccactgggcctcagccctagaagactttccctgggcagccctgaatccagggctgtgggactcccactgggactatccgccggacgacgctgcagccttactggaggagaggaaagcgccagagcttggggtgggagctggggcccagggaatcccatcttcccacagctcaccctgtag

SEQ ID NO: 26516 - DNA, 915 bp, Artificial Sequence
  Description of Artificial Sequence: Synthetic coding sequence
atgcttagcaccggcgtggtgagtttcttttcattgaagtctgatagcgctccaccgtggatggtgctggccgtgttgtggtgctctatggcgcagactctcctgctgccctcctttatctggagctgtgaaaggtatagagcggacgtgcgcaccgtatgggagcaatgtgttgcaataatgtccgaggaagatggcgacgatgatgggggatgcgacgactatgcagaagggagggtctgcaaagtgcgctttgacgccaacggtgcaaccggacctgggagcagggatccagctcaagtaaagctgctgccaggccgtcatatgttgttcccccccctcgagcgggtacactatctccaggtgcccctgtctcggaggcttagccacgatgagactaacatattctccacccctcgggagccaggtagttttctgcataaatggtcttcttcagacgacattagggttctgccagctcagtcccgggccctggggggaccaccggaatacctggggcaacgccaccggctagaggatgaagaggacgaagaagaggccgaaggtggtggccttgctagcctgagacagtttctggagagcggagtgctgggcagcggcggcggccccccacgcggccctgggtttttcagagaggaaattaccaccttcattgatgagacccccctgccgagccctaccgcctccccagggcactcaccccgaagaccgcgaccactaggcttatcaccccgtagactgtctctcgggtctcctgagtctagagctgtcggcctgcccttgggcctgagtgcaggaaggcgttgcagcctgactgggggcgaagaatcggcacgggcctggggagggagctggggaccaggaaatcccatttttccccagctgactctctag

SEQ ID NO: 26517 - DNA, 960 bp, Artificial Sequence
  Description of Artificial Sequence: Synthetic coding sequence
atgacaaacagcagcttcttctgtccagtgtataaagacctggagccctttacctattttttctatcttgtattcctggtgggaataattggaagctgttttgcaacatgggcattcattcagaagaacaccaatcaccggtgcgtatcaatatatctgatcaacttgctcaccgctgatttcctgctgaccctggccttgccggtgaaaatagtcgtggacctgggggtggcaccctggaagctaaagatttttcactgtcaggtgacggcctgtttgatctatattaatatgtacttgagcatcatcttcttagcatttgtttccattgacagatgcctgcagctgacacactcttgcaaaatctaccgaattcaggaacccggctttgccaagatgatttccacagttgtgtggctcatggtactgctgattatggtcccaaatatgatgattcccatcaaagacatcaaagaaaagtcaaacgttggctgtatggaattcaaaaaagagttcgggagaaattggcatttgctgaccaattttatttgcgttgcaattttcctaaacttcagcgccatcatcctcatttctaattgcctggttattcgccagctgtacaggaataaagacaacgagaattaccctaacgttaaaaaagcccttatcaacatcctcttagtcacgacagggtatattatctgcttcgttccataccatatcgtgcggatcccatatactctctcacagaccgaagttatcaccgactgttcaacaaggattagcctctttaaggctaaggaagccactctccttcttgcagtgagcaatttatgttttgatcctatcttgtattaccatttgtcaaaggcatttaggagtaaagtgactgaaacattcgcctcgccaaaagaaactaaggctcagaaggaaaaactgagatgtgaaaataatgcgtag

SEQ ID NO: 26518 - DNA, 57 bp, Artificial Sequence
  Description of Artificial Sequence: Synthetic coding sequence
atgaccaactcatcgttcttttgtcccgtttacaaggaccttgaaccctttacctag

SEQ ID NO: 26519 - DNA, 1122 bp, Artificial Sequence
  Description of Artificial Sequence: Synthetic coding sequence
atggccaatactaccggagagccagaagaagtctccggcgctctgtcccccccctcagcctctgcttacgtgaaactggttttgcttggactgataatgtgcgtttcgctcgccgggaacgctatactgagtttattggtactgaaggagcgcgcactgcacaaggcgccatactacttcttacttgatctttgtctcgctgacggcatccgatccgcagtctgcttcccatttgttctcgcgtccgttagacacgggtcttcatggacattcagtgccctatcatgtaaaatcgttgcctttatggcggtgttgttctgcttccacgccgccttcatgctgttttgcatttctgtgaccaggtacatggctatcgcacaccacaggttctatgcaaaaaggatgactctttggacttgcgctgccgtgatctgcatggcatggacattaagcgtggcaatggcttttccacccgtgtttgacgtcgggacgtataagttcatcagagaggaggatcagtgcatcttcgaacaccggtactttaaagctaacgatacgctaggattcatgctgatgttagcagtcctgatggccgccacacatgcagtttatggcaaactgctgttattcgaataccgacaccgtaaaatgaaaccagtacagatggtgcccgcaattagccagaattggacgttccacggtccaggcgcgacaggccaggccgccgctaattggatcgcgggtttcggcagaggcccaatgccacctacccttcttgggattcgccagaatggacatgccgcttctcgccggttactagggatggacgaggtcaagggagagaagcagctgggccgcatgttctacgccataaccctactgtttctgttattgtggtccccgtacatagtggcttgttactggcgtgtcttcgtgaaagcctgcgcagtgccccatcggtacctcgctactgccgtctggatgagcttcgcccaggccgcagtgaatcccatcgtctgctttctgttgaacaaggacctaaagaagtgtctccggacacacgccccgtgttggggaactggcggagccccagcaccacgcgagccgtattgtgtcatgtag

SEQ ID NO: 26520 - DNA, 159 bp, Artificial Sequence
  Description of Artificial Sequence: Synthetic coding sequence
atggcgaacactacaggcgagccagaggaagtgagtggcgccctctctcccccttccgcatctgcatacgttaaactggtcctcctgggcctcataatgtgcgtcagcctcgcgggaaacgccattctctctctgctagtgctgaaagagagggcctag

SEQ ID NO: 26521 - DNA, 1002 bp, Artificial Sequence
  Description of Artificial Sequence: Synthetic coding sequence
atgcctgccaactacacctgtacacgccccgacggggataacaccgattttagatatttcatttacgcagtcacctatactgtaatactggttcctggcctgatcggcaacattcttgcactgtgggttttttacgggtatatgaaagagactaagcgcgcagttatatttatgatcaatctggccatagcggacctccttcaggtcctttccctgcctctgaggattttctactacttgaaccatgattggccatttggcccagggctgtgcatgttttgcttctacctgaagtacgtgaatatgtatgccagcatttattttctcgtatgtatttcagtgcgaagattttggttcctgatgtaccccttccgtttccatgactgtaaacagaaatatgacctatacatttctattgccgggtggcttattatttgtcttgcgtgcgtgctgttccctctgttgcgcaccagtgatgacacctccggaaatcgaactaaatgcttcgtcgatctgcctactcgcaatgtaaacttagcacagtccgttgttatgatgactattggggaacttattggcttcgtgacaccactcctgattgttctgtattgcacatggaagacagtgctatccctgcaggacaagtaccccatggctcaggacctcggcgagaaacagaaggccctcaagatgatcctgacctgcgctggcgtcttcttgatctgcttcgctccttatcattttagcttccccttggactttctggttaaatccaacgaaatcaaaagctgtctcgctcggcgcgtgatcctgattttccacagcgtagcactctgcctagcaagtctcaattcttgtttagacccagtcatctactactttagtacaaatgagtttcgacgccgcttatcacgacaggaccttcacgattctatccaactgcatgcaaagagcttcgtgagtaaccatacggcttcaacgatgacgcccgagctctgttag

SEQ ID NO: 26522 - DNA, 7104 bp, Artificial Sequence
  Description of Artificial Sequence: Synthetic coding sequence
atgggaacacgaggggccgttatgccgccacctatgtggggcctgctgggttgctgttttgtttgtgcatgggccctcggtggccctaggcccattcgctctcttcccccactgagctctcaggtgaaaccgggcagcgtacccatgcaggtgccgctggagggggccgaggctgccttagcctacctctactccggcgatgcccaacagctgagccaagtgaattgctcggagcggtacgaggccagaggtgcaggggcaatgccaggactcccccctagtcttcagggtgcagctggaactctggcccaggccgcaaattttctcaatatgctactccaggccaatgatattcgagaaagttcagtcgaggaagatgttgaatggtatcaggcattggtgaggtccgttgccgagggtgatccaagagtgtatagagcattgctcacatttaatccacctccaggggcttcacatctccagctggcattgcaggccacgcggaccggagaagagacaatcctgcaggacctgtctggaaactgggttcaggaagaaaacccgcctggtgatttggacacacccgccctgaaaaaacgcgttctcaccaacgatctgggctccctcgggtccccaaagtggcctcaggcagatggatacgtgggcgacacccaacaggtgcgactgagccctccgttccttgaatgtcaagaaggacgtttgaggcctgggtggctgatcacactctcggccacattctacggcctgaagcctgatctatcccctgaggtgcgcggacaggtccagatggatgttgacctgcagagcgtggacattaaccagtgcgccagcggcccagggtggtacagtaacacacacttgtgtgacctcaatagcacacaatgtgtacctctggagtcgcagggcttcgtgcttggacgctatttatgccgttgccgccccggcttctatggtgctagcccgtcaggcggtttggaggaaagtgacttccagaccacagggcaatttggattccctgaggggaggagcgggcggctgctgcagtgtttgccttgccccgaaggttgcacaagttgcatggatgccacaccttgtttggtggaggaagctgctgttctgcgcgctgccgtcttagcttgccaggcatgctgcatgctcgccatcttcctgtcgatgctcgtctcataccgctgccggcggaacaaaaggatctgggcatctggtgtcgtgctgctcgagacagtcctttttggatttctattattatatttccccgtatttatcctgtattttaagcctagcgtttttcgttgtatcgcattacggtgggttagactcttgggttttgccattgtttacggaactatcattttgaaactgtaccgggttctgcagctcttcctgagccgcacggctcagaggtctgccctgctctccagtggccgactccttcgccgcttgggcctcctgttactgcccgtcctgggatttctggctgtgtggactgtgggggccctggagagaggaattcagcacgcgcctttggtcattcgggggcataccccgtccggacgacacttctacttatgtcatcacgatagatgggattatattatggtggtggccgaactgttgctgctctgctggggttcatttctctgctatgccacccgggccgtcttatcagcctttcatgaaccacgctacatgggaatcgcactgcacaatgaattgctgctctccgccgccttccatacagcccggttcgtcttagtgccatctctacaccctgattggaccctcctgttgtttttttttcacacacatagcacagtcacaacgaccttggccctgatcttcattccaaaattttggaaactgggagcccctccacgagaagagatggtggatgaggtatgcgaagatgaacttgaccttcagcattcaggttcgtacctgggttcctctattgcgagcgcgtggtcagagcattctttagaccccggcgatataagagatgaattgaagaaactgtacgcccaactggaagtccacaagactaaagaaatggctgctaataatccccacctacccaaaaagaggggctcatcctgccaggggctgggacggtccttcatgcgttatttagccgaatttcccgaagcactggcaaggcagcattcaagggactcagggtcccctgggcacggaagcctgccagggagctctaggaggcgcctcctttcaagtagtctgcaggaaccggaaggaacaccagctcttcacaagtcaagatctacctacgatcaaaggagggaacaggacccccccctactcgattccttgttaaggcggaagctcgctaagaaagccagcaggactgagagccgcgagagtgttgagggtccaccggccctaggctttagaagtgcaagtgctcacaatctgaccgtcggagagaggctcccaagggcacgtccagcctctttgcaaaaaagtcttagtgtagccagcagcagagagaaggccttgctgatggccagccaggcgtacctggaggagacttatcgccaggccaaggaacgcgaggagagaaaaaaagctaaagcagcaatggcctctttagtgcggcgaccctcagcccggcgcctggagcggcctcgaggcgctcctctgtcggcgcctccctcaccggctaaaagtagttctgttgacagctcccacacgtcggggaggttgcacgaagaggcccgccgacggttaccccacccccccatcagacatcaagtatctacaccaatcctcgcgctgtctgggggccttggggagccccggatgctcagtccaacctctacacttgcccctgccctactgccagccctcgctccgactcccgccccagccctggcccccgtgcctgtcagtccccagagtcccaacttgcttacctacatatgcccttgggagaatgccgaattaccagccaaacaggagaacgtgccccaggagggcccgagtggtcctgagcgaggtcatcattccccagccccagcacgtgctcggttgtggagagccctctccgtagcagtcgagaagagcagagccggtgagaatgagatggacgccgaggatgctcaccaccagagggaagccaatgatgtggacgaagatcgacccaagatctttcctaaatctcactcgctaaaagccccggttcagcaaggatccatgaggtccctggggctggccataaaggcattgacccgtagccgctctacttacagagagaaagagtcggtggaagagagtcctgagggccaaaactcaggaacggcaggtgagtcaatgggagctccatcccgaagccctcgattgggtagaccaaaagccgtctccaagcaggctgctctgatcccctccgacgataaagagtcccttcagaaccagcagaatgcccatacttcaaggatgttacaggtgtgccagagggagggctcacgtgagcaagaggatagaggccggcggatgacccagggtcttggggaaagaaaggctgaaagagctggaaagactggtttggccatgcttagacaagtgtcgcgggacaaaaatattaaacagagcaaagaaacgccagttggatggcaggagctacccaaagcaggcctccaaagcctgggatctgctgaccatcgcgtggctgaggtctgcccttgggaggtcaccgagtccgaaacccgccaaccggacagcggcaacaaggcggaaatctgcccttgggaaacatctgagggtgcacccgagtcccgggctctgcgtcaagacccgggtgattctcaaaagaaaaggggggaagcccgggggaaaagcgagccaatcgatgtggtgcccatgatgagaaagaagccagaacgcctggttcgggaacaggaagccgtgtgcccctgggaatcagcagatcgaggagggcttagtccaggaagcgctccgcaagacccaggacgtattagagataagtcagaagctggcgactccgtcgaggcaaggaaggtagaaaagcctggttgggaggcagcaggaccagaggcccacacgcccgatattaccaaagctgagccttgcccctgggaagcttcagaaggcggagaggatggaaagcctgcccaagaggcagtgaaagatctgcctcaggagaaacagaagacaaggaaggcaacattctggaaggagcagaagcccggtggcgacctggaatctctctgcccctgggagagcacggatttcaggggaccgtcagcagtttcaatccaggctcctggctccagcgaatgttctggctctctgggcagtggaatagctgaagtgtgcctgtgggaagccggcgatgccccagccatccagaaagccgaaatctgcccttgggagctcgatgataatgtgatggggcaggaaatgctaagcctgggaacaggtcgggaatcactccaggaaaaggagaaggctagccggaagggatccttcggagagatgggagaacagacggttaaggcagtgcagaagctctcccagcaacaggagagcgtgtgccctcgggagagtacagtgcccgggcacagctcaccctgcctggacaactcctcctccaaagctggatctcagttcttatgcaacggtgggtctagggccacacaagtgtgccctcaagaggaccttcggcccgaagctcaggaagccacgcccgcaaagacagagatatgtccatgggaggttaatgagagaactcgggaggaatggacatccgcacaggttccccgtggaggggagagccaaaaggacaaagaaaagatgcccggaaagtcggaaatcgaagatgtgactgcatgggagaaaccggaggggcaaattcagaagcaggaggcagttggaccgtgggagtcagtcgaccctggatctttcagcccccaaccgaggccccaggatacagagcggcctcagactttgctccagatgagcggcagtgtcggctccaaagctgccgatatctgtcctcttgatgtggaggaaaacctgacagcaggaaaggcggaaatttgtccatgggaagtcggtgccggcgctggcgaggaaagagccttaggagcggaggctatccgcaagagtcccaatgacactggtaaagtgagtgccgacctgggccctcgggagagggccgtgacagccccggaaaaacctcagaaacctacccccgagtgggaggtcgcgtgtccctggggatctgtcggtccaggagcctgttcccaacatcctggtacacttgatgccgacgggcctaaggcaggcttccaagaactagaccacatggggtgccgaccaggagaggtttgcccttgggaagcccaggaggccgctacgtccgagaaggctaaaatctgcccgtgggaagtctccgaaggaaccacgggaaagggcttggatcagaaagccggctctgaatcggccgagcaacgggaaaaagcccttgagaagggccggttgacctcattgggcgaagacgtgagcaaggggatggcaaaactctgtcagcagcaagagactatctgcatctgggaaaataaggatctccgcgaatccccagcacaggctcctaaaattagtgacctcccatcaagtatgagctctgaagtcgccgagggacatagtcttgaggctaccgaaaaaggagatctcaggcaagaccctaaaacaggatcattcccggagcacattacccaggagaaagccccagcagcagacacggaggagttcactacagaggacggggagaaaacttcacacgagttgcagtcagtctgcccgtgggaaactacagcgcctgccgactcagtgtcacatctagatcgtcagcgcccggatcaaccaaaggcatcgagccagcggcttgtctcaacgggggggcgcgcagcagatgtctgtccttgggatgtgcccgatgccggggtgtataagtcggactcctccgcaaaggccgagacatgcccttgggaggtcactgaacgtatcccggtgaagggagtgagccggcaggacgggaaaggggacagccaggaggaaaaggggcgcgctcctgaaaagtcagaacctaaaggggtcccggtgcaaaagaaacccgaaatggccgacttcaggcagcaggaggctgtgtgcccatgggaaagtcaggacggtaagggtctcagccctcaaccagcccccgatgctagcgacagatctaggggtagtagtgaggctgctgggtcagtggaaacaagagtggcagaggtttgcctgtgggaagtagtcgaggccccaagcgctaaaaaagccgagatttgtccatgggaggctggggggggcgcagcggaggagggagaacaggagagggagagtcaggggcagggagaaatgttcctccagaaagccggccccggaggtaccgaggagcatttctcaaaagctgcagccaaaccaagagaacaggaggctgtgtgtcccggagagggtacaggctccggcggcctgctcccccagtcaggagccttggatccagagctgaaggtaagcccaaaagaggcaggaagcatgggatcaagaatggctgagctttgtcaatgggagattactgacccggaaggtaataagatcaagggtacgatggctgacatctgcccaggtgaggagacaggggtgccttccgaagagtctggattacttgcactgacagctacaagaagagagttcttccctacagcaccagagaaacccctctgcctactcgtacacgggcccctagaccacttctttcctgaatccaaaattccctgccccaaggtgagccgtcccgccagtaccttcacccttgaaggcgttcgtgagcttcaaggacccagcggtttagagccacgcacctcgctggcaccagagccttcgctgcaggaagcggagagccagagttctagcctgactgaagactcaggacaggttgcattcgaagctcagtacgaggagtttacaccccctacagtgtatccttgggattgggagtag

SEQ ID NO: 26523 - DNA, 1323 bp, Artificial Sequence
  Description of Artificial Sequence: Synthetic coding sequence
atgggggggttgaggctactggcagtggccctgacctgctgctggtggccacagggcagccaggggaaaacactgcggggtagtttcagcagtaccgccgctcaggatgcccaaggtcagcgtatcggacactttgaattccacggcgatcatgcactgttgtgtgtccgaatcaacaatattgctgttgcggtcggcaaggaggcgaaattatatttgtttcaggcacaggagtggttgaaactgcagcagagctcacatggatatagttgcagcgagaagctgagcaaggcacaactgactatgacaatgaatcagactgaacataacctaacagtaagccagattccgagcccacagacctggcatgttttttacgcggataagtatacgtgccaggatgacaaagaaaactcccaagttgaggacattccctttgagatggtgcttctgaatcccgatgccgagggtaacccctttgaccacttcagcgcaggtgaatctggactgcacgaattctttttcttgctggtgctggtctacttcgttatcgcctgcatctacgcccagtctctctggcaagcgatcaaaaagggcgggcctatgcatatgatactcaaggtgttaacaacagctctgctgttgcaggcagggtctgcgctggccaactacatacacttcagctcctactcaaaggacgggattggggttcctttcatgggcagcttggccgaatttttcgacattgccagccagattcaaatgttatacctgctgttgagtttatgtatgggctggactatcgtgcggatgaagaaatcccagagtaggcccctccagtgggattccacccccgccagcacaggcatagctgtatttatcgttatgactcagagcgtcctgctgctgtgggagcagtttgaggacatctcccatcactcatatcactcacatcataacctcgccggtatcctgctgattgtgctacgaatttgcctggcactcagcctcggatgcggtctctaccagataatcaccgtggaacgcagcactcttaaacgcgagttttacatcacctttgcgaagggttgcatcctctggtttctgtgccacccagtgctcgcctgcatatctgtgatatttagcgactaccagcgcgataaggttattactatcggtgtcattctctgtcagtcagtgtcgatggtcattctgtaccgactgtttctttctcattcactttactgggaagtgagctccctgagcagtgtaacactgccactcacaatatcctctgggcacaagagccgacctcatttctag

SEQ ID NO: 26524 - DNA, 1215 bp, Artificial Sequence
  Description of Artificial Sequence: Synthetic coding sequence
atgagtgtcaagccttcctggggccctggaccatctgagggtgtgacagcggtccccacatctgacctgggggaaattcataattggacagagctcttggacttgtttaaccatacacttagtgaatgtcatgtggagctgtctcagtctactaagagggtcgtgttattcgctctatatctggcaatgttcgtggtcggcctcgttgagaacctcttggtgatttgtgtgaactggcgtgggtccggcagagcaggtttaatgaacctctatattcttaacatggccatagctgatctcggtattgtcttgagccttcctgtgtggatgctggaagtgacgctcgattacacctggctgtggggaagcttctcctgcagattcacacactatttctatttcgttaatatgtactcaagcatattttttttggtctgtctgtctgttgacagatatgtaacactgactagcgcttcaccctcatggcagaggtatcagcacagggttaggagggccatgtgcgctggaatctgggtgctgagcgcaatcatccctttgcccgaggtggttcacatccagctggtggagggtcccgaacctatgtgcctattcatggcgcccttcgagacctacagcacctgggctctagcagtggccctttctacaactatcttggggtttctcctgccctttcccctgatcaccgtcttcaatgtactcaccgcttgccgcctgcgccagcccggtcagcctaaatcgcggcgacattgcctgcttctgtgcgcctatgtggcagtctttgtcatgtgttggctgccataccatgtgactctgttgctgctcacattgcatggcactcacattagcctccattgtcatctcgttcatctcctgtattttttttacgacgtcattgattgtttctcaatgctacactgtgttattaatccgattctgtacaattttctgagcccacattttaggggtcgccttcttaatgccgtggttcattacttacccaaagaccagactaaagccggcacctgcgcatccagctcctcttgctcaacccaacactctatcattatcactaagggcgattcacaaccagccgctgcagcccctcacccagagccttcccttagtttccaggcacaccacttgttgccaaacacctcccccatcagtcccactcagcccctcacaccttcatag

SEQ ID NO: 26525 - DNA, 1446 bp, Artificial Sequence
  Description of Artificial Sequence: Synthetic coding sequence
atgcgctggctgtggccactcgccgtttccctggccgtcattctagccgtcggcctctcaagagtcagcggcggagctccactacatctgggccgccacagggctgaaacccaggaacaacagagccggtctaagagaggcacagaagatgaggaggccaaaggcgtgcagcagtacgttccagaagagtgggccgagtatccgagaccgattcaccccgccgggttgcagccaaccaaacctctggttgcaacctccccaaaccctggtaaggatggtggtacccctgactctgggcaagaattacggggcaacctgaccggtgcccccggccagaggttgcagattcagaacccattgtatcccgtgaccgaatcatcgtatagcgcatacgccattatgcttttagcgctggtcgtcttcgccgtgggcatagtcggtaacctgagcgtcatgtgtattgtgtggcacagctactacttgaagagcgcttggaatagtattctggcttccttggccctttgggattttctcgtcctgttcttctgcctgcccattgtgatctttaacgagatcaccaaacagcgcctcttgggggacgtaagctgtcgggccgtgccgttcatggaagtgtcaagccttggcgtgaccaccttcagcctgtgcgcgcttggaatcgatcgattccatgtcgccacttctaccctgcccaaagtgagacctatcgaaagatgccaatcgatcctggctaagctggctgtgatttgggtaggctcaatgaccttagcggtgccggagctgctcctttggcagcttgcccaggaacctgccccgactatggggacactggatagctgtatcatgaagccttccgcatctctgcccgaaagtttatattcactggttatgacctatcaaaatgcccgcatgtggtggtactttggatgctacttttgcctgccaatcttgtttactgtaacctgccagctggtaacgtggcgagtgcggggccccccaggcagaaaatcagaatgcagagcaagtaaacatgagcagtgtgaaagccagctgaattctaccgtcgttggactaacagtcgtatatgcgttctgtactctccccgagaacgtctgcaacatcgttgtggcctatctgtcaaccgaactgacgaggcagactttggatttgctgggtctgattaatcagttttcgaccttctttaagggggcaattacacccgtcctgcttctgtgtatctgtcggccccttggacaggcttttttggactgttgttgctgctgttgctgcgaagaatgtggcggcgcttcagaggcttccgctgccaacggctctgacaacaagctgaaaaccgaagtcagctcttctatctattttcacaagcccagagagagtcctcccctgctgcccctgggcaccccttgctag

SEQ ID NO: 26526 - DNA, 1047 bp, Artificial Sequence
  Description of Artificial Sequence: Synthetic coding sequence
atgctactcgccctggttgtgttcgctgttggcatcgtgggcaatctgtctgtcatgtgcatcgtttggcactcatattatttgaagtctgcgtggaattccattctagcctcacttgccctctgggacttcctggtgctgtttttttgcttaccgattgtgatttttaatgagatcactaagcaaaggttgctcggagacgtgtcctgcagagccgttccattcatggaggtcagcagcctgggcgtcaccacattttctctgtgtgccttgggtatcgataggttccacgtggccacgtccaccctgccgaaggtaagacccattgaacgttgccagtctatcctggcaaaactcgccgtgatctgggtgggtagtatgaccctggccgtcccagagttattattgtggcaactcgcccaggagcccgccccaaccatgggcaccctggacagttgcattatgaagccgtcagcatccctccctgagtcactctactccctggtgatgacttaccagaatgctagaatgtggtggtattttgggtgctacttttgcttgcccatcttgtttacagtcacctgtcagttagttacctggcgggtgagaggccctcctggacggaagagcgagtgtagagcctcaaaacatgagcagtgcgagtcacagcttaattccaccgtcgtgggactgaccgtggtttacgcattttgcacactccccgagaacgtttgcaacattgttgtggcatatttatcgaccgaactcacccgacagaccctcgatttgctgggactaatcaatcagttttccactttttttaagggtgctattaccccagtgcttttgttgtgcatctgcagacccttgggccaggcttttctggactgctgttgctgttgctgttgcgaggaatgcgggggtgccagtgaagccagcgcagccaatggatccgacaacaagctcaagactgaagtttcctccagcatttactttcacaagcctagagagtcgccaccacttctgccactgggaaccccttgttag

SEQ ID NO: 26527 - DNA, 1014 bp, Artificial Sequence
  Description of Artificial Sequence: Synthetic coding sequence
atgggcaatgattcagtgagctatgaatacggcgactactccgacctatcagacagacccgtggactgcctcgatggagcctgcctggctatcgacccactgagggtggctccgctgcctctctacgcagcaatcttcctcgttggcgttcccggaaacgccatggtggcctgggtcgcaggaaaagttgcccggcgcagggtcggagctacttggctgctccatctggctgtggccgacctcctttgctgtttgagtctgccgatactggcagtgcctatcgcccggggtggccattggccatacggagctgtaggctgcagagcactgccttcaataatccttctcactatgtacgcttccgtgctcctccttgctgctctcagcgctgacctctgcttcctcgcgctcggccctgcctggtggtcaaccgtgcagcgagcatgcggcgtccaagtggcatgcggggcagcttggacccttgccctgctactgaccgtgccatctgcaatctatcgacgattgcaccaggagcacttcccagccaggttacagtgcgtggtcgactatggcgggtcttctagcaccgaaaacgcggtgaccgccattcgctttcttttcggatttctgggtcccttggtggcagtggccagctgtcattccgccctcttgtgctgggccgcaaggaggtgcaggcccctgggcaccgcaattgtggtcggattcttcgtatgctgggccccatatcatctgctcggcttggtactgacagtggcggcacctaactccgctctgctcgcaagggctcttcgagctgaacccctgatagttggcttggccctggcccactcttgcttaaaccccatgctattcctgtatttcgggagggctcagctgcgacgctctttaccagcggcatgccattgggctctgagagagagtcagggccaggacgagtcagtagatagtaagaaatcaacaagccacgacctcgtctcggagatggaagtatag

SEQ ID NO: 26528 - DNA, 1014 bp, Artificial Sequence
  Description of Artificial Sequence: Synthetic coding sequence
atgggcaatgacagtgtgtcctatgaatacggggactactctgacctcagtgatcgtcccgtggattgcctcgatggggcctgcttagccatcgacccactgagggtcgctccgctacctctgtacgctgctatcttcttggtcggtgtgccaggcaacgctatggtagcatgggtagcaggtaaagtggccaggaggagggttggtgctacctggctattgcatttggccgtcgcagacctgctgtgctgcctatctctgccaatactggcggtaccaattgcccggggggggcattggccctatggcgccgtgggctgcagggccttgccaagcattattttactgaccatgtacgccagtgtcctgctgctcgctgcacttagtgctgacctttgtttcctggctctggggcccgcgtggtggtccacagttcaacgggcctgtggcgttcaggtcgcttgcggcgccgcctggactctcgcactgctgttgactgttccctccgccatctatagaaggctgcaccaagagcacttccctgctagactgcagtgtgtcgtcgattatggggggagctcttccacagagaacgcagtgacagctattaggtttctgttcggatttctggggcccctggtagccgtggcctcctgccacagcgcactgctctgttgggccgcaaggaggtgccgtccattaggtactgcaatagtagttgggttctttgtgtgttgggccccctaccacctgctagggctggtactgaccgtcgcagctcccaactccgcactcctagcgcgcgcgctgcgtgcagagccactgatcgttggcctagctcttgcacactcgtgcctgaatccaatgttattcctttatttcggaagagcccaactgaggaggtcgctgcctgctgcttgtcactgggcactgcgtgagtcccaaggccaggacgagtctgtggattcgaagaagtccactagccacgacctcgtgtccgaaatggaagtgtag

SEQ ID NO: 26529 - DNA, 1155 bp, Artificial Sequence
  Description of Artificial Sequence: Synthetic coding sequence
atgactaattccagtagcaccagcacttcctccactaccgggggatccttacttctgttgtgtgaggaagaggagtcttgggccggtagaagaatccctgtgagcttgctttacagcggactggctattgggggtacactggccaatggtatggtgatctatcttgtgtcatcctttaggaagttgcaaaccactagtaatgccttcattgtcaacggttgcgctgccgatctgtccgtgtgtgccttgtggatgccacaagaggcagtgcttggtctcctgcccaccggctcagcagagccccctgccgactgggacggcgctggtggcagttacaggctgcttaggggcggtctactcggtctgggcctgacggtctccctcctctcacactgtcttgttgccctgaataggtatcttctcattactagggcgcctgccacataccaggcgctgtaccagcggaggcacactgccggtatgctggccttgagttgggcattggcgttggggctggtacttcttctacccccttgggccccaagaccgggtgctgcacccccacgcgtccactaccctgccctgttggctgcagctgcactgctggcccagaccgccctgctccttcactgctacctcggaatcgtccgaagggttagagtcagtgtgaaacgcgtaagcgtgcttaacttccacctgctgcatcagttaccgggttgcgccgcggccgccgccgcgtttcccggggcccagcatgctcccggtcctggtggcgctgcccatcccgctcaggctcagcccctcccgcccgcccttcatccacggcgggcccaaaggcgcctgagcgggctaagtgtgctcctcttatgttgtgtgtttttgctcgcaacccaacctcttgtgtgggtgagcctcgcaagtggtttttctcttcccgttccatggggggtgcaggcagccagttggctcctctgttgcgccctgtcagccctgaatccattgctgtacacctggcggaatgaagagttccgccgtagcgtgagatccgtactccccggggtcggcgacgccgcggccgctgctgtagccgctaccgccgttccagcagtaagtcaagcccagctggggacccgagcagctgggcaacactggtag

SEQ ID NO: 26530 - DNA, 963 bp, Artificial Sequence
  Description of Artificial Sequence: Synthetic coding sequence
atgttcttaggcattttatccattgagcagcttatctcccgggttggagtaatcggggtgactctaatggctcttttgtccggttttggcgctgtaaattgtccatatacctatatgagctacttcctgagaaacgtgacagatactgatatacttgccctggagagacggctgctgcaaaccatggacatgatcattagcaaaaagaagcgcatggccatggctagaaggactatgtttcagaaaggcgaggtccacaacaagccttcaggcttctgggggatgattaagtcggtgaccacaagtgcttcaggctcagagaatttgaccctcatacagcaagaagtagatgccctggaggagctcagccgacagctcttccttgaaactgctgatctgtatgccacaaaggagcgcatcgagtattccaaaactttcaaggggaaatactttaattttctcggatacttcttctcaatatactgcgtctggaagattttcatggccacaattaatattgtgttcgaccgggttggaaagaccgatccagtgactcgggggatagagatcacagtaaactacctcggaattcagttcgacgttaaattttggagccaacatattagcttcattctcgtcggaatcattatcgttacttctattagggggttgctcatcacattaactaaatttttctatgccatcagctcctcaaaaagtagcaacgtgattgttctcctgctggcacagatcatgggtatgtacttcgtgtcgtctgtgctgctgatcagaatgagcatgcctctggagtatcgcaccattattaccgaagtgctgggtgaattgcagtttaacttctatcaccgatggttcgatgtgatctttctggtatcagctctttcctctatcctgtttttatacctggcccataagcaggccccggagaagcaaatggcaccctag

SEQ ID NO: 26531 - DNA, 1173 bp, Artificial Sequence
  Description of Artificial Sequence: Synthetic coding sequence
atgaccctgacctgtgtgttctgggacgtaacaaagggcaccacgggggactggtctagtgaggggtgttcaaccgaagttaggcccgaggggactgtgtgctgctgcgaccatcttacattttttgcccttctactcaggcccaccctagatcagagcacggtgcacattctcacccgaatctcgcaggcgggctgcggggtttccatgatatttcttgcgttcactatcattttgtatgcattcctaagacttagtcgcgagagattcaaaagcgaagacgcccctaaaatacacgtcgcactgggagggtcactttttctgttgaatctggctttcctagtgaacgtgggatctgggagtaaaggcagcgacgcggcatgctgggcaaggggcgcagttttccactacttcttgctgtgtgcttttacatggatgggcctcgaggcattccacctgtacttgctcgctgtaagagtgttcaacacttatttcgggcactacttcttaaagctctcgctggtggggtggggactccctgccctcatggtgattggtaccggcagcgccaactcttatggactgtatactattcgagacagggagaacaggacaagcttagaattgtgttggtttagagaggggactacaatgtacgccctttatatcaccgttcacggctattttcttattacctttctgttcggtatggtcgtgctggcacttgtggtgtggaagatttttaccctgagccgtgctaccgcagttaaggagcggggaaagaaccgcaagaaagtcctgaccctgctgggtttgtcatctcttgtcggcgtaacctggggccttgccattttcacgcctctgggtcttagcactgtttatatatttgccctgttcaactctctgcagggctcaagcgtagattgccaggccctcagcgcgggagagaagttgctgtccctgctgggactgccccagcaaccctggaaacttcgcgcagcagcacatctgcctgtacggatgctcggcgccgacgtggactgcaaatggatgcggtttgccagccctccgtcgccacaggctgtggagcgccaggaaggcggaccctccctctacgctcgccgatgcgtgccgggcagggagatactcggacggggccattgtattatctag

SEQ ID NO: 26532 - DNA, 1650 bp, Artificial Sequence
  Description of Artificial Sequence: Synthetic coding sequence
atggctaccccccggggactgggtgctcttcttctactcctgctactgccaacatccggacaagagaagcctaccgaaggtcctcgaaacacttgtcttggttccaacaatatgtacgacatcttcaacttgaacgataaggccctctgtttcaccaaatgccgacaaagcgggtccgacagctgtaacgttgagaacctgcagcgatactggctgaactacgaggcccacctcatgaaggagggcctgacccagaaggtcaacacacctttcctaaaggctctcgtccaaaacttaagcactaacacggctgaggacttttacttcagcctggaacctagccaagtccccagacaagtgatgaaagacgaggataagccccctgaccgagtcagactgcccaagtccctgttcagatcccttcccggaaataggagtgtggtgaggctggccgtcaccattcttgatataggacccggcaccctcttcaagggaccacgcctgggcctcggcgatggctctggcgttttaaacaaccgccttgttggcttgtctgttgggcagatgcacgtgactaagctggccgagcctcttgaaatcgtgtttagccatcagcggccaccacccaacatgacccttacttgtgtattttgggatgtgacgaaagggaccaccggagactggagctccgaggggtgttccaccgaagtaagacccgagggaactgtgtgttgctgtgatcacctgacttttttcgctctcctcctgcggcccaccctggaccagagtactgtccatattctgactagaattagccaagccggttgtggcgtatctatgatcttcctggccttcacaataatcctgtatgccttcctgcggcttagtagagagaggtttaaatcagaggacgcgcctaaaatccacgtcgcgctcggaggcagcttgttcctgctgaatttagcgtttttggtgaatgtgggatctggcagtaagggttcggacgcagcgtgttgggcacgcggggcagtattccactattttctgctgtgtgccttcacttggatgggtctggaggctttccatctgtacttgttagctgtgagagtgtttaacacatactttggccactatttcctcaagttgtccctggtcggatggggcctacctgcgctcatggtgattggaacgggatcagccaatagctacgggttatacacgatcagggacagggaaaatcgcactagcttggaactctgctggtttagagagggaacaaccatgtacgcactctatattacagtgcatggttacttcttaatcacatttttgttcggcatggtggttctggccttggtggtgtggaaaatctttaccctttcaagagccacggccgtgaaggaaaggggaaagaaccggaaaaaagtgctaaccctgcttggcctgtctagtttggtgggtgttacctgggggctagccatcttcacgcctttgggactttctacggtttacatcttcgcgctgttcaatagcctacagggtgttttcatctgttgttggttcacaatcctgtacctgccttcccaatccacaacagttagtagcagtactgcccggctggaccaggcccacagcgcttcgcaggagtag

SEQ ID NO: 26533 - DNA, 1290 bp, Artificial Sequence
  Description of Artificial Sequence: Synthetic coding sequence
atgaaggacgaagataaacctcctgacagagtcaggctccccaaaagcttgtttcggtcattaccagggaaccgtagcgtagtacgcctagctgtgactatactggatatcggcccaggcacgctgtttaaaggaccccgtctgggcctgggagacggcagtggcgtgctgaataaccgcttggtcggattgtcagtgggccaaatgcacgttacaaagcttgctgagccactggaaatcgtattttcccaccagaggcctccaccgaatatgacattgacttgcgtgttttgggatgtgaccaagggcacaaccggcgactggtcatccgaagggtgttctaccgaagtgcgacctgaggggaccgtctgttgttgcgatcatttgacattctttgcccttctgctgcggcctacgttggatcagtccacagtacacattttgactaggatcagccaggctggctgcggagtctccatgatattcttggccttcacaatcatcttgtatgcgttcttaagactctcaagagagcgtttcaagtccgaagatgccccaaaaatacacgtagccttgggtgggagcctctttctgttaaacctagcctttctcgtgaacgtcggctcgggctcaaagggatctgacgccgcctgttgggccaggggggctgtttttcactactttctgctgtgtgcctttacatggatgggactggaggcatttcacctgtacctgctggccgtgagggtgtttaacacctacttcgggcactatttcctcaagctgagtttggttgggtggggcctgcccgcattgatggtgattggaacaggctcagcgaattcatatggcctgtatactattagagatcgggaaaataggactagcctagagttgtgttggtttagggagggcaccaccatgtacgccctttacatcacagtgcatgggtatttccttatcacttttctattcggtatggtggtattggccttggtggtgtggaagatctttaccctgagcagggccactgctgtcaaggagcgcggcaaaaatcgtaagaaggtcctcacccttttgggcttaagctcattagtgggagtcacatggggcctagcaatttttacccccctgggtctgagtactgtttatatatttgctctcttcaactctcttcagggggtgtttatttgttgctggtttacaatactgtacctgcctagccagtcgacaacggtcagcagctctacagccagattagatcaggcccattcggcgagccaagagtag

SEQ ID NO: 26534 - DNA, 1074 bp, Artificial Sequence
  Description of Artificial Sequence: Synthetic coding sequence
atggccacaacggtgccagatggatgcagaaacgggctcaaaagtaagtattaccggctatgtgacaaggccgaggcttggggaattgtgctggagacagttgccactgctggcgtggtgacgtccgtcgcatttatgttgaccttaccaatcctggtgtgtaaagttcaagacagcaatagaaggaagatgcttcctacacagttcctcttcctgctgggcgtactaggcatcttcggcttgacctttgcctttatcatcggactggacgggagcactgggcccactaggtttttcctgttcggaatccttttctctatttgtttttcttgcctgttggcccacgccgtgagtcttaccaaactggtcagagggagaaaacccctctctcttcttgtaatactgggactggcagtgggattctctttggtgcaggatgtcattgctatcgagtacatagtacttaccatgaatcgcaccaacgtaaacgtcttttcagaactcagcgctcccaggagaaatgaggactttgtgttattattaacctacgtcctttttctgatggctttgactttccttatgtcttcattcacgttctgtgggagttttacaggctggaaacgccatggagctcatatttatctgaccatgctccttagcatcgccatctgggttgcatggataactctcctgatgctaccagacttcgataggagatgggacgacaccatcttgtccagcgccttggccgccaacggttgggtcttcctcctggcatatgtgagccccgagttttggctactgaccaagcagcgaaatcccatggattatccagtggaagatgctttctgtaaaccacagctcgttaagaagtcctatggcgtagagaatcgtgcctacagccaggaggaaattacccagggattcgaggagaccggggataccctatatgccccctactccacacactttcagctgcagaaccagcctcctcagaaggagttttctatcccaagagcacacgcctggccaagtccatacaaggactacgaggttaagaaagaggggtcatag

SEQ ID NO: 26535 - DNA, 825 bp, Artificial Sequence
  Description of Artificial Sequence: Synthetic coding sequence
atggccacaaccgtgcccgatgggtgtagaaatggactcaaatccaagtattacaggttatgtgataaggcagaagcctggggaatagtgctggagacggtggctacagctggcgtggtgacatccgtcgcattcatgctgacactgcccatactcgtatgcaaggtccaggattccaatcgccggaagatgctgcctacacagtttctgttcctgttgggggtcctgggcatcttcggcctgacttttgcttttattatcggtttggacggcagtactggaccaactaggtttttcctgtttggcattctgttctccatttgtttttcgtgcctgttggctcacgccgtttccttgactaaactggttagaggccggaagcctctgagtttgctggtgatactcggtctggcggtaggcttcagtctggtgcaggacgtgattgcaattgaatatatcgtacttaccatgaatcggacaaacgtgaatgtgtttagtgagctgagcgcgccacgccggaacgaagacttcgtccttctgctgacttacgttcttttcctgatggcactcacatttctaatgtctagttttactttctgcgggagctttacagggtggaagcgccacggtgctcacatatacttgaccatgcttctgtcgatagctatttgggtcgcctggataacgctactaatgttgccagactttgacagaagatgggatgacactatactttcaagtgccttggctgcaaacggttgggtgttcttgctggcctacgtgtcccccgagttttggctgctcacaaaacagcgcaatccatag

SEQ ID NO: 26536 - DNA, 2781 bp, Artificial Sequence
  Description of Artificial Sequence: Synthetic coding sequence
atggccttcctgatcatcctgattacctgtttcgttataattctggccactagtcagccatgtcagaccccagacgactttgtcgcggctacatcgccgggacacatcatcattggtgggttgtttgcaattcacgagaaaatgctgtcctcagaggattcccctcgtcggccgcagattcaggaatgtgtagggtttgagatctccgtctttcttcagacgcttgcaatgatccattcgattgagatgataaacaacagtacactgctgccgggcgtgaagctgggctatgaaatatatgacacgtgcaccgaagtcactgtcgccatggccgccaccctgaggttcttgtcaaaattcaactgcagccgggagaccgtcgagtttaagtgtgactacagcagctacatgcccagagtgaaagccgtcatcgggtctggatacagcgaaattaccatggccgtgtctcgtatgttaaatctccagttgatgccccaagtggggtatgagtctacagccgagatcttatcggacaaaatccgcttccccagcttcttgcgaacggtgccctctgattttcatcagattaaggctatggcccacttaatccaaaagtctggttggaattggatcggtattattacaacagatgacgattacggtcgcctcgctctgaacacctttataatccaggcagaggctaataatgtgtgtatcgcatttaaggaggtgctccctgcttttttgagtgataatacgattgaagtccgaattaatcgcacactcaagaagattatcctggaagcccaggtcaacgtgattgtggtctttctgcgtcagtttcacgtctttgacctatttaacaaggcgatcgagatgaacatcaataagatgtggatcgcttcagacaactggtccacagcaacaaaaataaccaccatccctaacgtcaagaaaatcggtaaggtggtcggcttcgcattccgccgcgggaatatctccagttttcactcattcctgcagaacctgcatctgcttccttccgatagccataagttactccatgagtacgctatgcacctgagtgcctgcgcctatgtgaaggacactgatttgagccaatgtatattcaaccattcccaacggaccttggcctacaaggctaacaaggctatagaaagaaatttcgtgatgaggaatgacttcctgtgggactacgccgaaccaggactgatccattccatacagctcgccgtttttgcactcggctatgcaattcgcgacctgtgtcaggccagggactgccagaatcccaacgcctttcaaccttgggagctgttaggtgtattgaaaaacgtgacattcaccgacggctggaactcttttcattttgacgcacatggggatttaaacacggggtacgacgtcgtgctctggaaagaaattaatggccatatgacagtcacaaaaatggccgagtatgacctgcaaaatgatgtatttattatcccggaccaggagactaagaacgaattccgaaaccttaagcagatacaaagcaaatgctccaaggagtgttcccccgggcagatgaaaaagaccaccagatcgcagcacatttgctgttatgaatgtcagaactgccctgagaaccactataccaatcagacagatatgccgcactgtctcctatgtaacaataaaactcactgggcccctgtgcgctctacaatgtgttttgagaaagaggtggagtacttaaattggaacgactcactcgctatcctgttgttgatcttatcgctgctcggcatcatctttgtcctggtggtcggaatcatttttacccggaatctgaacacccccgtcgtgaagagctcagggggtctgagggtgtgttacgtgatccttttatgccactttctgaacttcgcctccacctctttttttatcggggagccacaggattttacatgtaagactcgacaaacaatgtttggggtcagtttcactttatgcatttcgtgcatattaactaagtccctaaagatcctcctagccttctctttcgaccccaaacttcagaagttcctgaagtgtctctatcgaccaattctaataatcttcacctgcacagggatacaggtggtgatatgcaccctgtggcttatcttcgccgcacctaccgtggaagttaatgtgagcttaccacgcgtaatcatacttgaatgtgaagagggcagcattctagccttcggcacaatgcttggctacattgcaatactggcttttatatgttttatttttgccttcaaggggaagtatgagaactataatgaagccaaattcatcactttcggcatgctgatttacttcatcgcctggatcacattcatcccgatctatgctactacctttgggaaatatgtgccggccgtcgagattatagtaattctcatctctaattacgggatactgtattgtacattcatccctaaatgctacgtgatcatctgtaagcaggagataaatactaagagcgcatttcttaagatgatttacagctattcctcccactctgtatcgagcattgcactgtccccagcctccctcgattccatgtccggaaacgtgaccatgacaaatccatcttcctctggcaaatcagccacttggcaaaaatcaaaggacttacaggcacaagccttcgctcatatatgcagagagaacgcaacatctgtttcaaaaactctgcctagaaagaggatgtcctctatatag

SEQ ID NO: 26537 - DNA, 2568 bp, Artificial Sequence
  Description of Artificial Sequence: Synthetic coding sequence
atggcttttctaatcatactcatcacgtgcttcgtgatcatactggccacatcacaaccctgccaaacaccagatgactttgtggctgcgacgtctcctggtcatattattattggtgggctcttcgccatccatgaaaaaatgctttcttccgaagactcccctagacgtccccaaatccaggaatgtgtaggattcgaaatctccgttttcttacagacccttgccatgatccattcaattgaaatgatcaacaattctaccctcctgcccggtgttaagctggggtacgagatttatgatacctgtactgaggtcactgtggccatggctgcaacattaagatttctgtcaaaattcaactgctctcgggagacagtagagtttaagtgtgactattcaagctacatgcctcgggttaaagctgtcatcggtagcggatattctgaaatcacaatggccgtctccagaatgctcaacctccagctgatgccccaagttggatacgaatccacggccgagattctctcagacaaaatacgcttcccgagctttctgcgcacggtgccttcggatttccaccagatcaaagctatggcacaccttattcagaagtctgggtggaactggatcgggataatcacgacagacgacgactacggccgcctggcactgaatacattcattatccaagcggaagccaataacgtgtgtatcgcttttaaggaggtattaccagcctttctgagcgacaacacaatagaagtccgtattaatcggacccttaaaaaaatcatccttgaagcccaggtgaacgttatagttgttttcctgcgccagtttcacgtcttcgacctctttaacaaggccattgaaatgaatatcaataagatgtggattgcttccgataactggtccaccgccacaaagattaccacaatacccaatgtaaagaagattggcaaggttgtcggcttcgcgtttcggagaggcaatatttctagcttccattcattcttgcagaacctccacttacttccatcagacagccataaactgctgcacgagtatgccatgcatctttctgcgtgcgcatatgttaaagacaccgatctttctcaatgtattttcaaccacagccagaggaccttagcttacaaggctaataaagccatagagcggaacttcgttatgcggaacgactttttgtgggattatgctgagccaggcctgatacactccatacagctcgcggtgttcgctttgggctatgcgataagagacctttgtcaggcacgggattgccagaaccccaatgcctttcaaccgtgggagcagattcagagcaagtgctcaaaagagtgctctcctggacagatgaagaagacaacacgctcccaacacatctgctgttatgagtgtcagaactgcccagaaaatcactataccaatcagacagacatgccccactgcttgttgtgtaacaacaaaacgcattgggcccccgtgcgcagtacaatgtgcttcgagaaagaagtggagtaccttaattggaatgacagcctcgcaatccttctgctaatcctgagtctgctggggatcatcttcgtccttgtcgtcgggattatctttactcgcaacctcaacacacccgttgtgaagtcctctggcgggctgagagtgtgctacgtaatactgctctgccactttcttaatttcgccagcacgtctttcttcattggagagccccaagattttacttgtaagacgcgtcagaccatgtttggtgtgtcctttaccctgtgcatttcttgcatcctaacaaagagtctgaagatcctgttggccttcagtttcgacccaaagctacagaagttccttaagtgtctgtaccgtcctatactgataatttttacctgcacgggcattcaggtggtgatctgtacactgtggctgatcttcgccgcacccaccgtggaggtgaacgtcagcttgccacgagtgatcattctggaatgtgaagaaggttccatcctggccttcggcacaatgctggggtatattgctattttggccttcatttgcttcatttttgctttcaaaggaaagtacgagaattataatgaagctaaattcatcacattcggcatgctgatctatttcattgcctggattacgtttattccaatttacgccaccacttttggtaagtatgtccctgcagtggaaatcatcgtcattctaatttcgaactacggtatcctgtattgcacatttatcccgaagtgctatgtgataatctgcaagcaggagatcaacactaagtcagcatttctgaagatgatttatagctactcgtcccacagcgtgagctctatagccctgagccctgcgtcgctcgacagtatgagcggtaatgtgactatgacgaatcccagctcttccggaaagagcgcaacctggcagaaatcaaaagaccttcaggcacaggcttttgcccatatctgccgggaaaatgcaacctctgtgtccaaaactctgcctagaaagcgcatgtcgtcaatttag

SEQ ID NO: 26538 - DNA, 2256 bp, Artificial Sequence
  Description of Artificial Sequence: Synthetic coding sequence
atggccttcctgataatcctgataacctgcttcgtgataatactcgcaacaagccagccttgccaaaccccggatgatttcgtcgcagccacctcacccggacacattattatcggcggtctgtttgccatacatgaaaagatgctgtcctccgaagatagtcccaggcgacctcagatccaggagtgcgtaggttttgaaatctcggtcttcctgcagactttggccatgatccattcgatcgagatgattaataactccacactgttgcctggtgtgaaattaggttacgaaatttatgacacctgcaccgaagttactgtcgcaatggctgccaccttgcggttcctgtccaagttcaactgctcgcgagagaccgtagagtttaagtgcgactatagctcgtatatgccaagagtcaaggccgtgatagggtccggttattcagagatcaccatggccgtctctcgaatgcttaacctccaactgatgcctcaggttggctacgagagtaccgccgagattctctccgacaagattcgctttccaagttttctgcgaactgtaccgtctgatttccatcagatcaaggctatggcacaccttatccagaaatcgggatggaactggattgggatcatcactacagacgacgactatggcagactcgccctgaacactttcatcatacaggcagaagctaataatgtgtgcattgcttttaaagaggtccttccagcctttctgagcgataacaccattgaggtacggattaaccgtacactgaaaaaaatcatcctagaggcacagctgctgggagtcctgaagaatgtgacctttactgatgggtggaactcattccactttgatgctcatggggacttaaacacgggctacgacgttgttctatggaaggaaattaacgggcatatgacggtaactaaaatggccgagtacgacttgcagaacgacgtcttcatcattcccgatcaggaaaccaagaacgaatttcgcaacctgaaacagatacagtctaagtgctctaaagaatgcagtcctgggcagatgaagaagaccacacgaagccagcacatatgttgttatgaatgccagaattgtccagagaaccactatactaatcagaccgacatgcctcactgcctcttgtgcaataacaagacacattgggcccccgtgcgcagcactatgtgttttgagaaggaagtggagtacctgaattggaacgacagtctcgctatcttattgctgattttgagtcttctcggcattatatttgttctggtcgttgggattatatttaccagaaacctcaatactccggtggtgaaatcgtccggcggcctcagggtctgctatgtgatcctgctgtgccattttctgaacttcgcgtctactagctttttcataggagaaccccaggacttcacctgcaagacccggcaaaccatgttcggcgtgtcattcactctttgcatcagctgtatcctgaccaagtcccttaaaatcttactggcctttagtttcgaccccaaactgcagaagttcctgaagtgcctgtaccgtcctatactcataatcttcacatgtactggcatccaggttgtgatttgcacgctatggctgattttcgcggctccgacagtcgaggtcaatgtcagccttccaagggttatcatcctggaatgtgaagaaggcagtattctggccttcggcactatgctggggtacatcgccatcctggcctttatatgctttatcttcgccttcaagggaaaatacgaaaattataatgaagcaaagttcataacgtttggtatgctgatttactttatagcgtggatcactttcattccaatatacgcaacaactttcgggaagtacgtgccagctgttgaaataatcgtgattctcatttcaaactacggtatcctctattgtactttcattcccaagtgctacgtgattatttgcaaacaggaaattaacacaaaaagcgccttcctcaaaatgatctactcctactcctcccatagtgtctcctccatcgccttgagcccagccagtctcgactccatgtccgggaacgtgactatgacaaatccttcttcttccggcaagtctgccacctggcagaaatcaaaggacctgcaggcccaagcttttgcccatatttgccgggagaatgcgacaagcgttagcaagactctgccaagaaaacggatgtcttcaatctag

SEQ ID NO: 26539 - DNA, 330 bp, Artificial Sequence
  Description of Artificial Sequence: Synthetic coding sequence
atgaaggaagaagattcaagttttaagttatgcgtgcccggaatcgtggccctgcaatcgcctcccaataaagcctttagatctaccgacaccgtgggcttcctggagtcagaattaaagaagcttctgggcatgcaacaggaatcacgcttgtggaagctagggtctcaggaggggagggagctgcttactcggccggaaattactgttgtggaaggcgaaggctatgaggtccagaggcgtctcaggcatctacccagccctatctctgttgcgcaatgcctgctgctggaggagaaaggcgaaatgggaaactggccccctgagtag

SEQ ID NO: 26540 - DNA, 2886 bp, Artificial Sequence
  Description of Artificial Sequence: Synthetic coding sequence
atgctgctgctgctcctgttagcccccctgtttttgaggcccccgggcgctgggggcgtgcagacacctaacgccactagcgaggggtgccagatcatccaccccccgtgggaggggggaattagatacaggggacttactagggaccaagtaaaggccatcaatttcttacccgtcgattatgagattgagtacgtgtgcagaggcgagcgcgaggtggttggtcctaaggtgcgcaaatgtctcgccaatgggtcttggacagatatggatacaccaagtcggtgtgtccggatctgcagcaaatcatatcttaccctagaaaacggcaaggtgtttctgactggcggcgacctccctgcgttagacggcgctcgtgtggactttagatgcgacccggacttccatttggtggggtcaagccgctcgatttgcagtcagggacaatggtctactcccaagccccactgccaggtcaatcgtactcctcacagcgaacggcgcgcagtctatattggcgcacttttccctatgtctggcggctggcccgggggccaggcctgtcagcccgcggtggaaatggcactggaagacgtgaattccagaagagacatcctgccagattatgagctgaagctgatacaccatgattcaaaatgcgatccgggccaggctactaaatacctgtatgagttgttgtataatgatcccatcaagattattctcatgcctgggtgctcgagtgtctccaccctcgtagctgaggctgccagaatgtggaacctgatcgtgctttcctacggctcttcttctcctgccctgtccaacagacagaggtttccaacattttttagaacccacccgagtgctacactgcacaacccaacacgcgtgaagttatttgagaagtggggctggaaaaagatcgctacaattcaacaaacaaccgaggtgtttacttctactttggacgacctcgaagagcgtgtgaaagaagctggaatcgagattacatttaggcagtccttctttagcgatcctgcggtgccggtgaaaaatttgaagaggcaggatgcacgcataatcgtcggactattttacgagaccgaggctcgcaaggtcttctgcgaggtgtacaaggaaaggctgttcggaaaaaagtacgtctggttcctgattggctggtacgccgacaactggtttaagatatacgaccctagcattaactgtaccgtggacgaaatgaccgaggcagtggaaggccatatcaccacagaaatcgtcatgctgaatcctgcgaacaccagaagtattagtaacatgactagtcaggagtttgtcgaaaagttgacaaaaaggcttaagaggcaccctgaggagaccggtggtttccaagaggctccacttgcatacgatgccatttgggctttagccctggccctaaacaagacaagcggcggcggtggaaggtcaggtgtgagattagaggattttaactataataaccagaccattacggaccagatttatcgggctatgaatagttctagcttcgaaggtgtgtccggccacgtagtcttcgatgcctccggctccaggatggcatggacacttatcgagcagcttcagggcggatcatataagaaaatcgggtattatgattctacgaaagacgatttgtcctggagcaagaccgataaatggattggtggctcccctccggccgaccagacactggtgattaagacttttcgatttctaagccagaaattatttatttccgtgagcgtactgagctccctcggaatcgtgctcgcagtcgtgtgtctctcctttaacatatacaacagccatgtcagatatatacagaattcccagcccaacctgaacaacctcactgcagtggggtgctccttggccctggcagcggtcttccctctcgggttagatggataccacattgggagaaatcaattcccttttgtatgccaggctcgtttgtggcttttgggcctgggtttttccctggggtacgggtcgatgttcacgaaaatttggtgggtgcacaccgtgtttacaaaaaaggaggagaaaaaagagtggcgcaaaaccttggagccctggaagctttatgcgacagtgggcctgctcgtgggaatggacgtcctgacactggcaatatggcagatagtagatcccttacatcggactattgagacgttcgccaaagaggaaccaaaggaggacatcgacgtgagcattcttcctcagctcgagcattgtagcagcaggaaaatgaatacctggctcgggatattttacgggtacaagggactgttactcctgttggggatctttctcgcctatgagactaagtcagtgagtaccgagaagatcaatgaccaccgcgcggtcggaatggccatttacaatgttgcggtgctgtgtctgatcacggcacctgtcacaatgattctgtcgagccagcaggatgcagcttttgctttcgcctctctggcgatcgtgttttcatcctacatcacgttggtggtgctgtttgtccccaaaatgaggaggctcatcacccgtggtgagtggcagagtgaggcacaggatacaatgaagaccggttcatcaacaaataataacgaggaggagaaatctagactgctcgaaaaggaaaaccgagagttagagaagataatcgcagaaaaggaagagcgagttagcgagcttagacatcagctgcagagcagacaacagcttcggtctcggaggcatcccccaactcctcctgagccctccgggggcctgcccagaggacctcccgagcccccagatcggctcagttgcgatgggtctagagtgcacctgctgtataaatag

SEQ ID NO: 26541 - DNA, 2700 bp, Artificial Sequence
  Description of Artificial Sequence: Synthetic coding sequence
atgctgttattgctactactagcccctctctttctacgacctccgggagctggcggagtgcaaacaccaaatgcgacctctgagggttgccagatcatccaccctccctgggagggcggaatacgctatcgcgggctcactcgcgatcaggtaaaggctatcaactttttaccggtagattatgagattgaatatgtatgcagaggtgagagggaggtagttggccccaaggtgcgaaagtgccttgctaacgggagttggacggatatggataccccatcacgctgtgtaaaccggaccccccattccgagcgaagagctgtgtacatcggggcactcttcccaatgtcagggggttggcctggcggccaggcctgccagccggctgtggaaatggcactcgaggatgttaatagcagacgcgatatcttgcctgactacgaactcaagcttatccatcatgattctaagtgcgacccagggcaggccacaaagtatctgtacgagcttttgtacaatgatcccatcaagatcattctgatgcctggctgctccagtgtgtcaactctagtggcagaggcagcaagaatgtggaacctgatcgttctatcatacggttcctcctcaccagccttgtctaaccgccaaagattccctaccttcttcagaacccaccccagcgcaaccctgcacaaccccacccgcgtcaagctcttcgagaaatggggatggaagaagattgccacaatacagcagacaaccgaagttttcaccagcacactagacgacttagaagagcgggtcaaggaggcgggaattgagattacctttcgacaatcatttttcagcgatccggctgtgcctgtgaagaatctgaaaagacaagatgcccgtatcattgtggggctgttctatgaaacagaggccagaaaggtgttctgtgaagtgtacaaggagcgccttttcgggaagaagtacgtgtggttcctgatcggttggtatgcggacaactggttcaagatatatgatcccagtatcaactgcacagtcgatgaaatgactgaggccgtagagggtcacatcaccactgagatcgtcatgctgaatcccgccaacacaaggtccatcagcaacatgacttcacaagagttcgtggaaaaacttacaaaacggctgaaaaggcacccagaggaaacgggcggcttccaagaagcccccctagcatacgatgccatatgggcactggccctggcactcaacaaaacgtccggaggggggggcagatccggagtcaggttggaggatttcaattataacaatcagactatcaccgatcagatatatcgtgcaatgaattcgagcagtttcgaaggagtgtccggtcacgtggtgtttgacgcttcaggatcccgaatggcctggactttgatagaacagctgcaaggaggttcgtataaaaagattggctactacgactcaaccaaagatgatttaagttggagcaagaccgacaagtggatcgggggatccccgcccgcagaccagactctggtcatcaagacctttaggttcctttcccagaagctttttataagcgttagtgtcttgtccagcctaggaatcgtgctggccgtcgtgtgcctgagctttaacatatataacagccacgtgaggtacatccagaattctcagcctaatctgaacaaccttaccgccgtcggctgcagcttggcgctggccgctgtgtttccacttggcctggatggctatcatatcggacggaatcagttccccttcgtgtgtcaggcacgcctttggctactgggccttggattcagcctgggctatggatccatgtttaccaaaatctggtgggttcatacagtttttactaagaaggaagaaaagaaagaatggaggaaaacccttgaaccatggaagctgtacgcaaccgtcggcctgctggtggggatggacgtactaactttagcaatctggcagatcgtggatccactccataggaccatagagaccttcgccaaggaggagccgaaagaggacattgatgtgtctattctaccgcaactcgaacactgctccagcagaaaaatgaacacttggctcggcatattttatggttacaaggggctcctgctgctattggggatttttttggcctacgaaaccaagtcagtgtctactgagaagataaatgatcaccgggctgtgggtatggcaatctacaatgtggccgtactctgcctgatcacggcaccagtgaccatgattctgagtagtcagcaggacgccgctttcgcattcgcctctctggcgattgtgttctccagttacattacgctggtcgtgctttttgtgcctaagatgcggcggctgattacccgaggggaatggcagagcgaagcacaagacacgatgaaaaccggaagcagtacaaataataacgaggaagaaaagagccgattgctggaaaaagaaaaccgggaactcgagaagattattgctgagaaagaagagagggtgagcgagctgcggcaccagctacagtctaggcagcagttacgttcaagaagacatcccccaactcctccagagccgtctggtggactcccgcgaggtccacccgaaccccccgacaggttgtcttgcgatgggtccagagtccacctactgtataagtag

SEQ ID NO: 26542 - DNA, 2535 bp, Artificial Sequence
  Description of Artificial Sequence: Synthetic coding sequence
atgggcccaggagcgccctttgcccgggttggttggcccctgcccttgttggttgtgatggcagctggcgtagcacctgtctgggcctcccatagtccacatctgccaagaccccacagccgcgtgccacctcacccctcttctgaacgccgggccgtctatataggcgctctgttccccatgagcgggggctggccaggaggtcaagcttgtcagccagcagtggaaatggcactcgaggatgtgaattcgcgcagagatattctgcctgattacgaattgaagttgattcaccatgactccaaatgcgatcctggccaggcaaccaagtacctgtatgaattgctgtataatgatcccatcaagataatactgatgccagggtgctcttcagtgagcactcttgtcgctgaggccgcaaggatgtggaacctgatcgtgctgtcatatggaagctcttccccggctttatcaaatcgtcaaagatttccgacctttttcagaactcaccccagtgctacactgcacaaccccacccgggtgaagctgtttgagaaatggggttggaagaaaatagccacgatccagcagacaaccgaagtgttcactagtaccttagacgacctcgaggagagagtaaaggaggccggcattgagataacatttcggcagagttttttctctgaccctgcagtgccagtgaaaaatttgaaacggcaggacgctagaattattgtcgggctattctacgaaaccgaggcccgtaaggtgttttgtgaggtgtacaaagaaaggctctttggcaagaaatacgtctggtttctgatcggatggtatgccgacaattggttcaaaatatacgatccctcaatcaattgtactgtagatgaaatgaccgaggcggtggaggggcacattactactgaaatagtgatgttgaatccagctaatacacgctcaatatctaacatgacatcccaagaattcgtcgagaagttaacaaagcgactgaagcggcatcccgaggaaacaggggggtttcaggaggcgccattggcctatgatgctatctgggccctcgccctggccctgaacaagacctcaggcgggggcgggaggtccggtgtccggctcgaggattttaattataacaaccaaacaataacggatcagatatacagggcaatgaatagtagttctttcgaaggtgtatctgggcacgtcgtcttcgatgcatcaggaagcaggatggcatggaccctgatagagcagttacaaggcggaagctataagaaaattggatattatgattcaactaaggatgacctgagctggtccaagaccgataagtggataggcggttcaccccccgcagatcaaacacttgtcattaaaaccttccgcttcctgtcgcagaagctcttcatctcggtgtctgttctttctagcctcggaatcgtcctagctgttgtgtgcctcagtttcaatatctacaactctcatgtaaggtacatccagaatagtcaacctaacctgaacaacttgaccgcagtcggctgctcactcgctcttgccgcagtgttccctctgggcttagatggttaccacattggccgtaatcaattccccttcgtctgtcaggctaggctgtggttactcggcctgggcttttcactgggttatgggagtatgttcaccaaaatctggtgggtccacaccgtcttcacgaaaaaggaggaaaagaaggagtggcggaagaccctggaaccatggaaactttacgcaacagttggactgctggtgggaatggacgttctgacgttggcaatctggcagatcgtggatcccctccaccggacaatcgagactttcgctaaagaagaaccaaaggaagacattgacgtttctatcctcccacagctggagcattgctcttcccggaaaatgaatacctggttaggaattttctacgggtataagggcttgctgctactcctagggatcttcttagcttacgagacgaagtctgtgtcaactgagaagataaatgaccaccgggccgtcggcatggctatctacaacgtcgcggtactgtgcctcatcaccgcaccagtgactatgattctgtcatcccaacaggacgcggcctttgctttcgcgagcctcgccattgtgttcagcagctacatcacattggttgtgctgttcgtacctaaaatgcggcgactgatcacgcggggcgagtggcaaagcgaggcccaggacaccatgaagacagggtcgagcactaacaacaacgaagaggagaagtctcggttgcttgaaaaagaaaatcgcgagctcgaaaaaataattgcggaaaaggaggagcgcgttagtgaactcaggcatcaattgcaatctcggcaacaacttcgcagcagacggcaccccccaaccccacccgagccaagtggagggctgcctcgaggaccacccgagccacccgacagactctcttgtgacggaagcagggttcatctgctatataaatag

SEQ ID NO: 26543 - DNA, 2535 bp, Artificial Sequence
  Description of Artificial Sequence: Synthetic coding sequence
atgggccccggcgccccctttgcccgagtgggctggccacttccccttctggtcgtgatggcagccggggttgctccagtctgggcatcccactctccccacctgcctcggccccactcacgagttccaccacaccccagctcagaacgccgcgccgtatatatcggagcccttttcccaatgtccggcggatggccaggcgggcaggcctgtcaacccgcagttgaaatggcgctggaagacgtaaattcgcgacgggacatcctgcctgattacgagctcaaactgatccatcacgattctaaatgcgatcctggacaggctacaaagtatctgtacgagctattgtataacgaccctatcaagataattctcatgcccggatgttcaagtgtgagcacgctcgtggcagaagctgcccggatgtggaacttgatcgtcctatcatacggtagctccagcccagctctctcaaatcgacagaggttccctacgttctttcgtacgcacccatctgctacactccacaaccccaccagggtgaaactattcgagaagtggggatggaaaaagatcgcgaccatccaacagacgacggaggtgtttaccagcaccctcgacgaccttgaggagcgtgtcaaggaagccgggatcgagattaccttccggcagagcttcttttctgaccctgccgtcccggttaaaaatctcaagcggcaggacgctcgcattatcgtgggactgttctatgaaaccgaagctcgtaaagtattttgtgaggtctacaaggagcgattattcgggaagaagtatgtgtggttcctgattggctggtacgctgacaactggtttaagatctacgaccctagcatcaattgcacagtcgacgagatgactgaggcagtggagggccatatcactacggagattgtgatgctgaatccagcaaataccagatccatttcaaatatgacctcccaggagttcgtggaaaaactgactaaacggctgaagcggcacccagaagaaacaggaggctttcaggaagcccctctggcatatgacgccatctgggccctggcgcttgccctaaataagacttccggcggtggaggtcgcagcggcgtccgactcgaggacttcaattacaataaccagaccatcactgaccagatttatcgggctatgaacagctctagtttcgagggggttagcgggcatgtcgtgttcgacgcctcgggatccaggatggcctggacactcattgagcagttgcagggaggatcctacaagaagatcgggtactatgactccaccaaagacgacctctcctggagtaagaccgacaagtggatcgggggctccccccctgctgaccagacgcttgtcattaagaccttccggttcctgagtcagaaacttttcatctccgttagcgtgctgagttccctgggcatcgtgctggcagtggtgtgcctcagcttcaatatttataacagccacgtgaggtatatccagaatagccaacccaatctgaataatctaacggctgtaggctgcagtctcgccttagccgccgtctttcccctcggactggatggataccatattggtaggaaccagttcccattcgtttgccaggccagactgtggttgctgggcctgggcttttcccttgggtatggatccatgtttacaaagatttggtgggtgcacaccgtgtttacaaaaaaagaagagaagaaagaatggcggaagaccctggaaccctggaaactatacgctactgttggtctcctcgtcggcatggacgtgctgactcttgccatttggcaaatcgtggacccactgcatcgtactatcgagacctttgcaaaagaggagcccaaggaggacatcgacgtaagcatactccctcagctggaacactgctcctccagaaagatgaacacctggctcggcattttctacgggtacaaaggattactgttactgttgggcatttttttagcctatgagaccaaatcagtgtcgacagagaagattaatgatcacagagccgttggtatggcaatctacaatgtcgccgtgctctgccttattaccgcacctgtgactatgattctgtcttcacagcaagatgccgcttttgcgtttgcctctctggcaatcgttttctcatcatacattaccctggtagtactgtttgtacctaaaatgcggaggctcatcactaggggagagtggcagtcagaagcacaggataccatgaaaaccgggagcagtacgaacaacaacgaggaagaaaagtcgcggttattggaaaaggagaatcgcgaactggagaagattatcgccgagaaggaagagcgcgtgagcgaactaaggcaccaactgcagagcagacagcagctgcgaagccggcgacaccctccaacgcccccagaaccaagcggggggctgccccgcgggccccccgagccccccgaccggctttcttgtgacggctcacgcgtccatttgctgtataagtag

SEQ ID NO: 26544 - DNA, 1737 bp, Artificial Sequence
  Description of Artificial Sequence: Synthetic coding sequence
atgttgttgttgctcctgctggcccccctttttcttcggccacccggcgctgggggcgtccagactcctaacgcaaccagcgagggctgtcagatcattcatccaccctgggaaggcggcattcgctatcgggggctgactcgcgatcaggtgaaggccatcaactttctaccggtggactatgagatcgagtatgtgtgtcgtggcgagcgcgaggtcgttggcccgaaagtcagaaagtgtttggccaatggatcgtggacagacatggataccccttcccgttgcgtcaggatttgctccaaatcctatttgacactcgagaatgggaaagtgtttcttaccggaggggatctgcccgctctggatggggcccgtgtagatttcaggtgtgatccggattttcatttggtcggtagttcacgttcgatctgcagtcagggccaatggtccacccccaagccgcattgtcaggttaatcggaccccccattcagagcgacgagcagtctatattggggccctttttcccatgtctgggggctggcctgggggacaggcatgtcagcccgcagtggagatggccttagaagacgtgaactcacgccgcgacattctacccgactacgaactcaagctgatacaccatgactcgaagtgtgaccccggccaggcaaccaaatatttatacgagctgctctacaacgaccctattaagataattcttatgccggggtgttccagcgtgtctaccctggtcgcagaagccgcaagaatgtggaacctcatcgtcctgtcttacggaagtagttcccctgcactcagcaacagacagcggtttcctacattctttagaactcatccatctgcaacactacacaatccaacccgggttaagcttttcgaaaaatggggctggaagaagattgcaaccatccagcagaccactgaggttttcacgagtactttagacgacctcgaggaaagagtaaaagaggcgggcatagaaatcactttcaggcagagctttttcagcgaccccgctgtgcctgttaagaacctcaagagacaggacgcgcgcatcattgtgggcttgttttatgagaccgaggccaggaaggtgttttgcgaagtctacaaggaaaggctgtttggcaagaaatacgtgtggttccttatcggttggtacgctgataattggtttaaaatatatgaccctagtataaattgcaccgtggatgaaatgactgaagctgtagaagggcatattacaactgagatagtgatgttgaatccagccaacaccagatccatttctaacatgacttcccaagagtttgtagagaagctcacgaaacgattgaaacggcatcccgaggagaccggggggttccaggaagcgccactcgcttatgacgctatttgggccctcgccttggcgctgaataaaacctctggaggtgggggtaggagcggggttaggcttgaggatttcaactataacaaccagaccatcactgaccagatctatcgggctatgaacagtagtagttttgaaggcgtctctggacatgtggtcttcgatgcctcaggttcgcgcatggcatggacactgattgagcagttgcagggcggaagctataagaaaattggatactacgacagcacaaaggacgacttgagctggagcaagactgataagtggatcgtgataagtcggacacactctccgacatag

SEQ ID NO: 26545 - DNA, 1989 bp, Artificial Sequence
  Description of Artificial Sequence: Synthetic coding sequence
atggccgcggagaacgaggctagccaagaatcagctctcggtgcttactcaccggtcgactacatgtcaatcacctcctttccacgacttcctgaggatgaacctgcccccgcagctcctttgcgcggtcgtaaagacgaggatgctttcctcggagaccctgatactgaccccgattcctttttaaaatcagcaagactccaaagactccccagttcctctagcgagatgggctctcaggacgggtctcctctcagggagacaagaaaggacccctttagcgcagccgccgcagaatgcagttgccgtcaggacggactgaccgtgatcgtcaccgcgtgtttgacttttgctacaggtgtcaccgtggccctcgtaatgcagatctacttcggcgatccacagatattccagcagggcgctgtcgtgacggacgctgcgcgctgtaccagcctgggcatcgaggtgttaagtaagcaggggtcatctgtggacgcagctgtggccgctgctttatgtttgggcattgtggctccccactccagtggcctggggggaggaggtgtcatgctagttcatgatatccgcagaaatgaaagtcatctgatagacttccgtgagtccgctcccggggctctgagggaggagactctgcagcggagttgggaaacaaaacccggcctgctcgttggcgttcctgggatggtcaaagggctccacgaggcccaccagctgtacgggcggcttccttggagccaggttctggcattcgccgctgctgtcgctcaggacggtttcaatgtgacacatgatcttgcaagggccctggccgagcaactcccccccaacatgagtgagcgctttagagagacgtttctgcctagcggacgcccgcccctgcctggcagcctcctgcaccggccagacctcgcggaagtgctagatgtcctcggaaccagcggccccgctgccttctacgcaggaggcaacctgaccctggagatggttgcggaagcccagcatgccggcggcgtcataaccgaggaggacttctcgaactattccgccttagtagagaagcccgtttgcggggtttacagggggcatcttgtgttatcaccaccccctcctcacacaggtccagctctgatcagcgctctaaatatcttggaggggttcaacttaactagccttgtgtcacgcgagcaggcgctgcactgggttgccgaaaccctcaaaatagccttagctcttgccagccgattgggcgatccagtgtacgactcgacgatcactgagtccatggacgacatgctctctaaggtggaggctgcttatttaagaggccacatcaatgattcacaagctgcacctgcgcccctgctgccagtatacgagctggacggcgccccgaccgcagcgcaagtattgatcatgggaccagatgattttattgtcgccatggtgagctcactaaatcaaccattcggttctggcttaatcaccccctccggcatcctcctgaactcacagatgttggatttcagttggccaaataggacagccaatcattccgccccaagcctggaaaattccgtccagccaggcaaaagaccactaagttttcttctgccaacagtcgttcgccctgccgaaggtctttgtggcacctatcttgcacttggcgctaacggtgcggcccgaggcctctctggactcactcaggtgctgctgaacgtgctgacattgaatcggaacctgtcagactccctcgcgcgaggtagattgcatcctgatttgcagagtaatcttttacaggtggacagcgaattcacggaagaggaaatagaattcctggaagccagagggcaccacgtagaaaaagtagatgtcttgtcctgggtgcatggctctcgtcggactaataattttataatagctgttaaagatccaagatcgccagatgccgccggagctaccatattgtag

SEQ ID NO: 26546 - DNA, 1185 bp, Artificial Sequence
  Description of Artificial Sequence: Synthetic coding sequence
atgattgtttttatattccttgccatgggcctgtcactagaaaatgaatatacatcccagacaaacaactgtacgtacttaagagagcagtgtctgagagacgccaatggatgcaaacacgcctggagagtgatggaagatgcgtgtaacgactccgacccaggagacccctgcaagatgcgcaattcttcttattgcaatctgtcaattcagtacctggtggaatccaacttccaatttaaagaatgtctttgtactgacgatttttactgcactgtgaacaaactactgggaaagaaatgcataaacaagagcgacaatgtaaaggaagacaagttcaaatggaatctgacaaccaggtctcatcatggcttcaagggcatgtggtcttgcctcgaggtggcggaggcctgcgtcggggacgtggtttgcaacgcccagcttgcaagctacttgaaagcttgctccgcaaatgggaatccctgtgatctgaaacagtgtcaagccgccatccggttcttttaccaaaacattccttttaacatagctcagatgctagccttctgtgattgcgcccaatctgatatcccctgccagcagagtaaggaagcattgcacagcaagacctgtgccgttaacatggtaccaccccctacctgcctgagtgtgatccgctcttgccagaacgacgagttgtgtagacggcattacaggacattccagagtaagtgttggcagagagtcacccgcaaatgccatgaggacgagaactgtatctctacactgagtaagcaggatctgacttgctctggatccgacgactgtaaagccgcttacatcgacatcctcggcaccgtgttgcaggttcaatgcacttgccgcacaatcacccaatcggaggagtcgctttgtaagatttttcaacatatgctacataggaagtcttgcttcaactacccaacactgtccaatgtgaaaggcatggcgctgtatacgagaaaacacgccaacaaaatcacactgactgggtttcacagccctttcaacggcgaggtaatttatgccgccatgtgtatgaccgttacatgcgggattctgctgctcgtcatggtcaagctaagaaccagcagaatatcctcaaaggcgcgcgaccccagtagcatccaaatcccaggcgaactgtag

SEQ ID NO: 26547 - DNA, 1593 bp, Artificial Sequence
  Description of Artificial Sequence: Synthetic coding sequence
atgctcctctggcctctgctgctgctacttctcttactccccaccttagctctgttaagacagcaacgatcgcaggacgcccgactctcatggctggccgggctgcagcatagggtcgcctggggcgccctcgtttgggccgccacctggcagcgtcgcagactcgagcagtctacccttcatgtgcaccagtctcagcagcaggccctcaggtggtgccttcaaggggcgcaacggccacactgtagcctccgaagatctactgatatctccacctttcgcaaccatcttccacttactaaagcctcacaaacacagcaggaagactctggggagcaacccctgcccccaaccagtaatcaggacctgggagaagccagcctgcaggctactttattagggctggcggcactgaacaaagcataccctgaggtccttgctcaggggagaacggcaagggtgacgctgactagtccttggcctcgacctctaccctggcccggcaacacgctgggacaggtgggtacgccagggacaaaagaccccagagccttattactcgacgcactgagatcgcccgggttgcgagcattagaagctggcactgccgtcgaactcctggacgtgtttctaggtcttgaaacggacggcgaggagctggccggggccatcgctgctggaaatcccggtgctcctctgagagagcgcgcagcggagttgcgcgaggccctggagcaggggcccagaggcctggcactcagactgtggcccaaactccaggtggtggtcaccctcgatgcggggggacaggcggaggccgtggcagccctgggagcgctgtggtgtcagggcctcgccttcttctcaccagcctatgcggccagtggcggcgtactcgggctcaatctgcagcccgagcagccccacggcttgtatctcttgcctccaggcgccccattcatagaactgttacccgttaaggagggcacccaagaggaggctgcaagcaccttattgctcgctgaagcccagcagggtaaggagtatgaactggtcttgaccgatcgagcctccctgacccgctgtcgcctgggcgacgtggtccgggtggtgggcgcttacaatcagtgcccagtagtcagattcatctgtcgactcgaccagaccctgtcagttaggggggaggatatcggtgaggacctgttttctgaggcgctcgggagggcagttggccagtgggcaggcgcaaagctcctagaccacggatgcgttgaatctagtatcctggatagctctgcaggaagtgcccctcattatgaggtgttcgtggctttaagggggctcaggaacttgagcgaagagaatcgggataaactcgatcattgtctacaagaagccagcccgcgatataaatctttgcgcttttggggtagtgtgggccccgccagagtgcaccttgtcggacagggagccttccgagccctaagagctgccctggcggcttgcccatctagtccatttccgccagccatgcctcgggtgctacggcaccggcatctggcacagtgcctacaagaacgggtggtatcttag

SEQ ID NO: 26548 - DNA, 1425 bp, Artificial Sequence
  Description of Artificial Sequence: Synthetic coding sequence
atgcttctgtggccgctactgctactgctccttctgttacctacactggccttgctccggcagcagcgtccccattgctcacttagaaggagtaccgatatttctacattccgcaaccatctgcctctcacgaaggcttcccagacacaacaagaggactctggagaacagccactgcctccaaccagcaaccaagatctgggcgaggccagccttcaagccaccctcctgggcctggcagctcttaataaggcctaccccgaggtgctcgcacaaggaagaaccgccagggtaacgctgacctcgccctggccccggcccctgccatggccagggaatactctgggtcaggtcggaacgcccggtacaaaagatcccagggccttgttactggatgcccttagaagccccggactgagagctctcgaagcagggaccgccgttgaacttctggatgttttcctcggtctcgagaccgacggggaggagctcgcaggcgccattgcagcaggaaaccccggagcccctctgcgggaaagggcggcagagctgagagaggccctggagcaaggcccacgcgggctcgcattaagactctggcctaaactgcaggtggtggtcaccctggacgcaggcgggcaagccgaggcagtggcggcccttggagccctttggtgccaaggactggccttcttctccccagcctacgcagcgtctggtggcgttctgggactcaatctgcagccagaacagccccacggcttatatttgcttccacccggtgccccctttattgagctgttacccgtcaaggagggcactcaggaggaggccgcgtccacactgcttctggctgaggcacaacagggcaaggagtatgaactcgtcttgactgatagggcatctctgacccggtgtcgactgggtgatgtcgtcagagtggtgggggcttataaccagtgccccgtggtgagatttatttgccggctggaccagacgctgagcgttcgaggcgaggacatcggcgaggatttattttccgaggccttgggcagggcggtgggacagtgggccggagcaaagctgttagaccatggctgtgtggaatcatccattctcgacagctcagctggatcggccccgcattatgaggtttttgtggctctccgcgggttgcggaacttatctgaggaaaatagagacaaactggaccactgcttgcaggaagcctctccacgatataagtccctccgtttttgggggtcggtgggcccggcccgggtgcacctggtgggacagggtgctttccgggccctgcgtgccgctcttgccgcctgtccctcctcaccttttcccccagcaatgcctcgcgtgttgcgtcatcgtcacctagcgcagtgcctccaagagcgggtggtatcctag

SEQ ID NO: 26549 - DNA, 1425 bp, Artificial Sequence
  Description of Artificial Sequence: Synthetic coding sequence
atgcttctgtggccactgcttttactgctgttgctcctgccaaccctcgctcttctgaggcagcagagatcacaggacgcccgcctatcttggctggccggccttcagcatagagtcgcctggggtgctctggtatgggccgctacatggcagagacgacgcctcgaacagtcaactttgcatgtccaccaatcccagcaacaggccctgagatggtgtcttcagggagcacagaggccccattgtagcttgagacggagcactgatatatccaccttccggaatcacctcccgctaaccaaagccagtcaaacccaacaggaggactccggcgaacagccacttccacctactagtaatcaggatctgggggaagcctctttacaagccaccctgttgggattggcagcgctgaacaaggcatatcctgaggtgcttgcccagggcagaactgcaagagtaaccttgacaagcccgtggccaagacccctgccatggcccgggaacacactggggcaagtgggcacacccgggacaaaggatcctagagcccttctactggatgccctgcggtccccaggcttgcgggccctggaggctgggacagcagtggaattactagacgtgttcttaggactggagacagacggcgaagagctcgctggagctattgctgcaggcaatcctggagctcccttgcgcgagcgcgccgccgagttgagggaggctctggagcagggcccccgaggtctggccctcaggctttggcccaaactccaggtggtggtgacattggacgctgggggtcaagccgaggctgttgctgctctcggcgctctctggtgccagggacttgctttcttctccccagcctacgccgcttcgggtggtgtactgggcctgaaccttcagccggaacaacctcatggcctttacttgctaccgccgggcgcaccctttatagagctactgcccgtcaaggaggggacccaagaggaagctgccagcaccctgcttcttgcagaggcccagcagggcaaggaatacgaactggtactgactgacagggcaagcctgacaagatgtcggctgggcgacgtggtgcgagtggtcggcgcttacaaccaatgccctgttgtccggtttatttgtaggttggaccagaccctctccgtccggggggaggacatcggggaggacttgtttagcgaggccctcggtcgggccgtggggcagtgggctggagcaaaactgcttgatcatgggtgcgtcgagtccagcatccttgagtggggccggaccgatcgagcagaagatacgaggctgggctcctgcccattcacaggttctatgtgcgctcacggagtgtattcacagatccctttgcgggccctgctccccactacccgttgcttgtggaggtag

SEQ ID NO: 26550 - DNA, 1476 bp, Artificial Sequence
  Description of Artificial Sequence: Synthetic coding sequence
atgctgctgtggcccctcctgcttttactcctgctactcccaacacttgctcttcttaggcagcagcgaagccaggatgcacggctaagttggctggctggacttcaacaccgcgtggcatggggagctctggtgtgggctgcaacttggcagagacgaaggttggagcaatccactttacatgtccatcagtcacagcagcaggctctccgatggtgtctgcaaggtgcccagagaccccattgctctcttagaaggtcaactgatatctccacctttcgaaaccacctacccttgaccaaggcataccctgaagtcctggcccagggaaggaccgcccgcgtgactctcacgtccccgtggcctcgaccgctgccctggccaggtaatacattagggcaggtcgggacaccagggactaaagacccccgcgccttgctgcttgacgcgttaaggagtccagggctgagagcccttgaggccggaaccgctgtagaactcctggatgtgttcctggggctggaaactgacggggaagaactcgctggggctatagcagctggcaatccaggagctcctctccgcgaaagagcagccgagctacgcgaagccctcgaacagggccccaggggcctggccctgcgactatggcccaaactgcaggttgtggtgacacttgacgctgggggtcaagcggaggcagtggccgccttaggcgccctctggtgtcagggcctggctttcttctcacccgcatacgctgcctccgggggggtcctgggcttgaatctccagcctgaacagcctcacggtctatatctcctgcctcctggcgcaccttttatcgagctattgcccgttaaagaaggtactcaagaggaagctgcgagcactctgctgctggccgaagcgcagcagggcaaagagtatgagttggttttgactgatagagctagcttgacacgctgccggctcggggacgtcgtgagagtcgtgggagcctacaatcagtgtcctgtggtgcgcttcatctgtagactggaccaaacactgtccgtacggggagaagacattggcgaagatctattcagcgaggcactcggtagggcagtcggccagtgggctggcgccaagttgctcgatcacgggtgtgtggagagcagcatcctggattcgtctgctggctctgccccacattacgaagtattcgtcgctctgagggggttaaggaatctcagcgaagaaaatcgcgataagttggaccattgcctgcaagaagcgtccccacggtacaagagtctacggttctggggctcagtggggccggccagagtgcatctggtgggccagggtgcatttcgggcccttcgtgctgcgttggccgcttgtccgagctctcccttcccaccggccatgccgagggttttgcgtcacagacatctagcccagtgtctccaggaacgggtggtctcctag

SEQ ID NO: 26551 - DNA, 1425 bp, Artificial Sequence
  Description of Artificial Sequence: Synthetic coding sequence
atgctcctgtggcccctgctgctattgctactgcttctgccaaccctagccctactgcgacagcagaggtctcaggatgcccgcctgtcatggctggccggtctgcagcaccgggtcgcctggggcgcccttgtctgggcagcaacgtggcagaggagacggctggagcaaagtacactgcatgtgcaccagagccagcagcaggctctcagatggtgtctgcaaggcgcccagcgaccccactgttctttgcggcggtccaccgacatctcaactttcaggaatcacctgcctttaaccaaggcaagccagactcagcaagaggatagcggtgagcagccgctcccccccaccagcaatcaggatttgggtgaagctagcctgcaggccacattgcttgggctcgcagccctcaataaggcttaccctgaagtgttggctcagggccggacggcacgcgtgacactaactagcccatggccacgacctctcccatggcccgggaatacgctaggccaagtgggcacacccgggacaaaggatcctcgggccctgctgctggacgcattgcggtcccctgggctgcgggcactcgaggcagggacagctgtggaactcttggacgtgtttttggggctagaaacagacggcgaagagctggcgggtgccattgcagcgggaaacccgggggcccccttgcgggagagagccgcagagctgagagaggccttggagcagggacctcgcgggctggcgttgcggctatggcctaagctgcaggtggtggtgacactagacgccggaggtcaagcagaagccgtggcagccctgggcgctttgtggtgtcaaggcctggcctttttcagccctgcttacgcggcctctggaggggtactaggactcaatctgcaaccagagcagccacacggtttgtacctgctccccccaggcgctccatttatcgaactgttaccagtaaaggagggaacacaagaagaggcagctagcaccctccttctggctgaggctcagcagggtaaagagtacgagctggtgctgaccgatagggcctctcttacccgatgtaggctgggcgacgtagtacgggtggtcggggcctataatcagtgtcccgttgttagatttatctgtaggctcgatcagactttgagcgtcagaggggaagacatcggggaggatctgttcagtgaggctctcggccgggcagtcggccagtgggcgggggcaaaactgctggaccatggctgcgttgaaagtagtatcctggagtggggccgtactgaccgagcagaggacactcggctcgggagctgccctttcacaggttccatgtgcgcacacggcgtctatagccagatccccctgcgcgccctgctgcctaccactaggtgcctgtggcggtag

SEQ ID NO: 26552 - DNA, 1593 bp, Artificial Sequence
  Description of Artificial Sequence: Synthetic coding sequence
atgctgctctggcctctgctgctgctcttgcttctactccccaccctggcattgctacgacagcaacggtcacaggacgccaggttgtcgtggctcgctggcctgcaacatagagtggcctggggcgcactcgtctgggctgctacctggcagcggcgccgtctagaacagtctactctccatgtgcaccagagtcagcagcaggccctccgttggtgtttacagggagcacagcgaccacactgcagcctgcgcagatcaaccgatatcagcacttttaggaatcacttgccattaactaaggcaagccagacgcagcaggaggacagcggagaacagccactgcccccaacgagcaatcaggacctcggcgaggcgtcgctgcaggccactttgcttgggctcgctgccttaaataaagcatacccagaggtgctcgctcaaggacgtacagctcgcgttaccctgactagcccttggcccagacctctgccctggcccggaaataccttaggacaagtgggcactcccggcactaaagacccccgagccttgctgttagacgccttacgaagtcccggtctgcgggccctcgaggccggcacggccgtggaacttctggatgtctttctgggcctggagacagacggtgaagagctcgcaggggccattgccgcagggaatcctggtgccccgctgagagaacgcgcagccgaactgcgtgaggccctggagcaaggccctcgtggacttgccctccgattgtggcccaagctacaagtcgtggttaccctcgacgctgggggacaggccgaggccgtagccgccctgggcgccctgtggtgccaggggctggcatttttctctcccgcttatgcggcaagtggaggtgtgctgggactcaacctgcagccagagcagcctcatggtctttacttactgcctccaggcgctcccttcattgagctgcttccagttaaggaggggactcaggaggaggcggcttctaccctcttgctggctgaagcccagcagggcaaagagtacgagttggtcctcacagaccgtgcctctctcacccggtgtcgtctcggagacgtcgtgcgggttgtgggtgcctacaaccagtgccccgtagtaagattcatctgtcggctcgaccagacgctctcagtgcgcggcgaagatatcggggaagacctcttctcggaagccctgggcagagcagtggggcagtgggccggcgctaagctactcgaccacgggtgtgttgaaagtagtatactagattccagcgcaggctctgctccacactatgaggttttcgtggccttgcgaggcctgcggaatttatcggaagagaacagagataagctcgaccactgtctgcaggaggcgtctccccgctataaatctctccgcttttggggatcagtagggccagcgagagtgcacctggtgggccaaggggctttcagggccctgagagcagcattggccgcctgtccaagcagcccctttccacccgccatgccgagggtgctgcggcacagacaccttgctcagtgtctccaggagagggtcgtgtcatag

SEQ ID NO: 26553 - DNA, 1002 bp, Artificial Sequence
  Description of Artificial Sequence: Synthetic coding sequence
atgccgttgggcctcggcaggcggaagaaagctccaccgctagtggagaacgaagaagccgaaccaggcagaggcgggcttggcgtgggtgaacctggccctttaggtggcggagggagcggcggcccacagatgggactgccccccccaccacccgcactccgtcctagactcgtgtttcatacccaacttgcgcacggatcacccactggcagaatcgagggatttactaacgtgaaggaattgtacggaaagattgccgaagcctttcgcctcccaaccgcagaggtaatgttctgtacacttaatacccataaggttgacatggacaaactactgggaggccagataggactggaagatttcatatttgcccatgttaaaggtcagaggaaagaggttgaggtgttcaaatcggaggacgccttgggtctcactataacggataacggggctggctatgcctttatcaagcgcatcaaggagggctccgttatagaccacatccatctcatctccgttggtgatatgattgaagccataaatggccaatcactgttgggctgccggcactatgaagtggcccgtcttcttaaagaactcccacgcgggaggacattcacacttaagctgacggagccccgcaaggctttcgacatgatcagccagagatctgcgggcggaaggcccggatctggcccacaactggggactggaagaggtaccctccgacttcggtcccgtgggcctgctacggtggaagatttgccctctgctttcgaggagaaagcgattgagaaagtggacgatttgttggagtcgtacatgggcatacgagacacagagcttgccgcaaccatggtggaactaggcaaggataaaagaaacccagacgaactggccgaggcgctggacgagaggctgggtgactttgcatttccggacgagttcgtattcgacgtgtggggagcaatcggagacgcgaaggttggtaggtattag

SEQ ID NO: 26554 - DNA, 1002 bp, Artificial Sequence
  Description of Artificial Sequence: Synthetic coding sequence
atgccgttgggcctagggcggcgcaagaaggcccctcccctggtggagaatgaggaggcggagcctggaaggggcggcctaggagtgggggaacccggtccgcttggcgggggcggtagcggtggcccacagatgggtttaccaccccctccacctgccctgcgccccagactggtgttccatactcagctggcgcacggatcccctaccggacggattgaggggttcacgaacgtcaaggaactgtatggaaagatcgctgaggctttccgtctcccaacagcagaggtcatgttttgcactttgaatactcacaaagtggacatggacaagctgcttggcggtcaaatcggattggaggactttatctttgctcatgtcaaaggacagcgcaaggaggttgaggtctttaaaagtgaagacgccctcggtctgacgatcacagacaacggagcgggatacgccttcataaaaaggatcaaagaagggagtgtgatagaccacatccacctcattagtgttggcgacatgatcgaagctattaatggtcagtccctcctcggctgtcggcattatgaagtggcgcggttactcaaagaactgcccagaggaaggacattcacgctcaagcttacggagcctcgcaaggctttcgacatgatttcgcagcggtccgctggaggacgaccggggagcggcccgcagctcgggacgggcaggggcaccttaagactcagatcgcgcggtccagccacagtcgaagatttgccgagcgcttttgaggagaaggctatcgaaaaagtcgatgacctactggagtcttatatggggatcagagacactgaattagctgccactatggtggaacttggcaaggacaaaagaaatcccgacgagctcgcagaggccctggacgagcgcttgggcgatttcgccttcccagatgaatttgtgttcgacgtgtggggggctatcggcgacgcaaaagttggtcggtactag

SEQ ID NO: 26555 - DNA, 711 bp, Artificial Sequence
  Description of Artificial Sequence: Synthetic coding sequence
atgttctgcaccctgaatacacacaaagtggacatggacaaactgctggggggccagatcggattggaggattttatcttcgcacatgttaagggccagcgcaaggaagtggaggtgttcaaaagcgaggatgcactcggcctgacgataaccgacaatggagcgggatacgcctttatcaagaggatcaaagagggctcagtgatcgaccacatccacctcatttccgtgggcgatatgatcgaagcgatcaacgggcagtcactgctgggctgtcgtcactatgaggtggcgaggctgctgaaggagctgccgcgcggcaggacatttactctcaaactcaccgaacctcgcaaagctttcgatatgatctcccagaggtctgctggtggccggccaggtagcggaccacagctcggtactggccgcggtacactgaggttacgctcccgagggcctgccacggtcgaggatctgcccagtgcatttgaggaaaaggctatcgagaaagtggatgacctgcttgaaagctacatgggcatccgtgatacagagctggcagcgaccatggtcgaactgggaaaggacaagcggaatccagacgagctcgccgaggccctggatgagagacttggtgacttcgccttcccagacgagttcgtctttgacgtctggggagccatcggcgacgctaaggtgggacggtattag

SEQ ID NO: 26556 - DNA, 711 bp, Artificial Sequence
  Description of Artificial Sequence: Synthetic coding sequence
atgttctgtactctgaatacacacaaggtggatatggataaactcctcggaggtcagatcggcttagaggattttatatttgcccacgtgaaggggcagaggaaggaggttgaggtctttaagtccgaagatgcccttggcttaaccattacagacaatggagccggttacgcttttatcaagcgaatcaaagaaggatcagtaatcgatcacatacacctgattagtgtcggcgacatgatcgaagctatcaatggccagtccctgcttggctgtaggcattacgaggtcgcacgcttgttgaaagagctgccccgcggacgcacatttacacttaagctgactgagcctcggaaagcatttgacatgatatcacagcgaagcgctggaggtcgcccaggcagtggcccccaacttggaactggaagaggaaccctgcggctgagatctcgcggtccagccactgtggaggatctgcctagtgcgtttgaagagaaagcgatagaaaaggtggatgatctccttgagtcttatatgggcatccgcgacaccgagcttgccgccactatggtggaacttggcaaagataaaagaaaccccgacgagctggcagaggctttagacgagcgcttaggcgacttcgccttccccgatgagtttgtgttcgacgtttggggggcaattggggatgccaaggtgggccgctattag

SEQ ID NO: 26557 - DNA, 1002 bp, Artificial Sequence
  Description of Artificial Sequence: Synthetic coding sequence
atgccgctaggtctagggcgcagaaagaaagcgccgccccttgtagagaacgaagaggccgagcctgggcggggaggcctgggtgtgggtgagcccggcccactgggcgggggcggcagcggcggcccacagatggggctgcctccaccgccgcccgccctgagaccacgcctggtgttccacacccagctggcccacggatctcctaccggacggatcgagggatttactaacgtgaaggagctgtacggaaagatcgcagaagctttcaggttgcctaccgctgaggtgatgttctgtacccttaatactcacaaggtggatatggataagttactcggaggacagattggtctggaggattttatcttcgcacatgtgaagggtcagagaaaagaggtggaggtcttcaaatctgaggatgcgttgggattgacaattaccgacaacggagctggatacgctttcattaaaagaatcaaagaaggaagcgtcatagatcatatccacctgatcagtgtcggggacatgatcgaagccatcaacggccaaagcttgttggggtgtaggcactatgaggtcgcacggcttcttaaggagcttccacggggacgaacattcactttgaaactcactgagccccgtaaagcttttgatatgattagccagcgctcagctggagggcggcccggctcaggtccacagctcggaaccggacgcggaaccttgcggctgaggtccagaggacccgcaacggttgaagatctacccagtgccttcgaagaaaaagcaattgagaaggtcgacgaccttttggagagctatatgggaatccgcgacaccgagctagccgccacaatggtcgaattgggcaaggacaagcgaaaccctgacgagttagccgaggctctcgacgaacggcttggcgactttgccttcccagacgaatttgtttttgacgtttggggcgctatcggggacgccaaggtgggtcggtattag

SEQ ID NO: 26558 - DNA, 762 bp, Artificial Sequence
  Description of Artificial Sequence: Synthetic coding sequence
atggaggcggctcgaccattcgcacgcgaatggcgggcacagtccttacccttggcggtgggaggcgttctcaagctcagactgtgcgaactgtggttgctcctgctcgggagttccctgaatgctcggtttttacctgatgaagaggatgtcgactttatcaatgagtacgtgaatcttcataatgaattaaggggggacgtgatcccacgtggctcaaatctgcgatttatgacctgggatgtggctttaagccgcacagctagggcgtggggtaaaaagtgtctgttcactcataatatctacctgcaggacgtgcagatggttcatccaaaattttacggtataggggaaaacatgtgggtggggcctgaaaacgagttcactgcctctatcgccattaggagttggcatgccgagaagaagatgtacaatttcgagaacggatcctgttccggagattgctccaactacatccaattagtctgggaccactcttataaggtggggtgcgcagtgacaccatgctctaagatcggccacatcattcacgccgctattttcatctgcaattatgcccctgggggcactttaacaagacggccatatgagccaggaattttttgtactcggtgcggaagaagagataaatgcaccgacttcctgtgctccaagatcaaaaagatcaacatgaagaagatgcacaacggtctcgacaaaaaaaacaagagactcaatacatctttcctctggtcatgctag

SEQ ID NO: 26559 - DNA, 321 bp, Artificial Sequence
  Description of Artificial Sequence: Synthetic coding sequence
atggaggccgctagaccatttgcccgggagtggcgggctcagtccctacccctggcggtggggggcgtgctcaaacttcgactgtgcgagctgtggctgttgcttttaggaagttcactcaacgctaggtttcttccagatgaggaagatgtcgacttcattaatgagtatgtgaaccttcacaacgaattgcggggggacgtgatcccgagaggctctaacctccggtttatgttgtggtactgttgtgatagcgacggtagtaggtttataatcggatttccgaacctgagcccccggaccccgtctgcccctctgtag

SEQ ID NO: 26560 - DNA, 714 bp, Artificial Sequence
  Description of Artificial Sequence: Synthetic coding sequence
atggtgcacccgaagttttatggtataggcgagaacatgtgggtgggaccagagaatgagttcacagcgtccattgctatccgctcctggcacgctgagaagaaaatgtacaacttcgaaaatgggtcatgttccggagactgcagtaactatattcagctggtgtgggaccatagctacaaggttggatgcgctgtgacaccctgttctaaaatcggtcacataatacatgctgccattttcatctgtaactacgcacccggcggtactttgactcgtcgcccttatgaacctggcatcttttgtaccagatgcgggcgcagggataagtgtactgatttcctctgctcaaacgccgaccgggaccaggccacctattatcggttctggtaccccaaatgggaaatgcccagaccagtggtatgtgatccgctgtgcacatttattctgctcctaaggattctgtgttttatcttatgcgtgatcactgtgctgatcgtccagagccagtttcctaacattctgctagaacagcaaatgatcttcactcccgaggaatctgaagctggtaacgaagaggaagagaaggaagaggagaagaaggaaaaagaagaaatggagatggaaatcatggagatggaggaggagaaagaggagcgcgaagaggaggaagaggagacacagaaagagaagatggaggaggaggagaagtag

SEQ ID NO: 26561 - DNA, 507 bp, Artificial Sequence
  Description of Artificial Sequence: Synthetic coding sequence
atggaagccgcccgcccttttgcccgggaatggcgggcacagtcattgcctcttgccgtgggaggcgtgctcaaactcagactgtgcgaactctggctgcttctgctggggtcctccctcaacgcacggtttctgcccgacgaggaggacgtcgacttcataaatgaatatgttaacttgcacaacgagctgagaggggatgtgatacccaggggctctaacttgcgcttcatgacatgggacgtggccctgtcccgcacagccagagcatggggtaagaagtgcctgttcacacataacatctacctacaggacgttcagatggtacaccctaagttctatggaataggcgaaaacatgtgggtgggaccggagaatgagttcactgcttccattgccattcggtcatggcatgcagaaaagaaaatgtataactttgagaacgggagctgcagtggcgactgttcaaactatatacagcggaatactgatgaaaaaacactttag

SEQ ID NO: 26562 - DNA, 840 bp, Artificial Sequence
  Description of Artificial Sequence: Synthetic coding sequence
atgctgattacgatgattttacaccgtgcccgcacaaagacgtgggacgtggctctctctcgaacagctagagcctggggaaaaaaatgtctctttacccacaacatttatttacaagacgtgcaaatggtgcaccctaagttttatgggataggcgagaacatgtgggtgggacccgaaaatgagttcaccgcttctatagccatccgaagttggcatgctgagaagaagatgtacaactttgaaaatggaagttgcagcggcgattgttctaactacatccagctggtgtgggatcacagttacaaggtggggtgtgctgtgaccccatgctccaagattgggcatatcattcacgcagctatatttatctgtaactacgcccctggaggaaccttaacaagacgcccttacgaaccaggcatattttgtaccagatgtggacggcgggataagtgtaccgatttcctgtgtagcaatgccgaccgggatcaagccacctactataggttctggtacccaaagtgggagatgccgcggccagtggtctgcgatccactttgtactttcatcctgctcctgcggattctgtgtttcattctgtgtgtcatcactgttctcatcgttcagtctcagttccctaatatcctccttgaacagcaaatgatctttacaccagaggaatccgaggctggtaacgaggaggaagagaaggaagaagaaaagaaggagaaagaagagatggagatggagatcatggaaatggaagaagaaaaagaggagcgcgaagaggaggaagaggagacacagaaagaaaaaatggaggaagaggaaaagtag

SEQ ID NO: 26563 - DNA, 1035 bp, Artificial Sequence
  Description of Artificial Sequence: Synthetic coding sequence
atggaggctgcaagaccttttgctcgagagtggagggcacagtcgctgccccttgccgtaggcggagtcttgaaattaagactttgcgagctgtggctcctgctgcttggctcctcactcaacgccaggttcctcccggacgaggaggacgttgattttattaacgaatacgtgaatctgcacaacgagctcaggggagatgtgattcccagaggatccaatcttaggtttatgacatgggacgtcgcgctatccagaaccgcccgcgcatgggggaagaaatgtctgtttacacataacatttacctgcaagatgtgcagatggtgcaccccaagttttacgggatcggggaaaatatgtgggtgggtccagagaatgaatttacagctagcattgcaattaggagctggcacgcagaaaaaaagatgtataatttcgaaaacggctcgtgcagcggtgactgcagcaattacatccaactcgtatgggatcactcctataaggtgggctgtgccgtgaccccctgctctaaaatcggtcacatcattcacgcagccatcttcatttgtaattacgcccctgggggaaccctcacccgtcggccttacgagccaggaatcttctgcacaaggtgtgggcggcgtgataagtgcacagatttcctatgctcaaatgctgatagggaccaggcgacatattaccgattctggtatccaaagtgggagatgccaagaccagtggtgtgcgatcccctatgcacatttatcctccttcttaggattctctgctttatcctgtgcgtcatcactgttctcatcgtgcagtctcagtttcccaacatcctgcttgaacagcagatgatctttacacccgaggaaagtgaagccggcaacgaggaagaagaaaaggaggaagagaaaaaagaaaaggaggagatggaaatggagatcatggagatggaggaagagaaagaagagagggaggaagaggaagaggagacgcagaaagaaaagatggaggaggaggagaaatag

SEQ ID NO: 26564 - DNA, 2544 bp, Artificial Sequence
  Description of Artificial Sequence: Synthetic coding sequence
atggccaagccacttacagaccaagaaaagcgtaggcaaatcagtatcagagggattgtgggagtggaaaatgtggccgaattaaaaaagagttttaatagacatttacatttcactctggtaaaagaccgaaatgtggcgacgaccagggactattactttgcgttggctcacaccgtaagggatcacttggtcggtcggtggatccggacccagcagcattattatgataaatgtcccaaacgggtgtattatcttagcctagagttttacatgggccgtaccctgcagaacaccatgatcaacttagggttgcagaacgcctgcgatgaggccatctatcagctcggcctggacatagaagaactcgaggaaattgaagaagatgcaggcctggggaacggtggtctgggccggttggccgcctgttttcttgatagcatggccaccctgggcctggccgcctacggctacggaataaggtatgagtatgggatttttaatcagaagataagagatgggtggcaggttgaggaagccgatgattggctgagatatgggaatccatgggagaaaagccgcccagaattcatgctgcccgtccacttctacggtaaggttgagcataccaacaccggaactaaatggatcgatacccaggtcgtcctggccctgccctacgacacacccgtccccggctacatgaataatactgtgaacacaatgcgtctctggtccgcacgcgcacccaacgactttaacttacgtgatttcaacgtaggagattacatccaagcagtgctggaccggaatctcgctgagaatatcagtcgtgtgctgtatcctaatgacaatttctttgagggcaaggaacttcgtttgaagcaggagtactttgtcgttgcagcaacactgcaggatatcattaggcgattcaaagcgagcaagttcggcagcacccgcggcgccggcacagtgtttgacgccttccccgatcaggtagctatccagctcaacgacacccaccccgctctggctattcccgagctgatgaggatctttgtggatatcgaaaagttgccttggtccaaggcttgggaactgacacagaagactttcgcctacacaaatcacactgtcctgcctgaagccttggaacgctggcctgtcgatctagtggagaagctcctgcctcgccacctggagatcatttatgaaattaaccaaaaacatctcgatcggatagtggccctcttccccaaagacgttgacagactgcgccgtatgagtctgattgaggaagagggttctaaaaggatcaatatggcgcatctttgtatagtaggatcgcacgctgtgaatggcgtggccaagatccacagcgacatcgttaagacaaaggtatttaaagattttagcgagctagagcctgacaagttccagaataagactaacgggatcacgccacgtagatggttgctcctttgtaacccgggactcgctgagctcattgctgagaagatcggggaagattacgtcaaagacttgagccagctgacaaagctgcacagttttctgggtgatgacgtgtttttgcgtgagttggctaaagttaagcaggagaacaagttgaaattcagccaattcctggaaaccgagtacaaggtgaagatcaacccaagtagcatgtttgatgttcaggtgaaacgcattcatgagtacaaacggcagctgctgaattgcctgcacgtgatcaccatgtataaccgtataaaaaaggatcctaagaagcttttcgtgccccgaacagtcatcattggcggtaaagccgctccaggctatcacatggccaaaatgattatcaagctaataacgtccgtcgctgatgtcgtcaataacgacccaatggtggggtctaaacttaaggtgatcttcctggaaaactatagggtctccttggccgaaaaagtcattccagccacagacctgtcagaacaaatctcaaccgccggcaccgaagccagtgggaccggcaacatgaagttcatgctgaatggagcactgaccataggcacaatggatggtgctaacgttgagatggctgaagaagccggggaagagaacctatttatcttcggcatgcgaatcgacgacgtcgccgcgcttgacaagaaggggtatgaggccaaggagtactatgaagcactccccgagctgaaactggtgattgaccaaatagataatggtttcttcagtcccaagcaaccagatctttttaaggacattatcaatatgcttttctaccatgatcggtttaaggtgttcgccgactatgaagcctacgtaaagtgtcaggataaagttagtcagctgtacatgaatccaaaagcctggaatactatggtcctgaaaaacatcgccgcttccggaaagtttagttctgacagaactattaaagaatatgctcagaatatctggaacgtggaaccaagtgatctcaaaatttccctgtccaatgaaagtaataaagtgaacgggaattag

SEQ ID NO: 26565 - DNA, 492 bp, Artificial Sequence
  Description of Artificial Sequence: Synthetic coding sequence
atgaaacctgatgagacacctatgtttgacccgagcctcctgaaggaagttgattggagccagaacactgccacattctcacccgcgatcagtcctacacacccaggtgaaggcctggttctgcggcctctctgtactgcggacttaaaccgcggattttttaaggtgcttggtcagctgacagagaccggagtcgtgtcaccagagcagttcatgaaatcatttgagcacatgaaaaagtcaggagattactacgtgactgttgtagaggacgtgacgctcggccagattgtggccactgcaacactaataatcgagcataaattcatccacagctgcgccaaaaggggccgagttgaagatgtggtggtatccgatgaatgccgcggcaaacagctaggcaagctgctgttgtccactctgacgctcttatctaagaaactcaattgctacaaaatcacactggaatgtttgccccagaatgtcggttag

SEQ ID NO: 26566 - DNA, 1362 bp, Artificial Sequence
  Description of Artificial Sequence: Synthetic coding sequence
atgaagatattcaagtgttatttcaagcacactttgcagcagaaagtgttcattctctttctgactctctggcttctgtctttgttgaaactgctcaatgtgaggcggctgtttccgcagaaggatatctacctcgtggagtactccctcagcactagcccattcgtacgtaatcgatatacgcacgtcaaagacgaagtgaggtatgaggtcaactgttcgggcatctacgagcaggaacctctggaaattggcaaaagtctggagatacggcggcgtgatatcatcgacctggaagatgatgatgttgtggcgatgacttcagactgcgatatctaccagactcttagaggttatgcccagaaactagtgagcaaggaggaaaagagcttcccaatcgcctattccctggtggttcacaaagatgctattatggtggagcggctcatccacgccatatacaatcagcacaatatctactgcatccattatgacaggaaggcccctgatacctttaaggtagcgatgaacaacctcgctaagtgcttcagcaatatcttcatcgcctcgaagctcgaagctgtagaatacgcccatatttctcgattacaagccgacttaaattgtttgtctgatctcctcaagtcatccatccaatggaaatacgttattaatttgtgcggtcaggacttcccgctgaagtccaatttcgaactcgtgtccgagctgaaaaaacttaacggggccaatatgctggagactgtaaaacccccaaacagcaaactggagcggtttacataccaccacgaactccgacgtgtgccctacgagtacgtcaaactgccaatacgcaccaatatatcaaaggaggctcccccgcacaacatacagatctttgtgggaagtgcatacttcgtgttaagccaggcgtttgttaaatacatcttcaataatagcatagtgcaggatttcttcgcctggtctaaagacacgtacagtcctgatgagcatttctgggctactctaatccgggtgccagggattcccggggagatctctcggtccgcacaggacgtgtcagaccttcagtcaaagacgcgtctggtgaaatggaactactatgagggcttcttttatccatcctgcaccggctcgcatttgcgctctgtgtgtatctacggtgcagccgagctgagatggctgattaaagacggtcattggtttgcaaacaagtttgattcgaaggtggatcccattctcattaagtgtctcgccgaaaagttggaggagcagcagagagactggatcactttgccttccgagaaactgtttatggacagaaacttaaccaccacgtcatag

SEQ ID NO: 26567 - DNA, 927 bp, Artificial Sequence
  Description of Artificial Sequence: Synthetic coding sequence
atgttcgtccaactactccgcgctatctatgtcccccaaaacgtttattgcatacacgttgacgaaaaagctcccatgaaatataaaaccgcggtgcagactctagtcaattgctttgaaaacgtttttatcagctcaaagaccgaaaaggttgcctacgcagggtttactcgtttacaggccgatataaactgcatgaaggtgctggtccacagcaagtttcagtggaattatgtaatcaatttgtgcggacaggacttccctatcaagacaaaccgagagattatccactatatccggtccaaatggagtgacaagaacatcacaccaggggtgatccaacccctgcatatcaaatcgaagacttcacagagccatcttgagttcgtgcctaagggatccatatacgctccgcccaacaataggttcaaagacaaacctcctcacaacttaacgatatactttgggagtgcctactacgtcctgaccaggaagttcgtggagttcattctcacagatattcatgccaaagacatgctgcaatggtctaaagatatcaggtctccggaacaacactattgggtaacactgaacaggctgaaagatgcacctggagccacaccgaacgcaggctgggaaggcaacgtgcgggctatcaagagaaagagcgaagaagggaacgtccacgacggttgtaagggacgctatgttgaagacatctgtgtgtacggacctggggatctgccctggcttatccaatcccccagcctcttcgctaataagtttgagccttcgaccgatccactggtggtgacctgtctggagcggcgtcacagactccaggtgctgcggcaggccgaagtgccgattgaacctcactggcacttccagcagcagagccatttcaatatgagattaaaccgctag

SEQ ID NO: 26568 - DNA, 519 bp, Artificial Sequence
  Description of Artificial Sequence: Synthetic coding sequence
atgagagattgttgtgggatggtttccagcgggagcctttcctccctcaaggccgcagagcgtacacctggagctctcttcttcagtagtagtacccctggtcgatattataattatgattctagcagcagaccacagagccgttcagtgatgtctgaccaatgcgccggccaatggtttctgaaagcctgcggcctaggtgagggcgataccgaggttttccccacccaacatgtggtgcgggctctccagacgatctttgagctgaatgtccaggccttcgctggcggggcaatgggcgccgtgaacggaatgcagcctcacggtgttccagacaaatcgagcgttcagtccgatgaggtatgggtcggggtggtttacggactcgcagctaccatgatccaggaggtgatgcattccttttcacacctctctacaatttgcattctcgctcagaagacaagcagtaccactaaattcctgcaaggaattacacagtgccacctagtgcgcctatag

SEQ ID NO: 26569 - DNA, 2634 bp, Artificial Sequence
  Description of Artificial Sequence: Synthetic coding sequence
atgggaactcaggacccggggaacatggggaccggagttccagctagtgagcaaatttcttgcgcaaaagaggatccacaagtgtactgtcctgaggaaaccggcggaaccaaggatgtgcaggtgacagattgcaagagccctgaggatagccggccacctaaggagactgactgctgcaatcctgaggattctggccaacttatggtttcttacgagggtaaggccatgggttaccaagtcccaccattcggctggaggatctgtttagcccatgagtttactgagaaacgaaagccattccaggcgaacaatgtgtccctcagcaacatgatcaaacatatcggcatgggtctgagatacctacagtggtggtacagaaaaacccacgtggaaaagaaaaccccctttatcgacatgattaactctgtacccttgagacagatctatggttgcccccttgggggcattggtggcggtactataacaaggggatggcgggggcagttttgtaggtggcagttgaatccaggtatgtatcaacacagaactgtcattgcggaccagtttaccgtgtgtctcagaagggaggggcagaccgtgtatcagcaggtcctgtctctagagcgaccttcagtgttgcgatcatggaattgggggctgtgtgggtacttcgctttttaccacgccttatatcctcgggcatggactgtgtaccagcttcccggccagaacgtgactctgacttgtcggcagattactcccattctgcctcatgattatcaggacagctctctgcccgtaggagtctttgtctgggatgtggagaatgagggcgacgaggccctggacgtgtccatcatgttcagtatgagaaacgggctgggcggaggggacgatgcccctggaggactttggaatgagccattttgccttgagcgatcaggggaaactgttcgggggttgcttctgcaccaccctaccttgcctaacccctataccatggcagtggcagcgagggtgactgctgccaccaccgtgacgcacatcaccgcctttgaccctgactccacagggcagcaggtgtggcaggacctccttcaagatggccagcttgattctccaaccggtcagtccactccaacccagaagggggtgggaattgccggcgctgtgtgcgtttcaagcaaactgcgtccgaggggacaatgcaggcttgagttttctcttgcctgggatatgccgcgaatcatgtttggggcaaaaggccaggttcattacagacgctacacacgtttttttggtcaagacggggacgcagcgccagcactgagtcactatgccctctgcaggtacgctgagtgggaggaaagaattagcgcgtggcagtccccggtactcgacgaccggtccctaccggcctggtataagagcgctttgttcaatgagctatacttcttggcagacggaggcactgtttggttggaggttttggaggatagtctgcccgaggaactcggccgcaacatgtgccatttaagaccgacattgcgagactacggcagattcggttacctggaggggcaggaatatcggatgtataacacctatgacgtgcatttctatgcgagttttgcgctgattatgttgtggccaaaactggagctatcactccagtacgacatggccctggccacactgcgcgaagatctgaccagacgtaggtacctcatgagcggcgtgatggccccagtgaagcggcgtaatgtgataccacacgatataggagatcctgatgacgagccctggttacgggttaatgcttatctgatacatgacactgcagactggaaagacctcaacctgaaattcgtcctgcaggtttaccgtgattattatctgacgggcgaccagaacttcctaaaagatatgtggccggtgtgcctagctgttatggaaagcgaaatgaagttcgataaagatcatgacgggcttatcgagaatggcgggtatgctgatcaaacatacgacggctgggtgacaaccgggccgagcgcttactgtgggggcctttggctagccgccgtagccgtcatggtgcaaatggccgccctctgtggcgcccaggacatccaggataagttcagctccattctttcccgaggacaagaagcatacgagcgtctcctctggaatggcagatactacaactatgacagcagctctagaccccaaagtagatctgtcatgtcagaccagtgtgccggccagtggttcctaaaggcttgtgggttgggagaaggcgatactgaggtatttccaactcaacatgtggtgcgggccctgcaaaccatctttgagctgaatgtgcaggccttcgccggcggcgctatgggtgctgtgaatggcatgcagccacacggggtgcccgataagagtagtgtgcagtctgatgaggtgtgggtgggagttgtctacggtttggccgctaccatgatccaagagctcctaccaagcggcttctgcttatgggtgatcgtgatctcaagtacttgttgggaattgttggagggcaaggatagcaccgccagcatctatcccgtggaggtggctctgcagagggtgcccagctag

SEQ ID NO: 26570 - DNA, 2784 bp, Artificial Sequence
  Description of Artificial Sequence: Synthetic coding sequence
atgggcactcaggatccagggaacatgggtactggggtgcctgcctctgagcaaatctcttgtgccaaagaggacccccaagtgtattgtccagaggagactggcggcaccaaagacgtccaggtgactgactgcaagtctccagaggatagtaggcccccaaaggagactgactgttgcaacccagaggactccggtcaacttatggtctcatacgagggcaaggccatgggctatcaagtcccgccctttggctggagaatatgcttagctcacgaatttacagaaaagaggaaacctttccaggccaacaacgtgtcgctctctaatatgattaaacacattggcatgggactcagatacctgcaatggtggtataggaagacccacgtggaaaaaaaaacacctttcatcgatatgataaactctgtgcccctccgacagatttatggttgtccccttgggggcattgggggaggaacgattactcggggatggcggggccaattttgtcggtggcagttaaaccctggaatgtaccagcacaggacggtgatcgctgaccaattcactgtatgcctgcgacgggaagggcaaacagtgtatcagcaggtgctttccctggagcgtccaagtgtcctccgtagttggaactggggtttatgcggctattttgcattttaccatgcgctttatcctcgcgcttggacagtataccaattaccaggccaaaatgtgacactaacatgccggcagattactccgattctcccgcacgattaccaggacagcagcctgccggtgggcgtgttcgtttgggatgtggaaaacgagggggacgaggccttggacgtttccatcatgtttagcatgagaaacggtctcggggggggcgatgatgcccctggtgggctgtggaatgaacccttctgcttggaacgatccggggagaccgttagggggcttctgctgcatcaccctacactgcctaacccttacacgatggctgtagcagctagagtcactgcagccactaccgtcactcacatcaccgcgttcgacccagattcaactggccagcaagtttggcaggacttgttacaggacggtcaactagattcccccacaggacagtctactcccactcaaaagggggtcgggatcgcaggagctgtctgcgtttccagcaagctccgcccccgggggcagtgcaggttggagttctctctagcctgggatatgccacgaatcatgttcggagccaaagggcaggtgcactatcggcgctatacgcggtttttcggacaagacggagatgcagcccccgcacttagccattatgcactttgtcgctacgccgagtgggaggagagaatatctgcatggcaatcacctgtattggacgataggtcacttcccgcctggtataagtcagcactcttcaatgagctctatttcctggcagatgggggaaccgtgtggttagaagtgcttgaggacagcctacctgaagaactaggcaggaacatgtgccatttgagacccacccttcgggattacggcagatttgggtacttggaaggccaggaataccgcatgtacaacacctacgatgtccatttctacgccagctttgcactgatcatgctgtggcccaaactggagctctccctacagtatgatatggccctcgcaacccttcgcgaggatctgacccgccgacgatatctgatgtctggggtgatggctcccgttaagcgtcgtaatgttatccctcacgacataggggacccggacgacgagccctggctgcgggtaaacgcataccttatccacgatacagcagactggaaggacctaaacctgaaatttgtgttgcaagtgtatcgggactactacctaacaggcgaccagaattttctgaaggatatgtggcccgtgtgccttgctgtaatggagagtgagatgaagttcgataaagaccacgacggcttgattgaaaatggtggctacgccgaccaaacatatgacgggtgggttactaccggacctagcgcctactgcgggggcctctggctggccgccgtggccgtcatggttcagatggccgctttgtgtggggcccaagacatccaggataaattctcttccattttatctagggggcaggaggcctatgaacgtctgttatggaatggaagatactataattacgattctagctctcgaccgcagagtagatctgtcatgagtgatcaatgtgcgggtcagtggtttctcaaggcatgcggcctcggtgaaggtgatactgaggttttccctactcagcacgtggtccgcgcgctgcagaccattttcgaacttaacgtacaggccttcgccgggggagcgatgggggcagtgaatggtatgcagccccacggtgtacctgacaaatcaagcgtacagagtgatgaagtgtgggtgggggtggtgtatggactggctgccactatgatacaggagggcctgacttgggagggttttcagactgccgagggctgttaccgcacagtgtgggaacggctgggccttgctttccagaccccagaggcatattgccaacagcgggtcttcagatcattggcttatatgcgccccctgtctatctgggcgatgcagcttgctctgcaacagcaacagcacaagaaagccagctggcctaaggttaaacagggcacaggtctgcgtacagggcccatgttcggtcccaaagaagcaatggcaaacctgtccccagaatag

SEQ ID NO: 26571 - DNA, 2802 bp, Artificial Sequence
  Description of Artificial Sequence: Synthetic coding sequence
atgggaactcaggacccaggtaacatgggtaccggagttccggcatctgaacagatcagttgcgccaaagaagatccgcaggtttattgccccgaggagactggcggcactaaagatgttcaagttacggattgcaagagtccagaggattcaaggccccccaaagaaacagattgctgtaatccggaggactctggccaactgatggtctcatacgagggaaaggcgatgggctatcaggtgcccccctttggttggcggatctgtctggcacacgagttcacagaaaagagaaagccatttcaggccaataacgttagcctcagtaacatgattaagcacattgggatgggcctgagatatctgcagtggtggtaccgcaaaacccacgtagaaaaaaagactccctttatcgacatgatcaattccgtgccactgaggcagatctatggctgtcccctgggtggaatcggggggggcaccattacgagaggatggcggggacagttctgtcgctggcagcttaatcctgggatgtaccagcaccggacggtaattgcggatcaaccgatctgccccctgaaatttactgtctgcctacgcagggaaggacagactgtctaccaacaggtgctgtcccttgagcgccctagtgtgcttcgatcatggaattggggtctgtgtggatactttgcattttatcacgccctgtacccacgtgcttggaccgtttatcagttacctggtcagaacgttacactcacttgccgccagatcactcctatccttcctcatgactatcaagactcctcgcttccagtgggcgtgttcgtgtgggatgtggagaatgaaggggatgaagccctggacgtctctattatgttcagtatgcggaacggcctcggcggcggcgacgatgcacctggcggcctttggaatgaaccattctgtctggagagatctggcgagactgtgagaggactgttgctgcatcaccccacactacccaatccttatacaatggctgtcgcagcccgcgtcacagctgcaaccacggtcactcatattactgcgttcgatcctgacagtaccgggcaacaggtgtggcaggatttgttgcaggatggacagttggactcaccgacgggccagagtacaccaactcagaagggcgtgggtattgccggggccgtgtgcgtatctagcaaacttcgcccccgagggcagtgccggctagaattcagcttggcctgggacatgcccagaattatgttcggtgctaaggggcaggtgcactaccgtaggtatacacgcttttttggacaggatggggacgccgcacctgccctgtctcattatgccctgtgcagatatgcagagtgggaggagcggattagcgcctggcagagtccagtcttggacgacagatccctgcccgcatggtacaagtccgctctgtttaatgaactgtattttctagccgatgggggcactgtgtggctagaagtgctggaggactcgttacctgaggagctagggcgaaatatgtgccatttgcgaccgacactgagagattatggcaggtttggctacctcgaaggtcaagaatacagaatgtataacacctacgacgtccacttttacgccagttttgccctgattatgttgtggcctaagcttgaactgtcgttgcagtacgacatggccctggctacgctgcgtgaagacttgacccgtcgaagataccttatgagcggagtgatggccccggtcaaaaggaggaacgtcatcccacatgacattggggaccctgacgatgaaccctggcttcgggtcaacgcctacttgattcacgacacagccgattggaaagacctgaatctgaagtttgtgctgcaggtgtacagagactactacttaaccggtgatcagaacttcctgaaggatatgtggcccgtctgtctcgccgtcatggagtcagagatgaaattcgacaaagaccacgatgggttgatagaaaacgggggctatgctgaccagacctatgacggatgggtgactactggcccaagtgcgtattgtggagggctgtggctggccgctgtcgcagttatggtgcagatggcagccctgtgtggtgcccaagatattcaggacaaattttccagcattttgagcagaggacaggaggcatacgaaagattgctttggaatggccgttattacaactacgactcatcttcaagacctcaaagcaggtctgtcatgagcgaccagtgcgcgggacagtggttcctcaaggcttgcgggctgggtgaaggtgataccgaagtctttcccacacagcatgtagtgagggccctccagaccatcttcgaattaaacgtgcaggccttcgctggtggagctatgggtgcagtcaacggaatgcagccccatggggttccagacaagtccagtgtgcagtctgacgaggtgtgggtgggggtggtttatgggcttgccgcgaccatgatccaggagggcctgacttgggaggggttccaaaccgccgagggatgttaccggaccgtttgggaaaggttggggctggcctttcagacacctgaggcctactgtcagcagagggtgtttcgcagcctggcttatatgcgacccctgtctatatgggccatgcagttggcactccagcagcaacagcataagaaagcttcctggcccaaagtgaagcagggcaccggcttgaggactggacctatgtttgggccaaaggaagcgatggctaacctatcacctgaatag

SEQ ID NO: 26572 - DNA, 3636 bp, Artificial Sequence
  Description of Artificial Sequence: Synthetic coding sequence
atggcaactaccgcgacgccagccacaaatcagggttggcctgaagactttggatttcgcttgggaggctccggcccatgcttcgttctggaggtggcaaagggtagctccgcacacgccgggggactgcgccctggcgaccaaatcttggaggtggagggcttggcggtcggggggctctcacgcgagaggcttgttcgactcgctcggagatgtccacgtgtgccaccctctctcggcgtgttgcccgcgccagatggcggacccggaccagggtctgggcctgccgcccccaccaccgtcctcagagcgcctcggtgcggtcgagggttggccctcggccgggagctgttacgcctcgccggtcgaaagcgacctgacgctgtgcaccgtgaacgccgaaggaaggctcaggagttttctcggaaagtggacgaaatcctgggtgaccagccaacggcaaaggagcaggtgtttgcggcactgaaacagttcgccgctgaacaacgagtggacgatctggtgtggactttgacactcgcactgccgcgggaggcttgtggtccactgctggataacctcaggatctttatacccaagaagcaccgggccaggtttgacgaggtcgtgtctcagggcctgctcggcaaactctgtcgggcccggagggcccagggagcgcagcgattaagaaggagtagaagtgaggagcgccccgagcggcttctggtctccacgagggcctcagctccgccacgtcgtcccgatgaacccccaccgcgaagggcctcattgctcgtgggagggctggccgggcctggaggggctaggaggactgtgagagtgtataaaggaaataagagcttcgggttcactctcagagggcacgggcccgtgtggattgaatcggttctgccaggctctcccgctgataatgctgctctcaagagcggagaccgaatcctgttcctgaacggccttgacatgaggaactgctctcatgataaagtagttagcatgcttcaaggatccggtgctatgcccacactggtcgtggaggagggcctggtcccgtttgcgagcgattccgattctctggacagtccaaacccaagttcggcactgaccagtctccagtgggtcgcagagatcttgccaagcagtatccgggtgcaggggcggaccttttcacaacagcttgagcacctgctgacgccccccgagcgttacggagtctgccgggccctcgaatccttttttcaacatcggaacattgacacgctgattgtcgacgtctacccggtgctggacacccccgccaaacaggtgctttggcagtttatctatcagctcctgacatacgaagaacaggagctatgtcaggaaaaaatcgcctgctttctcggttacactgctatgactgccgaaccagaaccagaactggacctggagagcgagcccacaccagagccacaaccccggtcctcccttagagccagcagtatgtgcaggcgctctttgcgctcccaggggctggaagctggcctctcctgcggcccttcggagtgccctgagatgccgctccccttaataccgggggagcgccaggctggggacgggaccagtcttcccgagactccgaacccaaagatgatgtccgccgtctacgcagagctagagtcacgcctgaattcttcattcaaaggcaagatggggacagtctccaagtcacgggcctctccaccaggcccgagtcccgccgtcacgactggtccgcgcactctgtccggtgtgtcctggccgagtgagagactgctgccgtcgccttgctaccaccccctatgtagtggcgggttagcctccccctcaagctctgaatcccatccttacgctagcctggacagttctcgggccccctcccctcagcctgggcccggtcctatttgtccagacagcccgccttcacccgacccaactcgcccaccttcccggcggaaactgttcacgttctcccaccctgtgcgtagccgcgatacagacaggtttctagacgttctcagcgagcagctgggtccacgcgtgacaatcgtcgacgactttctcactcctgagaacgattacgaggagatgtcattccacgatgatcagggctcgtttgttactaacgaacgatcttcagcgtcagattgcattagttctagtgaagaagggtcctcattgacctattcgtctatttcggatcatattccaccccctcccttatccccaccacctcctccaccgcttccatttcatgatgccaagccttcaagtcgttctagcgacggctctcggggacccgctcaggcactcgcaaagccacttacacaactgagtcatccagttcccccaccacctcctcccccccttccacctcccgtcccgtgcgctccaccaatgttatcccgaggcttgggacatagacgcagtgagacgagtcacatgagcgtgaagaggttgaggtgggagcaggtggagaactctgagggaacaatctgggggcaactgggtgaggactcagactacgataagctgtcagacatggtgaagtacctggatctggagctgcattttggcacccagaaaccagcaaagcccgtaccagggccagaaccgtttcgtaaaaaggaagtggtggaaattctaagtcacaagaaagcttacaacacctccatcttgctggctcacctgaaactgtctcccgctgagctgcgccaggttttaatgagtatggagccgcggcggctggagcctgcccatctggctcagcttctgctctttgcccctgatgcggacgaggaacaacgttaccaggccttccgagaggcacctggccgacttagcgagcccgatcaattcgtgctccagatgctgtcggtccccgaatacaaaacgcgacttcgatcgctccactttcaagcgaccctgcaggagaagactgaagagatcagggggagcctggagtgtctgaggcaagctagcctcgaacttaaaaatagccgaaaactcgcaaagatattagagtttgtgctggctatggggaattacctgaacgacgggcagccaaagacaaacaaaactacgggattcaaaattaacttcctcactgagcttaattccacaaaaaccgttgacgggaagagtacctttcttcacatcctggccaaatccctctctcaacatttccccgagctactggggtttgcgcaagatctgcccacggttccactcgctgctaaggtgaatcagcgtgcactgacgagcgacctggccgaccttcacgggaccattagtgaaatccaggacgcctgccagtctatttctcctagtagcgaggacaagtttgcaatggttatgagcagttttcttgagacagctcagccagcacttcgagcgttagatggacttcagcgcgaggcaatggaggaactgggtaaggccttggcattttttggagaggattcaaaggccaccacaagcgaggcattctttggcattttcgccgaattcatgtcaaaatttgaaagggccttgtccgatctacaggctggcgaaggtctgagaagctccggcatggtcagccctctcgcatggtag

SEQ ID NO: 26573 - DNA, 1197 bp, Artificial Sequence
  Description of Artificial Sequence: Synthetic coding sequence
atgcacaccgtagcaacctccggacctaatgcgtcctggggggctcccgcgaatgccagcggctgtccagggtgtggagccaatgcatccgacggccccgttccatcgccccgcgctgtcgatgcctggctcgtacctctgttttttgctgccctgatgttgttaggattggtgggaaacagtctggtgatttatgtaatttgcaggcacaagccaatgcgcactgtcaccaacttctacatcgccaatctggctgccaccgacgtaactttcctactctgctgtgtgcccttcactgcattgctgtacccattgccgggctgggttcttggggatttcatgtgcaaatttgtgaattacatccagcaggttagcgtccaggcaacctgcgccactttaacagcgatgagcgtggatcgctggtatgtaaccgtgtttcctctgagggccctgcatcggcggaccccccgtctggctctggctgtgagcctatctatttgggtggggtccgccgctgtgagtgcacctgtgttagcgctccaccggctaagccctggtcctcgcgcctactgcagcgaagccttcccgtcgcgcgcattggaaagggcttttgctctctacaacctgctggccctgtacctcttgcccctgttagccacttgcgcatgctacgcagccatgctgaggcacctgggcagggtggctgtgagacccgcgcctgccgactctgctttacaggggcaggtactggcagaacgagctggtgccgtgcgggccaaggtctctcgcctcgtagcagctgtggtcctgctgtttgccgcctgttggggcccaatacagctgttcctggtcttgcaggccttgggaccagcaggcagctggcacccacgttcgtatgccgcctatgctctgaaaacatgggcccactgtatgagctactctaacagcgctctcaatcccctactctacgcattcctaggaagtcacttcaggcaagccttcagaagggtctgcccatgcgcaccacgacgaccaagacggccccggcggcctggacctagcgacccggccgcgccccatgcagaactactccggctcgggtcccatcctgctccggctcgcgcccaaaagcccggcagtagtgggctagcggcccgagggctgtgtgtgctgggagaggataacgcccccctctag

SEQ ID NO: 26574 - DNA, 3543 bp, Artificial Sequence
  Description of Artificial Sequence: Synthetic coding sequence
atggtgttactgctcattttatcagtcctcttactgaaggaagacgtgcgcggaagtgctcagtcttcagaaagaagagtggtcgctcacatgcccggggatatcattatcggtgccctgttctccgtacaccaccagccaaccgtcgataaagtgcacgaacgaaagtgcggagcagtgcgagagcaatacgggatccagagggttgaggctatgctacacaccttggagcgtatcaatagcgatcctactctcctgcctaacatcactctcgggtgtgagatccgcgactcttgctggcactcggctgtggctcttgagcagagcattgaattcattagggacagtctgattagttcagaggaggaggagggcctagtgcggtgtgtggacggtagctctagcagtttccgctcgaaaaagcccatagtaggagtcataggacctggttccagtagtgtggctatccaagtgcaaaatctgttacagctgtttaacatcccccagatcgcttatagcgcaacctcaatggacctgtcagacaagacgctgttcaaatacttcatgcgagtggtgccatcagatgctcagcaagcaagggcaatggtcgacattgtgaagcggtacaattggacttacgtatcagcagtccatacagaggggaactacggagagagcgggatggaagcgtttaaggatatgtctgcaaaggagggcatctgtatcgcacacagctacaagatttattccaacgcaggcgaacaatcattcgacaaactcctcaagaagttgacctcccacctaccgaaggcccgggtggtcgcttgcttttgcgaagggatgaccgtgcgcgggttgctcatggccatgagacgattggggctcgcaggtgaattccttcttctaggcagtgatgggtgggccgaccggtacgacgtcaccgatggttatcaaagggaggccgtgggaggtatcacaataaaactacagagtcccgacgtgaaatggttcgacgattattacctaaagctccggccggagaccaatcataggaatccatggtttcaggagttttggcaacatagatttcagtgcagattagaaggcttcccacaggagaatagtaagtacaataagacatgtaactcatcactaactctcaagacgcaccatgtacaggacagcaagatgggttttgtgataaatgcaatctattcaatggcttacggattgcacaatatgcagatgtctctgtgtcccggctacgcaggcctgtgcgatgccatgaaaccgattgacggccgtaagctgctcgagagccttatgaagaccaacttcactggtgtctcaggagataccattctttttgacgagaatggcgactcacccggccggtacgagattatgaactttaaagagatgggaaaggattattttgattatattaacgtcggcagctgggacaatggcgaactgaagatggacgacgatgaagtgtggagcaagaagagcaatattattcggagcgtgtgcagcgagccgtgcgagaaaggtcagataaaggtcatccggaagggggaggtctcttgttgttggacgtgcacaccttgcaaggaaaatgagtatgtcttcgacgaatatacatgcaaggcatgtcagttgggatcttggccaaccgacgatctgaccggctgtgacctgatccccgtccaatatctgcgctggggtgatcctgagcccattgcggctgtggtatttgcctgtctcggcctgcttgcaaccctgttcgtaacagtcgtgtttatcatatacagggacacacccgttgtcaaatccagctctagagagctctgttatatcatcctggccggtatatgtctgggatacttgtgcaccttttgcctcattgccaagccgaagcagatctactgttatctccaacgcatcggcatcgggctgagtccagccatgtcctacagtgccttggtgacaaagaccaatcggattgcacggatcctggcaggaagcaagaagaagatctgcacaaaaaaaccccggttcatgtccgcctgtgctcagctggtgatagccttcattctaatctgtatacagctgggcattatcgtggctctgttcattatggagcctccagacattatgcatgactacccctcaatcagggaggtatatttaatttgtaacactacaaatcttggggtggttacacccttaggctacaacggcctgctcatcttgtcatgcacattctacgcatttaagacccggaacgtccctgcaaacttcaacgaagctaagtatatcgccttcaccatgtataccacatgcataatttggctggcttttgtgcctatctacttcggctccaattataagataattaccatgtgtttctccgtcagtttgtccgcaacagtcgccctcggctgtatgttcgttcccaaagtgtacatcatcctcgctaaaccagaacgaaatgtgaggagtgcctttactacgtctaccgtggtacggatgcacgtcggggatgggaaatccagctccgccgcaagtcggtcttcaagcctagtcaacctctggaagaggcgagggtcttcaggcgaaaccttgtcatcaaatgggaaatccgtcacctgggctcagaacgagaaatctagcagaggccagcacttatggcagcgtctgtccatacacattaacaagaaggagaaccccaaccagacagctgtgatcaagcccttccctaagagtacagaaagtcgcggtctcggtgctggagcaggcgctggcggcagtgctggaggagtcggggcaacgggcggtgccggctgtgcaggcgcaggcccaggcggccctgagtcacctgacgccggacctaaggccctctatgatgtggcagaggccgaagaacacttcccagccccagcgcgaccacggtctcccagcccaatctctactttgagccacagggctggatccgcaagtaggactgacgatgacgtaccctcattacattctgagcccgtcgcccggtcttcgagcagccaagggtctcttatggagcagatcagtagtgtagtgacaagattcaccgcaaatatttctgagcttaactcgatgatgctctccacagccgctccaagtcccggcgttggcgctcccttgtgttcttcatacctgatcccgaaggagatccagttgcccaccaccatgaccaccttcgcggagattcaaccacttcctgccatagaggtgactggcggggcccaacctgcagcaggtgcccaggcagccggcgacgcagcaagagaaagcccggccgctggacccgaagccgcagccgcaaaacctgatctggaggagcttgtggccttgacccctccctccccatttcgagactctgtggattctggctcaaccaccccaaattccccagtgagcgagagcgctctatgtatccctagctctcctaagtacgatactctcattatcagggattacactcaatctagcagttcgctgtag

SEQ ID NO: 26575 - DNA, 3639 bp, Artificial Sequence
  Description of Artificial Sequence: Synthetic coding sequence
atggtgctcttgctcatcttaagcgtcctactgctaaaagaggatgtgcgcggcagcgcccagtcttcggaacggagggtggtggcccacatgcccggcgatatcattataggagctttattcagcgttcatcatcagcctacggtagacaaagtccatgaacggaagtgtggcgctgtccgcgagcagtatggtatccagcgagttgaagccatgcttcacaccttagaaaggatcaactccgacccaactcttctgcccaacatcaccctcggctgtgaaattcgcgattcgtgttggcatagcgccgttgctctggagcagagcatcgagttcatccgcgatagtcttatatcctccgaggaggaggagggtctggttcggtgcgtggatggctcatcctcaagctttcgcagtaaaaaaccaatcgtgggagtcattggacctggcagctctagcgtggcaatccaggttcagaatctgctgcagctgttcaacatcccccagatcgcatattctgccacgtccatggacttgtcagacaagaccctgtttaagtatttcatgagggtagtgccttcagacgcccaacaagctagagcaatggttgatattgtaaaaaggtacaactggacgtatgtgagtgcagtccacacagaaggaaactatggcgaatcaggaatggaggcttttaaggacatgtccgcgaaagaaggcatatgtatcgcccactcatataagatatatagcaatgccggcgaacaaagcttcgacaagcttctgaaaaagttgacttcacatcttcccaaggcgagggtcgttgcctgcttctgcgaggggatgaccgttcgtggtctgttgatggctatgcgtagactcggcctagctggggaattcctcctgctgggatccgacggttgggcagatcggtacgatgtaaccgatgggtatcaacgcgaggcagttggaggaatcaccataaaactgcagagcccggacgtcaaatggtttgacgattattacttgaagctgagaccagagaccaaccatcggaatccctggttccaggagttctggcaacacagattccagtgccgactcgaaggcttccctcaagaaaattcaaaatataacaaaacctgcaacagcagccttacacttaagacccatcacgtgcaggatagtaagatgggtttcgttatcaacgccatatatagcatggcctatgggttgcacaatatgcagatgtccctctgtccaggctatgcggggctgtgtgacgccatgaagcccattgacggtagaaagctgcttgagagtttaatgaagacaaatttcactggagtgtcgggggatacgatactcttcgatgaaaacggtgacagcccaggaagatatgagattatgaatttcaaggaaatgggcaaagactattttgactatatcaatgtgggatcctgggataatggggagttgaaaatggacgacgatgaggtgtggtcaaagaagtctaacattatccgtagcgtgtgtagtgagccatgtgagaaagggcagatcaaggttatcaggaagggagaggttagctgctgttggacctgtaccccttgtaaggagaacgaatatgtgttcgacgagtacacctgcaaagcctgccaactcggttcatggcccacagatgatctgaccgggtgtgatctgatccctgttcagtatttgcgttggggtgaccccgaaccaatcgcagcagttgtatttgcgtgcttgggcctgttggctaccctcttcgtcaccgtagtgttcatcatctaccgcgacacccccgtcgtgaaatctagcagccgggagctctgctacattatcctggccggaatctgtctggggtacttatgtaccttttgtttaattgccaagccaaaacagatctactgctacctgcagcggatcgggatcggcctatctccagccatgtcatattccgcccttgtgaccaagaccaatcgaattgctcgcatcctcgccggcagcaaaaagaagatctgtactaagaagcccagatttatgtccgcctgtgctcaactggtcattgctttcattctcatttgtatccagttaggtatcatcgtcgccctatttattatggaaccaccggatattatgcatgactatccctccatcagggaggtctatttgatctgcaacacaactaatctgggtgtcgtcacgcctttagggtataacggactgctcatcttgtcatgcactttttacgcctttaagacgcggaacgtccctgcaaacttcaacgaagccaagtacattgctttcactatgtacactacctgtatcatttggttggccttcgtgcccatttacttcggaagcaattacaagattatcaccatgtgtttttctgtgtctctatccgccaccgtggctctcggctgtatgtttgtgccgaaagtgtatatcattctggccaagccagagaggaacgtgagaagtgccttcaccacaagcacggtcgtgcgcatgcatgtgggcgatggtaagtctagtagtgctgctagtaggtcttccagccttgttaacctgtggaagcgaaggggctccagcggtgagacactccgctacaaagaccggaggttggctcaacataagtccgagatcgagtgctttacaccaaaagggagtatgggcaatggaggccgggccaccatgtcatctagcaatgggaagtccgtaacctgggctcaaaacgagaaatcctctcgaggccagcatttatggcagaggctgagcattcatatcaataagaaggagaaccctaatcagactgccgtcatcaagccatttcctaaaagtacagaatccagaggtctgggcgcaggcgcaggcgctgggggatctgccggtggagtaggcgcgaccggaggagccgggtgtgccggcgcgggcccgggtggccctgaatcccctgatgctggtccgaaggccctgtacgatgttgccgaggcagaagaacacttcccagccccagccaggcccaggagcccctcccccatttccaccctgagtcatcgtgccggaagcgcttccaggacggacgatgatgtgccttcattgcacagcgaacctgttgcccgctcctcatcaagtcagggatctttgatggaacaaattagttctgtggtgacaaggtttactgcgaatatctccgagttgaactctatgatgctttcaactgccgcgcccagtcccggtgtgggcgccccactgtgttcctcttatttaattccaaaagaaattcagttgccaacaactatgacaacttttgcagagatacagccactgcctgctattgaggtcactggaggagcccagcctgccgctggagcacaagccgcgggcgacgcagcaagagagtcgccggcagctggcccagaggcagccgcggccaagccagacttggaagagctcgtcgcattgacacctccctcacctttccgcgacagcgtggacagcgggagtactaccccaaattcgcctgtgtcagaaagcgccctctgcattccaagctcacccaaatacgacacactaataatcagagactatacccaaagctcatcaagcctctag

SEQ ID NO: 26576 - DNA, 2829 bp, Artificial Sequence
  Description of Artificial Sequence: Synthetic coding sequence
atggtgctgcttctgattctgtccgttctgctgcttaaggaggatgtgcgggggtccgcccagtcaagcgagagacgcgtagtggcccacatgcctggtgatataatcatcggagctcttttctcagtgcatcatcagcccacagtggacaaggtgcacgaaagaaagtgcggcgccgtgagagagcaatatggtatacagcgggtcgaggctatgctgcacaccttggagcgtatcaattccgaccctaccttgctgccaaacataacgctgggatgcgagatccgcgattcttgctggcactccgctgtcgcgctggagcagtccattgagtttataagggattctttaatttcatccgaagaggaagagggcctggtgaggtgcgtcgacgggtcctcaagcagtttccgctccaaaaagcctatcgtaggtgtaattggcccagggtcttctagcgtagctattcaagtgcagaacctactgcagctctttaatattcctcaaattgcctacagtgcgacgtccatggatctctccgataagaccttgttcaagtattttatgcgtgtagtgcctagtgacgcacagcaggcaagggctatggtcgatatcgttaaaagatacaattggacttatgttagcgctgtgcacaccgaaggaaattacggagaatcaggcatggaggcctttaaggatatgtcagcaaaggaggggatctgcatcgcccactcttacaagatttatagtaatgctggcgaacagtcgtttgacaagctgctgaagaaactaacgagtcaccttccaaaagcccgggttgtggcttgcttttgcgagggaatgacagtcagaggcctgttaatggcaatgaggaggctcggtctggctggcgaatttctgctgcttgggtcagacgggtgggccgatcgatatgacgtgactgacggctaccagcgggaggcagtgggaggcattacgatcaaattacagtcgccagacgtaaaatggttcgatgattactacctaaagctgcggcccgaaacaaaccatagaaacccatggttccaggagttttggcagcacaggttccaatgccgcctggagggtttcccacaggagaattctaaatacaataagacgtgcaattcttcactgaccctcaagacacaccatgtgcaggacagtaagatgggattcgtgattaatgcgatctattctatggcctacggcctgcacaatatgcagatgtccctctgccccggatatgcaggcctgtgcgacgcaatgaagcccatcgatggcagaaagctccttgaatcactgatgaaaacaaacttcacgggtgtttcaggcgacacaatcttgttcgatgagaatggggatagccctgggcgctatgaaataatgaactttaaagagatgggaaaggattacttcgactacattaacgtcggttcttgggacaacggagaactgaagatggacgatgacgaggtctggagtaagaagagcaatattattcggagcgtttgttctgaaccgtgtgagaagggccaaattaaggtgataagaaagggcgaggtctcttgctgttggacttgcacaccttgtaaagagaacgagtacgtgtttgacgaatacacctgcaaagcttgtcagctcgggtcctggccgactgacgacctgactggctgcgacttgattcctgttcagtacctgcgctggggcgatcctgagcccattgccgccgtggtattcgcctgccttgggttgctggctacgctgtttgttactgtcgtctttattatataccgggacacccctgtggtgaagtcgagtagccgagaactgtgctatatcatccttgccggaatttgtttgggctatctgtgcaccttctgcttgatcgcgaagcccaagcagatctactgctaccttcaacggataggaattggactgagtccagctatgagctacagtgcacttgtgacaaagaccaacagaattgccagaattcttgcgggcagcaagaaaaaaatctgcacaaaaaaacctaggttcatgagcgcctgtgctcagttagttatcgcttttattcttatatgcatccagttgggcatcatcgttgccctcttcattatggagccacctgacataatgcacgattatccaagcatccgggaggtttatctgatctgtaacacgaccaacctcggagtagttactcccttggggtataacggactgctaattctcagctgcacattttatgcttttaagacccggaacgtgcccgcgaacttcaatgaggctaaatatattgcctttacgatgtacaccacatgtattatatggctggcctttgtcccaatttactttggatctaactacaagataatcacaatgtgcttctcggtcagtttgtctgccacagttgctctcgggtgcatgttcgtgccaaaggtgtatattattctagcgaagcctgagaggaatgtgaggagtgccttcactacgtcgacggtagtgcggatgcacgtcggagacggcaagagcagctccgccgcctcacggtcaagctcccttgtaaatctgtggaaacgccgaggttccagcggagagaccctgagatacaaggaccggcgcctcgctcagcataaatctgagatcgagtgcttcaccccccctagcccttttcgagattcagtcgactccgggtctacaacccccaactcaccggtttcagagagcgcactttgcattccttcttcacctaagtatgataccttgattattcgagattacacccagtccagctctagcctgtag

SEQ ID NO: 26577 - DNA, 3639 bp, Artificial Sequence
  Description of Artificial Sequence: Synthetic coding sequence
atggtcctccttctgattctgtctgtgttgctcctgaaagaggatgtcagaggctcagctcaatcgagtgaacgaagggtggtggcccatatgcctggagatatcattattggtgccttgttcagcgtacatcaccaacccacggtagacaaagtccacgaacgcaagtgtggtgcagttcgggagcaatacggcatccagcgggtggaggcaatgttgcacacccttgagcgtatcaatagcgatcccactctcctgccaaatatcacattaggctgcgaaattcgagattcgtgctggcattcagccgttgccttggaacaaagcatcgagttcatccgcgatagcttgatctcttccgaggaggaagaaggcttggtgcggtgcgtcgatgggagctcctcatcttttaggtctaagaaacctattgtgggcgtgatcgggcccgggagctcaagcgtggctatacaggttcagaacctactgcagctgttcaacattcctcaaattgcctattctgcaacctcaatggatctgagtgataaaactttgttcaaatattttatgagggtggtgccttcagatgcacagcaagctagggctatggtggatatcgttaagcggtataactggacttacgtgtcagcggtgcacaccgaaggcaactatggcgaatctggaatggaggcattcaaggacatgagcgctaaggaagggatctgtatcgcacactcctataagatctacagtaatgctggagagcaatctttcgataagttactgaaaaagctgacgtctcacttgcctaaggcacgtgtggttgcttgcttttgcgagggcatgacggtgcgaggtctcttgatggccatgcggcgcttgggcctcgccggagaattcttgttattgggttccgacggctgggccgatcgatacgacgtgacggacggttaccagagagaggctgtgggcggcatcacaattaaactgcagtctcccgatgtcaagtggtttgatgactactatctgaagctgcggcccgaaactaaccaccgtaacccgtggtttcaggaattctggcagcaccggtttcagtgcaggctcgaaggttttcctcaggaaaattctaaatataataagacttgtaatagtagtttgactctgaaaacccaccatgtccaggattctaagatgggctttgtcatcaacgctatttactcaatggcctacggattgcataatatgcaaatgtctctttgccccggctatgcaggcctgtgcgatgccatgaaacctatcgacgggcggaaactgctggagtccttaatgaagactaacttcactggtgtctcaggggacacgatcctctttgatgagaacggagactctcctggccgttatgaaattatgaattttaaggaaatgggcaaagactattttgattatattaatgtgggcagttgggacaacggggagttaaagatggatgatgacgaggtttggtccaagaagagcaatataatccggtcagtgtgttccgagccctgtgaaaagggccagataaaggtgatccgcaaaggcgaggtgtcatgctgctggacctgcacaccttgtaaagaaaacgagtatgtgttcgatgagtacacttgcaaagcctgtcagctggggtcgtggccaacagacgatcttacaggatgcgatctgattcccgtccagtatttgcggtggggcgatcccgagcccatcgcggcagtggtgtttgcatgcctcggcctgctggccacactctttgtaaccgtggtgttcattatctacagggataccccggttgtcaagagcagctcacgtgaactctgttacatcatccttgccgggatttgccttgggtatctgtgtacattctgcctgatcgcgaagcctaaacagatctattgttatcttcagcgaataggcattggcctctctcctgcaatgagctattcagcccttgtaacgaaaaccaatcgcatagcccggatattagccgggagtaagaaaaagatctgcactaagaagcctcgattcatgtccgcttgtgcgcagctggtaattgccttcattttaatatgcatacaactcggcattatcgttgccctgttcatcatggagccccccgatatcatgcatgactatccttcgatcagagaagtttacctgatctgtaacaccactaatctgggggtcgtgactcccctgggctacaacggcctgctgattctaagttgcacattttatgcctttaagacacgcaacgttccagctaatttcaacgaggccaagtatatcgcatttacaatgtacaccacctgcattatttggttagccttcgttcccatctatttcggctccaactataagattattaccatgtgcttctcagttagcctgagcgcaaccgtggcgttgggctgcatgttcgtgccaaaggtgtatatcattctagccaaaccggagcgaaacgttcgctcagcctttaccacctcaaccgtggtgaggatgcatgtgggcgatggaaagtccagctcagccgcatctaggtcttcgagtctagttaacctgtggaaacgcagggggtcgagcggggaaactctaagatataaggaccggagactggcgcagcacaaatcagagatcgagtgtttcacccccaaaggaagcatggggaacggtggcagagcaaccatgagctcctccaacgggaagagcgtgacatgggcgcaaaacgagaagtcttctaggggccaacatctgtggcagaggctgagtatccacatcaacaagaaagagaaccccaaccagactgccgtgatcaagccttttccaaagagcacagagagccgaggactgggtgctggcgctggcgctgggggtagcgctggaggtgtgggagctaccggcggagccgggtgcgccggagcaggcccaggaggtcctgagagtccggacgccgggcctaaagcgctatacgatgtcgccgaggccgaggagcacttccccgccccagctcgtcccagaagcccctctccaatcagcaccctgagtcaccgtgccggcagcgcttcgaggaccgacgatgatgttccgagcctgcacagtgagcccgtggcccgctcaagcagctcccaggggagcctgatggagcagattagctcagttgtcactcgctttacagccaacataagtgaattgaactccatgatgttgtccaccgcggcaccatcccccggcgtaggcgcccctctgtgttcatcatatctcattcccaaggaaatacagctccctactacaatgacgacctttgcggagatccagccgctcccagccatcgaggtgaccggaggggcccagcctgctgctggagcccaagctgccggcgacgcagctcgtgagagccccgccgctggccccgaggcagccgccgccaaaccagatctagaggagcttgtagccctcactcctcctagtcccttcagagactctgtagacagcggatctaccacacctaacagccctgtaagtgagtcggctctgtgcatcccctccagtcctaagtatgacacccttattatcagggattatacgcagtcatcatcttccctctag

SEQ ID NO: 26578 - DNA, 3543 bp, Artificial Sequence
  Description of Artificial Sequence: Synthetic coding sequence
atggtgttgctactcattttgagcgtcctgcttttaaaggaagatgtgagaggctctgctcagtcctctgagagaagggtggtagcccacatgcctggcgatataatcatcggggcgttgttcagtgtgcaccaccagcctaccgtagataaggtacacgagcgcaagtgcggcgccgtgcgagaacagtacggaattcagcgcgtcgaagccatgctccacacactcgaacggatcaactcggacccgactctgctccctaacattacacttgggtgcgagatccgagactcttgctggcactccgccgtagcactggaacagtcaatcgagtttattcgagatagcctaatcagctctgaagaggaagagggcctagtgcggtgtgtggatgggtcctcctcaagctttaggtctaagaagcctattgttggggtgattgggcccggctcctctagtgtggcaattcaagttcagaacttactgcaactctttaatattccacaaatcgcgtactcggccacgtccatggatttgtccgataaaaccctgttcaagtacttcatgagagtggtgccctccgatgcacagcaggcccgcgccatggttgatatcgtaaagcgctataactggacttacgtttccgcagtccacactgagggcaactacggggagtctggcatggaggcttttaaggatatgagcgctaaggagggaatttgtattgcacattcttataaaatctactctaatgcaggggaacaaagcttcgacaaattactgaagaagcttaccagtcacttgcccaaggcaagagtggtcgcctgcttttgtgagggtatgacagtgcgtggactgttaatggctatgaggcggctgggcttagctggagagttcctcctcttgggcagtgatggctgggccgaccggtatgatgtaactgatggctatcagcgggaagccgtgggaggcattaccatcaagctccagtctccggacgtgaaatggttcgacgattactatctgaaactgagacccgagacgaatcaccgaaatccgtggttccaggagttctggcagcatagattccagtgcagattggaaggctttccccaagagaacagcaagtataataagacatgcaattcttcccttacgttaaagacccaccacgtccaagactctaaaatgggcttcgtcattaacgctatttacagcatggcctatggcctgcataacatgcagatgagcctttgtccaggctacgcaggcctgtgcgatgccatgaaacctatcgatgggaggaaattgctcgagtcattaatgaaaactaactttactggggtaagtggtgacaccattctctttgacgaaaatggggacagtcctggtcggtacgaaattatgaattttaaggagatggggaaagactactttgactacatcaatgttggctcatgggacaacggcgaactgaaaatggatgacgacgaagtgtggagcaaaaagtctaacattatacgaagtgtgtgctcagagccctgcgagaagggacagatcaaagtgattagaaagggcgaagtgagttgctgctggacttgcaccccttgtaaagaaaacgagtacgtgttcgacgagtacacatgcaaggcctgccaactcggctcttggcccactgacgacctgactgggtgcgacctaattcctgttcaatacctcaggtggggagatcctgaaccgattgccgcggtggtctttgcttgtctgggcctgctcgcaacccttttcgtaactgttgtcttcattatctatcgagatactcctgtggttaaatcaagtagtagggagttgtgctatatcatcctggcagggatatgtctcggatacttgtgtaccttctgtctgatagccaagcctaagcagatctattgttacctgcagcggattggaattgggctttcccccgccatgagctacagtgccttggttaccaaaacaaatagaatcgctagaatcctcgcggggtcaaagaagaaaatctgtaccaaaaaacctaggtttatgagcgcctgcgctcaattggtcatcgcctttattcttatctgtatacagctaggcatcattgtggcgttgttcatcatggagcccccagatattatgcatgactatccgagcatcagagaagtctatttgatctgcaacactaccaacctcggagtggtcacgccactcgggtacaacgggttgctcattctgtcttgtaccttttatgcattcaaaacccgcaatgttcccgcaaacttcaatgaggccaagtatattgctttcactatgtacaccacgtgtatcatctggttggcatttgtgcctatctactttggcagtaactacaaaataattacaatgtgtttttcagtgtcactaagcgctactgtggcattggggtgtatgttcgtaccaaaagtctatattatcctggcaaagcctgagaggaatgtgcgaagtgcattcaccacctccaccgtggtacgcatgcacgtaggcgacggcaaaagcagctccgcggctagtaggagttcctccttagtgaacctgtggaaaagacggggatctagcggggaaaccctctctagtaatgggaaaagcgttacttgggcccagaatgaaaagtcctcacgggggcagcacctgtggcagcggttgagcattcatatcaataaaaaagagaaccccaatcagacagcagtcataaaaccttttcctaaatctacagagagtaggggactgggcgccggcgccggagcaggtggctcagccgggggcgtgggggcgactggtggagctgggtgtgctggagccggtccaggcggcccggagtccccagatgctggtcctaaggccctgtatgatgtggccgaagcagaagagcatttccccgcccctgctcgccctcggagccctagtccaatctccaccctgtcacacagggccggatcagctagtcggacagacgatgacgtacctagcctccacagtgaacccgtggccaggtcaagttcaagtcaggggtcactgatggagcagattagcagcgtagtcaccaggtttaccgctaacatctccgaactgaattctatgatgctgagcaccgctgctccttcacccggcgtgggggctccactgtgctcctcatatttgattccaaaagagatccagctgccgaccacaatgacaacattcgctgaaatccaaccactgcctgccattgaagtcactggtggcgctcaacccgccgccggcgcccaggccgcaggcgacgcagcaagggagtctcccgcagccggaccagaagccgcagccgctaagcccgaccttgaggaactggtcgccctaactccacccagcccttttcgtgattcagttgactctggctcaacaacacccaactcgcccgtctcagaaagcgccctgtgcataccatcgtcgcctaagtacgatactctgatcattcgcgactatacccagtcatcttctagcctgtag

SEQ ID NO: 26579 - DNA, 1149 bp, Artificial Sequence
  Description of Artificial Sequence: Synthetic coding sequence
atgcgaagcggtgggcgcggtaggccccggctgcgactcggtgagcgagggttgatggaaccccttcttcctccaaaacggcgcttgctccctagggtgcggctactgcccttgttactggccctggccgtgggaagtgctttttacaccatctggagcggatggcaccggaggactgaggagttgccactcggcagagaattgagggtgcccctcattggctctctgccagaagcaagactgcgaagagtagttggtcaactagacccccagaggctttggtctacgtacttgaggcctctgctcgtcgtcaggaccccaggcagtccaggcaaccttcaggtgagaaaattcttagaagctacccttcgaagcttgactgccggatggcatgtggagctcgaccccttcacggcctcaaccccgctggggcccgtggacttcggaaacgtcgtggccacgctcgatccacgcgcggccaggcacttaactctagcctgccactacgacagcaagctctttcctcctggctcaacacccttcgtgggagccacggacagcgccgttccttgtgctctcctcctggagcttgctcaggcccttgacctggaactgtcccgcgctaagaagcaggctgcgcctgtgaccctgcagttactgttcttggatggagaggaggcactcaaagagtgggggccgaaggactcactgtatgggtctaggcatctagcccagctgatggaatcaatccctcactcaccgggtcctactcgcattcaggctatagaactcttcatgctgctcgatctacttggagcaccaaatcctaccttttatagccatttccctcggacggtgaggtggtttcatcggctgcgttccatagagaagaggctccaccgcctaaatctgttgcagtcccaccctcaggaagttatgtatttccagccaggcgagccattcggatctgtcgaagacgatcacattcccttcctaaggaggggcgttcccgtgctgcaccttatcagcacaccctttccggcggtgtggcataccccagccgatacagaagtgaatctccatccccctactgtccacaatctctgcaggatccttgctgtgtttctggccgagtatctggggctctag

SEQ ID NO: 26580 - DNA, 867 bp, Artificial Sequence
  Description of Artificial Sequence: Synthetic coding sequence
atgaggtccggagggagggggagacccagattgcgcctgggagagaggggtctgatggagccgctgctcccgcctaagagacgactgctcccacgggttaggttgctgcctctgctactagctctcgccgttggttccgcattctacaccatttggtctggctggcacaggcgaaccgaagagttacccctgggccgggaactccgggtgcccttgattggttctctgccagaagcacggttgaggcgagtggtgggacaactcgaccctcaacgcctgtggtcgacatacctgcggccactgctagtggtcagaacacctggaagcccagggaaccttcaggtaaggaaggccgccccggttacactacagttgctgtttcttgacggagaagaggctctaaaagaatggggaccaaaggactcgctgtatggctcacggcacctggcccaactcatggagtccattccccatagcccaggccccactcgtattcaagcgatcgaactgttcatgctgctcgatctgctcggcgctcccaaccctacattctattctcacttcccaaggacagtaagatggttccatcgtcttcgatctatagaaaaacggctgcatcgtctgaatttgcttcagagtcaccctcaagaagtcatgtacttccagcccggcgaaccatttggcagcgtagaggacgatcacatcccctttctgcgaagaggggtgccagttctgcacctgatcagtacaccttttcccgccgtgtggcacacacctgctgatactgaggtaaatttgcatccgcccaccgttcataatctctgccgaattctggcagtctttctggctgaatacctcggcctctag

SEQ ID NO: 26581 - DNA, 960 bp, Artificial Sequence
  Description of Artificial Sequence: Synthetic coding sequence
atgctgggcaggtctctgcgggaggtctccgcggctctgaagcaagggcagattacccctacagagctctgtcagaaatgtctcagccttataaaaaagacgaagtttcttaatgcctatatcaccgtatccgaggaagtggccctgaaacaggccgaggaatcagagaagcgctataaaaacggccagtccctcggtgatctggacggcatcccaattgcagtcaaggacaatttttcaacttcgggaattgagacaacctgcgcgtctaacatgctgaagggttacatacctccatacaatgctactgttgtgcagaaattactggatcaaggggccctcctgatggggaagaccaaccttgacgaattcgccatgggcagcggcagcacggatggggtcttcgggcctgttaagaacccatggtcgtactcaaagcagtacagagagaagagaaagcagaacccgcactctgaaaatgaggatagcgattggctgattaccggaggttcttccggaggctctgctgccgctgtgtctgcttttacctgctatgctgccttaggaagcgatactggtggaagcacaagaaatccggctgcacattgcgggttggtcggcttcaaaccaagctacggcctggttagccgtcacggtctgataccgctcgtgaattcaatggacgttccagggattttgacaagatgcgtggacgacgcggccattgtgctaggagccctagcaggtccagacccccgggatagcactactgtgcacgagccgattaacaaaccattcatgttaccgtctttggccgacgtgagcaagctgtgcataggcattccaaaggttactttctcttttcactactttacagagatcctctcgtctcccattgagtcaaccgacttgggcgggggattgggaggatttgaaagtctcctgtgccacttctactag

SEQ ID NO: 26582 - DNA, 1587 bp, Artificial Sequence
  Description of Artificial Sequence: Synthetic coding sequence
atgcttggcagatcgctccgggaagtgtcagcagccctgaaacagggtcaaatcacccctaccgagctttgtcagaagtgcctcagtcttatcaagaagactaagttcctgaatgcatacatcactgttagtgaggaggtagctctgaaacaagcggaggagagtgaaaaacgttacaagaacggtcaatccctgggcgatctagatggcatcccaattgcagtgaaggataatttcagtaccagtggtatcgagaccacttgtgcaagtaacatgttgaagggctacataccaccctacaacgctactgtggttcaaaagcttctcgatcagggagctctcctcatgggaaagacaaacttggacgagttcgcaatgggcagcggcagtacggacggagtcttcgggcctgtgaagaacccctggtcttattctaaacagtaccgggagaagcggaaacagaatccacatagcgaaaacgaagactctgattggctaatcactggaggttccagtggcggctccgcagcagcagtgtccgcattcacttgctacgctgccttagggtctgatacaggagggtccaccaggaatccagccgcgcattgtggcctcgttggcttcaagccaagttacgggcttgtgtcacgtcatggtttgatcccgctcgtcaactccatggacgtgcctggcatcctcacacggtgcgtcgacgacgccgcaatcgttctcggggcactcgccggccccgacccaagggactccactacagtgcacgagcctattaataaaccttttatgctaccttcccttgccgatgttagtaaactatgtatcggcatcccaaaggagtatctggtgcctgagctgtcttcggaagttcagtcactgtggagcaaagccgcggaccttttcgagagcgaaggcgccaaagtgatcgaagtgagcttgcctcacacgtcttactcaatcgtgtgctatcacgtgttatgtactagcgaggtggcgtccaacatggcccgcttcgatgggctccagtacggtcatcgctgcgacattgacgtctccaccgaagctatgtatgcagcgacgcgtagagaagggttcaacgacgtcgttagaggccggatcctctccggaaacttcttcctgctgaaagaaaactacgagaactacttcgtcaaggcacagaaggtgcggagactgatcgccaatgactttgtgaatgccttcaacagcggagtggatgtactgctaactcccaccactctttctgaagctgtgccctatctggaatttattaaggaggacaaccggacgagatcagcacaggacgacatctttactcaggcagtcaatatggcagggctccctgccgtctctatccctgtcgctctcagcaatcagggactccccatcggcctgcagtttatcgggcgcgccttttgtgaccaacagttgctcactgtggcaaaatggtttgagaaacaggtgcagtttcccgtcatccagctccaggagttgatggacgactgtagcgctgtactcgaaaacgagaaactcgcaagcgtcagtttgaagcagtag

SEQ ID NO: 26583 - DNA, 411 bp, Artificial Sequence
  Description of Artificial Sequence: Synthetic coding sequence
atgtggtccagattggtgtggctgggactccgcgcacccctcgggggacggcagggatttacatctaaggcagaccctcaggggagtgggaggattaccgcagcagtcattgaacaccttgaacgactcgcgctggtggattttggaagccgggaggcagtcgcccgcttagagaaagccatcgcattcgccgacagactacgggccgtggacaccgacggggtcgagcctatggagtccgtgctggaggaccggtgcctatatctgcggtcggacaacgtcgtcgaaggcaattgtgccgatgaactcttacaaaactctcaccgggtggtggaggagtatttcgttgcgccaccgggaaacatatctctgccaaaactcgacgagcaggaaccttttcctcactcctag

SEQ ID NO: 26584 - DNA, 630 bp, Artificial Sequence
  Description of Artificial Sequence: Synthetic coding sequence
atggagccactcgccgcctaccccctcaaatgctcgggcccccgagctaaggttttcgccgtgctcctctccatagttctctgtacggtgacactttttctgctccagctgaaattcctgaagccaaaaatcaattctttctatgcttttgaagttaaggacgccaaaggcaggactgtctcattggaaaagtataaggggaaagtgagtctggtcgtaaatgtggcgtccgattgccagctcacggatcgtaactacctaggcctgaaggagctgcataaagaatttggcccttcacacttcagcgtgctcgcctttccttgcaatcagtttggagagtccgagccacgcccaagtaaggaagtggagtcatttgccaggaagaactacggcgtgacattccctatttttcataagataaaaattctgggctccgagggcgaaccagctttcaggttcctggttgatagctctaaaaaggaacctcggtggaatttctggaagtatctggtcaaccctgagggccaggtggtgaaattctggaaaccagaagaaccaatcgaggtaatccgccccgacattgcagctctggttcgccaggtaatcattaagaaaaaggaggacctttag

SEQ ID NO: 26585 - DNA, 2388 bp, Artificial Sequence
  Description of Artificial Sequence: Synthetic coding sequence
atggcaactatgttggaaggtcgttgtcaaactcagcctagatcctccccgagcggtagagaggctagcctgtggagttccggcttcggtatgaagcttgaagctgtgacccctttcctgggaaagtaccgaccattcgtgggaaggtgctgtcagacctgtactccaaaatcctgggaatccctctttcatcgctcaataacagaccttggattttgcaacgttatcctggtgaaggaagaaaacactaggtttcgggggtggctggtgagacgactttgctatttcctttggagcctcgagcagcacatccccccatgccaggacgtgcctcaaaaaattatggaaagtactggcgtccaaaatctgctcagtggcagagtgcctggtggaacaggtgaaggccaggtccctgatctcgtgaaaaaagaggtgcaaaggattctgggacacatccaggcaccaccaagacctttcctcgtccggctgttctcgtgggcacttcttcgattcttaaactgtctctttctgaatgtgcagctgcataaaggacagatgaaaatggtgcagaaagcagctcaagccggcctgcctctggtcctcttgtctacacacaagaccctcttggatgggattctcctgccattcatgctgctctcccaaggactgggtgtgttacgcgtcgcatgggattcacgcgcatgttcccctgcgctaagggccttgctgagaaagctgggcggcctctttctgccacccgaggcgtcattgtcactcgatagctcggaaggcctgctcgcccgagcggtggtacaggcagtgattgaacagctactggtgagcgggcagccactcctgatcttcctagaggagcccccaggggcactcggcccccgattatccgctctggggcaagcttgggtgggatttgtagtccaggctgtgcaggtgggcattgtgcctgatgctttgctggtacctgtggcagtcacctatgacctggtccccgatgccccgtgcgacatagatcatgcaagtgctcctctgggcctctggactggggccctagcagtattacgctcgttgtggagtcgatggggctgtagtcaccgaatatgctctcgcgtacacttggcccagcctttttcactgcaggagtacatcgtgagcgctcgttcctgctggggtggtaggcagactcttgaacagctgctgcagcctatcgtcctcggacagtgcacagccgtccccgatacagagaaggaacaggaatggacccctatcactgggcccctgctggctctgaaggaggaagatcagctattagtgcggcgactctcatgtcacgttctgagcgcttcggtggggtcttccgcggtaatgtccacggccattatggcaacactgctgcttttcaagcaccagaaactgttgggagaattttcttggctgaccgaggagatactgctgagaggttttgacgtgggtttctcaggccagctcagatccctgctccagcacagcctctccttgctccgggctcacgtagcgttactcagaatacgtcagggcgacctgctcgtagtcccgcagcccggtcctggcttaacgcacctagcccagctcagcgccgagctgctaccagtttttctgtccgaggcagtgggtgcttgtgccgttcgcggcctccttgctggacgcgtccccccccaaggcccatgggaactccagggaatcttactcttgtctcagaacgaactctacagacagatactcctgctgatgcacctgttgccccaggacttactgctcttaaagccctgccagtcctcttattgctactgtcaggaagtgttggatcgtcttatccaatgtgggctgctcgtggccgaggaaactcctggtagcaggccagcgtgtgacacgggccggcagaggctgagccggaagctcttatggaagcccagtggggattttacagatagcgactctgacgacttcggggaagctgatggcaggtatttccggctttctcagcagtctcattgcccagactttttcctgttcttatgccggctcctcagccccttgttgaaagccttcgcccaggcagccgctttcttacggcagggccagttacctgatactgaactcggttatacagaacagctatttcagtttctccaggctaccgctcaggaggaggggatcttcgagtgcgctgaccctaaactggcaatctcagccgtgtggacgtttagggatttgggtgtactgcagcagaccccgagcccggcgggtcctagactccacctttctccaaccttcgctagtcttgacaatcaggagaagttggaacagttcattcgtcagttcatctgctcctag

SEQ ID NO: 26586 - DNA, 2016 bp, Artificial Sequence
  Description of Artificial Sequence: Synthetic coding sequence
atggctacaatgcttgaagggcgctgtcaaacacagccccggagctctcctagcggaagggaggccagtctgtggtcctccggattcgggatgaaactcgaggccgttacccctttcttgggcaagtaccgcccgtttgttggcaggtgctgtcagacttgtacgccaaaatcttgggagtccctgtttcataggtctatcacagatctgggcttttgcaacgtgatcctggtgaaagaggagaacactaggttccgtggctggctcgtgcgcagactgtgctattttttatggagtttagaacaacacatccccccctgtcaggatgtcccccagaagatcatggagagtacaggggtgcagaacctgctatcaggaagggtaccaggtggcactggtgaaggccaggtacccgatctggtgaagaaagaagtacagcgcattttgggccatattcaggctcctcctcgcccctttttggtgagactgttttcttgggccctgctgagattcctgaactgtctgtttctcaacgtacagctgcacaagggtcagatgaagatggtgcaaaaagccgcacaggctggcctccccctggtgctgctgtccactcacaagaccttgctggacggaattctgttaccctttatgcttctgagccagggcctgggagttctccgtgtggcctgggacagtcgagcttgttcccctgcactgagggctctcctaagaaaactcggcgggctgttcctgccacccgaagcaagcctctctctcgattcctcagagggcctcctggcgagagctgttgttcaagctgtgatcgagcagctgctggtgagcgggcagcccctgctgattttcctggaggagcctcccggcgccctcggtccgcgccttagtgcgctcggccaggcttgggtcggattcgtggtccaagccgtgcaggtggggattgtgcctgacgcactgctagtgcctgtcgctgtgacctacgatctcgttcccgacgccccatgcgacattgatcatgcgtccgccccacttggtctctggacgggggccctggccgttcttagaagcctgtggagtagatggggatgcagccatcggatctgctccagggttcatctggcccaacctttctcactccaagagtacattgtttccgctcgcagctgctggggcggtcgtcagaccctagagcagctgcttcagcccatcgtcctggggcaatgcaccgccgtgcctgacacagagaaagagcaagagtggacgcctatcaccggccctctgttagctctgaaggaagaggatcaactgctggtgaggcgactgtcatgccacgtcctatcggcttccgttgggagcagtgccgtgatgagcaccgcaatcatggcaaccttactgcttttcaagcaccagaagctgcttggggaattcagctggcttacagaagagatcctcctccgcggctttgacgtgggcttttctggccagctccgctcactcctgcagcattcactttccctgctccgggcacatgttgcccttctgcgcatcagacagggcgacttattagtggttcctcagcccggaccaggcctcacccacctggcccaactctcagcagagctgctgcccgtgttcctgtccgaggctgtgggtgcctgcgccgtgagaggtctgctggcaggcagggtgcctcctcaagggccgtgggagctccaaggcatcctcctccttagtcagaacgaactctataggcagattctgttgttaatgcaccttctgcctcaggatctacttctgctcaagccctgccagagctcatactgctattgccaggaggtgcttgaccgtctaattcaatgtgggcttctggtggcggaagaaagctgggccacacagtcgtcttgctcctctagctgcagaccccccccccgaaaaaagggtagtagttccgttagaacacaaagcagtccgtccgtgctgtcgggcccgtctgagacttag

SEQ ID NO: 26587 - DNA, 2388 bp, Artificial Sequence
  Description of Artificial Sequence: Synthetic coding sequence
atggccacaatgctcgagggccgctgtcagactcagccgcgctcttccccaagcggcagagaagcctcactgtggtcttcggggttcggcatgaagctggaagccgttacaccatttttgggtaaatatagaccttttgttggccgttgctgccagacgtgtaccccaaaatcatgggagtccctgtttcacaggagcattactgacctgggtttttgcaatgtcatcctggtgaaggaggaaaacaccaggtttcggggctggctcgttcggcgactctgctacttcttgtggagcctggagcagcacatccccccgtgccaagacgtacctcaaaagatcatggaatctacaggagtgcaaaatctcctctctgggcgtgtcccagggggcaccggagaaggacaggtaccagacttggtgaaaaaggaggtgcagcgcatcctagggcacatccaggccccccccagaccctttctggtgagactatttagctgggcactgttgcggttcttgaattgcctcttcctaaacgtgcagcttcacaaagggcagatgaagatggtgcagaaggctgcccaagccgggctccccctcgttctcttgagcacgcataagacactgctcgacgggatactactcccgttcatgctgctttcccaaggtctaggcgttctcagggtcgcatgggacagcagggcatgttccccagcgctccgagctctccttcgcaaactcggaggcttgttcctaccccccgaagctagcttgtctttggattctagcgagggactgctggctagggccgtggtgcaagccgtaatcgagcagctgttagtttctgggcagccactacttatttttctggaagaacctccgggcgcgctggggcccagacttagtgccctgggacaggcttgggtgggttttgtggtgcaggctgttcaggtgggaatcgtgccagatgctctgttggtacccgtcgcggtgacctatgatctggtgccagatgctccctgcgatattgatcacgcatccgcacccttggggctgtggaccggagctttagctgtcctgaggtccctgtggtctcgctggggttgctcccatagaatttgcagtcgggtccatctcgcacagcccttctctcttcaggaatacatagtttcagctagaagttgctggggggggaggcagacattggaacaactgcttcagcccattgtcttgggacagtgcaccgccgtgccagatacggagaaggagcaagagtggacaccaatcactggcccgctcctggccctcaaagaagaggatcagctgctggtgcggcggctgtcctgccatgtgctgtccgcgtcagttgggagctcagccgtgatgtccacagctattatggccactttgctactgttcaagcatcaaaagctcctgggcgaattttcgtggctgactgaagagattttgctgaggggtttcgacgtgggattttctggccagctccgttccctgctgcagcattccttatctctgttgcgagcccatgtggctctcctgcggattagacagggggatcttcttgtggtcccccagccagggccggggttgacccatctggcccagctgagcgccgagctattgccagtgttcctgtccgaggcggtgggggcatgtgcggtgcgaggactcctggcggggcgtgttcctccacaggggccctgggaattgcagggcatcttactactctcccagaatgagctctatagacagatcctgcttctcatgcacctgctaccccaagacttactcctattgaaaccctgccagtcgtcctactgctattgtcaagaagtgctggatcgcctcattcagtgcggactcctagtcgctgaggagacacccggttcccgccccgcctgcgatactggaagacagaggctgagccgaaaactgctgtggaagcccagcggagatttcactgattctgacagcgatgatttcggagaagccgatgggagatatttcaggctgagtcagcagagtcactgtcccgattttttccttttcctgtgtcggctcctctccccactgctcaaggcgttcgcacaggcagcagcctttctaaggcagggacagctgccagatacagaactcggatatactgagcagcttttccaattcctacaagcaacagctcaggaagaaggcattttcgagtgcgccgatcctaaactggccatcagtgctgtgtggaccttcagggatctcggcgtcttgcagcagaccccgagccccgccggacctaggctgcacctttcaccaacctttgcgtccctcgacaatcaggagaaactggagcagtttatccgccagttcatctgtagctag

SEQ ID NO: 26588 - DNA, 483 bp, Artificial Sequence
  Description of Artificial Sequence: Synthetic coding sequence
atggctactatgcttgagggtcggtgtcaaacccagcctagatcgagcccatccggcagagaagctagtctttggagctcgggttttggaatgaaactggaagccgtgacacccttcctcgggaagtataggccctttgtgggacgctgttgtcagacctgtactccaaagagctgggagtctcttttccatcgttctattaccgacttaggattctgtaatgtcattctggtcaaagaagaaaataccagattccgcggatggcttgtgcggagactctgttatttcctatggtctcttgagcagcacataccaccttgccaggacgtcccccaaaagatcatggagtccacgggcgtgcagaacctcctttccggccgcgtaccaggcggcaccggggaaggccaagttccagatctcgtgaaaaaagaggtgcagcggatactgggacatatacaggccccccccagacccttcctttag

SEQ ID NO: 26589 - DNA, 2487 bp, Artificial Sequence
  Description of Artificial Sequence: Synthetic coding sequence
atggatgagtccgccctaacactcggaaccattgatgtctcatatttgcctcactcctccgaatacagtgtaggcaggtgcaagcatacaagtgaggagtggggtgagtgcggatttcgacccacgatattcaggagcgccacgctcaagtggaaggagtcactaatgtcacgcaagcgcccctttgtggggcgctgttgttactcatgcacacctcagagttgggataagttctttaaccccagtattccctctttgggcttgcggaatgtaatctacatcaacgagacgcatacacgtcatcggggctggctggcacgtcggctgagctacgtcctgtttattcaggagcgagacgtgcacaaaggaatgtttgccactaatgttacagaaaacgtgctaaacagctctcgggtgcaggaagcgatcgccgaagtggccgcagagttgaatccggacggaagcgctcagcaacagtccaaagctgtcaacaaagttaagaagaaggctaaacgaatcctgcaggagatggtggccaccgtgtcccccgcaatgatcagactgaccggctgggtgctgctcaagttgtttaattctttcttctggaacatacagatccacaaggggcagttagagatggtgaaagccgccaccgaaactaatctgcccctccttttcctgcccgtacatcgatcccacattgattacctgctgcttaccttcattttgttttgccacaacatcaaagccccgtacatcgcctctgggaacaacttgaatattccaattttttctacattgatacacaagcttggtggattttttatcagacggagactggacgagacccccgatggtcgtaaagatgtgctgtatcgggccttgctgcatggccacatcgtcgagttgctcaggcagcagcaattcttagagatctttctggaaggtaccagatccaggagtggcaagactagttgtgcacgagcagggttattgagcgttgtggtggacaccttgtctacaaacgtgataccagacattttaatcattccagttggcatctcgtatgatagaattatcgaaggacactacaacggagagcagctgggcaaacccaaaaagaacgaatctttatggtctgtcgcccgaggcgtcatacggatgctacggaagaactacggatgtgtgcgtgtggacttcgctcaacccttttccttgaaggagtatcttgaatcacaatcccagaagcccgtcagcgcacttctttcgcttgagcaggccctgctgccggcaatccttccatccagaccaagcgacgcagctgatgagggccgagacacttccataaatgaatctaggaacgcaacggacgagagcctacggcgccgcctgatagcgaacctggctgaacacatcctcttcaccgcaagcaagagttgtgccataatgagcacccacatcgtcgcttgtttactgctgtatcgccaccgccagggtattgacctttcaacactggtggaggatttcttcgtgatgaaagaggaggttctcgctcgggatttcgatttggggttctccggtaactcagaggacgtggtcatgcatgccattcaactgctgggcaattgcgtgactatcacacacacttccagaaacgatgagttcttcatcaccccctctactaccgtgccatctgtctttgagctgaatttctactcaaacggcgttctccatgtcttcattatggaggccattatcgcctgctcactctacgccgtgctcaacaaaagaggcctgggtgggcctacctccactccgcctaatctgattagtcaagagcagctcgtacgtaaagctgcttcattatgctatctactctccaacgaggggactatcagcttgccctgtcagacgttctaccaagtttgccatgagacagtgggcaagttcattcaatacggaattttgacggtggccgagcatgatgaccaggaggacatctcgccctctctggccgagcaacaatgggataagaagctgccagaaccgctcagttggcgcagcgatgaggaagatgaggatagcgactttggcgaggaacagagggactgttatctgaaggtaagccagtcaaaggaacaccagcaattcatcacgttcctgcagcgattgttgggtcctctgttagaagcatactcatctgctgctatttttgtgcataatttttcagggcccgtgcccgaaccagaatatctgcaaaaactgcacaaatatctgattacccggactgagcgcaatgtagctgtttatgcagaatccgctacttattgcctggtgaagaatgccgtgaagatgtttaaggatattggtgtgttcaaggaaacaaaacaaaagcgggtttctgttttggagctctctagcacctttttgccccagtgtaatcgccagaagttgctagaatatatcctctcttttgttgtgttatag

SEQ ID NO: 26590 - DNA, 2133 bp, Artificial Sequence
  Description of Artificial Sequence: Synthetic coding sequence
atggatgagtctgcgctaacactcgggaccatcgatgtgtcatacctgcctcacagttctgaatactccgtgggtcggtgtaagcatacatctgaggaatggggggagtgcgggtttagacctaccatcttccggtcagcaacgttaaaatggaaggaaagtctcatgagccggaagcgtccttttgtcggcagatgctgttatagctgtacaccacagtcttgggacaaattctttaacccatccattccgagtctagggctgaggaatgtgatttacatcaatgaaacacacacccgccatagaggctggttggctcgaaggctgagctacgtattatttattcaggaacgtgacgttcacaagggcatgtttgccactaacgtgaccgaaaatgtacttaatagttctcgggtacaagaggcaatcgcagaggtggccgccgagctgaacccagatgggtctgcccagcagcagtcgaaggctgtgaacaaagtgaaaaagaaagcaaagaggatcctccaagaaatggtggcaactgtctctccggctatgatcaggctcactggatgggttctgctcaaactgttcaattcttttttctggaacattcagatccataagggccagctcgaaatggttaaagctgccaccgagacaaacctgccactactctttctgcctgtccacaggtcccacatcgactatcttctcctgacttttatcctattttgccacaatattaaggccccatatatcgcctcaggcaacaatcttaacatccccatcttcagcactcttatccataagttgggcgggttctttatcagaaggcgcttggacgaaactccagacggtagaaaagacgtcttgtatagagcgctgctgcacgggcacattgtagagttgctgcggcagcaacagttcctggaaatctttctggaaggcacaaggagtcggagtggcaagacgtcgtgtgcgcgtgctgggctactgtcagtagtagttgataccttgtcaacaaatgttatcccagacatactgatcatccccgtgggcatttcttatgatcgcatcatcgagggacattataatggggagcagctggggaagccaaagaaaaatgaaagtctttggagcgtggccagaggggttatcagaatgctccgaaagaattatggttgtgtgagggttgacttcgctcaacccttcagtctgaaggagtatctagagagccagtcgcagaagccagttagcgctctgctctctctcgagcaggccctcctgccagctattcttcccagtagaccaagcgacgccgccgatgagggaagagacacaagcatcaatgaatctagaaacgccaccgacgaatcgctgaggcgtcgccttatcgctaaccttgctgaacacatccttttcaccgcgagcaagagttgcgccatcatgtctacacacattgtcgcgtgcttgcttctgtatcggcacaggcaaggcatcgatctgagtactctggtcgaagattttttcgtgatgaaagaagaagtgcttgcgcgggatttcgatctcggcttctctggaaatagcgaggacgtcgttatgcatgctatccaactgttagggaattgcgtgaccattacccatacttcaaggaatgacgaattcttcattacaccctctactactgtgccctctgtgttcgagttgaacttctatagtaacggagtcctgcacgtcttcataatggaagcgataattgcctgctcgctttacgcagtgctcaataagcgcggcctcggaggtccaaccagtacaccccccaacctgatatctcaggaacagttagttcggaaggcagcttcattgtgttatctgctctctaatgaaggaacgatctcactgccgtgccagacattctaccaggtgtgtcacgaaaccgtgggtaaatttatccagtatggcattctgacagtcgctgagcacgatgatcaggaagatattagcccttctctcgccgaacagcaatgggataagaagctgcctgagcccttgtcctggaggagtgacgaggaagacgaagatagtgatttcggcgaggaacaaagggattgctacctgaaggtcctgggttag

SEQ ID NO: 26591 - DNA, 2487 bp, Artificial Sequence
  Description of Artificial Sequence: Synthetic coding sequence
atggacgaatctgcgctgaccctgggcactatagacgtgtcctacctccctcactccagcgaatattccgtagggcggtgcaaacatacctctgaggaatggggcgagtgcgggtttaggccaactatttttagatcagcaactctgaaatggaaagagtcactcatgtcacgaaaaaggcccttcgtgggacgctgctgttactcttgtacaccacaatcctgggacaaattctttaacccctccattccttctcttgggttgagaaatgtcatctacatcaacgagactcatactagacaccgtgggtggttggcccggaggctgtcatatgtcttgtttattcaggagcgggatgtgcacaaaggaatgttcgcaactaacgtcaccgaaaatgtgctcaacagttcacgagtgcaggaggccatcgctgaagtcgccgccgagctgaaccctgacgggtcagcccaacagcagtctaaggccgtcaataaagtgaagaaaaaggctaaaaggattctgcaggagatggtggccacagtgtcgccggcaatgattagattgaccggttgggtgctgctaaaacttttcaactccttcttttggaatatacagattcacaaagggcaactcgagatggtgaaagccgccactgagaccaatctaccactgttattcctgcccgtccatcggagccacatagactacttgctgttgacatttattctgttttgtcacaacattaaagccccttacatcgcatcggggaacaatctcaacatccccatattttcaacactgatccataaactgggtgggttttttatccgtaggaggctggacgagacccctgatggtaggaaggatgttctgtaccgggccctgctgcacggccacatcgtggagctgcttaggcagcagcagttcctggaaatctttttggagggaacacgctcccgtagtggcaagacctcctgtgctcgagcaggcctcctatcagtggtggtcgacacccttagcaccaatgttatccctgatatcttaattataccagtaggtattagctacgacagaattattgaaggacactacaatggcgaacagttgggcaaaccaaaaaaaaacgagtctctctggagcgtggcccgcggcgtgatccgcatgctcagaaaaaactacggctgcgtcagagttgattttgctcaacctttcagtcttaaggaatacttggagagccagtcccagaaaccagtctctgcactgctgtccctggagcaagcccttcttccagcaatcctgccttcgcgtccgtccgatgccgccgatgaaggcagagatacttccataaatgagtcccgaaacgccacagacgagtccctccggaggcgcctcatcgcgaatttggcagaacatattctgttcactgcttcgaaatcttgcgccatcatgagtactcatatcgtcgcatgtctgctgttgtaccgccacagacagggaatcgatctgtcaaccctggtggaggactttttcgtcatgaaggaggaggtactggcacgcgactttgacctcggtttttcaggcaattccgaggacgtggtgatgcatgccattcagctattaggtaattgcgttacaatcactcacaccagtaggaatgacgagtttttcattacgccatctaccaccgtgccatctgtgtttgaattgaatttctactcaaacggcgtcctccacgtgtttataatggaagcaatcatcgcatgttcactgtatgccgtactgaacaagcgcggcctcggcggtccgacttctacaccccctaatctcatcagccaggagcaacttgttaggaaggcagcctccctgtgctacctgttgagcaatgagggaaccatttcactcccgtgccagactttctaccaagtttgtcacgaaacggtcggcaagtttattcagtatggtattctgactgtagccgaacacgatgatcaggaagatatttcccccagtctggcggagcagcagtgggataagaaactgcccgagcctctgagctggaggtcggacgaggaagatgaggatagcgacttcggagaggagcagcgggattgttatctgaaggtctcccagtccaaagagcatcagcagttcatcacgttcctgcaaagactcctggggcctcttctcgaagcgtactctagtgcggccatctttgtccataacttctccgggcccgtgccagagcctgaatatctccagaaactccataagtatcttatcaccagaactgagaggaacgtcgctgtgtacgccgagtcagcaacttactgcctggtaaagaatgctgtgaagatgtttaaagacatcggggtatttaaggaaacgaagcaaaaacgggttagcgtactagagctttcaagcactttccttccccaatgcaataggcagaagctcctggaatatatcttaagctttgtggtcttgtag

SEQ ID NO: 26592 - DNA, 945 bp, Artificial Sequence
  Description of Artificial Sequence: Synthetic coding sequence
atgtccagcactgccgcgttctacctccttagcacactcggcggataccttgtgacaagcttccttctgctgaagtaccccactctgctacaccaaaggaaaaaacagcgcttcctctctaagcatatctcccaccgggggggcgcaggggagaaccttgaaaacacaatggcagcatttcagcatgccgtaaaaatcgggaccgatatgttagaactggactgccatattacaaaggatgagcaggttgttgtcagccatgacgagaatctaaaacgtgctactggtgttaacgtcaatatcagcgacctaaagtactgtgaattgcctccttatttgggcaaactggatgtatcttttcagagggcctgccagtgtgaagggaaggataacagaatcccgctgctgaaagaagtattcgaagcatttccaaatacccctattaacatcgatatcaaggttaacaataatgttctgatcaagaaggtctctgagcttgtcaagcgatacaatcgggagcacctaacagtgtgggggaatgcgaattacgaaatcgttgagaagtgttataaagagaattcggatatcccgatcctgttctctctccagagagtgctcctgatcctcggtctcttctttaccggccttctcccctttgtcccaattcgcgagcagttctttgagatcccaatgcccagcattattctaaagctcaaagagcctcacactatgagccggagtcagaaattcctaatttggctgagcgacctgctgctcatgcggaaggccttgttcgaccaccttacggcccggggcattcaggtgtacatctgggtcctgaacgaggagcaggaatataaacgagccttcgatctgggagcaaccggagtgatgaccgactatcccactaaactgcgagactttctgcataacttttccgcctag

SEQ ID NO: 26593 - DNA, 870 bp, Artificial Sequence
  Description of Artificial Sequence: Synthetic coding sequence
atgtcaagtacagctgcgttctacctgctgtccacactgggggggtacctagtgacttcattcctcctgttgaagtacccaacactcctccatcagcgcaagaagcagcggttcctgagcaagcacatctctcacagagggggtgccggagagaatctggaaaatactatggccgctttccagcatgccgttaaaattgggacagatatgcttgagcttgattgtcacatcacgaaggatgagcaagtggtggtctcccacgacgagaatctaaagagagccacaggagtaaacgtgaacatttccgacctaaaatactgtgagctcccaccctacctcgggaaactcgatgtgagctttcagcgcgcatgtcagtgcgagggtaaagataaccgaattcctctcctcaaagaagtgtttgaggcttttcccaacaccccaataaacattgacataaaggtcaataataacgtgctcattaagaaagtgagcgaacttgtgaagagatataaccgggagcacctgacagtctgggggaatgctaactacgagatcgttgagaagtgctataaggagaacagtgacatcccaattctctttagtttacagagggtactgctcatcctgggcttgttcttcacggggctgctaccttttgtccctataagggagcagtttttcgagatccctatgccgagcattatcttgaaactcaaggaacctcatacaatgagcaggtcgcagaagttcctcatttggttgtcggacctgctgttaatgcgcaaggcgctcttcgaacctctacaccctgcatcaaagcggaactttgaaggacattgctcatatctagtcgtgagctgttacttctag

SEQ ID NO: 26594 - DNA, 873 bp, Artificial Sequence
  Description of Artificial Sequence: Synthetic coding sequence
atgtcctctacggcagccttctatctcctgagcactctcggaggatatctggtcacctccttcctactcctaaaataccctaccctgctacatcagcgtaaaaagcagcgattcctgagcaagcacatttctcaccgcggcggcgccggagagaacttagaaaataccatggctgcgtttcaacatgcggtgaagataggaaccgatatgctcgagctggattgtcatatcactaaggatgagcaggtggtggtgtcgcatgacgaaaatttaaagcgtgctaccggggtgaacgttaacatttccgatctcaagtattgcgaactgccgccttatctaggaaaactggatgtatcatttcagcgtgcctgccagtgcgagggcaaggacaaccgcatccctttattgaaagaagtttttgaagccttcccaaacacccccatcaacatcgacattaaggtaaataacaatgtgctcatcaaaaaggttagcgaattagtgaagagatataaccgcgaacacctgacagtgtggggaaacgccaactacgagattgtggaaaaatgttataaggagaacagtgacatcccaattcttttttctcttcaacgcgtgctacttatcttaggtctatttttcacaggcctcctgccatttgtgcccatccgcgaacagttctttgaaattcctatgccctctataatcctcaaacttaaagaaccgcacacaatgagtaggtcccagaagtttctgatatggttgtctgaccttctgctgatgcgtaaagccttgtttgatcatcttacagcgcgtgggattcaagtgtctttctggaacgacgccttttggaagcagcactcttcccctgtatag

SEQ ID NO: 26595 - DNA, 1620 bp, Artificial Sequence
  Description of Artificial Sequence: Synthetic coding sequence
atggcagagtcccccggctgttgtagcgtgtgggcaagatgccttcattgtctctacagctgccattggcgcaagtgtcctcgtgaacggatgcagaccagcaagtgcgactgcatatggttcggattgctgttcctgaccttcctactatcactgagctggctgtacataggactcgtcctactgaatgacctacataatttcaacgagtttctgttccgaagatggggtcactggatggattggtccctcgcattccttctcgtgatcagcctgctcgtgacctatgcatccttactgctggtgctcgctcttcttctgcgtttgtgtcgacaaccactccatctacattccctgcataaagtcctcttactgctaatcatgctgttggttgctgcgggcttggtgggcctggatattcaatggcaacaggaatggcatagtctgagggtctcgctgcaggcaactgccccatttctgcacatcggtgccgccgcagggattgcgctcctagcctggcctgtggccgataccttttaccgcattcatagaaggggtcctaaaattttgttactgcttctgttcttcggagtcgtgctcgtgatttatctggcaccattgtgcatctcaagtccctgtatcatggaaccgagggatttgccacctaagcctgggctcgtaggacaccgtggagcccccatgcttgcacccgagaatacccttatgtccctgaggaagacagctgaatgcggcgctacagtgttcgagaccgatgtgatggtgtcatctgatggggtgccgtttctgatgcacgacgagcacctcagcaggaccaccaacgtcgcatcggtgtttcccacacgaattacagcccacagctccgatttctcctggacagagttgaagagactgaacgccgggtcgtggtttcttgagcggcggcctttttggggggcgaagcctctcgcaggacctgatcagaaggaagccgagtctcaaaccgtacctgcgctggaggagctgctcgaggaggccgccgctttgaatctgtctattatgtttgacctgcgacggccaccgcagaatcacacctattacgacacttttgtaattcagaccctcgagacagtactcaatgcgagggtcccacaggctatggtgttttggctgcccgacgaggacagggccaacgtgcaacgcagagccccaggtatgaggcagatttatggtcggcaaggcggcaaccgcacggagaggccccagtttctaaacctaccttatcaggatctcccactactcgatatcaaggcgctccataaggataatgttagcgtaaacctgttcgtggtgaataaaccatggctcttctccctcctttggtgtgccggtgtagacagcgtcactacaaatgattgtcagctgcttcagcagatgcgctaccccatctggctgattaccccccagacatacctgataatttgggtgatcacaaactgcgtctcaactatgctcttgttgtggacttttctgcttcagaggcgtttcgttaagaagcgaggcaagacgggcctcgagacggctgttctattgaccaggattaataacttcatgatggagtag

SEQ ID NO: 26596 - DNA, 1773 bp, Artificial Sequence
  Description of Artificial Sequence: Synthetic coding sequence
atggctgagagccctgggtgttgcagcgtatgggccagatgccttcattgcctgtacagctgccactggcgtaaatgcccacgtgagaggatgcagacctccaagtgcgattgtatttggttcggcctcctgtttcttaccttcctcctgtccctcagctggctgtacatagggctggtcctcctgaacgacctccacaatttcaatgagttcttgttcagaaggtgggggcattggatggactggagccttgcttttctccttgtaatcagtttgcttgtcacctacgcttccctgctgctagttcttgcacttttattgcgactatgtcgccagcccctccacctgcatagccttcacaaggtactgttattattgattatgctgctggtggctgcaggactggtgggcctggatatccagtggcagcaggagtggcattctctgcgcgtgagtctccaggccaccgcacctttcttgcatatcggagccgcggccggaatcgctttgctagcctggccagtggcagatacattctatagaattcatcgcaggggtcccaaaatcctgcttctgctcttgttcttcggggttgtacttgtgatctatttggccccgttgtgtatcagttccccgtgcatcatggaaccacgagacctgcctcctaagcctggtttagtgggacaccgtggtgcccctatgctggcgccagagaataccttaatgtccttacggaaaacggcagaatgtggcgccaccgtgtttgagaccgacgttatggtgtcttccgatggggttcctttccttatgcatgacgagcaccttagccgaacaacgaacgtggcttcagtgtttcctactcgcataaccgcacacagctccgacttttcttggaccgaactgaagcggctgaacgccgggtcatggttcttagaacgccggccattttggggagctaaacctctcgccggacccgaccagaaggaggccgaatctcagacagtccccgctttggaagagctcctggaggaggcagcggcgctgaatctctcaatcatgtttgacctgcgacgccccccgcagaaccatacatactacgacaccttcgtgatccaaacactggaaactgtgctgaatgcccgggtgccccaggccatggtattttggcttccggacgaggaccgcgcgaatgttcaaaggagggcacccgggatgcgccagatttacggacgccaggggggcaatagaacggagcggccccagttccttaatctcccctatcaggatttgccactactagatattaaggatcgcttcctgttacctgcccaggctgggctgaagttactggcgagtagcaatctgcccgcttcagcttcccagtcagccggcatcacaggcctatcccattgcccgccacagcctccaggctataaacatgaattgagccaccttgcaatggctctacataaagacaacgtgagtgtcaatctgtttgtggtaaataaaccttggcttttcagcctgctctggtgtgctggagtggattcagtcacgacaaatgattgccagctgctgcagcaaatgcggtaccctatttggctgattacccctcagacgtatctaataatttgggtgatcacaaattgcgtatcaacaatgttactcttgtggaccttcctgcttcagagaaggttcgtgaagaaaagaggcaaaactgggctcgaaacagctgtcttgcttacacgcatcaacaatttcatgatggagtag

SEQ ID NO: 26597 - DNA, 1383 bp, Artificial Sequence
  Description of Artificial Sequence: Synthetic coding sequence
atggattggagtctcgccttcctgctggtgatatcgctactggtgacatatgcatcccttctgctggtactggccttactgctgcggttgtgcagacagccactgcatctgcacagtttgcacaaggttctgctgttactgatcatgctactggttgcggccggcctagttggacttgatattcagtggcagcaggagtggcattcacttcgggtttctcttcaggccacagcccccttcttacatattggagccgcagctgggatcgcgctcctggcgtggcctgtagcggacaccttttataggattcataggagggggccgaagattttgctcctgctactgttcttcggagtggtactggtgatctacctggcccctctctgtataagttctccttgtattatggaacccagagacttaccccctaaacctgggttagtcggtcatcgcggggcccccatgcttgcgcccgagaataccctgatgagtctccgcaaaaccgcggagtgcggcgcaaccgtgttcgagacagacgtcatggtatccagcgatggcgtgccctttttaatgcacgatgaacacctgtctaggacgaccaacgtagccagcgtcttccccacgcgaatcactgcacacagcagcgacttctcttggaccgagctgaaacggctgaatgccgggagctggtttttggagaggcggccgttttggggggctaagccactggcaggcccggatcagaaggaggccgagtcccagaccgtgccagccctggaggaactgctcgaggaggccgcggccctcaacttatcaataatgttcgacttgcggaggccccctcagaaccatacgtactacgacacatttgtgatccagactctggagacagtcctgaacgcaagggtgccacaggcaatggtgttttggttgcctgatgaggatcgcgcaaacgtgcaacgtcgagcgccaggcatgcgccaaatttacgggagacagggaggaaatcgaaccgaaagaccccagttccttaacctcccatatcaagacctgcctctgctggacatcaaggctttgcataaagataacgttagtgtgaatctgttcgttgtcaataaaccttggctattctcactgctatggtgcgccggggtggattccgtaaccaccaatgattgccagcttttgcagcagatgagatacccaatctggttgataaccccacagacatatcttatcatttgggtgatcacaaattgcgtgtccacaatgcttttattatggactttcctgctgcagcgccggttcgtgaaaaagagggggaagacaggactggagactgccgtgcttctgactagaatcaacaacttcatgatggagtag

SEQ ID NO: 26598 - DNA, 1383 bp, Artificial Sequence
  Description of Artificial Sequence: Synthetic coding sequence
atggattggagcctcgcgttcctgctagtgatctcccttctcgtcacttacgcgtcactcctgctagtactcgcacttctactcagactgtgtaggcagccactccatttgcactccttgcacaaggtcttgctgctccttatcatgctgctagtggctgcaggcctggtgggcctagacattcagtggcagcaagagtggcattccttacgcgtgtctctgcaggcaacagctcccttcctgcacattggggcagctgctggaatcgctttactggcctggcctgtggccgacacattttaccggatacacagaagggggccaaagatattactgctcctattgttctttggggtggtcctcgtgatttacctagcccccttgtgcatctccagcccatgcataatggagccccgggacctgccacccaagccgggtctggtgggccataggggcgctccgatgctcgcacccgagaacaccctgatgtccctacggaagacagccgagtgtggagccaccgtcttcgaaaccgatgtcatggtcagctcagatggggtgccctttcttatgcatgacgaacatctgtccagaaccaccaacgtggcctctgtgttcccgacgcgcatcacggcacactcatccgatttctcgtggactgagctgaagcggctcaacgccggcagttggtttctggaacggagacctttctggggtgctaaaccactcgccgggcccgatcagaaagaggctgagtcccagactgtgcccgcactggaagaactgcttgaggaggcagcagctctcaacctgtcaatcatgttcgacttgcggcgcccccctcagaatcatacctactatgatacatttgtgatccagaccctggagactgtgttgaatgcccgagtccctcaagctatggtgttctggctgcccgatgaggatagagcaaatgtgcaaaggagggctcctggcatgcggcagatttacggtcgacaaggcgggaaccgcaccgagagacctcagttcctgaacctaccatatcaggatctgccactgctggatattaaagccttacacaaagacaacgtgtccgtcaacctttttgtcgttaataagccctggcttttttccttgctttggtgtgccggcgtcgatagtgtcactaccaacgattgccagctgctgcaacagatgaggtatcccatctggctaatcacaccacagacctacttgatcatatgggtgataacaaactgcgtgtcaaccatgcttttactgtggacatttctgttgcagcgccggttcgtgaagaaacggggtaagacggggttggagacggcggtgctgctgacgagaattaataatttcatgatggaatag

SEQ ID NO: 26599 - DNA, 771 bp, Artificial Sequence
  Description of Artificial Sequence: Synthetic coding sequence
atggcccagaggagcgacctgctcgagctggactgtcaactcacccgtgacagagtggttgtcgttagccatgacgagaatctctgtagacagtccggcttgaacagggacgtcggaagtctggactttgaagacctgccactgtacaaggagaagctggaagtgtatttttcccctggtcactttgctcatggctctgacagaaggatggttcgtctggaggacctgtttcagagatttccccggactcctatgtctgtcgagatcaagggcaaaaacgaggaattaattcgggagatagcaggtctggtgcgaaggtacgatagaaacgaaattacgatatgggcgtctgagaaaagctccgtcatgaagaaatgtaaggctgctaacccagaaatgccactgtctttcaccattagcagggggttttgggttctcctcagctattatctcggcctcttaccattcatcccgatcccagagaagtttttcttctgtttcctgcctaacatcatcaacagaacttattttccttttagttgcagttgcctgaatcagctgttggccgtggtgagtaagtggctgatcatgagaaagtcactcattcggcatttagaggagcgtggggtgcaggtggtattttggtgtttgaatgaggaatccgactttgaggcagctttctcagtcggtgcaaccggcgtgatcacagattacccaacagctctaaggcactatcttgacaaccacgggccagccgcaagaacctcgtag

SEQ ID NO: 26600 - DNA, 957 bp, Artificial Sequence
  Description of Artificial Sequence: Synthetic coding sequence
atgagcctgcttttatactacgctttaccagccttgggtagttacgcaatgctgagcattttcttcctgcgccggccccatctcctccatacgccaagagcccccaccttccgcattagattgggcgcacaccgcggtggaagtggggaactcctcgagaatacaatggaggccatggagaattcaatggcgcaacggtctgatctgttggagctcgattgtcaactgacccgcgatcgcgtggtggtggtctcccacgacgaaaatctgtgcaggcagtctgggctgaatcgcgatgtcgggagcctggatttcgaagacttaccactttacaaggagaagctggaggtctacttctcacctggccactttgcacatgggagcgaccgccgaatggtcagacttgaggatctgttccagcggtttccccgtactccaatgagtgtcgagatcaaaggaaaaaatgaagaactcattcgtgaaattgcaggacttgtgagacgatacgatcgcaatgaaatcacaatctgggctagcgagaagtctagcgtgatgaagaaatgcaaagctgccaaccctgagatgcctctgtcgttcactatatccaggggattttgggtgctgctgagctattacctcggactcctccctttcattcccataccggagaagttcttcttctgtttcctgcccaatattatcaaccggacgtattttccctttagctgttcatgcctcaaccagctgcttgccgtcgtatcaaagtggctgattatgaggaagagtctcatcagacatctggaggaaagaggagtgcaggtggtgttttggtgcctgaacgaagagtccgattttgaagccgcattctctgttggtgccacgggcgtaattaccgattaccctaccgccctaagacattacctggacaaccatggacctgccgcgcgaacgtcatag

SEQ ID NO: 26601 - DNA, 1563 bp, Artificial Sequence
  Description of Artificial Sequence: Synthetic coding sequence
atgctgctcttcttgtggattgaaacgtctagcgagtatttcaatttcgactgggtgacatttctgggtaccggttattggtttttctggagtatctttattctcagtttagcccgcattcttacggcatatagctcccttttactactgctcgggttcctgttgttatgggagagaatcgagctatatttacatctgtgtcacaagatcctgattctactggtaatcttattgtgtgtcatattgatgtttattatctgcaaattttggaaggagcgatggttggtcgcgggactgtcaatgcagattttcgccccctacgtgcatttggtgtctatcactgttatggtcatcctgttctggcccgttgctttttacgtcgcttgcttggaacgagaggttcggatgcggcgctaccgtatgactcattccgagaaaaagagactgaagcaatgcaatgtgatcacacggctccgaggactacaggtgcctgtggggctgccctttctgctgatcctgttagggctctacctgatgcctttaggcatttactcgccatgtatccaagagaaggagaacctgggccccaaacccacgatttttggtcacaggggtgccccaatgctaggtccagagaataccatgatgtcttttgaaaaggccgtcgagcacggcgcacacggcttggagacagatatccacctttcctatgatcacgtccccttcctgatgcatgattttgacctcaagagaacaacaaatattggcgaggtacagcccgagagcgcttgtgaaaatcccgcttttttcaattgggactttctaagtaccctgaacgctggcaaatggtttgtcaagcccgaactccgtccattctataacatgaagcccctgtccgaagctgacaaagagagggccagaaatcagagtattcctaccctggccgacctcctcacactggcagagaaagagcggaaatttgtgattttcgatttacaccgaccccccccaaagcatccactcagacacacctttgtgaggcaggtcgtatcagtcattctggcctcaaagattgagcagcatctcattttctggctccctgctcacgacagacagtacgttcggtcagtggcgcccggctttcagcacgtgggtaggctggtgagtatcgagacgcttgctaagaataatatctctatcattaacgtggattataaaaaattgtttcccaacggcctgagggactataaggcggccaatatccatatcaatgtttacacggtcaatgagccctggttatttagtctggcatggtgctctcgcatcaactctgttaccactgacaacatcgggctgttgtctcagctggatcatccacatttctttatgacccccaaattctacgtctttatgtggttactggctgatattatcagtgttctgtttatcgtggccatattttgtttccactggcggcgggagactgagaaggaaaagctcttcgagaccagttctaccaggactgacacccaatccggatctaagaacgaagaagaccgatag

SEQ ID NO: 26602 - DNA, 1872 bp, Artificial Sequence
  Description of Artificial Sequence: Synthetic coding sequence
atgctcctgtttttatggatcgagacaagcagtgaatacttcaattttgactgggtaaccttccttggaaccggctactggttcttctggagtatttttatacttagcctggcacgtatcttaactgcttacagttccctcttactgctgttgggcttcctgctgctgtgggaaaggatagagctttatctgcacctgtgccacaagatcctaattctcctggtgatcctactatgcgttatactgatgtttattatttgcaagttctggaaggagaggtggctagttgcagggctatctatgcagatcttcgcaccttatgtgcatctcgtgtcaatcactgttatggtaattctgttctggcctgtcgctttttatgttgcatgcctcgagcgcgaagtaagaatgcgacgctaccgcatgacccattccgaaaagaagcgccttaaacaatgcaatgtaatcaccaggttgcggggactgcaggtgccagtcggactgcctttcctcttgatattgttgggattatatcttatgcccctcggcatctattcaccgtgtatccaagaaaaagagaacttgggacctaaacctaccatattcggacaccggggagccccaatgctcggacctgaaaatacaatgatgtcttttgagaaggccgtcgagcatggcgctcacggattagagacagatattcatttatcctatgaccacgtgccattcttgatgcacgacttcgacctgaagagaactactaacattggcgaggtgcaaccggaatcagcttgcgagaatcccgcattcttcaactgggattttctgtccacccttaacgccgggaaatggtttgtaaagcctgaattgcgtcctttctacaacatgaagccactgtcagaggccgacaaagaaagggcccgtaaccaatcaattcctactcttgcagatcttttgacactggccgagaaggaaaggaagttcgttattttcgacttgcacaggcctcctccgaaacaccccctgcgccacacatttgtcaggcaggtcgtttccgtgattttggcctccaagatcgagcagcacttgatcttctggctgccggcccacgacagacagtatgtgaggtctgtggcccctggcttccaacacgtgggacgcttggtgagcatcgagacactggcaaaaaacaacatctctatcattaacgtggactataagaaactgtttccgaatgggttgcgggattataaagctgctaacatacatattaacgtctatacagttaacgagccatggctgttttctctcgcatggtgctcacggatcaactctgtgacaacagataacattggtcttctgtcccagctggaccacccacacttcttcatgacccccaagttctacgtgtttatgtggcttctcgctgatattatttctgtgctctttattgtcgccattttttgcttccactggagacgggaaactgagaaagagaaacttttcgagacctctagcacccgcacagacacacagtccggcaatcttcatatcgctatgaagccgccggttcgcgttgtggaggggccttggacactggccgcactctatcctgctttgcctaagtctggtaaagagcatcagggccactttaatttcgccgcgccctcaaaaaagcttttgcctatcaagaacgccgtgacacctctgaagccaggtaagcacgaaattcagccccctatgccaacagtggtattcgagctgactcaggcgcccactaggcaagctacgagcgaagccaccttccaaacaacgctcccaactcttaaagtggacaagcctacgatgccctctatcgaagtcccttacccttag

SEQ ID NO: 26603 - DNA, 1254 bp, Artificial Sequence
  Description of Artificial Sequence: Synthetic coding sequence
atgactactctagtccctgcgaccttgtcctttctgctcctctggaccttacctggccaggtcctgcttcgcgtggcactggcgaaagaagaggtgaaatcaggaaccaagggttcccagccgatgagcccgtcagacttccttgataaattaatgggtcgaaccagcggttatgatgcccgcatacgtccaaatttcaaaggccctcccgtgaacgttacttgtaatatctttattaattcatttagctctataaccaagacaacaatggattacagagtcaacgtgttcttgaggcagcagtggaatgaccctcgccttagttatcgagagtacccagatgactctcttgatcttgaccccagtatgcttgatagtatctggaagcccgatctgtttttcgcgaatgaaaagggtgctaacttccatgaggtaaccaccgacaataagctgcttaggatattcaaaaacggaaatgtgctctactccatcagattgacgttgattctgtcttgtctcatggatctgaagaatttccctatggacattcagacatgtaccatgcaactcgaatctttcggctatactatgaaggacttagtgttcgagtggttggaagatgccccagctgtgcaggttgccgagggcctaactctcccccaattcattctccgcgatgagaaggatctcggctgttgtacgaagcactacaacacggggaaatttacatgcatagaggtcaaattccatctggagagacagatgggatactatttgattcaaatgtacatcccatccttgctgatcgttatcctaagttgggtgtccttctggataaatatggacgctgcccccgcgagagtgggcttaggaattacaacagtccttactatgactacccagtcttcagggagtcgggcaagcttgcccaaggtgtcttatgtcaaggctatagacatctggatggctgtgtgtctcttgttcgtgtttgccgcgcttctagagtacgccgcaattaattttgtgagtcgacagcataaagagttcatccggctcagaaggagacagcggcgccagagactagaagaagacatcatccaggaatcccgcttttatttcagaggctacggattgggccactgcctgcaagctcgcgacggaggtccgatggaaggcagcggcatttattctcctcagccacctgctccactgctcagagaaggcgaaactacccgaaagttatatgtcgactag

SEQ ID NO: 26604 - DNA, 1002 bp, Artificial Sequence
  Description of Artificial Sequence: Synthetic coding sequence
atgttcaagctgtgctccaataaaatggtctcccaagaagggtctgaagtggaattactggtgtctcctggtgcaaggagcgaacacggcagatacctacaagatccaatcgttagcatagacctgtcagaatggttgaggattatagagtttctacttcaaggtttaaaagtgtacgggtccgtgtatcatataaatcacggcaacccctttaatatggaggtgctcgtggacagctggcctgagtaccaaatggtgataatccgcccccagaagcaggaaatgacagatgatatggactcctacacaaacgtgtaccggatgttttctaaagaaccgcagaaaagtgaagaggttctgaaaaactgcgagattgtcaattggaagcagcgactgcagatccagggtctgcaggagagcctgggcgagggcataagagtagcgacattttccaagtctgtcaaggtggagcactcaagggcccttctgctcgtcactgaagatattctgaagttgaatgcatccagtaagagtaagttgggctcctgggcagagactggccaccctgacgacgaatttgaatctgagactcctaatttcaagtatgcccaacttgatgtcagttactctggcttggtaaatgataattggaaaagaggaaaaaatgagcggtccctgcactacatcaaacgttgtattgaagatctgcccgctgcctgtatgctcggcccagagggcgttccagtgtcctgggtcactatggacccaagctgcgaggttggcatggcttactccatggaaaaataccggcgaacaggaaacatggctagagtgatggtgcggtatatgaagtacctgcggcagaagaatatccctttctacatttccgtgttggaggagaatgaagactctcggcgtttcgtgggtcagtttggatttttcgaggctagctgcgagtggcatcaatggacctgctatccgcaaaacctggtgcctttttag

SEQ ID NO: 26605 - DNA, 909 bp, Artificial Sequence
  Description of Artificial Sequence: Synthetic coding sequence
atgatcctactgaacaactcccataagctgttagctttgtacaaaagtttggctaggagcattcccgagtctcttaaagtttacggctccgtttatcatatcaatcatggtaacccctttaacatggaggtactcgtcgatagttggcccgagtatcaaatggtcattatacggccgcagaagcaagagatgacggatgacatggatagttacactaacgtttataggatgtttagtaaagaaccccagaagtctgaggaagttctgaagaattgtgaaattgttaattggaaacaaagacttcagatccagggcctccaggagtccctgggggaaggcatccgggtcgccacattctcaaagtcagtcaaggtcgagcactcgagggccctgctcctggtgacagaagatatcctcaagctcaacgcaagctctaaatctaaactggggagctgggccgagactggccatccagacgacgaattcgagtctgagactccaaattttaaatatgctcaactggatgtcagttattcaggtctggtgaatgataattggaaacggggcaagaatgagaggtccctgcattacatcaagaggtgcatcgaagacttaccagcagcttgtatgctgggacctgagggcgtgccagtgagctgggtcactatggatccgtcctgcgaggtgggcatggcctactccatggagaagtatagaagaactggaaatatggcccgtgtgatggtcaggtatatgaaatatcttagacagaagaatattccattctacattagtgttcttgaggagaatgaggatagccggcgttttgtaggccagttcgggttcttcgaagccagctgtgaatggcaccagtggacgtgctacccgcagaacttagtgcccttttag

SEQ ID NO: 26606 - DNA, 840 bp, Artificial Sequence
  Description of Artificial Sequence: Synthetic coding sequence
atgatcctgctgaacaattctcacaaactacttgctctgtacaaatccctcgcgcgttctatccccgagagcctgaaggtctacgggtccgtctatcatataaaccacggtaaccccttcaatatggaggtattggttgacagttggcccgagtaccagatggttatcattagaccgcaaaagtcagaagaagtacttaagaactgcgaaattgttaattggaaacagcgtctacagatccagggtcttcaagagtctttgggcgaaggcattagagtggccacattttcaaagtccgtcaaggttgagcattcaagagccctcttactggtgactgaggacatcttgaagttaaacgcgtcctctaagtcgaaactgggttcttgggctgaaacagggcaccccgacgatgagtttgaatccgagacacccaatttcaagtacgcacagctcgatgtaagctacagcgggctggtgaacgacaactggaaacggggcaaaaacgaacgctccctgcactacatcaagagatgtattgaagatcttcctgcagcctgcatgctgggtcccgaaggcgtcccggtctcatgggttaccatggatccctcctgcgaagtgggaatggcttattctatggaaaagtaccgccgcaccggaaatatggcacgggttatggttcgatatatgaaatacctgcggcaaaaaaatatccccttctatatcagcgtactggaagagaacgaggattcacgtcgcttcgtgggccagtttggcttcttcgaagcaagctgcgagtggcatcagtggacctgctatccccaaaacttagttcctttctag

SEQ ID NO: 26607 - DNA, 207 bp, Artificial Sequence
  Description of Artificial Sequence: Synthetic coding sequence
atgattctccttaataactcccataaactgctggccctgtacaagtcattggctaggtcaatccccgagagtctaaaggtgtatgggtctgtctaccatatcaaccacggaaacccattcaatatggaagtgctggtggattcctggccggagtaccaaatggttatcatccgtccccaaaagcaggaaatgaccgacgatatgtag

SEQ ID NO: 26608 - DNA, 240 bp, Artificial Sequence
  Description of Artificial Sequence: Synthetic coding sequence
atgatcctgctaaacaactcacataagttgctcgccctttataaatcactggccaggtccatcccagagtcgctgaaggtctacggatctgtttaccacatcaaccatgggaatcctttcaacatggaagtgctggttgatagctggccggagtatcagatggtgataatacggccccagaagcaggagatgacagacgacatggattcctatacaaacgtgtacaggatgttctcctag

SEQ ID NO: 26609 - DNA, 885 bp, Artificial Sequence
  Description of Artificial Sequence: Synthetic coding sequence
atgctggtgctccacaattctcagaaactgcaaattctttacaaatcgctggagaagtctatcccagaatctattaaggtctatggggccatatttaatattaaggataagaacccctttaacatggaagttcttgtggacgcgtggccagactatcagattgtgatcacccgcccccaaaaacaggagatgaaggatgaccaggatcactacacaaacacctatcacatctttacgaaagctcccgacaagctggaggaggttctgtcttactcgaacgtaatttcctgggaacagacattacaaattcaagggtgtcaggaaggtctcgatgaggccattaggaaggtggctacgtctaagagcgtgcaggtggattatatgaagaccattctgtttatccctgagctgccgaaaaaacacaaaacttcatccaatgataagatggagttgtttgaggtagatgatgacaataaggagggtaattttagcaatatgttcctggacgccagccacgcgggcttggtgaatgagcactgggccttcggaaagaacgagcgatcgctgaaatacattgaacggtgcctccaggattttctgggcttcggcgtccttggcccagagggccagttagtaagctggattgtaatggagcagtcctgtgagctcagaatgggttacaccgtgcccaagtacagacaccagggaaatatgctgcagatcggctaccacttggagaaatatctgtcccagaaagagatccccttctacttccacgtggctgataacaatgaaaaaagcctgcaagcacttaacaacctgggtttcaagatctgcccatgtgggtggcatcagtggaaatgtacaccaaaaaagtattgctag

SEQ ID NO: 26610 - DNA, 885 bp, Artificial Sequence
  Description of Artificial Sequence: Synthetic coding sequence
atgcttgtccttcataacagccaaaaattacaaatcctgtacaagtctctcgagaagtcaattcccgaaagcattaaagtatacggtgctattttcaacattaaagataaaaatccctttaatatggaagtactggttgatgcctggcctgactatcaaattgtcataacccgaccacaaaagcaagaaatgaaggacgatcaggatcactatacaaacacctaccatatttttaccaaggctcctgataagctcgaagaggtgctcagctattccaatgttatatcatgggagcaaacacttcagatccagggatgccaggagggactggatgaagcaatccggaaggtggccaccagtaagtcggttcaagtcgactacatgaagaccatccttttcattccagagttaccaaaaaagcacaagaccagcagcaatgacaaaatggaattgttcgaagtggatgacgataataaagaaggaaactttagcaacatgtttctggatgcctctcatgccggccttgtgaatgaacactgggcttttgggaaaaatgagcgctctctgaagtacatcgagaggtgcctgcaggactttctcggattcggcgttctaggtccagagggccaactagtgtcatggatcgtcatggagcaatcttgtgaacttcgaatgggctacactgttcctaaatatcggcaccaggggaatatgctccagattggctaccatctcgaaaagtatcttagtcagaaagaaattcccttctacttccacgtggcagacaacaacgaaaagtccctgcaagccctaaataatctcggatttaagatttgcccttgcggatggcatcagtggaaatgtacgcctaagaagtactgttag

SEQ ID NO: 26611 - DNA, 867 bp, Artificial Sequence
  Description of Artificial Sequence: Synthetic coding sequence
atgctagtcctgaattgtagcactaaattgttgattctcgagaagatgctgaagtcttgttttccagagagcctcaaggtctatggcgccgtgatgaatataaacaggggtaatccgtttcagaaggaggtcgtgctggacagttggccagacttcaaagcagtcattactcgccggcagcgggaggccgaaacagacaacttggaccactataccaacgcatatgcagtattctataaggacgtcagagcctaccgccagttgctcgaagagtgtgatgtcttcaactgggatcaggtattccaaattcaaggcctgcaatctgagttgtatgatgtgagtaaagcagtagctaacagcaagcagctcaacattaaactgacatccttcaaggctgtgcactttagcccagtttccagtctgcctgacacttcgtttctcaagggacctagtccacgtctcacgtacctgtcagtggcaaatgctgatcttcttaacaggacttggtctagagggggaaacgagcaatgcctcaggtacattgccaacttaatatcgtgtttcccaagtgtctgcgttagagacgagaaaggcaatcccgtgtcttggtcaattacagatcagtttgccactatgtgccatgggtacacactccctgaacatcggaggaaagggtattcgcgcctcgtcgcactaacactagctcgaaaactacaatctcgtggcttccccagccaaggcaatgtacttgacgacaacacggcgtctataagcctgctgaagagtcttcatgccgagtttttaccttgccggttccaccgcctgatccttacgccagcaactttctctggcttgcctcacctttag

SEQ ID NO: 26612 - DNA, 471 bp, Artificial Sequence
  Description of Artificial Sequence: Synthetic coding sequence
atgctcgtgctgaattgcagtaccaaactgctgattctcgagaagatgctcaaaagctgctttcctgaatccttgaaggtgtacggcgctgtgatgaacatcaacagaggcaaccccttccaaaaagaggtggtcctggactcatggcctgactttaaggctgtaatcacacgaagacagagggaggccgagacggataacctcgaccactatactaatgcctatgccgtgttctacaaggacgtgagggcataccgccagctgctagaagaatgtgatgtgtttaattgggatcaggtgttccagatacagggcctccagagcgaactttatgacgttagtaaggcagtcgcgaattctaagcaactgaatatcaagcttactagcttcaaagcggtccacttcagccccgtttcctctctccctgatacatcctttcttaagggtccatcaccaagattgacatattag

SEQ ID NO: 26613 - DNA, 1683 bp, Artificial Sequence
  Description of Artificial Sequence: Synthetic coding sequence
atggagtgcctctactactttctcggatttctgctgctggcagctcgactacccctggacgcagccaaaagatttcacgatgttctgggtaacgagcgccctagcgcttatatgcgggagcacaatcagctgaacggatggtccagtgacgaaaacgattggaatgagaaactttaccccgtgtggaaaaggggcgacatgcggtggaagaactcctggaaaggaggacgcgttcaagctgttcttacttcagatagccctgcacttgtggggtccaatatcacgttcgccgtgaacctcattttcccaaggtgccaaaaagaggatgcaaatggtaacattgtatacgagaagaactgtcgcaacgaggcaggtctgagcgcagacccttacgtgtacaattggaccgcatggtctgaagattctgatggcgagaatggcaccggtcagagtcatcacaatgtgttcccagatggaaagcctttcccacatcaccccggatggcgcagatggaattttatctacgttttccatacactgggtcaatactttcaaaagctcggcaggtgtagcgtccgcgtaagtgtaaacacagcaaatgtcacgctgggcccacagcttatggaagtcactgtgtacagacgccatggccgggcctatgtgcctattgcacaggtgaaggacgtgtatgtggttacagaccaaattccagtgtttgtgacaatgttccagaaaaacgaccgcaattcttctgatgaaaccttcctgaaagacctccccatcatgttcgacgttcttattcacgacccaagtcactttctaaactacagtacaataaactacaagtggtcatttggcgataacaccggcctgtttgtttctaccaaccacacagtcaaccacacttatgttttgaacgggacattttcattaaacctcaccgtcaaggctgctgctccgggcccctgtccaccacctccacctccccccagacccagcaaacctactccttctctgggtcccgcaggagacaatccgctggagctgtcgcgtatcccagatgaaaattgtcagatcaaccgctatggccacttccaggctaccattactatagtagaaggcatactggaagtgaatattatccagatgacagatgtgctaatgccagtgccgtggcctgaatcttccctgatcgactttgtggtgacctgccagggctctatccctactgaagtttgtacaattatttccgaccccacatgtgagattactcagaatacagtttgctcacccgtggatgtggacgaaatgtgtttgctgaccgtccgcagaacttttaacggctccggcacctactgtgtaaatttgaccttgggcgacgacacctcactggcacttacgagtacactgattagtgtcccagacagggatccagcaagccccctaaggatggctaattccgcgctcattagtgttggctgcctagccatctttgtcactgtgatcagcttgctggtctacaagaagcacaaggaatataatccaatcgagaatagccccggaaatgtagtccgcagcaaaggattaagtgtgtttctcaatagagcgaaagccgtgttctttcctgggaatcaggaaaaagacccactgctcaagaaccaggagttcaagggcgtgagttag

SEQ ID NO: 26614 - DNA, 1719 bp, Artificial Sequence
  Description of Artificial Sequence: Synthetic coding sequence
atggaatgtctttactatttcctaggcttcctgcttctcgcagctagactgcctcttgacgccgccaagcgctttcacgatgtcctgggtaacgagaggccgagtgcgtacatgcgcgagcataatcaactgaacggttggtcttccgatgagaacgattggaacgaaaaactttatcccgtctggaagagaggggacatgcgatggaaaaactcatggaagggtgggcgggtgcaggccgtgctgacatcagactcccccgccctcgtgggctcgaacattacctttgcagtgaatctgattttcccccggtgccagaaggaagacgcgaatgggaatatagtgtacgaaaagaactgtcggaatgaggcaggattaagtgcagatccgtacgtgtataactggacagcctggtcagaggactccgatggggagaatggaacagggcagtcacatcataatgttttccctgacggaaagccatttccgcatcacccagggtggcggcgctggaacttcatatacgtctttcataccctcggacaatatttccagaagctgggccgctgttctgtccgagtatctgtcaatactgctaatgtgacgctcggaccgcagcttatggaggttaccgtgtatcgtcgccacggaagggcttatgttcccattgcacaggtgaaggacgtgtatgttgtgacggatcagattcccgtgtttgtgacaatgttccagaaaaatgacaggaatagttccgacgagacatttttgaaggatttgcccattatgttcgatgtccttattcacgacccctcccattttttaaattatagcactatcaattacaagtggtcatttggagacaacaccggactctttgtaagcacgaatcacacagtcaatcacacatatgtcctaaacgggactttctcgctgaacctcaccgtaaaagctgcagctccgggcccatgcccccctccgcccccgcctcccaggccctcaaagcccactccgagcctagccactactctgaagagctatgactcaaatacacccggccctgcaggagacaaccccctggaactgtccagaattcccgacgagaattgtcagattaacagatacggccatttccaagccacgatcacaattgtcgagggtatcctggaggtaaatattatccagatgacagacgtgttgatgccggtgccgtggcccgagtcttctctcattgacttcgtagttacctgtcaaggttccataccgaccgaagtatgcactattataagcgatccgacgtgcgagataacacagaacacagtttgtagtcccgtggacgtggatgagatgtgtctgctgactgtgaggcgaacatttaacggcagcggtacgtattgcgttaatcttaccctgggagacgatacatcattggcacttacatccaccctcatctccgtgcccgaccgcgatcccgcatctcccttgcgcatggctaattcagccctgatcagcgtgggctgcttggcgatctttgtgactgttatctcactgttggtgtacaagaagcacaaggagtataaccccatcgagaactcacccggtaatgttgttaggagcaaggggttgtccgtgtttctgaatcgagctaaagctgttttcttccccggtaatcaggagaaagatccccttctgaagaatcaggaatttaagggggtttcatag

SEQ ID NO: 26615 - DNA, 621 bp, Artificial Sequence
  Description of Artificial Sequence: Synthetic coding sequence
atggagtgcctgtactatttcctaggtttccttttattggccgcacggcttcccctcgacgccgccaagaggtttcacgatgtactcggcaatgaacggccttcagcttatatgagggagcacaaccagcttaacggatggagcagcgatgagaacgattggaatgaaaagctctaccccgtctggaaaaggggggatatgaggtggaagaactcgtggaagggtggaagggtgcaggccgtgctcacatccgattctcctgccttggtgggcagcaatataactttcgcggttaacctcatcttcccacgttgccagaaagaagatgccaacggcaatatcgtttacgaaaagaactgtcggaatgaggccgggctgagcgcagacccatacgtctacaactggacagcatggagcgaagactctgatggcgagaacggtacaggtcagagtcatcacaatgtgttccccgatggaaagccctttcctcatcatcctggctggcggcgctggaacttcatctatgtgttccacacacttggctggctgctgcagaccccaaagttactcctctatctgtccctgaagtttcaaccatcgctcttcctcctttataactag

SEQ ID NO: 26616 - DNA, 1368 bp, Artificial Sequence
  Description of Artificial Sequence: Synthetic coding sequence
atggagtgtctctattactttctgggatttctgttgctggcggccagacttcctttggacgcagcaaagcgttttcacgatgtattggggaacgaacgcccatctgcctacatgagagaacacaatcagctgaacggttggtcctccgacgagaatgattggaactttatatacgtcttccacaccctgggtcagtactttcagaagcttggccgctgcagcgtcagggtgagtgtgaacaccgccaacgttaccctggggccgcaactcatggaggttaccgtgtacagacggcatggaagagcctatgtgccaattgcgcaggtgaaggatgtgtacgtcgtaacagatcagattccggtgtttgtgacaatgttccagaaaaacgatagaaactctagcgatgaaacctttttgaaggacctgcccattatgtttgacgtgctgattcacgatccatcacactttcttaattactctacaattaattacaaatggtcctttggcgacaataccggattgttcgtatctacaaatcacactgtgaatcatacctacgtgctcaacggaacctttagcctcaatctcactgttaaggcggccgcgccaggcccctgtccccccccaccaccgccaccccgtccaagcaaaccaaccccttcgttggccaccaccttaaagtcatacgacagtaatacccccggccccgccggagacaatccactcgagctgtcacgcatcccagacgaaaattgccagattaatcggtacggacatttccaggccacgatcactatcgtggagggaattctcgaggtaaatatcattcagatgacagatgtgttgatgccagttccctggcctgaatccagtttaattgattttgtggtgacatgtcagggtagcatcccaactgaagtgtgtaccattatcagcgatccaacctgtgagattacacagaatactgtgtgcagtcctgtggatgtcgacgagatgtgcctgcttactgtgcggagaacatttaatggctccggtacttactgtgttaatcttactctgggagatgataccagtctggcattgacatccaccctaatatcagtgccagatagagacccggcctcaccactccggatggcaaattccgccctcatttctgttggctgcctcgccatcttcgtcaccgtgatctcgttgcttgtctataaaaaacacaaggaatacaatcctatagagaattctccggggaatgttgtccgctcaaagggactgagtgtgtttctcaacagagctaaggctgtcttttttcccggaaatcaggagaaggaccctctgctgaagaatcaggagttcaagggcgtgagctag

SEQ ID NO: 26617 - DNA, 1824 bp, Artificial Sequence
  Description of Artificial Sequence: Synthetic coding sequence
atgatactgccagaggccctgtatctgatcaagatcgagcgagaagcacctcaaatgcctgaggagcactgttgctcctggtggacagggcctgaagagttttccatggagtgtctgtactactttctcgggtttctgttactggccgctaggctgcccctggatgcagctaagcggtttcacgatgtgctggggaacgagcgcccttcagcctacatgcgagagcataatcagctaaacggatggagcagcgacgagaacgactggaacgagaaactatacccagtctggaagcgaggtgatatgagatggaagaactcgtggaaaggcgggcgcgttcaggccgtcctcacctctgacagccctgccctggtggggagcaacataacctttgccgtaaatctgatattcccgaggtgccagaaggaggatgctaatggaaatattgtatatgagaaaaactgtcgcaacgaggctggactgtctgcggatccatatgtgtataactggacagcatggtccgaagacagcgacggggaaaatggcactgggcagtcacaccataatgttttccccgacggcaaacccttcccccaccacccgggttggaggcggtggaacttcatttatgtgtttcacacgctgggccagtatttccaaaaactgggtcgttgtagcgtgagggtgtctgtcaatacggctaatgtgacgctgggccctcagctcatggaggtaacagtttatcggcgccacggccgggcatacgtgcccatagcgcaagtcaaggacgtttatgtggtgacagaccaaatccccgtgttcgtgaccatgtttcagaaaaacgataggaactcctcggatgaaaccttcctgaaggaccttccgatcatgttcgatgtgctcatacatgacccttcacacttcctgaattactcaaccataaattacaaatggtctttcggagacaacacagggctgttcgtctccacaaaccacacagtgaatcatacatacgtgctcaatggaacgttttcattgaacctaaccgtcaaggctgcggcgcccgggccctgtccaccacccccccctccaccacgcccctcaaaacccaccccgtcgcttgctaccacccttaagtcttatgatagtaacacccccgggccagcaggggacaatccattggaactgagtcgcattcccgatgagaattgccagatcaaccgatacgggcatttccaggccaccatcaccattgtggaagggattctggaggtcaatatcattcagatgacagatgtattgatgccagtcccatggcctgaatcctctctcatcgattttgtggttacatgtcaaggctctattccaacagaggtgtgcactatcatttcagaccccacatgcgagataacgcagaacaccgtgtgttcacctgttgacgttgacgagatgtgtttgttgaccgtgcgacgcacatttaatggtagcgggacctactgtgtgaacttgaccctcggggatgacacatccctggcattgacttccacactgatctcagtgcctgatagagaccccgcgagccccttacggatggctaacagcgcactaatctcagtgggttgtcttgcgatcttcgtgaccgtgataagcctcttagtatataaaaaacacaaggagtacaacccaattgaaaactcacctgggaacgtggttcgcagcaagggcctctccgtgttcttgaacagagccaaggcggtgttctttcctggtaaccaggagaaagatcccttactgaagaaccaggaatttaagggagtttcctag

SEQ ID NO: 26618 - DNA, 1545 bp, Artificial Sequence
  Description of Artificial Sequence: Synthetic coding sequence
atggagtgcctgtactatttcctggggtttctgctgctggcagctcgcttaccgctggacgcagcaaaacggtttcatgatgtcctggggaacgaacgtccttctgcatacatgcgggaacacaatcagctgaacggatggtcttctgacgagaatgactggaatgagaaactatatccagtatggaagcgcggagacatgcgatggaagaactcatggaagggcggccgagtgcaggcagttctcacttcggattcaccagctctagtcggctccaatatcacatttgctgttaatctaatcttccctagatgccagaaagaagacgcaaacggaaacattgtgtacgaaaaaaactgcaggaacgggcagtacttccagaaactcggacgctgttctgtgcgcgtttctgttaacaccgccaatgtaacccttggcccccagctaatggaagtgacagtgtatcgccgccacggccgcgcttatgtgccgatcgcccaggtgaaggatgtttatgtcgtgactgatcagatacccgtcttcgtcaccatgtttcaaaagaacgatagaaatagcagcgacgaaacgttcttaaaggacctacctattatgtttgatgttctaatccacgaccctagtcatttcctcaattattccacgatcaactataagtggagttttggagacaacacgggactctttgtgagcaccaaccacactgtgaaccacacatatgtattgaacggcaccttcagcctcaacctgaccgtgaaggccgccgcccctgggccttgccccccccccccaccacccccacgaccctctaagccgaccccttccctggctacaaccctgaaatcctacgacagcaatactcccggacctgctggcgacaatcctctggaactttcccgaattcctgatgagaattgtcagatcaaccggtacggacatttccaggctactattacaatagtagagggcatcctggaggtgaacatcatccagatgacagatgtcctgatgcctgtcccctggcccgagagttcacttatagacttcgtggtcacatgtcagggctcgatccccaccgaggtgtgtaccatcatcagcgaccctacgtgtgaaattacccagaacactgtgtgcagccctgtggatgtggatgagatgtgtcttctgaccgtgcgaaggacattcaacggatcaggtacgtattgtgtcaacttgacgttgggggatgacacctctttggccctgacgtccacactgatatcagtgcccgatcgcgacccggccagtccactccggatggccaacagcgcactcataagcgttggctgcttagccatcttcgttaccgtgattagtctcctggtttataagaaacataaagagtacaacccaattgagaattcacccggaaatgtggtcaggagcaagggcctgtcagtgttccttaaccgggcaaaggctgtgttcttccctggcaaccaggaaaaggatcctcttctgaagaatcaggagttcaagggggtgtcttag

SEQ ID NO: 26619 - DNA, 1386 bp, Artificial Sequence
  Description of Artificial Sequence: Synthetic coding sequence
atggagtgtttatattattttttggggtttctcctcttggcagcccgtcttcctctagatgccgcaaaacaggccggtctgtctgcggacccttatgtatacaactggaccgcatggtcagaggacagcgacggtgagaatggtaccgggcaatctcaccataatgtattccccgacgggaaaccgttcccacaccaccctggatggaggaggtggaactttatatatgtttttcacaccctgggacaatactttcagaaactggggagatgttccgttcgagtttccgtgaacacagccaacgtcacactgggaccacagttaatggaggttaccgtatacaggcgtcacggcagggcatatgttcctatcgcacaggttaaggacgtatacgttgttaccgatcaaatccctgtgttcgtgacaatgtttcagaaaaatgacaggaactcctctgatgagactttccttaaagaccttccgatcatgttcgatgtgctgattcacgacccatctcatttcctcaactattccactatcaattataagtggtcatttggcgataatacgggcctttttgtctccacaaatcataccgtcaaccatacatacgtccttaacggcacgttcagcctcaacttgacagtgaaagccgcggcacctggtccatgccctccccccccccctcctccgagacctagtaaacctaccccttctctggggcctgctggtgataatccactggagctcagccggattccagatgagaattgccagatcaaccgttacggtcacttccaggccacaattacaatcgtggagggtatcttggaagttaatatcattcagatgaccgatgtacttatgccggtcccctggccagaaagctccctcatcgactttgtagtcacctgtcagggcagcattccgacagaagtttgcactataattagcgacccaacctgtgaaattacacagaataccgtgtgctccccggtggacgtggacgagatgtgcctgctaaccgtccgcaggacattcaatggatccggaacctactgcgtgaaccttacgttgggcgatgatacaagtcttgcccttacatccacgctgatctccgtgccagaccgggatcctgcctcgccgcttcggatggccaacagtgccctcatctcggtaggatgtctggccattttcgtcaccgtgattagcctgctggtgtacaagaaacacaaagagtacaaccccatcgaaaacagtcccggaaacgtggtaaggagcaagggcctgtcagtttttctgaaccgtgctaaggccgttttttttccgggaaatcaggagaaggaccctttgctcaagaaccaggaatttaagggagtgtcatag

SEQ ID NO: 26620 - DNA, 960 bp, Artificial Sequence
  Description of Artificial Sequence: Synthetic coding sequence
atggtggggaagatgtggccagttctttggacactctgcgcagtaagggttacagtggatgccatcagtgtagagaccccgcaagacgttctacgagcttcccaaggcaaaagcgtgactctgccatgtacctatcatacctccacctcctctcgcgaaggactcatacaatgggacaagcttctgttgacacacacagagcgggtcgtgatttggcctttctcaaataaaaactatatccacggcgaactttacaaaaatcgcgtgagtatctctaataacgcagagcaatccgatgccagcataaccattgaccagctcacaatggcagataacggaacctacgagtgcagtgtttctttaatgtccgatttagagggcaacactaagagccgagttcgccttcttgtgctagtgccccccagtaagccggagtgcggaattgagggagagacgatcattggcaataacatccagctgacttgtcaaagtaaagaaggatccccaactccacagtacagctggaaaaggtacaacatcctgaatcaggaacagcccttggcacaaccagctagtggtcagcccgtatcgctaaagaacatctcaacagatactagcggctactatatttgtacatcttccaacgaagaagggacccagttctgcaacatcactgttgccgtgcgttcccccagtatgaacgtggccctgtacgtgggtatcgctgttggagtggttgctgccctgattatcatcggtattataatttattgttgctgctgccgcggcaaagatgacaacactgaagataaggaggatgcccgccccaaccgggaagcctacgaggaaccccctgaacaactaagggagctttctagagaacgggaggaagaggacgattacagacaggaagagcagaggtcgaccggccgggaatctcctgatcacctcgaccagtag

SEQ ID NO: 26621 - DNA, 1683 bp, Artificial Sequence
  Description of Artificial Sequence: Synthetic coding sequence
atgctgagaggaacactgttatgtgccgtgctgggtctgctccgggcccaaccgtttccatgtcctcccgcctgcaagtgcgttttccgtgacgcggcccaatgtagcggaggcgacgtggctagaatctctgcactgggcctgccaacaaatctcactcacattctgctttttggcatgggccgcggcgtactgcagtctcagagtttctccggcatgaccgtcctccaacgcctgatgatcagcgattcccacatcagcgcggttgctccaggtacattcagtgatctgataaagcttaagactttacgcctctcccgcaacaaaattacacatctacctggagccctgcttgacaagatggttctgctggagcaactattccttgaccataacgccctccgcgggattgaccagaatatgtttcaaaaactggttaacttgcaggaattggcactcaatcaaaatcaactagatttcttgcccgcatcattattcacaaacctggaaaaccttaagcttctcgacttgagcggtaataatttaacccacctaccgaagggactgctcggcgcccaagcaaaactcgagcgactgttgctccactccaatcgactggtgagcctcgacagcgggctcctcaatagcctgggcgccctgaccgagttgcaattccatcgcaatcatatccgtagcatcgcgcccggagcctttgaccgcttgccaaacctctcgagcctgactctgtcccggaaccatttagcattcctgccatctgccctcttccttcattctcacaaccttactctcctgaccctgttcgagaaccctctggcggaactgccaggcgtgctgttcggcgagatggggggcctgcaggaactgtggctaaatcgaacccagctgcgaacccttcctgcagccgctttccggaaccttagcaggctcagatatctaggagtaaccctctctccaaggctgtctgcgttgccacagggggcgttccagggactgggggaactgcaagttttggctctgcactctaacggtcttacagctctccccgatggcctgctaagaggcctgggcaagttgcgccaggtcagcctacggcgaaacagactaagagctctgccccgggccctgttccgaaacctgtcctccctggagtctgtccagctggatcacaaccagttggaaacgctacccggcgatgtgttcggcgcactcccacgcctgacagaagtgcttctgggccacaacagctggcgctgtgattgcggccttggtccattcctgggatggctccgccagcacctaggccttgtcggaggcgaggagcccccccgctgtgccggacctggggctcatgctggcctcccgctgtgggctctgcccggaggcgatgcagagtgccccggacctcggggtcccccccctcggcccgcggccgactctagctccgaggctccggtccaccctgctctggcccctaatagttcagagccctgggtgtgggctcagccagtgaccacggggaagggacaggatcacagtcccttctggggcttctatttcctgttgctggcggtgcaggcaatgataacggtgattatcgtgttcgccatgattaaaatcgggcagctgttccgaaagttgatacgggaacgggccctgggttag

SEQ ID NO: 26622 - DNA, 1683 bp, Artificial Sequence
  Description of Artificial Sequence: Synthetic coding sequence
atgctgcgggggacactgttgtgcgccgttctcggtctcctaagggcccagccattcccttgcccaccagcctgcaagtgcgtgttccgtgacgctgcacaatgctctggaggtgacgtagctaggatttctgcgcttggcttgcctactaatctgactcacatcctgctctttggcatgggccgcggagtcctgcagtctcagtctttttcgggaatgaccgtgctacagagactcatgattagtgattcccatattagtgctgtggcccctggcaccttttctgacctgattaaattgaagaccctccgtctgagcaggaataagattacacatttacctggggccctgcttgataagatggtgctactcgagcagttgttcctcgaccataatgccttacgaggaatcgaccagaatatgttccagaagctggtgaatcttcaggaactggccctcaatcagaatcaattggactttctgccggcctcactgttcaccaatctggaaaatctgaagctgctggacctgtctggcaacaaccttacgcaccttccaaaaggacttctaggcgcccaggctaagctcgagagattgttgctccactccaatagactcgtgtctctggattccggcctgctcaattccctgggtgccctgactgagttgcaattccaccggaaccatatccggtctatcgcgcctggggcgttcgatcgcctgccaaacctgtcgtctctgaccctcagcaggaaccacctggcctttctcccgagtgccctttttctgcatagccataacctgacactcttgaccctctttgaaaacccactagcagagctcccgggggtgctctttggagagatgggtggcttgcaggaactttggctgaatcgcacacaacttcggaccctgcctgccgcagccttccgaaacctgagcagactgcggtatctgggcgtcaccttgtcacctcggcttagcgctctacctcagggcgcgttccagggcctgggcgaactacaggttctagcgctccactcgaatgggctcaccgctcttcctgacggcctgctgcgtggattaggcaagttaaggcaagtgtctcttaggcgcaaccgattgcgggccttaccaagagccctttttcggaacctctcgtctctggaatctgtgcagctggatcacaaccaactggaaacactccccggggacgtctttggagcactccccaggcttactgaggtgctgctaggccataattcttggagatgcgattgtgggctggggccctttctggggtggctacgacagcacctggggctcgtgggaggcgaagagccaccgagatgcgccggcccaggcgcccacgccgggttaccactttgggctttgcccggtggcgacgctgaatgcccagggcctagaggccctcccccacgccccgctgccgacagttccagcgaagctccagttcatcccgcgctggcccccaactcatctgaaccttgggtctgggcgcagcccgtaacaacagggaagggccaggaccactcacccttctggggattttactttttgctgctggcagtgcaggccatgattacggtgatcatagtgttcgcaatgataaaaatcggacagttgtttcgcaaactcattcgcgaacgggcgctcgggtag

SEQ ID NO: 26623 - DNA, 1869 bp, Artificial Sequence
  Description of Artificial Sequence: Synthetic coding sequence
atggcagctgccccacgggctggacgcagaagaggacagccgttgttggcactgctgctcctgctgcttgcccctctcccacctggcgctccccctggagccgacgcgtatttcccagaggaaagatggtccccagaaagccctctgcaagcacctagggtacttatagctctgctggctcgcaacgcagcccatgcccttcccaccactctgggagccttggagcgtttgcgccatccaagggagagaaccgcactctgggtggcgacagatcacaatatggacaacacctccaccgtccttcgtgaatggcttgtcgccgtcaagtcactgtatcattccgttgaatggcgtccagcagaggagccgcgatcgtacccggacgaggaggggcctaaacattggtccgactcccgttacgagcatgtgatgaagcttcgtcaagcagctctgaagtctgcccgcgacatgtgggcagactatatcttattcgtggatgccgacaatctgatactaaaccccgatacattgtccttgttgatagccgaaaataaaacagtggtcgccccgatgttggactctagagccgcctatagcaacttttggtgcggcatgacttctcagggatactataagagaacgcctgcatatatccctattcggaaacgcgaccgacggggatgcttcgctgtgcccatggtacattctacctttctcatcgacctccgaaaagccgctagtagaaatctcgcgttttaccctccacacccagactacacgtggtctttcgacgacataatcgtgttcgccttctcctgtaagcaagctgaggttcagatgtatgtgtgcaacaaagaggagtacggcttcttaccagttcccttacgtgcccattccacactgcaagacgaagctgagagctttatgcatgtccagctcgaggtgatggtgaaacacccccctgctgaaccatcaagatttatctccgctcccacaaaaaccccagataaaatgggttttgacgaggtcttcatgattaacctgcggagaaggcaggacaggagagagagaatgctgcgggccttacaggcccaggagatcgagtgccgacttgtggaggccgtcgacggcaaagccatgaacaccagccaggtggaagccttaggcatccaaatgttgccggggtaccgcgacccttatcacggcaggccactgaccaagggagagttgggatgttttctgagccattataacatttggaaagaggtcgtagatagaggcctccagaaaagtctggtgtttgaggatgatctccgctttgaaatctttttcaagcgaagattaatgaacctgatgcgcgatgtggaacgtgaggggctcgattgggatctgatttacgtagggcggaaacggatgcaggttgaacacccagagaaagcggtaccccgggtgagaaatctagtggaggccgactactcatattggaccctcgcatatgtcatcagtctccaaggggctcggaagctcctggccgccgagccgttaagcaagatgttgcccgtggatgagttcctgcctgttatgttcgacaaacaccccgtgagtgagtacaaggcgcacttcagcctgaggaatctccacgcctttagcgtggagcccttgctgatctacccaactcactacaccggtgatgatggctacgtcagtgatacagagacctcagtcgtctggaacaacgagcacgtgaagacggattgggatagggccaagtcccagaaaatgcgcgagcaacaggccctctctcgcgaagccaaaaacagcgatgtgcttcagtccccactcgattcagctgccagagacgagctgtag

SEQ ID NO: 26624 - DNA, 702 bp, Artificial Sequence
  Description of Artificial Sequence: Synthetic coding sequence
atggttcacagcaccttccttatcgacctgagaaaagcagcatctcggaacttggctttttaccctccccacccagactatacttggtccttcgatgacatcatcgttttcgcgttttcatgtaaacaagcggtgaaacatccccccgcagagccctccaggttcataagcgctccgacgaaaacaccagacaagatgggctttgatgaggtgttcatgataaacctcagacgccggcaggatcggcgcgaacgcatgcttagggcactccaggcacaggagattgagtgtcgtctggtggaggccgtcgacgggaaggcgatgaacacctcgcaagtcgaagccctaggaatccaaatgctgccaggctaccgcgacccttatcacgggagaccacttacaaagggcgagctgggctgttttttaagccactataacatatggaaggaggtggtagaccgcggactgcaaaaatccctggtgttcgaagatgacctgcgcttcgagatcttcttcaaaaggagactgatgaaccttatgcgcgatgtcgaacgcgaagggctggactgggacctgatttacgtgggcaggaaaagaatgcaggttgaacaccccgaaaaggctgtaccacgcgttaggaacctcgtcgaggccgactactcatattggactgtcctgccagggatgaattcagagggttag

SEQ ID NO: 26625 - DNA, 1881 bp, Artificial Sequence
  Description of Artificial Sequence: Synthetic coding sequence
atggcggcaagaccggccgcgactctggcttggagcttattgcttctgtcttctgccctgttgcgggagggctgcagggcacgctttgtcgcggagcgtgactcagaagatgacggggaggaacctgtcgtctttcctgagagcccactgcagagtccgacagtgctcgtcgcggtattagcccgcaatgctgctcacacccttccccacttcctggggtgtttagaaagactggattatccaaaaagtaggatggctatatgggccgcgaccgatcacaatgtcgacaacaccaccgaaattttccgggaatggctgaaaaatgtgcaaagattgtaccactacgttgaatggcgcccaatggacgagccagagagctatcctgacgaaatcgggccaaaacactggcccacatcccgatttgcccatgtgatgaaactgaggcaggctgctctcaggaccgcacgcgaaaagtggtctgattatatcctcttcattgatgtggacaactttctgaccaatccccagaccctcaatttgttgatcgcagagaacaagacaatagtcgccccaatgctcgagtctagaggactgtattccaacttctggtgtgggattacccccaagggcttttataagaggacccccgattatgtgcagatccgtgagtggaagagaaccggatgtttcccagtcccgatggtgcattccacctttttaattgacctgcgcaaagaagcatccgacaaactgaccttctaccccccccaccaggactacacctggaccttcgatgacatcatcgtatttgctttctcaagccggcaggccggtatacagatgtacctgtgtaacagggaacactatgggtacttgcctatcccgttgaagccacatcagacccttcaagaggacatcgagaatcttattcatgtgcaaattgaagcaatgattgatcggccccctatggagccaagccagtacgtgagtgtggtccccaagtaccctgacaaaatgggattcgatgaaatttttatgatcaatcttaagcggaggaaggacaggagggacaggatgctgaggaccttatacgagcaggagatcgaggtgaaaattgtggaggctgtggacggcaaggcattgaacacctcccaattgaaagcattgaatattgagatgcttccaggctacagggatccctatagcagtcgaccccttactagaggggaaattggctgcttccttagccactactctgtgtggaaagaggtcatcgatagggaactagagaagaccctggtcattgaggatgatgttcgttttgaacatcagtttaagaaaaaattgatgaagctgatggacaatattgaccaggcgcagctggattgggagttaatttacattgggcgcaaaagaatgcaggtcaaggagccagaaaaggctgttcccaacgtggctaatttagtggaggcagactacagctactggactctgggctatgtgatttctttggaaggggcccaaaaactcgtcggggcgaacccatttgggaaaatgctaccagtagacgagtttctgcctgtaatgtacaataaacacccagtggccgaatataaggagtactatgagtccagggacttaaaagctttctctgccgagccgctgttgatttacccaacacactacactggacagcccggatacctttctgatactgaaacgtctacaatctgggacaatgagacagttgctacagattgggaccgaacgcacgcctggaaatctcgtaagcaaagccgtatctattcaaatgcgaagaataccgaagcactgccaccccccacatccctcgacacagtgcctagtagagacgagttatag

SEQ ID NO: 26626 - DNA, 1092 bp, Artificial Sequence
  Description of Artificial Sequence: Synthetic coding sequence
atgttctccgattgctggctgtgccccagtctgggatctagcggaattcagatgtacctgtgtaatagggagcattacggatacctgcccatcccacttaaaccacaccagacattgcaggaggacatagagaacctgatacacgtccagattgaggcaatgatagatagaccccctatggaacctagccagtacgtctcagtggtgccgaaataccctgataagatgggattcgacgagatcttcatgattaacctcaaacgtagaaaggatcggcgagaccggatgctccggacactgtacgaacaagaaatcgaagtgaagatcgtggaagctgtggatgggaaggccctgaatacaagccagctgaaagcactgaatatcgaaatgcttcctggctatcgggacccatacagctcaaggcctctcacaagaggggagatcggttgctttctgagccactacagtgtctggaaggaagtgattgaccgcgagctcgagaagaccctggtgattgaagacgacgtgagattcgagcaccagtttaaaaagaaacttatgaagctgatggacaacatcgatcaggcgcagctagactgggaactgatttatatcggtagaaagcgcatgcaggtgaaggaaccagaaaaagctgtgcccaacgtagctaacctggtggaggctgactacagttactggaccctgggctacgttatcagtctggaaggcgctcagaaacttgtgggggctaatccgtttggcaaaatgctgccagtggacgagtttctccccgtgatgtacaacaagcatccggtggctgagtacaaagaatattacgaatcacgtgatcttaaggctttttccgcagaacctctgctaatttaccctacacactacactggacagcccggctacctgtccgacaccgaaacctcaacaatctgggataacgagaccgtggccacagactgggaccgaacacatgcgtggaaatcaagaaagcagtcccgcatttatagcaatgcaaagaataccgaagcactccctccccccacctctcttgatactgttccgtctcgcgacgagctctag

SEQ ID NO: 26627 - DNA, 705 bp, Artificial Sequence
  Description of Artificial Sequence: Synthetic coding sequence
atgctgccaggctacagggatccatatagctcaaggcctctcacccggggcgagatcggctgctttctgtcccactactctgtgtggaaagaggtgattgatagggagctggaaaagacactcgtaatcgaagatgatgtcaggttcgagcaccagtttaaaaaaaaattaatgaagttgatggacaacatcgaccaggcccagcttgattgggagctgatatatatcggccgtaagcggatgcaggtgaaggagccagagaaggcggtgcccaatgtggctaatttggtggaagcagattattcatattggaccctggggtacgtgatttccctcgagggggcacagaagctagtcggggcaaacccctttggtaagatgctgcccgttgacgagtttctccctgtcatgtacaacaagcacccagtggcagagtataaggaatactacgagagccgtgaccttaaggccttctctgcagagccgttgctgatttatccgacgcactacaccgggcagcccgggtatctaagtgacactgaaacaagcacaatctgggataacgagaccgttgctaccgattgggatcggactcacgcctggaaatctaggaaacaatctcgaatttactccaatgcaaagaataccgaagcactcccaccgcctacctctctcgatacagtcccctctagagacgaactgtag

SEQ ID NO: 26628 - DNA, 1665 bp, Artificial Sequence
  Description of Artificial Sequence: Synthetic coding sequence
atggccgccaggcctgcggccaccctggcatggtccctcctgctgctgagctcagctctgctccgggaggggtgccgggcacggttcgtggcagagcgcgactctgaggatgacggcgaggaaccagtggtgtttcctgaatcacccctacagtcacccacagttctggttgcagttctggctcgcaacgccgcccatactctccctcactttctcgggtgcttggagcgattggattatcccaaatccaggatggccatatgggcggctaccgatcataacgtggacaatacaaccgaaatcttccgagaatggctgaaaaatgtacaaaggctttaccactacgtggagtggaggccgatggacgaacctgaaagctacccagacgaaatagggcccaagcactggccgacatctcgttttgcccacgtgatgaagctgagacaggctgcactccggaccgctcgagagaagtggtccgactatattctattcattgatgtagataatttcttgacaaacccacagacactgaacctcctcatcgcggagaataaaactatagtagcccccatgcttgagagcagaggcctgtattcaaacttctggtgcggaattacgccaaagggcttctataaacgcacacccgactacgtgcaaattcgcgagtggaaaaggacaggttgcttccccgtgcccatggtgcatagtacattcctcattgatctgaggaaggaggcctctgacaaattgaccttctatccgcctcatcaggactatacttggactttcgacgatatcatcgtttttgccttctcttctagacaggcgggcatccaaatgtatctgtgtaatcgggagcactacggatatttaccaatcccgcttaaacctcatcaaacactacaagaagatatagaaaacctgatccatgtccagatcgaagcaatgatcgatagacctccaatggagccatcccagtacgttagcgtggtcccaaagtatcctgacaagatgggattcgatgagatcttcatgataaatctcaagaggcgaaaagacagacgggacaggatgctgaggacactttatgaacaggagatagaggtcaaaatagtcgaggctgtggatggcaaagctctcaataccagtcagttaaaagccctcaacatcgaaatgctcccggggtaccgggacccctatagcagtcgtcctctcaccagaggggagattgggtgcttcctatcccattatagcgtatggaaagaagtgatcgatcgcgagctcgaaaagactttagttatcgaggatgacgttcggtttgaacaccagtttaaaaagaaactgatgaagctgatggacaacatcgaccaggctcagctcgactgggaattgatctacattgggcgcaagcggatgcaagtcaaagaacctgagaaggccgttccaaatgtggcgaacctggtggaggccgactacagttactggacacttggatacgtcatcagtctagagggcgcccagaagttagtgggagccaacccattcgggaagatgttgcccgtggacgagtttttgcccgtgatgtataacaagcatcccgtcctgctcagcagcccccattgccacctgtttcagactctgtctgatgactgccagaggtag

SEQ ID NO: 26629 - DNA, 1050 bp, Artificial Sequence
  Description of Artificial Sequence: Synthetic coding sequence
atggctctactcaggaagatcaatcaggtgcttctcttcctactcattgttactctgtgcgtaatactttacaaaaaggttcacaaggggaccgttccaaagaatgacgccgatgacgagagcgaaacccccgaagagttagaggaagaaattcctgttgtcatatgcgctgcggcgggtaggatgggagcaaccatggctgccatcaattcaatctattctaacaccgatgccaatattctattttacgtggttggactgcgtaacaccctaacgagaataaggaaatggatagaacactcaaagcttagagaaatcaattttaagatcgtcgagttcaatcccatggtgcttaaggggaagatacggcctgatagttcaaggccggagctgctgcagcccctgaattttgtgcggttctacctacctctactgattcatcagcacgagaaggtgatctatctcgacgacgacgtcattgttcagggcgacatacaggaactgtatgacaccactctggccctcgggcacgccgctgcctttagcgacgattgcgatctgccttctgcacaagatatcaaccgccttgtgggcctccagaacacttatatgggttacctggactatagaaagaaggccatcaaagatctaggtatctctcccagtacctgttcattcaacccaggggttatagtagctaatatgactgaatggaagcaccagagaatcacgaagcagctagagaaatggatgcagaagaacgtggaagagaatctctacagcagttctcttgggggaggggtggctaccagccccatgctcattgtgtttcacggtaagtattccacaattaaccctctttggcacattcggcatctagggtggaaccccgacgccaggtattcagagcacttcttgcaagaagccaaacttctccactggaatggacgacataaaccatgggactttccttccgtccacaatgacttgtgggagagttggttcgtgccggaccctgcaggtattttcaaactgaaccaccactcatag

SEQ ID NO: 26630 - DNA, 1050 bp, Artificial Sequence
  Description of Artificial Sequence: Synthetic coding sequence
atggctctgctgcgcaagataaaccaggtgcttctttttttactgatcgtaacgctgtgtgtgattctgtataagaaggtgcacaaaggaacagtgcctaagaacgacgcggatgatgagagcgaaacccccgaagagctcgaagaggagatccccgtggtcatttgcgccgccgcaggtaggatgggtgctacaatggctgccataaactctatctactccaatacggatgcgaacattctgttttatgtggttggactgcgaaacacactgactcggattaggaagtggattgagcacagtaagcttagggaaattaacttcaagatcgtggagttcaatcccatggtgttaaaagggaagataaggccggacagttcacgcccagagctccttcagccgctgaacttcgtccgtttttatcttccactactgattcaccaacatgaaaaggtcatctatctggacgatgatgttattgtacagggcgacattcaagaactgtatgacaccaccctcgcgctcggtcatgccgctgccttttccgacgattgcgacttaccttccgctcaggatattaaccgccttgtgggacttcagaacacatacatgggatacctagattatcgcaagaaggccataaaggatctggggatatccccatcaacctgctctttcaacccaggcgtcatcgtcgcaaatatgaccgaatggaagcaccagaggattactaaacaattggaaaaatggatgcaaaaaaacgttgaggagaacctgtacagcagctcgctaggggggggggtggcaacctctcccatgctaatcgtgtttcacggcaagtatagcactatcaatcccttgtggcatataaggcaccttggttggaatcccgacgcccggtactcagaacatttcctgcaggaagcaaagctgctgcattggaacgggagacacaaaccatgggatttcccctccgtacataatgatttatgggagtcctggtttgttcctgatcccgccggaatcttcaagttaaaccatcacagctag

SEQ ID NO: 26631 - DNA, 1050 bp, Artificial Sequence
  Description of Artificial Sequence: Synthetic coding sequence
atggccctacttagaaaaatcaaccaagtgttgctgttcctcttaatcgtgacactttgcgtgatcttgtacaaaaaggttcataagggtaccgtgccgaaaaatgatgctgatgacgagagcgaaacacctgaggaactcgaggaggaaatccctgtggtcatttgcgcagctgccggaagaatgggggcaactatggccgccattaatagtatatactccaatacagatgcgaatattttattctacgtcgtagggttgaggaataccctgacccggatacgaaagtggatcgaacactcaaagctgcgcgaaatcaacttcaaaattgtagagttcaacccgatggtgctaaagggtaaaatcagaccggatagctctcgaccagagcttttgcaaccactcaatttcgtacggttctacttgcctctcctgatacatcagcacgagaaggtaatctatcttgacgatgatgtgatcgtgcaaggggatattcaggagttatacgataccaccctagctcttggccatgccgccgcattctccgacgattgcgacctaccatcagcgcaggacatcaatagattggtcgggctgcaaaacacttatatgggatacttggactataggaagaaggcaatcaaggacctggggattagtccatcaacctgtagtttcaatcccggagtgatagtagccaatatgactgaatggaagcatcagcgcattactaaacagctggaaaaatggatgcagaagaacgtagaggaaaatctgtacagttcctcacttgggggtggcgtcgctacctcccccatgttaatcgtctttcatggcaagtattctacaattaatcctctgtggcacattagacatctcgggtggaacccagatgcccgctacagcgaacactttctgcaggaggcaaagctgctccactggaacggtcgacacaaaccatgggacttcccaagtgtgcacaatgatttatgggagtcgtggttcgtcccagaccccgctgggattttcaagctgaatcatcatagctag

SEQ ID NO: 26632 - DNA, 942 bp, Artificial Sequence
  Description of Artificial Sequence: Synthetic coding sequence
atggcggctcggagagccctgcatttcgtttttaaagtgggcaatcgtttccagaccgctaggttttaccgcgacgtgctgggaatgaaggtggagtcttgcagcgttgctagactggagtgcagcggcgccatctctgcacactgctccgattacacccggatcaccgaggatagtttctccaagccctatgacgggaaatggagcaaaactatggtaggcttcggtccagaggatgaccacttcgtggcagagctcacatataactatggggtaggagactataagcttgggaacgattttatggggatcaccctggcatctagtcaggcagtttcgaatgccaggaagctcgaatggccattaaccgaagtggctgaaggagtgtttgaaacagaggctcctggaggctacaaattctatctgcaaaatagatccttgcctcagtctgacccagtgcttaaggtaaccctcgctgtgagcgatctgcagaagagcctgaactactggtgcaacctgctggggatgaagatctacgagaaagatgaggagaagcagagagctttactagggtacgccgataaccagtgcaagctggagctgcagggggtcaaaggtggggtagatcacgccgccgcattcggtcgtattgcgtttagctgcccccagaaagagctgcccgatctagaggacctcatgaagagggagaatcagaagatccttacccccctagtttcactggacacccctgggaaagcaacagtacaagtggtgatcctcgccgatcctgacgggcacgaaatatgctttgtcggcgatgaggcctttcgggaactatctaagatggatccagaggggagcaaactgctcgacgacgccatggctgctgacaagagcgacgagtggtttgcgaagcataacaagcctaaggcttcaggatag

SEQ ID NO: 26633 - DNA, 897 bp, Artificial Sequence
  Description of Artificial Sequence: Synthetic coding sequence
atggcggcaaggagagctctccattttgtatttaaagtggggaaccggttccagactgcgaggttctatagagatgttctgggcatgaaagtgctgcgccatgaggagttcgaagaaggctgcaaggccgcatgtaacgggccctatgatggcaaatggtcaaaaactatggtgggctttggcccggaagacgaccatttcgtggccgaattaacatataattacggcgtcggagactataagctgggaaacgatttcatggggataaccctggccagcagtcaagctgtgtcaaacgcaaggaaactggaatggccactgaccgaggttgccgagggcgttttcgaaaccgaagccccagggggctataagttctacctgcagaatcgttccctcccccagtctgaccctgtcctcaaggtgactctcgcggtctccgatcttcagaaatcactaaattattggtgcaacttactcggtatgaaaatctacgaaaaagacgaggaaaaacagcgcgctctcctggggtacgccgataaccagtgtaaattggagttgcagggggttaagggtggcgttgaccatgccgccgccttcggtaggattgcttttagctgcccccagaaggaactcccagacctcgaggacttaatgaagagggaaaaccagaaaatcctgactccattggtttccctcgatacaccaggcaaggccaccgtgcaggttgtgatcctggctgaccctgacggccacgagatatgtttcgtcggcgatgaagcgtttcgcgaactgtcgaagatggatccggaaggatcaaaattactcgatgatgctatggcagctgataagagtgatgagtggttcgccaaacataacaaaccaaaggcttctggctag

SEQ ID NO: 26634 - DNA, 1506 bp, Artificial Sequence
  Description of Artificial Sequence: Synthetic coding sequence
atgcgacttacccctttcagcttatctacggggaacagcttccgctactcaaggcgtttaaagaagaatatttttgggacagctcctgcactacgcgcttccgagatgagcttgaggccatccagccggatctttccatgcttctcccgaaacggactggatttcactattgtcattactttactccagccccctgtgccaggcatctcttttattgtcgcgaagcctagactttttcctggtgccggctctgctggttgtgggctgctggagaggctattcctttcactgctgctcgggactgggctacgctggtgtcgtggctgctttcccggagcccgtttctgcagtaccacttctcctgaggggaataccacgtttaccgggctccgcaggtcagcacggacccagagactccagggccccaagcctgggcccccggcagctactgtggccaggcaaaccagccgggtttctcctgcccccccctgcagtctgcgcccagggttgcgccacgaatccgcacctagcgccgccagcgacgttacagccagaggcgccctcagaggactgggttgtaccgtccgggtgacagccgcctgtggagggaaccacggctgcagccaattgcatttcgttttcaaagtcggaaatagattccaaactgcaagattctaccgagacgtgcttggcatgaaggttttaagacatgaggaatttgaagaggggtgtaaagcagcttgtaacggaccctatgatgggaagtggagcaaaacaatggtgggatttggcccagaagatgaccacttcgtcgccgaactaacctataattatggagtaggcgattacaagctgggcaatgattttatgggaatcactctcgctagctcgcaggccgtgagcaatgccagaaagttggagtggcccctgactgaggtggccgagggagtctttgagaccgaagcgccaggcggttacaagttttatctgcagaatagatctctgccacagagcgatcccgtcctgaaggtgacactcgccgtctctgacctacaaaaaagtctaaattattggtgtaacttattgggcatgaaaatctacgagaaggatgaggagaaacaacgagcattactgggttatgcggacaatcagtgcaagctggaattgcagggagtgaagggaggagtggatcatgccgcagccttcggtagaattgctttctcctgccctcaaaaggagctgccggacctcgaggacttaatgaagcgtgagaatcagaagatactcactccactggtgtcacttgacacccctggaaaggctactgtccaggtggtcatactggcagatcccgatggccacgagatatgcttcgtaggcgatgaagcgtttcgcgaattatcgaagatggaccctgagggatccaaactactcgatgacgccatggctgccgacaagtctgacgaatggtttgccaaacacaacaagcccaaagctagcgggtag

SEQ ID NO: 26635 - DNA, 870 bp, Artificial Sequence
  Description of Artificial Sequence: Synthetic coding sequence
atgcggaatctcaaaaaagccgctaagttgccagtgatgggcatgatcccatgtttcctgaaaagcccacttgggagtgactatacaagaatcacagaggattcattcagcaagccctacgatggaaagtggtccaagacaatggttgggtttggacctgaagatgaccattttgttgcagagttgacatataactacggtgttggcgattataaactgggaaatgatttcatggggattacattggcttcaagtcaggccgttagcaacgcccggaagcttgaatggcccctcaccgaggtggctgaaggagtgttcgagaccgaagcacctggcggatacaagttttacctccagaataggtctctgccccagagcgatcccgttcttaaggttacactggcggtctcagatctgcagaaatctctcaactattggtgcaatcttttgggcatgaagatctatgaaaaggacgaggaaaaacagagggctctgctgggatatgcagataatcagtgtaagctcgagctgcagggtgtgaagggcggggtagatcacgctgctgccttcggcaggatcgctttttcatgtccgcagaaagagctccctgatttggaggatttaatgaaacgagagaaccagaagatattaacccccctcgtgtctctcgatacaccgggcaaagccactgtacaggttgtcatcctcgccgaccctgatggacatgaaatctgcttcgtgggagacgaggccttcagggagctgagcaagatggaccccgaggggtcaaagttgttagatgacgccatggccgctgacaaaagcgacgaatggtttgcaaagcataataaacctaaggctagcgggtag

SEQ ID NO: 26636 - DNA, 5850 bp, Artificial Sequence
  Description of Artificial Sequence: Synthetic coding sequence
atgggaaactcttacgccggacagcttaagaccacaagattcgaagaagtgctacacaattccatagaggcatctcttcgcagcaataacctggtccctaggcctatcttctctcagctctacctggaggccgagcagcaattggctgctcttgagggcgggtctagagtcgacaacgaagaggaagaagaagagggcgagggtggccttgaaaccaatgggcctcctaatccgtttcagctccatccactgcctgagggctgttgtactaccgacggcttctgtcaggccggtaaggacttgcggctggtaagcatatccaatgagccaatggatgtccccgccggatttctactcgtaggcgtgaaatctccctctttgccggaccacctgttggtgtgtgccgtggacaagcgatttctgccagatgataacgggcacaacgcgctgctgggattctcaggaaactgcgtaggatgcggaaagaaagggttttgctactttaccgagttctctaatcatatcaatctcaagctgaccacccagcctaaaaagcagaagcatctgaaatactatctggtcaggaacgcacaaggaacattgacgaagggcccactcatatgctggaaagggtctgaattccgatctcggcagatccccgccagtacctgttcgtccagcttattcccagcactggaatccactgctgcatttccaagcgagcctgtgcccggaaccaatcccagtattctcatgggagcccagcaagccggcccagctagtgatcaccccagcctgaatgctgccatgggtccggccgtgttcaacggcaaagacagtcctaagtgtcagcaattggccaagaacaatctccttgcccttcctagacctagcgcgctaggcattctatccaactccggaccaccaaagaagcggcacaaggggtggtcgcctgagagcccttccgctccagacggcgggtgtccccaaggtggcggaaacagagccaaatacgagtcggcaggcatgtcctgcgtccctcaggtgggcttggtgggccccgcttcggtcacctttcctgtggttgcatctggcgagcctgtgagcgtgcccgataatcttctgaaaatatgtaaggctaagcccgtaatcttcaaaggccatggtaactttccatatctctgtgggaatctgaacgatgtggtcgtgagccctctgctgtacacatgttaccagaatagccaatcagtatctcgcgcatacgaacagtatggggcctcagccatccagcctatcagcgaggaaatgcagctgttgctgaccgtatactatctcgtgcagttggccgcagatcaggtgcccctcatggaggacctcgagcaaattttcctccgctcctggagggagtctcatttgaccgagataagacagtaccagcaggccccaccccagccttttccccctgccccctccgcagctgctcccgtcacttcggcccagttaccatggctggcgagcctcgcagcatccagctgcaatgatagcgtgcacgtgattgaatgcgcctatagtcttgcagaggggctctctgagatgtttcgactcttggttgagggaaagcttgccaaaactaattacgtcgttatcatatgcgcctgcagatcagccgccatagacagttgcattgctgttacgggcaagtaccaggcgagaattttgagcgagtctcttttaacgcccgccgagtatcagaaagaggtgaattacgagctcgtgacaggcaaggtcgacagcttgggagcctttttctccacactgtgtcctgaaggagacattgatatccttctcgacaagtttcatcaggagaatcaaggccatatcagctcctcacttgcagcgtcttctgtcaccaaggccgccagccttgatgtctctggaactccggtgtgcacatcgtataatctggaaccccatagcattcgcccattccagctggccgttgctcagaaattattgagccatgtgtgcagcattgcggattcctccacgcagaatctcgaccttggcagcttcgagaaggttgattttttaatatgcatcccacccagcgaggtaacataccagcagactttgctgcatgtgtggcactccggcgtactgctagaattgggactgaaaaaggagcacatgactaaacaaagggtggagcagtatgttctcaagttagacacagaagcgcagacgaagttcaaagcttttcttcaaaattccttccagaacccgcatacactgtttgtgctaatccacgaccacgcccattgggacctggtatctagtaccgtccataacttgtattctcagagtgatccatcagtgggtttggtggaccggctgctaaattgccgcgaagtgaaagaggcacccaacatagtaactctgcacgtaaccagcttcccttatgcacttcagacacagcacaccctgatctccccctacaatgagatacactggcccgccagttgtagcaacggagtggacctataccacgaaaataagaaatacttcggcctgtcagagtttatcgaaagcaccctgtctggccattccttaccactcctccgatatgactcttcctttgaagctatggtcactgccctgggcaagaggttcccccgacttcacagtgctgttatccggacatttgtcctggtgcagcattacgctgctgcactgatggcagtctcgggactgccccaaatgaagaactacacctccgtggaaaccctcgagattacacaaaatctgctcaactcccccaaacagtgcccatgtggccacggcctcatggttttgcttcgcgtcccgtgcagtcccctcgctgtggtcgcatatgagaggttggcccatgtgcgcgctcgactggcactggaggagcacttcgagattattttgggttctccttcctccggcgtaactgtcggtaagcacttcgtgaagcagctgcggatgtggcagaagatcgaggacgtggagtggagaccacagacctatctggagctggaggggcttccatgcatattaattttctctggcatggatccacacggtgagagcctgccgcgttccttgcgttactgtgacctgcgattaataaattcgagttgtctggtgcgaaccgctctggaacaagagctcggactggccgcttattttgtctccaatgaagtccccctggaaaagggtgccaggaacgaagcattggaaagtgatgccgaaaagctgtcttcaaccgacaacgaagacgaggaactgggtacggaaggaagcactagcgaaaagaggtcgcccatgaaaagggaaagaagccggtctcatgacagtgcttctagcagtctgtctagtaaggcgtctgggtctgcactgggcggcgagtctagcgcacagcccaccgccttgccccagggcgagcacgctcggtctccccagcccaggggccccgctgaagaaggccgcgcacccggcgaaaaacagcgccctcgcgcctcgcaagggcctccaagcgccataagccgtcacagcccaggccccacaccgcaaccagattgctctcttcgcactggtcagcgctccgtccaggtgtccgtgacatcttcgtgcagccaactgagttcaagctccggaagttcgtctagtagtgtggcgccagctgcagggacttgggtcctgcaagcttcccagtgctccttgactaaggcctgtcgccaaccacctattgtctttctgccaaaattggtctacgacatggtggtcagcactgattcctctggacttccaaaggcagccagccttctcccaagtccatccgtgatgtgggctagctctttccgccccctcttgtctaagacaatgacttctacggaacaatccctttattacagacagtggacggtgccccgtccaagtcatatggattacgggaacagggctgagggacgcgtggatggcttccacccacggcgcctgctgctgagcgggccacctcagattggtaagaccggcgcataccttcaatttctctccgttcttagtcgcatgcttgtgcgccttactgaggtggacgtgtatgatgaggaggagataaacatcaaccttagggaagagtctgattggcactatctccaactgtccgacccttggccagacctcgagctatttaagaagctgccctttgactatatcatccatgatccgaaatacgaagacgcgagtctaatttgctctcattaccagggaatcaagtcggaggacaggggcatgtctaggaagccagaggacctttacgttaggagacagaccgcccggatgcggctcagcaagtatgccgcttacaatacctaccaccactgcgagcaatgccaccagtacatggggtttcacccgcggtatcagctgtacgaaagtaccttgcatgcatttgctttctcctactccatgctcggggaggagatccaactacactttattatccctaaatcgaaagaacaccactttgtcttctctcagccaggaggtcagctagaatccatgcggctgcccctggttactgacaagagtcatgagtatatcaagtcacccacattcactcctacaacagggcggcatgagcatggtttgttcaacttgtatcatgcaatggatggagcctcacatctgcatgtgctggttgtcaaggagtacgagatggcaatttacaagaagtattggcctaaccacatcatgctggtgctgccgtccattttcaactctgccggagtaggggcagcccacttcctgataaaggaacttagctaccacaacctagaactggaacgcaaccggcaggaggaacttggtatcaaaccccaggacatctggccctttatcgtgataagcgacgattcctgcgtaatgtggaacgtagttgatgtcaactccgctggggaaagaagccgagaattctcatggtccgagagaaacgtgtccttgaagcacatcatgcagcacatagaagctgccccagacattatgcactacgcactattgggtcttcggaaatggtcttccaagactagggcaagtgaagttcaagaaccgttctcacggtgccatgtgcacaacttcatcatactgaatgtcgatctgacacagaatgtgcagtataaccaaaatcgatttctgtgtgatgatgtagattttaacctgcgcgttcactccgcagggctcctgctctgccgcttcaatcgcttctccgttatgaagaaacagatagtggtggggggccataggagcttccatatcacatctaaggtgtcagacaacagtgctgctgtggtgccagcccagtatatctgtgcgccagactcaaagcacacatttctcgcagcgcccgcccagctgctcctagagaaatttttgcagcatcatagccatctgttttttcctctctccttgaaaaaccacgatcacccagttttgtcggtggactgttacttaaatttgggatctcagataagcgtctgctatgtttcatcacgaccccattccctcaatataagttgtagcgacctgctgttcagcgggctcctgctctacttgtgtgactcatttgtgggtgcgtcttttctgaagaagttccacttcctgaagggcgccactctttgtgtgatatgtcaagatcgtagctcgttgcgacaaacagtggtccgcctggagttggaggacgagtggcagtttagactcagagacgagtttcaaacagccaacgcacgggaggaccgtcccttgttttttctgacggggcgacatatttag

SEQ ID NO: 26637 - DNA, 1395 bp, Artificial Sequence
  Description of Artificial Sequence: Synthetic coding sequence
atgagagagggcagctcgacattatcggaaatacggaagctgaaacctgggatcatggtttgcacatgtaacccttcctattccaaccaggaaaccgaggtccaggaaaattctcctggtcaccgcgcagggcttgagcccttctttgatttcatagtctctatcaatgggagtaggttgaacaaggacaatgataccttgaaggatttgctgaaagcaaacgtagagaagcctgtgaaaatgctgatctattcttccaagacccttgaactccgggagacctcagtaacaccttcaaacttgtggggcggccaaggcctcttaggcgtatctattcgattttgttccttcgatggcgcaaacgaaaatgtgtggcacgtcctggaggttgaaagcaacagcccagcagccctggcaggacttcgtccacactcagattatataataggggccgacaccgtcatgaacgagagcgaagaccttttctcccttatcgaaacgcacgaggccaaacccctgaaattatacgtatataacaccgatactgacaactgccgggaagtcattatcactccgaactcagcctggggaggggaagggagtctgggctgcggaattggctacggctatctgcaccgcatccctacacggccattcgaagagggaaaaaagatcagcttgcccggccagatggccgggaccccgattacgccactgaaggacgggttcactgaagttcagctgtcttctgtgaatccgcccagtctctcccccccgggaacaacagggatcgaacaaagtctgaccgggttaagcatttcatctactcctccagccgtaagttctgtcttatctacaggcgtgccgactgttcccctcttgcctccccaggttaaccaatccttgaccagcgtgccacccatgaatcccgccaccacgttaccaggccttatgcctttacccgctggtcttcctaacctccccaatctaaatttgaatttgccagctccccatatcatgcccggtgtgggcctcccagaactggttaacccaggtttgccacccctgcccagtatgccacccagaaacctgcccggaatcgcacccctgcccctgccatccgagttcctccctagtttcccattagttcccgagtcttcctccgcagcctcctcgggcgagcttttgagtagcctgccacctacgtccaacgccccaagcgacccagcaaccactactgccaaggcagatgcggcatcatccttgactgtggacgtaacgccacctactgctaaggccccaacgacagtagaggaccgcgtgggagattccacccccgtctctgaaaagcccgtatctgctgcggtcgacgccaacgcttcagagtctccctag

SEQ ID NO: 26638 - DNA, 399 bp, Artificial Sequence
  Description of Artificial Sequence: Synthetic coding sequence
atgataagcatcacagagtggcagaagatcggcgtcggaatcactggattcggtattttcttcattctgtttggaaccctcctctattttgactcagtgctcctggcctttggaaatttgctgtttctgaccggcttgtcactgatcattggcttgcgaaagacgttttggtttttcttccaaaggcataagctcaaagggacctcatttttactcgggggggttgtgattgtgctcctacgctggcctttactcggcatgtttctggagacttatggctttttttctctgttcaaaggcttctttcctgtggcctttgggttcctggggaatgtgtgtaacataccattcctaggggctctattcagaagacttcaagggacgtccagtatggtatag

SEQ ID NO: 26639 - DNA, 918 bp, Artificial Sequence
  Description of Artificial Sequence: Synthetic coding sequence
atgagtgttgaccccgcttgcccacaatcgctcccctgttttgaggcctccgactgcaaggagagcagtccaatgccagtcatttgcggtcctgaagaaaactatcctagcttgcaaatgtcttcggcagagatgcctcataccgaaactgtttcgcccctgccctcgagcatggaccttctaattcaggatagcccggatagtagcacctctccaaaaggcaaacagcccacaagcgcggagaaatccgttgcaaagaaagaggacaaagtccctgtaaaaaagcagaaaacccgcacagtgttttctagtactcagttatgtgtactgaatgataggttccagaggcagaagtacctcagccttcagcagatgcaggaactgtccaacattctcaatttgtcatataagcaggtgaaaacatggtttcagaaccagaggatgaaaagcaaacggtggcaaaaaaacaactggccgaagaatagcaacggagtcactcagaaggcttctgctcctacttacccatccttatactccagctatcaccagggctgcctggtgaatccaaccggcaatttgcctatgtggtcaaaccagacttggaacaactccacctggagtaatcaaactcaaaacatccaatcatggtccaaccattcatggaatactcagacctggtgtacccagtcgtggaacaaccaggcctggaattctcccttctacaactgcggcgaggagagtttgcaatcctgcatgcaattccagcctaatagccccgcctccgaccttgaagccgccctggaagccgcgggagaagggctgaatgtcatccagcaaaccactaggtatttctctacaccccaaacgatggatcttttcctgaattactctatgaatatgcagcctgaggacgtctag

SEQ ID NO: 26640 - DNA, 1842 bp, Artificial Sequence
  Description of Artificial Sequence: Synthetic coding sequence
atggcggctaccgcagtggctgcagccgttgccgggactgaaagcgctcagggccctcctggccccgccgctagcctggagctatggctcaacaaagctaccgacccaagcatgtcagagcaggactggagcgcaattcagaatttttgcgagcaggtgaatactgaccccaatggacctacacacgccccgtggctgctggcccataagatccaatcacctcaggaaaaggaggccttatatgcactcactgtgttagaaatgtgtatgaaccactgcggcgagaaattccattctgaagtagccaagtttcgatttctcaacgagttgatcaaggtcctcagccccaagtacctgggctcctgggcaacggggaaagtcaaaggcagagtaatagagatcctctttagttggaccgtgtggttccctgaagatattaagatcagagacgcttatcaaatgctaaagaaacaggggatcatcaaacaggatcctaagctgccagttgacaagatcctcccaccaccatcgccttggcccaagagcagcatattcgatgctgatgaagagaagtccaaactgctgacccgccttcttaagtccaaccaccccgaggaccttcaagcagctaataggttgatcaagaacctggtcaaggaggaacaagaaaagtctgagaaagtctcaaaacgcgtgtctgcagtcgaggaggtccggtcacatgtcaaggttcttcaggagatgcttagcatgtaccggcgccccggccaagcccctcccgaccaggaagctctgcaggttgtttacgaaagatgcgaaaagttgcggcctactctgtttagactggcctcagatactaccgacgacgacgatgccctcgctgagatcctgcaggccaacgacctgctaactcagggggtacttctgtacaaacaagttatggagggcagagtaacttttgggaatcgggtaacgtcctccctcggtgacatccccgtttccagggtttttcaaaatccggccggctgtatgaaaacatgccccctgatcgacctggaagttgataacgggccagcccagatgggaacggtggtgccttctttactacaccaagaccttgccgccttaggaataagtgacgccccagtgaccggtatggtctccggccagaactgttgcgaagagaagcggaacccatcctcttcaaccctgccaggcggtggtgtgcagaaccccagcgccgacagaaacctgctggatcttcttagtgctcagcctgccccatgcccattgaactacgtaagccagaagtccgttcccaaggaggttccaccagggactaagtcatcacccgggtggagctgggaagctggacctttggcaccttccccttcaagtcagaatactccattggcacaagtgttcgtgccactcgaatcagtgaaaccaagcagccttccccctctgattgtgtacgaccggaacggattcaggatactgctgcacttcagccagacaggcgccccaggccaccctgaggtccaggtgctgctgctaaccatgatgtccacggccccgcagcccgtatgggatatcatgtttcaggtggccgtgcctaagtctatgagagtgaaacttcagcccgcctcctctagtaagttgccagcttttagtcccctcatgcctccggctgtgatcagccaaatgctcctcctcgataatccccacaaggaacctatcaggctgcggtataaacttaccttcaaccagggcgggcaaccattttcagaagttggggaagtgaaggactttcctgaccttgccgttctaggagccgcatag

SEQ ID NO: 26641 - DNA, 522 bp, Artificial Sequence
  Description of Artificial Sequence: Synthetic coding sequence
atgactttctccaagctcctcatttgtcttgactttctcgatgtgctggagcgcatgggtgtagctctgctttttatctggaaacaggtggaattgctcttagggataagcttgtacagcttcttgaccggtatctcagatgcccccgtgacaggaatggtcaggatgccctttccggggccgggggagaggatggggggatcccaaacgtgcccctgcgaggcagctcttcccggcgaacagaggggcgctccggcactttccagatgggaccacggacttggagggccaaaaccccttcctcatccatattgtctcgcggatacatggggacggcaagtggcaccaggtagctgttttctagaggtctgtcccggcgctgcctgtgatctggccttgagtttcccctcttgcccaaagcgctgccaccagtccggcccccagcagctgggttgggctcaagagtcctgcgcgctggtactgctgtggctgatggtcatccacactctcgtgctgttttag

SEQ ID NO: 26642 - DNA, 861 bp, Artificial Sequence
  Description of Artificial Sequence: Synthetic coding sequence
atggctgtgcctcaaccaatgcctagcatacccgaggacctcgagtctagggaggcaatggtggcttttttcaattccgccgttgctagtgcagaagaagaacaggcacggctccgcggacagctcaaggagcagagggtccggtgccggcgcctggcacaccttctcgccagcgcccagaaggagccagaagctgctgcccccgctcccgggaccggaggagattcagtatgcggggagacgcaccgggcgctgcaaggagctatggaaaaattacaaagccggtttatggaactaatgcaagagaaggcagacctgaaggagcgagtcgaagagctggagcatagatgcattcaattatcaggagagactgatactataggtgagtatattgcactgtaccaatcccagagggccgtgctaaaagagcggcatagagaaaaagaggagtacatctctagacttgctcaagacaaggaagaaatgaaggtcaaactgctggagctgcaggaactggtgctgagactcgtcggcgaccgtaacgaatggcatgggcggttcttggccgctgcccagaaccccgctgacgaaccaaccagcggcgctcccgctccgcaagaactgggcgcagccaaccagcagggtgacctctgcgaggtgtccctggccggaagcgtggaacccgcacagggcgaggcgcgggagggtagccctcgcgacaacccaaccgcccagcagatcatgcagctgttgagagaaatgcagaatccacgcgagagacccggattgggatctaacccgtgtatccctttcttctaccgggctgacgaaaacgatgaggtgaagattacggtaatttag

SEQ ID NO: 26643 - DNA, 3009 bp, Artificial Sequence
  Description of Artificial Sequence: Synthetic coding sequence
atgtggccccaacctcggctgcccccacgccccgctatgtctgaagaaacacgccagagcaagctagccgcggcaaaaaagaagctgcgggagtaccaacagaggaatagccccggggtccctacaggcgcgaagaaaaaaaaaaagattaaaaatggctctaaccccgagaccactacctccgggggttgtcactctccggaggacaccccgaaggacaacgctgccacgctgcagccgtcagatgataccgtgctgcccggaggagtgccctctccaggggcttccctgaccagtatggcggcttcccaaaatcacgacgcagataacgtccctaatctgatggacgagaccaaaactttctcgtccaccgagtctctgcggcaactgtcacagcaactgaatgggcttgtgtgtgagagcgctacctgcgtaaatggagaaggccctgccagctccgcaaatctgaaagaccttgaaagccgttaccagcagcttgcagtggccctcgatagcagctacgttacaaacaaacagctgaacattaccatcgagaagttgaagcagcaaaatcaggaaatcactgatcagttagaggaggaaaaaaaagaatgccaccagaagcaaggagctctgcgagagcagttgcaggtccacatccagaccatcggcatcctagttagtgaaaaagcggaactccagactgcactggcacacactcagcacgctgcccgccagaaggagggcgagtcagaagatctcgcttcacgcttacagtacagccggcgtcgcgttggcgaattggaaagagctctttccgctgtgtctacccaacaaaaaaaagccgaccggtataataaagagttgaccaaggaaagggacgccttaaggctcgaactgtataagaacacccagtcaaatgaagacttgaagcaggagaagtccgagctggaagagaagctcagggtgctggtgacagaaaaagccggaatgcagctcaatctcgaggagttacaaaagaaactcgagatgacagaattgctgctacagcagttctcctcaaggtgtgaagcccctgacgcgaaccagcagctgcagcaagccatggaggaacgtgctcagctcgaggcacacctcggccaggtgatggagagcgttaggcagcttcagatggagagggacaagtatgcggaaaacctcaagggtgagtcagctatgtggcgccaacggatgcagcagatgtcggaacaggtacatacacttagggaggaaaaggagtgtagcatgtcccgagtgcaggagttagagacatcactcgctgagctgaggaatcaaatggctgagcccccccccccagagcctccagcaggtccgtcggaggtggagcagcaactgcaggccgaggccgagcaccttcggaaagaactggaagggttggcaggtcagctgcaggcccaggtgcaggacaatgaggggcttagccggctcaatcgagaacaggaggaaagactgttggaactggaacgcgcggctgagctatggggcgagcaggccgaagcccgccgacaaatcctcgagacaatgcagaacgatagaaccacgattagcagagctctttctcaaaatcgcgagctcaaagaacagctcgccgaactccaatccggtttcgtcaaactgaccaatgagaatatggagattacaagtgcattacagagcgaacaacacgtcaagcgagagctggggaaaaaactcggagaactgcaagaaaaactgtccgagttgaaggagactgtggaactgaaaagccaggaagctcagagcctgcagcagcagcgagatcagtatctcggccatctgcagcagtacgttgcggcttatcagcagttaacctctgaaaaggaagtgctccataatcagttattattacagactcaactggtggatcagctgcagcagcaggaggcccagggcaaagctgtggccgagatggctaggcaggagttgcaggagactcaggaaaggctggaagccgccactcagcagaaccaacaactacgcgctcaacttagtctgatggctcaccccggggagggcgacggcctggacagagaggaagaggaggatgaggaggaagaggaggaggaagcagtcgccgtgccacagcctatgccttcaattcccgaggatctggagtctagagaggccatggtggcgttctttaattccgcagtggcatcagctgaggaagagcaggcacgcctgcgggggcagctgaaggagcagagagtgaggtgtcgtagacttgcgcacctactcgccagcgcccagaaagagccagaggccgccgcaccggctcctggcactggcggggattctgtatgtggcgagacacatcgcgctctacagggcgcaatggagaagctacagtcacgatttatggaactcatgcaggaaaaagccgatctgaaggagagggttgaggagctggagcaccggtgcatacagctatccggagagacagatacaatcggcgaatacattgcgctgtatcagagtcaacgcgccgtgctcaaagagagacacagggaaaaggaggaatacatctcgcgcctcgcccaggacaaggaagagatgaaggtgaaactactcgagttacaagagctggtcctaaggttggttggagataggaacgaatggcatggccgctttctggccgccgcccagaatcctgccgacgaacctacctctggggcaccagccccccaggaactaggcgctgcaaatcagcagggagatctttgtgaggtgtcccttgctggaagtgtggaacccgctcaaggggaggcacgcgaggggagtccccgcgataaccccacagctcagcagattatgcagctcctgagggaaatgcagaatcctagagagcggcccggcctaggttcgaatccctgcatcccctttttctatcgggctgacgaaaacgacgaagtgaagattaccgtgatttag

SEQ ID NO: 26644 - DNA, 1422 bp, Artificial Sequence
  Description of Artificial Sequence: Synthetic coding sequence
atgtggccccagccccggctgcctcctcgtcccgcaatgtccgaggagactaggcaatcgaagttggctgctgcaaagaaaaagctccgggaatatcagcagcgaaacagccctggcgttcccaccggggcaaagaaaaaaaagaaaattaagaatggctccaaccctgaaactacgacctcaggcggatgccattctcccgaagatatccaggacatcttgaaagtgttggtttcagatctgaaccgctctaatggggtagcccttccccccctcgacaagtggaagacaccaaaggacaacgctgcaacgctgcaaccgtccgacgacaccgtcttgcccggcggagtcccatctccaggtgcctcgctgacctctatggccgcttctcaaaatcacgatgccgataatgtacccaatttgatggatgaaacgaagacatttagctctacggaatctctccgacagctcagccagcagctaaatggtctggtgtgtgaatctgcaacatgcgttaacggcgagggccccgccagcagcgcaaatttgaaggacctggagtctaggtaccaacagctggccgtggccttggactcctcttacgtcaccaacaagcagcttaatataaccatcgagaagctgaaacaacaaaatcaggaaataaccgatcagctcgaggaggaaaaaaaagaatgccatcagaagcaaggcgctcttcgggaacagctccaggtacacatccagacaattggaatcctggtcagtgagaaagcagagttacagacagctctagcccacacccaacacgccgcaagacagaaagaaggcgagtcagaggacctcgcctctcgtttgcagtactcacgtagacgggtcggtgaactcgaaagagcacttagcgccgtaagtactcagcaaaagaaggcagaccgctacaacaaggaactgaccaaggaacgagacgccctgcgcctggaactgtacaaaaacacgcagagcaatgaagatctgaaacaggagaaaagtgaattggaagagaagctccgcgtactggtgaccgaaaaggccggcatgcaactcaaccttgaggaacttcaaaaaaaactggaaatgactgaactgctcttacagcaattcagctctcgatgcgaggccccagacgccaatcaacagctgcaacaggcaatggaggaacgagcacaactcgaggcacatctgggccaggtaatggagagtgtccgtcaacttcagatggagcgggacaaatacgcagagaatttaaagggggagagcgccatgtggcggcagcgaatgcagcaaatgtccgagcaggtccacacgctgcgcgaagaaaaggagtgctctatgtccagggttcaagaattagagacatcccttgcggagcttagaaatcagatgtag

SEQ ID NO: 26645 - DNA, 414 bp, Artificial Sequence
  Description of Artificial Sequence: Synthetic coding sequence
atgcgcccccagcaggccccggtcagcggtaaggtgtttatacagagagactactcttcaggtaccaggtgtcagtttcagactaaattcccagccgaactcgagaacaggatcgataggcaacaatttgaggagacagtccggaccctgaataatctgtatgccgaggctgaaaaattaggagggcagagttacctcgagggctgcctcgcctgtctaactgcttatacgatctttctgtgtatggaaacacactacgaaaaggttctgaagaaagtgtccaaatacattcaagaacagaatgagaagatctacgccccacaaggtttgctcttgacagatcccatagagaggggactacgcgtgatcgaaattacgatctatgaagatagaggtatgtccagcgggcgctag

SEQ ID NO: 26646 - DNA, 405 bp, Artificial Sequence
  Description of Artificial Sequence: Synthetic coding sequence
atgagaccgcagcaggctccagtatcagggaaggttttcatccagcgggactattcttctgggactaggtgtcagtttcagaccaagttcccggcagagttggagaaccgcatcgacaggcagcaattcgaggaaaccgtcagaaccctgaataacctctatgccgaagcggaaaagttgggcggccaatcttacctcgagggctgcctggcatgtcttaccgcgtacacaatcttcctgtgtatggagactcattatgaaaaggtactgaaaaaagtgagtaaatatattcaggagcagaatgaaaaaatttacgcaccacagggcctgctgctgacagatcctatcgagaggggtctgcgtgtatttaggctgaagttgccctttatgaagacagaagcttag

SEQ ID NO: 26647 - DNA, 414 bp, Artificial Sequence
  Description of Artificial Sequence: Synthetic coding sequence
atgaggcctcagcaagcgcccgtgtcagggaaggtttttattcaaagagattactccagcggcactaggtgccagtttcagacgaagttccccgcggagctcgaaaaccgcattgacaggcagcagtttgaagaaaccgtgagaacccttaacaatctatacgcggaagctgaaaagctcggcgggcaatcttacctcgaggggtgccttgcctgccttactgcctataccatattcttgtgtatggaaacccattacgagaaggtcctcaaaaaggtgtccaagtatatccaggagcagaatgagaaaatttatgcaccacagggattattgttgaccgatcccatcgagcgcggtctgagagtgatcgaaattacaatatatgaagatcgtggaatgagttcaggccgctag

SEQ ID NO: 26648 - DNA, 414 bp, Artificial Sequence
  Description of Artificial Sequence: Synthetic coding sequence
atgcgaccacaacaggcaccagtcagtggcaaagtcttcatccagagagattattcatccgggacgcggtgccaattccaaaccaagtttcctgcagagctcgagaatcgcattgatcggcagcagtttgaggagaccgtcagaacactgaataacctgtatgccgaagcggaaaaactcggcggccagtcctacttggaaggatgcctagcctgtcttacagcttatacgatctttctgtgtatggaaacccattatgagaaagtcttaaagaaagtcagtaagtacattcaagagcagaatgagaaaatctatgcccctcaggggctgttgctgactgacccgatcgagaggggactgcgtgtcatcgaaatcacgatctatgaggacagaggcatgtcaagcggaaggtag

SEQ ID NO: 26649 - DNA, 501 bp, Artificial Sequence
  Description of Artificial Sequence: Synthetic coding sequence
atggatgatcaacgatgccctctggatgacgggcaggctggagccgccgaggcgaccgctgcacccaccctggaagatcggattgcccagcccagcatgacggcctctcctcagacggaggaatttttcgacctgatcgctagctcgcagtctcgacgactggacgaccagcgcgcctctgttggatcacttcccggcttgagaatcacgcattccaacgctgggcacctccggggacacggcgagccgcaggagcccggtgacgattttttcaacatgctgataaagtaccagagcagtagaattgatgaccaacgctgtccaccacctgacgtcttaccgaggggcccaacaatgccagacgaggacttcttcagcttaatccaacgggtgcaggctaagcgcatggatgaacagagagtggacctggctggcggacctgaacagggcgccggtggaccacccgaaccccagcagcagtgccaacctggggcttcgtag

SEQ ID NO: 26650 - DNA, 1959 bp, Artificial Sequence
  Description of Artificial Sequence: Synthetic coding sequence
atggaggcttcatgcctggaacttgccctcgaaggagagcgcctgtgcaaagccggcgattttaaaacaggggtggcctttttcgaggctgccgtgcaggtggggactgaggacctcaaaacgctctcagcaatatattcacaactgggaaatgcctacttctatctgaaagagcacggtagggctcttgagtatcacaagcacgatttattgctagccagaaccattggagaccgtatgggcgaagctaaggctagcggaaacctcggtaacacacttaaggtactgggacgtttcgatgaagcagccgtttgctgtcaacggcatctgtcgatagcccaggagcagggggacaaagtcggagaggcacgcgccctttacaacattggaaatgtgtaccacgctaagggcaagcagctctcttggaatgcagccaatgctacacaggatcctgggcacctccctcccgatgtcagagaaactctctgtaaggctagtgagttttacgagcgaaatctctctctggttaaagagctgggggatagagctgcccagggccgcgcatacgggaatcttggcaacactcactacctgctaggtaacttcacggaagcgacaaccttccacaaggaaagactcgccattgccaaagagttcggcgacaaagcggctgagcgaagagcatattccaatctaggtaatgcccatgtgtttctgggcagattcgacgttgccgccgagtattacaagaaaactctacagctatctcggcagctgagggatcaagctgtggaggctcaggcctgttattctcttgggaatacctacaccttgctgcaggattacgaaagggccgcagaatatcacctgaggcacctcctcatcgctcaggagcttgcagatagagtaggggaaggtagagcttgctggtccttgggaaatgcttatgtatccatgggtcgtcccgctcaggcgttaacattcgccaaaaaacacttgcagatcagtcaggagatcggggaccgacacggcgagctaactgcgcgtatgaatgtagcccagcttcaactcgttttgggacgactgacctccccggccgcctctgagaagccggatctggcaggctatgaagcacagggtgctcgccccaagagaacacagcggctttctgctgaaacctgggatctgttgagactcccactggaaagagaacagaacggcgattctcatcactctggcgattggcgggggccatcccgggattccctgccactacccgtcagaagtagaaagtaccaagaaggtccagacgcagaaagaagacccagagagggaagtcacagtcctttggacagtgccgatgtaagagtgcacgttccaagaacgtccatccctcgagcaccctctagtgatgaggaatgctttttcgatctgttgacaaagttccagtcaagccggatggacgatcagcgatgccctttggacgatggacaagccggtgccgccgaagcgactgccgcacctactcttgaagaccggattgctcagcctagtatgaccgcttccccccagaccgaagaattttttgacctcatagccagctcgcagtccagacggctggacgaccagcgagcttctgtcgggtctctgcctgggttaagaatcacacactctaatgctggacatctgaggggacatggagaaccccaagagcctggagacgactttttcaacatgcttattaaatatcaaagcagccgaattgacgatcagcgatgtccccctccagacgttctcccaaggggcccaaccatgcccgacgaggattttttttcactgatccagcgagtccaggcgaaaaggatggacgaacagcgagtggacttagctggcggaccagagcaaggcgccggcggacccccagaaccacagcagcaatgccagcccggcgccagctag

SEQ ID NO: 26651 - DNA, 501 bp, Artificial Sequence
  Description of Artificial Sequence: Synthetic coding sequence
atggatgatcagcgatgtccactcgacgatgggcaggctggcgctgctgaagctactgctgcccccactctggaggatcgaatcgcacagcccagtatgacagccagcccacagaccgaagaatttttcgacctgattgcatcttctcaaagtcggcggctggatgaccaaagggcatctgttggaagtctccctggcctccgtatcacgcacagtaatgcggggcaccttagggggcatggcgagccacaagaacccggcgatgatttttttaacatgcttatcaaatatcagtcttcccggatagatgaccaacgctgcccacccccggatgtgctgcctagaggccccacaatgccagacgaggacttcttctcattaatccagcgggtgcaagctaagcggatggacgaacagcgcgtggatctggccggcggccctgagcaaggagcagggggaccacccgaaccccagcagcaatgccagccgggagcaagttag

SEQ ID NO: 26652 - DNA, 1374 bp, Artificial Sequence
  Description of Artificial Sequence: Synthetic coding sequence
atggccggcccggccccccctgtggccgatgagctgcctggccctgcagcccgccggttatattcaagaatggaagcaagctgtcttgagctggccttggaaggcgagagactgtgcaaagcaggcgactttaagactggagtggcattcttcgaagcggcagtgcaggtgggcaccgaagatctgaaaactctgagtgcaatttactcccagctcggcaatgcctacttttatttgaaggaacacggccgtgcattagagtatcataaacacgatctgttactggctaggacaattggagatcgaatgggagaggccaaggcttccggtaacctgggcaacaccttgaaagtgctcggccggttcgatgaagcagcggtgtgctgtcagagacacctgtcaatcgcacaggaacaaggagataaagtgggagaggctagggccctctataacattggtaatgtttatcacgctaagggcaagcagctctcttggaatgctgctaacgctacacaggaccctggacatctccctccagacgtgcgggagacactttgcaaggccagcgagttttacgagcgaaacctctctctcgtgaaggaattgggcgaccgggctgctcagggaagggcgtatggtaatcttggcaatacacattatttgctggggaacttcactgaagccacaaccttccacaaagagaggctggctatagccaaagagttcggtgacaaggcagcagaacgtagagcgtactcaaacctgggaaatgcgcacgtgtttttaggtaggttcgacgtcgccgctgagtactataaaaaaacgttgcagctgagcaggcagcttcgtgatcaggctgtggaagcccaagcctgttattccctggggaatacttacaccttgctccaggactacgagcgagccgccgagtatcacttgaggcacctactgattgcccaggagctggcagaccgtgtgggggagggtcgcgcatgctggtctttagggaacgcctatgtttccatgggacggccggcgcaagctcttacatttgccaaaaaacatctgcagattagccaggaaattggtgaccgccatggggagctgactgctcgcatgaacgtggcccagctccagctggtcctgggccggttaacaagtcccgcagcatctgagaagcctgatctggctggatacgaggcacagggagagttccaaggttgcggaggtgtgctgctgccaacgggaactgacagaatccggagctgcggcggcgtgggctcaaggcctggacaacacgggggcggcgggagcaggcagaaaatggctcctaccagtcagttcttccttgcttctggtaccgctcaggcttag

SEQ ID NO: 26653 - DNA, 501 bp, Artificial Sequence
  Description of Artificial Sequence: Synthetic coding sequence
atggacgatcagcggtgtccccttgacgacggccaagctggggcggcagaagcaaccgccgctcctactctcgaggatcgaatagcacagccaagtatgaccgcctctcctcagaccgaggagttcttcgatttgattgcttcatctcaaagtcgccggctcgatgatcagagagcatctgtcggtagcctgcccggattgcgcatcacccacagcaacgcgggccacttacgcggtcacggcgagccgcaggagccgggggacgactttttcaacatgctaatcaagtatcaaagcagccggattgacgaccagcgctgtccccccccagatgtgctgcctaggggcccgaccatgccagatgaagatttcttctcgctgatacagcgagtgcaagctaaaagaatggatgaacagagggtggacctggcaggaggacccgagcaaggagcagggggcccaccagaaccacagcagcaatgccaaccgggcgcttcttag

SEQ ID NO: 26654 - DNA, 2028 bp, Artificial Sequence
  Description of Artificial Sequence: Synthetic coding sequence
atggcaggacccgcccctccggtggccgatgaattgccagggcccgcagcgcggcggctttattcgaggatggaggcatcctgtctggagctggccttggagggggagaggctatgcaaagctggagactttaaaacaggcgttgccttcttcgaggctgccgtgcaggtggggaccgaggatctgaaaactttgtccgccatttattcccagctggggaacgcctatttctatctgaaggagcatggtcgtgctcttgaataccataaacacgacctcctactcgccaggactatcggcgaccgcatgggtgaagctaaggcttctggcaatttgggtaataccctgaaggtgcttggaaggtttgacgaggccgccgtctgctgtcagagacacttatccattgcacaggagcagggggataaagtgggcgaagctagggccctgtacaacatcggaaatgtgtaccacgccaaggggaagcagttgtcatggaacgccgccaatgctacgcaggatcctgggcatctcccacccgatgtgcgcgagaccctgtgcaaggcttccgaattctatgaacggaatctgtctctggtgaaagaattgggtgatcgcgcggctcaggggagggcatatggaaacttagggaacacccattatctgcttggcaattttactgaagctactactttccacaaagaacggctcgcaatcgccaaagagtttggagacaaggccgcagagcgcagggcatattctaacctcggcaatgcccatgtctttctaggacggttcgacgtggcagcagagtactacaagaagacgctgcagctctctcggcaactgagagaccaagccgtggaggctcaggcttgctattccctgggaaacacctacactcttctgcaggactacgaacgcgcagcggagtatcatttacggcatctgttgatagcccaggagttagccgatcgggttggggagggacgcgcttgttggtctcttggcaacgcctatgtctccatgggacggcccgctcaggcattgactttcgctaagaaacacttgcagatttctcaggaaattggggataggcatggcgaactgacagctagaatgaatgtggcccagctgcagctggtcttgggcaggctgacttcgccagccgcttctgagaagcccgatctcgcggggtatgaagctcaaggagcacgccctaagaggacgcaaaggctaagtgctgagacctgggatctcttgcggctgcccctggaacgcgagcaaaacggcgattcccaccactctggggactggcgagggccgagcagggattccctccccctgccagtgaggagccgaaagtaccaagagggaccagacgccgaacggaggccacgtgaaggaagccatagtcccctggattccgccgatgttagggtgcacgtaccccgaacttcaatacctagggccccttcttctgacgaggaatgtttcttcgacctgctgacgaagttccagagctcccgaatggacgatcagagatgccccttagatgatggacaggcgggagccgcggaggcaacagcagccccgactcttgaggaccgaatagcccagccatcaatgactgcctcaccgcagactgaggagttctttgacctgatagcaagttctcaatcgagacggctggacgatcagagagcctctgtaggctccctgcccgggctgcgaatcacccacagcaacgctggccatttgcggggtcacggggaaccccaggagcctggcgatgacttctttaatatgctcatcaaatatcagtcctctagaattgatgaccagaggtgtccaccacctgacgttcttccccgcgggccaaccatgccggatgaggactttttttcactgattcaacgtgtgcaggccaaacggatggatgaacagagggtggatctcgccggaggtccagagcagggggccggcggcccccccgaaccacagcagcagtgtcaaccaggagcttcctag

SEQ ID NO: 26655 - DNA, 2175 bp, Artificial Sequence
  Description of Artificial Sequence: Synthetic coding sequence
atgtttgatactaccccacactcaggtcggagcactccaagctcaagcccgtccttgagaaagaggctgcagctgctgcccccttcacgtcctcctccggaacctgagccaggtaccatggtcgaaaaagggtctgactcaagctctgagaaaggcggcgtcccgggtaccccatccacccagagccttggttcccgcaacttcattcgaaattctaagaagatgcagagctggtattctatgctgagcccgacttacaagcagagaaatgaggatttcagaaagctgtttagtaaactgcctgaagccgaacgcctcattgtggattatagctgtgccctacaaagggagatattactccagggccggctctacctgagcgaaaattggatttgtttttattctaatatattccggtgggaaactactattagcatccaactcaaggaagtcacttgcctgaagaaggagaagactgctaaattgatccctaacgcgatacaaatttgcacagaatcagagaagcacttttttactagctttggagctagagaccgctgcttcctgctcatcttccgcctctggcagaatgctctgctcgagaagacactgtcaccccgggagctctggcatctcgttcatcagtgctatggctcggagttggggctgacatcagaagatgaagattatgtttccccactgcaattgaacggcctcggtacacccaaggaggttggtgacgtcatcgcactgtctgacatcacctcaagcggcgccgcagaccgatctcaggagccaagccctgtgggatctcgccgcgggcacgtcactcccaatctgtcccgcgcgtctagtgatgcagatcatggggccgaggaggataaggaagaacaggttgattcgcagcctgacgcctcatctagtcaaactgtcacccccgtcgccgaaccccctagcaccgaacctactcaacctgatggcccaacgaccctcggtccccttgacctcctacccagtgaagagctgttgactgacacatctaattcctcatctagtaccggagaagaagctgacttggctgctctgttacctgatctaagcggccggctgctaatcaatagtgtctttcatgtgggggccgagagacttcagcagatgctttttagcgattccccattcctgcaggggttcctgcagcagtgtaaatttacagatgtgaccctttcaccctggtccggagacagtaaatgtcatcagcggcgcgtcctgacctacaccatccccatttccaatcctctcggccctaagagtgcaagtgtcgtagagacccagactctgtttcggaggggcccacaagctggcggctgtgttgtagattcagaggtcctgacccagggaattccttaccaggattacttctatacagcccataggtattgcatcctaggactggcccgaaacaaggcaaggctcagggtgtccagcgagataaggtataggaagcagccttggtccctcgtgaagtccctgatcgagaagaattcatggtccggaatcgaggattatttccaccacctcgaaagagagctggcgaaagcggagaaactctctttagaggaggggggcaaagacgcgcgtgggctgctgtctggcctccgtcgcagaaagcgacccttatcctggagagctcacggtgatggaccccagcaccccgaccctgacccctgcgctcgcgccggtattcatacttcgggcagtctgagcagcaggttcagtgagccttccgtggatcagggtccgggggcgggtattcctagtgccttggttctaatctccattgttatctgcgtctctttaataattctcatagcattaaacgtcttactcttctataggctgtggagtctggagcggacagcacacacattcgagtcgtggcatagcctggctctggccaagggtaagtttccccagacagccacagagtgggctgagatactcgcattgcaaaaacagttccactccgttgaggtgcataaatggcggcagatcctgcgtgcctcagttgaactcctggacgaaatgaagttctctctggaaaagttgcaccagggcatcaccgtttccgatcctccatttgacacccagccaagacctgacgactcgttttcatag

SEQ ID NO: 26656 - DNA, 2142 bp, Artificial Sequence
  Description of Artificial Sequence: Synthetic coding sequence
atgtttgatacaacccctcactcgggtaggagcacaccttctagtagcccatcactcagaaagcgactgcagctgttgcccccctcccggccaccaccagaacctgagcccggaacaatggtcgaaaagggttctgattccagctctgaaaaggggggggtgccaggtacaccatcaacccagtccctggggtcccgcaattttatacgcaattcaaagatgctgtcccccacgtacaagcagagaaacgaagactttagaaagctcttctctaagttacctgaggccgaaagactgatcgtcgactactcttgtgcactgcagagggaaatattgctccaaggtcgtctgtaccttagcgaaaactggatttgtttctattcaaatattttccgttgggagacgacaatctcaatacagttgaaagaggtaacatgcctgaaaaaggaaaagacagccaaactgatccccaatgccatacagatctgtaccgagtccgaaaagcatttcttcactagcttcggagcgagggataggtgttttctgctaatcttccgcctgtggcagaacgccctactagagaaaacgctctccccccgagagctctggcacttggtacatcagtgttatggaagtgagttggggctcacatcagaagacgaagactatgtcagcccccttcaactgaacggactgggaaccccaaaggaggttggtgacgtcattgcactcagcgacatcacttctagcggcgctgcggaccggtctcaggaaccttcccccgtgggcagcagaaggggccacgtcacccctaacttaagtagagccagtagtgacgccgaccacggagcagaagaggataaagaggagcaggtggattcccagcccgacgcttcttccagtcaaactgtcacccccgttgcagagcccccctctactgagcccacccaacctgatgggccgactactctggggcccttagacttgctccccagcgaagagctgctgacagacactagcaattctagctcgtctacgggtgaggaagccgacctggctgctttgctgcctgacctgagcggccgacttttgatcaactctgtattccacgtgggcgccgagcggctacagcagatgttgttctctgacagcccatttctgcagggcttcctccagcagtgcaaatttacggatgtgaccctgagtccttggtcaggagatagtaaatgccaccagcgaagagtgctcacttacacgattcctatcagtaatcccctgggccccaaatctgcctccgtggtcgagactcagacactgttcaggcgggggcctcaggctggaggttgcgtggtcgacagcgaggtgctgacccaaggcattccctaccaagattacttttacacagctcatcggtattgcatactggggttggcccgtaacaaagcccggctgcgggtgtcttctgaaattaggtatcgtaaacaaccgtggtccttggtgaagtcgctcattgagaagaactcctggagcgggatagaagactacttccaccatcttgagcgggagctcgcaaaggcagaaaagttgtccctggaagagggagggaaagacgctcgagggctgctctcaggtctccgcagaagaaagcgccctctcagctggagggctcatggagatgggccccagcaccctgacccagacccctgtgcaagagctgggatccatacaagtgggtctttgagctcgcggttttccgagcccagcgtagatcaaggtccaggagctgggatccctagcgcactcgttttgatatcgatcgtcctcattatattgatcgcgctgaacgtgttgctgttttatcggttgtggagcctcgaacgcaccgcccacacctttgaaagctggcactccctggcgctggccaaggggaagtttccgcagaccgctacagagtgggccgagatccttgcgctgcagaagcagtttcacagtgtggaagtgcacaagtggaggcagatcctgagggccagtgtggagctgctagacgagatgaagtttagcctcgagaaactccatcaaggtataactgtctcggacccgcccttcgacacccagcccaggccagacgattcattctcatag

SEQ ID NO: 26657 - DNA, 2421 bp, Artificial Sequence
  Description of Artificial Sequence: Synthetic coding sequence
atggacgacgtgctgcctttaatgccatgggagaccctgcttgcccagggttcccctcaggggtcacccgacttgcctgctggccagcggaaacagcagccccagggggaccgcgcccagggattggcttctgaatcctggaaattactagaggtgccaattatccacatcactccttcatctgatggcgaaagccccgcttgtactcccactcctaggaggcggcagcaacagagaatgccagatcctcagagccttagtcaggacagcactacaccacactccgggaggagcactccaagttcatctcccagcttgcgcaagagactccagctgttgcccccatctcggccccccccagagccagagcctggcacaatggtagagaagggctctgattcctcaagcgagaaaggcggcgtccccggaacaccaagcacacagagcctgggtagcaggaactttatacgcaacagcaaaaagatgcagtcctggtactccatgctgtcaccaacgtacaagcagcgaaatgaggattttcgtaagctctttagtaagctccctgaggccgaacggttgatcgtggactactcctgcgcgctgcagagagagatcctgctgcagggccgcctgtacctttcagaaaattggatatgcttctacagcaatatttttagatgggaaacaaccatcagcatacagctaaaagaggttacttgcctgaaaaaagaaaagaccgccaaactgatcccaaatgccatacagatttgtaccgagagcgagaaacacttcttcaccagcttcggggcccgcgaccgctgttttctcctcatctttagactgtggcagaatgcattgctcgagaaaaccctgtcaccccgggaattatggcacctggtgcaccagtgctacgggagcgaactcggtctaacctcagaggatgaagattacgtgagtccattgcagctgaatggtttgggcacccccaaagaagtgggcgacgtaatcgcacttagcgatatcacttctagcggagctgcggacagatcgcaggagccttcccctgtcggcagtagaaggggccatgtcacacccaatttgtcccgggccagcagcgacgctgatcatggcgccgaggaagataaagaggagcaggtagactcccagcccgacgcgtcatcctcccagacagtcactcccgtggcagaacctcccagtacagaaccaacccagccagacggacccaccaccctgggaccattggatctgttgcccagtgaggaattgctgacagacaccagcaactcttcatcttcaacaggcgaggaagaccttgctgcactgcttcctgacctcagcggtcggctgttgatcaactccgtcttccacgtgggcgcagagcggcttcagcagatgctgttttcagactccccttttctgcagggctttctgcagcagtgcaaattcacagatgtaactcttagtccctggtcaggtgatagcaagtgtcatcagagacgggtgttaacctacacaattcccatatctaacccgttaggccctaaaagtgcaagcgtcgtggagacgcaaacccttttccgccggggccctcaggccggcgggtgtgttgtcgactctgaagtccttactcaggggatcccatatcaagattatttttacaccgcccatcgctactgcatcctgggtctggcaaggaacaaggcgcggctcagagtctctagcgagattcgttacaggaaacagccatggtctctggtgaagtccttaattgaaaaaaatagctggtcaggaatcgaggattatttccatcacctcgagcgcgaacttgctaaggcagagaaacttagcttagaagagggcgggaaggatgctcgaggtctgctgtctgggctaaggcggcggaaacgacctctatcttggcgggcacatggcgacggtccacagcaccccgacccagacccttgtgcaagagcgggcattcacacatcaggatcattgtcctctaggttctcggagcctagcgtggaccaggggcccggtgccggcatcccgtctgccctagtcttaatatctatcgtattaatcatcctgatcgcccttaacgtcctgttattctatagactgtggtccctggagaggaccgcccacactttcgaatcgtggcactctttagctcttgccaaggggaaattccctcagactgccacggaatgggccgaaatactcgccctccaaaagcagtttcacagcgttgaagttcataagtggcggcaaattttgcgggctagcgtcgagctgctggatgagatgaagttctctctcgaaaaactccatcagggaatcactgtgtcagacccccctttcgatacccagcccagaccagacgacagcttctcttag

SEQ ID NO: 26658 - DNA, 1461 bp, Artificial Sequence
  Description of Artificial Sequence: Synthetic coding sequence
atgcactgcctaaagcggactccaaaggaggttggggatgtgattgcactgagcgacataactagctccggcgccgctgatcggagccaagaacccagcccggttgggtctcggcgtggacacgtcacacctaatctgagtagggcttcttccgacgctgatcacggcgccgaggaagacaaggaggaacaagtagactcacagcccgatgcatcatcttctcagaccgtgacccctgtggccgaacctccctcaaccgagccaacccagccagacggccctacaactctcggacccctggatttactgccaagcgaggaacttttgaccgacacctctaactcgtcttcttccaccggggaggaagctgacctagctgctctgctcccagatctgtctggaaggctactcatcaactcagtgttccatgtgggcgcagaaaggttgcagcagatgttatttagtgatagcccctttctccagggattcttacagcagtgcaagttcacagacgtgacactttctccgtggtccggcgattctaaatgccaccagcgcagggttctaacttatactatccccatttctaatcccctgggtcctaaatcggcgtctgtggttgagacacagaccctttttagacggggaccacaggcaggcggctgtgtggtcgattctgaagttcttactcagggcattccgtatcaggattatttttacacagcgcatagatattgtatactgggccttgccagaaacaaagctcgcctgagagtctccagcgagatccggtatcggaaacagccttggtctttggttaaaagtctgattgagaagaattcctggtcggggatcgaagactactttcatcacctagaaagagaactggcaaaggctgagaaactgtccttggaggaaggggggaaagatgccaggggtcttctaagcggcctaaggcggaggaagaggcctctgtcctggcgcgcacatggcgatggcccccagcaccctgaccccgatccgtgcgcccgcgccggtatacatacaagtggctccttgtctagtcgttttagtgagcctagcgttgaccagggcccgggcgcaggaatccccagtgctttagttctgatatcgatcgttctgataatcctgatagcactcaacgtgctgctcttttatcggctctggtccctagagagaacggcacacacctttgaatcctggcacagtctcgccctggccaaaggcaaattccctcagaccgccaccgagtgggcagaaatcttggccttacagaaacaatttcactccgttgaagtacacaaatggcgccagatactgcgcgcctctgtggagctgctggacgaaatgaagttcagcctggagaagttgcatcagggaattactgtgtctgaccccccatttgatacccaaccccggccagacgattccttcagctag

SEQ ID NO: 26659 - DNA, 2217 bp, Artificial Sequence
  Description of Artificial Sequence: Synthetic coding sequence
atgaagggcttcaagctttcatgtactgcttccaatagcaaccggtccacgccagcatgttcaccgatcctgcgaaaacggagtagatcaccaaccccacagaatcaggatggtgacactatggtggagaagggcagcgaccattcgtctgataagagtccgtccacccctgagcagggcgtgcagaggtcttgttcttcacagtcggggcgtagcggaggaaaaaattctaaaaaaagccaatcctggtacaatgttttgagtccaacttataagcagaggaacgaggattttcgaaaactgttcaaacagctcccagacacggaaagactgattgttgattactcctgcgccctgcagcgggatatcctgctgcaaggccgactgtacttgagtgaaaattggatctgtttttacagcaacatcttccggtgggagacattattaaccgtccgcctcaaggatatatgctccatgactaaggaaaagactgctcgccttatccccaacgccatccaagtctgcacagacagcgagaaacacttctttacaagtttcggagcaagggaccgcacttatatgatgatgttccgactgtggcaaaacgctctgctcgagaagcctttatgccctaaagagctgtggcattttgtgcaccagtgctacgggaacgagttgggcctgacatctgacgatgaagattacgtgccaccagacgacgacttcaacaccatgggatattgcgaggaaattcctgtggaagagaacgaagtgaacgattcctcctccaaatcctccatagaaactaaaccagatgcatccccacagctacccaaaaaatctatcacgaacagtaccctgacgtccactgggtctagcgaggccccggtaagcttcgacggccttccacttgaagaggaagcattagaaggcgatggcagcctcgagaaggagctagcgattgacaatatcatgggagagaagatcgaaatgatcgccccagtcaattcccctagcctagattttaacgacaacgaagatatccctacagagctctccgattctagcgatactcacgacgagggagaggtacaagccttctacgaagatctctcagggagacaatacgtcaacgaggtgtttaatttttcagtggacaaactatacgacctgctgtttactaactccccattccagcgcgattttatggaacagcggcgattttccgacattatctttcatccttggaaaaaggaagaaaatggcaatcaatctcgcgtcatcctctacactattaccctgacaaaccccctcgcgcccaagacggccaccgtccgtgagacacagacaatgtataaagccagtcaggagagcgagtgttatgtgatcgatgctgaggttctcacgcatgacgtcccctaccatgattatttttacacaatcaacagatatactctgactcgggtggccaggaacaagagcagactgcgggtgtctacagaactccgataccggaaacaaccttggggacttgtgaagacattcattgaaaagaacttttggtccggcctggaagattactttcgacacctcgaaagcgagctggcaaagacggagtctacctacctcgctgagatgcaccgacaatcgcctaaagagaaggcttctaaaaccaccacagtgcgccgtcgaaagaggccccatgcccatctgcgcgtgccacacctggaggaagtcatgagccctgttacgactcccacagacgaggacgtgggccaccggatcaagcacgtggccggcagtacgcagactcgccatatcccagaggatacaccaaatgggttccatctgcagtccgtgtctaaactgctcctggtgatatcctgtgtcgtttcattcagcttagtcttgctggtcatactgaatatgatgttattctataagctttggatgctcgaatacacaacgcaaactttaacagcatggcagggcctgcggctgcaggagcggctgccccagtcccagaccgagtgggcacagctacttgaaagccaacagaagtaccacgatacagaactccaaaagtggcgcgaaattattaagagtagtgtcatgttactcgatcagatgaaggatagcctcataaacttgcagaatggcatacgcagtcgggattacacctctgagagcgaagaaaagcgtaaccgttaccactag

SEQ ID NO: 26660 - DNA, 2217 bp, Artificial Sequence
  Description of Artificial Sequence: Synthetic coding sequence
atgaaaggctttaaattgtcctgtaccgcctccaatagcaaccgcagtactccagcctgctcccccatcctccgcaaacgaagtcgctcgccaacacctcagaaccaagatggagacaccatggtggaaaagggatctgaccattcaagcgataaaagccctagcacacctgaacagggggttcagcgctcatgcagtagccaaagtggccgttctggaggaaagaacagtaagaaatcacagagctggtacaatgtcctctctcctacctacaaacagaggaacgaggacttccgtaaactgtttaagcagctgccagataccgaaaggttaattgtagactattcctgcgctctccagcgggacatactcctccagggtagattgtacctctccgaaaactggatatgtttctatagtaatatatttcggtgggaaactctgctaactgtgaggctgaaggatatctgttcgatgactaaggaaaaaacagctaggttgattccaaacgccattcaagtttgtaccgacagtgaaaaacattttttcacctccttcggggcccgcgatcggacctacatgatgatgtttcggctttggcagaacgccctgctggagaaaccgttgtgtccgaaggagctgtggcattttgtgcaccagtgttatgggaatgagcttggactgactagcgacgatgaagactacgtgcctcccgatgatgattttaatacaatgggttactgcgaggagattccagtggaggaaaacgaagtcaatgattcctcctcaaagtccagtatcgagacaaaacccgacgcttcgccacagcttcctaagaagtctattactaactctactttaacgagtaccggatcaagcgaggcccccgttagttttgacggactgccactggaagaggaggctcttgaaggggacgggagcctcgaaaaagagctggccatcgataacataatgggcgagaagattgagatgatcgctccagtcaattcaccatcccttgatttcaacgataacgaggatatccctaccgagctgtccgattccagtgacacccatgacgaaggagaagtgcaagcgttctacgaggacctgtcaggccggcagtatgtaaacgaggtcttcaactttagtgttgacaaactgtacgaccttctctttacaaactcacccttccagcgcgactttatggaacaaagaaggttctctgatatcatctttcacccctggaagaaagaagaaaatggaaaccagagccgcgtaattctgtacacaatcaccctgactaaccccttggctcccaagactgctacagtgagagagacccagacaatgtataaagcctcccaagaaagtgaatgttatgtgatcgacgcggaagtgcttacacacgatgtcccctatcacgattatttttacaccatcaacagatatacgctgacaagggtggcccgtaataagtcccgcctgcgagtgagcactgagctgaggtataggaaacagccttggggcctggtgaagacgtttattgaaaaaaatttttggagcggattggaagactacttcaggcatctggagtcggaactggcgaagacggaaagcacctatctcgcggagatgcatcgacaaagccctaaggagaaggcgtctaaaactacaacagtgcggcgcagaaaacggccacacgctcacttgagggtacctcacctggaggaagtgatgagccccgtgaccacacctacggatgaggatgtaggccatcggattaagcatgtggcgggttccacccagactcgccatatcccagaagataccccgaatggcttccatttgcagtcagttagcaagttgctgctggttatcagctgtgtaatttgctttagcctcgttttgttggtgatcctaaacatgatgcttttctacaaactgtggatgcttgaatacaccacacaaacacttacagcgtggcaggggctccggcttcaggaacgtcttccccaaagccagaccgaatgggctcagctgctcgaatcacagcagaaatatcatgataccgaactacaaaagtggagggagattattaagagctctgtgatgctgctcgatcagatgaaggacagtcttattaacctacaaaacgggataaggagcagggattacacctctgaaagtgaggagaaacgtaacagatatcactag

SEQ ID NO: 26661 - DNA, 2238 bp, Artificial Sequence
  Description of Artificial Sequence: Synthetic coding sequence
atgaagggttttaagttgtcttgcacagcctccaattcgaatagaagcacccctgcttgctccccaattctccgcaaacgcagcaggtcccctactccacagaatcaggatggggacaccatggttgagaaaggatcagatcattcttccgacaagtccccatccacgcctgagcagggtgtccaacggagttgctcctcgcaatccgggagatcaggtgggaagaacagtaaatcccacaaacggctgagcaagaaatctcagagctggtataatgtgctgtctccaacgtacaaacaacggaacgaggactttcgcaagctgttcaaacagttgcccgacaccgaaagactgatcgtcgattactcctgtgccctccagcgagatatcctgctgcagggcagactttatttgagcgagaactggatttgcttctactctaacattttcaggtgggagacactcctgacagtccggctgaaggacatttgcagcatgaccaaggaaaaaacagcaaggcttatcccaaacgcgattcaggtctgcacagactccgagaagcatttttttacatcgttcggcgcccgcgacaggacctacatgatgatgtttagactgtggcagaatgctctgttggagaaaccgctttgccctaaggagctgtggcactttgtccaccaatgttacggaaatgaacttggccttacgtcagacgacgaagattacgtaccccccgacgacgattttaatacgatgggttactgtgaagaaatccctgtggaggagaacgaagtgaatgattcctcttcaaagtcatctatcgagactaaacctgacgctagcccccagctgccaaagaaatctatcacaaattccaccttgacatctacaggctcttccgaagcccccgtgtcatttgatggcttgcccctggaagaggaggccttagaaggtgatggttctctagaaaaagagttggccatcgataacatcatgggggagaagattgagatgattgcccctgtcaatagtccatcactggatttcaatgacaacgaggatatcccaacggagttatcggattcgagcgatactcatgatgagggagaagtccaggccttttatgaggacctgagcgggcggcagtatgtgaacgaggtgttcaactttagtgtcgacaagctctacgacctcctctttaccaactctcctttccagagggactttatggaacagaggcggttctcagacatcatttttcacccttggaagaaggaggaaaatggaaaccaatctcgtgtgattctctatacaatcaccctgacaaaccccctagcacccaagacggcgacggtccgggagacccagaccatgtataaggcatctcaagagagcgaatgttatgtgattgacgccgaggtgttgacccacgatgtgccctaccacgattatttctatacgatcaaccgatacaccctaacaagagtcgctaggaacaagagcagactgcgggtttctacggaattgaggtaccgtaaacaaccgtggggactggtcaaaaccttcattgagaagaacttctggtctggcctggaggattactttaggcatttggagagtgagcttgcaaaaactgagtctacatatttggcagaaatgcatcggcaaagcccgaaagaaaaggcctccaaaactactactgtgcggcgccgaaagcgccctcatgcccacctccgtgtcccccacttggaggaagtgatgagcccagtgaccacacctacagatgaagatgttggccacaggattaaacacgtggcagggagtacgcagacgagacatattcccgaggatactccaaacgggttccatctgcagagtgtgagcaagttactcctggtgatctcatgtgttgtttcattttccctggtgctgttggtgattcttaatatgatgctcttctataaattgtggatgttagaatataccacccagactctcactgcttggcagggactcaggttgcaggagcgacttcctcagtcacagacagagtgggcccaactgctggaatctcagcaaaagtatcacgacaccgaattgcagaaatggagagaaatcattaaaagttccgtgatgttgctggaccagatgaaagattcgctgatcaacctgcaaaatggaataaggagccgagattacactagcgagagcgaggaaaaacgaaaccgctaccactag

SEQ ID NO: 26662 - DNA, 1989 bp, Artificial Sequence
  Description of Artificial Sequence: Synthetic coding sequence
atggaaggggcacctaccgtgaggcaggttatgaacgaaggggactccagcctggccacagatctccaggaagacgtggaggagaacccctctcccaccgtggaggaaaacaacgtagtggtgaaaaaacagggcccgaacctccacaattggtccggagactggtctttctggatctccagctcgacttacaaagacaggaatgaggaatatagacgtcagtttacacatcttcctgacacagagcggctgatagccgattacgcatgtgccttgcagcgggatattctgctgcaaggcagactctatctatccgaaaattggctctgtttctattccaacatttttagatgggagactacaatttcaattgccctgaagaacataacttttatgaccaaggagaaaacagcgcggttaattcccaatgccatccaaatagtaacagagtctgaaaagtttttttttaccagcttcggagccagagatcgcagctacctgtccatctttcgtctttggcagaatgtactacttgacaagtcattaacacgccaggagttttggcagcttctccagcagaattatggaacagagttaggcctgaacgctgaggagatggaaaatttgtctttatccattgaggacgtccaacctcgtagccccgggaggagctccctggatgatagcggcgagcgagacgagaaactgtcaaaatcaatatctttcactagtgagtcaattagtagggtgagcgaaaccgaatcgttcgacgggaattctagcaagggagggttggggaaggaagaaagccaaaacgagaagcagacgaaaaagagcctcctgcccacactagagaagaagcttaccagggttccatccaaaagcctcgacttgaacaaaaatgaatatttgtcattagacaagtcatctacttctgattctgtcgacgaagagaacgtgcctgaaaaagatctgcacggccgcttgttcataaatcgcatttttcatatctcagccgacagaatgttcgagctactgttcacttcctcgagatttatgcagaagtttgccagttcccggaacattattgatgtggtgtctacaccctggactgccgaactgggaggcgaccaactgagaactatgacctatacaattgtcctgaattctccgctaacgggtaaatgtactgccgcaaccgagaaacagacactctataaagaatcgcgggaagcccgcttctaccttgtggactcagaggtcttaacacacgatgtaccataccacgactatttttataccgtgaaccgatactgcatcatccgttctagcaaacagaaatgccggttgcgcgtgtccaccgatttgaaataccgcaagcagccttggggcctagtgaagtccctgatcgaaaaaaatagttggtcatctctggaagactatttcaaacaactggaatcggacttattgattgaagagtccgtgctcaatcaggctattgaggatccagggaagctgaccggacttcgcagaaggagaaggactttcaataggacagccgaaaccgtgcctaagctgtcttctcaacactcctcaggtgatgtcggtctcggggccaagggggacatcactggcaagaagaaagagatggaaaattacaacgtgacattgattgtagtgatgtctattttcgtgctgcttttggtgctgctgaatgtgaccttgtttctgaaacttagtaagatcgaacatgcggcccaaagtttttacagattgaggctgcaggaggaaaagagcttgaatttggcgtctgacatggtctccagggcagagactatccagaaaaacaaggatcaagcccacagactgaagggggtgttgcgagactctattgtcatgctcgaacaactcaagagtagtctcattatgcttcagaagacgttcgatttactgaataagaataagactgggatggcagttgagtcatag

SEQ ID NO: 26663 - DNA, 1374 bp, Artificial Sequence
  Description of Artificial Sequence: Synthetic coding sequence
atggaaaacctctctctaagtatcgaggacgtgcagcccagatcccctggccgctcctctttggacgattccggcgagagagatgagaaacttagcaagtccattagcttcacttccgagtccatctcaagagtcagcgagacagagtcctttgatggcaattctagtaaaggtggactcgggaaagaggagtcacaaaacgaaaaacaaacaaaaaagtcattactccccactctggaaaaaaagctcacgcgggtgccgtccaaatccctcgacctcaataagaatgaatacctgtctttggacaaatcttccacgtccgactctgtcgacgaggaaaacgtgccagaaaaagacttgcacggtcggcttttcataaatcggatatttcacatttctgctgatcgcatgtttgaactgctcttcacaagcagtcgcttcatgcaaaaattcgcttcctctaggaatatcatcgacgtagtgagtacgccttggacagcggaattaggcggcgaccaattaaggactatgacatacacaattgtccttaattcaccactgaccgggaaatgcacagccgcaactgaaaagcaaactttgtataaggaaagtcgcgaggctaggttttatttggtggattcagaagtgttgacacatgacgttccataccatgactacttctatactgttaacaggtattgtattataagatccagtaaacagaagtgcaggttacgcgtcagtaccgacctcaaatatagaaagcagccttggggattggtaaagtccctcattgaaaagaactcatggtcatctcttgaagactatttcaagcaactcgagagcgatctgctcatcgaggagagtgtcctgaaccaagccattgaggatcctggcaaactcacaggattgcggagaagaaggcgtaccttcaacagaactgccgaaaccgttcccaaactgtcctcacagcactcctccggcgatgtgggcctcggagctaaaggcgatattactggaaagaagaaagaaatggagaactacaacgtgaccctcatagtcgtgatgagcatttttgttttattattggtcctgcttaacgtgaccttattcctcaaattaagtaagatcgaacatgctgctcaaagcttctaccggctacggttacaggaagagaaatccttaaacttggctagcgacatggtttccagagcggaaactatacaaaaaaacaaagatcaggcccatagactgaagggagtcctccgcgattccatcgtaatgctggagcaattgaagtcctcgctgatcatgctgcagaagaccttcgatctccttaacaagaataaaacgggaatggctgtggaaagctag

SEQ ID NO: 26664 - DNA, 1176 bp, Artificial Sequence
  Description of Artificial Sequence: Synthetic coding sequence
atgaatatattcttgtggacgaaggcagccttgcagatcctgctgatgaagtatgccgctgggcacgggttagtcatcaggtgtcttcctgagttcaggacattgggacgaagcaccctggccccctccggccagatcgaaaacgtgcctgagaaagatctgcacggccggctctttatcaacaggatcttccatatttcggctgatcgcatgttcgagctgctgtttacttcctccagattcatgcaaaagttcgcctcttcgcggaacatcatcgacgtggtctcaaccccttggactgccgagctcggcggagatcagctgcgcacgatgacttatacgatagtgctaaattcaccccttacgggcaaatgtacagccgccacggagaagcagacgttatataaggagtctagggaagcacggttctatctcgttgactccgaagtgctgacccacgatgttccatatcatgactacttttataccgtgaacagatattgcatcattaggagcagtaagcaaaaatgccggcttcgagtctctacagatctaaagtacagaaagcagccttggggattggtcaaaagccttattgagaagaattcctggtcatccttggaagactattttaaacagctggagtccgacctgcttatagaggaaagcgtcctaaaccaggcgattgaagacccaggcaaacttactggtctgagaagacgacgtagaacatttaaccggaccgcagaaaccgtgccgaaattgagctcacagcacagcagcggggacgtgggcctgggcgccaagggcgatatcactggtaaaaaaaaggaaatggaaaactacaacgtgaccctgatagtggtaatgagcattttcgtgttactcctagtcttgttgaacgtgactctatttctcaagctgtctaaaatcgaacacgcggcacagagcttctaccgactgcgcctgcaggaggagaaatccttaaatctggcaagcgatatggtttccagggcagagacaatccagaaaaataaagaccaagcacaccgcctaaaaggcgtgctacgcgattcaatcgtgatgctggaacaactgaaatccagtctaataatgctgcagaagaccttcgacctcctcaataaaaacaagacaggcatggctgtggagagctag

SEQ ID NO: 26665 - DNA, 1143 bp, Artificial Sequence
  Description of Artificial Sequence: Synthetic coding sequence
atggaaaatctaagtctgtctatcgaagacgtccagccaaggtcccccggtaggtcaagcctggacgactccggtgagagggatgagaagctgtcaaagtcaatctcattcacttctgagtccatcagccgggtgtctgaaaccgaatccttcgatgggaacagcagtaagggcgggctgggcaaagaagagtcccagaacgagaagcagacgaagaaaagtcttctgccaacactggaaaagaagctgacacgggttccttctaagagccttgacctgaacaagaacgaatatctctctctggacaagtcctctacatctgactccgtggacgaagaaaacgtgccagagaaagacttacacgggaggttgttcattaaccgtattttccatatttctgctgatagaatgttcgagttattgttcacgtcttctcggttcatgcagaagtttgccagttcgaggaatataatcgatgttgtgagcacgccgtggacagccgagctggggggtgatcaattgaggacaatgacctacaccattgtgctgaactcaccgctgactggcaaatgtaccgcagcaacagagaagcagaccctgtataaggagtctcgagaggcgaggttttacctggtggacagcgaagtactgactcacgatgttccttaccacgattacttctacacggtgaacagatactgcataattagatcaagcaagcaaaagtgtcgcctgcgggtgtccacggacctaaagtacaggaaacagccttggggacttgtcaagagccttatcgagaagaactcctggtcaagcctggaggactattttaagcaacttgagagcgacctgttgatagaagagtcagtgttaaatcaggcaatcgaagatcctggaaagctgacaggtctgaggcgccgcagaaggaccttcaatcggactgctgaaactgtgcctaaactgtcctctcagcattcttcgggggatgttgggcttggcgccaaaggggatattacaggaaaaaagaaagagatggagaattataacgtgacactgatcgtcgtcatgtccatttttgtcctgctactagtgcttctgaatgtaactcttttcctcaaactgagcaagatcgaacacgcctag

SEQ ID NO: 26666 - DNA, 1065 bp, Artificial Sequence
  Description of Artificial Sequence: Synthetic coding sequence
atgactgcattatcccgaagtgaagccacagaggagggcggcaaccaacaaatgcatagaaaaaccgccagtctgaactctcctgtctcatgcaaggagaaacctgaccgggtggaggagccacctgactattcactgcactggcccgaggggcttaaaggcgaagaaatcaaaaagtgcggaagggagggtatcacactgaataagtacaatcaacagtaccacaagctgttcaaggacgtccctctggaggaggtggttctgaaagtgtgttcatgtgcactccagagggattttcttctgcagggcaggttatacatttcccccaactggctgtgctttcacgcctctctgtttggaaaagacataaaagtggtcatccctgtcgtgtctgtccagatgatcaagaaacataagatggcccgccttttgcccaatgggctggccataacaaccaacaccagccagaagtacatcttcgtaagtctactctcccgggactccgtgtatgacctgctgcggcgtgtgtgcactcacctgcaaccaagcagtaaaaaatctctgtctgtaagagagttttcaggcgaacccgagagtttggaggttctcatcccagaaatgaagtggcgtaaggtgtgtcctagctccaggtctttatcactccctgacaatatcccctgcattcctccctcttcagttgacagtacggatagttttttcccttcccggaagccaccgatgagcgaaaagtctagggcccaagtggcctccgagaatggtggacgctgggcttggccaatgcccggatgggggccagcctgccccaaaaaaatgccaaattgttctccaactgccaaaaacgccgtatacgaggaagacgaattggaggaggagccgagatccaccggtgaactcaggctttgggattaccgcttgcttaaggtattcttcgtcctgatttgtttcctggtgatgagcagctcctacctagcctttcggattagccgccttgaacagcagctgtgctctttgtcttgggatgaccccgtacccggccacagatag

SEQ ID NO: 26667 - DNA, 474 bp, Artificial Sequence
  Description of Artificial Sequence: Synthetic coding sequence
atgagcaagagttgtggcaacaacttggcggcgatctccgttggtatttctctgctgctgctcctcgttgtctgcgggattggatgtgtgtggcattggaaacaccgggtcgctactcgttttacgctgccccggttcctgcaaagaaggagctctcgaaggaaggtttgtacaaaaacctttctgggaccacgaattatcggcctcagacacgaaatatcggtggagacacaagatcacaagagcgcagtcaggggaaacaacacgcatgataattatgagaacgtggaggcagggccaccaaaggctaagggcaagactgacaaagaactgtacgaaaacacaggacagagcaacttcgaggagcatatctacggcaacgagacttctagtgactattacaactttcagaaaccaaggccctcagaagttccccaggacgaggacatttacattctccccgatagttactag

SEQ ID NO: 26668 - DNA, 474 bp, Artificial Sequence
  Description of Artificial Sequence: Synthetic coding sequence
atgtctaaatcatgcggcaataaccttgcagcgatttccgtcggcatctctctgctgctcctcctcgtggtctgtggtatcggctgtgtctggcattggaagcatcgtgttgcaacacggttcactctgcctcgcttcctgcagaggagaagcagcagacggaaagtctgcaccaagaccttcctgggcccgaggatcatcggcctacgccacgagatcagcgtggaaacccaggaccacaagtcggctgtacgggggaataacacacatgataattatgagaacgtcgaagcaggtccccccaaggcaaagggcaagactgacaaggagttgtacgaaaacacaggccaaagcaactttgaagagcacatttatggaaacgaaacctctagcgattattataattttcaaaagccgcgtcccagcgaggtcccgcaggatgaagatatttatattctgccagattcatattag

SEQ ID NO: 26669 - DNA, 207 bp, Artificial Sequence
  Description of Artificial Sequence: Synthetic coding sequence
atgagtaagagttgtggaaacaacctcgctgccatttctgtgggaattagccttctgttactccttgtcgtttgtggcatcggttgtgtctggcactggaagcatcgcgtggccacccgatttacactaccacgattcctgcagagacggtcgagccggaggaaagtttgcaccaaaacgttcctcggcccccgaattattggatag

SEQ ID NO: 26670 - DNA, 210 bp, Artificial Sequence
  Description of Artificial Sequence: Synthetic coding sequence
atgagtaagagttgcgggaacaatctcgcagctatcagcgtcggaatatctctgctcctcctcctggtggtgtgtgggatcggttgcgtgtggcactggaagcacagagtagccaccagattcactctcccaaggtttttgcagagacggagcagcagacgcaaggtgtgtaccaaaactttcctgggaccacgtataattggactatag

SEQ ID NO: 26671 - DNA, 753 bp, Artificial Sequence
  Description of Artificial Sequence: Synthetic coding sequence
atgatccagagttctcagcccatgagcctgaaactgacgtgcagcgcgttcagacttcaacgggctctgcgattcttactgggtagattgccctggcgggtcgcttcaggagcccgacggtttcggcggtggctgaacagatactcatacactgtgttgtcaagctggcctgagcgagctctgatctcgttaaaaaatagaagccggttcttggtgcggccaaacacccgtaatcgtgccttttcgtggacatgtagggccgccaggtccaaaccacggccccgccggtcgactgccctgccgcgaagccaggcctctagctcacgccacagttgggccgagtttctgaagtttagaaagtccttccagatgtccaatacttcccagcctgacccgtcacggcctggcaccgagaggacttcatcgaaagaggctggctgtcggcccctagggcagctcgactcattcagttgggctgcccgacctcccccaggggccgctggtttagccgtgtcagaaggtttctttcgaaaaattcggtcaagcgcccctagctccccatcttttagccgggcactgatgtctaatacctatctttgtttcctgactacggggccccgaagtagccgagagaacacacagaagagctttcctgcaaccagtccgagagagcctgtaacctctcggctgcggggcaaggcccctgcactgtcgccttccagagaacttagcttcacgtcagccccattctag

SEQ ID NO: 26672 - DNA, 978 bp, Artificial Sequence
  Description of Artificial Sequence: Synthetic coding sequence
atgctcgccgcccgcctggtgtgtctaaggacccttccctcccgcgtgtttcatccagccttcactaaggcaagccctgtggtgaaaaacagtatcactaaaaatcagtggcttctaactccgtctagagaatatgctacgaagacacgaatcggcatcagacgcggtagaaccggccaggagcttaaagaggcagctctggagccttccatggaaaaaatatttaagattgatcagatggggcgctggtttgtcgccggtggcgctatagagaaagcggttatctggccacagtatgtaaaagaccggattcattcgacatatatgtacctcgccgggagcattggactgacagcactttcggcaatcgcgatcagccgcacacccgtcttgatgaactttatgatgagggggtcatgggtcacaattggagtgacattcgcggccatggtaggtgcaggcatgctggtcaggagtatcccttacgaccagagccccgggcctaagcatctggcctggcttctgcatagtggggtgatgggtgcggtggtagcaccacttacaatcctcggggggcccctgcttattcgggccgcctggtacacagccggtattgtgggagggctgtcaacggtggccatgtgcgcgccttcagaaaagttcctcaacatgggtgccccattaggcgtgggcctcggcttggtctttgtatcttccctcgggagcatgtttctcccccctactacagtggcgggcgcaacactgtattccgttgccatgtatggaggactcgttctcttttcgatgttcctgctgtacgatacgcagaaagtcatcaagagggccgaagtctctcccatgtacggcgtacagaaatacgaccccatcaactctatgttatccatatatatggacactctgaatattttcatgcgggtcgccaccatgctagcgaccggcggcaaccgtaaaaagtag

SEQ ID NO: 26673 - DNA, 1038 bp, Artificial Sequence
  Description of Artificial Sequence: Synthetic coding sequence
atgcttgctgctcggctcgtttgcttacggaccctgcctagtagagtgttccatcccgcctttactaaagcttctccagttgtcaaaaactccattacaaaaaatcaatggttgctaaccccttctagggagtacgctactaaaaccagaatagggataaggcggggcaggactggccaagagctgaaggaggcagcacttgagccgtctatggagaagatcttcaagatcgaccaaatgggaaggtggtttgtggccggtggagctgcagtggggttgggagctctgtgctattatggactgggacttagtaacgagattggcgctatcgagaaagccgtgatatggcctcagtatgtgaaagaccgcatccacagcacctacatgtacttagctggctcaatcggcttaaccgcactgagtgccatcgccatatctagaacgccagtcttgatgaacttcatgatgcggggctcctgggtgacaattggagtgacatttgccgcgatggtgggagcgggaatgttggtgcggagcatcccttacgatcagtcccccgggcccaaacaccttgcctggctgttgcacagcggcgtgatgggagcagttgttgcccccttgactattttgggaggcccattgctgattagggctgcctggtatacagcagggatcgtcggcggcttgtccacagtcgccatgtgcgccccttctgagaaattcctcaacatgggggccccgctcggcgttggcctgggcctggtgtttgtgtcctccctgggctccatgttcctgcctcccacaactgtggctggggcaaccttgtactcagtcgctatgtatggcgggctggtattattcagtatgttcctcctgtacgatacacagaaggtgatcaagcgggccgaagtctctcctatgtacggcgtgcagaagtacgatccaattaactccatgctgagtatctatatggacacgcttaacatattcatgcgagtggcaacaatgctcgctaccggtggcaataggaagaagtag

SEQ ID NO: 26674 - DNA, 960 bp, Artificial Sequence
  Description of Artificial Sequence: Synthetic coding sequence
atgctcgctgctaggctggtttgtctccggacgctcccgtctagagtgttccatcccgccttcaccaaggctagtccggttgtcaaaaattctatcacaaagaatcagtggctcctgaccccttccagagagtacgcaacgaaaaccaggatcggtattagaaggggcaggacaggccaggagctgaaggaagccgccctggaaccctctatggagaagatattcaagatcgaccagatgggtagatggtttgtcgctggaggcgctgccgtcgggctcggagcgctctgctactacggcctaggattatcgaacgagatcggagccattgagaaggctgtgatctggcctcagtacgtcaaggaccgaattcactccacttacatgtacttggctgggagtatcggcttaacagcgctgagtgcgatcgcgatcagtcgcacaccagtgttgatgaacttcatgatgcgggggagctgggttaccatcggcgtcactttcgcagcaatggtgggggcaggcatgctggtccgatctattccatacgaccaatcacctggcccaaagcatctggcctggctacttcatagcggtgttatgggtgccgtggtcgctcctctcaccatcctggggggaccactactgattcgtgccgcctggtatacggccgggattgtcggtggtctctccaccgtcgctatgtgcgccccaagcgagaagttcttgaatatgggcgcccccctcggggtggggctggggctcgtgttcgtatcatcattgggttcaatgttcttacctcctaccaccgtggctggggcaacactgtactcagttgccatgtacggaggcctggtgctgttcagcatgtttctgctctatgatacccagaaggtttcaagtgtgcaaaagtatcaccaatgcatggagttcaagaacatgataccactcacccgctgttag

SEQ ID NO: 26675 - DNA, 999 bp, Artificial Sequence
  Description of Artificial Sequence: Synthetic coding sequence
atgttagcggctagactggtgtgcctgcgaacgctgccttttgtaaagaattcaatcactaagaaccagtggctgctgactcccagccgcgaatacgctactaagacccggatcgggatacgaagagggcgaactggacaggagttaaaggaggctgctctcgagccaagcatggagaagatattcaagattgatcagatgggcagatggttcgtagccgggggggccgcagtgggccttggagccttatgctactacggccttggtctgtccaacgaaattggcgccattgaaaaggctgtgatctggcctcagtacgttaaggatcgaatccactcgacctacatgtatctggcagggtccatcggactaacagcgctgagcgcgatcgctattagccggacaccagttctgatgaattttatgatgcggggctcctgggtgactatcggcgtgacctttgctgccatggtgggcgccgggatgctagttagatcaattccgtatgaccaaagccccgggcctaaacatctggcttggctactgcatagtggtgtgatgggggccgtggtggccccccttactatcctgggagggcctctgctcatccgggcagcatggtacacagcaggcatcgttggggggttgtctaccgtggcgatgtgcgcgccttctgagaaatttttgaacatgggcgcccccctgggggtaggactgggtttggtgttcgtgtcgagcctggggtctatgttcttgccccccacaacagtggcaggcgctaccttatatagcgttgcgatgtacggcggcctcgtacttttctcaatgttcctgctgtacgatacacagaaagtcatcaagcgggccgaagtgagtccaatgtacggcgtacaaaaatacgatccaataaacagcatgctgagtatctatatggacaccctgaatatcttcatgcgcgttgctactatgctggccacgggcggaaatcggaagaagtag

SEQ ID NO: 26676 - DNA, 5445 bp, Artificial Sequence
  Description of Artificial Sequence: Synthetic coding sequence
atgggcaatagctatgccggacagcttaagtctgctcgctttgaagaagctctccacaattccatcgaagcgtctctacggtgtagttccgtcgtgccgcgtcccatctttagccagctttacctcgaccccgaccagcatcccttttcctctgctgacgttaaaccgaaggtcgaggatctagataaggaccttgtcaatagatacacccagaatggtagcctggatttttctaacaatcttaccgtaaacgagatggaggatgacgaagacgatgaagagatgagtgactcaaatagtccccctatcccttactcccagaagcccgcccctgaaggcagctgtaccaccgatgggttctgccaggctggaaaggacttgcgtttggtctccctctgcatggaacagatcgacatccccgccgggtttctgctggttggggccaagtcaccaaacctcccagagcatattctcgtgtgcgcggtagacaagagattcctccctgacgaccatggcaaaaatgcactgctgggcttctctggaaactgcatcggatgcggcgaacgcggctttcggtacttcacggaattctctaatcacataaatttgaaactaaccacacagcccaagaagcaaaaacacttaaaatactaccttgttcgctcctcacagggggtcttgtctaaaggtcccctcatctgctggaaagaatgccgctcaagacagagctccgcctcgtgtcacagtatcaagccctcatcctctgtctctagcacagtgactcctgaaaatggcaccacaaatggctacaaatcaggcttcactcagacagatgccgccaacggtaacagcagtcacggcggcaaggggagtgcctcatcatcaactcccgctcacactggtaattacagcctctcgccccgaccgtcctacgcctcaggagatcaggctaccatgtttatcagcggtccaccaaaaaaaagacacagggggtggtaccctggcagcccgttgcctcagccaggacttgtggtcccagtgccaacagtgaggccactcagccggacagaacctctcctgagtgctcctgtgccacagacgcctctcaccggcatcctgcagccccgcccaatcccagcgggggagacggttatcgtgcccgagaacttactctctaattccggcgtgaggcctgtgattttaatcggatatggaacattgccatacttttacgggaacgtgggggacatcgttgtgagcccgcttctggtgaattgctacaagattccccagctggagaacaaggatctagaaaaacttggcctaaccggctctcaattcctctccgtggagaatatgatcctcctgacaattcagtacctggtccggctaggtcagcaccaatctcgggcgctggccgaatctatgctgaccaccagtgagttccttaaagagatctcctacgaactaataactggaaaggtgtcttttctcgccagccattttaagactacctccctgggcgacgacctggataagctgctggaaaaaatgcagcaacgtcggggagatagcgtggtgaccccttttgatggggatctcaatgagtgcgtgagcccccaggaggccgcggccatgatccccacacagaatctcgacctggacaacgaaacattccatatttatcagcctcaactcactgtggctcggaaactgctgtcacaggtttgtgctatcgcagattcgggatcccagtctttggatcttggtcatttcagcaaggtagattttatcataatagtcccgagaagtgaagtgctcgtccagcagacattgcagcgcattaggcagtccggcgtgctggtggacttgggcctcgaggaaaacggcaccgctcatcagcgagccgaaaagtacgttgtgcgcctcgataatgaaatccaaaccaagttcgaagtctttatgcgaagagtgaagcagaacccatacacgctgttcgttctggtgcacgacaatagccatgtggagcttacttcagtcatttcaggttcgctgagtcacagcgaaccttcccacggactggccgaccgcgtgatcaactgtcgagaggtactggaagcgtttaacctgcttgtgcttcaggtcagcagctttccctatactttgcaaactcagcagagcagaatctcctcttcaaatgaagtgcactggatccagctggacactggggaagacgtgggttgtgaggagaagctgtacttcggattgagcgagtactccaaatcactgcaatgggggatcaccagtcctttgctgagatgtgatgagaccttcgaaaagatggtgaacaccctgctggagagatacccacggctgcattcaatggtagtccggtgttatttgctcatccagcagtattcagaggcccttatggcccttactaccatggctagcctgagggatcactctacccccgaaaccttatctatcatggatgatctaatcagctcaccagggaaaaacaaatccggacgggggcatatgctaatcattagagtcccgtccgtccagctggcaatgctggcaaaagagaggttgcaagaagtcagagacaagcttggactgcaatataggtttgagatcatcctcggcaaccccgccacggaactgtccgttgccactcacttcgtggccaggctcaaatcatggagggggaatgagccggaagagtggatccccaggacttatcaagacctcgatggcctcccctgcattgtgatcttgactggcaaggaccccctgggcgagactttcccccgctcactaaagtactgcgatctgcgacttattgatagctcctacctgaccaggaccgctctggaacaggaagttggcctcgcctgttgttacgtctctaaggaggtgatcaggggccctacggttgccctggacttgtccggtaaagaacaggaacgggctgccgtcagcgagaacgactctgacgagctgctgatagatcttgaaaggccccagagtaattcatctgcagttacaggcacaagtgggagcatcatggagaatggagtgtcctcgtcaagcactgctgataagagccagaagcagagcctgaccccttctttccagagcccggcaacatctttgggattggacgaaggggtgagcgcaagttcagcgggagctggagcgggcgaaaccttaaagcaggaatgtgactccctgggcccacagatggcctcctcaaccacctctaaaccctcctcttcatcctcagggccacgcaccttaccatggcccggacagccaatccgcggctgcagaggaccccaggcggcactgcctcctgttgtgatcctcagcaaggccgcctactccctgctgggctctcaaaagtccggtaagttgcctagcagctctagtctcttgccccacgccgatgtcgcgtgggtgagcagcctgcgacctttgttgaataaggatatgagttctgaagagcagagtctgtactaccgccagtggacactcgcccgccagcaccatgcagactactctaaccagctagaccccgcctcgggaacccgaaacttccacccaaggcgactgcttttgactggtccccctcaagttggcaaaactgggtcctacttgcagttcctcagaatcctctttaggatgttaatcaggctgcttgaggttgacgtttacgatgaagaagaaatcaataccgaccataatgaaagctctgaagtcagtcaatctgagggtgaaccttggccagacattgagtctttctcaaaaatgccgtttgacgtgtctgttcacgaccctaaatacagcttgatgtcgctggtgtacacagagaagttggccggggtcaaacaggaagtcatcaaagaatctaaggtggaggaaccaaggaaaagagaaacggtttctatcatgctgacgaagtatgcagcctataacacattccatcactgcgagcaatgccggcagtacatggacttcacctcggctagccaaatgagcgactctacacttcacgccttcacattctcctctagtatgctaggggaggaagtccagctctactttataatccccaagagcaaggaaagtcacttcgtcttttcaaagcaggggaagcatctggagtcaatgcgactccctctcgtgtcagacaaaaaccttaacgctgttaagagccctatttttaccccctcctccgggcgccacgagcatggtctgctgaacctgtttcatgccatggaaggaatctctcatctgcacctgcttgttgttaaggaatatgaaatgcctctttaccgtaagtactggcctaaccatatcatgctcgtcttgccaggcatgtttaacaacgccggggtcggcgcagccaggtttttaatcaaggaactctcatatcataacttagagctggagcggaaccggctggaagaacttgggattaaacgacagtgcgtgtggcccttcatcgtgatgatggatgatagctgcgtactgtggaatatacattctgtgcaggagcctagcagccagcctatggaggtaggagtgtcctcaaaaaacgtgtccctgaagactgtactccaacacatcgaggctacacctaagattgtgcattatgctatcctgggaattcaaaagtggtcctccaagctgacttctcagtctctaaaagcacccttctcacgctgccacgtgcacgactttatattgctgaatacagatctgactcagaacgtgcagtacgactttaaccggtacttttgcgaagatgctgattttaacctaaggacgaactccagcggcctattaatttgtcgctttaataacttctccctgatgaagaaacacgtgcaggtcggcggccaacgcgattttatcattaaacccaagataatggttagcgagtcactggcgcctatcctcccattacagtacatctgtgcccctgattccgaacacaccctcctcgccgctcctgctcagtttcttctggagaagtttctccaacatgcctcatacaaattgttcccgaaagctatccacaacttcagaagcccagtgttagctattgactgctatctgaatattgggccagaggtagcaatatgttatatctccagccgaccacactcttccaatgtaaattgcgaaggcgttttcttttcaggcctattactctatctctgtgactcctttgtcggcgccgacctgaaaaagttcaagttcctgaaaggggctactttgtgcgtcatctgtcaggaccgctcgtctctgagacagactatcgtgcggttagaattggaggatgaatggcaatttcggctgcgagacgaattccagacagcgaattctagcgacgacaaacctctttatttcctcaccggccggcatgtgtag

SEQ ID NO: 26677 - DNA, 2229 bp, Artificial Sequence
  Description of Artificial Sequence: Synthetic coding sequence
atggggaactcctacgctggacagctcaaatccgcccggtttgaggaggcattacataacagcattgaagcaagtctgagatgtagtagtgtggtaccccgccctattttttctcagctgtacctcgacccagaccagcaccccttctcttccgcggacgtaaagccgaaggtcgaagatctcgataaggatctggtgaataggtacactcagaacggaagcctggactttagtaataatcttaccgtcaacgagatggaagacgatgaagacgacgaggagatgagcgactcaaatagccctcccatcccatactcacagaaacccgcccctgagggttcctgcactacagacggcttttgccaggctgggaaagatctgcgcctcgttagcttatgtatggaacaaatcgatatccccgcaggctttctcttagtgggtgccaaaagccctaatctgccagaacatatacttgtgtgcgctgtggataagcggtttctgcctgatgatcacgggaaaaacgccctgctgggttttagtggtaattgcatcgggtgcggcgagcgggggtttcggtactttacagagtttagtaaccatatcaacctgaaactcaccacccaacccaagaagcagaaacacttaaagtactatctcgtcaggtcttctcagggtgtgctcagcaagggccccttgatatgttggaaggaatgcagaagtagacagagttcagcctcctgccacagcattaagccgtcctcatctgtatcttcgactgtaactcccgaaaatggaacaacaaacggctataaatccggctttacccagactgacgcagccaacggcaacagctctcacgggggcaaaggctcagcgtcctcttcaacacccgcacatactggtaattattccctttctccacgtcctagctacgcttccggcgaccaggcaacaatgttcatctctggcccacccaagaaaaggcaccgaggctggtaccctggcagtccactgccacagccgggcttagtagttccagtcccaactgtgaggcctctgtcgcggaccgaacctttgcttagcgcacctgtgcctcagacaccgctcacaggcattctgcagcccaggccaatacctgcaggagaaacggtcatcgtgccggaaaaccttctgtccaacagcggggttagaccggtgatcttaatcggatatggaacgctcccctatttttatggaaacgtaggagacatcgttgtctcccctctgctggtgaactgttataagattccgcagcttgagaataaggatctcgaaaaactgggcctcactgggagccagtttttaagcgttgagaacatgatcctgttgacaatccagtatctcgtgagactcgggcctgatcaggtgcccctcagggaggaattcgaacaaatcatgctgaaggcaatgcaggagttcaccctgcgtgagagggccttgcaaattggcgctcaatgcgttcccgttagcccaggacagctgccctggcttgcacggctaattgcaagcgtttcccaggacttagtgcacgtcgtcgttacacagaactcgctggccgaaggaatcagcgaaacactcagaacgctctctgagatgaggcactaccagcgtttgcctgattatgtcgttgtgatttgcgcgtcaaaaatcaggggtaacgaattctgtgttgtggtcttaggacagcatcagtccagagccctggcagagagcatgttgactacaagcgagttcctgaaagagatttcttacgagctcatcaccgggaaagttagctttctggcttctcacttcaagacaacaagtttaggcgacgacttggataaactactggagaagatgcagcagcgcagaggcgactccgtcgtaactccttttgacggagatctgaatgaatgcgtttcccctcaggaggccgcagctatgatacccacgcaaaacctggacctggataatgagacgttccatatttaccaaccccaactgacggttgcccgaaagctcctttcacaggtttgtgcaatcgcggatagtggatcccagagcctggatttggggcactttagcaaggtagacttcatcataatagtcccaagatcggaggttttagttcagcaaaccttacagaggattcgacagtccgtcagcttccaggcactctgccatatcgcgaatcccgtgatgggctag

SEQ ID NO: 26678 - DNA, 5772 bp, Artificial Sequence
  Description of Artificial Sequence: Synthetic coding sequence
atgggcaattcatacgccggccaactcaagtctgctaggtttgaggaggctctccataattctattgaagctagtctccgctgttcctctgtggttcctcgccctatattcagccagctgtatctcgatccagatcagcatccttttagcagcgccgatgtcaagccaaaagtggaagacctcgacaaggacttggttaaccgctatacacagaatggttctctggatttcagcaataacttgacagttaatgagatggaggatgatgaggatgacgaggaaatgtctgacagcaatagtcccccaatcccttattctcaaaagccagcccccgagggctcatgcactacagacggtttctgtcaagctggcaaggatctccggttagtgtccctctgcatggaacaaattgacattcccgctgggtttctgctggtgggggcaaagtcaccaaacctgcctgagcatatcctggtgtgtgcagtggataagcggtttttgcctgacgaccatggaaagaacgccctgctcggcttctcaggaaattgtatcggctgcggagagcgaggatttagatactttacagagttcagcaaccacatcaacctcaagctgacgacacagccaaagaagcaaaagcacctcaaatactacctcgtgcggtccagccagggggtgctgtccaagggaccattgatctgttggaaggaatgcaggtcaagacagtcctctgctagctgtcacagtattaaaccgtcctcctcagtgtcatccacagtcacgccagaaaacggaactaccaatggatacaagagcggctttacccagacagatgcggccaacggtaacagttcccacggtggaaaaggttcagcctcttcttctacccctgcacacactgggaactacagtctcagcccacgaccttcttacgcctctggcgatcaggccactatgttcatctctgggccacccaaaaaaagacaccgtggatggtaccctggctctccactgccccagccaggactcgtagtgcctgtgccaaccgtgcgccctctgtcaaggaccgaaccattgctctccgcaccggtgcctcagactcccttgacgggcatacttcagccacggcctataccagcaggagaaacggtgattgtgcccgaaaacttgctttcaaatagcggggtgaggccagtcattctgatcggctatggcactctgccttatttttatggtaacgtgggggatattgttgtctcccctctcctggtgaactgttacaaaattccacagctcgagaacaaggatctggaaaagctgggtctcacagggtcccagttccttagcgttgaaaatatgattttgctcacaattcagtacctggtcaggctgggcccggatcaggtgcctctgagggaagaatttgaacagatcatgctgaaggccatgcaagaatttactctccgcgagcgcgccttacaaattggagctcagtgtgtgcccgttagtcctgggcaactgccatggctagccaggcttatcgcctctgtgtctcaggatctagtgcatgtcgtcgttactcagaatagcttggccgaagggatctcagaaacgctccgaaccctgtcagagatgaggcattaccagcgactgccagattatgtggttgttatttgcgcaagtaaaattaggggcaatgaattctgcgtggttgttctggggcagcatcagtctcgcgccctcgcggagtctatgctgaccacatctgagttcctgaaagaaatcagctatgaacttatcaccggaaaggtctccttcttggccagccattttaagacgactagtctaggggatgatctggacaagctcttggagaaaatgcaacagcgtaggggagattcagtggtaacccctttcgacggtgatctgaatgagtgcgtcagtccccaagaggccgccgctatgattcccacacagaatctcgatctggataacgaaacatttcacatatatcagccacagttgacagtggcacgtaaactcctcagccaggtatgtgctatcgctgattctgggagtcagtctcttgatctaggccacttcagcaaggtggacttcataatcatcgtgccccgcagtgaagtcctagtccagcagactctgcaaagaatccggcaatccggcgttcttgtggatctgggcctcgaggagaacggaactgcacaccagcgcgccgagaagtatgtggtccgcctcgataatgaaattcagactaagtttgaagtatttatgcggcgtgtgaagcaaaacccttacaccctttttgttctggtgcacgacaacagccacgtcgaactcacatccgtaatctcgggatctctgagtcactcggagccctcgcacggactggctgaccgggtgataaattgtcgagaggtcctggaggctttcaacctacttgtgctgcaggtgtcatcgttcccatatactcttcaaacccaacaaagtcgcattagctcatcgaatgaagtgcattggattcagctggatacaggcgaagatgtcggctgcgaagagaagctctacttcggcctttccgagtactcaaaaagccttcagtggggcataacgagtccgctgcttcgctgcgacgaaacctttgaaaaaatggtgaacaccctgctcgagcgctacccaagattacactctatggtcgtccgctgttatctgctgatccaacagtactccgaagcactaatggccctcacgacgatggcgtctctgagagatcactccacaccggagactttaagcataatggacgatctaataagttcacctggtaaaaataaatcagggaggggccatatgctgattatccgggtgccctcagtgcagctcgctatgcttgctaaagaaaggttgcaggaagttcgcgataagttgggcctgcagtatagattcgagattattctagggaatcccgcaactgaactcagcgtggctactcatttcgttgcacgactaaagtcttggcgaggtaatgagcccgaagagtggatacctaggacgtaccaggacttagatggattgccttgtatcgtaatactgacaggaaaggacccactaggcgagacctttcctcggagcctgaagtattgtgacctccgacttattgacagtagctacctgaccaggactgcgctggagcaagaggtgggcctagcttgttgctatgtgtctaaggaagtaatccgaggccccacggtggcattagacctctcagggaaagaacaagaacgtgctgcagtctctgagaacgactcagacgaactgcttattgacctcgagcggccacagtccaattcaagtgccgtgacaggcacctccgggtcaatcatggaaaatggcgtttctagcagcagcacggccgacaagagtcagaagcagtctctgactccgagcttccagtccccagctacgtccctgggacttgacgaaggggtgtctgcgagcagcgcgggggcaggggcaggagaaactctcaaacaagaatgtgattctcttggcccccagatggcaagctccaccacgtcgaagccgtctagctcgtcatctggcccccgcactctcccctggcccggccaacctatcaggggctgccgcgggccacaagccgccttaccgccagtagttatcctctccaaagccgcttattcactactcgggagccaaaaaagcggcaaattgccatcaagctcctccctgctgcctcatgcggatgttgcatgggtctcctcgctaaggcccctgttgaataaagatatgtcttccgaggagcagagcctgtattaccggcagtggactctcgccagacaacaccacgcagattactctaaccagctggaccccgcaagcggtaccagaaatttccacccacgaaggctgctgctgactggcccaccgcaggtaggaaagactggatcatatctgcagttcctcagaatcctgttccggatgctgatccgactgctggaagtcgacgtatatgacgaagaagagatcaatacagaccacaacgaaagttccgaagtttcccagtcagaaggagagccctggcccgatattgaaagcttttccaaaatgccttttgacgtgtccgtgcacgaccccaagtactccctaatgtcattggtatatacagagaaactggctggagtcaagcaagaagtgatcaaagagtctaaagtggaggaacccaggaagcgcgagacagtaagtatcatgctgacaaagtatgctgcctacaacacctttcaccattgtgaacagtgtaggcagtatatggacttcaccagcgcctcacagatgtctgattctacgctccacgcattcaccttcagtagcagcatgctcggcgaggaggtacagctttattttataattcctaaatccaaggagagccactttgtcttctcaaagcagggcaagcacctcgagtcaatgagactccccctggtttcagataagaatctaaatgccgttaagagtccaatattcaccccctcctctgggagacacgaacacggcctcctgaacctttttcatgccatggagggcatctctcacttacacttgctcgtggttaaagagtacgaaatgcccctgtaccgcaaatattggcccaaccacattatgctcgtcctccccgggatgttcaacaatgccggtgtcggagcggccagatttctgatcaaggagttgtcataccataatttagaactggagcgtaaccggctagaggaactgggcatcaagagacagtgtgtttggccattcatcgttatgatggacgattcatgtgtgttgtggaacattcattcagtgcaggaaccatcgtctcaaccgatggaggtcggagtgtcaagtaaaaatgttagtctgaaaactgtcctgcaacacattgaggcaactcccaagatcgtgcattatgccatcctgggaattcagaaatggtcatctaaactaacatctcaaagcctgaaggctcccttttcacgatgccatgtgcatgacttcattttactgaacacagacctcacccagaacgtgcaatacgattttaatcgatatttctgtgaagacgctgatttcaacttaaggaccaactcgtcggggctcctgatttgcagatttaataacttctctctaatgaagaagcacgtgcaggtcggaggtcagcgcgatttcatcataaagccaaaaattatggtatccgagtctctcgcacctatccttccactgcaatacatctgcgcccccgactcagagcacacactgctggcagcccccgcgcagttcctccttgaaaagttcctgcaacatgctagctacaagctgttcccaaaagccatacacaatttcaggtcgcctgtgctagccattgattgctatctcaacatcgggcctgaggtcgcaatatgctatataagctcccgtccccacagctccaacgttaactgtgaaggcgtctttttcagcggcctcttactttacctgtgtgactccttcgtgggggcggacttaaagaaatttaagtttcttaaaggggcaacgctgtgcgttatttgtcaggatcggagttccctacgccagactattgttcggctcgagctcgaagacgaatggcagtttagactccgtgatgagttccagacggctaattcctctgatgacaaacccttgtacttcctgaccggacgccatgtgtag

SEQ ID NO: 26679 - DNA, 2244 bp, Artificial Sequence
  Description of Artificial Sequence: Synthetic coding sequence
atgggcaactcttatgccggccagctcaagtctgctagatttgaggaggcacttcacaactctattgaggcctccctgagatgctcttcggtggtgcccagaccaattttttctcagctgtaccttgacccagatcagcacccatttagttccgccgacgtgaagccgaaggtcgaagatctggataaggatctcgttaacaggtacacccaaaatggtagtttggacttcagcaacaatctgacggtcaatgagatggaggatgacgaggacgatgaagagatgagcgacagcaacagtcctccgatcccctattctcagaagccagctcccgagggctcatgcacaacggatggcttttgtcaggcaggaaaggatctgaggctggtcagcttatgcatggagcagattgacatccctgctggcttccttctcgttggcgcaaagtcacctaacctgcccgagcacatcctagtgtgtgccgtcgacaagcgcttcctgcctgacgaccatggaaaaaatgcccttttgggttttagtggaaactgtataggatgcggagagcgcggctttcgttatttcactgaatttagtaatcacatcaacctgaaactgactacccagcccaagaagcagaagcatctgaaatattaccttgtgcgttctagtcagggcgtgctctctaaagggccactgatctgctggaaggaatgcagatccagacaatcgtcggccagttgccattctattaagccctcctcaagcgtgtcgagcactgttacacccgagaacggcactactaacgggtataagtctggatttactcagacagatgccgcgaacgggaatagctctcatggtggcaagggctctgcctcctcatctacccccgctcataccgggaattactctcttagtccaaggcccagctatgcttcaggcgaccaggccacaatgttcattagtggaccaccgaagaagcgacacagagggtggtaccctgggtcaccactcccccagcctgggctagtcgttcccgtacctacggttcgacctctatccagaacagagcctctcctctccgcccccgtgccccagactcctcttaccggcatactgcagccacgccccattcccgcaggggaaacggtgatagtccccgagaaccttcttagcaattctggcgtccgcccagtcatacttatcggatacggcacgcttccatacttctacgggaacgtgggcgatattgtggtgtccccccttcttgtaaactgttataaaataccacagttggagaataaggacctagagaaactgggactgacaggcagccaattcttgtcagtggagaacatgattctgctgactatccaatacctcgtacggctgggcccagaccaggttccgctgagagaagaatttgagcagatcatgcttaaggccatgcaggaatttacccttcgcgagcgggccttacagatcggagcccagtgcgtaccggtgtcacctggccagctgccttggctagcacgcttgatcgctagcgtttcccaggacttggtgcatgtggtcgtgacacagaactctctggcagagggaatttctgagacactccggaccttgagcgagatgcggcattaccagagactgcctgactatgtggtcgtcatttgtgcctcaaaaattagggggaatgagttctgtgttgttgtcctcggccagcatcagtctcgcgcccttgcagagtctatgctgactacatctgagttcctcaaggagattagctatgagctcattacggggaaagtgagcttcttggcctctcatttcaaaaccacctcgcttggggatgatctggataaactgctagagaagatgcagcagcgtcgcggggatagcgtggtaaccccgtttgatggcgacctgaatgagtgcgtgtccccccaggaggctgccgccatgatccctactcagaacctggacctggacaacgagacattccatatttatcaacctcagctgacggtggcgagaaagctcctgtcccaagtgtgcgccatcgcagatagtggttctcaatcgcttgacctcggacacttctcaaaggtcgactttattattatagtccctcgtagcgaagtcctggtgcagcagacattgcagcgaatacggcagtctggctcgagccctggatcacatatcgctttctcttacgtactcttcatcagctgtaatttgtag

SEQ ID NO: 26680 - DNA, 531 bp, Artificial Sequence
  Description of Artificial Sequence: Synthetic coding sequence
atgtgcttggaattgtttcactcaagtaacgtcattgacggccttaaattgaacgcatttgccgcggtctttacagtgctttctggcttgctgggcatggtagctcacatgatgtacactcaagtgttccaggtcaccgtctctttgggcccggaggattggcggccacactcgtgggattatgggtggtccttctgcctggcttggggctcattcacttgttgcatggccgctagtgtgactacgcttaattcttacactaaaacagtgatcgaatttcggcacaagcggaaagtgtttgaacaggggtatcgcgaagagccgacctttatagaccctgaggccataaagtattttcgggaacggatggaaaagcgcgatggctccgaggaggactttcatctcgattgcagacatgagcggtaccccgcacgtcatcagccacacatggccgacagctggccccgaagctctgcccaggaagctcctgaacttaacaggcagtgctgggttttgggacattgggtgtag

SEQ ID NO: 26681 - DNA, 585 bp, Artificial Sequence
  Description of Artificial Sequence: Synthetic coding sequence
atgtgtctcgaactgtttcattcctccaacgtgattgatgggttgaagctaaatgctttcgccgccgttttcactgtcttaagtggactgctgggcatggtagcccatatgatgtatacacaagtatttcaggttactgtgtcccttggccctgaggattggaggccacactcctgggattatggatggtccttctgcttggcttggggaagcttcacatgctgcatggccgccagcgtcacgactctgaattcatatacaaaaaccgtcattgagtttcggcataagcgcaaggtgtttgaacaaggataccgagaggaaccgacctttattgatccagaagccattaaatacttcagggagaggtggcagattgaggcccagagaggacgggctacttgtccacggagccattcctggatggagaagcgagacggatcagaggaggatttccatctggactgccgacacgaacggtacccagccaggcatcagcctcacatggcagactcatggccccgcagtagcgctcaggaggctccggagctgaaccgccagtgttgggtactgggccattgggtgtag

SEQ ID NO: 26682 - DNA, 843 bp, Artificial Sequence
  Description of Artificial Sequence: Synthetic coding sequence
atgaagacctccagacgcggcagggcactgttagctgtcgcgcttaatctcctcgcccttctgtttgctaccacagcctttctgactactcactggtgtcagggaacccagagggtgcccaagcccggctgtggtcaggggggaagagcgaactgccctaattccggcgccaatgccaccgcgaacggaaccgcagctcccgccgctgccgcagctgctgccacagcctccggcaacgggccccctggtggagccctgtactcctgggagacaggtgatgacagattcttgttcaggaacttccacaccggcatctggtacagctgcgaggaggagttatcagggctaggggaaaaatgcaggtctttcatcgatctcgcccctgcatcggaaaagggattgctgggcatggtcgcacatatgatgtatactcaggtgttccaggtgacggtatctctgggacctgaggactggcgacctcactcttgggattatggctggtcattttgccttgcttggggcagttttacatgctgtatggccgcaagcgtcaccaccctgaattcttatacaaaaactgttattgagttccgccataagaggaaagtgtttgagcaggggtaccgtgaagagcccacattcatcgaccccgaggccattaagtactttcgggaacgcatggagaaacgcgatgggtcggaggaggatttccacctcgactgccgacatgagagatatcccgctcggcatcagccgcacatggcggactcttggcctaggtcttccgctcaagaggctccggaactaaacaggcagtgttgggtgttggggcattgggtctag

SEQ ID NO: 26683 - DNA, 996 bp, Artificial Sequence
  Description of Artificial Sequence: Synthetic coding sequence
atgaaaacctctcggaggggacgagcccttctagcagtcgccctgaatttgttggcacttctattcgcgaccactgcctttttgacgacccactggtgccaaggtacacagagagtgccaaagccaggttgtggacagggaggcagagcgaattgcccaaatagcggcgctaacgccacagcaaacggaactgctgcgcctgccgccgcagcagccgctgcaacagcaagcggaaacggcccaccaggcggggccctctactcctgggagaccggggacgatcggttcctgttcaggaactttcacacaggaatatggtattcctgtgaggaggaactctctgggttaggcgaaaagtgtagatctttcattgatcttgccccagccagcgagaagggggttctctggctgagcgtggtaagcgaagttctgtacatcctgctgctcgtggtggggttcagcctgatgtgtcttgagcttttccacagctctaacgtaatcgacgggctcaaactgaacgcgtttgcggcggttttcacagtattatcaggattgctggggatggtggctcatatgatgtatacccaagtatttcaagtcacagtttcactggggccggaggactggagaccccacagctgggactatggctggtccttttgcctggcatggggctcatttacctgctgcatggccgcttctgtgactacattgaatagctatacaaaaacggtgatagagtttagacataaaagaaaggttttcgagcaaggttacagggaggaaccgactttcattgaccctgaagctatcaagtacttccgcgaaaggatggagaagcgggacggatcagaggaagattttcacctggattgccgccacgagcggtatcccgccaggcaccagccccacatggccgattcatggccacggtcaagcgctcaagaagccccggagctgaacaggcagtgttgggtactggggcactgggtgtag

SEQ ID NO: 26684 - DNA, 1479 bp, Artificial Sequence
  Description of Artificial Sequence: Synthetic coding sequence
atgtggcgcggtctctggaccctcgccgcccaggcagccagaggcccccgcaggctgtgcacccgaagatcatctggggctcctgcccctgggtctggagccaccatttttgccttgtcttctggccaaggacggtgtggcatagccgtaatccgtacttcaggacctgcctccggtcacgcactgcgtattctgacagctcccagggatctccccttggcccgtcatgcatctcttcgactcttaagtgatccacgcagcggtgaacccttggacagagcgctggtactctggttccctggcccacagagcttcaccggagaagattgcgtcgaattccacgttcacgggggaccagccgtggtgtccggcgttctgcaagcgcttggcagtgtgcccggcctgaggcccgcagaagcaggcgagttcacccggagagccttcgctaatggcaaactgaaccttacagaagtggaaggtcttgcagacctgatccacgcagagacagaagcgcagcgacgccaggctctgagacagctggatggcgagctggggcacctctgccgggggtgggctgagacactgacaaaggcgctggcccatgtggaggcctacattgacttcggagaggatgacaacctggaagagggggtgctggaacaggcagatatcgaagtgagagccctgcaggtcgccctgggcgctcatctgcgcgacgcccgaagaggccaacggctgagaagtggcgttcatgtagtcgtcacgggcccccctaacgcgggtaagagtagtctggtgaacctgctctcccggaaacccgtgtcgattgtgagcccagaacccggaacaacacgagatgtactcgagacaccagtcgacctggctggattccctgtgttgctgtccgatacagccgggttacgagagggcgtaggccccgtcgagcaagaaggggttagacgggcacgagagcgcctggagcaggccgacttgatcctggcgatgctggatgcttcggacctggctagcccatcaagctgcaattttctagccactgttgtggcttctgtaggcgcacaatcaccatcggattctagtcagcgcctgctgctggtacttaacaagagtgacctcctgtccccggagggtcctggtcctggccctgacctgccccctcatttactgcttagctgcctgaccggcgagggtctagacggactgctcgaagctctcagaaaggagctggcagctgtctgtggagacccttcaacagatccccctctacttactcgagccagacatcagcaccatctccagggatgcctcgatgccctgggacactataagcagagcaaggatctggctctagcggcagaggcgctgagagtcgcgcggggccatctgacgcgcctgacgggtggtggcgggactgaggaaatcctggatattatcttccaggacttctgcgttgggaagtag

SEQ ID NO: 26685 - DNA, 1575 bp, Artificial Sequence
  Description of Artificial Sequence: Synthetic coding sequence
atgtggagaggcctgtggacactggcagcacaagcagccaggggcccccggcggctttgcacacgaaggtcttcaggggcccctgccccgggcagcggcgcaacaatcttcgctctgagcagcggacaggggcgatgtggcatcgcggtgatacggaccagtgggcccgccagcggacatgcactacgaattctcacggccccacgtgatttacctctggcgcggcacgcttcactgaggcttctgagtgacccaagaagtggagagcctctggatcgcgctctggtcctgtggttccccggaccccagtctttcacaggggaggattgtgttgagtttcacgtacatggaggccctgccgtcgtgtctggcgtgttacaggccttggggtccgtgccaggactacggcctgccgaggcaggggaattcacgcgccgtgcattcgctaatgggaagctgaacctgaccgaagtggaaggtttggccgacttgattcacgcagagactgaggcccagcggcgtcaggcacttcgccagctcgatggtgaactcggccacttatgtcgcggatgggccgagacccttactaaggctttggcccacgtagaagcgtatattgatttcggcgaagacgacaacctggaagagggggtgttagagcaagggggaagcacctggtggtggggcagaaagactccccacataagccctcagagactgcctagcttgtctctctcagcatgtctcttgagtccaaccgcggatatcgaggtgagagccctacaagtcgccctaggggcgcacctccgagatgcccggaggggacagcggctccggagcggcgtccatgttgtcgtgactggccctccgaacgcggggaaatctagcctggtcaatctgttgagccggaagcctgtctccatagtgagtccagaaccgggtacgacacgcgacgttctcgagacacccgtggatctcgcgggatttcccgttctgcttagcgacactgctggcttaagagagggagtggggcccgtggaacaggagggggtacgtcgggcccgcgagaggttggaacaggccgacctaatcctggcaatgttagacgcaagcgacctcgcctcgcctagttcttgcaatttcctcgctaccgtggtcgcatcggtgggagcacagtccccgtccgattcctctcagagactgctcctggtcttgaataaaagcgatttgctgagtcctgaagggcctggccccgggcccgacctgccaccccacctgctccttagttgcctcactggggaggggctcgatggcctgctggaagctctgcgcaaggagctggccgctgtgtgtggagaccctagtaccgatcctccattactgacccgggcccgccaccagcaccacttgcaaggatgccttgacgcgctgggccactacaaacaatccaaagatcttgcattagcagctgaggccctgagagtggcgaggggacacctgacgcggctaacaggcggtggaggcacagaagaaattctggacataatatttcaggacttttgcgtggggaagtag

SEQ ID NO: 26686 - DNA, 1545 bp, Artificial Sequence
  Description of Artificial Sequence: Synthetic coding sequence
atggtccactcacctacctgtccccacccatgcttcctccttgttcccgctagcgagccacaatttccccatctgcagactcctgatcccggtgacgcagtgtggaatgtacgctgggccctgtgcacccggaggagctcaggggctcccgctcctggatccggtgctaccatatttgcactgagctccggtcagggcagatgtggcatcgctgtgatacggacttccggtccagccagcggacatgcccttagaatccttactgccccccgggatctcccgctggcaagacacgcctcactccgcctgctttcagaccccaggtctggggaacctctggacagggcacttgtgctctggtttcccggtcctcagagtttcaccggagaggattgcgtggagtttcacgtgcatggaggccccgctgtggtctcaggcgttctgcaagcccttggttccgtacccggactgcgccccgccgaggcaggcgaattcaccagacgagcctttgctaacgggaagcttaatctcacagaagtagaaggacttgcggatttaattcacgccgagacagaggctcaaaggaggcaagcccttaggcaacttgacggagagctggggcacctatgtcgcggctgggcagaaacactgaccaaggcattggcgcatgtggaggcctatatcgatttcggcgaagacgacaatctcgaagagggggtgctcgagcaagctgacatcgaggtaagagccctccaggtggcactgggggctcatctgagagatgccagacgcggtcagcgactccggtcaggtgttcacgtagtcgtaactggtcccccaaatgctggtaaaagttctctcgtgaatctcctgagccgaaagcctgtctctattgtgagtccagaacctggcacaactcgggatgttcttgagacccccgtggatctcgcagggttccccgtgcttttaagcgacaccgcgggactgagggagggtgtgggtcccgtcgaacaagagggagtccgcagagctcgggaaagacttgaacaagctgatctgatattagccatgcttgatgcttcagacctggcatctccctcgagttgcaacttcttggctactgtcgtggcctcggtgggagcccagtctcctagcgactcctcccaacgcttgctgctggtgttgaataaatcagacctgctttcacccgaagggcccggccctgggcccgatctgcccccccaccttcttcttagttgcctgacaggggaaggcctcgacgggctgctggaggccttgcgcaaagagttggccgccgtctgcggagacccaagcacagaccccccactcctcacccgggctcggcatcaacaccatctccagggttgccttgacgctctgggacattataagcagagtaaggacctcgcccttgcagctgaggccctgcgcgtggcccgaggtcatctgactcgcctgacaggaggtgggggcaccgaggaaatattagacatcatctttcaggacttctgcgtaggaaaatag

SEQ ID NO: 26687 - DNA, 456 bp, Artificial Sequence
  Description of Artificial Sequence: Synthetic coding sequence
atgtggcgcgggctttggacattggccgcacaggcagcccgcgggcctcggcggctgtgtacgagacgctcaagtggagcccccgcacccggctccggagcaaccatcttcgccttgagcagcggtcagggccgctgtggtatcgccgtgatacgtacaagcggccccgcctctgggcacgccctgcgcatcctgacagcacctagggacctgcctctcgctcgccacgctagtcttaggctcctgtctgacccgcgatctggcgaacccctagaccgcgccctggtcctctggttcccaggacctcagagtttcaccggcgaagactgcgttgagtttcacgtgcatggcggtcctgccgtggtgtcgggggttttgcaggctctgggctccgtcccaggtctgaggccagccgagccaggggccgggaggggctcggcacagggctgtacctag

SEQ ID NO: 26688 - DNA, 1416 bp, Artificial Sequence
  Description of Artificial Sequence: Synthetic coding sequence
atgtggcgtggcctctggacgctggccgcacaggctgcgcggggccctcgtaggctgtgtacccgccgatcatcaggggcacctgctcccggatcgggtgctacaatcttcgccctgtcctcaggccaaggccggtgtggtatagccgtgatcaggacctctgggcccgccagtgggcacgccctgcggatcctgactgccccccgggatctaccgctggcacggcacgcttccctccgactgctatccgaccccaggtccggtgagcctctcgatagagccctggtgctctggttcccgggcccacagtctttcaccggggaggactgcgtagaatttcatgtccacggaggccctgccgtagtctcaggcgttctccaggctttgggaagcgtgccagggctcagaccggccgaggcgggtgagtttacacggcgcgccttcgccaacgggaagctgaacctgacagaggttgaaggcttggcggatctgatccatgcagagactgaagctcaacgcaggcaggcactgcggcagctcgatggcgaattggggcatttatgtaggggctgggctgagaccctgaccaaggccctcgctcatgtggaggcttacatagattttggagaggatgacaacttagaggagggggtgttggaacaggctgatatagaagtccgggcgctgcaggtggccttgggggcccatttacgggatgccagaagaggtcagaggcttagatcaggggtgcacgtcgttgtgacaggcccgccaaacgccggtaagtctagtctcgtgaacctgctgtctcggaagcccgtgtccattgtctctcctgagccaggcacgactagggatgtgttggagacccctgtcgacctggcagggttcccggtgctgttgagtgacacagcaggactcagggagggtgtggggcctgtcgagcaggagggagtccggagggctagggaatcctgcaattttctcgccacagtggtcgcctcagtcggggcccagtccccatccgatagctcgcagagactcctcttggtgctgaataaaagcgatctcctgtcccccgagggcccaggaccaggacccgatctgcccccacacctgctgctgtcctgcctcactggagaggggctggacggcttgcttgaggctctcaggaaggagttggctgctgtgtgtggcgaccccagcacagacccgccactcttaacaagagcaaggcatcaacaccatctgcagggctgtctcgatgcgctggggcattacaagcaaagcaaggatctggcactggccgcagaagctttacgagtggcccggggccatctgacaagacttaccggggggggaggaacagaagaaatccttgatattattttccaagacttctgcgtgggcaagtag

SEQ ID NO: 26689 - DNA, 423 bp, Artificial Sequence
  Description of Artificial Sequence: Synthetic coding sequence
atgagaaaggtaaagtttacacaacagaattaccatgatcgccttagtcagattttgaccgactttccaaaactggatgacatccaccctttttacgctgatctgatgaatatactgtatgacaaagaccattataaacttgccctgggccagattaatattgcgaagaacttggtggataatgtggctaaggactacgttcgcctcatgaagtatggagattcactctatcggtgtaaacagttgaaacgtgccgcacttggccgtatgtgcacagtgatcaaaaggcagaaacaatcattggaatacctcgaacaggtgcggcagcatctgagcagactgcccaccattgatccaaacacacgaactctcttactctgcgggtatcccaatgttgggaagtcttcttttattaacaaatag

SEQ ID NO: 26690 - DNA, 1905 bp, Artificial Sequence
  Description of Artificial Sequence: Synthetic coding sequence
atggcccactataattttaaaaagatcacggtggttccctctgcaaaggattttatcgatttaacccttagtaaaacacaacgtaaaaccccgactgtgatccataaacattaccaaattcaccgcatacgccacttttacatgagaaaggtcaaattcacccagcaaaactatcatgataggctgtcgcagattttgaccgacttcccgaaactcgacgacatccaccccttttatgccgatctgatgaacatactctacgacaaagaccattacaaattggccctaggacagatcaatatagcgaagaatctggtagacaatgttgccaaggactacgtccggctaatgaagtatggcgactctctctatcggtgtaaacagttgaaacgcgccgctctaggccgaatgtgtacagtcataaaaagacagaaacaatcactggagtacctggagcaggtgagacagcacctttctcggctgcctacaattgatccgaacacacggactctgctgctgtgcggataccccaacgtcgggaaaagctcctttatcaacaaggttacgagagctgacgttgatgtgcagccctacgcctttactactaagtccctatttgtgggccatatggactataagtatctgcgatggcaggtggtcgacacaccggggattctagatcaccctctcgaggataggaacacaatcgaaatgcaggccataacagcactggcacacctgagagctgccgtcctctacgtgatggatttatctgagcagtgcggacatggattgagagagcagctcgaacttttccagaacatcagacccctgttcataaataaacccctcattgtcgttgccaataaatgtgacgtgaagcgaatcgccgaactgagtgaggatgatcagaaaattttcaccgaccttcagtccgaaggattcccagtgattgagacatccactcttacggaggagggtgtcatcaaggtcaagactgaggcatgcgatcgtctcctcgcccatagggtagaaacaaaaatgaagggaaataaggttaacgaagtcctgaatcgcttacacttggctatccctactagacgggacgacaaggaacgtccgcctttcattccggagggtgtggtggcccggcggaagcgcatggagaccgaagagagtaggaaaaaacgcgagcgggatctcgaactcgagatgggggacgactatatcttggaccttcaaaagtattgggacctaatgaacctgagcgaaaaacacgataagattccagagatctgggagggacataatatcgccgactacatcgaccctgccattatgaagaaactggaggaattagagaaagaagaagagctgaggacggctgcaggagaatatgactccgtgagcgagagcgaggacgaagagatgctggagatcagacaattggcaaaacagattcgggagaagaaaaagctgaagatactcgaaagcaaagagaaaaacacccaagggcccagaatgccccggaccgcaaagaaagtccagagaactgtgctcgagaaagagatgcgcagtctgggagtggatatggacgacaaggatgacgctcattacgcggttcaagcacgccgctcacgatctatcactcgcaaacgcaagcgagaggacagtgcgccccctagtagcgtggcccggtcggggtcatgctctagaaccccccgagatgtctcgggactgcgcgatgtgaaaatggtaaaaaaggcaaaaaccatgatgaagaacgcacagaaaaagatgaatcgactgggaaagaagggggaggcagacagacacgtctttgacatgaaacctaaacatctcttgagtggaaagagaaaagccggtaaaaaagatcgtcgatag

SEQ ID NO: 26691 - DNA, 1557 bp, Artificial Sequence
  Description of Artificial Sequence: Synthetic coding sequence
atgaaatatggagatagcctgtacagatgcaaacagcttaaacgcgccgccctcgggaggatgtgcacagtcatcaaaagacaaaaacaatcactcgagtacttagagcaggtccgccagcacctgtctcggctgccaaccatcgacccgaacaccaggaccctgctgctgtgcggctatcccaatgtgggaaagtcttcgttcataaataaggtgaccagggccgatgttgatgtgcagccttacgccttcacgacgaagtctctgtttgtcggccacatggactataaatatctgaggtggcaggtcgtagacaccccgggaatcctcgaccatcctcttgaagatcggaataccatcgaaatgcaggcaatcacagccttagcccacctccgcgcagcggtgttgtatgtgatggatctgtcagagcagtgtgggcacggactgcgggagcagcttgaactgttccagaatatcagacccctcttcatcaataaacccctaattgtcgtggctaataagtgcgatgtgaagagaattgctgagctaagtgaggatgatcagaagattttcaccgatctgcaatcagaggggttccctgtgatagaaactagtactctcactgaagagggtgttatcaaagtgaaaaccgaagcatgtgaccgactcctagctcatagagtagagacgaaaatgaaagggaacaaggtgaacgaagttctcaatcgactccacctcgctatcccgaccagaagggatgacaaagaacgccctccgttcatcccagagggtgtggttgcccgaaggaagcggatggaaactgaagaaagccggaagaagcgagaaagagaccttgagctcgagatgggggacgactatatcctagacttgcagaagtactgggatctgatgaacctttctgaaaaacatgacaagattccggagatctgggagggccacaacatcgccgattatatcgaccccgccatcatgaaaaagctggaggaactggaaaaagaagaggaactgcggacagcagctggcgaatacgacagtgtgtctgagagcgaggacgaggagatgctggagatccgtcaactcgcgaagcagatcagagagaagaaaaaacttaagattctggagtctaaggagaaaaacacacagggacccaggatgccgcgcacagccaaaaaagttcagagaactgtgctcgagaaggaaatgaggtcacttggcgtagatatggatgacaaggacgacgcccactacgctgtacaagctaggcggagccggtctataaccagaaaacgcaagagggaagattctgccccaccatcctcagtcgcccggtccggttcttgctcaagaaccccacgggacgtctcaggcttaagggacgtgaagatggtcaaaaaagctaagactatgatgaaaaacgcccagaagaagatgaataggctggggaaaaagggagaggctgatagacatgtcttcgacatgaagccaaagcatctactctcaggtaagcgtaaggctggcaagaaggatagaaggtag

SEQ ID NO: 26692 - DNA, 1764 bp, Artificial Sequence
  Description of Artificial Sequence: Synthetic coding sequence
atgcgcaaggtaaagtttacgcagcagaattaccatgaccggctctcgcagatactgaccgactttcctaagctggacgacattcatccattttacgcagacctgatgaatatcttatacgataaggatcattacaagctggcactgggccagattaacattgccaagaacttagtcgacaatgtagcaaaagactacgtccggctgatgaagtacggcgatagtctatatcgctgtaaacaattaaagcgtgccgcattgggtcggatgtgcactgtcatcaagaggcagaaacagagcctggagtatctagagcaagttagacagcatttatctagattaccaactatcgaccctaacacgcgaacactgctgctctgtggctatcctaatgtggggaaaagttccttcataaataaagtgactagagccgatgttgacgtgcagccttacgcgtttactaccaagtccctgttcgtcggtcacatggattacaagtacctccgatggcaagtagtggatacacctggaatacttgatcacccattggaagacagaaacactatcgaaatgcaagcaatcacagctctggctcatctgcgggccgccgtgctgtacgtgatggacctatccgagcaatgcgggcacgggctacgcgagcagcttgagctcttccagaacattagacctttgttcattaataagccactcatagtggtggcaaacaagtgtgatgtgaaaaggattgctgaattatccgaagacgatcaaaagatcttcacagatctacaaagcgaaggatttcccgtaatcgagacctccaccctcacggaggagggggtaataaaagtcaaaacggaagcttgtgatcggctgttagcccaccgcgttgaaaccaagatgaaggggaataaggtgaacgaagtgctgaatcgcctgcacctggccattcctactagacgcgatgataaagagcgcccacccttcatcccagagggcgtggttgcccgacgcaagcggatggaaaccgaagagagtagaaagaagagggaacgggacctggaactggagatgggcgacgattatatcctcgacttgcagaagtattgggacctgatgaacctgtccgaaaagcacgataaaattccagagatctgggaggggcacaacatagctgactatatcgacccagccataatgaagaagctggaagaattagaaaaggaggaagaactgcggacggcagccggcgagtacgactcagtgtcagaatccgaagacgaggagatgttggagatccgccagctcgctaaacaaatcagggaaaaaaagaaactgaagatattggaaagtaaagaaaagaatactcaaggtcccagaatgcctcgaacagcaaaaaaagtgcaaagaacagtgctggaaaaggagatgcggtccctcggagttgacatggacgacaaagacgacgctcactacgccgtacaggctcgaaggagtaggagcatcacaaggaaaaggaagcgtgaagattccgctcccccttcctctgtcgccaggagcggttcttgtagcaggactccgcgggatgtaagcggactgcgcgacgtgaaaatggtgaagaaggctaagacaatgatgaaaaatgctcagaaaaaaatgaacaggctcggaaaaaagggagaggctgacaggcacgtgttcgatatgaagccaaagcaccttttgagcggaaagaggaaggccggcaaaaaggaccgaaggtag

SEQ ID NO: 26693 - DNA, 1998 bp, Artificial Sequence
  Description of Artificial Sequence: Synthetic coding sequence
atgagcgaacagtcttgtcaaatgtccgaactcaggctgttgctgttgggtaagtgtcgctccgggaaatctgccacaggcaatgccatcctcggcaaacacgtttttaaatcaaaattctctgatcagacggtgataaaaatgtgtcaaagagaatcttgggttcttcgcgaacgtaaggtggtggtgatcgacacgcctgatttgttcagtagcatcgcttgcgccgaagataagcaaagaaacatacagcattgcttagagctatctgccccctcccttcatgccctcctgttagttattgccattgggcatttcacaagggaggatgaagaaacggccaagggtattcagcaagttttcggcgccgaagcacgccgccacatcattattgtgtttactagaaaagacgacctcggtgacgacttgttacaagatttcatcgagaagaataagcctttgaaacaactcgttcaggactatgagggcaggtactgcatcttcaataataaaacgaattctaaggacgaacagatcacgcaggtcttggagctcctgaggaaggtagaatcgctcgtgaataccaatggtggcccgtaccatgtgaacttcaaaacggaaggaagcagattccaagactgcgtgaacgaggccgcgagccaggagggagataaaccccagggcccccgcgaacgccagttacagtccacggggccagagcagaatcccggtaccagtgaacttaccgtgcttttagtgggtaaaaggggtgccggcaagtctgcggccggtaactcgatcctcggcagacaggccttccagaccgggttttcagaacagtcagtgacgcagagttttctgtccgagtcacggagttggaggaaaaagaaagtctctatcattgatgctcccgacatttcaagcctcaaaaatatagatagtgaagtcaggaagcacatttgtacagggcctcacgccttcttgctggtgactccccttggcttttacactaagaacgacgaagccgtcttgtctacaatccagaacaattttggagagaagttctttgaatatatgatcattctgttgacccggaaagaagaccttggtgatcaggatctggacacattccttcggaacagtaacaaagccctttacggtttaattcagaaatgcaaaaatcgctattctgcgttcaattatcgagcaaccggagaggaggagcaaaggcaggctgacgaacttttagagaaaatcgagagcatggtgcatcagaacggtaacaaacactgtgtctttagggagaaagaaacccttaatatcgtccttgtgggtcgttctggtacgggcaagtctgcaaccggcaactcaattctcggaagcctagtgttcacatctcgcctgcgagctcagcctgtgaccaagacctcacaatcaggacgaagaacatgggatggccaggaagttgttgtcgtcgacacccccagttttaaccaaatgctggacgtcgagaaggacccaagtcgtctggaagaggaagtgaagagatgtctatcctgctgtgaaaagggcgacacattctttgtgcttgtttttcagctgggaaggtttactgaagaagacaagacagcagtcgcgaagctggaggcgatctttggtgctgattttacaaaatacgcaatcatgctgtttacacgaaaggaggacctgggggccggcaacttagaggacttcatgaaaaacagcgataacaaggcccttcgcagaatcttcaaaaagtgcggaagaagggtttgtgccttcaataacaaagagaccggccaggcccaggaaactcaggtgaaagctctgctgacgaaggtgaacgatttgaggaaagagtcgggatggtccggctacccccacactcaggagaatgtgagcaaactcatcaagaatgtacaagaaatgagtcaggcagagaaattactgaagaacttaatcggaattctgcagtag

SEQ ID NO: 26694 - DNA, 924 bp, Artificial Sequence
  Description of Artificial Sequence: Synthetic coding sequence
atggccgcacctggactgaggcttggcgctggcagacttttcgaaatgcctgcggtgttggagaggctttccagatacaactcaacgagccaggcttttgcggaggtgttgcgactgcctaaacagcagctgaggaagttgctctaccccctccaagaggtggaacgtttcctggctccttacggccggcaggatcttcaccttcgaatctttgaccctagccctgaggacatcgccagggctgataatatcttcaccgccaccgaacggaacagaatagactacgtttccagcgccgtgcgcattgaccatgcacctgaccttcccaggccagaggtgagaggggattctaccgtccatctcagagccggcgtgaccgccttgccgctgcccggccgcccagcacgcggcgtgttctatagacagagtaatgtggggaagagcagcctgattaaattgtactttcactggcccttgaggcttaagtcagagagtcccaaaaaccaggacactcaggagaatgaatttttcaaggttggtaaacactttactgtggtggatatgcctggctatggtttcagggctccggaggactttgtggatatggtcgaaacgtatctgaaggaaagacgtaatttgaagcgcacgtttctgctagtcgactctgtggtggggatccagaaaacagacaatattgctatcgagatgtgtgaagagtttgccctcccttacgtgatcgtgttgacgaaaattgataagtcttcaaagggacaccttcttaagcaggtgctccagatccagaagtttgtgaacatgaagactcaggggtgctttccacaactgttccctgtttcagccgtcacttttagtggaattcacctgctgaggtgtttcattgccagcgtgaccgggtcccttgattag

SEQ ID NO: 26695 - DNA, 756 bp, Artificial Sequence
  Description of Artificial Sequence: Synthetic coding sequence
atggctgccccaggattaagattgggagcaggacggttgttcgagatgcccgctgtactggagagactatctagatataattctaccagccaggcttttgccgaagttctgaggcttccgaaacaacaactcaggaagctgctgtaccctctccaggaagtggagaggtttctcgccccatacggaagacaggatctgcacctacgtatttttgacccttcccccgaggatatcgccagagccgataacatcttcactgcaacagaaagaaatcgcatcgactatgtgtcgagcgccgtgcgtatcgatcacgctcctgacttgccgcgccctgaagggcacaccaagaaaatgaactttttcaaagtcggaaagcattttaccgtggtggatatgccaggctacggttttcgagcccccgaggatttcgtcgacatggtagagacttacctcaaggagcgtaggaatttgaaacgcacatttctcctcgttgatagcgtcgtggggatccagaagaccgacaatatcgccatagagatgtgtgaggagtttgccctgccttacgtgattgttctgactaaaatcgataagagttcgaaggggcatctcctgaaacaggttttgcagatacagaaatttgtgaatatgaagacccagggctgttttccccagctatttcccgtaagtgcagtgacttttagcgggattcacctgttgagatgctttatagcctccgtcactgggtcactggattag

SEQ ID NO: 26696 - DNA, 855 bp, Artificial Sequence
  Description of Artificial Sequence: Synthetic coding sequence
atggcagcgcccggcctccgcctgggggcgggtcgactgttcgagatgcctgcagtgctggagagactctctagatacaactcaacaagccaggcattcgctgaggtgctgcggctgcccaaacagcagcttagaaaactcctgtatccactccaggaagtcgaacgcttcctcgctccttacggccgtcaagatctgcacctaagaatatttgacccctctccagaggatattgctcgggccgacaatatttttacagctaccgaacgaaatcgaatcgactacgtttccagcgcagtgcggattgaccatgccccagatctcccgcggccagaggtgtgcttcatcgggcgtagtaacgtgggcaaatcttctctgataaaagccctcttttcactggccccagaggtggaagtacgcgtctctaaaaaacccggtcacacaaagaagatgaacttttttaaggtgggcaaacatttcacagtggtcgacatgcccggctatggcttcagggccccagaagatttcgtcgacatggtcgaaacatacctgaaggaacgacgcaacctgaagcggacgtttctgctggttgattcagtcgtcggaattcagaagacggacaatatcgccatcgaaatgtgcgaagagttcgctttaccctacgttattgtgctaactaagattgataagagttctaaaggccacctgctcaagcaagtgttacagatccagaaatttgtcaatatgaagacccaaggatgcttcccacaactgttccctgtgagcgccgtgactttcagcgggatccaccttctgaggtgtttcatcgcctcagtaacagggagcctggactag

SEQ ID NO: 26697 - DNA, 522 bp, Artificial Sequence
  Description of Artificial Sequence: Synthetic coding sequence
atggtatgttttatcggtagatctaacgtgggcaagtcatcgcttattaaagcactgttttctctggcgcccgaggtggaagtgcgggtgagtaaaaagccagggcatactaaaaagatgaacttttttaaggtaggcaaacactttactgtggtcgacatgcccgggtacggctttagagcacccgaggacttcgtggacatggtcgagacgtatctcaaggaacgcagaaacttgaagaggactttcctgctcgttgatagcgtcgtggggatccagaaaacagacaatatcgcaattgagatgtgcgaggaattcgcgctaccttatgtcatcgtactcaccaagattgacaagtcttccaagggccatttgctgaaacaggtcttacaaatccagaagtttgtcaacatgaagacccagggctgctttccccaactgttccctgtgtctgcagttaccttctcgggtatacacctgctccggtgcttcatcgcctccgtgactggatcattggattag

SEQ ID NO: 26698 - DNA, 405 bp, Artificial Sequence
  Description of Artificial Sequence: Synthetic coding sequence
atgaatttcttcaaagtgggcaagcatttcaccgtcgttgacatgcctgggtacggctttcgggcaccagaggactttgtagacatggtggaaacatacctgaaagagagaaggaacctcaagagaacttttctcttggttgattccgtggttggaattcaaaagactgacaatattgcaatagagatgtgtgaagagtttgccttgccatacgtcatcgtacttaccaagatagacaagtccagtaagggccatctgctgaagcaagtgctccagatccagaaattcgtgaacatgaagactcaaggctgcttcccccaactatttcccgtgtccgccgtaacattttccgggattcatttgcttcggtgtttcatcgcatctgttacagggagtctggattag

SEQ ID NO: 26699 - DNA, 756 bp, Artificial Sequence
  Description of Artificial Sequence: Synthetic coding sequence
atggctgcccctgggctgcgcctgggcgctgggcgtcttttcgaaatgccggcggtgctcgagcgccttagccgatacaattccaccagccaggcatttgccgaagttctgcgcttacctaaacagcagttacgcaagctcctgtaccctcttcaggaggtggaaaggtttctggccccttacggacgacaggacttacaccttcgcatcttcgaccctagccctgaggacatagcgagagccgacaacatctttaccgctacagaaaggaatcgtatcgactacgtcagctcagccgtgagaattgatcacgccccagatctcccccgccccgaaggacacaccaagaagatgaactttttcaaagtgggtaaacattttacagttgtcgatatgccagggtatgggttcagagctcctgaggatttcgtggacatggttgagacctatctgaaagaacgtagaaaccttaaaagaacgtttctcctcgttgatagtgtggtcggcattcagaagactgacaatatagctatcgaaatgtgcgaggaatttgctcttccatatgtaatcgtactcacaaaaatcgataagtcctcaaagggacatttgttaaagcaggtgttgcaaatacagaagttcgtgaacatgaaaacgcaagggtgtttcccccaactcttcccggtctccgcagtcacattttctgggatccacctactgcgctgttttattgccagcgtaacaggttccctcgattag

SEQ ID NO: 26700 - DNA, 462 bp, Artificial Sequence
  Description of Artificial Sequence: Synthetic coding sequence
atgacagaacagatgacgctgaggggcactttgaagggccacaacgggtgggtgacacagatagcgactaccccacaattcccagatatgattctgtcagcatcgcgagataagacgataataatgtggaagctcactcgtgatgaaaccaattacggaataccacagcgggccttgaggggacactcccactttgtatccgacgtggttatttcttcagatgggcaattcgctttaagcggatcttgggatggcaccctgaggttgtgggatttgaccaccggtaccaccaccagaagattcgtgggccacacaaaggatgtgctctccgtggcattcagctctgacaaccgccaaatagtaagtggaagcagagacaagactatcaagctgtggaacacattaggtgtttgcaaatacacagtgcagtcgcactctgtcgcgcaggcaggcgtacagtag

SEQ ID NO: 26701 - DNA, 954 bp, Artificial Sequence
  Description of Artificial Sequence: Synthetic coding sequence
atgaccgagcaaatgaccttacggggaacgttgaaggggcataacgggtgggtcacgcaaatcgcaaccacccctcagtttcctgatatgatcctcagcgcgagtagagataagaccatcatcatgtggaagttgacgagggatgagactaattacgggattccgcagagggccttacgcggtcatagtcatttcgtgtctgacgtggtgatctcgtcagacggacaattcgccctgtcagggagctgggatggaactctgcgcctgtgggatctcaccacagggaccaccacccgccgctttgtggggcatacaaaggatgtgttatccgtggctttttctagtgataacagacaaatagtgtcagggagtagagataagactatcaagctttggaataccttgggagtctgtaagtacaccgttcaggacgagtcacattcagaatgggtgtcttgtgtgcgcttctccccaaactcttcaaatcccatcatcgtgagctgtggatgggataagctcgtaaaagtgtggaacttggcaaactgtaagctgaaaacaaatcatatcgggcatacggggtacttgaatactgtcaccgtgtccccggacgggtccttgtgcgcaagcgggggtaaggacgggcaggccatgttatgggatctaaatgaggggaaacacctgtatacgctggatggcggtgatattatcaacgccctgtgcttctctcccaatcgttactggctttgtgccgcaacggggccaagcattaagatctgggacctcgaaggcaagattatcgttgacgaactgaagcaggaggtgattagcacctctagcaaagcagaaccacctcaatgtactagtctggcctggtcagcggacggccagacactgttcgccgggtatactgacaatttggtgcgggtgtggcaggtgaccatcggaacccgttag

SEQ ID NO: 26702 - DNA, 207 bp, Artificial Sequence
  Description of Artificial Sequence: Synthetic coding sequence
atgagttccggggcatccgccagcgctcttcagcgactggtggaacagctgaaattggaagccggggtggaaaggatcaaggtgtcccaggccgcagctgaattgcagcagtattgtatgcagaatgcctgcaaggatgccctgcttgtgggtgtacctgccggaagcaatccattcagggaaccgcggagctgcgctctgctttag

SEQ ID NO: 26703 - DNA, 219 bp, Artificial Sequence
  Description of Artificial Sequence: Synthetic coding sequence
atgtcatcaaaaaccgcctccaccaacaacattgcccaggcaagacgcacagtccagcagctgaggttggaggccagtattgaacgcattaaagtgtctaaagccagtgctgatctcatgagctattgcgaggaacatgcccggtccgacccactactgatcggcatccctactagtgagaatccttttaaagacaagaaaacctgtatcatactctag

SEQ ID NO: 26704 - DNA, 228 bp, Artificial Sequence
  Description of Artificial Sequence: Synthetic coding sequence
atgaaaggcgagactccagttaacagtaccatgtccatcggacaagcacggaagatggtcgagcagttgaagatcgaagcaagcctgtgccgcataaaagtcagcaaggctgccgccgacctcatgacatactgcgatgcccatgcttgcgaagatcccctcattacccccgtgcccacaagcgagaaccctttcagggagaagaaatttttttgtgctcttctgtag

SEQ ID NO: 26705 - DNA, 228 bp, Artificial Sequence
  Description of Artificial Sequence: Synthetic coding sequence
atgaaagagggcatgagtaataacagcaccacttccatctcccaggctcgcaaggctgttgagcagctcaaaatggaagcatgtatggatcgtgtcaaagttagtcaagcagccgctgatctgctcgcctactgcgaggcacacgttcgcgaggacccactgattatccccgttccggccagcgagaatcctttcagagagaagaagtttttttgcacaattttgtag

SEQ ID NO: 26706 - DNA, 228 bp, Artificial Sequence
  Description of Artificial Sequence: Synthetic coding sequence
atgaaggagggaatgagcaacaattctaccacctctatcagccaggctcgcaaggctgtcgaacaactgaagatggaggcatgtatggacagagtaaaggtcagtcaagcagcagcagacctgcttgcatattgcgaggcccacgtgcgagaggaccctcttatcatccccgtaccagcctccgagaacccgtttagagagaagaagtttttttgtacaatactgtag

SEQ ID NO: 26707 - DNA, 228 bp, Artificial Sequence
  Description of Artificial Sequence: Synthetic coding sequence
atgaaagagggaatgtccaacaacagtaccacatccattagtcaggccaggaaggcggtcgagcagttaaagatggaggcctgcatggacagagtgaaagttagccaggcggcagctgacttgctcgcatactgtgaggcccacgtgagagaggatccattaattatccccgtcccagcctccgaaaatcctttcagagagaaaaaatttttctgcaccatcctgtag

SEQ ID NO: 26708 - DNA, 228 bp, Artificial Sequence
  Description of Artificial Sequence: Synthetic coding sequence
atgaaggaaggtatgagtaacaactccaccacgagtatttctcaggcgaggaaagccgtagagcagctcaagatggaggcctgtatggaccgcgtgaaagtttcacaggcagctgcagaccttctggcctactgtgaagctcacgtccgcgaggacccattgattatacctgttccagcttctgagaacccatttagggagaagaagtttttctgcacaattctctag

SEQ ID NO: 26709 - DNA, 207 bp, Artificial Sequence
  Description of Artificial Sequence: Synthetic coding sequence
atgtcagcaaccaacaacatcgctcaggcacgcaagctggtggagcagttacgcattgaggccggcattgaaaggattaaggtgtcaaaagcagcaagtgacttgatgtcttattgcgagcagcatgctcgtaatgacccattgctggtaggggtccccgcaagcgaaaacccctttaaagacaaaaaaccttgcattatcctctag

SEQ ID NO: 26710 - DNA, 141 bp, Artificial Sequence
  Description of Artificial Sequence: Synthetic coding sequence
atgcctgtaattaacattgaagacttaaccgagaaagataaactgaaaatggaggtggatcagctgaagaaagaggtgacactggagaggatgttgatccccgccaggcatttgcagaaccaatccctcatggattattag

SEQ ID NO: 26711 - DNA, 141 bp, Artificial Sequence
  Description of Artificial Sequence: Synthetic coding sequence
atgccggtgattaatatcgaagacctgaccgagaaggacaagcttaagatggaggttgatcaattgaagaaggaggtgacgctggaacggatgctgatccccgctcgtcatctccaaaaccagtctctcatggattattag

SEQ ID NO: 26712 - DNA, 141 bp, Artificial Sequence
  Description of Artificial Sequence: Synthetic coding sequence
atgcctgtgatcaatattgaggatctgaccgagaaggataagctcaagatggaggtcgaccagctgaaaaaggaggtgaccctagagagaatgctgatcccagcacgtcacttgcagaatcagtcccttatggactattag

SEQ ID NO: 26713 - DNA, 1065 bp, Artificial Sequence
  Description of Artificial Sequence: Synthetic coding sequence
atggggtctgggatttcttctgaaagcaaagaaagtgccaaacgcagcaaggagttggagaagaagctgcaggaggacgcagagcgggatgcccgcaccgtgaagttgctacttctaggcgccggcgagtcaggtaaatccaccatcgtaaagcaaatgaagataatacataaaaatgggtacagtgaacaggagtgtatggagttcaaggccgtgatttactccaataccctgcagtccatcctggcaatagtgaaagccatgactacactcgggatcgactatgtgaatccccgtagtgccgaggatcagagacaactctacgcaatggctaacaccctcgaggatgggggcatgaccccacagctcgccgaggtaatcaagagactgtggcgagatcccggcatccaggcatgttttgagagagcgtctgagtatcagctgaatgattccgcagcttattatctcaacgatttagaccgcataactgcgagcggctatgttcctaatgaacaggatgtgctgcactcccgcgtgaaaaccaccgggattatagaaactcaattcagtttcaaggacttgcacttccggatgtttgatgttggtggccagcgatctgaaaggaaaaaatggattcactgttttgagggagttacctgtattatcttctgcgctgcgctgtcagcatacgacatggtcctggtggaagatgaggaagtgaatcgcatgcacgagagcctccatctgttcaacagcatttgtaatcacaagtactttagtactacatccattgtgctattcctcaacaagaaggacattttccaggagaaggtgactaaggtccatctgtcgatttgctttccggagtatacaggcccaaatacgtttgaagatgccgggaactatataaaaaaccagtttctggatcttaacctgaagaaagaggacaaagagatctactcacatatgacctgtgctaccgacacacagaacgtcaagttcgttttcgatgccgtgaccgacataataatcaaagaaaatctgaaagattgtgggctgttttag

SEQ ID NO: 26714 - DNA, 1749 bp, Artificial Sequence
  Description of Artificial Sequence: Synthetic coding sequence
atgatgaaactgaggcacaaaaacaagaagcccggagagggcagtaagggtcataaaaaaatttcctggccttatccacaacctgcaaaacaaaatggcaagaaagccacaagtaaagtgccgtcggccccccacttcgtacacccaaatgaccatgccaaccgcgaggcagagctaaaaaaaaaatgggtcgaggaaatgcgcgaaaaacaacaggctgcgcgtgagcaggaaaggcaaaagagacgcaccatcgagagctattgtcaggacgtgctgagaagacaggaggagttcgagcacaaggaggaggtgctgcaggagctcaatatgtttcctcagctagatgatgaagccacccgcaaggcatactacaaggaatttcgaaaggttgtggagtactcagatgtgattctggaggtgttggatgctcgagaccctttgggttgcagatgtttccaaatggaggaggctgtgttgagagcccaggggaataagaaactggttctagttctgaataaaatagaccttgtaccaaaagaagtcgtggagaagtggcttgattacctgagaaacgaactccctacagtggccttcaaggcttccacccagcatcaggtgaaaaaccttaatcgctgcagtgtgcccgtggatcaggcatcagaatcactgctgaagtctaaggcttgtttcggggccgagaacttgatgagggtcctggggaactactgccggctgggggaggtcagaacacatattagggtaggggttgtcgggttgccaaatgtgggcaaatcttccttgatcaattccctcaagcggtcgcgggcctgtagcgtgggagccgtgccaggtatcacaaagtttatgcaagaggtgtacctggacaaatttattaggctgttggacgcgccggggattgtgccaggacctaactcagaagtcggcacgattctgcgcaattgcgttcatgtgcaaaagttggccgatccggtgacccctgttgagacaattttgcaacggtgtaatctggaggagatcagcaactattatggagtcagcggcttccagactaccgagcactttctgacagccgtcgcccacaggctgggaaagaaaaaaaagggcggtctgtatagtcaggagcaagctgctaaagcggtcctggccgattgggtgagcgggaagatttctttttacatccctccccctgccacccacactctaccgacccacctgtccgccgagatcgttaaggaaatgaccgaggtgtttgatatcgaagacacagagcaagccaatgaagacaccatggagtgtttggccaccggtgagtcggacgaactccttggggacaccgatccactcgaaatggagatcaagttgcttcactcccctatgaccaagattgccgacgctatcgagaacaagaccacggtgtacaaaattggtgatctgaccggatactgtacaaatcccaaccgacaccaaatgggctgggcaaagcgaaacgtggaccaccgccctaagtcaaattccatggtggacgtgtgtagcgtcgaccgtagaagtgttttgcagaggatcatggagactgacccactacagcagggccaagctctggcctcggccctcaaaaataaaaaaaaaatgcagaaacgagccgacaaaatagcatcaaaattatctgatagcatgatgtccgccctagatctgtcaggcaatgccgacgacggcgtgggggactag

SEQ ID NO: 26715 - DNA, 1749 bp, Artificial Sequence
  Description of Artificial Sequence: Synthetic coding sequence
atgatgaagctccgccacaagaataagaagcccggggaggggagtaagggtcacaagaaaatctcttggccctacccacaaccagccaagcagaatgggaaaaaagccacctctaaggtaccttctgctccccactttgttcatccaaatgatcatgccaaccgcgaagctgaactaaaaaaaaagtgggttgaagagatgcgcgagaaacagcaggccgcgcgggaacaagaacgccagaagagacgaaccatcgagtcatactgccaggatgtgctgaggcgacaggaggaattcgagcataaggaagaagtgctccaggaactaaatatgtttccacagctggatgatgaggccacccggaaggcctactataaggagtttcggaaagtcgtcgagtactccgacgtgatcctggaggttctggacgctagagaccctttgggttgtaggtgctttcagatggaggaagcagtgctgagagcacagggcaataaaaagctggtgcttgtccttaacaaaattgacctcgtgccaaaagaagtggtggagaagtggttggactatctacgcaacgagctgcctaccgtggcttttaaggcatcaacgcagcatcaggttaaaaacttaaataggtgttcggtgccagtggatcaggcctccgagtctctgttaaaatctaaggcttgttttggggctgagaacctgatgcgggtcctcggtaattactgtagactgggggaggttcggactcatatacgcgttggcgtggtcggcctccctaacgtggggaaaagtagcctgatcaattctctgaaacgcagtagggcttgtagcgtgggtgccgtccctgggattaccaagttcatgcaggaggtctacttggacaagttcattcgattgctggacgcacccggcatcgtgcctggaccaaattccgaggtgggcactattctcagaaactgcgtccatgtccagaaactcgcggaccctgttacaccggtagagacaattttgcaaagatgtaacctggaagaaatcagcaactattacggggtgtcaggctttcagacaaccgaacacttcctcactgcagtcgcccacaggcttggaaagaagaagaaggggggcttgtacagccaggagcaagcagccaaagcagtgttagccgactgggtgtcagggaaaatatctttctatatcccccctcccgcaacccatactcttcctactcacttgtctgccgaaatcgtgaaggaaatgaccgaggtgttcgatattgaggataccgaacaggcgaatgaagataccatggagtgtctcgctacaggggagagcgatgagctgctgggggacaccgatcctctcgaaatggagattaagctgctgcacagtcctatgactaagattgccgacgccatcgagaataaaaccaccgtatataaaattggagacctgaccggttactgcactaaccccaatcgacatcaaatggggtgggctaagaggaacgtggaccaccgaccaaaatctaactccatggtcgacgtttgctccgtggacagaaggagcgtccttcagaggatcatggaaacagatcccctgcagcagggtcaggctttggcttctgcactgaagaataaaaaaaagatgcagaagagggccgataagatcgcctccaagctgagcgactctatgatgagcgcactggacctgtctgggaacgccgacgatggtgtgggagattag

SEQ ID NO: 26716 - DNA, 2010 bp, Artificial Sequence
  Description of Artificial Sequence: Synthetic coding sequence
atgtggactctcgtgggccgcgggtgggggtgcgctcgtgccctggcaccgagagccaccggcgctgctctgctagtcgctcccggaccaagatctgcacctactctcggcgcagcccctgagtcgtgggccacagacagactgtattcctcggcggagttcaaggaaaagctggacatgtctcgatttccagtggagaatatacgcaacttcagcatcgtcgcccacgttgaccatgggaaatccaccctggcagacaggctgctggaactcactgggaccattgacaaaactaaaaacaacaagcaagtgttagacaagttgcaggtcgaacgggaacgggggattacggtcaaagctcagaccgcctccctgttctacaactgcgaaggcaagcagtatttattgaacctgattgatacgccagggcacgttgatttcagctatgaagttagcaggtctctgtctgcctgccagggggttttgctggtcgttgacgccaatgagggcattcaggctcaaacagtagcaaacttcttcctggccttcgaagcccagctttccgtgattcccgtgattaacaagatcgatttaaagaacgcagaccctgagagagtggagaaccaaatcgaaaaggtctttgacattccgagcgacgaatgtattaaaatctccgccaagcttggaaccaacgtggaatcagtgctgcaagcaatcatcgagcgtattcccccccccaaagtgcacagaaagaatccactgagggcattagtgtttgatagtacctttgaccaataccgcggggtgatcgctaatgtggccctgtttgacggggtggttagcaagggggacaagatcgtctccgcccatacccagaagacatacgaagtgaacgaggtcggggtgttgaatcccaacgagcagcctacacacaagctgtacgctggccaggttggatatttgatcgctgggatgaaagatgtcacagaggcacaaataggcgatactctctgcctccataaacagccagtagagccattacccggctttaaatctgcgaagccaatggtctttgcaggcatgtacccacttgatcagtctgagtataacaatcttaagtccgccatcgaaaagctgacactcaacgacagcagtgtaaccgtccacagggatagctcgctggctctgggggcggggtggcgactggggttccttggtctgctccacatggaagtgttcaatcagaggctggagcaggaatacaacgcctcagttattctgaccactcctacggttccctataaggctgtgttatcatcctctaaactcatcaaagaacatagggaaaaggaaatcactattattaatcccgcacagtttccggacaagtcgaaggtgaccgagtatctggagcctgtggttttgggcaccattatcacccccgacgagtatactggcaagataatgatgctgtgtgaagcgcgtagagctgtgcaaaagaatatgatcttcatagatcaaaacagggtgatgctcaagtacctgtttccactgaacgagatcgtggtcgacttttacgacagcctgaaatcgttgtcctcaggatacgcaagctttgattacgaggatgctggctaccaaactgcagaactggtcaagatggacatcctactcaacggtaacaccgtcgaggagttggtgacagttgttcacaaagataaagctcattccatcggaaaggccatctgcgagaggttgaaggatagcctgccaagacagctgtttgaaatagcgatccaggccgccatcgggtcaaagattatcgctcgggagaccgtcaaggcttaccgcaagaatgtccttgcaaagtgttatggtggtgacataacacgaaaaatgaaactgttaaagcggcaggccgagggtaaaaagaagcttaggaagataggcaacgtggaggtcccaaaagacgccttcatcaaagtactaaagacccagtcaagcaaatag

SEQ ID NO: 26717 - DNA, 756 bp, Artificial Sequence
  Description of Artificial Sequence: Synthetic coding sequence
atggcccaccggttgcaaataaggctccttacttgggacgtgaaggatacacttctgaggctccggcaccctcttggcgaggcctatgccaccaaagcgcgcgctcacgggttggaagtagaaccctctgcccttgaacagggtttccgacaagcataccgtgcccaatcacacagcttccctaactatgggctatctcatggtttaaccagtcgacaatggtggctcgacgtggtcctgcaaacctttcatctggctggagtgcaagacgcacaggccgttgcacccattgccgagcagctgtataaggacttttctcacccatgcacctggcaggtgctagacggggctgaggacactttaagggagtgtcggacccggggactccgtcttgcggtgatcagcaatttcgaccgccgtcttgagggcattttggggggtcttggtctcagagagcacttcgattttgtacttacatctgaagctgctgggtggcctaaaccagatcctcgtatttttcaggaagccctgcgattggcccacatggaaccagtcgttgcagcacacgtcggcgacaactacctgtgcgattatcagggaccccgtgctgtaggaatgcattctttcttggtagtgggccctcaggcattggaccctgtggtccgagattcagtacctaaagaacacatcctaccaagtctggcacatctgctgccggctttggattgcttagaaggtagcacgccggggctctag

SEQ ID NO: 26718 - DNA, 756 bp, Artificial Sequence
  Description of Artificial Sequence: Synthetic coding sequence
atggcccatcggttacaaatcagactgctaacttgggatgtgaaggacaccctactacggctgcgccaccctcttggggaggcgtacgctacaaaagctcgagctcacggcctggaagtagaaccctcagccctcgaacagggattccggcaggcgtacagggctcagtcgcatagtttccccaactacggtctctctcacggactcacctcacgacaatggtggctggacgtggtgcttcagacgtttcatctggctggtgtccaggatgctcaagcagtggccccaatcgcggagcagttgtataaggatttcagccacccctgtacatggcaggtcctggatggagccgaggacactctccgcgagtgtcgcaccaggggactccgtcttgcggttatatccaacttcgatagacggttagagggcatactgggtggactggggctccgggaacattttgatttcgtgttgacaagcgaagcagcaggatggcccaagccggaccctcggatattccaggaggcgctgaggctggctcatatggagccagtggtggctgcccacgtcggggacaactatctctgcgattatcaaggtccgcgggccgttgggatgcactccttcctggtggttggtccccaggcactcgatcccgttgtcagggacagcgtccccaaggaacatatactgccaagcctggcccatctcctccctgctttggactgcctggaggggtccacccccggcctgtag

SEQ ID NO: 26719 - DNA, 867 bp, Artificial Sequence
  Description of Artificial Sequence: Synthetic coding sequence
atggacatcggcctgtcaattgccaactcttccgggttccagctgtcagagttcattttaatagggttcccagggatacacgaatggcaacattggttgtccttaccccttgctctgggagccaacctgctgatcattatcacaatccaacacgaaacaatgcttcacgaacccatgtatcatctgctgggcatcctggcagttgttgacattggtcttgccactaccattatgcccaaaatcctggctattttctggttcgacgcaaaggctataagcctgccggaatgctttgctcagatttacgccatccactcatttatgtgcatggagtccggtatcttcctgtgcatggcagttgacaggtatatggccatctgctatcctttacagtacacttccatcgtgacagaggcgttcgtgattaaagctacactgagcgtggtgctccggaacggactgctaacaatccccgtgcctgtgttggctgcacagaggcactactgttctaggaatgagatcgatcagtgtctgtgtagtaatttaggggtgacatccctcgcttgtgatgatacaacaattaaccgcttttaccagctggcccttgtgtgggtggtagtaggatcagatatggggctcgtgtttgccagctacagtcttataatccactctgttcttaaacttaactcggccaaagccaccagtaaggcgctgaatacctgttcatcccacctgattcttattctgtttttctacaccgccatcattgtggtatccgtaactacttggcaggaggaaggacttcctgcatcgctcttcagctctatgtgttgtattctgagctcccctcagcctctcactccctag

SEQ ID NO: 26720 - DNA, 513 bp, Artificial Sequence
  Description of Artificial Sequence: Synthetic coding sequence
atggctagcgtatcgtccgccactttctctggacacggagccaggtctctgctgcaatttctcagactggtcggacagctgaagagggtacccaggaccgggtgggtatacaggaatgtccagaggcctgaatcagtcagcgaccacatgtataggatggccgtgatggctatggttatcaaggatgaccggttaaacaaagacagagaggccatgaaacagatcacccagttgctccctgaagatctcagaaaggaactgtacgagctgtgggaggaatatgaaactcagagttctgccgaagccaagtttgtgaaacaactggatcagtgtgaaatgatacttcaagcgtctgaatatgaggaccttgagcacaagccggggaggctgcaggacttttatgattcaacagctggaaagttcaatcaccccgaaatcgtccaactagttagtgagctggaagccgaacggtcgacgaacatcgccgccgccgccagtgaaccccactcatag

SEQ ID NO: 26721 - DNA, 615 bp, Artificial Sequence
  Description of Artificial Sequence: Synthetic coding sequence
atggcctccgtctcatctgctacttttagcggacatggcgcaaggtcgctgttgcagtttttgcggctggtgggccagctgaagcgtgtgcctcgtacaggctgggtttatcgcaacgtccagagacctgaatctgtaagtgaccatatgtacagaatggcagtgatggctatggtgatcaaagacgaccggctgaacaaagacaggtgtgtcaggctagccctggtgcacgatatggctgaatgtatcgtgggcgatatagccccggccgataacatccccaaagaggagaaacaccgcagagaggaggaggctatgaagcagatcactcagcttctccctgaggatttgcgtaaagaactttacgaactgtgggaagagtacgaaacacagtccagtgccgaggccaaattcgtaaagcaactcgaccagtgtgaaatgattctccaggctagcgagtatgaggacctcgagcacaaacccggtcgcctccaggacttttatgattccacagcagggaagtttaatcacccagaaattgtgcagctggtaagcgaactcgaagcagagagatccaccaacatcgctgctgccgcttccgagccgcattcctag

SEQ ID NO: 26722 - DNA, 3135 bp, Artificial Sequence
  Description of Artificial Sequence: Synthetic coding sequence
atggcactgagccctggggcaaacctcgttttccatgaggaccctaagatgaccccctcaccacccagttgcggagcgcctggtctcggatccggcacaataccccaacctcaccctgacatggctcaggtgccaatgttgaatctgctgccgtctccgggtctggccttggtgcctgacctgaacgatagcctcagtcctgtttccggtgaggccagcgggctggtaagcgagaatacacctaggcccgacgactcccgagctatagccccagcaagcttgcagatcacttcgtcttgtagtggcgaggccctcgaccttgacagtaaggacgtgagcaggcccgactcacagggacggttatgcccagcatccaatcccattctgtcaccctcttccacagaggcacccagactcagctcgggcaaccatccccagtccaatagcgaggacgcattcaaatgcttaagctccaagatctttaagcttgggcaacgaaattctaacccttccagacacgaacttaatccttttatacgtcaccactcccgagagggcctggttttgggtcattgcatatcacggccctcctctaaggctctactgatccccacatccaattccagcctggatttggactcaaatcctcttttaaatatgggctcaaggaacacgtctaagctgaatctgaatgttgccccagactcccatggaacattaatcccagacacaaacgagacaataactttggcttcgcacaatatctccgagtccgtttctaaaggcgcattcagcaccacctggagcacctctagcaaggaaaccatgaacgtggcgagctccggccacagccgcagcgatctatcagtcacaattacccaagcttcctacgtgaccttgatccctggaagcagttacggcattagcctgcattcgtccacccatgaacccaacagtacgatttcaccccccagttgcatgacgcttattcttgggtctaacgaaacactcagtctcgatagctctttgttattttctgacactagcaccctcactttgagcagtcagcaggacgacgccaaggataattccatccacacagtcccactggaggaaaacctcgagagttggtcagaaatggcgagtatcaaggtgggccagttcccccttggcttcccgattagcaatccagcaggtaaagacgctgtcaccctgcaaggcattccagagggcgcattcgacgaggtgacatcttgtcttgtgaaagtacccgagaaaacagagggtggcaacaatatggcgctcgttgagaatgtgactaccctgcagaaaagccaggatttactggaggcagagggggaaaaaaaaacgatgatcaagaagatcatgcgtcagattcaagaagagcctctggacagtctgtcctcatccgtaaggaaacaggcgatggagatccttacacaattgagtcacacccagccaacactggggatgcgggagcggtcagaactggtgaacgtatgtgtccattccgtattctccctgccttccgtacaggccatgcaggaaaaagatgaggctaaggcggaaactatccaggcgctgtatcaccagaccctggaagctctacaaacgctactcaaggccctcttcattgaagacccgacccccgccgggctgaaatctatcctcgaagcgctcggtccttggatgaatagcggaaaggcacacgagagggctagggctgtgaacaccaatgtgtcagtgctgaaccatatgctacttactctgcccttttttatgcccttgggcttccctgctcttggcctgctgttaggaaggcttatcctgcatatcggggaccccgatgaggagattggatgcgaagcgctcgacgggatcattatcctgtacaccattctggaacttcagaaaagggcacgagacaaggaggagactaacaaaaaggagctgtatgaatcaaacaagcatttcttgggcccctacaacccggtgtcgccttgccagaacatcctccgcgtgatcgaggaatttggagacttcctcggcccgcagcaaatcaaagacctcctgctggcagctctggagggcttgaaaggcagctcagaagccccaggaaaagattccagagaaatgatgcagctggcttctgaggtcatgctaagctctgtgctggagtggtatagacaccgggcgcttgaggtgatacccgaaatcatgcaggggatttacatgcagctgtcacatatccaggagccacgcgcccggcaggtggcccttttacccgtcagtttgctggccagctcttttatgacagaggtggtcgttgctctcttgatgtgtccactgccgcttaacagcaatggcgccgagatgtggaggcagcttatcctttgcaagccatcatgcgacgtgagagacctgctggatctcttgttgggctctcttaaggagaagcctgtcacaaaggaaggccgtgcatctatcgttccgcttgcagccgcttctggattgtgcgagctgttatcggttaactcctgcatgggcagggtaagaagaatttacccccagctcctgctcgctctgttgatccaggtccactatcatatcggcctgaatctaccagggtgcgttgcccctccaaaagacactaagaaaggcgcacaaccctcaccattcgtgccagtgcgctgggtggttaaggttgttaagaccctgcttctaaggatgggatgttcgtatgagacgacattcctggaagatcagggaggctgggagctcatggaacaggtggagtcccatcatcggggcgtggcactcctggcgagggctatggtgcagtacagctgccaagagttgtgcaggattctatacctccttattccactcttggagaggggagacgagaagcaccggattaccgccactgcgttctttgtagagcagccttgcgaagaaggcattgtcattctgatgctgcgcatctcttgggagagacagcagcaggctgtgacgggcgcccggtcttggcgcgtcacccattcagccctgccacacggtgcggatgggcatcagacagaaacatctagcaacctgcttgtcttgcaagtttag

SEQ ID NO: 26723 - DNA, 1179 bp, Artificial Sequence
  Description of Artificial Sequence: Synthetic coding sequence
atggtgctgatggatataaggagaaggttgcctgccatttgttggttttgtaagagcgaggctcccggtagggccgaaccggggatccaatgtgcaattccagtgcacggccggcctggtggttgccccgcgcctctctccctgggaagcaacgatccgctcttaccccaactgctgcaaatggaacaggttagacgcatccctgaggaatactcactggggcgaatggccgagggcttgtctcaccacgaccctatcatgaaggtgctgtctatccgaggtctggtaatcctcgcacggcgttctgagaagactgccaaagtgaaagctcttctaccatccatggtcaaggggctgaaaaatatggacgggatgctggtggtggaagcagtgcacaatcttaaggctgtgtttaagggtagagaccagaagctcatggactctgctgtgtatgtggaaatgctgcagatacttctgccccatttttccgatgccagggaggtcgtcaggtcatcctgtattaacctatacgggaaagtcgtgcaaaaactacgggcgcctaggacccaggccatggaggagcagctcgtgagtacattagtgcctttattactgaccatgcaggagggcaactcgaaggtgtctcagaagtgcgtcaagactttactccgctgcagctatttcatggcatgggagctcccaaagagagcctattctcgaaagccgtgggataaccagcagcaaactgtagcaaagatttgcaaatgcctcgtgaacacacatcgggactcagcgtttatttttctcagtcagtctctggagtacgctaaaaactcacgggcgagtttaaggaagtgctcagtaatgtttatcgggagcctagtgccatgcatggagagtatcatgacggaagaccgcctgaacgaggtaaaagctgctctcgacaacttgagacatgatcccgaggccagtgtatgtatttacgccgctcaggtgcaggatcacattcttgcatcctgctggcagaacagttggctgccacacggcaactcttgggtttgttactctgccaccacccaccgttggagtccctcgtgtgagaacctgcccacttctcatcagagacggtcatggatcatgcaggctctcgggagctggaagatgagcctgaaaaaatag

SEQ ID NO: 26724 - DNA, 3093 bp, Artificial Sequence
  Description of Artificial Sequence: Synthetic coding sequence
atggccctatccccaggtgcaaatctggtgttccatgaggatccaaaaatgactccttcacccccatcttgcggcgccccagggctgggatcggggacaataccacagccccatccggacatggcacaggttcccatgttgaacctgcttcctagcccaggcctcgccttagtgccagacttaaacgactcactgtcacccgtgtctggtgaggcttcgggccttgtgagcgagaatactccccgacccgatgatagccgagcaatagccccggcatctttgcagattactagctcctgcagtggggaggcactagacctcgatagtaaagacgtgtcacggcccgactcccagggcaggttatgtcccgcttccaaccccatcctctctccctcttccacggaggcccctcgcctgtcatcaggaaatcatccacagtccaattctgaagatgcctttaaatgcttgagctcaaaaatttttaaactggggcagcggaattctaacccttctcgccacgaactgaatccatttattcgccaccatagccgtgagggccttgtactgggacactgcatttcgagaccaagtagcaaggccctgttaatcccaaccagtaattcttcactggacttggactcgaacccccttcttaatatggggtcacggaacacatctaagctgaacttgaatgtggccccggacagtcacggcaccctgatacccgacaccaacgaaacgattaccctggcttcacacaatatctctgagtcagtgtcaaagggtgctttctcgaccacttggtcaacgagctcaaaggagactatgaacgtcgccagttctggtcacagtaggagcgacctcagtgtgaccatcacacaggcctcctacgtgacactcattcccggttcgtcatacgggattagcctacattcttctacccatgagccaaacagcacaatcagcccaccttcctgtatgacgttgatacttgggtcaaacgaaacactcagtctcgattctagcctcttgttctctgacactagcaccctgactctgtcgagtcagcaggatgacgcaaaggataactcaattcacaccgtgcctttagaggagaacttggaatcctggtccgagatggcttcaattaaggttggtcaatttccactcggtttcccaataagtaatcccgccggtaaagacgccgttacccttcagggcatccctgagggagctttcgacgaggtgaccagctgtcttgtaaaggtgccggagaagactgaaggtggcaacaacatggcgttagtagagaatgtgactactctgcagaaaagccaggacttgctggaagccgagggggagaagaaaactatgataaagaaaatcatgagacagatccaagaggagcctttggattctctcagtagctccgtgagaaagcaagctatggaaatccttacccagctctctcatacacagcctactctggggatgcgtgagagatcagaactggtgaacgtgtgcgtacactctgtattcagccttccttctgtccaggctatgcaagagaaagacgaggcaaaagccgaaaccattcaagctctttatcatcagaccctcgaagccctgcagaccttgttgaaagccttgttcatcgaagatcccacacccgcgggtctaaagagcattctcgaggccctcggcccctggatgaattctgggaaggcccacgagcgtgctcgcgctgtgaacacaaacgtcagtgtactaaaccatatgctgttaactttgcctttcttcatgcccttgggctttcccgcccttgggctactcctcggcaggttgattctccacatcggagatcccgatgaggaaatcggctgtgaagcgcttgatggtattataattttgtataccatcctggagcttcaaaagcgagcccgtgataaagaggaaaccaataagaaagagttatacgagagcaacaaacactttctgggcccttataaccccgtgtccccctgtcaaaatatcctgcgcgtgatcgaagagttcggagactttctcggccctcagcagattaaggatctgttacttgcagctctggagggattgaaaggctcatctgaggcccctggcaaagacagtcgagagatgatgcagctggctagtgaggtgatgctgtcctctgtgttagagtggtacagacatagagcccttgaagtgatccctgagattatgcaagggatttatatgcaactgagccacatacaggaaccacgagcacggcaagttgccttgttgcctgtatcactgctggcaagttcctttatgaccgaggttgtcgtcgcactgctcatgtgtcctttgcccttgaattccaacggggcggagatgtggagacagctcatcctgtgtaagccaagctgtgacgtacgggacctcttggacttacttctcggcagtctcaaagagaaaccagtcacaaaggagggaagagcatcaatcgtgcctctggcagcggctagtgggctgtgcgagctgttatctgtaaactcatgtatgggaagggtgagaagaatctatccacagctgcttctcgctcttctcatccaggtccattaccatatcgggttaaatcttccaggctgtgtggcccctcctaaggacactaagaaaggtgcccagccgtctcccttcgtgcccgtgaggtgggtggtcaaggtggtgaagacactacttttgcggatgggttgttcctacgaaacaactttcctcgaagatcagggtggctgggagctgatggagcaggtagagagccatcaccggggggtggctctgctggctcgggccatggtacaatattcctgccaagagctgtgtagaattctctacctcttaattcctttgctggaacgcggagacgaaaagcatcggattacagctactgccttctttgtggaacagccttgcgaagagggcatagtcattttgatgctgcggccgcaagacttgatgggtaaggctacaacttcaagccacagggggtctgagctcgaaagtgacaccctcagcttcgccacctggtgttag

SEQ ID NO: 26725 - DNA, 3870 bp, Artificial Sequence
  Description of Artificial Sequence: Synthetic coding sequence
atggccctcagtccaggagccaatcttgtgttccacgaggaccccaagatgacccccagccctccaagctgtggggcaccaggtcttggctctggcaccatccctcagccccacccagatatggcccaagtaccaatgctgaatctgttgccatcccccggcctggctctggtgcctgatctcaatgattctttgagtcctgttagcggtgaagcaagtggcctcgtatctgagaacacaccccggccggacgactcccgcgcaatcgcccctgcgtccctccagataactagttcatgttcgggcgaggctctcgacctcgatagtaaggatgtttcacgtcccgatagtcagggcagattatgcccggcgtctaaccctatcctgagtcccagtagcaccgaagcaccgcgcctttcttcaggtaaccacccacagtctaatagcgaagatgcttttaagtgtctgagttcaaagatctttaaattggggcagcggaattccaatcctagcaggcacgagctgaacccttttatccggcaccacagtagagagggactggtgctgggtcactgcatctccagaccttcctctaaggcactcctgataccaacttccaactcttctcttgatctcgacagtaaccctctgctgaacatgggcagccgtaacacatcaaagctgaacctaaatgtggcaccagacagccacggtacactgatccctgacactaatgaaactatcacactggcctctcataatattagcgaaagcgtctcgaagggcgccttttcaactacatggagtacttctagcaaggagactatgaacgtggcctcgagtggacactcgcgttcggatctttctgtgaccatcactcaggcatcctatgttacgctcattccgggctcctcttacggtatatcgctacatagcagcacccacgagcctaattcaaccataagccctccgtcctgtatgaccttaatcctcggctctaatgaaaccctgagtctggactcaagtctgctgttctcagacacctccactctgacactctcctctcagcaggatgacgccaaggacaactcaatccatactgtacccctggaggagaacctagaaagttggtccgagatggcgtcaatcaaagttggacagttccctctcggctttcccatcagtaacccagccgggaaggacgccgtgaccctccaaggcatcccagaagatggagtgtctctgctcctccccagactggaatgtaatggggccatcagtgctcactgtaatctctgtctcccaggcgctttcgatgaggtgactagttgcctagtgaaagtacctgagaagaccgagggtggtaataacatggccttggttgagaacgtgactactcttcagaaatcacaggatctcttggaggcagaaggagagaaaaagactatgatcaagaaaatcatgaggcagattcaagaggagccgctcgattctctctcaagttccgtgaggaagcaggccatggagatcttaacccagctcagtcatacacagcccactcttggcatgagagagcgttccgagcttgtgaacgtgtgcgtgcattccgtttttagccttcccagcgtgcaggccatgcaggagaaagacgaggccaaggccgaaacaatccaggccctgtaccatcagacactggaggcactccaaacactactgaaagccctctttatcgaagatcctacacccgcgggcctaaagtccattcttgaggccctgggcccatggatgaatagtggaaaagctcacgagcgagctcgcgctgtgaacaccaacgtcagcgttctcaaccatatgctgctgactctgccattcttcattgctatacagatgcccctgggctttccagccctaggtctgctactgggccggttgatattgcatattggcgacccagacgaggaaataggttgtgaggccctggacggcattataattttgtacacaatcctagagctccagaagagagcacgcgacaaagaggaaaccaataaaaaggagttatatgagagtaataagcatttcctaggcccctataaccccgtgagcccctgccaaaatatactaagagtgattgaagagtttggcgactttctgggcccccagcaaatcaaagaccttttgctcgcagccctcgaagggctaaaagggagtagtgaagccccaggaaaggactcgagagagatgatgcagctggcttctgaggtcatgctgagctctgtcttagaatggtataggcacagggctttggaggttatccccgaaatcatgcaaggcatctatatgcagctgtcacacattcaggaacccagggctcggcaagtcgcgctgctccctgtgtctctactggcatcctctttcatgaccgaagttgtggtcgcgctgctgatgtgtcccctgcctctgaattctaatggggccgagatgtggagacagcttatcttatgcaagccctcctgcgacgtcagagatctgctcgatctcctactgggtagtctcaaggagaagcccgtcactaaagagggcagggcaagcattgtgcctctggccgccgctagcggactttgcgaacttctgagcgtaaatagctgtatgggacgcgtgcgaagaatctatcctcagctcctcctcgccttattgatccaggtccattaccatatcggccttaacttgccaggctgcgtcgcccctccgaaggacacgaaaaaaggcgctcaacccagcccattcgtgcccgtgagatgggtcgtcaaggtggtaaaaaccctactgctcagaatgggatgctcatatgagactacctttctcgaggatcaaggcgggtgggagctgatggagcaggtggagtcccaccataggggtgtcgctctgcttgcccgggcaatggttcaatactcttgccaagagctttgccggatcctctacctactcatccctttgctggagagaggagacgaaaagcaccgcattactgctacagcatttttcgtagagcttctccagatggagcaggtgaggaggattccggaagaatactcacttggtagaatggctgaaggcctcagtcatcatgaccccattatgaaggtcctgagtatacgcgggctggttatcctggctaggcgttccgagaagaccgccaaggtcaaggcattactaccttctatggtaaaaggtttgaagaacatggacggcatgctcgtggtagaggcggtgcataacctgaaggccgttttcaagggtcgcgatcagaagttaatggattccgcagtgtacgtggaaatgctgcagatactcctgccacatttcagcgacgctcgagaggtggtgcgctcctcctgcattaatttatatggcaaggtagtgcaaaaacttagagctcctcggactcaggccatggaggagcagctcgtcagtaccctggtgcccctcctccttacaatgcaggaggggaactccaaggtgtctcagaaatgcgtgaaaaccctgcttagatgctcatattttatggcttgggagttgcctaaaagagcatactcgcgaaaaccatgggacaaccagcagcagaccgttgctaaaatctgtaagtgcctcgtgaacacccatcgcgactccgcatttatattcctctcgcagagccttgagtatgccaagaactcgagggcatcccttcgtaagtgttctgtcatgttcatcgctacacctcggggccagaggtttcatctgctgtgcccgcctttgtattcccagccactagagcaggccggttcagccgagcgggctaaaaatcttaagcgaagtccctatctgtag

SEQ ID NO: 26726 - DNA, 3972 bp, Artificial Sequence
  Description of Artificial Sequence: Synthetic coding sequence
atggccctcagccccggagccaatctggtatttcacgaggaccctaagatgaccccaagcccgccatcttgcggcgctccgggccttggtagcggcacgatccctcagccacaccccgatatggcacaggtccctatgttgaatctgctgccatcccccgggttggctctcgttcctgatctcaacgatagcctatcgccagtctcaggagaagcctcagggctggtcagcgagaacaccccacgccccgacgacagcagggctattgcaccagctagtctgcagattacctcctcgtgctcaggagaagctctggatctggattcgaaagacgtctcacgaccagactctcagggtcgcttgtgccccgcatctaacccaatcctcagcccttcgtccacagaggctccacgccttagttcaggaaaccaccctcagagcaattcggaggatgcatttaagtgcttatcatccaagatcttcaagctgggccagagaaacagtaatccaagcaggcacgaactgaacccattcatccgccaccactcacgtgaaggcctcgtgctaggccactgtatttccaggccatctagtaaggcccttctgatccctacctctaacagcagtttggatctggatagcaatccacttctgaatatgggcagccgcaacacgagcaaactcaatctgaacgtagcaccagattcacatgggacgctgattcccgacaccaacgagactattactctggccagccataatattagcgagtccgtaagcaaaggtgccttttccacaacatggtccacgtccagcaaagagaccatgaacgtggcaagtagtggccactcccgctccgatctgtcggtcaccataacgcaggcaagctacgtgactcttattcctggatccagttacggaatttctctgcacagctccacacatgaaccaaacagcaccatctcaccgccctcctgtatgactctgatcctcgggagcaacgaaacgttgagcctggactcatctctgctgttctcagatacttccaccttgacactgtcctctcaacaagatgatgctaaggacaactctatccacacagtgcccctagaggaaaacctcgagtcctggtccgagatggcgtcgatcaaggtcggtcaatttcccctaggcttccctatttccaaccctgccgggaaagatgcagttactttgcaggggatcccggaaggcgctttcgatgaggtgacatcttgtctggtaaaggtacctgagaagactgaaggaggaaataacatggctctcgtggaaaatgtcacgacactgcagaagtcccaggacctgttagaagctgagggagagaagaagactatgatcaaaaaaatcatgaggcagattcaagaagagccgttggactccctgagttccagtgtgaggaagcaggcaatggagatactaacacagctgagccacactcaaccaactcttggaatgcgcgagagaagcgaactcgtgaatgtttgcgttcatagcgtgttctccctgccatccgttcaggccatgcaggagaaagacgaggcaaaagcggagacaatccaagctctttaccatcaaaccctggaagcccttcagacactgctcaaggcgctgttcatagaagaccctactcccgccgggctgaaatcgatcctggaagctctgggaccctggatgaacagcggaaaagcccacgagcgcgctcgcgctgtcaataccaatgtgagcgtactcaaccatatgctgttgactctccctttctttatgccactgggctttcccgccctgggcttgctcctggggaggctcatcttacacatcggagatccagacgaggagatcgggtgtgaagctcttgacgggattatcatcctctatactatattggagctacagaagagggcccgggacaaggaagagacaaataaaaaagaactctacgaaagcaataaacattttctcggaccgtacaatcccgtcagcccgtgccagaatatcctccgcgtgatcgaggagttcggcgactttctcgggcctcaacaaatcaaggacctcctgctggcagccctggaggggctcaagggttcttctgaggcaccgggtaaagacagccgcgagatgatgcaactggccagcgaagtcatgctctccagtgtgctcgaatggtatcgacaccgagcactggaagtgatccctgaaattatgcagggaatctatatgcagctgtcacacatccaggagccccgcgctcggcaggtagctcttttgcctgtttccctgttggcatccagcttcatgacagaggtggttgtggccttactcatgtgcccattgcctctgaactccaacggggcggaaatgtggcggcaactcatcctgtgtaagccctcctgtgacgtgagagacctgctggacctattgttaggcagtcttaaggaaaagcctgtgactaaagaaggcagggccagcatcgtgcccttggcggctgcatcaggcctatgcgagctactgtcagtgaattcttgtatgggccgagtgaggaggatttatcctcagttgctgttggccttactgattcaagttcactaccacatcggcctgaacttgcctgggtgcgtggccccaccgaaggataccaaaaaaggagcccaaccatcacctttcgttcccgtgaggtgggttgtaaaggtcgtgaagacattgctccttcggatgggatgctcatatgagacaacctttctcgaggaccaaggaggctgggagctgatggagcaagttgagtcacatcataggggcgtggcactgctcgcgcgagcgatggtacagtattcttgtcaagaactctgccggatcctctatcttttgattccactgctggagaggggggatgagaaacaccggattactgcgacagccttctttgtagaactgctccagatggagcaagtgaggcgcatacctgaggagtattcattgggacgtatggccgaaggcctgtctcatcacgaccccataatgaaggtcctctctattcgggggctggtgatcctggcaagacgatcggaaaagacggccaaggtcaaagccctactgccttctatggtgaagggactaaagaatatggatggtatgctggtggtggaggcagttcacaatctgaaagcagtgttcaagggccgagaccaaaaactgatggatagcgctgtatatgttgaaatgctgcagattctgttgcctcacttctccgatgcgagggaagtcgtgaggtcctcatgcattaacctctacggtaaagtggtgcagaagctcagggccccgcggacacaggccatggaagagcagcttgtttcaacactcgtgccattactgttaacaatgcaagaaggcaattccaaggtttcacagaagtgcgtcaagaccttgctgaggtgtagctattttatggcctgggagctgcccaagcgagcttatagccggaaaccttgggacaatcagcagcagaccgttgctaagatctgtaaatgccttgtgaatacacatcgagactctgcattcatattcctctctcaatccttggagtatgccaaaaactcgcgcgcttctcttaggaaatgctccgtgatgttcatcggttctctggtgccctgcatggagtccatcatgacggaagatcgcctgaacgaggtcaaggcagctctggacaatctgcgccacgatcctgaggcgtctgtttgtatctacgccgcccaggtgcaggaccacatcctggcaagctgttggcagaattcatggctcccccatggaaacagttgggtatgctactccgccaccacacacaggtggtcgccctcctgtgaaaacctgccaacttcccaccagagacggtcttggattatgcaggcactaggcagttggaagatgtctttaaaaaagtag

SEQ ID NO: 26727 - DNA, 2526 bp, Artificial Sequence
  Description of Artificial Sequence: Synthetic coding sequence
atggaaattttgacacaacttagccacacccaacccacacttggtatgcgggaaagaagcgagctggtgaatgtttgtgtgcactcggtgttctctcttcctagcgtgcaggctatgcaggagaaagatgaagcaaaggctgagacgatccaggcattatatcatcagaccttggaagctctgcaaacccttctgaaggctttgttcatcgaggatcctactccggccggcctgaagtctatcctggaggctctcggtccttggatgaatagtggaaaggcgcacgaacgagcacgggccgtcaataccaatgtttcagtgttgaaccatatgttactgacgctgcccttctttatgcccctgggttttccagctctggggctactgttgggccggctgattctccatatcggcgaccccgacgaggagattggttgtgaagctttggacggaatcataatcctgtacaccatcctggagctgcagaaaagagccagggacaaagaggaaaccaataagaaggagctgtacgagtcgaacaagcatttcctgggaccttacaaccctgtttccccttgccagaacatcctccgcgtgattgaggaattcggagattttctaggcccccagcagattaaagacctgctactggcggccctggaggggctgaaagggagcagtgaagctccaggcaaagatagcagagagatgatgcaactggcaagtgaagtgatgctgtcttccgtactggagtggtacagacacagagccctcgaggtgattcctgaaatcatgcaaggcatctacatgcagcttagccatatccaggaaccccgggcgagacaggtggctctccttcctgtgagcctcctggcgtcttcctttatgacagaggtggtcgtggccctgcttatgtgtccgctgcccttgaattccaacggcgccgaaatgtggagacaattgattttatgcaagccctcctgcgatgtgagagatctgctggacttgctcttaggttctctgaaggaaaagcccgtgactaaagagggcagagcgagtatcgtgccactggccgcagcgagtggtctgtgtgagctcttaagcgtgaacagctgcatgggcagggtgcgacgcatctacccccagttactgttggccctgctgatccaggtgcattaccacattggattgaatctaccgggctgtgtagctccgcccaaggatactaaaaagggcgcacagcctagtccatttgtgcctgttcggtgggtggtgaaagtcgtaaaaaccctgctcctgcggatggggtgttcgtatgaaaccacctttctggaggatcaggggggctgggagcttatggagcaggttgagtcacaccacaggggagttgccctactcgcaagagccatggtgcaatacagctgccaagaactttgtcgcatcctgtatctgttgatccccctcctcgaaaggggagatgagaagcatcgaatcaccgccaccgccttcttcgtcgaactgctccaaatggagcaggtacggcgcatcccagaagagtattcccttggccgcatggccgagggactctcccaccacgacccaattatgaaagtcttgtccatcaggggcctggtgatacttgcccgtagaagtgaaaaaaccgctaaagttaaagcactgctgccatcaatggtgaaggggctgaagaacatggacggcatgctcgtcgtggaagctgtacataacctgaaagcagtttttaaaggtcgagaccagaagctgatggactcagcagtgtatgtggagatgctccagattctgctgcctcatttctccgacgctagggaagtagttagatcttcgtgtattaatctctatggcaaggtggtacagaaactgagagccccgagaacccaggccatggaggagcaactggtctctactttggtccccctcctgcttacgatgcaggagggcaattccaaggtaagtcaaaaatgcgttaaaaccttgctgcggtgttcctatttcatggcatgggaactgccaaaacgagcctatagtcggaagccctgggacaaccagcagcagaccgtagcaaagatttgcaaatgccttgttaatacccaccgtgatagcgcttttattttcctgtcgcagagtttagagtatgcaaaaaacagtagagcctcactgcgtaaatgtagtgtgatgttcattgggtcactagttccttgtatggagagcatcatgaccgaggatagacttaatgaagtgaaagcagccttggacaatctgagacatgatcccgaagcctccgtgtgcatctatgccgctcaagtacaggatcacattttagcttcctgttggcagaacagctggctcccccacgggaacagctgggtttgctatagcgccacaacccatcggtggtccccttcctgtgagaacctccccactagtcaccagcgcaggtcttggattatgcaagccttgggctcttggaaaatgtcattaaagaagtag

SEQ ID NO: 26728 - DNA, 1623 bp, Artificial Sequence
  Description of Artificial Sequence: Synthetic coding sequence
atggctttggtggaaaatgtcaccacattgcagaaatcccaggatctgctcgaggcggagggcgagaaaaagacaatgatcaagaagatcatgcgacagattcaggaagaacccctggacagtctctcttcttctgtccgcaagcaggctatggagatcctcacacagctgtcacatactcaaccaacgctaggcatgcgtgagagatcagaacttgtgaacgtttgtgttcactctgtgttcagcctgcccagcgttcaggctatgcaggagaaggatgaagcaaaggccgaaaccatccaagccctctatcatcagacactggaagctttgcaaacgctactgaaagccttatttatcgaagaccccacgcccgcagggctgaaatccattcttgaggcgctgggaccatggatgaattcagggaaggcccatgaaagggcgcgggctgttaatactaacgtgtcagttctgaatcacatgctgctgaccctccccttctttatgccacttggttttccagcacttggcctgttgctggggcggttaattctgcatataggggaccccgatgaggagattggctgtgaagccctggatggcattattatcctctacactattctggaactccagaaacgcgccagagataaagaggagaccaacaagaaggagctgtacgagtcaaacaagcactttttggggccctacaacccagtgagcccttgccagaacattctgcgagtcatcgaagagttcggagactttctggggccccagcaaataaaggatctgctgctggctgctcttgaaggtctcaagggctcctccgaggcgcccggcaaggacagcagagagatgatgcagttagccagcgaggtgatgctcagttccgtcctggaatggtacagacaccgtgcgttggaggtgatcccagaaatcatgcaggggatctacatgcaactctcacacattcaagagccgagagcccgtcaggtggctttgctgccagtgtctttgctcgccagttcctttatgactgaggtcgtggtggcacttctgatgtgccccctgccgcttaattctaacggtgccgaaatgtggaggcaactgattttatgtaaaccctcctgtgacgtccgcgacctgcttgatctactgctgggtagcctaaaggaaaagcctgtaacaaaggagggtagggcatcaatcgtgcccctggcggcagcatccggcctgtgtgaactgcttagtgtcaatagctgcatgggacgggtgaggcgcatataccctcagctgctgcttgccctgcttatccaggtgcattatcatattggtctgaatctgcctggctgtgtggctccgcccaaagataccaagaagggcgcccagcccagccctttcgtgcccgtacggtgggtggtgaaagtcgtaaagactctcctgctgcgtatgggttgctcctatgaaactaccttcttagaagaccagggggggtgggaattgatggaacaggtggagtcacatcacaggggcgttgcactgctagcctcttccagtcgatggagccgctgcgccggaagccctaggaatactctgtgggggggttggcagaaggcctag

SEQ ID NO: 26729 - DNA, 1416 bp, Artificial Sequence
  Description of Artificial Sequence: Synthetic coding sequence
atggccagagagatgacaattctgggctccgctgtgctcacactgcttctggctggctacctggcccaacagtacctcccgctgccaaccccgaaggttattggcattgacctaggaaccacctactgcagcgtgggtgtctttttcccagggaccggaaaggtcaaagtcattcccgatgaaaatggccatatctccatcccaagcatggtttcattcaccgacaatgacgtctatgtgggctatgagtcagtagaacttgccgatagtaacccacagaacaccatctatgacgcgaaacgttttataggaaaaatctttacagcagaggaactcgaggccgaaattggccggtatcctttcaaagtgctcaacaaaaacggcatggtggagttctcggtgacttctaacgagacgattaccgtttctcctgaatacgtaggctccagattgttactgaagctgaaggaaatggctgaggcctacctgggtatgcccgtggctaacgctgtcatttcagtgccggccgagttcgaccttaaacagaggaatagcacaatagaggctgctaacctcgcaggcttaaagatcctccgcgttataaacgagcctacagctgccgctatggcttacggactgcataaagccgatgtgttccatgttttagtgattgatctggggggcggtaccctggacgttagtttgttaaacaaacaggggggtatgttcttaacacgggctatgtctgggaataacaagcttgggggacaagactttaaccaacgcctgctgcagtacctctacaagcagatataccagacctacgggtttgtgccaagtaggaaggaggagatccaccgcctgagacaggcggtggaaatggttaagctgaacctcaccctgcatcagagcgcccagctgagcgtgctgctgaccgtagaagaacaggaccgcaaagaaccacactcatctgatactgagctgcccaaggataaattatcttcagcagatgaccaccgcgtcaactccgggttcggtcgcgggctgtcggataagaaatctggtgagtcacaagtgctgtttgagacagagatttctcgcaaactgttcgacaccctgaacgaagaccttttccagaagattctggtgccaatacagcaggtccttaaggagggacatctagaaaaaaccgagatcgacgaagtggtactcgtgggggggtcaaccagaattccacgtattcggcaggtcatccaggagttttttggcaaagatcctaatacctccgttgacccagatctcgctgtcgtcacaggggtggcaatacaggccggaatcgatggcggaagttggcccttgcaagtgagcgcactggagattccaaataaacatcttcagaaaactaatttcaattag

SEQ ID NO: 26730 - DNA, 792 bp, Artificial Sequence
  Description of Artificial Sequence: Synthetic coding sequence
atggcttacggcctgcacaaggcagacgtgttccacgtgcttgtaatcgacctgggcggcggcactttggacgtgagtctcctaaataagcagggtggcatgtttcttactcgcgccatgtccggcaataataaattggggggccaggatttcaatcagagattgctgcaatatctgtacaagcagatataccagacatatgggttcgtgcctagtagaaaggaagaaatccatagacttaggcaggccgtggagatggtgaaacttaacctcaccctccatcagagcgctcagctttccgtcctgcttaccgttgaagagcaggacagaaaagagccacattccagtgacaccgaacttcctaaggacaagttgtcatctgccgacgatcacagggtgaattctggttttgggcgaggcctgagcgacaaaaaatcgggagagtctcaggttttgttcgagaccgagatatctagaaaactgttcgataccctgaacgaggacctgtttcagaaaatccttgtcccaatccagcaggtgctgaaagaggggcacctcgagaagactgagatcgatgaggtggttctggtaggtggttctactaggataccccgcataaggcaggtcatccaggagttcttcggcaaagatcccaacactagcgtggacccagaccttgccgtggtcaccggcgtcgcgattcaggctggaatcgatgggggttcttggcccctgcaggtgtcggctcttgaaatcccaaataagcacctgcagaagaccaacttcaattag

SEQ ID NO: 26731 - DNA, 1515 bp, Artificial Sequence
  Description of Artificial Sequence: Synthetic coding sequence
atgggcatcaaaactgccttgcccgcggcagagttgggactctatagtctggtgctgagtggcgctctggcttacgctggtagaggtctgctggaagcctcccaggatggagctcatcgcaaagcattcagagagtccgtgaggcccgggtgggaatatataggacgcaaaatggatgtagctgactttgaatgggttatgtggttcacctcttttagaaatgtcattatattcgccttatccggccacgtgctgttcgcaaaactgtgtacaatggtagcaccaaagctccgtagctggatgtacgccgtttatggcgctttggctgtaatgggtactatggggccttggtacctcctcctgctattgggacattgcgttggcctttacgtggcctcactgttaggccagccctggttatgcctgggcttgggactcgctagcctggccagtttcaagatggaccctctcatcagctggcagtccggttttgtgaccgggacttttgaccttcaggaggttctatttcacggaggatcatcatttaccgtgctccgctgcacatcattcgctctggaaagctgtgcccacccggacaggcactacagtctggcagatcttctgaagtacaatttttatctgcctttttttttctttgggccgattatgaccttcgacaggtttcacgcgcaagtgagccaggtagaaccagtgcggcgcgagggcgagctctggcatatcagggctcaagctggcctcagcgttgtggccattatggccgttgatatctttttccatttcttctatattttaactatccccagtgacctgaagtttgccaatagactaccagattctgcgctcgcgggactagcgtactccaatttggtgtatgactgggtgaaggcggccgtgctgtttggggttgtgaacaccgttgcttgcctggaccacctggaccctccgcagccacccaaatgcattactgcactctacgtattcgcagaaactcacttcgacagggggattaacgattggctgtgtaaatacgtttataaccacatcgggggagagcactctgctgttatcccagagctggcagctactgtcgctacatttgcaataactactctctggctgggcccctgtgacatcgtgtacctttggagtttccttaattgtttcggcctgaatttcgaattatggatgcagaaactcgcagagtggggtcccctggcaaggattgaggcctcgctcagcgtccaaatgtcccgtcgagtgcgcgcactttttggagccatgaatttttgggccatcattatgtacaatctggtgtcattgaattccctcaaatttaccgaactggtagcccgtcgactactgctgaccggcttccctcagacaacgctcagcattttattcgtaacttattgcggcgtacagttagtcaaagaacgagagcggactctggcccttgaggaggagcagaagcaggataaagaaaagcctgagtag

SEQ ID NO: 26732 - DNA, 738 bp, Artificial Sequence
  Description of Artificial Sequence: Synthetic coding sequence
atggttgcgccgaagctgaggtcatggatgtacgcggtttacggggcactggctgtcatggggaccatggggccttggtatctgctcctccttctcgggcattgtgtcggcttgtatgtggcctcacttctgggtcagccttggctttgcctgggcctgggactggcatcattagcgtccttcaagatggatcccctaattagttggcagtctggatttgtgactggaacgtttgatcttcaggaggtgctctttcacgggggtagttcatttacagtgctcaggtgcacgtcctttgcccttgagtcttgcgcccatccagacagacactactcgctagcagatctgctgaagtataatttttacctgcccttcttctttttcggacctataatgacattcgacagattccatgcccaggtgtctcaggtggaaccggtccgacgcgaaggtgagctatggcacatccgggctcaagcggggctgtcagtggtggccatcatggcagtggacattttttttcatttcttctatatcttatcacccgcaacatcctcctcacctactgcaagccagactgtgcccagtgcaggtttagcctattctaatctcgtgtatgactgggtgaaaggaagaccgctgtggtgttgtcaacactggcatgctagcactacctggactcaccctcctcccaaatgcatcacggcactgtacgtcttcgccgaaacccatttctag

SEQ ID NO: 26733 - DNA, 696 bp, Artificial Sequence
  Description of Artificial Sequence: Synthetic coding sequence
atgggcattaaaactgcgttacccgctgccgagttgggtctgtattctctggttctgagcggtgctctggcctatgccggccgcgggctcctcgaagcctcacaagatggagcccataggaaggcctttagggaaagcgttaggcccggctgggaatacatcggacgcaaaatggacgtggccgatttcgaatgggttatgtggtttacaagcttccgcaacgtgataatctttgctttaagtggccacgtattatttgccaaattatgcactatggtcgccccgaaactccgttcttggatgtatgccgtgtacggtgctctggccgtaatgggtactatgggaccatggtacctcttgctgctgttgggccactgcgtgggcctgtatgtagcatcactgctcggacagccttggctgtgtctgggactcggattggcatccctggcctcctttaaaatggatccacttatatcctggcagtctgggttcgtcactggcaccttcgacctacaggaagtgctgttccatggtggatcctcgtttaccgtgttgcgctgtaccagcttcgcactagagtcatgcgcccatccagataggcactatagccttgccgatctgcttaaatacaacttctacctgccatttttcttctttgggccaatcatgaccttcgatagattccatgcccagtag

SEQ ID NO: 26734 - DNA, 1515 bp, Artificial Sequence
  Description of Artificial Sequence: Synthetic coding sequence
atggggattaaaacagccctacccgctgcagagctggggttgtacagtttagtccttagtggagcccttgcctatgctgggcggggactactggaagccagtcaggacggcgcccaccggaaggcctttagggagtctgtccgtcccggctgggaatacatcggcaggaaaatggatgttgccgacttcgagtgggtgatgtggtttacctcatttcgcaatgtgataatttttgctttgagcggacatgtactgttcgccaagctttgcactatggtcgcccctaagctgcgaagctggatgtatgcagtgtatggggcacttgccgtgatggggaccatgggcccatggtacctattgctgctgctcggacattgcgtaggcctctacgtcgcatccctcttgggccagccttggctgtgcctgggacttgggttggcgtctctggctagcttcaagatggacccactgatttcttggcagtcaggcttcgtgacaggcacattcgatctgcaggaggttctgtttcacggtggatccagctttaccgttctcaggtgtacttcctttgccttagaaagttgtgcccaccccgaccgtcattattcactagccgatctcctcaagtataacttttaccttccattcttcttcttcgggccaattatgacctttgatcgtttccacgcgcaggtgtcccaggtagaaccggtgcggcgagagggggaactatggcacatcagagcccaggcaggactatccgtcgtcgccattatggccgtagacatcttttttcactttttttacatacttaccattcccagcgacttgaagttcgccaaccgcttgcctgattcagcgctggccggtctagcatacagcaaccttgtgtacgattgggttaaagcggccgtcctgttcggagtggtcaatactgtggcatgcctggatcacctggacccacctcagccccccaaatgtataacggcactctacgtgttcgctgaaacccactttgacaggggtattaacgattggttgtgtaagtacgtgtacaaccacattggaggggagcatagtgccgtgatcccagaactggctgccacggtagccacatttgctatcaccaccctctggttaggaccgtgtgatatagtgtacctgtggtcctttctgaactgttttggtcttaacttcgaactttggatgcagaagcttgccgagtggggccctcttgcgcggatagaggccagccttagtgtgcagatgtctcggcgtgtgcgggcattgtttggcgccatgaacttttgggccatcatcatgtacaacctggtctcactgaactcccttaaatttactgagctggtcgcccgcaggctgctgctaactgggttccctcaaaccacactgtccatcctgttcgtgacatattgtggagtgcagctcgtgaaagaacgcgaacgtacactcgctttagaggaggaacaaaagcaggacaaagaaaagcctgaatag

SEQ ID NO: 26735 - DNA, 282 bp, Artificial Sequence
  Description of Artificial Sequence: Synthetic coding sequence
atgatacacttgggacacatcctcttcctactcttattacctgttgccgccgctcagaccacaccgggggagcgttctagcttgcctgctttctaccccggtacatccgggagctgctccggctgcggatccttgtcccttcccctgctggcaggtctcgttgccgctgatgccgttgcctccctcctaatcgttggcgccgtctttttgtgtgctaggccacgccgatctcccgctcaggaagatggaaaggtttacatcaacatgcctggccgcgggtag

SEQ ID NO: 26736 - DNA, 279 bp, Artificial Sequence
  Description of Artificial Sequence: Synthetic coding sequence
atgattcacctgggacacattcttttcctgcttctgctgcccgtagcggctgctcagaccaccccaggcgagcgaagcagcctgccagccttttatccgggcacaagcggcagctgtagcggatgtggctccctctctttacctcttctcgccggactggttgcggcggatgccgttgccagtctgctcatcgttggtgctgttttcctgtgtgcaaggccgcgcagaagccccgcacaggacggtaaagtctacattaacatgccgggacgaggatag

SEQ ID NO: 26737 - DNA, 924 bp, Artificial Sequence
  Description of Artificial Sequence: Synthetic coding sequence
atggctgccctgctcctcggggccgtcctgcttgtggcacagccccagttagttccaagccgcccagcagaacttggccagcaggagttgctgcgaaaagccgggaccctccaggacgacgtgcgcgatggagtcgcacccaatggcagcgcccagcagttgccacagaccatcatcatcggagtccgtaagggggggacccgggcactgctggaaatgcttagtcttcatcccgacgtagctgcagccgagaatgaggtccacttttttgattgggaagaacattactcacatgggcttggttggtacctctcgcaaatgccgtttagctggccccatcagctcactgtcgagaaaacgcctgcatactttacatcccccaaagttcccgagcgagtatattccatgaatccttcgataagactgctgttaattctccgggacccctccgaaagggtgctgtccgactacactcaagtcttttataatcatatgcagaagcacaaaccatacccatccatcgaagagtttcttgtccgagatggacgccttaatgtggattataaggccctgaatcgcagtctttaccatgttcatatgcagaactggcttaggtttttcccccttcgacacattcacatcgtggacggagatagattaattagggatccatttcccgagattcagaaggtcgaacggtttttgaagttgtcaccccagatcaatgcaagtaacttctattttaataaaaccaaaggcttctactgtctgagagattcaggtcgggatagatgcttgcatgaaagtaagggcagggctcaccctcaggttgacccaaagctcttgaataagctgcatgaatatttccatgaaccaaataagaagttcttcgaactggtcggaaggaccttcgactggcactag

SEQ ID NO: 26738 - DNA, 252 bp, Artificial Sequence
  Description of Artificial Sequence: Synthetic coding sequence
atggcggcactcctcctcggggccgtcctcctggttgcccaaccccagctggttccatctcgcccagccgagctgggccagcaggagctgcttagaaaggcagggacactgcaggacgacgtcagggacggcgtggccccaaacggctccgctcaacagcttcctcaaactatcatcatcggggtccggaaaggcggcacccgtgccctattggagatgctcagtctgcacccagacgtcgccgcagcctag

SEQ ID NO: 26739 - DNA, 252 bp, Artificial Sequence
  Description of Artificial Sequence: Synthetic coding sequence
atggccgctctgcttttaggcgcagtcttgcttgtcgcccagccccagctggtgccctctaggcctgctgaactgggccagcaggagctgcttcgtaaggccggaactctgcaggacgacgtcagagatggcgtagcccctaacggttctgctcagcagttgccacagaccatcatcattggtgtacgtaagggtggaacaagggcactgctggagatgctcagcctgcaccctgatgtcgccgctgcttag

SEQ ID NO: 26740 - DNA, 1029 bp, Artificial Sequence
  Description of Artificial Sequence: Synthetic coding sequence
atggccgggtccggcggcttgggtggcggagccggaggaggtcagggagccggcgcaggacagggcgcagctctgcgcgcaagcagggcaccaatgcttctcgtagccctcgtcctgggagcctattgcttgtgcgccctgcccggcagatgccctcctgctgcacgggccccggctccggcccctgcccccagcgagccttccagctccgttcaccggcctggggccccgggcctgcctctggcatccggacccggaaggagaagattccctcaggcactcattgtcggagtcaagaaggggggcaccagagccctactagagtttctgcgcctgcaccctgatgtaagagccctgggaagcgaaccccatttctttgatcgttgctacgagagaggcctagcctggtacagaagcctaatgcccaggactctggatgggcagatcacgatggaaaagaccccatcatacttcgtcactcgcgaggctccaagacgcatacatgccatgtcacctgatactaaactcatagtcgtcgtgcggaaccccgtcactagagcgatttccgattacgcgcagacgctgagtaaaactccaggcctgccctccttccgggctcttgcttttagacatgggctcggccctgtcgacaccgcctggtccgctgttcgtatcggcctgtatgctcagcatttggatcactggcttcgttacttcccgttgtcacattttctctttgttagtggcgagcgtttggtgtctgaccctgcgggagaggtgggacgcgtacaggatttcctcggtcttaagagggtggtgacagacaagcacttttacttcaacgccaccaagggcttcccttgtctcaaaaaggctcagggtgggagtagaccaaggtgtttggggaagtccaaagggaggccccacccaagggtgcctcaggccctagtcagacggctgcaggagttttaccggccattcaatcggaggttttatcaaatgacaggccaggacttcggttggggttag

SEQ ID NO: 26741 - DNA, 936 bp, Artificial Sequence
  Description of Artificial Sequence: Synthetic coding sequence
atgcttctggttgcactcgttttgggagcttactgcctgtgtgctctgcctgggagatgcccacccgcggcccgcgcgcccgcaccagcgccagccccgagcgagccaagcagctccgtgcaccgacccggtgcgcctgggttgccattagcctccgggcccggcagaaggaggtttcctcaggctttaatcgtaggcgtcaagaagggaggcactcgagcgctcctagagttcctgcggcttcacccagacgtgcgggctctgggctcagagccacacttcttcgataggtgctacgagcgcggactggcttggtatcggagccttatgccccgaactctggatgggcagattaccatggaaaaaactccgtcctatttcgttacaagggaggcccccagacggatacacgccatgtcccctgatacgaagctcattgtggtggtgcggaaccctgtgacccgcgcgatctctgattacgcccagacactgtccaaaaccccagggttaccttcattccgagctctcgcattccgacacgggctggggccagtggatacagcctggtccgccgtccgcattgggctttacgctcaacacttggatcattggctccgttactttcccctgtcccacttcttatttgtgagtggagaacgactggtcagcgaccccgcgggggaggtcgggcgcgtccaggatttcctgggcctcaagcgggtggtgacagacaagcatttttattttaatgctacaaagggcttcccatgcctgaagaaagctcaaggaggaagccgcccaagatgtctgggaaagtccaagggcagacctcaccctagggtaccccaggctcttgtccgccggttgcaggaattctacagaccctttaaccggcgcttctaccagatgacgggccaggatttcggttggggttag

SEQ ID NO: 26742 - DNA, 1146 bp, Artificial Sequence
  Description of Artificial Sequence: Synthetic coding sequence
gccgcaggacccccaggtgctgagcacaaaccaggaacacatgggttgtcaggtgctcgcgctgagatgagagcccggttactgccacctctgccaggtctggagcgtcgggacccaatggcaggcagcggcggacttggtggcggagccggaggcggccagggggccggtgccggacagggcgctgccttacgtgcctcacgggcgcccatgcttctggtggccctggtgctgggcgcatactgcctgtgtgctttacccggaaggtgcccgccggccgccagggctcccgcccctgctccagctccatctgagccctctagcagcgtgcatcgcccgggcgctccggggcttccactcgcaagtggccccggccggaggcgcttcccacaggcactgattgtgggggtgaagaaagggggaactcgagcactgttggagtttttgagactgcaccctgacgtacgggctctcggctccgagccgcattttttcgatcggtgttacgaacggggactggcctggtatagatcactgatgcctaggactctagatggacagatcacgatggaaaagacccccagttatttcgtgaccagggaagcgcctaggaggattcacgccatgtctccggacacaaaactgatcgtagtggtgaggaatcctgtcactagggctatctcggattacgcccagactctctcaaagaccccaggtctaccctctttcagggccctggcgtttcgacatggactggggccagttgacactgcctggtcagccgtcaggatcgggttatacgcgcagcatctggatcattggttgaggtattttcctctttcgcactttctgtttgtttctggagagcggctggtttctgaccccgccggcgaagttggaagagttcaggactttcttggccttaagcgcgtggtgacggataaacacttctattttaacgccaccaagggattcccctgtctgaagaaggcccaaggaggcagtcgccctcgttgtttaggcaagtctaaggggcgcccgcatccgcgtgttccccaggccctggtgcgccgcctccaggagttttatagaccatttaacagaagattctaccagatgaccggacaagactttggctggggctag

SEQ ID NO: 26743 - DNA, 906 bp, Artificial Sequence
  Description of Artificial Sequence: Synthetic coding sequence
atgttcagtcatctaccattcgactgcgtgctacttctgctattgcttctgttaacaagaagcagcgaagttgagtatagggcagaagtggggcagaacgcttaccttccttgcttttacacaccagccgctcctggcaacttggtacctgtatgttgggggaaaggcgcctgtcctgtgtttgaatgcgggaatgtggtgttaaggaccgacgaacgagacgtgaactattggacatccagatattggttaaatggcgacttccgcaaaggggatgttagcctgaccatcgaaaacgtgactctagctgactctggtatctattgttgtcggattcaaatccctgggataatgaatgacgagaaattcaacctaaagctcgtgatcaaaccagcgaaggttaccccagcacctacacgacagcgcgactttactgctgccttcccccggatgctgaccactcggggacacgggccggccgagacccagaccttggggtccttacctgacatcaaccttacgcagattagtaccctggcaaatgagctccgcgattcccgtctggctaatgatctcagggattctggagctactattcgtattgggatttacattggcgctggcatctgtgctggcctcgccctagccttgatctttggcgccctgatcttcaagtggtatagccacagcaaagagaagattcagaatttgtcactgataagtctcgccaatcttcccccttctgggcttgccaatgccgtggccgaaggcatccggtccgaggaaaatatctatacaattgaggagaatgtatatgaggtcgaggagcctaacgaatattattgctatgtaagctctcgtcagcagccttcccagcccctgggctgccggttcgccatgccctag

SEQ ID NO: 26744 - DNA, 3480 bp, Artificial Sequence
  Description of Artificial Sequence: Synthetic coding sequence
atgccgagaaagcaacctgctggctgtatttttctgctgaccttcctggggctctctggcctagtcggcactgtgactcggacctattatattgggatcgtggaagagtattggaactatgtgcctcagggaaagaatgttattactggcaaaagtttcaccgaggacaagctcgccacactgttcttggaaagaggacccaataggattgggtctatatataaaaaggccgtctacagacgctttaccgatgggacgtatagcatcgaaatccccaagcccccttggctcgggtttttaggccctatcctgagagccgaggtgggcgatgttatagtgatccacctgaagaacttcgctagtcggccctatagtctgcacccccacggagttttctataataaggactctgagggcgcgctgtaccccgacggaacttccggcaggaacaagaatgacgatatggtgccccctggtaagaattacacttatgtgtggccagtgagggaggaatacgcaccgacacccgccgacgccaattgcctgacatgggtgtaccactctcatatcgacgcgccaaaggatatatgtagcggcctcattggaccactgctggtgtgcaaggaggggatccttaatagatacagcggaacaagaaatgatgtcgatagggagtttgttatcatgttcactctggtagatgagaatcagtcctggtatcttaacgagaatattaaacacttttgcactaatcctgattccgtggacaagaaggatgctgtcttccagcgaagtaacaagatgcacgccttaaacggatacctgttcggcaattttcctgaaccagacatgtgcgtgggcgagtccgttagttggcatctgttcggcatgggcaatgaaattgacatacactctatttatttttacggcaatacatttataagcaggggacacaggactgatgtagtaaacttgtttccggccacatttctcaccacagagatgattgctgaaaacccaggcaaatggatgatcacgtgccaggtttccgaccacctgcaagcgggcatgctgggccaatacaatgtggataactgtaagagcgatattttctatccaaagatgaaaggtcagcaacggcgttacttcattgctgccgaaaagatactctgggattacgctcctcagggatacaataaattttccggcctgcccttgaacgcctcaggcagtgattccgacctatacttcacacaaggcgataaccgaatcggaggaaagtactggaaggttcgctataccgagtttgttgacgcgacattcaccaagcgtaaacggctcagtgcagaagaggcacacctggggatcctgggacccgtcatcaaagcagaggtaggggacacactgctcgtgacctttgccaacaaggccgacaaggtctacagtatcctgccacatggtgtgatctatgacaaggccagcgacgccgctcccaatttagacggcttcgttaaaccaggggcccacgttaaaccaggtgagacttttacctataaatggaccgttcctgaatcagtgtcccctaccgccggagaccctccttgtctgacctatctatacttctccgccgtcgacccaatcaaggatacgagctcaggcttagtcggccccctgttggtttgtaaaaagggtgtgctgaatgccgacggtacccagaaggggatcgacaaggagttttatctgcttttcacggttttcgatgaaaatctgtctcgatacttcgacgagaacatacagaagttcatctggcaccccttctccattgacaaagaggacaaggaattcgttaagagtaaccggatgcatgcagtgaacggatacatgtacgggaatcaacccggcctaaatatgtgtaagcgcgatcgcgtgagctggcacttaataggcctcggtaccgatactgatatgcacggcattgtgttccaggggaacacaattcatctccgcggaactcacagggattctcttgcacttttcccccatatggcaaccactgcattcatgcaaccagaccacgctggcatctttcgcgtgttctgcgcaaccatgccccatctgagtaggggcatgggacaaatctatgaggtgtcatcttgtgacaatagggaccccagcgaacagcggtatggcatgatcagaacattctacatagccgccgaagaggtcgagtgggattatgcaccaaataaaaattgggaattcgagaagcagcacgttgatgcgaggggcgaacgacatggagacatctttatgaatcggacagagaattggatcgggtcccagtataagaaggtcgtgtacagggagtacactgacggggagtttgtcgaaatcaaggccagaccgcctagggaagagcatcttgagctgctggggccgatgatccatgccgaggtggggaacactgtcctgatcatctttaaaaataaggcatctcgtccttactccatttccgctcagggggtggaagagatggattccggtaaacagttccaggtgcccatgaccaaaccaggcgaggtgaagacataccggtggaacatccccaagaggtccggtccaggtccatctgacccgaactgcataccgtgggtttactacagcacagtcaactttgtgaaagacacttactctgggctcatgggacccttgatcacctgtaggaagggtgttctgaacgaaaaaggacgcaggtcagatgtggattatgagtttgcccttttgttccttgtctttaacgaaaatgaatcatggtatctggacgacaacatcaagaagtacttaaacaaggatccaagagacttcaagagaaccgatgactttgaggaaagtaacaggatgcatgcaataaatggcaaaatcttcggtaatttgcacggcctgatcatgaatgaagacacaatgacgaactggtacctcctgggaatcgggtctgaggtagacattcatacaattcactatcatgccgagtcttttttgttcaagatcgataagtcatatagggaggatgtgtatgatttgttccccggaacttttcagaccatcgagctgttcgctgaccatcccgggacatggctgctgcactgtcacgtctcagatcacattcacgcgggtatggagacaacctacaccgtactgaggaacattgataatagaattccgtactctactacaagtccaggcgtagcgtcacacccagcaacagtccctagcaatgagagacccggcaaggagcagttatacttctttggcaaaaatttgggccccaccggagcaaaggcagccctcgtgattctgttcattattgggttactgctcttgattacgaccgtgatcctatccttgcgcttgtgcagcgcaatgaagcagacagactaccagcaggttcagtcctgcgctttgccgaccgacgcactgtag

SEQ ID NO: 26745 - DNA, 1221 bp, Artificial Sequence
  Description of Artificial Sequence: Synthetic coding sequence
atggaccaaagcggcatggagatccctgtgacgctgatcattaaggcacctaatcaaaagtactccgatcaaacaatatcctgtttcctgaactggaccgtcggcaaactaaagacacatctctccaacgtgtatccgagtaagcctctgaccaaggaccagcgcctcgtctatagcgggcgactgctgcccgatcatttacagctgaaagacatactgaggaaacaggacgagtatcacatggtccatctggtctgcacttctcggacacccccaagcagccctaagagctcgaccaatagggagtcacacgaggctttggcctcatcatctaactcttcctccgatcactctggctctacaactccttcctctggccaagagacgctgagcttggctgtgggatcttcttccgaagggctgcgccaacgcacactgcctcaagcacagactgatcaggcccagtcccatcagttcccctacgtcatgcagggtaatgtcgacaaccaatttccaggccaggccgctccgccaggatttccagtgtaccctgccttctccccgctccagatgctgtggtggcagcaaatgtacgctcatcagtattacatgcagtaccaagccgcagtctctgcccaagccactagcaatgttaatccgacccagccgacaactagtcagcctctgaaccttgcccatgtccccggagaggagcccccccctgcacctaatctagtggcacaggaaaatcgtcccatgaatgaaaatgtgcagatgaacgcccaaggcggtcctgtactcaacgaggaagatttcaacagagattggctcgactggatgtatacattttctagagctgcaatcctgctctccattgtgtacttctattctagtttctctagatttattatggtcatgggagccatgttactggtgtaccttcaccaggcaggttggttcccctttcgacaagaaggggggcaccagcaggctccaaacaataacgctgaagtgaacaatgacgggcaaaacgcgaataatctggagcttgaagagatggagcgactcatggatgatggtctggaggacgagtccggcgaggacggcggagaggacgcttctgcgattcagaggcccggtctgatggcatctgcgtggagcttcattaccacgttcttcacatctctgatccccgagggccccccccaggtggccaactag

SEQ ID NO: 26746 - DNA, 1221 bp, Artificial Sequence
  Description of Artificial Sequence: Synthetic coding sequence
atggatcaatcaggtatggaaatacccgtgacattgatcatcaaggccccaaaccagaagtactctgatcagacaatttcctgttttctgaattggactgtcggaaagcttaaaacccacctgtcaaacgtgtacccctccaagccattgacaaaagatcagcggctggtgtattccggccgcctgttaccagatcatctgcaactgaaagacatcctgcgcaaacaggacgaataccatatggttcaccttgtctgtacttctaggaccccaccttcctccccaaaaagttccaccaatagagaaagtcacgaggccttggcctctagttccaattcatcttccgatcattccggaagtaccacccccagcagcggccaagagacactgagcctagctgtgggcagcagtagtgagggtctacgacagcgtacgctgccgcaagcccagacagaccaggctcaaagtcatcagtttccttacgttatgcagggaaacgtcgataatcagtttcccggccaggccgccccccctggcttccccgtttaccctgctttcagtcccctgcagatgttatggtggcaacagatgtatgcccatcagtactacatgcagtaccaggctgcagtgtcagcgcaggccacatctaacgtcaatcccacccagccgactacaagccaaccgctcaacttggctcatgtacctggggaggaaccgcctccggctccaaacctggtggcccaagaaaaccgacctatgaacgaaaacgtgcagatgaatgctcagggaggacccgtactcaacgaggaggacttcaaccgcgactggctggactggatgtataccttttcgcgagctgctatccttctgtctatagtgtacttttactctagcttctcaaggtttattatggtgatgggcgccatgttattagtctaccttcaccaggctggatggtttccattccggcaagaaggtggtcaccagcaagccccaaataacaacgctgaggtgaataacgacggccagaacgccaacaacctggagttagaagagatggagaggttaatggatgacggtttggaggatgaatctggggaagatggcggggaagatgcttccgctatccaacggcccggcctcatggcgagcgcttggagtttcataactacatttttcaccagccttattcctgagggccccccacaggtcgcaaattag

SEQ ID NO: 26747 - DNA, 1245 bp, Artificial Sequence
  Description of Artificial Sequence: Synthetic coding sequence
atgaaagcccagactgctttgtctttctttctcattctcattacgagcttgagtggtagtcaaggcatcttccctttagcgttttttatctacgtgcctatgaacgaacagatcgtgattgggcggcttgacgaggacattatactgccaagttctttcgagcgtggttctgaggtcgtaatacactggaaataccaggacagctacaaggtccattcatactacaagggcagcgaccacttggagtcgcaggacccccggtacgcgaaccgcacttcactgttctacaatgagatccagaacggcaacgccagtctatttttcaggcgcgtttcattgctggatgaggggatttatacatgttacgttggtacagccattcaggttattactaacaaagtcgtcctgaaggtaggcgtgtttttaaccccagtgatgaagtatgaaaaaaggaacactaacagctttcttatctgcagtgtgctctccgtttatcccaggccaatcataacctggaagatggacaacaccccaatttcagaaaacaacatggaggaaacaggatcccttgattctttttccattaactctcccctgaatatcaccgggtccaacagttcttacgagtgcactatcgagaatagcctgttaaagcagacatggacaggccgctggacaatgaaggatgggcttcacaaaatgcagtctgagcacgtcagcctcagctgccagcccgtgaacgactacttctcccctaaccaggatttcaaagtcacatggagcagaatgaaatccgggaccttcagcgtgctggcctactacctgtctagcagtcagaatacgatcatcaacgagtcgcggttctcctggaacaaggagctgattaaccaatccgatttttcaatgaatctcatggacttgaacttatccgatagtggcgagtacttgtgcaatatctcgagcgacgagtatacattactgaccatacatactgttcatgttgagccttcacaggaaacagcgagccacaacaagggtctttggatactcgtaccttccgcaatactcgctgcctttctcctcatctggtccgtgaaatgttgccgggcacagttagaggctcgccgctctcgccatcctgccgatggtgcacagcaggagagatgctgcgttccaccaggcgagcgttgtcctagtgctccagacaatggcgaagaaaacgtacccctatcaggaaaagtatag

SEQ ID NO: 26748 - DNA, 294 bp, Artificial Sequence
  Description of Artificial Sequence: Synthetic coding sequence
atgaaggctcagaccgcactttcatttttcctgatcctgataacctctttgagcggttcccagggaatctttccactcgcctttttcatctatgtacccatgaacgagcagatcgtgatcggcaggttggacgaagatatcattctaccttcttctttcgagagaggcagcgaggtcgtgattcactggaaatatcaggatagctacaaggtgcactcttactacaagggctcagaccacctggagagccaggacccccgttacgccaatagaactagcctgttctacaattag

SEQ ID NO: 26749 - DNA, 438 bp, Artificial Sequence
  Description of Artificial Sequence: Synthetic coding sequence
atgaaagcccagactgccctctcatttttcctaatattgattacatcactgtccgggagccagggtatcttccccctggctttctttatatacgtgcctatgaacgagcagatagtaattggacggctggacgaggacattatccttcccagttctttcgaacgcgggagtgaagtggtaatacactggaagtatcaggattcttacaaggtacattcctactacaaggggagtgaccatctggagtcccaggatccccgctacgccaacagaaccagtctgttctacaacgagatacagaatgggaatgcctccctgttttttagacgcgtttcactgctggacgaagggatatacacttgttatgtgggcaccgccattcaggtcattaccaataaagtcgtcctgaaagtgggagtgttcctgacgccagtatag

SEQ ID NO: 26750 - DNA, 1245 bp, Artificial Sequence
  Description of Artificial Sequence: Synthetic coding sequence
atgaaggcccagacagctctatcatttttcctcatactcattaccagtctctctggttcccaggggatctttccactcgcatttttcatttatgtccctatgaacgagcaaatcgtcatcgggagactggatgaggatattattctgccgtcatcatttgagcgcggctcagaggtggttatccactggaagtatcaagactcttacaaagtgcattcctactacaaagggtcagatcatctcgagtcccaagaccccagatatgctaatcgtacgagtcttttttacaacgaaatccagaacggcaacgcctccctgttttttcggcgggtctcgctgctggatgaggggatctatacatgctacgtgggaacggccatccaggtcataaccaacaaggtggtgctcaaggtgggtgtctttctgactccagtcatgaagtacgaaaagagaaacacaaacagcttcctgatttgcagcgtattgtccgtctaccctaggcccatcattacctggaagatggataatacgcctatttccgagaacaacatggaggagactggatcactggactccttctctatcaattctcccctgaacattacagggagcaattcttcttacgaatgtaccattgaaaattccttgctgaaacagacttggaccgggcgttggaccatgaaggacggtttgcacaagatgcaaagcgaacacgtgagcctctcttgtcagcctgtgaatgattactttagccctaatcaggatttcaaggtcacttggtccagaatgaaatctggaacgttttccgttctggcttactatttatcttcaagtcagaacacaatcattaacgaatcccgcttttcctggaataaagagctgatcaaccagagtgatttctccatgaatcttatggacttaaatctaagtgattccggagaatacttgtgcaacatcagtagcgacgagtacacactcctcacaatccatacggtacatgttgaacctagccaggaaaccgcctcccacaataaagggttgtggattctggtgccaagcgccatcctggccgcatttctcctgatctggtccgtgaagtgttgtagggcgcagcttgaagcccgaagatcacgccatccagctgacggcgctcagcaggagcgctgctgcgtgccgcctggagaacgctgcccttctgcccctgacaatggagaagagaacgtgcctctgagcggaaaagtttag

SEQ ID NO: 26751 - DNA, 411 bp, Artificial Sequence
  Description of Artificial Sequence: Synthetic coding sequence
atgaaggctcagactgccctgtcttttttcttgatactcattactagtctctcaggctcacaaggcattttcccgctggcgttttttatttatgtgcctatgaatgagcaaatagtgattggcagactggatgaggacatcatcctgccatcatctttcgaacgagggtccgaagtagtgattcactggaagtatcaagacagctataaagtgcacagttactataaaggcagcgatcatctggagagccaggatccccggtatgccaaccggacgtcactcttttataacgaaatccagaatggcaacgcaagcctcttcttccggcgggtgagccttctggacgaaggaatctacacatgttacgtggggacagccatacaggttatcactaacaaggtggtgttatag

SEQ ID NO: 26752 - DNA, 1245 bp, Artificial Sequence
  Description of Artificial Sequence: Synthetic coding sequence
atgaaggctcagaccgctctttcctttttcctgatcctcattacatccctgagtgggtcacagggcatcttccctctggcatttttcatctacgtgcccatgaatgagcaaatcgtgattggccggctggacgaagacattatcttaccatcgagtttcgaaaggggctctgaggtcgtaattcactggaagtatcaagactcttacaaagtgcacagttactataaaggttccgatcatcttgagagtcaggatccccggtatgcgaataggacctccttgttctacaatgaaattcagaacgggaatgcctcactgttttttagacgggtttcacttctggacgagggtatctacacctgctatgtcggtaccgctattcaagtgattaccaacaaggtagtactgaaggtgggagtgttcctcacaccggtgatgaagtacgagaagagaaatacgaactcctttttgatttgtagtgtgctgagcgtgtatccacgccccatcataacctggaagatggacaacacacctatctctgaaaacaatatggaagaaaccgggagcctggattcgtttagtatcaactcccccctaaacattaccggctctaattcctcgtatgaatgcactatagagaactctctccttaagcagacctggaccggacggtggaccatgaaggacggactgcacaaaatgcaatccgagcacgtctctctgtcgtgccagcctgtcaatgactatttctccccaaaccaggactttaaggttacctggtcccggatgaaatcaggcaccttttctgtactggcatactacctgagcagcagccagaatacgattatcaatgagtcacgcttttcctggaataaagaacttatcaaccagagtgacttttcaatgaacctcatggacctcaatctctccgattcaggcgagtatctgtgtaatattagctcagacgaatatacgttactgacaattcataccgttcatgtagagccttctcaggagacagcctctcacaacaagggactctggatccttgtgccctcagccatactcgctgcatttttgctcatttggagtgtgaagtgctgccgagctcagctcgaagccaggaggagtcgccaccccgccgatggggcccagcaggaaaggtgctgtgtgcccccgggggagcgctgccctagtgcaccagataacggtgaggagaatgtgcctctatccggcaaggtgtag

SEQ ID NO: 26753 - DNA, 2193 bp, Artificial Sequence
  Description of Artificial Sequence: Synthetic coding sequence
atggcagctggggtggaagctgctgctgaagtagccgccacagagattaagatggaggaagaatctggggctccaggagtgccgagcggaaacggggccccgggaccgaaaggcgagggcgaacggcccgcccaaaatgagaagcgcaaggagaagaacatcaagaggggtgggaacagattcgagccctatgccaacccgacaaagcgttacagagcgttcatcaccaatattcccttcgatgtgaaatggcagagtcttaaggaccttgttaaagaaaaagtgggtgaggtgacatatgtcgagttattgatggacgctgagggcaagtctcgtggatgtgccgttgtggagttcaagatggaagagagcatgaaaaaggccgccgaagtgttgaacaaacattcattaagcggccggcccctaaaagtaaaagaagaccctgacggagagcatgctcgaagagcaatgcagaaggtcatggcaactactggagggatggggatggggccgggcggtcccggcatgatcactatccccccaagcatcttgaacaatcctaatattcctaatgagattatccacgctcttcaggctggtagactgggctccacagtcttcgttgcaaacttagattataaggtgggttggaagaaactcaaggaagtgttcagtatggctggtgtggtggtgcgtgccgatatcctcgaagataaagacggcaagagtagaggcatcggaacagtgaccttcgaacaatcaattgaggcagtccaagcaatctctatgttcaatgggcagctactctttgacaggcctatgcacgtgaagatggacgagagagctctccctaaaggagatttctttccacctgaacgccctcaacagctacctcatgggctagggggcataggcatggggctggggcctggagggcagccgatcgatgcaaatcacctcaacaaggggatcggcatggggaatattgggccggctggtatgggaatggaagggatcggctttggtatcaacaagatgggaggcatggaggggccttttggcggcgggatggagaacatggggaggttcggttccggtatgaacatggggagaatcaacgaaattctatccaacgcccttaagcgcggggaaattattgcgaagcaggggggcggagggggcggagggtccgtgcctggcattgaacgcatgggccctggcatcgaccgtctgggaggagccggcatggagcgcatgggagcggggctggggcacgggatggacagagtgggcagtgagatcgaaagaatgggacttgtgatggaccggatgggcagtgtcgagagaatgggaagcgggatcgagagaatgggtccactggggcttgaccatatggcaagcagcattgagagaatggggcaaaccatggaaagaataggatccggagtagagcggatgggcgccggtatgggcttcggactcgagcgcatggccgccccaatagatcgagtcgggcagactattgaaaggatgggaagtggagtggagcgcatgggccccgctatcgaaaggatgggcctcagcatggaacggatggttccagccggaatgggcgctggccttgaacgaatgggacccgttatggaccgtatggccacaggcttggaaaggatgggcgccaataatctagagagaatggggctggaacgcatgggggcaaattcgcttgagcggatggggctggaacgcatgggtgcaaacagccttgaacgaatgggccccgctatggggccagcccttggagcaggcatcgagcgcatgggattggccatgggcgggggtggtggcgcttcctttgatcgggccatcgagatggagcggggcaacttcgggggcagtttcgccggttcctttggcggcgctggcggccacgctccgggtgtcgccagaaaggcatgtcagatctttgtgcggaatctgccattcgattttacatggaaaatgttaaaagataagtttaacgagtgtggacacgtgctgtacgcggatatcaaaatggaaaacggtaaatctaaaggctgtggcgtggtaaagttcgagtcaccagaggtggccgagcgggcctgccggatgatgaacggaatgaagctctcaggacgcgagatcgatgttagaatagatcggaatgcctag

SEQ ID NO: 26754 - DNA, 2076 bp, Artificial Sequence
  Description of Artificial Sequence: Synthetic coding sequence
atggccgctggcgttgaagcagctgctgaggtcgccgccactgagatcaaaatggaggaggagtctggcgcaccaggggtcccaagcggcaacggagcacccggccccaagggtgaaggggaacggcctgcccagaacgagaagagaaaagagaaaaatataaagcgcggggggaatcgcttcgagccgtacgcaaatcccacgaaaagataccgtgcttttataaccaacattcccttcgatgttaaatggcagagtttaaaggatctcgttaaggaaaaggtcggggaggtaacctatgtggagcttctgatggatgcagaaggcaaaagccgaggctgcgccgtcgtggaattcaaaatggaggaatctatgaagaaggctgctgaagtgctgaataagcactcactcagtggtagaccactcaaagtgaaagaggatccagatggcgagcatgcaaggcgggccatgcagaaggcaggacgtttgggctcgacagtgttcgtcgccaaccttgattacaaggtgggctggaagaagcttaaagaggtgttttccatggccggggtggttgtgagggctgatattctggaggacaaggatgggaaaagccgagggatcgggacggtcacattcgagcagtccatcgaagccgtgcaggctatttccatgtttaatggtcagctgctgtttgacaggcccatgcacgtgaagatggacgagcgtgctttaccaaagggcgacttttttcctcctgaacggcctcagcagctcccccatggtttaggtggcatcggaatgggtctgggacccggaggccagcctatcgatgcaaaccacctgaacaagggcatagggatgggcaacataggacccgcaggtatgggcatggagggtatcggctttggaattaacaaaatgggcggtatggaaggcccgttcgggggcggcatggagaatatggggcgttttggcagcggaatgaacatggggagaattaatgagattctgagcaacgccctcaaacgcggagaaatcatcgccaaacaaggcggaggtggaggcgggggctccgtgcccggtatcgaaagaatggggccaggaattgacaggttgggcggggccggtatggaaagaatgggagcgggccttggtcatggcatggatagagtcggaagtgagatcgagcgaatgggactggttatggatcggatgggaagcgtggaaaggatgggctccggtattgaaaggatgggacctctcgggctggaccatatggcttcgtcgattgaaaggatggggcagacaatggagcgaatcggaagtggcgtggagaggatgggagctggcatgggcttcggacttgagcgaatggctgccccaattgatcgcgtggggcagaccatcgaaagaatgggatccggtgttgagaggatgggaccagctattgagcgaatgggactgtcgatggagcggatggtgccagccggcatgggagctggactggagaggatgggacctgttatggatagaatggctaccggccttgaacgcatgggggctaataacctagaaagaatgggtttagaaagaatgggggcaaatagtctggagagaatgggcttagaacgcatgggagcaaacagcctggagagaatggggccggccatggggccagccctgggggcagggatagaaagaatgggactggcaatgggaggcggaggcggtgcatcttttgaccgggctattgagatggagcgaggcaacttcggcggctctttcgccgggtccttcggcggcgcaggagggcatgctccgggagtggctaggaaggcttgtcaaatttttgtgagaaatcttccgttcgatttcacgtggaagatgttaaaagataaatttaatgagtgcggccacgtattatatgcggacatcaaaatggagaatggtaagagtaaaggatgcggagtggtcaagttcgaatcccccgaagtcgccgagcgagcatgtagaatgatgaacggtatgaagctcagcggtcgggagattgacgtgcggattgacaggaacgcctag

SEQ ID NO: 26755 - DNA, 864 bp, Artificial Sequence
  Description of Artificial Sequence: Synthetic coding sequence
atgggctccgtcgagaggatgggatcaggcattgagcggatggggccactggggctcgaccatatggcctcatccatcgagcgcatgggccaaaccatggagagaattggatccggagttgaacggatgggcgccggcatgggctttgggttggagcggatggcggcccccatagacagagtgggacagaccatcgagcgaatgggctcgggcgtagaacggatgggccccgccattgagcgaatgggtctttccatggaaagaatggtgcctgcagggatgggggcaggcttggaacggatgggaccggtgatggatagaatggccacaggattggaacgaatgggcgccaataatctggagagaatgggactcgaaagaatgggcgctaatagccttgaaaggatgggcctcgagcgaatgggagctaatagtctagagagaatgggccctgctatggggcctgccttgggcgcaggcatcgaaaggatgggcctggctatgggaggaggtggaggagccagcttcgatagggctatcgagatggaacggggtaatttcggcggtagcttcgccggctctttcgggggggccggcggacacgctcccggcgtagctcgaaaggcatgccagatattcgtacgcaatctgccctttgacttcacatggaaaatgcttaaggacaagtttaacgagtgtgggcacgtgctgtacgctgacattaagatggagaacgggaagagtaaaggatgcggcgttgttaagtttgaaagccctgaagtggccgagcgcgcctgccgcatgatgaatggaatgaagctgtccggtcgagagatcgatgttaggattgatagaaacgcatag

SEQ ID NO: 26756 - DNA, 1848 bp, Artificial Sequence
  Description of Artificial Sequence: Synthetic coding sequence
aatggctctcacctaaagacctggctcaaaaaaaaaggatgcgctgtagtcgagttcaagatggaggagtctatgaaaaaggctgccgaggtgttgaacaagcacagtctatccggtcggcccctgaaggtgaaggaggacccagatggtgagcacgcgagaagagccatgcagaaggtcatggccacaacaggaggaatggggatggggcccggagggcctgggatgatcactataccacccagtatactgaacaaccccaatatccctaacgaaatcatccacgccctgcaggccggacgtctaggttccaccgtcttcgtggcgaatctggactacaaagtcggctggaagaagttgaaagaagtcttcagcatggccggtgtagttgttcgggccgacatcttggaagacaaagatggaaaatctcgtggcataggcaccgtaacttttgaacagtccattgaagcagtgcaagccatttccatgtttaatggccagctactgttcgatagaccaatgcacgttaagatggacgagagggcgctgccgaaaggagacttttttccacccgagagaccccagcagctgccccacggcttaggaggtatcggcatgggcctgggaccaggcggtcagccaattgatgcaaatcacctaaataaaggaattggtatgggcaacattggacctgccggcatggagggcccctttggcggcggcatggagaacatgggccgcttcggcagcgggatgaatatgggcaggattaacgaaatcctgtcaaacgcactgaaacgcggtgaaattatcgccaagcagggcggtggcggcggggggggaagcgtccccggcatcgagaggatgggaccaggcatcgatcgacttggcggcgccgggatggagcgcatgggcgccggtctcggccacggtatggaccgagtcggaagcgagatcgagaggatgggtcttgtgatggaccgtatggggagtgtggaaaggatggggtcagggatcgagcgcatggggccactcggcctcgaccatatggcatccagcatcgagcgcatgggacagaccatggaacgaatcgggtccggcgtggagagaatgggggctggtatgggcttcggtttagaaaggatggccgctcctatcgaccgtgtgggacagactatcgaacggatgggaagcggcgtcgagagaatggggccggccatagagcggatgggcctgagcatggagaggatggtcccagcagggatgggcgctggcttggagcgaatgggaccagtgatggaccgcatggccacaggcttggaaagaatgggcgcaaataacctagagcggatgggcctggaacgcatgggggccaactccctggaacgaatgggtctggagagaatgggagcaaattccctcgaacggatggggcctgccatgggtccagcacttggggcaggtatcgagaggatgggactcgccatgggaggaggtggaggtgccagttttgaccgagcaatcgaaatggagagaggcaattttggggggagctttgcaggatcgtttggcggcgcaggtggacatgctcctggggtggctagaaaggcctgccagattttcgtccggaatctgcctttcgacttcacgtggaagatgctgaaagacaagtttaatgaatgcgggcacgtcctgtacgcggatattaaaatggaaaatggaaaaagcaaagggtgcggcgtggtcaagtttgaaagtcctgaagtggcggagagagcctgtcgcatgatgaatggtatgaaactcagcgggcgggagatcgacgtgagaattgatcgcaatgcttag

SEQ ID NO: 26757 - DNA, 2754 bp, Artificial Sequence
  Description of Artificial Sequence: Synthetic coding sequence
atgtttgcggtccacctgatggcattctattttagtaagctcaaggaagaccagattaaaaaggttgatagattcctctatcacatgcggctttccgatgataccttacttgacataatgaggcggttcagggctgagatggagaagggcctggcaaaggatacaaatcccactgcagcagtcaaaatgctgcccacattcgtgcgcgcaattcctgacggaagtgagaatggcgaatttcttagccttgacctggggggatccaaattcagggtccttaaggtacaggtggcagaggagggtaaacgccacgtccagatggaaagtcagttttatcctacgccaaatgaaatcatccgcgggaatgggaccgaactttttgaatatgtggctgactgtcttgcagatttcatgaagactaaggacctcaaacataagaagcttcctctgggcctgacctttagctttccatgcagacagaccaagctagaagagggagttttattgagctggactaagaagttcaaggccaggggcgtccaggataccgacgtggtgagccgcttaacaaaagccatgaggcgacacaaagacatggatgtagatatccttgctctcgtgaacgacactgtgggcacaatgatgacttgcgcctacgatgacccttactgtgaggtgggggtgataataggcaccggaactaatgcctgttatatggaggatatgtcgaacatagacttggtggagggtgatgaaggccgcatgtgtatcaatacagaatggggagcatttggtgacgacggtgcccttgaggacataagaactgagttcgatcgggagctggatttgggctcgctcaacccaggtaagcagctgttcgagaaaatgatctccggtctttacctgggggaactcgtgcggctgatcctcctcaaaatggcgaaggcaggcctactttttgggggcgaaaaaagcagcgccctccatactaagggcaagattgagacaagacacgtggccgcaatggagaaatataaagagggcctggcgaacacccgagagattctggtggacttggggttagagcctagcgaggccgattgtatagccgtgcaacacgtgtgcacgatcgtttcttttcgcagcgccaacctctgcgctgctgctctggcagcaatcctgacccggctgcgagaaaataaaaaggtggaacggctgcgtactactgtcggaatggacggtaccctgtataaaatccatccccagtacccaaaacggctccacaaagtagtacgcaaactagtgccatcctgcgatgtaagattcctattgtcagagtccggatccacgaagggcgccgcaatggtgactgcagtggcttcccgagtccaggcccagcgcaagcagatagaccgagtgctcgccctatttcagctgacccgagagcaattggtagacgtccaggctaagatgagagcagagttagagtacgggttgaagaaaaagtctcacggattggcaacagtgcggatgcttcctacctatgtgtgcggtcttcccgatggcacagagaaaggaaaatttctagcccttgatctgggcggcacaaactttcgggtgctcctggtcaagattagatccggacgtaggagcgtgcggatgtacaacaaaatcttcgcgatccccctcgagatcatgcagggcaccggagaagaattgtttgatcacattgtccagtgtatcgctgactttttagactacatgggactgaagggagcctcgcttccattgggatttacattctcatttccttgccggcagatgtctattgacaaagggacgctgatcggatggactaagggcttcaaggccaccgattgtgaaggagaggacgtcgtcgacatgttacgagaagcaataaagagaagaaacgagtttgacctcgatatagtggcagtggtcaatgatacagttggtaccatgatgacatgtggatatgaggatccgaactgtgaaattggcctgatagccgggaccggtagcaacatgtgttacatggaagacatgcgaaacatcgaaatggtggaaggaggtgaagggaaaatgtgtatcaacacagaatggggcgggtttggagataatggttgtatcgatgacatctggacaagatacgacactgaagttgatgaaggatcactgaatcctggcaagcagcgatatgaaaagatgaccagcgggatgtacctgggcgagattgtacgacaaatccttatcgatctgactaaacagggtttgctgttcagaggacagatctctgagaggctgcgcacacggggtatcttcgagactaagttcctgtcacagatcgaaagtgatcgcctggccctcctccaggtgagaagaatcctgcagcagctcggcctagattccacgtgtgaagattcaatagttgtcaaagaagtgtgcggcgccgtttcaaggcgggcagcccagctgtgtggcgctggcctcgccgcaatcgttgagaagcgcagagaagaccagggactggagcacctgcgcataaccgtgggcgtcgatggcaccttgtacaaactacaccctcatttctcacgcatactgcaggagacagtcaaggaattggctcctaggtgcgatgtaaccttcatgctgtccgaggatggctccggcaagggagctgcgctgatcaccgcagtggcaaagcgcctgcagcaagcccaaaaagaaaattag

SEQ ID NO: 26758 - DNA, 2421 bp, Artificial Sequence
  Description of Artificial Sequence: Synthetic coding sequence
atgttcgcggtgcatctgatggccttctatttctcgaaactgaaggaggatcaaataaaaaaagtcgacagatttctctaccatatgcgactgagcgatgatacactgctcgacattatgcgccgcttccgcgcggaaatggagaagggtctagcaaaagataccaatcctacggctgcagtaaagatgctgccaacattcgtgcgggctattcccgatggatcagaaaacggggagtttctctcattggatctcggcggctccaaatttcgggttctgaaagtgcaagtcgctgaggagggcaagcggcatgtgcagatggaatctcaattttatcctaccccaaacgagataatccggggaaacggcaccgagctcttcgaatacgtcgccgactgcctggccgacttcatgaaaacaaaggatctgaaacacaagaaactgccattgggactgacatttagcttcccatgccggcagaccaagctggaagagggtgtgttgctgtcgtggaccaaaaagttcaaggcacgtggagtgcaggacacagacgtcgtgtcacgcctcaccaaagccatgcggcgacataaagacatggacgtcgatatactcgctttggtaaatgacaccgtagggaccatgatgacatgcgcctacgacgatccgtactgtgaagtgggtgtgataatcgggacgggtactaatgcctgttatatggaggatatgagcaatatcgacctggttgaaggcgatgaaggccggatgtgcattaacacagaatggggggcattcggagacgacggcgcactcgaggacatccgcaccgagttcgatagagaactcgatttaggcagtctgaatcctggtaagcagctcttcgagaagatgatctcaggactctatctaggagagttagtgagactgattctgctgaaaatggccaaggcaggactgctctttggaggggaaaagtcttcagcgctccataccaaaggcaagatcgagaccaggcatgtggctgcaatggaaaagtacaaagaaggactggccaatacaagagagatcttggtggacctagggctggagccaagcgaggccgattgcatcgctgtgcaacacgtgtgtactattgtttcttttcgatccgccaatctgtgtgcagcagcgctggcggcgattcttacccgtctccgggaaaacaagaaggtcgagcgcctgcgtaccactgtggggatggatggtacattgtacaaaatccacccccagtatcccaaacgtcttcataaggtggttcgcaaactagtgccatcctgcgacgtgagatttttgttgtccgaatctggttcaactaagggtgccgctatggtgaccgcggtcgcctccagggtccaagcccagcgtaagcagatcgatcgcgttctggcactgttccagttgacacgggagcagctggttgacgttcaggctaagatgagggccgaactcgagtatggacttaaaaagaaatcccacggactggcaaccgtgcgcatgctcccaacctatgtgtgtggcttgccagatggcacagagaagggtaagttcttagctttggatctgggggggaccaacttcagggttttattagtgaagattagatcaggaaggaggtcggttagaatgtacaacaaaatattcgctattcccttagagatcatgcagggcaccggagaggagctgtttgaccatatcgtgcaatgtatcgctgactttctcgactacatgggacttaagggggcctctctccccctgggctttaccttttcatttccttgccgacagatgagtatcgacaaggggacacttatcggctggacaaaggggtttaaggccactgactgcgaaggcgaggacgtcgtcgacatgctgcgtgaggccatcaagcgacgtaatgagtttgacctggacatagtcgcagtggtcaacgacactgtcggtactatgatgacctgcggatacgaggatcctaactgtgaaatcggcctgattgcaggcacgggcagtaatatgtgttacatggaggacatgcggaacatcgaaatggttgaaggcggggagggcaaaatgtgtatcaacaccgaatggggcgggtttggagataatggctgcatcgacgacatctggaccaggtacgatactgaggtggatgagggaagcttgaaccccggcaagcagagatacgaaaaaatgaccagcggaatgtacttaggggagatcgtgcggcagatcctcatcgacctgaccaaacaggggttgctgttcagaggacagatcagtgaacggctaaggacacgggggatctttgaaactaaatttttatcacagattgaacgaatgctgagtgttattgacgcctactgccttgatctgctctttcattag

SEQ ID NO: 26759 - DNA, 2211 bp, Artificial Sequence
  Description of Artificial Sequence: Synthetic coding sequence
atgtttgcagtccacctcatggcgttttatttttcaaaactgaaagaagatcagatcaagaaggtggatcgctttctataccatatgcggttaagcgatgacacacttttggatattatgcgtcgcttcagggctgagatggaaaagggactggccaaggatactaaccccacagccgctgtaaagatgctaccaactttcgttcgcgctattcccgacggctccgagaatggcgagttcttgagcttggaccttggtggatccaagtttcgcgtgttgaaagtgcaagtcgccgaagaaggaaagcggcatgtgcaaatggagtcgcagttttatcccactcccaacgagatcatcaggggtaatggcacggagctgtttgaatacgtcgccgactgcctagcagacttcatgaaaaccaaagatttgaagcacaaaaaactgcctctgggtttgactttctcattcccctgtagacagacaaagttggaagaaggcgtgctgctgagctggacaaaaaaattcaaagctagaggcgtgcaggacacagacgtggtgtcccgattgaccaaagccatgaggcggcacaaggatatggacgtggacatcctggcacttgtgaacgacaccgtcggcacaatgatgacatgcgcatacgacgacccttattgcgaggttggagttatcattggcacgggtactaacgcctgctatatggaggatatgagcaacatagatctggtggaaggagatgagggcaggatgtgcattaatacagagtggggtgcttttggcgacgacggcgctctcgaggatatcaggacggagtttgacagggaattagacctcgggtccctgaaccctgggaagcaattatttgaaaagatgatctccggactttatctcggcgagcttgtgagactcattctattgaagatggctaaggccgggctactattcggtggcgagaaaagctccgcactccacacaaaggggaaaatagaaaccagacatgtcgcagcgatggaaaaatacaaggaaggattggcaaacacccgggagattctagtagacctaggactagagccttccgaggcagattgcatcgctgttcagcacgtttgtaccatcgtctcatttagaagcgctaatctgtgcgcggccgctcttgcagccattctaactaggctgcgagaaaataagaaggttgaacgccttaggaccacagtgggaatggacggcacattatacaaaatccacccacagtaccctaagcgtctacacaaggtggtccgtaaactggtcccaagttgtgacgttaggtttctgctcagcgaatctgggtccaccaagggtgccgccatggtcactgctgtggcctctagggtgcaggctcagagaaaacagatagaccgtgtcttagcgctgttccagctgactcgcgaacagctggtcgatgtgcaggccaaaatgcgcgccgaactggagtacggactgaagaaaaagtctcatggcttagccaccgtgcgtatgctgccaacttacgtttgtggattgccagacggcactgaaaagggtaagttccttgccctagacctcggtggaactaactttagggtgctgcttgttaaaattcgctccgggcgcaggagtgtacgcatgtacaacaagatctttgccattccactggaaatcatgcaaggaaccggtgaggagttgttcgaccatatcgtacagtgcatagccgatttcctggactacatgggtctgaagggcgcctccctgcctctgggattcaccttctcattcccatgccggcagatgtcaattgacaaagggactttaatagggtggactaaggggttcaaagctacagactgtgagggagaggatgttgtggacatgttacgggaggctataaagcgacgaaatgaatttgacttggacatcgtcgcagtggtcaatgatactgtaggaaccatgatgacgtgcgggtatgaagatcccaattgtgaaatcggactgattgcgggcaccggcagcaacatgtgttatatggaagacatgcggaacattgagatggtcgagggcggggaaggaaaaatgtgcatttgtttctccttctgtttatggtttgtgctccaagtgcttatagtggtgctgagaatagtgaggtaccgaaagtcttctaagttgatcaagaaattttag

SEQ ID NO: 26760 - DNA, 282 bp, Artificial Sequence
  Description of Artificial Sequence: Synthetic coding sequence
atgtcaaccgacactggcgtgtcattgcccagttacgaagaagatcagggaagcaagctgataagaaaagccaaggaggccccatttgtgcccgtgggcatcgctggattcgcggctatagtcgcatatggactgtataagctaaaaagccgagggaacactaaaatgagcatccacttaatccatatgcgggtcgccgctcaaggctttgttgtcggagctatgaccgtggggatgggatactccatgtacagggagttctgggccaagcctaaaccctag

SEQ ID NO: 26761 - DNA, 282 bp, Artificial Sequence
  Description of Artificial Sequence: Synthetic coding sequence
atgagtacagacactggagttagtttgccgtcttatgaagaagatcagggaagtaagttaatccggaaagctaaggaggccccctttgtgccagtaggcattgcaggctttgctgccattgtggcctatgggttgtacaaattaaagagccgcgggaacactaagatgtccatccacctcatccacatgcgggtcgctgcccagggcttcgtggtaggggctatgaccgtgggaatggggtacagtatgtatagggagttctgggcaaagcccaaaccttag

SEQ ID NO: 26762 - DNA, 324 bp, Artificial Sequence
  Description of Artificial Sequence: Synthetic coding sequence
atggagcagaagcttgtcgaagaaatactccaggccatcaccatgtccactgacaccggcgtatccttaccctcctatgaagaggatcaggggagcaaactcatcagaaaagccaaggaagccccctttgtccccgttggtattgcaggttttgccgccatagtcgcctatggactgtacaaactgaagagccgcggaaacaccaagatgagtattcatctaatacacatgagagtcgctgcgcagggcttcgtcgttggcgcgatgaccgtgggcatgggctacagcatgtatcgcgaattctgggccaagcccaagccttag

SEQ ID NO: 26763 - DNA, 300 bp, Artificial Sequence
  Description of Artificial Sequence: Synthetic coding sequence
atgagcgccaatcgcaggtggtgggtgccaccggatgacgaggattgcgtgagtgagaagctgctgcgcaagacccgtgaatccccacttgtacctattgggctgggagggtgtctggttgtggcagcataccgtatttaccgactacgctccagagggtccacaaagatgtctattcacttaattcatactagggtcgctgcccaggcgtgtgccgtgggcgccataatgttgggggctgtttacactatgtatagtgattacgtaaagcgaatggcccaggatgcgggggagaagtag

SEQ ID NO: 26764 - DNA, 321 bp, Artificial Sequence
  Description of Artificial Sequence: Synthetic coding sequence
atggcgacaccaggtccggtgatcccagaggtgcctttcgagcctagcaaaccacccgtaattgaaggcttgtcaccaaccgtttatcgcaatcctgagtctttcaaggagaaattcgtaaggaagactagggaaaatcctgtcgtcccaattggctgccttgcaacagcagctgccttgacttatggtctttactcttttcaccgcggaaatagccagcgaagccagctgatgatgcggacccggatagccgctcaggggttcaccgtagcggcaatcctcctcggactggccgtcacagccatgaagagccgcccctag

SEQ ID NO: 26765 - DNA, 321 bp, Artificial Sequence
  Description of Artificial Sequence: Synthetic coding sequence
atggcaaccctcggatttgtaacaccagaagcacccttcgaaagctctaagcctcctatttttgaaggattgtcccccacggtgtacagcaatcctgagggattcaaggagaaatttctgcgtaagacccgggagaatccagtggtgccgataggctttctttgcacagccgcagtgttaactaacggcctgtattgttttcaccagggcaattcacagtgcagcaggctgatgatgcatacccagatcgctgcgcaagggttcacgatagccgctattctgctcggcctggctgctaccgcaatgaagtcccccccctag

SEQ ID NO: 26766 - DNA, 1473 bp, Artificial Sequence
  Description of Artificial Sequence: Synthetic coding sequence
atgacccagggcaaaaaaaagaagcgggctgccaacagaagtatcatgttggccaaaaagattatcattaaggacggcggaactccgcaaggtatcgggagtccttccgtgtaccacgccgttattgtgattttcctggagttttttgcttgggggctgctaacagccccaacactcgtagtgttgcatgagacttttcctaaacatactttccttatgaacggcctaatccaaggggttaaggggctactttcttttctgtcggcccctttaatcggggcactgagtgacgtttgggggcggaaatccttcctgttactaactgtattcttcacctgcgccccaataccgctgatgaaaataagcccatggtggtatttcgcagtgattagtgtaagcggggtcttcgctgttactttcagtgtggtgtttgcttatgtggcagacattacccaggaacacgaacgcagtatggcttatggcctcgttagcgcaacctttgccgcatcccttgtgacctctcccgcgattggggcttatttaggcagagtgtacggtgactctttagtagtagtccttgctaccgctatcgcactcctagacatctgctttattctggtggccgtaccagagtccctccctgagaagatgcgacctgccagctggggcgcaccaatttcctgggagcaggcagatcctttcgcttcactgaaaaaggttggacaggacagtatagtactgctgatttgcatcacagtcttcttatcatatctccccgaggctggtcagtactcaagttttttcctctacctgcggcagatcatgaaattctcccctgagtccgtggcagcattcatcgccgtcttgggcattctctcaatcatcgcacagactatcgtgcttagcttgcttatgaggagtataggtaacaagaacaccatccttctcgggctgggcttccaaatactgcaactggcatggtatgggtttgggtccgagccctggatgatgtgggccgctggggccgtcgctgccatgtcatcaatcacatttccggccgtgagtgccctggtgagccgcaccgctgacgctgaccagcagggcgtcgtacagggtatgataaccggcattaggggtttgtgtaatgggctgggtcctgcgctctatggtttcattttctacatcttccatgtcgaactgaaggaactgcctatcaccggaaccgacttaggcaccaatacatccccacagcatcattttgaacagaactccatcatccctgggccaccctttctttttggagcctgctcagtgttgctggcattactggtggctttgtttatcccagaacacacaaatctgtcactccggagtagctcctggaggaaacactgtggcagtcacagccatcctcacaatacccaggcccccggggaggccaaggaacctctgcttcaagacactaacgtgtag

SEQ ID NO: 26767 - DNA, 363 bp, Artificial Sequence
  Description of Artificial Sequence: Synthetic coding sequence
taacatgaaacctttcccaagcatactttcctgatgaacggtctcatacagggagtgaaaggcctgctgtcctttctctcagctcccttaattggggctctaagcgatgtatggggccgtaaaagtttcctgctactgacggtgttttttacatgtgcccccatccccctcatgaaaatcagtccttggtggtatttcgcagtgatctcagtgagcggggtgttcgccgtgactttttcagtagttttcgcttatgtggccgacattacacaggaacacgagagaagcatggcttatggactcgtctgcatgttcatcctgtacctgttgtacttgttacgtaatgctctttttctacggtag

SEQ ID NO: 26768 - DNA, 462 bp, Artificial Sequence
  Description of Artificial Sequence: Synthetic coding sequence
atggttggcattttgtcaatcgttgcccagacagccttcctaagtatactgatgcggtcacttggcaacaagaacactgtgctactgggtctgggttttcaaatgctgcagttggcctggtacggttttggctcacaggcctggatgatgtgggcggccgggacagtcgccgccatgtcaagtattacgtttccagcaatcagcgcccttgtgagtcgaaatgccgaaagtgaccaacagggcgtggcccaggaccacaactggaataagcggactatgcagtggccaggagccctttacgggttcattttttatatgttccatgtagaactaaccgagctgggtccgaaattgaacagcaataatgtcccgttgcaggggagctgccatccaagaccagcagtttttatctggggaatgtactctccgtacgtcttcagcggatgcttgatccattcatag

SEQ ID NO: 26769 - DNA, 1521 bp, Artificial Sequence
  Description of Artificial Sequence: Synthetic coding sequence
atgagcgtcgaaccccccccagaactggaggagaaggccgccagcgagcccgaagcgggtgctatgcctgagaagagggcaggtgcccaggcggccggttcaacatggctccagggcttcggtagaccaagcgtgtaccacgcggctatcgtaatattcttggaattctttgcctggggactgctgaccacacctatgttaaccgttcttcacgagactttctcccagcacacttttctgatgaacgggctgatccagggcgtgaaaggactcctttctttcctgtcggctcccttaatcggagccttgtcagatgtctggggtaggaagcccttcctgctcggaactgtgttcttcacttgtttccccatccctcttatgaggataagcccctggtggtatttcgccatgatttccgtctctggcgtcttctcagtgaccttcagcgtcatattcgcgtatgtggcagatgtaacacaggaacatgagcggagtactgcgtacggttgggtctctgccaccttcgcagccagccttgtgagctctcccgctataggcgcatacctgtcggctagttacggagattcccttgtagtactcgtggctactgtagttgcgctgctagatatatgcttcattctggttgcagttccagagtcactcccggagaagatgagaccagtgtcttggggggcacagatatcgtggaaacaagccgacccgtttgcttcactgaaaaaggtcggcaaggactctacggttcttctcatttgcattactgtgttcctgagttatctgcctgaggctggacagtatagctcattcttcctctatctcagacaggtcataggcttcgggagcgttaagatcgcggcctttatcgccatggtcggcattctcagcattgttgcgcaaaccgcatttctttctatcctcatgcgctccctcggcaacaaaaataccgtcctcctcggtctgggctttcagatgctccaactcgcgtggtacggctttgggagccaggcctggatgatgtgggcagcagggaccgtggccgctatgtcttcaatcacattccccgcaatcagcgctcttgtttctcgaaatgcagagtctgaccaacagggtgtggcccagggcataatcaccggcatcagaggattgtgtaacgggctgggacctgcgctgtatggcttcattttctatatgtttcatgtggagttgaccgagttaggccccaaacttaacagcaataacgtgcctttgcaaggagccgtaatccccggccccccgttcctctttggtgcctgtattgtgttgatgtcatttctcgttgccctgtttatcccggagtattctaaggccagcggggtgcaaaagcacagcaacagcagctccggatccctgacgaacacacccgagagagggtctgatgaagacattgaacccctgctccaggattcaagtatctgggagcttagctcattcgaagagcccggcaatcagtgtaccgagctgtag

SEQ ID NO: 26770 - DNA, 936 bp, Artificial Sequence
  Description of Artificial Sequence: Synthetic coding sequence
atgctgacggtgctgcatgagacattctcacaacacaccttcttgatgaatggcctgattcagggcgtaaaggggctcttgtcctttttaagcgctccactgattggggcactgtccgatgtgtgggggcggaagccattcttgctaggcactgttttctttacctgtttccccatcccactgatgaggatttccccctggtggtactttgccatgataagtgtttctggggtgttctccgtgactttctcagtgattttcgcctatgtcgcggatgtgacgcaggagcatgaacgcagtaccgcttatggttgggtctcagctaccttcgccgcctctctggttagttcacccgccattggggcctatctctcagcgagttacggcgactcattagtcgtcttggttgctactgtggtggccctcctggacatctgcttcattcttgtagcagtgccagaatctctgccagaaaaaatgcggccggtcagttggggggcgcagatctcgtggaagcaagccgacccttttgccagtcttaagaaggtaggaaaggattccaccgtgctcctgatctgtatcacagtttttcttagctacctgcccgaggccggacaatactcatcattcttcctttatttacgccaagtgatcggatttggtagcgttaagatcgctgccttcatcgcaatggttggaatcttgtccattgtggcacaaacagcatttctctccattctcatgcgcagtttaggaaacaaaaataccgtactgctggggttaggatttcagatgctgcagttagcctggtatgggtttggaagccaagcttggtcctgcccgggagatcataactggaataaaaggaccatgcagtggcctggcgcctcgacagtgtggctgcacatccttcatgtgccatgcggcaccgactag

SEQ ID NO: 26771 - DNA, 405 bp, Artificial Sequence
  Description of Artificial Sequence: Synthetic coding sequence
atgtcagtggagccacctcccgagctggaggagaaggcagcaagcgagcccgaggccggggcgatgcccgaaaaaagagccggggcacaagccgccgggagcacttggctccagggatttggcccccctagtgtgtatcatgctgccattgttatatttttggaattctttgcatggggcctgctgaccactccgatgttaacagtgttgcacgagactttttcgcagcacactttcctcatgaacggtctgatacaaggtgtcaaaggcctgctgtccttcctttccgccccgctcattggtgcccttagcgacgtgtggggtcggaaacccttcctgctagggactgtgttcttcacctgtttcccaatccctctgatgaggatcagcccttgccaggcctag

SEQ ID NO: 26772 - DNA, 348 bp, Artificial Sequence
  Description of Artificial Sequence: Synthetic coding sequence
atgttaggactcttgggctccacggctctggtgggatggattaccggcgccgccgtggccgtgctcctgctgttgctgcttctggctacatgtctattccatggtagacaggactgcgacgtagagaggaaccgcacagccgcggggggtaatagggtgcgccgggcgcagccttggcccttccgtcgccgagggcacctgggaatctttcatcaccacagacatcccggccacgtctctcacgtccctaacgtggggcttcatcatcaccatcatccaaggcatacgccccatcacctgcaccatcaccatcacccccaccgacatcatcctagacatgcaaggtag

SEQ ID NO: 26773 - DNA, 1041 bp, Artificial Sequence
  Description of Artificial Sequence: Synthetic coding sequence
atgtacaatggatcttgttgcagaatcgagggggacaccattagccaggtgatgcccccgctcctgattgttgcgttcgtgctgggagctctcggcaatggcgttgccctgtgtgggttttgcttccatatgaaaacatggaagccttccaccgtgtatctgtttaacctggctgtcgcagatttcctgctaatgatctgcctccccttcagaaccgattattacctgcgccgtcggcattgggcatttggagacatcccctgtcgcgtgggactgttcaccctcgctatgaaccgagccgggtcaattgttttcctcaccgtggtggcggctgaccgttacttcaaagtggtgcatccacaccacgcagttaatacaatctcaacccgagtggccgctggaatcgtgtgcacgctgtgggcgttggtaatcttgggcactgtatacctcttgttagaaaatcatctctgcgtgcaagaaacagcggtgagttgcgagagctttataatggagtctgcaaacgggtggcatgatatcatgtttcagctcgagttctttatgcctttggggattattctgttttgttcatttaagatagtatggtcactgcggagaagacagcaactggcaagacaggctagaatgaaaaaagctaccaggttcatcatggttgtggcaatcgtgttcattacctgctacctgcccagtgtctcagctaggctgtatttcctatggaccgtgccctcctccgcgtgcgatccatcagtgcatggggcacttcatatcaccttgtcatttacatacatgaatagcatgttagacccgctcgtctattacttctcaagtcctagcttccccaagttttacaacaagcttaagatttgcagcctgaagcccaagcagcctggacatagtaaaacgcagcggccggaggagatgccaattagcaacctgggccggcggagctgcatcagtgtggcaaatagctttcagtcccagtcagacggtcagtgggatcctcacatcgtggaatggcattag

SEQ ID NO: 26774 - DNA, 1041 bp, Artificial Sequence
  Description of Artificial Sequence: Synthetic coding sequence
atgtataatggaagctgctgcagaatcgaaggagatactatatctcaggttatgccccctctgctgatcgtggcattcgtgcttggcgccctgggaaatggtgtggccctgtgcggattttgctttcatatgaagacctggaaaccatccaccgtgtatcttttcaacctcgccgtggcggacttcctcctgatgatttgcctcccttttcgcactgactactaccttcggaggagacattgggccttcggcgatattccctgtcgagtaggactgttcacattagctatgaaccgggctggaagcattgtgttcctcacagtcgtcgccgcagaccgatattttaaggtggttcacccgcaccatgccgtgaataccatcagtacaagagtagccgccggcatcgtgtgtaccctgtgggccttagtgatccttgggaccgtgtaccttctgctggagaaccacctgtgcgtgcaggaaactgctgtgtcttgcgagtcatttatcatggaatctgccaacggttggcacgatatcatgtttcagctcgagttttttatgcccctgggcattatcctcttttgctcattcaagatcgtgtggtctctacgacggcgtcagcagttggcccgccaggccaggatgaaaaaggctaccagattcatcatggtggtggccatcgttttcattacatgttatcttccatcagtttccgctcgcttatactttctgtggactgtcccgtcctctgcatgtgacccgtccgtgcatggtgcactgcacattacactgagctttacctatatgaactcaatgctcgacccacttgtatactacttcagtagccccagttttcctaagttttataataagctcaaaatctgctccctgaaaccaaagcaacctggccattccaagacacagcgtccagaggagatgccaatttctaacttggggcgcagaagctgcatttcagtagccaattcattccaaagccagagcgatggtcagtgggaccctcacattgttgaatggcactag

SEQ ID NO: 26775 - DNA, 1041 bp, Artificial Sequence
  Description of Artificial Sequence: Synthetic coding sequence
atgtataacggtagctgctgccggatcgaaggcgacaccataagccaagtgatgccacctctgctgatcgtggctttcgtactcggggcactcgggaatggagtggcgctctgtggcttttgttttcacatgaagacttggaaaccaagtactgtctacttatttaatctcgctgtcgccgacttcctgctgatgatttgcctccccttccgtacagattattatcttcggcgacggcattgggcattcggcgacataccctgtagagttggtctgtttaccctggccatgaatcgggccgggtcaatcgtttttctgacagtggttgccgcagataggtattttaaagtggtgcacccccatcatgcggttaacaccatctctactagagtcgccgccggcattgtgtgtaccctgtgggcgctggtaattctcggaaccgtgtatctgctcctggagaaccatttgtgcgtgcaggagacggcggtcagctgtgagagtttcataatggagagtgctaacggatggcatgatataatgtttcagctcgaattcttcatgcctttagggatcatcctgttctgcagcttcaaaatagtgtggtcactcagacgcagacagcagttagcacgccaggcgcggatgaaaaaggcgacgcgctttatcatggtagtggcaatcgtttttattacttgttatctcccttctgttagcgctcgcctatactttttatggaccgtgcccagctctgcatgcgacccatcagtgcatggagccctgcacatcaccctgtcatttacctacatgaatagcatgttagacccactcgtttattatttttcttcgcctagcttccccaaattctacaataagctgaaaatttgctccctgaaacctaagcagccagggcacagcaaaactcagcgacccgaggagatgccaatcagcaatctggggcgccggtcttgtatttctgtcgctaatagttttcagtctcaaagcgacgggcagtgggaccctcacattgtggaatggcactag

SEQ ID NO: 26776 - DNA, 1092 bp, Artificial Sequence
  Description of Artificial Sequence: Synthetic coding sequence
atgaacaggcatcatctgcaggaccactttttagagatcgacaaaaagaactgttgtgtgttccgggatgacttcattgtaaaagtcctgcccccggtgctcggactggaatttatcttcggcctccttggcaacggtctggctttatggatcttctgtttccatttaaagtcctggaagtcctccaggatctttttatttaacttagccgtggccgattttctgcttataatctgccttccattcttaatggataattacgtgaggagatgggactggaaattcggggatatcccttgccgactgatgctctttatgttagccatgaaccgccaaggtagcattatattccttacggtggttgcagtagatcgatactttcgcgtagtgcacccacaccatgctctgaataaaatttctaacaggacagcggcaataatttcatgtctgctttggggtattacaatcgggctcaccgtgcacctgctcaagaaaaaaatgcccattcaaaacgggggtgccaacctatgctcctcctttagtatttgtcatactttccagtggcatgaagccatgttcctgctggaatttttcctgcctttgggcatcatcctcttttgtagtgctaggattatttggagcttgcgacaaagacaaatggatcgtcatgccaagatcaaaagagccatcactttcatcatggtggtggccatcgtgtttgtcatctgctttctaccttctgtagttgtaaggattaggatattctggctgcttcataccagtgggacacagaattgcgaagtgtatcggtcagtcgacctcgcgttttttattactctttccttcacctacatgaactctatgctggatcccgtcgtgtactacttctcgtcccctagtttccccaacttcttcagtacactcatcaaccggtgtctgcagcgcaagatgacgggcgagcccgacaacaataggtccacatctgtcgaactaacaggggaccccaataagacaaggggggcaccagaggccctaatggccaacagcggagaaccctggagccccagttatctcgggccaacctcaccctag

SEQ ID NO: 26777 - DNA, 1164 bp, Artificial Sequence
  Description of Artificial Sequence: Synthetic coding sequence
atgaataggcaccatcttcaggaccactttctggaaatagataaaaaaaactgttgcgtgttccgggatgattttatagtgaaagtgctgccccctgttctcgggctagagtttatattcggactgctgggaaatggactggctttgtggattttttgttttcatctgaaatcttggaagtcatcccggattttcctgtttaatctggcagtggcagatttcttactcatcatttgcctgccattcctgatggataactatgtaaggcgctgggattggaagttcggggacatcccctgccggctcatgctctttatgctcgccatgaacaggcagggatccattatcttcttaactgtagtggccgtggaccggtatttccgagtggtgcacccacaccatgccctcaacaaaataagtaaccgcacagctgcaataatatcttgcctactctgggggatcaccattggattaacagtccatctccttaagaagaagatgcccatccaaaatggaggcgccaacctctgcagctccttctccatctgccatacttttcagtggcatgaagcaatgtttcttttggagttcttccttcccctgggcattatcctcttctgtagtgctcggattatctggagcttgcgtcagcgacaaatggatagacacgccaagataaagagggccattacattcatcatggtcgtggcaattgtgttcgtgatatgcttcctgcccagcgtggtggtcaggatccgcatcttttggctgctccacacctccgggacgcagaactgcgaggtgtatcgcagcgtcgacctggctttcttcattacactttcatttacttacatgaatagcatgctggacccagtggtgtactacttctctagtccaagctttcctaactttttctctactctgatcaataggtgtctccagcgcaaaatgacgggcgaacctgacaacaatcgcagcactagcgtcgaactaaccggggatcccaacaaaactagaggcgcccccgaggctctgatggccaatagcggcgaaccatggtcgccgagctacctgggacccacgagcaacaaccacgccaaaaagggccactgtcaccaggagcccggctcacttgaaaaacaactgggttgctgtatcgagtag

SEQ ID NO: 26778 - DNA, 954 bp, Artificial Sequence
  Description of Artificial Sequence: Synthetic coding sequence
atgtggctgtacctcgccgcatttgtcggcctttactacctgctacactggtatagggagcggcaagtggtgtcacacctgcaagacaaatatgtcttcatcacaggatgtgacagcggatttggcaacttactggctcgtcaactcgatgcaagagggctccgcgtgttagccgcttgcctgacagaaaagggcgcagaacagctgagaggccagacaagcgacagactggaaaccgtgactctagatgtgactaagatggagtcaatcgccgcagctacccagtgggtcaaagaacacgtgggtgatagaggcctctggggtttagttaataatgccgggatcttgacccccattacactgtgcgaatggctgaacaccgaagattccatgaacatgctgaaggtgaacctaatcggggtgattcaggtgactctttccatgctgcctttagtgcgccgggcccgcggcaggatagtaaacgtctccagcattcttggacgggtcgcattcttcgtaggcggttattgtgtgagcaagtacggtgtagaggccttctcagatattctgcgcagggaaattcagcacttcggggtcaagatctcaatcgtagaacctggctatttcagaacaggcatgaccaacatgacccagtcattggaacgtatgaaacaatcctggaaggaagcacccaaacatatcaaggaaacgtacggacagcagtattttgacgccctttataacatcatgaaggaaggcttgctgaactgttctactaatctgaatctggtgactgactgtatggaacacgctctgacatccgtacatccaaggacccggtatagcgctggctgggatgcaaagttcttctttattcctttgtcctacctgcctacatccctcgcagactatattttgactcgaagctggccaaagcccgcccaagctgtgtag

SEQ ID NO: 26779 - DNA, 954 bp, Artificial Sequence
  Description of Artificial Sequence: Synthetic coding sequence
atgtggctgtacctggctgcgttcgtgggcctgtattatttgcttcactggtaccgggagcgacaggtggtgtctcatctgcaggataagtatgtttttataaccggctgtgacagtggtttcggcaacctgttggcgagacagctcgacgcacgtggattgagggtgcttgcagcatgcctgactgagaagggggcggagcaacttcggggccagactagtgataggctagaaacagtcacgctagatgtgacaaagatggagagcattgcagccgcaacccagtgggtcaaagagcacgtgggcgaccgtggactatggggtctcgtaaacaatgccgggatattaaccccgatcacactgtgcgaatggctcaacaccgaggactccatgaacatgctgaaggtgaacctaatcggagtgatccaggtcacactgtctatgctgccactggttaggagggcgcgcggaaggatcgtcaacgtcagcagcatcctgggcagggtggcctttttcgtcggtggatactgcgtctctaaatatggagttgaagcgttctcagatatcttgagacgggaaatccaacactttggagtgaaaattagtatcgtggagcccgggtattttaggactggcatgactaacatgacacagagtttggaacggatgaagcagtcttggaaggaagcccctaagcacattaaagagacatacggccagcagtatttcgacgccctttataacatcatgaaagagggactgctgaactgttctactaatttaaacttagttactgactgtatggagcacgcattgacctccgtgcatccccgtacacgctatagtgctggctgggacgccaaatttttttttattccattgagttatttgcccaccagccttgccgattatatccttacccgctcatggcccaaacccgcacaggcggtatag

SEQ ID NO: 26780 - DNA, 267 bp, Artificial Sequence
  Description of Artificial Sequence: Synthetic coding sequence
atgtggctgtatctcgctgcgtttgtgggtctttactacctgctacattggtatagggaaagacaggtggtgagccaccttcaggacaaatacgtattcatcacaggttgcgacagcggattcggtaacttacttgcaaggcaactcgatgctcggggactgcgggtgctggcagcatgtctcacagagaaaggcgctgagcaactgagaggacagacatccgacaggctggaaaccgtgacgcttgacgtcaccaagatggagtag

SEQ ID NO: 26781 - DNA, 954 bp, Artificial Sequence
  Description of Artificial Sequence: Synthetic coding sequence
atgtggctatatttggccgcctttgtgggtctttattacctgctccactggtaccgagagcgtcaggttgttagccacttgcaggataagtatgtcttcataactggatgcgattcagggttcggaaacctcctggctcggcagctcgatgctcggggacttagggtcctggccgcgtgcctcacggagaaaggagccgaacagttaagaggccagacctcagatagactcgaaacagttaccctggacgtgactaaaatggaaagtatcgccgctgctacccaatgggtcaaggaacacgttggagaccgtggcctctggggcctggtgaacaatgcaggcatcttgacccccataaccttatgcgagtggcttaacactgaagatagtatgaacatgttgaaggtgaacttaattggagtgattcaggttaccctgagtatgctaccgctggtgcgcagggcccgtggccgcattgttaatgtgtccagcatactgggaagggtggccttcttcgtgggtggctactgcgtttccaagtacggagtagaggcctttagtgatatacttcgcagggaaatccagcatttcggtgttaagatttctatcgttgaacctggatacttccggacgggcatgactaatatgacgcaatctctcgagcgtatgaaacagagctggaaggaagcccctaaacatatcaaagaaacctatggccagcaatactttgatgctctgtataatataatgaaagagggactgttaaattgctccacaaacctaaatttggtcaccgattgcatggagcacgccctgaccagcgtgcacccacggaccaggtactctgccggctgggatgcgaagttttttttcatcccgctcagttacttaccaactagtttggcggattacattctcaccaggagttggcccaagccggctcaagccgtgtag

SEQ ID NO: 26782 - DNA, 954 bp, Artificial Sequence
  Description of Artificial Sequence: Synthetic coding sequence
atgtggctgtacctggccgctttcgtcggcctgtactacctgctgcactggtaccgcgagaggcaggttgtcagccatctccaggacaaatacgtgtttatcaccgggtgtgactccgggtttggaaacctactggcccgccagctcgatgcccgtggtctcagagtattggctgcgtgcctcacagagaaaggtgcggagcagttaagaggccagacgtccgacaggctggagactgtgaccttggatgtgacaaagatggagtcaattgctgctgccactcaatgggtgaaggagcatgtcggggatcgcgggctctggggattagtgaacaatgctggtatcctcacgcccatcacactctgcgaatggctcaacactgaagactcaatgaatatgctcaaggtaaatttgatcggcgtcattcaggtgacgctctccatgctcccgctagtgaggcgcgccagaggtcgaattgtgaatgtaagcagtatcctggggcgcgtcgctttctttgtgggagggtactgcgtatctaagtacggtgtggaggctttctcagatatactccgccgtgagatccaacattttggtgtgaaaataagtattgtagagccgggctatttccgtaccgggatgacaaacatgacccagtctctagagagaatgaaacagagctggaaagaagcacccaaacacatcaaagagacctatggacagcagtattttgacgctttatataacataatgaaggagggccttctcaactgctcgaccaatctgaacctggtcaccgattgcatggagcacgcactcacatcagtacacccaagaacccggtattcagctggatgggacgcaaagttcttcttcattcccttgagttatctgcccacttcactagcagactatatcctcactcggagttggccaaagcccgcacaagctgtgtag

SEQ ID NO: 26783 - DNA, 954 bp, Artificial Sequence
  Description of Artificial Sequence: Synthetic coding sequence
atgtggctatacttggctgcatttgtggggctctactacctattgcactggtatagggaacggcaggtggtgtcgcacctacaggacaagtacgtctttatcaccggttgtgatagtggtttcggtaacttactggcacgccagctcgacgcacgaggtcttcgagtgctcgccgcttgtctaacagagaagggtgcagaacaattgcggggccagaccagtgataggttggagaccgtaactctggacgtaacaaagatggagtctatcgcagctgcaacccaatgggtaaaagagcacgtaggagatagagggctgtggggattagtgaacaacgccgggattctgacgccaattaccctctgcgagtggcttaatacagaggactccatgaatatgctcaaggtgaacctgattggtgttatccaggtcacactaagcatgctgccccttgtgcgacgagcccgcggcagaattgtgaacgtgtccagtatcctaggaagggtggcattcttcgtgggcggctactgcgtgtcaaagtatggtgtagaggctttttccgatatcttgcgcagggagatccagcacttcggcgtgaagatttccatcgtggaaccaggctatttccgcaccgggatgaccaatatgacccaaagccttgaaaggatgaaacagagctggaaagaagccccgaaacatattaaagagacatatggtcaacagtatttcgatgcactctataacattatgaaggaagggctgctgaactgttccaccaacctgaacctcgtgacggactgcatggaacacgccttgaccagtgtccaccctaggactagatacagcgccgggtgggatgccaaattcttctttatccctctaagttacctccctaccagcctggctgattacatacttactcggtcctggccaaaaccggctcaggccgtatag

SEQ ID NO: 26784 - DNA, 228 bp, Artificial Sequence
  Description of Artificial Sequence: Synthetic coding sequence
atgtggttgtatctggctgcttttgtgggcctgtactatctgttacactggtacagagagagacaggtggtgtctcacctgcaggataaatatgtttttatcacaggttgcgactcggggttcggcaaccttctggcccggcagctcgatgcccggggcctgcgggttctcgctgcttgtttgacggagaaaggagcagagcaacttaggggacagactagcgactag

SEQ ID NO: 26785 - DNA, 897 bp, Artificial Sequence
  Description of Artificial Sequence: Synthetic coding sequence
atggtgacacctgccttgcaaatgaagaaacctaaacagttttgtcgccgcatggggcaaaaaaaacagcgccccgcccgcgccgggcagccccactcttctagcgacgctgcccaggcaccagccgaacaacctcacagttcttctgacgccgctcaggctccttgtcctcgggaacggtgtcttgggccgcccaccacaccggggccttatagatctatctacttttcatccccaaaaggccatctcactagattaggcttagaattcttcgatcagcctgcagtccctcttgcgagggcctttctaggccaggtcttggtcaggagattaccaaacgggactgagctccggggcagaatcgttgaaaccgaagcatatctagggcctgaggacgaagctgcacattcccgcggcgggagacagacaccccggaatcggggcatgtttatgaagcccggcactctgtacgtttatatcatctatggaatgtacttctgtatgaacatctcttcgcagggggatggagcttgtgttctgctacgagccctggaacctcttgagggactggagactatgcggcagctccgatccacactgaggaagggcacagctagcagagttttgaaggatagggaactgtgttcaggcccgtctaaactctgccaagcactggccataaacaaatcctttgaccagcgcgacctggcccaggacgaagcggtatggctggaaagaggacctttggaaccctccgaacccgctgttgtcgccgctgcccgggtcggtgtgggccacgcgggcgaatgggctagaaagcctctacgattctatgttagaggctctccctgggtctctgtggtggacagagtagccgaacaggatacccaagcatag

SEQ ID NO: 26786 - DNA, 828 bp, Artificial Sequence
  Description of Artificial Sequence: Synthetic coding sequence
atggctgcagtggattccttctatctcctctatcgagagatagcccgatcttgcaactgctatatggaagctctggcccttgtaggagcatggtacactgcccgcaaatccatcacggtgatctgtgacttctacagtctaattagactgcattttatcccacgcttggggtctcgagcagatttaatcaaacagtatggacggtgggccgtggtgagtggcgcaaccgatggaataggaaaagcctatgccgaggagctggctagtagaggccttaatatcattttgatttccaggaacgaggagaaactgcagtatttcactcaactaagcgaggataaactttgggatatcatcaacgtcaatatcgcagctgcctcacttatggtgcacgtagttttgccgggaatggttgaacgcaagaagggggctatagtgactatatcttctggcagctgctgtaaacccactccccagctcgcagcctttagtgctagcaaagcctatctagaccacttttcccgggccctgcagtatgagtatgcgtcaaaagggatctttgtgcagtccttgatcccattctatgtggccacctctatgacggcacctagcaatttcctgcaccggtgcagctggttagttccctctcctaaagtttacgcacaccatgcagtgtccacactcggtatctcaaaaaggactactggttactggtctcattccattcagtttctgttcgctcaatacatgcccgagtggctgtgggtgtggggggcaaatatcctgaaccggagtctacgcaaagaagctctgtcgtgcacggcctag

SEQ ID NO: 26787 - DNA, 2673 bp, Artificial Sequence
  Description of Artificial Sequence: Synthetic coding sequence
atggagggcggcggaaagcctaattcctcttcgaatagcagggacgatggtaactccgtgttccctgccaaagcatccgcgaccggggccggacctgctgccgcggaaaaacgccttggcactcctccagggggaggaggcgcaggagctaaggagcacggcaactctgtatgctttaaagtggacggtggagggggcggggggggaggcgggggaggtggcgaagagcctgcaggaggttttgaggacgccgagggccctagaagacagtatggattcatgcagcgccagttcacatctatgcttcaaccaggcgtgaataagttctctctgaggatgttcggttctcagaaagctgttgaaaaggagcaagagagagtgaagacagcaggattctggattatccacccctattcagattttagattttactgggatctcatcatgctgatcatgatggtggggaatctggtaattattcctgtgggcatcacattcttcacagaacaaactacaaccccctggatcatttttaacgtggcctcggacacagtcttcctgctggacctgattatgaatttccgcactggcacagtcaatgaggactccagcgagatcatcttagaccctaaagtgataaagatgaattatttgaagtcatggtttgtggtggattttattagctctattcccgtggactatatctttctcatcgtagaaaaggggatggattcggaggtgtacaaaaccgcccgcgcactcaggatcgttcggtttactaagattttaagcctgctgcggcttctgcgtctgagccgactgatccgctacattcaccagtgggaagaaatcttccacatgacgtacgatctggcgtctgcagttgtgaggatctttaacctcattgggatgatgcttctcctctgtcattgggatggttgcctgcagtttctggtgccgctcttgcaggatttcccgcccgactgctgggttagcttaaacgagatggtgaatgactcttgggggaaacagtacagctacgcattattcaaggcgatgtcacacatgctgtgtattggctacggggcccaagcccctgtttctatgagcgatttatggattaccatgctgagcatgatagtgggagcaacgtgctacgcgatgtttgtggggcacgccactgccctcatccagagtctggatagctctcgaaggcagtatcaggagaaatacaaacaagtggagcagtatatgagttttcacaagttacccgccgatatgaggcagaagattcacgactattacgagcatcggtatcagggaaagattttcgacgaggaaaatatcctgaacgaactcaatgatcctcttcgcgaagaaatcgtgaactttaactgcagaaaattggtggccactatgccactcttcgcaaacgccgatccgaatttcgtgacagctatgctctccaaattacgctttgaggtttttcaaccaggcgactatattatccgcgagggggccgtcggtaagaaaatgtatttcattcagcacggggtagcgggtgtgatcacaaagtccagcaaagagatgaaactgaccgacggtagctatttcggggagatctgtctgttgactaagggaagacggacagccagcgtgagagcggacacctattgcagactctatagccttagcgtcgacaatttcaacgaggttttagaagaataccctatgatgagacgggcgttcgagactgttgcgatcgaccgtctcgacaggatcggaaagaaaaactccatccttcttcagaaattccagaaagatttaaatacgggggtgttcaacaaccaggaaaatgaaattctgaaacaaattgtcaaacacgatagagaaatggtgcaggccatcgccccaattaactatccccagatgacaaccctgaacagtactagttcaacaacaacgcctacgtcccggatgaggactcagtccccaccagtctatacagctacatccctgtctcatagcaacctgcactcacccagcccatccacccagaccccccagccatccgccattttaagcccttgttcctatacgacggctgtgtgcagcccacccgttcagtcccccctggccgcccgcactttccattacgcctcgcccactgcatcccagctttcactgatgcagcaacagccacagcagcaggtgcagcagtcacagccaccccaaacccagccacagcagcccagtccacagccccaaaccccgggctcaagcacacctaagaatgaggtccacaaaagcacccaggctctgcataataccaaccttacaagagaagtgcgtccattgagtgcatctcaacctagtctcccacatgaggtaagcaccctcattagcagacctcatcctacagtcggggaatcactcgcttccattccccagccagtgactgctgtgccaggaacagggctgcaagccggaggtcgaagtactgtaccccagcgggttactctgttccgtcaaatgtcatccggagccatcccaccgaacaggggggtcccaccagccccacccccacctgccgcagctctgcctcgagagagctcctctgttctgaatacagatccagacgcagagaagcccagatttgccagcaatctgtag

SEQ ID NO: 26788 - DNA, 1170 bp, Artificial Sequence
  Description of Artificial Sequence: Synthetic coding sequence
atggaaccatctgctaccccaggagctcagatgggcgtacctccaggtagccgtgagcctagtccagtgccgcctgattacgaagacgagttcctgcgttatctttggagggactacttgtatccaaagcagtacgagtgggtgctcattgccgcctacgtcgccgtgttcgtggtagcgttagttggcaatacactagtgtgtctcgcagtttggcggaatcatcacatgaggacagtgacgaattacttcatcgtaaacttatcactcgctgatgtgcttgtgacagcgatttgccttccagcctcactgctcgtggacataaccgagagttggctattcgggcacgccctttgcaaagtaatcccatacctgcaggcagtgagcgtgagcgtcgccgtgctgactctgtcctttattgcgctggaccgatggtacgcaatctgccaccccttgctcttcaagtctacagcaagaagagcccgtggatctattctcggtatttgggccgtcagcctggccattatggtcccccaggccgccgtaatggagtgtagttcagtcctgcccgaactggccaacagaacacggctgtttagcgtatgcgacgagcggtgggcagacgatctgtacccaaagatctatcattcttgttttttcattgtgacatatttagccccactaggtctgatggcaatggcctattttcagatctttaggaaactgtggggcagacagatcccgggcacaacttccgctttggtgcgcaactggaaaaggccctccgaccagctgggagacctagagcagggactctcaggtgagccccagccacgggccagggcgttccttgctgaagtgaagcagatgagagcacgcaggaagactgccaagatgctgatggttgtccttctcgtgtttgctctttgttacctgcccattagcgttcttaacgtgctcaaaagagtatttggtatgtttcggcaggcatctgatagagaggccgtctacgcctgcttcacatttagtcattggcttgtgtatgccaattccgcagctaatcccattatctacaatttcctatcaggatgtaaggagaaatctctggccctctcctgccccagttgtcccggacacgacccacacctggccgcagcactgtgttcatag

SEQ ID NO: 26789 - DNA, 1278 bp, Artificial Sequence
  Description of Artificial Sequence: Synthetic coding sequence
atggagccttctgcaacccctggggcacagatgggggtaccccctggttccagggaaccctcgcccgtacctcctgactatgaagatgaattcttgcggtatctgtggagagactacctgtacccgaagcagtacgagtgggttttaatcgccgcttacgtggccgtgttcgtggtcgctttggtaggaaacacgctagtgtgcctggcagtctggcgtaatcatcacatgcggacggtgaccaactactttatcgttaatctatccctggcggacgtcctggttaccgccatttgtctccccgcctcactgctggtggatataaccgagagctggctcttcgggcatgctctctgcaaggttataccatacctccaggccgtctccgtcagtgtggccgttttaacgctgagctttatcgcccttgacaggtggtacgctatttgccatcctctgctgtttaagtcaacagcacggcgcgcccggggttcaatcctcggcatctgggctgtgtccctagctattatggtcccacaggccgccgtgatggagtgctcatccgtgcttcccgaactggcaaaccgaactaggctattctcagtgtgtgacgaacgttgggccgacgatctctatcccaagatttaccatagctgcttcttcattgttacctacctcgctccgctgggactcatggcaatggcttactttcagattttcaggaagttatggggtcgtcagatcccaggaaccacaagcgcccttgtgagaaactggaagcgccctagtgaccagttaggagacctggagcagggcttgtccggggaacctcaaccgcgtgctagggccttcctggccgaggttaaacagatgcgggccaggagaaaaacagccaagatgttgatggtggtgctgttggtcttcgcactgtgctatcttccaatatcggtgctaaatgtacttaagagagtgttcgggatgtttcgccaggcctccgaccgagaagctgtgtatgcctgtttcacgttttctcactggctggtttacgccaatagtgctgccaatcctatcatctacaactttctttcaggtaaattcagagaacagttcaaggccgccttttcctgttgcctgcctggactgggcccgtgtggcagcttgaaagctcccagtcccaggtctagtgcctcccacaagtcactctccttacagtcaagatgttctatctcaaaaatcagcgaacacgtggtgctgacatcagtcacgacagtcctgccctag

SEQ ID NO: 26790 - DNA, 1278 bp, Artificial Sequence
  Description of Artificial Sequence: Synthetic coding sequence
atggagccttccgccacaccgggggcccagatgggagtgcctcctgggagccgagaacctagccccgttccacctgattacgaagatgagtttctgcggtatttgtggcgggattatctataccccaagcagtacgagtgggtgctcatcgcggcatatgtagctgtgtttgtcgtggccctggtgggcaacacgctcgtgtgccttgccgtatggagaaaccaccatatgaggaccgtcaccaattacttcattgttaatctaagcctcgcggatgttctggtgaccgccatctgcttacccgcatctctactcgtggatatcaccgagagctggctgttcggacacgccctatgtaaggtgatcccctatctgcaggctgtaagtgtgtctgttgcagttctgacactgtccttcattgcactggaccgctggtatgccatctgtcacccacttctgttcaagagcactgctcgcagagcgcgtggttctatcctgggcatctgggccgtgagtctcgccataatggttccgcaggctgcagtgatggaatgcagcagtgttctgcctgaattggccaacaggaccaggctgttttctgtgtgtgacgagcgctgggctgatgatctctacccaaagatctatcacagctgttttttcattgttacttacctggcaccattggggcttatggcaatggcttattttcagatttttagaaagctgtggggcagacagatacctgggaccactagcgctctggtgcgtaattggaagcggccctccgatcagctgggtgatttggagcagggtctcagcggagaaccacagcccagagcccgggccttcctggctgaagtgaaacagatgagggcccgaagaaaaactgcgaagatgctcatggttgtgctccttgtgtttgctctatgctatttacctatctctgtcctgaacgtgctcaaaagggttttcggtatgttccgtcaagcttctgatcgggaggctgtgtacgcttgttttaccttctcccattggctggtgtacgccaactcagcggctaacccaattatctataattttctgtcaggaaaattcagagaacagtttaaagccgcgttctcttgttgcctgcccgggttgggaccctgcggctctctaaaggcaccgtcaccacggtcatcagcaagccacaagtctctttctctgcagagccgatgcagcatctccaagataagtgagcacgtagtgctgacatccgtgactaccgtactcccttag

SEQ ID NO: 26791 - DNA, 1335 bp, Artificial Sequence
  Description of Artificial Sequence: Synthetic coding sequence
atgagcggaaccaagctggaagattcacccccatgtcgcaactggtcctctgcctcagagctgaatgagacacaggagcccttcctaaatcctactgactacgacgatgaagagttcctcagatatctgtggcgggagtatctgcatcctaaggagtacgagtgggtgctaattgcagggtatattattgtgttcgtcgtggctctgatcggtaatgtccttgtgtgtgtggctgtgtggaaaaaccaccacatgcgcacagtgacaaactacttcattgttaatctgtccctggcggacgttctcgtcaccatcacctgcttgcccgccactctggtcgtggatatcaccgagacatggttttttggacaaagcctttgcaaagtgatcccctaccttcagacggtaagcgtgagcgtgtccgtgttaacactctcatgcatcgccctggacagatggtacgccatttgtcatcctctgatgttcaagtctactgctaaaagggcccgcaattctatcgtgattatttggattgtgtcttgcattatcatgattcctcaagcaatagtgatggaatgttcaacggtcttccctggactcgctaataagactaccctgttcactgtgtgtgacgagcggtggggtggggagatatatccaaagatgtaccatatctgcttcttcctcgttacctatatggctcccctgtgtctcatggtcctggcgtacctccagatcttccggaaactgtggtgcagacagatcccaggtacatcctccgtagtccaacgcaaatggaaacctctgcagcctgtgagccaaccccgaggccccggccagcccaccaagtcacggatgtccgccgtcgctgccgaaatcaagcagattcgggccagacggaaaacagcgagaatgttaatgatagtcctgctagtttttgctatctgctatcttcctatatcaatcctaaatgtgctgaagagagtttttggaatgttcgcacacactgaagatagggaaacagtgtatgcgtggttcacatttagtcactggttggtttacgccaattctgctgccaaccccattatatacaacttcctcagcggcaaatttcgcgaggagttcaaggccgcattctcctgctgctgcttgggcgtgcatcatcggcaagaagataggctgaccagaggaaggaccagtacggaatctagaaagagcctgaccacacagataagtaatttcgacaacatctccaaactatcagagcaggtagtgctgaccagcattagcacactcccggcagccaatggggccggtcctctccagaactggtag

SEQ ID NO: 26792 - DNA, 1134 bp, Artificial Sequence
  Description of Artificial Sequence: Synthetic coding sequence
atgtctgaagtgaagtctaggaaaaagtccggaccaaaaggagcccctgctgcagagcctggcaaaagaagtgagggcggaaagaccccagtggccaggtcctctggaggcggcggctgggccgaccctaggacatgcttgagtctcctctccttggggacgtgcttgggactggcctggtttgttttccagcagagcgagaaatttgccaaggtggaaaatcagtatcagctgctcaagctcgaaacaaacgagtttcagcaactccagtctaagatttcactaatctctgaaaagctggagagcacggagtctattctgcaggaggccacttcatcgatgtcactcatgacccagtttgaacaggaggtgagcaatctccaggacatcatgcacgacatccagaacaatgaagaggtgctcactcagcgaatgcagtctttaaatgaaaaattccaaaacatcacggatttttggaaaaggtccctcgaggaaatgaatatcaatacagatatatttaaatccgaagctaaacatatacattcacaggttacagtccagatcaattccgctgagcaggaaatcaagctgctcacggaacgtctgaaagatttggaggactctaccctgaggaacattcggaccgtgaaacggcaggaggaggaagatttgctgagagttgaagagcagttgggtagtgacaccaaggccatcgaaaaactggaggaagagcagcacgcgcttttcgcacgggatgaggacttgacgaataagctcagcgattatgaacctaaagtggaggaatgcaaaacccatctccctaccattgagtccgctatccatagcgtgctaagagtgtcccaggatctaatcgagactgaaaagaagatggaagatctgactatgcaaatgttcaatatggaggacgacatgctgaaagctgtctccgaaattatggagatgcaaaagaccttagagggcatacagtatgataatagtattctaaagatgcagaatgaactggatatccttaaggagaaagttcatgattttattgcctactccagtacaggtgaaaaaggaacattgaaggaatacaatattgaaaataagggcatcgggggggacttctag

SEQ ID NO: 26793 - DNA, 1053 bp, Artificial Sequence
  Description of Artificial Sequence: Synthetic coding sequence
atgagtgaggtgaaatctagaaaaaaatccggcccaaagggggcgcccgcggcagaaccaggcaaaagatctgaggggggtaagacacctgttgcaagatctagtggaggtgggggctgggctgatcctcgaacttgccttagtctcctcagcctcggaacctgcctgggcctggcatggttcgtatttcaacagagcgagaagtttgcgaaggttgagaatcagtaccagctcctgaagttggagactaacgaattccagcaattgcagtctaaaatatccctgatttccgagaaatggcaaaaatctgaggcaattatggagcagttaaagtctttccagatcattgctcacctaaagagacttcaagaggaaataaacgaggtgaagacctggtcaaaccggatcactgagaaacaggacattttgaacaattcacttacaacacttagccaggatattaccaaagtggatcagtccactacgtcaatggccaaggatgtggggcttaaaattactagcgtcaaaaccgatatccggagaatctcaggactagtgaccgacgttattagcctgaccgattccgttcaggagctcgagaataagattgagaaggtcgagaagaatactgtaaagaatattggagacctgctttcctcctccattgatcggacagccacacttcgtaagaccgcttctgaaaattcacagagaatcaattcggtcaaaaagacgctgacggaactcaaaagtgatttcgataaacataccgaccgattcctgtctcttgagggagacagggcaaaagtactgaaaaccgtgacctttgcaaacgacctcaaaccaaaagtatataacctgaagaaggactttagccggttagagccgttagtcaatgatcttactctccgtatcgggcgcctcgttaccgaccttctccagcgagaaaaagagattgccttcttgtctgaaaagatatctaatctgaccatagtccaggcagaaatcaaggacatcaaggatgaaatagcccatatctccgatatgaactag

SEQ ID NO: 26794 - DNA, 213 bp, Artificial Sequence
  Description of Artificial Sequence: Synthetic coding sequence
atgagcgaagtcaaatctaggaagaagagtgggcccaagggagctcctgctgctgaacctggtaagcggtctgaaggtgggaaaactcccgtagccagatccagtggagggggagggtgggccgaccctcggacatgcctcagccttttatctctgggaacatgccttggcctggcctgtggtcgcaatttaaagctgtcgtggaataactag

SEQ ID NO: 26795 - DNA, 735 bp, Artificial Sequence
  Description of Artificial Sequence: Synthetic coding sequence
atggagcagctgaagtcattccaaatcatcgcgcatctgaagcgattgcaggaagagattaacgaagtcaagacatggtctaatcgaattaccgaaaagcaagatatcttgaacaatagtctcaccactctgagccaggatatcacgaaggtggaccaatcgacaactagtatggccaaggacgtgggactaaaaatcacctccgtgaagacagacattagacgcatttctggtctggtgaccgatgttatctcactaaccgactctgtgcaggaacttgagaacaagatagagaaagtagaaaaaaacactgtcaagaacatcggggatctgttatcaagttccattgaccgcacagcaactctgaggaaaactgcatcggagaatagccaaagaatcaacagtgtgaaaaaaacactgactgagctaaagagcgatttcgacaagcacaccgatcgcttcctatcactggagggcgacagagccaaggtcttgaagactgtcacttttgcaaatgacttaaaacccaaggtgtacaacctgaaaaaagatttctcccgccttgagccactggtgaatgatcttacattgaggattggccgccttgtgactgacctgctgcagcgcgaaaaagaaatagcttttctgagtgagaaaattagcaacttgacaattgtgcaggcagagatcaaagatatcaaagacgaaatcgcacacatctccgatatgaattag

SEQ ID NO: 26796 - DNA, 2445 bp, Artificial Sequence
  Description of Artificial Sequence: Synthetic coding sequence
atggcagtacagagagcagcctcaccaaggaggccacccgctccactgtggcctcggctgctgctccctctacttctgctgctgttaccggctccctccgagggactgggacactcagccgagcttgccttcgcagtagaaccttccgacgatgtggccgtgccaggccaacctattgtgctggattgccgcgtggaagggacacctcccgtccgcataacttggaggaaaaatggggtggaactgcccgagtccacccacagtacactgctggcaaatggcagtctgatgatacgtcacttcaggctagagccaggcggtagcccgtccgatgagggcgattacgaatgcgttgcccagaatcgttttggcctagtcgtttccagaaaggctcgtatccaggcagccacgatgtcggactttcatgttcaccctcaggccactgtaggggaagagggaggcgtggccaggtttcagtgccagattcatgggctgccgaagccccttattacctgggaaaagaatcgagtgcctatagataccgacaatgaacgctacacgttgcttccgaagggtgtgctgcagatcacaggactcagagcagaagatggcggcattttccactgcgtcgcctcgaacatagcatccatacggatctcccatggcgcacgcctgactgtttctggatccggctctggggcgtataaagagcctgcaatcctggtgggccctgaaaacctcacactgactgtgcaccagacggccgtgctcgagtgtgtggcaactggaaacccacgaccgattgttagctggtcgcgcttagatggccgacctatcggagtggaggggatccaagtgttaggtacaggcaatctgattatctccgatgtgacagtgcagcactcaggtgtatacgtgtgtgctgctaaccggcctggtactcgcgtgcggcgaacggcacaggggcggctcgtggtccaggcccctgccgagttcgtgcagcaccctcaatcaatcagccggcctgctggaaccaccgctatgtttacctgccaggcacagggcgaacctcctcctcacgtgacatggttgaagaacgggcaggtgctgggacccggtggccacgtgcgtctgaaaaacaataatagcacactgactatctcaggaatcgggccagaggacgaggccatctaccagtgcgtcgctgaaaatagcgccggctcatctcaagcctcagctcgtctcacagttctttgggcagaaggtcttccggggccccctagaaacgtccgggcagtaagtgttagttccactgaagtgcgagtttcctggagcgagcccttggccaacaccaaggaaataataggctatgtgcttcatatcagaaaagcagccgatccccccgaactcgaatatcaagaagcagtttctaagtcaacttttcaacatctggtctccgacctggagccctccaccgcttattcgttctacattaaggcatatactccgcgcggtgcatccagtgcatctgtacccaccttggcttccactctgggggaggctccagcccccccgccacttagcgttcgggtgctaggtagctcatctttgcagctcctttgggaaccgtggccccgactagcgcaacatgagggcggttttaaactgttttataggcccgcttctaaaacatcctttaccgggcccatcctgttgcccgggaccgtttcctcttacaacttaagccaactggaccctactgcagtctacgaagtcaaattacttgcatacaatcagcatggggatggtaacgcaaccgtacgattcgtgagcctgcgcggagctagcgagcgcacagcactcagccctccatgtgattgcaggaaggaggaggcagcgaatcaaacctccactactgggattgtgatcggcatccatattggcgttacatgcattatattctgtgtcttgttcctgctgtttggccagcgggggcgcgtcttgctgtgtaaagacgttgagaatcaactgagcccaccacagggcccgcgatctcagcgtgatcctggaattctggccctgaacggagcgcggagaggccagagagggcagttaggacgcgacgagaagcgcgtcgatatgaaagagctggaacagctcttccctcctgctagcgcagcaggacagcccgaccctaggcccacacaggatcccgccgccccggccccttgcgaggaaacccagctgtccgtcttgcccctacaggggtgcggcctgatggaaggcaaaacaactgaggctaaaaccacagaggccacagctccctgtgccggcttggccgccgccccccctccaccagacggcggcccgggtctcctaagcgaggggcaggcctcccgaccagctgccgctcgcgtgactcaaccggcccacagcgagcagtag

SEQ ID NO: 26797 - DNA, 1914 bp, Artificial Sequence
  Description of Artificial Sequence: Synthetic coding sequence
atgagcgactttcacgtacatccgcaggcaacagtgggagaagagggcggagttgcccgtttccagtgtcagattcacggcctgcccaaaccccttataacttgggagaagaatcgggtgcctatcgacacagacaatgagcgatatacgcttctcccaaagggagtcctgcagatcaccggtttgagggctgaagacggtggaatttttcattgtgtggcatccaacatagctagtatccgaatcagccatggcgctcgcctgacagtgtccggctccggtagcggtgcttacaaggagccggccatattagtgggccccgaaaacttaaccttaacagtgcatcaaaccgcggtcttggagtgcgtggctaccggcaatccgaggcctatcgtgagttggtcgcgcttggacggacggccaattggggtggaaggcatccaggtgctggggactggaaacctcattatcagtgacgtaacagtgcagcatagcggcgtttatgtgtgcgccgccaacagaccagggactagagtgcgacgtactgctcagggacgactggttgtgcaggccccggctgaattcgtgcagcatcctcagtcaatctcccgtccagccggcacgacagccatgtttacatgccaggctcaaggcgaaccgccaccgcacgtcacctggctgaaaaacgggcaagtgctgggccctggaggacacgtcagactcaaaaataacaacagtactttgactattagtgggattggccctgaggacgaggccatatatcagtgtgtcgcagagaactccgccgggagttctcaggcatccgctagactgacggtgctgtgggccgagggtctgcctgggcccccaagaaacgtgcgcgcggtgtccgtgagcagcactgaagttcgcgtgtcctggtccgaaccacttgctaatactaaagagattatcgggtatgtgttgcacatcagaaaggccgcagatcctccagaactggaatatcaggaggccgtgagtaagtctacctttcagcacctcgtatccgacctagagcccagcacagcatattctttctatattaaagcttacactcccaggggcgcatccagcgctagtgtgcccactcttgcttccacactcggggaagcgcccgcgccaccacccttgtccgttcgggtcctggggtccagctcccttcaactgctgtgggaaccatggcctcggttggcccaacacgagggaggttttaagcttttttatcggcccgcctcgaagaccagcttcaccggtcccatattgcttcctggtactgtgtcttcttacaacttgtctcagcttgatcccacggcggtgtacgaggtaaagttactggcatacaaccagcacggcgatggaaatgcaaccgtgcgatttgtcagcctgaggggcgcttccgaacgtaccgcacttagcccaccttgtgattgcagaaaagaagaggcggctaaccagacctccaccacggggatcgtgatcgggatccatattggagttacttgtattatattctgtgtgctatttcttttgtttgggcagcggggccgggttctgctatgtaaggacgtggacatgaaggagctggaacagctgttccccccggcgtctgctgcggggcagcctgatccacgccctactgatcccgccgctcccgctccctgcgaggagacccagctgtccgttctgccactccaaggctgtgggctaatggaaggaaagacaactgaggccaagaccaccgaggccactgcgccatgtgctgggctcgctgccgcaccacctcccccagatggggggccaggcttgttatctgagggccaggcttctcgtcccgccgctgcacgggtgacacagccagcgcactctgagcagtag

SEQ ID NO: 26798 - DNA, 3753 bp, Artificial Sequence
  Description of Artificial Sequence: Synthetic coding sequence
atggcgcgaggcgatgccggaagagggagaggcctgctcgcgctaaccttttgccttctagcagcgaggggggagctgctgctcccacaagaaactactgtcgagctctcgtgtggcgtggggccactgcaggtgatactcggacccgaacaagcagccgtgctcaactgcagcctcggcgccgccgcggccggccctccgactcgggtgacatggagtaaggatggcgatactttacttgagcacgatcaccttcacctgttacctaacggcagcctctggctatctcaacctctggcccctaacgggagcgatgaaagcgtccctgaagcggtgggggtgatcgagggcaattactcttgcctggcacatggacctctgggcgtactggctagccagacagctgtcgttaaactggccactttagcggactttagcctgcatcctgagtctcagactgtggaggaaaacggcacagcccggtttgagtgccatattgaggggctgcctgcaccaatcatcacatgggaaaaggaccaggtcactttacccgaggaacctagacttattgtgctccccaacggggtcctgcaaatcctcgacgtgcaggagagtgatgcaggcccgtaccggtgcgtggccaccaattcagcgcgacagcatttctcccaggaagctctgctgtcagttgcccacaggggatcactggctagtacaagaggtcaggatgttgtgatcgtcgctgcacctgaaaacaccaccgtggtttccggccagtccgtggtgatggagtgcgtggcgtccgccgacccaacccccttcgtctcttgggtcagacaggacggaaagccaattagcactgatgtaatcgttttgggacgtaccaacctgttgattgccaacgctcagccttggcatagcggggtgtacgtctgtcgagccaataagccacgcacccgagacttcgcaactgcagcagcagaactccgggtactagcggcccccgccattacgcaggcgccggaggcattgtcgaggaccagggcgagcaccgccaggttcgtgtgccgggcaagcggggagccaagacccgcattgaggtggctgcacaatggggctcctctgcgacctaacggaagagtgaaagtgcagggcggtggaggatccctggttatcacgcaaatcggtttacaggacgccgggtactaccagtgcgtggcagagaatagtgcaggcatggcctgcgccgcagcctctctagccgtggttgtgcgtgaaggcctgcctagtgctcccacgagagtgacagccactcccctgagctcttccgctgtgctggtggcttgggagcgaccagaaatgcacagcgaacagatcataggcttctccctgcactatcagaaggccagaggaatggacaacgtggaataccagtttgcagtgaacaatgataccactgagctccaggtgcgcgacctggagccaaacacagactatgagttttacgtcgtggcatacagccagctgggtgctagccggaccagtacccccgccctcgtgcataccctggacgacgtcccctccgcggcgccgcaactcagtctgagcagcccaaatccatcagatatccgtgtagcgtggctgcctcttcccccttcactatccaacggtcaggtcgtgaaatataagatcgagtatggcttaggcaaagaggatcagatcttcagcactgaggtgcggggaaatgagactcaactgatgcttaattctcttcaaccaaataaggtgtacagagtgcggatcagcgccggaactgctgctgggtttggtgccccatctcagtggatgcatcatcgcacacctagcatgcacaatcagagccatgtaccatttgcgccggcagagctgaaagtccaggcaaagatggagagcctggtggtgtcctggcagccgccaccacaccctacccagatctccgggtacaaactctattggagagaagtgggggcagaggaggaagctaacggagacaggctccccggcggcaggggggatcaggcctgggacgttggtcccgtccgtctcaaaaaaaaggtgaagcagtatgaactgacccagcttgtgcctggccgtctttacgaagttaagctggttgcattcaacaagcacgaggacgggtatgccgccgtttggaagggaaagacagagaaggccccagcccccgacatgcccattcagcggggacctcctttgccgcctgcacacgtgcatgcggagtccaacagctcaacttccatttggctgcgctggaagaagcctgactttactaccgtgaagatcgtcaattacacggtaaggttttcgccctgggggttgaggaacgccagtctcgtgacttactacacttcaagcggcgaggatattttgatcgggggcctcaagcctttcactaaatatgaatttgcggtccagagtcatggggtggatatggatgggcccttcggctctgtggtggaaaggtctaccctgcctgatcgaccatcgactcctcctagtgacttgcgtctctcaccactgaccccttcaacggtaaggctccactggtgtccccccacagagccaaatggagagattgtcgagtatttgatcctttatagcagcaatcacacccagcccgagcaccaatggactttgctgaccacacaagggaatatcttctcagctgaggtgcacggattggagtctgatacccgctacttcttcaaaatgggcgctaggacagaggttgggccagggccattttcacggctccaagatgtcataaccctgcaggagaagctctctgattccctggacatgcatagcgtaaccggaattatcgttggggtctgtttgggcctgctgtgtctactggcttgcatgtgcgccggcctacgccgctcccctcatcgcgagtcattgcccggactgagctcgaccgcaacccctggaaaccctgcattgtactctcgcgctcggctcgggccaccttcgccgcccgcagcccacgagctagaaagcctggttcacccacacccacaagactggagccctcccccctcagatgttgaggaccgggcagaggtgcattcccttatgggcggaggcgtgagcgaaggcaggtctcacagtaagaggaaaatatcttgggctcagccttcaggactctcatgggcaggatcctgggctggctgtgaactgccccaggccggcccccggccagccctcacccgcgccttgctgccacccgcgggcacaggccagacactcttgttgcaggctctggtctacgacgccattaagggcaacggaagaaaaaaatcccctccggcctgtaggaaccaggtcgaggcagaggtaatcgtgcacagtgatttcagtgcttcaaacggcaacccggacctccaccttcaggatctggagcccgaggacccactgcctcctgaggccccggatttgatatcaggagtcggggatccaggtcaaggcgccgcttggctagacagagagttgggcggttgtgagcttgcggccccaggacctgataggctgacatgtctgccagaagctgcatcagcgtcatgctcctatccagatctgcagccaggcgaagtcttagaagagaccccaggagactcttgtcaacttaagagcccgtgcccactgggcgcttcccctgggctccctcggagccccgtgagcagtagtgcatag

SEQ ID NO: 26799 - DNA, 2940 bp, Artificial Sequence
  Description of Artificial Sequence: Synthetic coding sequence
atggggcgcagaaaagggagatccgctttgtcgcgcagcagcctcgagagagttaatcaaggggaagtcaaagtgattggacgtggggctcgggaagggggcgggggacaggcatggggcaccggcggcggtcgcgacctgtcctgtggcataccccgctcggcaagcccactagcccctttggctgcccccgccatcactcaggcccccgaagcactgtctcggacgcgagcgagcacagcccgattcgtgtgtagggccagcggcgaacctagacctgcacttcgatggctgcataatggagcccctttgcgcccaaatggtagagtgaaagtacagggcggaggaggtagcctagttattacacaaattgggctgcaggacgccggctactatcagtgtgtcgccgaaaattcagctgggatggcatgcgccgccgcatccttagccgtagtggtgcgggaaggcctgccctctgcccccacaagggtcaccgccacccccctgtccagctctgcagtcctggtggcatgggagcgccccgaaatgcattccgaacagatcattggatttagcctgcactatcaaaaagcccgagggatggataatgttgagtaccaatttgcagtaaataatgataccaccgagctccaggttcgggatttggaacccaatacagactatgagttctatgttgttgcctatagccagttgggagcaagccgtacctccactccagcacttgttcataccctggatgacgtcccctccgcagcgcctcaattgagcctctcatcacctaatccctctgacatacgggtggcatggctacccctgccgccaagcctctctaatggacaggtggtaaagtacaaaatcgagtatggtctggggaaagaagatcagatcttctcaactgaggtgcgtggaaacgaaacacagctgatgctgaattcacttcagcctaataaggtatatcgcgtcagaatttcagccgggactgctgcaggattcggcgcaccatcacagtggatgcatcataggactccgtccatgcacaaccagtcgcacgtcccatttgccccagccgagctcaaggtgcaggccaaaatggaatctctagtggtatcctggcagcctccccctcaccctacccagatatcaggatacaagctttactggcgggaagtgggagctgaggaagaagctaatggagatcggcttccagggggcagaggcgaccaggcttgggatgtgggcccggtccggcttaagaagaaggtgaagcagtatgagcttacacaactcgttcctggacgcctgtacgaggtgaaattggttgccttcaataagcatgaggacggctatgctgccgtctggaagggaaagacagagaaggcacctgcaccagatatgccgatacagcgcgggcccccgttgccaccagcccacgttcatgccgagagtaacagtagcacttcaatttggctgcgctggaagaagcctgatttcaccaccgtcaagatcgtcaactacaccgtgagattttccccctggggcctccgaaacgcttcactcgtgacatattacacctcatcaggcgaggacatcctgatcggaggcctcaagcccttcaccaagtacgaattcgccgtccagagtcatggcgttgacatggacggaccctttggcagtgtggtcgagcggtctaccctgcccgatcggccctctacccccccttctgatttgcggcttagcccactgacgccctccactgtaaggctgcactggtgcccgcccacagaacctaatggagagattgtggagtacttaattttgtattcctcaaaccacactcagccagaacaccagtggacgctgctcaccacacaaggaaacatcttttccgcggaagtacacggcctcgagagtgacactcgctatttttttaaaatgggggcccgcacagaggtcggtcccgggcctttctctcgactgcaggacgttatcactctccaggaaaagctgtctgactccctcgacatgcactccgtgaccggcataattgttggtgtgtgtctgggactgctatgtctattagcttgtatgtgtgctgggctcagacggtctccccatcgggaatctctaccagggctctccagtacagctacccccggcaaccctgcgctttattctcgcgcaaggctgggcccgccctcccctcccgcagcacatgagttagagtctttggtgcacccccaccctcaggattggagtcctcctccatctgacgttgaggacagggccgaggtgcattccttgatggggggcggcgtcagtgaaggccggtcccatagcaaaagaaaaatatcttgggcccagccaagtggactctcatgggccggctcttgggccggatgtgaactgcctcaggcaggtccccgacccgctttaacacgcgccctgctgccaccagcagggacaggacaaaccttgctgctacaggccttggtgtatgatgcaattaaaggcaatggacgaaaaaagtcaccccctgcctgccgcaatcaagtggaggcagaggttatcgttcactctgatttctcagcctctaatggcaatcccgacctgcaccttcaggatcttgagccggaagaccctctgcctcctgaggcccctgacctgattagcggggtgggagatcctgggcaaggggcagcatggttggaccgggagctcgggggttgcgagttggccgctcctgggcctgaccgtctcacttgtttgcccgaagccgccagtgcctcctgttcataccccgatctgcagcctggcgaagttctggaggaaacgccaggagactcttgccagctcaagtccccatgccctctgggagctagcccgggacttccaaggagccctgtgagtagcagcgcttag

SEQ ID NO: 26800 - DNA, 1293 bp, Artificial Sequence
  Description of Artificial Sequence: Synthetic coding sequence
atgtcgctcgtggagctccttctatggtggaattgcttctcccgaacgggagtcgccgcctcactagaagtcagcgagtctcccggatccattcaggtggctcgcggacaaccggcggtccttccctgcacctttacaacatccgccgccctgattaacttgaacgtgatctggatggtaaccccactgagtaacgccaatcagcccgaacaggtcatactgtaccagggcggccaaatgttcgacggtgcgcccagattccatggccgcgtgggcttcacggggactatgcctgctaccaatgtcagcatcttcatcaacaatacccagctgtcagatacgggcacctatcagtgtcttgtaaataatctaccagatattggggggcgcaatatcggcgttacagggctgacggttctggtgccccctagcgctcctcactgtcagatacagggaagccaggacatcgggtcagatgtcattttgctgtgcagctctgaagaggggatacctaggcccacctacctttgggagaaacttgacaacacactcaaactacccccaacggctacccaagatcaggtgcagggaaccgtgacaatccgcaacatctctgcactgtcctctggattgtaccagtgtgtagcctcgaatgcaatcgggacgagcacatgtcttctggacttgcaggtgatcagtccacagcctaggaacatagggttgatcgccggcgccattgggactggggctgttatcattatcttttgcatcgcactcatcctcggcgctttcttctactggcggagcaagaacaaagaagaggaggaggaggagattcccaatgagatcagagaggatgatctaccccctaaatgcagctcagcgaaagccttccacacagaaatctcaagcagtgacaacaacactctcacctcttctaacgcctacaattccaggtattggagcaacaacccaaaggtgcacagaaatactgaaagtgtctcccatttctctgacctcggccaatcatttagtttccactctggcaatgcaaacattccctccatttatgcaaacggaacacacctggtccccggtcagcataagactctggtggttactgcaaatcgaggctctagccctcaggtgatgtccagaagtaatggcagtgtatctagaaaaccaagaccccctcacacccacagctacactatcagtcatgccacgcttgaacgcatcggcgctgtcccggtgatggtgcctgcccagagccgggccgggtccctggtgtag

SEQ ID NO: 26801 - DNA, 1296 bp, Artificial Sequence
  Description of Artificial Sequence: Synthetic coding sequence
atgacaagtcagaggagcccactagcaccactcctactgctttcactacacggagtcgcagcaagtttggaggtgtcagagtcccctggctccattcaggtcgctcggggtcagcctgccgtcctcccatgtacattcaccaccagtgctgccctgattaatctgaatgttatttggatggtcaccccattgagcaatgcaaatcaacctgagcaggtgatcctttaccagggtggccaaatgtttgacggagcccctcgcttccatggccgggttggcttcacggggacaatgcctgcaactaacgtttccatattcattaataatacacagctgtcagacactggcacataccagtgcctcgtaaataacctccccgacatcggaggtcgtaacattggtgtgaccggcctcactgtgctcgttccaccctcggccccccactgccagattcagggctctcaggatatcggcagcgatgtgatactgctgtgcagttcagaggaaggcatccctcggcctacctacctgtgggagaagctcgacaacacccttaagctgcctccaactgccacccaggatcaggtgcaagggaccgtcactatcagaaatatatcagctctaagcagtggcctttaccagtgtgtggcttccaatgcaatcggaacgagcacatgcctgctggatctccaggtcattagtccccaaccgaggaacattggactgattgccggcgcgatcggaacaggcgccgtgattatcattttctgcatcgctctcatcctcggcgccttcttctactggcgatcgaaaaataaggaagaggaggaagaggagatccctaacgagatccgagaggatgatttgccccccaagtgtagctcagcaaaggccttccatacagaaattagttcttccgataataataccctgacatctagcaatgcatacaatagcagatactggtccaataaccccaaagtgcatcgtaacaccgagagtgtctcccacttttcagacctgggacagagcttttctttccatagcggcaacgcgaacattccaagtatctacgcaaacggaacccatctggtaccaggacagcataagacgttggtcgtgacagccaacagaggatccagcccccaggtaatgtcaagatctaacgggagcgtgtctcggaagccacgacccccccacacccactcctataccatttcacacgctacactggagcgcataggcgctgtgccagtcatggtccctgctcagtcgcgcgcaggttccttggtctag

SEQ ID NO: 26802 - DNA, 1293 bp, Artificial Sequence
  Description of Artificial Sequence: Synthetic coding sequence
atgtcactggtagagctccttctatggtggaattgctttagcaggacgggagtggcagcttctttggaggtgtctgagtccccaggctccattcaggtggcccgcggccagccggccgttttgccgtgcacattcaccacgtcggcagctctcatcaatttgaatgttatatggatggtgactcccctgagcaatgcaaatcaacctgaacaggtgatcctgtaccagggtggacagatgttcgacggggccccaaggttccacggaagggtgggcttcactggtactatgccagccacaaatgtgtcgatctttataaataacacacagctctccgatacaggtacttaccaatgtctcgtcaataacctgcctgacattggcgggaggaatattggggttactggtctaactgtgttggtgccaccatccgctcctcactgccagatccagggcagccaggacatcgggtcagatgtgatcttactgtgttcatctgaggagggtattcctaggcctacctatctgtgggaaaagctggataatactctcaagctgccaccaacagcgacacaggatcaggtccagggcactgtgacaattcgaaatatctccgccctgtctagtggtttgtaccagtgtgtggcgtcaaacgcaattggaactagtacctgcctgctggaccttcaggtgatttcgcctcagcctagaaacattggactgatagcaggcgccatcggaacaggggccgtgatcatcatcttctgtattgctctgattttaggtgcgttcttttattggcggagcaaaaacaaggaggaggaggaagaggaaatcccaaatgaaatacgcgaggacgacctccctcccaagtgctcgagtgccaaagcctttcatacagagattagctccagtgacaataacaccctgacaagttcaaatgcctataactctcgatactggagcaacaatcctaaggtacatcgcaacacggagagtgtctcgcacttttcagacctcggccagtcgtttagcttccattcgggcaacgccaatatcccaagtatatatgctaacggcacgcacttggtaccaggccagcacaagaccctcgtagtgacagccaatagaggttcgtcaccgcaggtgatgagccgctccaatggcagcgtcagccgaaaaccacgccccccgcacactcactcctacacgattagccatgccactctagagcggattggagccgtccccgtgatggtaccagctcagtcccgcgcgggcagcctagtctag

SEQ ID NO: 26803 - DNA, 579 bp, Artificial Sequence
  Description of Artificial Sequence: Synthetic coding sequence
atgcgtgctaagcctcagtctccgctgcccaggaatccggttccagcctggtccccaccaaccactacaactgatcctatgctcgaaaaggatgccgctgggggggactttccagccaacctggtcttgcaacttatgcccctgaaaacctttcctgccgccatccgcggtgtcatccaatctgaattgaactattccgtgattttgcagtgggttgtgacgatggatcctgaaccagtgctgtcctggaccttttccggcgtgccctgcgggatgggcgagaagctgtttattcggcgattaagctgtgaacagctcggcacttatatgtgtatcgccacgaatagcaagaaacagctagtgtcagagccagttaccatctccctccccaaaccgatcatgcaacccaccgaagccgaacccatggagccagatcccacgttgagtctgagcggtggtagcgctatcggcctcctcgcagccggaatcctgggagcaggcgcattgatagctgggatgtgcttcattataatccagtcattgcgcacagatagacagagaatagggatttgttcatag

SEQ ID NO: 26804 - DNA, 1224 bp, Artificial Sequence
  Description of Artificial Sequence: Synthetic coding sequence
atgggccaaaaagaaaggtctacagccgatacattgccagatctagaggaatggaaatctgccgcagggctccggtggtggcagactgcagtggtggacggatctggcagcggaaatgaagtgattgagggccctcaaaacgcccgggtgctcaagggctcgcaagctcgctttaactgcaccgtgagccagggatggaaactgatcatgtgggctctgtcagacatggtcgtcctgagcgtgagacctatggagccaattatcaccaacgacaggtttacaagtcagcggtatgaccaaggtgggaattttacttcagaaatgattatccacaatgttgagccttctgatagcggaaacattaggtgtagtctgcagaatagcaggcttcatggcagcgcttaccttactgtgcaggttatgggagagctgtttatcccctctgtaaacttagtcgtggcggagaatgaaccttgtgaagtgacttgcctgccctcccattggaccagacttcctgatattagttgggagctgggcctgctagtctcccactctagttattatttcgtcccagagccctcagatttgcaatctgccgtttccatcttagccttgaccccccagagtaatggcaccctcacctgtgtggctacatggaagtcactgaaggccagaaagagcgctacagttaatctcaccgtgatccggtgcccacaggacaccggtggcgggataaacattccgggggtgttgtcctctctcccatccttagggttctccctccccacctggggcaaggtgggtttaggtcttgctggtaccatgctgttgacgcccacgtgcactctcacgatcagatgctgctgttgtcggcgcagatgctgcgggtgcaactgttgttgcagatgctgcttttgttgtaggcggaaacggggatttcgcatccagttccagaaaaagagcgagaaggagaagactaacaaggagactgagactgagagcgggaatgagaacagcgggtataactctgacgagcagaaaactacagacacagcgtctcttcctcctaaatcatgtgagtcgtccgaccctgagcagcggaactcttcctgtggtcccccccatcagagggcagaccagagaccccctcgaccagcttcacatccccaggcttctttcaatctggcatccccagaaaaagttagcaataccacggtggtctag

SEQ ID NO: 26805 - DNA, 1920 bp, Artificial Sequence
  Description of Artificial Sequence: Synthetic coding sequence
atggaccgggttctcctccgttggatctctttgttttggttaactgcgatggtggagggactccaggtgaccgttcccgacaagaagaaagttgccatgttattccaaccaacggtccttcggtgtcatttttctacttcttctcatcaaccagctgtggtgcagtggaaatttaaatcttattgccaggatagaatgggagaatctctcggaatgtcttcgactagagcacagagcctgtcaaaacgcaacctcgagtgggacccgtacctcgattgcctggatagtcgccgcactgtccgggttgttgccagcaaacaagggtccactgtgaccctgggcgatttctatagaggacgagagattacgatcgtccacgatgccgatctgcagatcgggaagctaatgtggggcgactccggcctgtattattgtatcattactactcctgacgacctggaaggtaagaatgaggacagcgtggaattactagttctgggtagaaccgggctgctcgccgacctgctaccgtccttcgcagtggaaattatgcccgaatgggtctttgttgggctggttctgttgggagtgttcctcttcttcgttctggttgggatctgctggtgccagtgttgcccacatagttgttgctgctacgttaggtgtccttgctgtccagattcttgttgctgtcctcaggctctgtacgaggcaggcaaggcggctaaggccggataccccccatctgtgagtggagttccagggccttacagcataccttcagtgcctctggggggtgctcccagttctgggatgctgatggacaagccccacccaccacctttagctcctagcgattcaacgggcggatctcattcagtgcggaaaggctatcgtatacaagctgacaaggaaagagactccatgaaggtgctctactatgttgagaaagagcttgctcaatttgatccagctcggcgcatgagaggcaggtataacaacaccatatccgagttgtctagcttgcatgaagaagactcgaattttaggcaaagctttcaccaaatgcgtagcaagcagttccctgtgtctggagatttggaatcaaacccggattattggagcggcgtgatgggcgggtcttcaggggcctcgcgaggaccaagcgccatggagtacaataaagaagacagagaatcttttaggcactcccagccaaggtccaaatctgaaatgctgtcccgtaagaactttgcaactggcgtgcctgctgtgagcatggacgagttagccgccttcgctgactcctacggacagcggcctaggcgcgcggatggcaacagtcacgaagcccgtgggggaagtagattcgaaaggagcgaatctcgagcgcattcgggcttctaccaagatgattcattggaagagtactacgggcaaaggagtcgaagcagggagccgctcactgacgctgaccgaggctgggccttcagcccggctcgacgacggcccgcagaggacgcgcacctacctaggttggtgagtcgaactcccggaacagccccaaagtacgatcacagctacctggggagcgctagggagcgccaggctcgcccagagggggcgtctagagggggcagcctcgaaactccctcaaaacggtcagcccagttgggaccgcgctcagcctcgtattatgcctggagcccacctgggacttacaaagccggaagtagccaagacgaccaggaggatgcctctgatgacgctttacctccctattctgagctggagctgacgaggggaccttcctacaggggaagggacctgccctaccacagcaattccgaaaagaagcgcaagaaagagcccgcgaaaaaaacaaatgattttccgactcgaatgtcattagtggtctag

SEQ ID NO: 26806 - DNA, 1644 bp, Artificial Sequence
  Description of Artificial Sequence: Synthetic coding sequence
atggctatgggactgtttagagtttgtcttgtagtcgttactgcgatcataaatcatcctctgctctttccccgggaaaacgccaccgtccctgagaatgaggaagaaattatccggaaaatgcaagcacatcaggagaagcttcagctcgagcaattgagactcgaagaggaggtcgctcggttggcggccgagaaagaagccctggaacaggtggccgaggaagggcgacaacagaacgagaccagggtcgcgtgggacctctggagtactctctgtatgatcctgtttctaatgattgaagtatggagacaggaccaccaggaagggcctagccctgagtgcttagggggcgaggaagatgagctgccaggccttggcggcgcccccctgcagggcttgactctgcccaataaggcaaccctggggcacttctatgagcgctgtattcggggcgcaacagcagacgcagctaggactcgcgagttcctggaaggattcgtggatgacctgctggaggcgctacgctcgctgtgcaaccgagatacagacatggaagtcgaggacttcataggagtcgactctatgtatgagaattggcaagtcgataggccactgctctgtcatctgttcgtcccttttacacctcccgagccataccggtttcatccagagctgtggtgttccgggcggagcgtgccactggacaggcaaggatatggccaaattaaagtcgttcgggcagacggggataccctgagttgcatctgcggcaagactaagctcggtgaagacatgctctgtcttctccacgggcgcaactccatggctcctccttgcggtgatatggagaacctgctctgcgccactgattccctctatttggacactatgcaggtgatgaagtggtttcaaactgcgctcactcgagcgtggaaaggcattgcccataagtacgagttcgacctggcctttggccagcttgactcccccggatccctgaagattaagtttcgatccggtaaatttatgcccttcaatcttatacccgtcatccagtgcgatgattccgatctttacttcgtctctcatctccctcgggaaccgagtgagggaactcccgccagctccaccgactggctacttagttttgccgtatacgaaagacactttctgcgaacaactttgaaggctctaccggaaggcgcatgtcatttgtcatgtttgcagatcgcaagctttctgctttcgaaacaatcgagactgaccggtccatccggcctcagttcatatcacctcaagaccgcactactacacctacttctgctgaggcaggccgccgactggaaagcgggacaactggacgctcggctgcatgagttactctgtttcttggagaagagcttgctacagaaaaagctacaccacttttttattgggaataggaaagtgccggaagctatgggccttcctgaagcagtactgcgggccgagccactcaacctgttcagaccatttgtgctacaacgctccctttacagaaaaaccctcgatagcttctacgaaatgttaaagaacgcccccgctttgatctccgaatatagtctacatgttccttccgaccagcccacgccgaaaagctag

SEQ ID NO: 26807 - DNA, 1644 bp, Artificial Sequence
  Description of Artificial Sequence: Synthetic coding sequence
atggccatgggactgttccgggtctgtttagttgtggtcactgctattatcaaccatcccttgttgttccctagagaaaacgctaccgtgcccgagaatgaggaagaaatcatcagaaagatgcaggctcaccaggagaagttgcagctagaacaactgagactggaggaagaggtcgcacgattggccgcagagaaggaggccctcgagcaggtggcagaggagggacggcaacaaaatgagaccagagtggcatgggacttatggtcaacactgtgcatgatccttttcctgatgatcgaggtgtggcgccaggaccaccaggaggggccttctcctgagtgtcttggaggggaggaagacgagctgcctggtctgggaggcgcccctctccaggggcttacattgccgaacaaggctacattaggtcacttctacgaacgctgcatcagaggcgctactgcagacgcagcgcgtactcgcgagtttctggaaggattcgtggatgacctgctggaggctctgagatctctctgcaaccgggatactgacatggaggtggaagatttcattggggtcgattctatgtacgagaattggcaggttgaccgccctctcctgtgtcaccttttcgttccttttactcctccagagccctaccgcttccatcccgaactgtggtgttctggtagatctgtccctctggaccggcaaggctacggtcagataaaagtcgtgcgggccgacggtgacacactctcctgcatctgcgggaaaacaaagctcggagaggacatgttgtgcctcttacacggacggaactctatggcacccccttgtggagacatggagaatctgttatgtgccactgattctctctaccttgacactatgcaggtaatgaagtggtttcagacggcactcactcgtgcctggaaaggaattgctcataagtatgaattcgacctggccttcggccagcttgactcgccaggttctctgaaaatcaaatttcggtctgggaaattcatgcccttcaatttaattccggtgatccaatgtgatgattccgacttgtattttgtgagccacctgccacgtgaaccatcagagggaacgccagcaagttctactgattggcttctgtcgtttgcagtctatgagaggcattttttaaggacaactcttaaagccctgcctgagggtgcatgtcatcttagctgcctgcagatcgcttcgtttttactgtctaagcagtctaggcttacaggcccaagtggactctcctcctaccacctgaagacagctctcctccacctcctgttgctgcgtcaagctgccgattggaaggcaggccaattggacgcccgtctgcatgagctgctttgcttcctcgaaaagtccttattgcaaaaaaaacttcaccatttttttataggaaatcgtaaagtcccggaggctatgggcctgccagaagcagttcttagggccgagcccctaaacctgttcaggcccttcgtgctccagagaagcctatatcgaaagaccctcgattcattctatgagatgctgaaaaatgctcctgccttgatctctgagtatagcctgcacgtaccaagtgatcagcccaccccaaagagctag

SEQ ID NO: 26808 - DNA, 1644 bp, Artificial Sequence
  Description of Artificial Sequence: Synthetic coding sequence
atggcgatgggcttgttcagagtatgcctcgtggtggtgaccgcgatcatcaatcatcctctccttttcccccgggagaacgcaaccgttcccgagaacgaagaggaaataatcaggaagatgcaggctcaccaagaaaaactgcagctcgagcagctgcgactggaggaagaggtggcccggctggccgctgagaaggaagccctggagcaggttgctgaagagggccgacagcagaatgaaacaagagttgcatgggacctttggtcaactctttgcatgatactgttcctgatgatagaggtgtggcgtcaggaccaccaagagggccccagccccgagtgcctaggtggggaggaagatgaacttcctgggctaggtggggctcctctgcaaggtttgactttgccaaacaaggccacgctgggccatttctacgaaaggtgtattcggggagctacagccgatgcagcaaggacaagagagtttcttgagggatttgtcgatgatctgcttgaggctctacgaagtctgtgcaatagagatactgatatggaggtagaagattttatcggtgtcgattcaatgtatgagaactggcaggtggaccggcccctactttgccacctcttcgttccttttacacctccagagccataccgatttcatcctgagctgtggtgttccggcaggtccgtcccactcgaccgccagggatacggccaaatcaaggtagtccgcgctgatggagacactttgagctgtatttgtggaaagaccaaacttggtgaggacatgctgtgcttgctacacggccggaactctatggcccccccatgtggcgacatggaaaacctgctgtgcgcaacagatagcctatatctcgatacaatgcaagttatgaaatggtttcagacggctcttacaagggcatggaagggtatcgctcacaagtatgagttcgatttggcctttgggcagctggactctcccggttctctaaagatcaagttccgctctgggaagttcatgccttttaacctaataccagtgatccaatgtgatgattcagacctgtactttgtctcacacctccccagagaaccgagcgaaggcacacctgcgtccagcactgactggctcctctctttcgctgtatacgaacgccattttctcaggactaccctgaaggccctgccagaaggtgcctgtcacttgtcatgtctccagattgcttcctttctgctgtcgaagcagtcccgcctcacagggccctccggcctcagctcttaccatttgaagactgccctccttcaccttctcctgcttcgccaggcagcagactggaaagcgggacagctcgacgctaggcttcacgagttgttgtgctttttagaaaagtctcttttgcagaagaagctgcaccacttctttatcggaaatagaaaggtacctgaggcgatgggactgccagaagctgtcctaagagccgagcctctaaacctcttccgacccttcgtgctccagcggtctctctaccgcaaaacccttgactccttttatgagatgcttaaaaatgctcccgcccttatcagtgaatattctctccacgtcccaagcgatcagccgacgccaaaaagctag

SEQ ID NO: 26809 - DNA, 345 bp, Artificial Sequence
  Description of Artificial Sequence: Synthetic coding sequence
atggctatgggactgttcagggtgtgtttggtggtggtcacggccattatcaaccaccctctgctgttcccacgggagaacgctacggtgcctgagaacgaagaggaaatcatccgaaagatgcaggcccatcaggagaaactacaactggaacagctcagattggaagaggaggtcgcgagattggctgccgaaaaggaggctctagaacaagttgcagaagagggccggcagcagaatgaaactagagtcgcttgggacctctggagcacgctgtgtatgattctgttcctgatgattgaagtgtggagacaagatcaccaggagggccccagcccggagtag

SEQ ID NO: 26810 - DNA, 1692 bp, Artificial Sequence
  Description of Artificial Sequence: Synthetic coding sequence
atgactacagactcttattcccccacatcccccgatgccgaggcaagtatggctgttatctccttgctgttcttagccgtcatgtacgtggttcaccatcctttgatggtttccgatcgcatggatttggatactcttgcgcgctctaggcagctggagaaacggatgagcgaggagatgagactgcttgaaatggagttcgaggaacgaaaacgggcagcagagcagcggcaaaaggctgagaacttttggactggggacacctcaagtgatcaactcgtgcttgggaagaaagatatgggctggcctttccaagcggatggccaggagggccccctgggatggatgctggggaatttgtggaacactggtctgttttgtctatttctggtttttgagttgctccggcagaacatgcagcatgaaccagcgttcgattcatcatctgaggaggaagaagaggaggtgcgcgtagtgcccgtcacaagttataactggctcacagacttcccttcccaggaggccctggactctttctataaacactacgtccagaatgcaatccgggatctgccctgcacctgcgaatttgtggaatcctttgtcgatgacttgatcgaggcctgtagggtgctgagtaggcaggaagcacacccccagttagaggattgtctgggcattggcgcggcattcgagaagtggggaactctgcacgagacgcaaaagttcgatattttggtgcctattgtaccaccccagggaactatgtttgtgttagagatgagagatccagctctcgggaggagatgtggctgtgtgctcgttgagagtgagtgcgtttgtaagcgcgaaaaactgttgggcgacgtgctttgtctggtgcatcaccacagggatccatcagcagtgctgggcaaatgcagctcctccatcaaagccgcgctctgcactggatttcacctagatgtttgcaaaaccgtgcagtggtttcggaatatgatgggtaacgcttgggcattagttgcccataaatatgattttaagctgagcctgcctcctagcactaccagttgcaagctaagactagattaccgaagcggccgtttcctatcgatacacctcgtactcggagtgcagcgcgaggacactcttgtctacctggtcagtcaagcaccagaccaggagcagctcacaagcgttgattggcctgagtcttttgtggcctgcgagcacctcttcctgaagcttgtgggccggttcgcccctgaaaacacctgtcacctaaaatgtttacagattattctgtcattaagacagcaccagagcctgcctcatggtgcatctcggccaattctaacctcttatcactttaaaaccgctcttatgcacttgctattgcgtttacccctgactgactgggcacacaacatgctctcccaacggcttcaagatatcctctggtttctgggaagggggttacagcagcgctctcttcaccacttcctcattggtaataactttcttccactaacgattcctattcccaaaacgttcaggaatgcagaaccagttaacctatttcagcacctcgtgttgaatccaaaggcccactcgcaggccgtagaagaattccaaaatctgctaactcaggtgaagaccttgccgcacgcgcccttggccgcagctccctag

SEQ ID NO: 26811 - DNA, 1668 bp, Artificial Sequence
  Description of Artificial Sequence: Synthetic coding sequence
atgaacgtggacgctgaggccagtatggctgtcatatctctgttgttcctggctgttatgtatgtggtccaccatccccttatggtttcagatcggatggacctcgatacactggcccggagcagacagcttgaaaagcggatgtccgaagagatgaggctcctggagatggaatttgaggaaaggaagcgcgctgcagaacagagacagaaggccgagaacttctggaccggtgacacttctagtgaccagctggtgcttgggaagaaggacatgggttggcccttccaggctgacggtcaggagggaccccttgggtggatgctcggaaacctgtggaacacggggcttttctgcctgttcctggtcttcgagctgcttaggcaaaacatgcagcacgaacctgcatttgatagttcaagcgaggaggaggaggaggaggtgcgtgtcgtccccgtgacttcctataactggttaacagatttcccctcacaagaagccctggatagcttttacaaacactacgtgcaaaacgccatccgagatctgccctgtacatgcgaatttgtcgagtcattcgtggacgatctcatagaagcttgccgagttctttccaggcaggaagcgcatccacagcttgaagactgcctcggcatcggcgcagctttcgaaaagtggggaactctccatgaaacacaaaaatttgatatcctggtccccatcgttcctccacaggggaccatgttcgtattggaaatgcgggacccagcgctcgggcggcgttgcgggtgcgtgttggtggagtcggagtgtgtctgtaagagggagaagctcctaggcgacgtgttatgtttagtccaccaccaccgggacccaagcgcggtgctcgggaagtgcagctcaagcataaaggcggctctgtgcaccggctttcacctcgatgtgtgtaagaccgtacagtggttccgaaacatgatgggaaacgcatgggccctcgtggcgcataagtatgactttaagctcagcctgccaccgagcaccaccagttgcaagctccgtctcgattatcgctccggtcgttttctctcgatccacctggtgctaggcgtccaacgcgaagacacgctcgtgtacttagtgagccaggcccccgatcaagagcagctcacatcagtggactggcctgaatccttcgtggcttgcgaacatttattcttgaagctggtgggccgtttcgcccctgaaaacacatgtcaccttaagtgtctgcaaatcattcttagtctacgccagcaccagtcgttaccccacggcgcctctcggccaattctgaccagctaccatttcaagactgccctcatgcatttgcttctgcgcctaccactgaccgattgggctcacaacatgttatctcagaggcttcaagacatcctctggttcctgggtaggggactgcaacaaaggagccttcaccacttcctgataggcaacaattttttgccccttacgatccccattccaaaaaccttccgtaatgccgagcccgtgaatctttttcagcatttggtgctgaacccgaaggcccacagtcaggcggtggaagagtttcaaaacctactgacccaagtaaaaacgcttcctcatgcaccacttgccgcagcgccctag

SEQ ID NO: 26812 - DNA, 1644 bp, Artificial Sequence
  Description of Artificial Sequence: Synthetic coding sequence
atggccgttatttccctgctttttttagcagtcatgtacgtagtgcaccatcccctaatggtcagcgaccggatggatctggatacgctggcaagatcgaggcagctggagaagcgcatgtctgaggagatgcgccttctggaaatggaattcgaggagcggaagcgggctgctgaacagcgccagaaggccgagaacttttggacgggcgatacttcctctgatcagttagtactggggaaaaaagacatgggttggccgtttcaggcagacggccaggaaggccctttaggatggatgctgggtaatctgtggaataccgggctgttttgtctctttctagttttcgagctgctacgccaaaatatgcagcacgaacctgctttcgactccagctccgaggaggaagaagaggaagtgcgcgtggtgcctgtgacgtcatacaactggctgacggatttccccagccaggaagccctagactcattctacaaacactacgtacagaatgcgatcagggacctcccctgcacatgcgagttcgtggagtccttcgtagacgatctgatagaagcatgccgagtcctgtcacgccaggaagcacaccctcagctggaagattgccttgggatcggtgccgccttcgaaaagtgggggaccctgcatgaaactcagaagttcgacatcctggtgcccatagtaccaccgcagggcacgatgttcgtcctggagatgcgcgatccagccctcggccgaagatgtgggtgcgtgctggtcgagagtgagtgcgtctgtaaacgcgaaaagctcctgggggacgtgctgtgtctggtgcaccaccaccgggacccctccgccgtgttgggaaaatgtagcagctctataaaggcagcattatgcaccggatttcaccttgacgtgtgcaaaactgtccagtggtttcggaacatgatgggaaacgcctgggcacttgtagcacacaagtatgatttcaaactgtcacttccccctagcacgactagctgtaaactgcgcctagactatcggtcgggccggttcctgagtatacacctggtgctgggcgtgcagcgtgaggatactctggtttatctcgtctcccaggcccctgatcaggaacagctgacatcagtcgactggcccgaaagctttgtggcatgcgaacacctctttctaaaacttgtagggcgcttcgctccagaaaacacatgtcacctaaaatgcctccagatcatccttagccttagacaacaccaaagcctcccccacggagcctcccgacccatcctgaccagttaccacttcaagacagcattgatgcacctgttgctgagattgcccctcactgattgggctcataatatgctgtcccagcggctccaggacattctgtggttcctaggaagggggctgcaacagagatccctccaccattttctgatcggcaataacttcctgcccctgacgatcccaattccaaagacattccgaaacgcggagcctgtgaaccttttccaacaccttgttcttaatccaaaggcacactcacaagctgtggaggaattccaaaacctattgactcaggtcaagaccctgccccacgctcccctagcagcagctccctag

SEQ ID NO: 26813 - DNA, 1644 bp, Artificial Sequence
  Description of Artificial Sequence: Synthetic coding sequence
atggccgtcatctccctgctcttcctagcggtcatgtacgttgtgcaccatcctctaatggtctctgatcgcatggatctcgacacactagctagatcacgccagctggagaagagaatgtcggaggagatgagactgctcgagatggagttcgaggaacggaaacgggctgccgaacaaaggcaaaaggcagaaaatttctggaccggggacacttcttctgatcagctggtgctcggtaaaaaagatatgggatggcccttccaagctgatggacaagaaggtcctttgggatggatgttaggaaacctctggaacacaggcctgttctgcctgtttcttgttttcgagcttctcagacagaatatgcaacacgagcccgcttttgatagttccagcgaggaagaggaggaagaagtcagggtggtgccagtgacatcttacaactggttgaccgattttccatcgcaggaggcgctcgatagtttttataagcattacgtccagaacgcaattagggaccttccttgtacatgcgagttcgtggaatcctttgtggacgatctgattgaggcctgccgggtcctgagcaggcaagaagcccatccacagctagaagattgcctcggaattggggccgcatttgaaaaatggggaacactgcacgagactcaaaaatttgatatcctcgtcccaatcgtccctcctcagggcaccatgtttgtcctcgagatgcgcgatccagccttgggacggcgctgtggatgcgtgctcgtggaatctgaatgtgtgtgcaagagggagaaactgctcggggatgtgctctgtctggtccatcaccaccgagaccctagtgctgtgctgggcaaatgtagcagctccatcaaggcggcactgtgcaccggattccacctcgatgtgtgtaaaaccgtacaatggttcagaaacatgatgggtaatgcttgggcacttgtcgctcataaatacgatttcaaactgtcactcccacccagcacaacgtcctgtaaactccgcctagactatcgcagcggcaggttcttgagtattcatcttgtgcttggagttcagcgagaggacactctcgtttacttggtttcccaggccccggaccaggaacagctcacatccgttgactggccagaatccttcgtcgcctgcgagcatttattccttaaactcgtagggaggttcgctcctgaaaatacatgtcatctgaaatgcttgcagataattctctccttacggcaacatcagagccttccacatggcgccagcaggcccatcctgacctcctatcattttaaaacagccctaatgcacctgctgctgcgcctcccactcacagattgggcccacaatatgctcagtcagcgtttgcaggacatcctgtggtttctgggccggggtctccagcagcgttccctccaccattttttgatcggcaataactttctccctctgactatccccatccctaagacattcagaaacgccgagccagtaaatctcttccagcatctggttcttaatcctaaggctcatagccaggccgtcgaggagtttcaaaaccttctgacacaggtgaagaccttaccacacgcacctctggctgcagccccttag

SEQ ID NO: 26814 - DNA, 1608 bp, Artificial Sequence
  Description of Artificial Sequence: Synthetic coding sequence
atgtcagtgcactataccctgaatcttcgcgtgttctggccgctggttactggcctgtgcactgcactagtctgcctgtatcacgtgctccgcgggagcggaggggcaagggcggaaccagcggacggtgtggacgggggttttccattgttaaaggtggcagttctgctgctactctcctatgttctcctgagatgcagacatgcagtgcgccaaaggtttctgcctggatccccacgactagaggggcatgctgcctttagctcccggcactttcgggagcccggacttagcatcctgctagaatcgtattatgagcacgaggttcggctctctccacatgtgctgggacactcaaaagcccatgtatctcgaattgtaggggagctggttcgcgcaggcagagcgcgaggtagtcccgggctcattcccggtggcgcattagccctggcattccgtggggatttcatccaggtgggcagcgcctatgaacagcataaaattcgtcggccagactcctttgatgtccttgtgccccttcggcttcccccactggttgctctggagccacggtccctcggcgaagaaccagcactcgcccctgccttcagagggtgctttctgtgtgcactgaaggctcctcctagcccaagtggagccagcggcgggcactggctcagagattgcaagcccttcgctgatgctttctgtgtcgacgttcggggtaggcggcatctttccgctaccctagttctgcggtggttccagtcccatctgcagagatccttggccaccgttcgatatagcttggagggccgctgtcgcgtcaccctgacgcctgggggactcgagcaacccccaacattacacattcttccttgtagaactgactacggatgttgcagattaagcatggcagttcggctgatcccggcagtgcatctcggtgacggggtgttcttggtcgcccccccaccccctccactgccgagtgccccactcctcgagttgccagagggccttcgtgcggaagcgctctggggagtcaacaccgcccggcaggagcagaagctcttaagttggcttcaggaaagagccgcccctggcgcatgctacctcaaatgtctccagctgctgaaagcccttagggatctcggcgcacgcggcttggattcagcggccgcaactcagtggggcaggattctgtcctcatatgtcctgaaaaccgtgttgctggccgtgctgcttagaaagggtgcaccgggtcagggttgggacgaggaacatcttggccgctgcctcgaagaactggtgcagttcctgagagactgtttgcttagacgacacaccttgtttcactgcgtgctgggcccgggtggcgcagcagccgaggtgggccccttgccaaaggccctgagggaggcagccccagtggatcttctggctgcatttgacggacatgcccgagagctggctgctgcacgcctgctgtccacctggcagcgactaccacaactgctgagggcatacgggggtcctcgctatcttgccagatgtcccccacctagaagtcagcgcacgcagggcttccttgagggtgagccctag

SEQ ID NO: 26815 - DNA, 3774 bp, Artificial Sequence
  Description of Artificial Sequence: Synthetic coding sequence
atggccagttgcagttttacaagagatcaagcaactcgtcggttaagaggcgctgcggccgccgctgccgcagcactggccgcggtcgtgaccactccactgctctcatctggaacccctaccgctcttattggcacaggctcttcttgtcccggtgcaatgtggctgagtacagccacaggctctcgttcagactcggagtctgaggaggaagaccttcccgtaggcgaagaagtgtgcaaacggggatacctaagaaagcaaaagcatggccatcggcgctattttgtgttaaaactcgaaaccgctgacgcgcctgccaggcttgagtattatgagaacgctcgcaaattccgacattccgtgagagctgccgctgcagcggcagctgcagcagccagcggcgccgcaatcccaccattaattcctccccggcgggtgatcacgttataccagtgcttcagcgtgtcacaaagagcggatgctcgatataggcatctgatcgctttatttacccaggacgaatactttgccatggtggctgagaatgagtctgaacaggaatcttggtatctgttgctcagcagactgattctggagtctaagaggaggagatgcggtaccctgggtgctcagcccgatggcgaacccgcggcactagctgccgcagcggctgctgaaccacctttctacaaggacgtgtggcaagtcatcgttaaaccaagggggctcggtcacagaaaggagctaagcggggtgttcagactatgtctgaccgatgaagaagtcgtgtttgtacggctgaatactgaagtggcatccgtggtggttcagcttttgtccatcagacgatgcgggcattcggaacagtactttttcctggaggtgggaaggagcactgtgatcggcccaggtgagctctggatgcaggtggacgattgtgtggtcgcacagaatatgcacgaactctttttggagaagatgcgggctttatgcgccgacgagtaccgagcaagatgtcgaagctacagcattagtattggcgcacacctgctcaccttgctgtccgccagaagacatttgggcctcgtgcctcttgaaccaggaggctggctccgccggtctagatttgaacagttttgccaccttcgcgccataggcgatggcgaggatgagatgctgttcactaggcgctttgtgacccctagtgaaccagtggctcacagcagacgcgggcgccttcatcttccacgtgggcgcagatctcgaagggcagtgtccgtgcctgcatcctttttccggagattagcgccttcaccggcccgccctcgccacccagctgaagcacctaataatggagctcgccttagttcagaagtgtcaggcagcggcagcggaaatttcggagaagaaggaaatccacagggcaaagaagatcaggaggggtccgggggcgattacatgcccatgaataattggggtagtggcaacggcagaggaagcgggggcggccagggctccaatggccagggttcaagttcccactccagcggtggcaaccagtgttccggggaggggcagggctcccgtgggggacagggttccaacggccagggatctggtggaaatcagtgctcaagggatggtcagggaaccgctgggggccacgggtcaggtggggggcagcgcccgggcggtggacatggtagcggaggcggacaggggccaggcgatggccatggtagcgggggaggcaagaattccgggggaggaaagggttccggatccgggaagggcagcgacggggatggcgaaagagggaaatcactgaagaaaagatcatactttggcaaacttactcagtctaagcagcagcagatgcccccccctccgccgccaccccctccccctccgcccgccgggggcaccgggggaaaaggcaaaagcggaggcaggttccggctttatttttgtgttgataggggtgccacaaaggagtgtaaagaggccaaagaggtcaaggatgcagaaatccccgagggtgccgcaagaggtccccatcgagctcgggccttcgacgaagatgaggatgacccgtacgtccccatgagaccaggtgttgctacaccacttgttagttccagcgattacatgcctatggctccccagaatgtcagtgcctctaagaaaagacacagtcggtcccctttcgaagatagcagagggtatatgatgatgtttccacgcgtgtctcccccgcctgcccccagtccaccaaaggctccagacacgaataaagaggatgattcgaaggacaacgactctgagagcgattacatgtttatggctccaggagccggagctatccccaagaacccacgaaatccacaggggggatcttctagcaagtcatggtctagctatttctccctacccaacccgtttagatcctctccactcggccagaacgataattcggaatatgttcctatgctcccaggcaaattcctaggacgagggcttgacaaagaggtgtcgtataattgggacccaaaggacgccgcctcaaaaccaagtggcgagggatcattttcaaagcccggagacggtggatctccatcaaaaccctcagatcatgaacccccaaaaaataaagccaagagacctaatagattaagcttcattacaaaaggctacaagatcaagccaaaacctcagaagccgacacacgaacagagggaagccgatagtagttcagattatgtgaacatggatttcaccaagagggagagcaacacacccgccccctcgacgcaaggccttccagacagttggggtatcatcgctgagccacgccagtctgcctttagcaactacgtcaatgttgagttcggcgtcccctttcccaatcccgcgaatgatttgagcgacctactgagggccatccctagagcgaacccactttctctggactccgcaagatggccacttccacccctccccttgagcgccaccggttccaacgccatcgaggaagagggagactatatcgaagtgatcttcaacagcgccatgacaccagctatggcactagctgattcagcaattagatatgacgcagagaccggcaggatctatgttgtggatccgttttctgagtgttgcatggatatttctctcagcccatcccggtgctcagagccccctcccgtggcaagacttcttcaagaagaggagcaagaacgcaggaggccacagtcgaggagtcagtcattcttcgccgccgccagggcagccgtatctgccttccctactgactctcttgagcgggatcttagcccttcatctgcgcctgccgtagcttccgccgctgagcccaccctggcgctttcccaggttgttgccgcggctagcgccctggctgcggcaccagggatcggagccgcagctgctgccgcagggtttgattccgcatcagcccgatggtttcagccagtcgctaatgctgcagatgcggaagccgtgaggggggcacaggacgtagcagggggcagcaaccccggagcccataacccatctgccaatctggcccgcggtgacaaccaggccggaggcgcggccgcagcggctgccgccccagagcccccccctaggagtcgccgcgtcccccgaccaccagagagggaggactcggacaatgacgatgacacccatgtgaggatggattttgccagacgggacaatcagtttgattccccaaaacgcggcagatag

SEQ ID NO: 26816 - DNA, 7185 bp, Artificial Sequence
  Description of Artificial Sequence: Synthetic coding sequence
atgtggctgtctgggaagtctcaagttcagaagcgaggcgcagtgagataccttcaggcgcctccagtgaatggagaggccagcgcgtgcccagctcccccgacgcacctggatcgaacaacatgcgctaggcgccgtccagctcgattgcctcctccgtggggagcagccggcatccggcccgcgccgcgggcttcaagggcctcgttttgggctaggttccctccacattgctttcccagcgggtgttctggcagtagggtgctggagggcggcgaaatcggttttcgcttccgcggaggccgcgttgcagctgcagcactccggtctcgctgggctcggggcgatgctgcagcagccggaagccgagaggggcgaggaagaatgaacagagccaagccgaccacagtgcggaggccatcagcagccgccaaaccatccggacacccaccacccggcgactttatagccctgggcagtaagggtcaggccaatgaaagcaaaaccgcttccacattgctcaaacccgcgccatctggcttacccagtgagcggaagagagatgctgcggcggccctctcttctgcttcagcgctgaccgggcttaccaagcggcccaagctgtcttcaactccccccctgtccgctctcggacgcctcgcagaagccgcagtcgctgaaaaaagagctatctcacctagtattaaagagccatcagtggtacctattgaggtgctgccaaccgttctgttggacgagattgaagcagcggaactggaaggcaatgatgatcggatcgaaggtgtgctttgcggtgcagtcaagcaactgaaagtgacaagggccaagcccgacagcaccctatacctgagtctgatgtacctggccaagatcaagcccaacatttttgccaccgagggtgtaatcgaggccctgtgtagccttctccgacgggacgctagcattaacttcaaagccaaaggcaactcactggtgagcgtattggcctgcaatctgctgatggcagcatacgaggaggacgagaactggcccgaaatattcgtcaaggtttatatcgaagatagtttaggggagaggatctgggtcgattcgccgcactgtaaaacgttcgtggacaacatccagaccgcattcaacaccaggatgcccccaagatccgtactgctgcaaggcgaagccggccgcgtcgccggggacctcggcgccggctccagccctcacccgagcctgaccgaggaggaagacagccagacagaattgctgattgccgaagaaaagctgtcacccgagcaggaaggtcagctcatgcccagatacgaagaactcgctgaaagtgtggaagaatatgtcctggatatgctgagggatcagctgaaccggcgccagccaattgacaacgtatccagaaatttactcaggctcctcacaagcacttgtggatataaagaagttcggcttctggccgtgcagaagctcgagatgtggctgcaaaaccctaagttgacgagacctgctcaagacctcttaatgtctgtctgcatgaactgtaatacccacggaagtgaagacatggatgttataagtcacctaataaagattagactgaaaccaaaagtcctgcttaatcacttcatgctctgtataagagagctcttatcggcccacaaggacaacttgggaacaaccataaaactggtgatctttaacgagctgtcttcagcccgaaacccgaataatatgcaggttctgtatacagccctgcaacatagctctgaactcgccccaaagtttctcgctatggtcttccaagatttgcttacaaataaagacgattatctgcgggcctctagggctctgctcagagagattatcaaacaaaccaagcacgaaatcaactttcaggctttctgtctcgggctcatgcaggaacgaaaagagccacaatatttagaaatggaatttaaggagcgcttcgtggtgcacatcaccgatgtgttggccgtgtctatgatgcttgggatcaccgctcaggtgaaggaggcgggtattgcctgggataagggcgagaaacggaatcttgaagtgctccgctcttttcagaaccagatcgcggccatacaacgggacgccgtatggtggctgcacactgtcgtaccttcgatttctaaactcgccccaaaggattatgtccattgcctgcacaaagtactgttcaccgaacagcccgaaacatattataagtgggacaattggccacccgaaagtgatcgcaacttttttctgcggctatgtagtgaagtgccaatcctggaagacacactcatgcgcattcttgtcattggactgagtcgcgaactccccctgggacccgccgacgccatggagttggccgaccacctggtcaagagggccgccgcagtgcaggcagatgacgtcgaagtcttaaaggttgggcggacccagctcatcgacgccgtgctgaatctatgcacctatcatcatcctgagaatatccaactccctccaggttaccagcccccaaacctagctattagcacactttactggaaggcatggcctctactcctggtggtagcggcctttaatcccgagaatattggcctggcagcctgggaagaatatcccacactcaagatgctgatggaaatggtgatgaccaataactatagctacccgccatgcactttgaccgatgaagaaacgcgtaccgagatgctcaatagggagctccagacagcacaaagagagaaacaggagatcctcgcattcgagggccacttggccgctgcatccaccaagcagactattactgagtcttcttcactgcttctatcccagttaaccagtttggacccccagtacgcagctcacactgctcctccttgtgcgtgccgtcgggatctgggcccacctagacggccacccccccacatcctcgaccaggtgaagtcactcaaccagagcctgaggttaggccacttgctgtgcaggagccgcaatcccgattttctgttacacatcattcagcgtcaggcctcttctcagtccatgccatggttggcagatttagtgcaatcctccgaaggctcactggacgtgttaccggtgcagtgcctttgtgagttcctcctccacgacgcagtcgacgacgctgctagtggggaggaggacgacgaaggggaaagcaaagagcaaaaggccaaaaagcgtcagcgccagcagaaacaaaggcagcttttggggagactgcaggacctgctcctcggccctaaggccgacgaacaaactacttgcgaagtgctggactatttcctacgcagactcggaagctcgcaggtggcctctcgggtgctcgccatgaaaggtgaaacattgcccgccctacctaaggcgggccctgcgcacgagtgcttgcctcaaggtttatccttagttctctccgagggctcgctgcgtgatggagaggagaaggagccacccatggaggaggacgtcggcgacacagatgttctccagggctaccagtggttgcttcgcgacttaccacgcctgccactctttgactcagtgcggtctaccacagccttagctctgcagcaggccattcacatggagacagatcctcagaccatctcagcttacctgatctatctgtcacagcacacaccagtcgaagagcaggctcagcacagtgatctagcactcgacgtggcacgcctagtcgtggaaaggtctacaatcatgtcccatctatttagtaaactgtcaccttctgctgcctccgatgctgtgctcagcgccttactctccattttttccagatacgtcaggcggatgcggcagtccaaagaaggcgaggaggtgtattcttggtcagagagtcaggatcaggtcttcctccggtggtctagtggcgaaacagctaccatgcacatcctcgtggttcatgctatggtcatcctgctgacactgggaccccccagggccgacgactcagagtttcaggctctccttgatatttggtttcctgaggaaaaacctctgccgaccgcctttctcgtcgacacctccgaagaagccctgctgttaccggattggctgaagctgaggatgatcaggagtgaggttttgaggctcgtggacgctgctttacaggatctggaacctcaacagcttctgctatttgtgcagagttttggaatacctgtgtccagcatgtccaaactgctccaattcctagaccaggctgtagcccacgatccacaaacactggagcagaatatcatggacaaatctaagatgcctgggacctgtggcgtgggctcccacacactaactgaaccacagcctgggcaggctttcggcgcttgggtgagagctggcgtgacattgctccgattcgccgattacatggcacaccttgtcgaagtccagcacgagagaggcgcctccggtggccagacatttcacagtctattgaccgcctcactgcctcctagaagggactcaaccgaggcaccgaagcctaagagtagccccgagcagcctatcggccagggcagaattcgggtgggtactcaactcagagtgttagggccagaagatgatctggccgggatgttcctgcagatctttccattatccccagaccctcgatggcaatcctccagccccaggcctgtcgcactagctctgcaacaagccctcggccaggagctggcccgcgtggtgcagggtagcccggaagtgcccgggatcaccgtccgtgtactgcaggcacttgctacactcctatccagtccacacgggggagccctggtcatgagtatgcacaggagccacttcctggcttgcccactgctgagacaactctgtcagtaccaaaggtgcgttccacaggacacaggcttttctagcttgtttctgaaggtgttactgcaaatgctgcagtggctggattctcccggagtggaagggggaccactgagagctcagttgaggatgctcgcgagccaggcctctgctggcagacgcctttccgatgtgcgcggtggtcttctgcgcttggccgaggccctggcattccggcaggaccttgaggtcgtgagttcaaccgtaagggctgtcattgccactcttcggagtggagaacagtgttctgttgaacctgatttgatttctaaggtgctgcaaggcctcatcgaagtgcgcagcccccatctcgaggaactgctgacagcgttcttcagcgcgactgcagacgcagctagcccattcccagcatgtaaacccgtagtcgtggtatcttcattgctgcttcaagaggaagagcccctggcgggaggaaagcctggagctgatggaggatctctcgaagccgtccgcctcgggccaagcagcggattgcttgtggattggcttgaaatgctggatcctgaggtagtcagtagctgccctgacctccaactgcgactcctcttttccagacgcaaggggaagggacaggcccaggtgcctagcttcagaccctatctgctgacactgttcactcatcagtcctcctggcccaccctgcaccagtgcatccgtgtcttactgggcaaaagccgtgagcagcggtttgaccctagcgcttcactcgactttctttgggcttgcatccacgttcccagaatctggcagggaagggaccagaggacaccacaggcaggcctggggagaaagagaagagaggaattagtcctgcgcgtgcaaggacccgagttgatctctctcgtggagctgatacttgctgaagcagaaaccagatcccaggacggagacaccgctgcttgctcacttatacaggcccggttgccccttctgctgagttgttgctgtggggacgacgagtccgtgaggaaagtcaccgagcatctcagcgggtgcattcagcagtggggcgactctgtcctcgggaggcgttgccgggatctgctcctgcagttgtacctgcagcggcccgagttgcgtgtacccgtccctgaggtactacttcacagtgagggtgcggccagtagcagcgtctgcaagctagacggacttatccatcgatttatcacccttctggccgacaccagcgactccagggcacttgagaacagaggtgcagacgccagcatggcctgtcgaaaacttgctgtcgcccaccctttgcttttgcttagacacctgccgatgattgccgccctgctacatggtcgcacccacctaaactttcaagagtttcgccaacagaatcatttatcttgcttcctgcatgtgttgggacttctggagttgctccagccgcacgtctttcggagcgaacaccagggagcactgtgggactgcctactgagtttcatccggttactgcttaactaccgcaagtccagcaggcatttggcggcttttattaataagttcgtgcaattcatacacaaatacataacctacaatgctccagccgcgatttcattcttacagaaacatgccgaccctctccacgatctgagttttgacaactcggatcttgttatgttaaaatccctcttggccggtctatccctgccctctcgagacgaccgcacagataggggtcttgatgaggaaggcgaggaggaaagctcggccggctccctgcccttagtgtcagtatctttgtttacgccactcactgccgccgagatggccccttacatgaagaggttgtcgagaggacagaccgttgaggaccttctcgaggtgctcagcgacatcgacgagatgtctagaaggcgccctgaaatactgagtttttttagcacgaatctgcagcggcttatgtcttccgccgaggaatgctgcaggaacctggcattcagcctggcattgcgaagcatgcagaactcaccaagcattgctgccgcttttctacccaccttcatgtactgtttgggctctcaggattttgaggtagtccagaccgccctccggaatcttccagagtacgccctgctctgccaagagcacgctgccgttctgcttcaccgggcctttctggtggggatgtacggacaaatggacccctccgctcagatcagtgaagcattgagaatcctgcacatggaggcagtgatgtag

SEQ ID NO: 26817 - DNA, 6573 bp, Artificial Sequence
  Description of Artificial Sequence: Synthetic coding sequence
atgaaccgcgccaaacctactaccgtgagacgtccaagtgcggctgccaaaccaagtggccatccaccaccaggggactttatcgcactaggatcaaaaggtcaagcgaatgaatccaaaactgcctctacactgctgaaacctgcaccatctggcctgcccagcgagaggaaacgcgatgccgcggccgctctttctagcgcctcagccttgaccggcctgactaagcgcccgaagctgagcagtactcccccattatctgcactcgggcggcttgctgaagccgcggtagccgagaagcgggctataagccctagcatcaaagaacccagtgtcgtgcctatagaggtgctgccaactgtgctgctggacgagatcgaagccgccgaactcgagggcaatgacgatagaatagaaggtgtcttatgcggggccgtcaaacagctgaaggtaacccgcgcaaagcctgatagtaccctgtatctgagtttgatgtatctggcaaaaatcaagccaaacatattcgctacagaaggggtgatcgaggccctttgttctctactgaggcgggatgcaagcattaatttcaaggctaaggggaactcgttggtttccgtgctcgcctgtaacctgttaatggctgcgtacgaagaggacgaaaactggccagagattttcgtgaaggtctacattgaagattctctgggagagagaatctgggtggattcacctcattgcaagaccttcgtggacaatatacagaccgcctttaataccagaatgccccccaggagcgtgctgctgcagggagaagctggacgagttgcaggggatctaggggccggctcatccccacatccgagcttaactgaggaggaagactctcagaccgagctgttgattgctgaggagaagctgtcgccagaacaggagggacagttaatgccaaggtacgaggaactggctgagtcagtggaagagtacgtgttggatatgctgcgggatcagctgaatcgcaggcagcctatcgacaacgtcagccgtaatctgctacgcctgctaacctccacgtgtggatacaaggaggtgcgcctattggccgtccaaaaacttgagatgtggttacagaacccgaagttgactcgcccagcccaagacctgctgatgtctgtgtgcatgaattgtaacacacatgggagtgaagacatggatgtaatcagccacttgattaaaataagattaaaaccaaaagtgttattaaatcattttatgctttgtattcgcgagttgctctcagcccacaaggataacctcggtactaccataaaactggtgatttttaatgagctctccagcgcccgtaacccaaacaatatgcaggtcctgtacaccgctctccaacacagcagcgaactggcccctaagtttcttgcaatggtgtttcaggatctgctgaccaacaaggacgattacctcagggctagtagagctctgttgcgggagataatcaaacaaactaaacatgagatcaatttccaggccttctgcctcgggcttatgcaggagaggaaggaaccgcagtacctggagatggagtttaaagagcgattcgtggtccacattacagatgtgttagcagtttctatgatgcttggcatcaccgcccaagtaaaggaagccgggattgcctgggacaaaggcgaaaagcgtaacctcgaggtgttgcgatcatttcagaaccagattgccgctatccagagggatgcagtctggtggctgcatacggttgttccatctatttccaagctcgcccccaaggattacgtacactgcctacacaaggtgttgtttacagaacagcccgagacgtactataagtgggataattggccccccgaatccgaccggaatttcttcctgcggctctgctccgaggtgccaatcctggaggatacactgatgaggatactggtgattggcctctcgagggaactgccactgggccctgcggatgccatggaacttgcggaccacctcgtgaaaagagccgccgcggtccaggctgatgatgtggaagtcctcaaggtggggcggacccaactaattgacgccgtcctcaatctgtgtacataccaccatcccgagaacatccaactgccccctggataccagccaccaaaccttgcaattagtaccctttactggaaggcctggccgctgctgctcgtagtcgcggctttcaacccagaaaacattggactggctgcgtgggaagagtatccaaccttgaaaatgctgatggaaatggtcatgaccaacaattattcataccctccttgcactcttacggatgaggagacacgtaccgagatgctcaacagggaactgcagaccgcccagcgtgagaagcaagaaattctcgcttttgaaggtcacttggcagccgcctctaccaagcagactattaccgagagtagctcactgctcctctcacagctcacaagcctggatccacagggtccccccagacgccccccgccccacatcctcgaccaggtaaagtcgttgaatcagtccctgagactggggcacctgctgtgtcggtcaagaaatcccgactttctcctacacatcatccagcgccaagcatcctctcagagcatgccttggctcgccgatcttgtccaaagctcagagggatcactagacgtgttgcctgtgcaatgcctgtgtgaattcctgctccacgacgctgtggatgacgccgcctccggtgaggaggatgatgaaggcgagagtaaggagcagaaggcaaagaagcgccagcgacaacagaagcagaggcagctgttagggcggctccaagatctgctcctggggcctaaagctgacgagcagacgacctgtgaagttctcgactactttctccgacgactaggttctagtcaggttgccagtcgtgttctcgccatgaaaggactgtcattggtcctgtccgagggatcgctgagggacggggaggagaaggagccccccatggaagaggacgttggcgacacagacgtcttgcagggctaccagtggctcttgcgggacctcccgaggctgcctttgttcgactctgtgaggtccacaacagcacttgccttacagcaagctattcatatggagacagatccccagacgatctctgcgtacttaatttatctgagccagcacacgcccgttgaagaacaagctcaacatagcgacctggcactggatgttgcaagacttgtagtcgagagaagcacaatcatgtctcacctctttagcaaactgtctccatcagcagccagtgacgccgtgttatcggctctgctgtcgatctttagcaggtatgtgagacgtatgaggcaaagtaaagagggtgaagaggtgtattcatggagcgaatcacaggaccaggtctttctgagatggagctccggtgagaccgcaaccatgcatatccttgttgttcacgccatggtcattcttctgaccctgggccctccaagggcagacgactcagagtttcaggctctcctcgacatttggttccccgaagaaaaaccccttcccactgcattccttgtggatactagcgaagaggccctgctgctgccagactggctgaaactcagaatgatcaggagcgaagtgcttcggctggtggacgctgcccttcaagacctggaaccacagcaacttctgttgtttgttcagtcatttgggatcccagtgagctccatgagtaagctgctgcaatttctcgaccaggcggtggcacatgatcctcagacactcgaacagaacatcatggacaaaaactacatggcccatctggtagaggtacagcacgaacgcggggcctccggcgggcagacttttcattctctcctgaccgcgtcactgccccccagacgcgatagtaccgaagcccctaagcccaagagctcgccagagcagcctatcggtcaaggaagaataagggtcggcacacagttaagggttctaggcccagaggatgacctggcgggcatgtttctacagatttttccacttagccccgatccacgctggcaatcttcttccccgcgtccagtagccctcgctctccagcaggcacttggacaagagttggcacgcgtggtccaaggctcaccagaggtgcctggtatcactgttagggtcttgcaggcgcttgccactctgctgagtagccctcatggaggtgccttagtgatgagcatgcacagaagccacttccttgcttgtcctctgctgcgacaactatgtcagtatcagaggtgcgtgccacaggacacaggattttcatccctttttctgaaggtgctgctgcagatgctccagtggctggatagccctggcgtggagggtggccctttgcgcgcacagttgcggatgctcgcttcccaggcttcagctggccggaggttaagcgatgtaagaggaggcctgctgagattagccgaggccctggctttccgccaagacttagaagtggtcagttctacagtgcgagccgtcatcgccaccttgaggtccggagaacaatgttccgtcgaacccgacttgatttcaaaggtactgcagggactgatagaagtgcggtctccacatctggaggaactgctgactgcctttttctcagccaccgccgatgccgctagccctttccccgcttgcaaaccggttgtcgtggtatcttctctcttactccaagaggaggagccactggcggggggaaagcctggggctgacggcggctctctcgaagcggtaaggttaggcccatcctctggcctgctcgttgattggcttgaaatgctggatccggaggtggtgtcaagttgccccgatttgcaactacgattactattttccagaagaaagggcaaagggcaagcacaggtaccgtccttccgcccatatttactcactctgttcacccaccagtctagctggccaacactgcaccagtgcattcgggtcctgctgggtaagtctcgagaacagagattcgacccttccgcgagccttgatttcctctgggcctgtatacatgtgccgcgcatttggcagggaagagatcagagaacaccccagaaaagacgtgaagagctcgtcctgcgagtgcagggcccagagctcatatcattggtagaactcatcttagcggaggcagagacgcgttcccaggatggtgacaccgccgcctgttcattaatccaggctcggctcccgcttctcctcagttgctgctgcggagatgatgaaagcgtgcgcaaggtgaccgaacatttgtccggctgcattcagcaatggggggacagtgttctgggacggcgctgtcgcgacctgctgctgcagctttacctgcaacggccggagcttcgcgttccggtgcctgaagtactccttcattcagagggtgccgcctcttcctcagtttgcaagctggacgggttaattcatagatttatcacactcctagccgacacgtccgattcgcgcgccctggagaatcggggagcggacgcctccatggcctgccggaaactggcagtggcacaccctctactcctcctgaggcatttgcccatgatcgctgccctactgcatggccgaacccacctgaactttcaagaatttcgacagcagaatcacctatcttgtttcctccacgtgctgggacttctcgaactactgcagccacacgtgtttcgaagcgagcatcaaggagctttgtgggactgtttgctaagctttatacggttgttactcaactatagaaaatcgagtaggcatctagcagcttttatcaacaagtttgtccagttcatacataaatatataacatacaacgcgcccgcggcaattagtttcctgcaaaaacacgctgatcctctgcatgatctgtctttcgacaactctgatctcgtcatgctgaaaagcctgctggccggtctgagcctcccgagtcgggatgatcgtaccgatcgaggtctagatgaggagggggaagaagagtccagcgctggttcccttcctctggtgagcgtgtctctgttcacgcccttgacagccgcagaaatggcaccctacatgaagagactctcaagaggacagaccgtggaggaccttctggaggtactgtccgatatcgacgaaatgagcagaagaagaccagagatactgtctttcttctccaccaacctccaacggctgatgtcgtcagctgaggaatgctgccgaaatcttgctttctcgctcgctctgagaagtatgcagaactcgccaagtatcgctgcagcattcctgccaacattcatgtactgcctgggctcccaagatttcgaagtagtgcagacagccttgcggaatctgccagagtacgctctgctgtgtcaggagcacgcagcagtcctcctgcaccgcgcttttctcgtcggcatgtacggccagatggatccaagcgcccagatctctgaggccctacgcatcctccatatggaggcagtgatgtag

SEQ ID NO: 26818 - DNA, 3612 bp, Artificial Sequence
  Description of Artificial Sequence: Synthetic coding sequence
aaagaccagcagactgtaattatgaccgaatgtacaagcctgcagtttgtgtctccgttcgcatttgaggcaatgcagaaggtggacgtggtatgtctcgcttccctgtcggatccagaattaagacttttactcccatgtcttgtgaggatggcgttatgtgcgccagccgaccaaagccaatcctgggctcaggataaaaagctgatactacgtcttctcagcggagtcgaagccgtgaatagcatcgtggcattgttgtcagtggatttccatgcgctggagcaggatgctagtaaggagcagcagctgaggcacaaattgggtggcggttccggggagagcatacttgtctcacagctgcaacatggtcttactctggagtttgagcattcagactctccacgacgcctgaggctcgtgctctctgagctcttggccatcatgaataaagtctctgaatctaacggcgagtttttttttaaaagttcagagttgtttgaatcccccgtgtacttggaagaagcggctgacgtgttatgtatattgcaggcagaactgcccagcctgctgccaattgtggacgtggcagaggcacttttgcacgtgcgcaacggggcctggttcctatgcctcttagtggccaatgtgcccgatagcttcaatgaggtctgtagagggctgatcaagaacggagagaggcaggacgaggaatcattgggtgggagacgcagaacagatgccctgaggttcctatgcaaaatgaacccgagtcaggctctgaaggtgagaggaatggttgtagaagaatgccatctgcctggattgggtgtcgccctgacactggaccacacaaagaatgaagcatgcgaagacggggtcagtgatttggtttgttttgtgtccggccttctcctggggacaaacgccaaggtgagaacctggttcgggacattcattagaaacggtcaacagagaaaaagagaaacttccagctccgtgctgtggcagatgaggcggcagcttctcctggaacttatgggcatcctgcccacagtgaggagcaccaggatcgtggaggaggccgatgtggacatggagcccaatgttagcgtgtactctggtctcaaggaggagcacgtggtgaaggcctccgccttgctacgcctctattgtgcactgatgggaatcgctggactgaagccaacggaggaagaagccgaacagctcctgcagcttatgacatctaggcctccggctactccggccggtgtgagatttgttagcctgtcattttgtatgttattagccttctcgaccctcgtgtcaactcccgagcaggaacagctcatggtagtctggctttcctggatgatcaaggaggaggcgtatttcgaatccacaagtggcgtgagtgcttcctttggggagatgctgttactggtagccatgtactttcactccaatcagttgagcgccatcatcgacctagtgtgtagtaccctcgggatgaagatcgttatcaaacccagctctctgagccggatgaaaactatcttcactcaggagatctttacagaacaagtggtgacagcacacgccgttcgggtccccgtgactagtaatttatccgcaaacattacaggatttcttcctatccattgcatataccaactcctcaggtcaagatcctttacaaaacataaggttagtatcaaggactggatatacaggcagctgtgtgagactagcacgcctttgcatcctcagctactgccgcttatagacgtctacattaacagtattcttactcccgctagtaagagtaatcccgaagctaccaatcagcccgtcacagaacaggaaatcttaaatattttccagggcgtgattggaggggacaatattcggctgaatcagcgcttctccatcacagcccagctgctggtgctatactatattctatcatacgaggaggcactgctggctaacacaaaaactctggcagccatgcagcgcaagcctaagtcatactcctcatcgctcatggaccagatccctattaagttccttattaggcaagcccagggcttacagcaagaacttggtggcctgcatagtgccttgctgcgactgctggctaccaactacccccacctgtgtattgtcgacgattggatatgcgaggaggagatcactggcaccgacgccctgctgcgaagaatgctgctgactaacaatgccaaaaaccatagcccaaagcaactccaagaagctttctcggctgtccctgtcaacaacactcaggtaatgcaaattatagaacatctgacactgcttagcgcatcagagctgatcccctatgccgaagtgctcaccagtaacatgtcacagttgctgaattcgggtgtcccaagacggatactgcagacggtgaacaagctgtggatggtgctgaatacagtcatgcccaggcgcctatgggttatgacagtgaatgcactgcagccatccataaagttcgtacggcagcagaagtatacgcagaatgatctaatgattgaccccctcatagtcctgcgatgtgatcagcgtgtacaccgctgtccgccattaatggatataaccctccacatgttgaacggatacctcctagcgtctaaggcttacctatctgcgcatctgaaggaaacagaacaggatcggccatcgcaaaacaacacaatcgggctagtcggacagacagacgctccagaggtgacccgcgaggagctgaagaacgccttacttgctgcccaggactctgctgctgtccaaatcttacttgagatatgtctgcctacagaagaagagaaggcgaacggagtcaaccctgacagcttgcttcggaacgtgcaaagcgtgattacaacaagtgcaccaaacaagggcatggaggagggtgaggataatctgctgtgtaacctccgagaggtccagtgtctgatctgctgcttgctccatcaaatgtacatcgctgaccctaatatcgcaaaactagttcatttccagggctatccctgcgagctgttgccacttaccgtcgctggcatcccaagcatgcacatttgtctggatttcattcctgagctgattgcccaacccgagttggagaagcagatttttgcaatacaacttttgagccacctttgtatccagtacgccctgcccaagtcattaagcgtggcccggctggccgtcaatgtgatgggcacacttttgacggttcttacccaagcaaagcgttatgcgttctttatgccgactcttccgagtctggtttcattctgtcgggcttttccaccgttatatgaggacataatgagcctgttaattcagatcggtcaggtgtgcgcaagtgacgtagccacccagacacgcgatatcgatcctattatcactcgactgcagcagatcaaagaaaaaccaagcgggtggagtcagatctgcaaagacagtagttacaagaatgggtctagagacaccggcagcatggaccctgatgtgcagctgtgtcactgtattgagcgcaccgtgattgagattattaatatgtctgtgtccggtatctag

SEQ ID NO: 26819 - DNA, 3615 bp, Artificial Sequence
  Description of Artificial Sequence: Synthetic coding sequence
atgaaggaccagcaaacagtgataatgaccgagtgcactagcttacagttcgtctcccctttcgcattcgaggcaatgcagaaggtggacgtggtctgtctagcctccctctccgacccagagctgagactgctgctaccatgtttggtgcggatggccctttgtgccccagccgaccaaagccagagctgggcccaggataaaaaactaatcctgaggctcttatccggagtggaggctgtgaattccatcgtggcgttgctttccgtcgactttcacgccctggaacaggacgcctccaaggaacagcagctgcgacataaactagggggagggagcggtgagtctattcttgtctcgcagctccagcatgggttgacgctggaattcgagcactcagattccccccggaggctccgactcgttctgagcgaactgttagccattatgaataaggtttctgaatccaatggggagttctttttcaagtctagcgaactcttcgaaagtcctgtctatctcgaggaagccgccgacgtgctgtgtattcttcaagcagagctgccaagtctgttgccaatcgtggacgtggccgaggcactcctgcacgtgagaaacggtgcatggttcctttgcctgctggtggcgaacgtccctgactcctttaatgaggtttgcaggggcctcatcaaaaacggcgaacgccaggatgaagagtcgttgggggggcgccgacgcacagacgccttgaggtttttgtgtaagatgaaccccagccaggcattgaaggtgcgggggatggtggtagaagagtgccacctcccaggtctcggtgtggccctgactctcgaccacaccaagaacgaagcttgtgaggacggagtgtctgacctggtgtgctttgtctcagggctcctgctgggaaccaacgctaaggtgcggacatggtttggcaccttcattaggaatggacaacagcgcaagcgtgagaccagcagtagcgtcctgtggcaaatgagacgacagttgttactcgagctgatggggatacttcctacagtacgatccacaagaatagtcgaggaggccgatgtggatatggagccaaacgtgtcagtttactctggcctcaaggaggaacatgtcgttaaagcaagcgccttattacggttatattgtgcactgatgggcatcgctgggctgaagcccacggaggaagaagccgagcagctcctacagctgatgacctctcgcccccccgccacaccggccggggtaagattcgtttccctaagtttctgtatgctgttggcattcagcacactggtgtctacacctgagcaagagcagctaatggtggtttggttgtcttggatgataaaggaagaagcatactttgagtcaaccagtggggtatctgcatcatttggggaaatgctcttgctggtcgctatgtactttcactccaaccaattgtctgccataatagacctggtgtgttccaccttaggcatgaagatagttattaagccatcctcactgtctcggatgaagaccattttcacacaggaaattttcacggaacaggttgtcacagcccacgccgtcagagtgccagtcacatctaatctgtccgctaacataaccggatttctccctattcactgtatatatcagctgctgaggtctcgttccttcacaaagcataaggtgtcgattaaagactggatttatcggcagctgtgcgaaaccagtaccccgctgcacccccagctgttgccactgatcgatgtctatatcaattctatactgaccccagcatctaagagcaacccagaagctactaaccaacctgttacagagcaagaaatcctgaacattttccaaggcgttattggtggcgacaatatcagactaaaccaacgattttctatcacggcccaactgctcgtcctttactatattctgtcttatgaagaggccctgctagctaacactaagaccttagcggctatgcagcgcaagccaaagtcctattcatccagtctgatggatcagattccgattaagtttcttattcgtcaggcccagggtctccagcaggaactcgggggccttcacagtgccctgctgcgcctgctcgctaccaattacccccatctgtgcattgtggacgactggatttgcgaggaagaaatcacgggaactgatgcattgctacgacgaatgctactgactaacaatgccaagaatcacagtcccaagcagttgcaggaagctttttcagcggtacccgtaaataatacccaggtgatgcaaataatcgagcatttgacgctgctgagcgcatctgagttgataccatatgctgaggtgctcacatccaacatgagccagctcctgaattctggcgttccccgacggatacttcagacagttaacaagctctggatggtcctgaatactgtcatgcccaggaggctgtgggttatgacagtgaatgctctgcagccttcgataaagttcgttcgacagcaaaagtacacccagaacgatctgatgatcgacccactgattgtgttgcggtgcgaccagcgcgtgcaccgctgccccccactcatggatataactctccacatgctgaacggttatcttcttgcttctaaggcctatctaagcgcccatctgaaggagactgagcaggatcgtccctcccagaataacaccatagggctcgttgggcagaccgatgccccagaagtcacccgcgaagaattaaagaatgctctgctcgccgcccaggactccgctgctgtgcagatactgctggagatatgtcttccaacagaggaagagaaagccaacggggtgaaccctgattccctgctcagaaacgtgcagtccgtaattactacgagcgctcccaataagggtatggaggagggcgaggataacctgctctgtaacctccgcgaggtgcagtgtctaatctgctgcctcctccatcagatgtacatcgcagacccaaacatagctaagttagtccacttccagggatacccatgcgagctcctgcctctcactgtcgctggcatcccatccatgcacatctgcttggattttattcccgagttgattgcacagccagagctagagaagcagatatttgcaatccagctgctttctcatctgtgcattcagtatgctctaccaaagagcctctccgtggcccgcttggcagtgaatgtgatgggcaccctgctgacagtgctgacacaggcaaagcgttatgcgttcttcatgccaaccttgccttctctcgtctctttttgtcgcgctttccctcccctgtacgaggacattatgtccctgctgatccaaattggccaggtttgcgctagtgacgttgcaacacagacccgcgatatcgatcctattattactcgcctgcaacagattaaggagaaaccaagcggatggtcacagatctgcaaggattctagttataaaaatggttccagggatactgggtcaatggacccggacgtgcaactgtgtcattgcatcgagagaactgtaatcgaaattattaacatgtcagtttctggcatttag

SEQ ID NO: 26820 - DNA, 3060 bp, Artificial Sequence
  Description of Artificial Sequence: Synthetic coding sequence
atgtcagctttgtgtgatccgccaggggcccctgggcccccgggtccagcaccagcaacccatgggcccgcaccactcagtgcgcaggagctttctcaggagatcaaggcattccttaccggagtggatcctattctgggacaccaactgagcgcacgcgagcacgcaagatgtggcctgctgttgctgagaagcctgcctcctgctagagctgctgtcctggatcacttacggggcgtttttgatgaatcagtgagggcacacctagccgcccttgatgagacccccgtggctggccctccccatctcaggcctcctcctccgagccacgtaccagcgggcggacctggcttggaagatgtggtccaggaggtgcaacaagtactctcagaattcatccgagcgaatcccaaggcttgggcccccgtcatttcagcatggtccatagacttgatgggacagctgtcgagtacctattcggggcagcatcagagagtcccgcacgctaccggtgctcttaatgagttattgcagctttggatgggatgtagagccacgaggacgttgatggatatctatgtgcagtgtctgtctgctctgattggttcatgtccagatgcgtgcgtcgacgcgttgctcgacacttcagtccaacactccccccatttcgattgggttgtggctcacataggaagcagttttcccggaaccattatcagccgagtcctgagctgcggccttaaggatttttgcgtacatggaggggctggtggtggtgccggatcttccggagggagcagtagccaaaccccatccacggatcccttcccagggtcccctgctattccagccgaaaagagagtacccaaaatcgcttctgtagtaggcatcctcggtcacctcgccagccggcacggcgactccatacgaagagagcttcttcggatgtttcatgactctctggcgggggggagcggcgggagaagtggcgatccaagcctacaggccaccgttccatttttgctacagctagcagtcatgtctccagcactgctgggtaccgtgtccggagaattggtggattgcctgaagcccccagcagtactgtctcaattgcagcagcatctgcagggattcccacgagaggagctagacaatatgctgaatctggccgtgcacttggtgagccaggccagcggagctggcgcctaccgtctgcttcagttcctagtggataccgctatgcccgctagtgttattaccactcagggcctcgctgttcctgatactgtgagagaagcatgcgaccgactcatccagcttctcttgctgcaccttcagaagctcgttcaccatcggggaggatctcccggtgaaggggtactgggtcccccgcctccccccaggcttgtaccttttctggatgcactcaaaaatcacgtgggcgagctgtgcggagagactctgcggctcgaacggaaacgatttctgtggcagcatcagctcctcggactgctaagtgtgtacacccggcctagctgtggcccggaggcactgggccatctcctgagccgggcaaggtcacccgaggaactctcgctagcaacccagctgtatgctggccttgtggtaagtctcagcggactcctaccgctggccttcaggtcttgtttagccagagtgcatgctggcacattacaacctccattcacggcaaggtttcttcgaaatctggcccttttggtgggctgggaacagcaagggggagaaggcccagccgctttaggggcacatttcggagagagtgcctcggcccacttgtcagatttggctcctctgctcctccaccccgaagaagaagtggccgaggctgcagcatccctgctagcaatctgtcctttccccagcgaggcactttcccccagtcagctgttaggactcgtccgagctggagtccatcgcttctttgcaagcctccgcttgcatgggcctcctggcgtggccagcgcatgccaactcctgacgcgcctgagccagactagtcctgccggactgaaggcagtgctgcagctcctggttgaaggcgccttgcaccgcgggaacaccgaactgtttggcggtcaggtggatggagataacgagacgctgtccgtagtcagcgcctccctggcaagtgcgagtctgctggacactaaccgacgtcataccgctgcagtgcctggcccgggtggaatatggtctgtgtttcacgctggggtaataggtcgcggtctgaaaccccctaaattcgtacagagccgcaatcagcaggaagtgatatacaatacccagtccttgctgagcctgctggtgcactgctgtagcgccccaggcgggactgagtgcggagaatgctggggggctcccatattgtcaccagaggctgccaaggccgtagcagtgactttagtcgaaagcgtttgcccagatgcagccggagcggagctcgcgtggcctcctgaagaacatgcaagagccacagtcgagcgggatttgcgcattggacggaggttcagggagcagcctctgctgtttgagttgttgaaactcgtggccgcagctcctcctgcgctctgctactgctcagtgctgctgcgcggtctgttagctgcactgttgggacactgggaggcttctaggcatccagacactacacactcgccctggcatctcgaagctagctgcactcttgtcgccgtcatggcggaaggttcactcctgccacccgctctggggaatatgcatgaagtatttagtcaactcgccccgttcgaggtaaggctcctgctcctgagtgtctgggggtttctgagagagcatggccctttgccgcagaagtttatctttcagtctgagagaggacggtttatccgcgatttttcacgggagggggggggagaaggcggaccccatctggcggtactgcactctgtgctgcacaggaatatcgataggcttgggctcttctctggtcgatttcaagccccatccccatctactctcctgcggcagggaacttag

SEQ ID NO: 26821 - DNA, 1659 bp, Artificial Sequence
  Description of Artificial Sequence: Synthetic coding sequence
atgctggatcataaggatctggaggcagagatccatccattaaagaacgaagaaaggaagagccaggagaacctgggcaacccatcaaagaatgaagacaatgtcaagagcgctccaccacaatcccgcttgtccagatgccgcgctgcagccttcttcctttccttgtttctgtgtctgtttgtggtgttcgtggtgtcttttgttataccttgtcctgacagaccggccagccagagaatgtggcgaattgactactccgccgctgtcatctacgacttcctggccgtggacgatatcaatggagatagaattcaggatgtactttttttatacaaaaatactaattcatccaataacttctctcggtcatgtgtggacgagggtttctcctcaccctgcaccttcgcagctgctgtctccggtgcaaacggatcaacgctgtgggaaaggcccgtggcccaggacgtggcccttgtggagtgcgccgtgccacagccacgaggaagcgaagcgccttctgcctgtattctggtggggcggccatcttctttcattgccgtgaatctgttcactggggaaacactgtggaatcacagcagctccttcagcggtaacgcttccattctgtcacccctgcttcaggtccctgacgtcgacggggacggggcacccgacctgctggtgctaacccaggagcgggaagaggtgagcgggcatctctacagtggctcaaccggtcaccagattgggctcaggggctctctgggggtggacggagagagtggatttcttctgcatgtcactcgtactggtgcacactatattctctttccatgcgcatccagcttgtgtgggtgctcggtgaaaggtttatacgagaaggtcaccgggagtggggggccatttaagagcgacccccactgggaatcgatgcttaacgccacaactaggcggatgctgtcgcactcatccggcgcagtcagataccttatgcacgtgcctgggaatgcaggggccgatgtgttgctggtgggatcagaggcatttgtgcttctggatggccaggagttgaccccccgctggacccctaaagctgctcacgtgctgaggaagccaattttcggcaggtacaaaccggacacgctggctgtggcggtcgagaatggaacgggcacggacagacagattttattcctcgacctggggactggtgcggtgctatgtagtttggccctgccctccctccccggaggaccactctccgcctccctgccaacagcagatcatcgcagtgcctttttcttttggggtctgcacgagctcggcagtaccagcgagactgaaactggcgaagctagacattctttgtatatgtttcaccctactctgccgcgcgtgttacttgaactggcgaatgtgagcacacatatagtggctttcgatgccgtcctgtttgaaccatctcgccatgccgcttacatcctgctcacaggtccagcggactctgaggccccagggctggttagcgtgattaagcacaaggtgagagatcttgtgcccagttcccgcgtggtccgacttggagaggggggacccgattctgatcaggccatcagggaccgttttagtaggctccgctaccagtccgaagcctag

SEQ ID NO: 26822 - DNA, 1659 bp, Artificial Sequence
  Description of Artificial Sequence: Synthetic coding sequence
atgctcgaccacaaagacctcgaggcagagattcacccactgaaaaatgaagagcgcaaaagccaggaaaacctcggcaatccctcaaagaatgaagataacgtcaagagcgccccacctcagagtcgcttgtctcggtgtcgagccgctgcattcttcctgagcttgtttttgtgtctattcgtcgtctttgttgtgtcgtttgtcataccgtgcccagatagaccagcctcccaacggatgtggcgcatcgattactcagccgccgtgatttatgacttcctggccgtggatgacattaacggtgaccggatccaagacgtactgttcctgtacaagaataccaattccagcaacaacttcagtcgctcttgtgtggacgagggtttcagcagcccttgtaccttcgctgctgcagtgagtggggcaaacggctctacactgtgggaaaggccagttgcacaggacgtagctttggtcgagtgcgcagtcccccagccgagaggctcagaggctcccagcgcttgcatcctagtgggaagaccatcatccttcatcgccgtcaatcttttcactggcgaaacgctttggaaccacagcagctcattctcaggcaacgcatccatccttagccctcttctgcaggtgcccgatgttgacggcgacggcgctccagatctgttggtgcttactcaagagcgggaagaggtcagcgggcacctgtatagtggcagcactgggcaccaaatcggcctgaggggctccctgggcgtggacggagagagcggattcttgctgcatgtgacccgcacaggggcccattacatcctgttcccttgtgccagtagcctgtgcggctgctcagttaagggcctgtacgaaaaagtgacaggcagcgggggtcctttcaaatctgaccctcactgggagtccatgttaaacgccacaacacggcgcatgctgtctcatagcagtggggcggtccgctacctgatgcacgtgccaggaaacgctggcgccgacgtactactcgtgggttccgaagctttcgtcctgctggacgggcaggaattgacccctcgatggacaccgaaggccgcacatgttctgcgcaagccaatctttggcaggtataaacctgatacacttgcagtggctgtagagaacggtactgggacggatagacagattcttttcctagatttgggcaccggggcagtcctctgcagtcttgcactgcccagtctgccgggcggacctctgtccgcttcactccccacagccgaccatcgaagtgctttctttttttggggcctgcacgaactgggatcaacctctgaaaccgaaacaggtgaagccaggcatagtctgtatatgttccaccctactctaccaagagtgctactagaattggctaacgttagcacacacatcgtcgcctttgatgccgtgctgttcgaacccagcaggcacgccgcgtatatactcctgactggacctgccgactccgaggccccgggacttgttagtgttatcaaacacaaagttcgggatctggtgccgtcaagccgtgtcgtacggctgggggagggggggcccgattctgatcaggcaatcagggacagatttagccggctgcgctaccaaagcgaagcctag

SEQ ID NO: 26823 - DNA, 210 bp, Artificial Sequence
  Description of Artificial Sequence: Synthetic coding sequence
atgctcgaccataaggacctggaggcagaaatccatcctctcaagaatgaggagcggaagagccaggaaaatctaggcaatcctagcaagaacgaggataacgtgaagtctgccccgccacagagtaggctctcccggtgcagagccgcagccttctttctgtccctgtttctctgtctgtttgtagtattcgtcgtgagcttcgtttag

SEQ ID NO: 26824 - DNA, 309 bp, Artificial Sequence
  Description of Artificial Sequence: Synthetic coding sequence
atgctcgatcataaggatctggaggctgagattcatccccttaaaaatgaggaacgcaagtctcaagagaatcttggcaatccatcgaaaaatgaagataatgtgaaaagtgcccctccccagagcaggctgagccgctgccgcgccgctgccttcttcttaagtctttttctatgtctctttgtggtattcgtcgtaagtttcgtcattccttgtcccgataggccagccagtcagcgcatgtggagaatcgattacagtgcagccgtgatttacgacttcctcgctgttgatgacatcaatgggtag

SEQ ID NO: 26825 - DNA, 702 bp, Artificial Sequence
  Description of Artificial Sequence: Synthetic coding sequence
atgctcgatcacaaggatctcgaggcggagattcacccgcttaaaaatgaagaacggaaatctcaggaaaacctcggcaatccaagtaagaacgaagacaatgtgaagagtgcgcctcctcagagccggttaagcagatgcagggctgccgcctttttcctctccctgtttctttgtttgttcgttgtctttgtcgtttcgttcgtgatcccgtgtccagatcgaccagccagtcagaggatgtggcgtatcgactactctgctgcagtgatctacgatttcctagccgtggatgacattaatggtgatcggatacaggatgtgcttttcctctataagaatactaactcaagtaacaacttctcacgctcgtgtgtcgacgaggggtttagttccccatgcaccttcgcggcggcggtcagcggagccaacggtagtaccctctgggagcgcccagttgctcaggacgtggcactcgtcgagtgtgccgttcctcaaccgaggggtagtgaagccccaagcgcctgtatactcgtgggacgtccttcatcctttatcgccgtgaaccttttcactggggagacactatggaatcactcgtcctcttttagcgggaatgctagtatactctctcctttactgcaggtgcccgatgtggacggggacggcgctccagatctgctggtgctgacccaggagtag

SEQ ID NO: 26826 - DNA, 156 bp, Artificial Sequence
  Description of Artificial Sequence: Synthetic coding sequence
atgctcgaccacaaagacttggaggctgagattcatcctctgaagaatgaagagagaaaatcccaagaaaatctcgggaatccctcaaaaaatgaggataacgtcaaaagtgccccaccacaatcaagactgtctcggtgtagagccgctgcctag

SEQ ID NO: 26827 - DNA, 1596 bp, Artificial Sequence
  Description of Artificial Sequence: Synthetic coding sequence
atgctggatcacaaagacctggaagcggaaattcaccccctgaagaacgaggagaggaagagccaggaaaacctggggaacccctctaagaatgaggacaatgtgaagtcggctccaccccaatcacgcttatctcgctgcagggccgccgccttctttctctctctgtttctgtgtctcttcgttgtcttcgtggtctccttcgtgattccgtgtccagaccgtcctgccagtcagaggatgtggcgaatcgattattccgctgccgtaatttatgacttcctggcagtagacgacattaacggggacaggatccaggacgtgctgttcctttataagaacactaactcatctaataatttttcacgctcttgcgttgacgaggggtttagtagcccctgtacttttgccgccgctgtttcaggagccaacggcagcactctgtgggagcgtcccgttgcccaggacgtagccctggttgaatgcgccgtaccccagccgcgcgggagcgaagcaccatccgcatgcattttagtcgggcgcccgagcagcttcatcgcggtcaacctattcacaggcgagacgctgtggaaccacagtagcagcttcagcggtaacgctagtatcctctcgcccttactccaggtcccagatgttgacggagacggagctccggacctgctggtgttgacccaggagagggaggaagtcagcggtcacctatacagcggtagtacaggccaccagattggcctgcgcgggagtctgggggtggacggggaaagcggttttctgctgcatgtaactcggaccggagctcactacatactttttccttgtgcctcatctctgtgcggctgctctgtaaagggtctgtacgagaaggttactggctccggaggcccctttaagtctgaccctcattgggagagcatgctgaacgccactacccggcggatgctttcgcactccagtggagctgtgcgatacctgatgcatgtaccggggaatgcaggagccgatgtcctgctggtagggtctgaagccttcgtgctgcttgacggtcaggagctgactcctcgctggacacccaaggccgcgcatgtgctcagaaagcctatatttgggcggtataaacctgacacactggccgtggcggtggagaacggcactgggaccgaccgccagatcctttttttagacctggggacgggagctgttttgtgttctctcgcactgcccagcttgccaggaggccctctgtcagcttccctgcccacagcagatcaccgctctgctttctttttctggggtcttcacgaacttggaagcacatccgagacagaaaccggggaagcacgccattcgctgtacatgtttcaccctaccctgccccgggtactgctcgagctggctaatgtgagcactcatatagtcgcattcgacggttctcactgggcaaccgccgagagattactcgacggcgcggaactagccccccgaccggcatgccccaggctggtcacgggtgtttgggaggcagctcgcttatgcatattgcttcctggcattcggtggcttatctactggttttag

SEQ ID NO: 26828 - DNA, 264 bp, Artificial Sequence
  Description of Artificial Sequence: Synthetic coding sequence
atgctggatcacaaggacctggaggcggagattcacccgctaaagaacgaagagcgcaagtcacaagagaatctggggaatccctccaagaacgaggataatgtgaagagcgcaccccctcagagccggctaagcagatgtcgcgctgccgctttcttcctgtcactgtttctctgcttgttcgtggtgttcgtggtgtccttcgttatcccttgcccagatagacctgctagtcagagaatgtggcgcatagactatagctag

SEQ ID NO: 26829 - DNA, 1623 bp, Artificial Sequence
  Description of Artificial Sequence: Synthetic coding sequence
atgctcgaccataaggatctggaggcggaaatacaccccctgaaaaacgaggagcgaaagagccaggaaaatctcggtaatccttctaagaacgaggacaacgttaagagcgcccccccacagtctcgtctttcaaggtgtcgggccgccgccttctttctctcattgtttctgtgtttgttcgttgtctttgtagttagtttcgttatcccctgtccggataggcccgcttcgcaacgaatgtggcggatcgactattctgcggccgtgatatacgattttctcgctgtggatgacatcaacggcgaccgtatccaggacgttctctttctttataagaataccaattctagtaataacttcagcaggagttgtgtggacgagggattctcatctccatgcactttcgccgctgccgttagcggggctaatggcagcaccctctgggagaggcctgtggcacaggacgtggctctcgttgaatgtgccgtgccccaaccgcgaggcagtgaagcccctagtgcatgcatattggtgggccggccaagcagtttcatcgccgtgaatctgtttactggtgaaactctctggaaccactcttcttcctttagcggtaatgcttctatcctttcacccctattacaagtacctgatgttgacggcgatggcgcacctgatctcctcgttttgacccaggaacgtgaagaggtgtctggtcatctttactcgggttcaacaggacatcaaattggcttgagaggatcccttggagtggatggggagagcggcttcctgttgcacgtgacacgcacaggcgcccattacatcctttttccctgtgccagttcactatgcggttgtagcgttaaggggctctacgaaaaggttaccggcagcgggggccctttcaagagcgatccccattgggaatcgatgctgaacgctacaaccagaaggatgctcagccactctagcggtgcagtgaggtacctgatgcacgtccctggaaatgcaggagccgatgtcttactggtgggctcggaggccttcgtgctgctggacggacaagaactcacgcctcgatggactcctaaagccgctcatgtccttcgaaagcctattttcggcaggtataagccggacactcttgccgttgcagtagagaatgggactggcactgaccgtcagattctttttctagacctgggaactggggcagttttgtgttcccttgctctgccatctttacccggcggtccactgtctgctagcttgcccactgccgaccatcgtagcgcatttttcttttggggcctgcatgagctgggatcaacgtcagagactgagaccggagaagctcggcatagcctgtatatgtttcacccaaccctgcctagggtgctgctggaactcgcaaatgtttccactcacatagttgcttttgacgctgtcctgtttgagccttcaaggcatgcagcttacatcttgttaacaggacccgcagatagcgaagctcccggtctagttagtgtgatcaagcataaggcccacacgggcagacagcggcggggaagctggaccggccagagttccaggagagacctccacgtgcgagtcttgtag

SEQ ID NO: 26830 - DNA, 711 bp, Artificial Sequence
  Description of Artificial Sequence: Synthetic coding sequence
atgttagaccataaagacctggaggctgagatccaccccttgaagaatgaagaaaggaaatcgcaggaaaatctgggtaacccttcaaagaacgaagataatgtgaaaagcgccccaccgcagtccaggctttcgcgttgcagagctgcagctttctttttgtccctctttctgtgcctattcgtggtgttcgtcgtatccttcgtgatcccttgtcccgataggccagcttcccaacgaatgtggaggatcgactacagcgctgccgttatttacgattttcttgccgtggacgacataaacggtgaccgcatccaggatgtcctgttcctgtataagaacacaaatagcagcaataatttttcaaggtcctgcgtcgacgaagggttcagttccccatgtacctttgccgctgccgtgagcggtgctaatggaagcaccctctgggagagaccagtcgctcaagacgtcgccctcgtggaatgtgccgttccacagccgaggggttccgaggcacccagcgcctgtattctggtgggtaggccatcatcattcatcgcagtaaatctgttcacgggggaaaccctgtggaatcactctagctccttcagtggaaacgcatccatcctgagcccactcctccaagttccggacgtcgatggagacggggcacccgatttgttggtgctcacacaagaacgggaagaatag

SEQ ID NO: 26831 - DNA, 3504 bp, Artificial Sequence
  Description of Artificial Sequence: Synthetic coding sequence
atggagctgccatttgtgacccacctgtttttacctctggtcttcctgacaggactatgcagccctttcaatctggacgaacatcacccacggctcttcccgggccccccagaggctgagttcggttacagtgtgctccagcacgttggaggtggacagcggtggatgcttgtgggagcaccttgggatggtccgtccggggataggaggggggatgtgtatcgctgcccggtggggggggcacataacgcaccctgcgccaagggacacctgggtgattaccaactcgggaactcctcccaccctgccgtaaacatgcatctagggatgagcctgttggagaccgatggcgatggtgggttcatggcatgtgctccactgtggagcagggcttgtgggtcatccgttttttcctctggcatatgcgcacgggtggacgctagtttccagcctcaaggaagtctggccccaactgcccagcgctgccccacatatatggatgtggtaatagttttagacggctcaaactcaatctacccatggtctgaagtgcagaccttcttacgcaggctagttggcaaactgttcatcgaccccgagcagattcaggtagggctggtccaatacggtgagtctcccgtgcatgagtggtcattgggcgatttccggacgaaggaggaagttgttagggccgctaaaaaccttagccgccgcgaagggcgtgaaacgaagactgcacaggcaattatggtagcttgcaccgaaggcttttcccagagtcatggaggtcgcccagaagctgcccgtctcttggtggtcgtgacagatggcgaaagtcatgacggcgaagagttgccagcggccctgaaagcctgcgaagctggaagagtgaccagatacggtatagcggtgttaggacattacctacggcgccagcgcgatccctctagctttctgagagagatcaggactattgcgtctgatcccgatgagaggtttttcttcaatgtgaccgatgaagcggccctgacagatatcgtggatgccctgggagacaggatctttggtttggagggatcccatgctgaaaacgagagctctttcggattggagatgagccaaatcgggtttagtactcataggctgaaggacgggatcctgttcgggatggtgggcgcttacgactggggtgggagcgttctttggctcgaaggcggtcataggctgttcccaccaaggatggcgcttgaggatgagttcccaccagccctacagaatcacgccgcctacctaggatacagtgtgagttccatgctgttaagaggaggacggagactattcctgtccggagccccccgttttagacaccgcgggaaagtcatcgctttccaactgaagaaggatggcgccgtgcgggtggcgcaaagcctccagggcgaacaaattggcagttactttgggagcgaactctgtcctcttgatacagaccgtgatgggactacagacgtgctcctggtcgcggctcctatgttcctgggaccccagaataaagagactggaagggtctacgtgtacctggtgggacagcagagcctgctgactctccagggtacacttcaaccggagcccccacaagatgcgagattcgggttcgcgatgggtgcccttcctgatctcaaccaggacggctttgcggacgtcgccgtgggtgccccattggaagacggtcatcagggagccctgtacctgtaccatggaacccaatctggagtccgcccgcatccagcccagaggatagcagcagccagtatgccccatgctctttcatactttggccgctcggtggacgggagacttgacctcgacggggatgatctcgtggacgttgccgtgggcgcccagggcgccgcaatcctgctgtcaagccgcccaatcgtccacctgacaccaagcctagaggtgacccctcaagccatttcagttgtccagcgtgattgccggcgacgaggacaggaagcagtatgccttactgccgctctgtgttttcaggttacttcgcggacccctggtaggtgggatcaccagttctacatgcggtttaccgcgagcctggatgaatggaccgccggagctagagccgcttttgacgggagcggtcaacgcttgagtcccagacgcctcaggctctccgtgggcaatgtcacatgcgagcagctccactttcacgtgctggacacgtcagattacttaagaccggtcgccttaaccgtgaccttcgctcttgacaatactaccaaacccggaccggtgctgaacgaaggaagtcctactagcatccagaagttggtgccgtttagcaaagactgtggcccagataatgagtgtgtgacagaccttgtgctgcaagtgaacatggacatccggggcagcagaaaggctcccttcgtcgtcagaggtgggcggcgaaaggtgctggttagcaccactttagagaataggaaagagaatgcttataatacaagcctgtcccttatattttctaggaacctgcacctggcttccctgacccctcagcgcgagtcaccaatcaaagttgagtgtgcggccccctctgctcatgctagactgtgtagtgttggtcatcccgtgttccagacaggagccaaagtgacttttttgctagaatttgaattttcttgctcaagcctgctctcccaggtattcgtcaagctgacagcaagctctgatagcctcgaaagaaatggcacactgcaggacaatacagcccagacgtctgcatacattcagtacgagcctcacttgctttttagtagtgagtccacactccatcggtacgaagtgcacccttacggcaccctaccagtcgggccaggccccgaattcaagaccactctgcgcgtgcagaacttaggatgctatgtagtgagtggactcattatctccgcactcctcccagcagtagcccatggcgggaactacttcctatcgctgagccaggtgattacaaacaacgcatcctgtatagtgcaaaatctgactgagccgccaggaccaccggtccaccctgaagaacttcagcatactaaccggctgaatggctctaatactcagtgccaagtggtccggtgccatctgggtcagctcgccaagggcaccgaggtttctgtcgggctgcttaggctcgttcataacgagtttttccggcgggcaaagttcaagagcctgactgtcgtgtcaacctttgagcttggaactgaggaggggagcgtgttacaactcaccgaggcatctaggtggtctgagtccctccttgaggttgttcaaaccaggccgattctgatttcgctgtggattctcatcggcagtgtcctggggggacttctcctcttggccttactcgttttctgcctgtggaaactggggtttttcgcccacaagaagatcccggaggaggaaaagagggaagagaaactggaacagtag

SEQ ID NO: 26832 - DNA, 3111 bp, Artificial Sequence
  Description of Artificial Sequence: Synthetic coding sequence
atgaacatcacccatgcatatagccaggggcatcagaagctcaatctcgatacagtatcatacaatatgcttggggttgatagcgacggctgtccaacatacatggatgtggtgatcgtcctggatggctcgaactcgatttatccatggtctgaagtccagacattcttacggcggctggtgggtaagctgtttatcgacccagagcagatacaagtgggtctcgttcagtacggtgagtcccctgttcacgagtggagcttaggcgacttcaggacaaaggaggaagtagtacgcgcagcaaagaatctgtcaagacgcgaaggcagggaaacgaagacggctcaggcgataatggtcgcgtgcacagaagggttttcccagagtcacgggggtcgccccgaagccgcgcgtctgctcgtggtcgttactgatggtgaaagccacgatggagaagagctcccggctgcccttaaagcctgcgaagcggggcgcgtaacaagatatggaattgctgttcttgggcattacctcagacgccagcgcgacccgtcaagcttcctgagggagattagaacgattgccagcgacccggacgagagatttttcttcaacgtgacagacgaagcagccttaaccgacatcgtagacgcgctgggagaccgcatcttcggtctcgaaggttcccacgcagaaaacgagagcagctttgggcttgaaatgtcacagattggcttctcaacacaccgcctcaaggacggcatcctcttcgggatggtcggggcttatgactgggggggcagtgtcctgtggctcgagggtggccataggctgttcccaccccgcatggccttagaggacgagtttccacccgctttgcagaaccacgccgcctatcttggatattctgtaagctcaatgctgctccgcgggggtcgacggctttttctgagcggggctcctcggttccggcaccggggaaaggtgatcgcattccaactgaagaaagacggcgctgtgcgggtcgcacagagcctccaaggagagcagatcgggagttattttggatcagaactgtgtcctctcgataccgacagagacggaactaccgatgttctacttgtggctgcccccatgttcttaggccctcagaacaaagagacaggacgagtgtacgtgtaccttgtggggcagcagagtctactcacgttacaagggaccctgcagccagaaccaccacaggacgccagatttggctttgcaatgggcgctctccctgacctaaatcaggatgggtttgccgatgttgccgtgggggcaccattggaggacggccaccagggtgccctctacttgtatcatggcacacagtcaggggtccggccccaccctgctcagagaatcgcagccgcctccatgcctcacgccctgagctactttggaaggagtgttgacgggagactggacttggacggggacgacctggtggacgtagccgtgggggctcagggcgccgccattctgctttctagtcgtcccatcgtgcatctgactccgtctctcgaggtgacacctcaagccatctctgtggtccaaagggattgccgtcggcgggggcaggaggccgtttgcctgaccgctgctctgtgcttccaggttacgtcgcggactcccggacgatgggatcatcagttttatatgaggtttacggccagccttgacgagtggacggctggcgcgagagccgctttcgacggttcgggccagagactctccccgaggcgcctgcgcctctcggtaggcaatgtgacatgtgagcagttgcacttccacgtgctagatacgtcagattacctccgaccagtggctctgaccgttacgtttgctttggacaataccaccaagcccggacccgttctgaacgaggggagccctacctccattcagaaactggtcccctttagtaaagactgcggccccgacaacgaatgcgtgaccgacttagtgctgcaggtaaatatggatatacgtggctccagaaaagccccgttcgtggtccgcggaggcagacgaaaagtgcttgtttctactactctcgagaatcggaaagaaaatgcttataatacatcgctatctttaatttttagcaggaacctccacctagcctcccttactccccagagggagtctccaataaaggtggaatgtgccgctccctcagcccacgcaaggctgtgcagcgtaggccatcccgttttccagactggagcgaaagttacctttctgttggagttcgaatttagctgttcttctctgctgtctcaagtttttgtgaaactcaccgcttcgagtgattcgctcgaaagaaatggaacgctgcaggacaacaccgcccagacctcagcttacattcaatacgaaccgcacctgctgttctcatccgaaagcacactgcatcgctacgaggtgcatccctatggcactctgccagtggggccaggtccagagttcaagacaacactgagggttcagaatctgggatgctatgtggtgtctggcctcatcatctctgctctattgcccgccgtggcacacggcggcaattattttttgagcctttcccaggtgattacgaataatgcctcctgcatcgtgcagaacctaacggagccacctggtccacctgttcatccagaggagctgcagcatacaaaccgcttgaacggctctaatacgcagtgccaagtggttcggtgccacctggggcaactggccaaaggcacagaagttagtgtgggactgctgcggctggtgcacaatgagttcttcaggagagctaaattcaaatccttaacagtggtgagtacgttcgagttgggaacggaagagggaagcgtgctgcagcttactgaggcctcccgatggtcagaaagcttactggaagtcgtgcagacacgtcctattctgatcagcctgtggatcctgatcggatctgtgttgggtggattactgctactcgctctgctcgtgttttgcctctggaagctgggcttctttgcccacaagaaaatcccagaagaggaaaagcgggaagaaaagctcgaacagtag

SEQ ID NO: 26833 - DNA, 3075 bp, Artificial Sequence
  Description of Artificial Sequence: Synthetic coding sequence
atggaactgccctttgtgacacatctgttcctacctttggtgttcctgacaggctgtccaacctatatggatgtggtgatagtgcttgatggcagcaattccatttacccttggagtgaagttcagacctttctccgaaggctggtgggcaaattgtttatcgacccagaacagatacaggtcggcttggtgcagtacggggaatcacccgtacacgagtggagtttaggggactttaggacaaaggaggaagtcgtccgcgccgcaaagaaccttagtcggagggaggggagagagacaaaaacagctcaggccataatggtggcttgcaccgaaggcttctctcagagtcacgggggccgcccagaagcagcccgtttgctcgtggttgttactgatggcgagagtcacgatggggaggagctgcccgcagccctgaaggcatgtgaggccggtagggtgacgagatacggcattgcagtcctgggacactacctgagacggcagagagaccctagctcattcttgcgcgagattcggaccatcgcgagtgaccccgacgagaggttctttttcaacgtaacagatgaggccgcgctcaccgatattgtcgacgctttaggcgatcgcatattcgggttggagggcagccacgcagaaaacgaaagcagttttggcttagagatgagccagattggcttctcaactcataggctgaaggatggcatcctctttggcatggtgggagcctacgactggggggggagcgtgttgtggcttgaaggcggccatagactgtttcctccaagaatggctctggaagacgagttccctcctgcgctgcagaaccacgcagcgtacctgggctatagcgtgtcttccatgcttctccgcggcgggcggagactctttctgagtggcgcacccagatttagacatagaggaaaagtgatagcattccaactgaagaaagacggggccgtccgcgttgcacagtcattacaaggcgagcagatcgggagctattttggctcggaactttgccccctggacaccgacagggacggcaccacagacgttctgttggtcgcagctcctatgtttttagggccccagaacaaggagaccggacgtgtgtacgtgtatctggtgggccaacaatcactgctgaccttgcagggcactcttcagccagaaccgccacaagacgcacgtttcgggtttgctatgggagctctgcctgatctcaaccaggatgggttcgcagatgtggccgtgggcgccccactcgaggatggacatcagggcgccctgtacttataccacggcacacaatcaggggtgaggccacatccagctcagcgtatcgccgcggcctctatgcctcacgcactatcttatttcggccgatcagtagatggccgcctggatttggacggagatgatctcgtggatgtggctgtcggtgcacaaggcgctgcaatattgctctccagcaggcccattgtacacctcacaccatcactcgaagtcactcctcaggccatctccgtagttcaacgcgactgtcggagaaggggtcaggaagcagtgtgtctgacggctgccctttgttttcaagtcacctcccgaacacccggcaggtgggatcatcagttctacatgcgtttcacagcctcactggacgaatggaccgcgggggcccgggccgccttcgacggctccggtcagcgcttgtccccccgccggctcagactctccgtcggcaacgtgacttgcgaacagttgcactttcatgtgctcgacactagtgattatctaaggcctgttgcccttaccgtgacattcgctttggataataccaccaaacccgggccagtgttgaacgaaggctctccgacatccatccaaaagctggttccttttagtaaagactgtgggccagacaacgagtgcgtgactgatctggtgctgcaagtcaacatggacatccggggctcccgtaaggctcccttcgttgtcaggggagggcggaggaaggtgctcgtctctacgactctggagaatcgaaaagaaaatgcctataataccagccttagtcttatattttcgcggaacctccacctcgcaagtcttacgccacagcgtgaaagccccatcaaggtggaatgtgctgcccctagcgcacatgctaggttgtgctctgtcggacatcccgtctttcaaaccggagccaaagtgacttttcttctcgaatttgagttctcttgctcctctctgctgtcacaggtgtttgtgaaactgacggcatccagtgacagccttgagcgaaacggcaccctacaggacaataccgctcagacctcagcctacatccaatatgaaccacacctgctgttcagtagtgaaagtactctacaccgctacgaagtccacccctatggtaccttaccagtgggcccaggcccggagttcaagactactcttagagtgcagaatcttggatgttacgtggtctccggcctgatcattagcgccttattgccagcagttgcacacggggggaattattttctatctttgagtcaggtgattacgaacaacgcatcatgtatcgtgcagaatctgaccgagccaccaggaccgcctgttcacccggaggaactgcaacacactaacaggctgaacgggtccaatacccagtgtcaggttgttaggtgtcacttgggacagctagcaaaggggaccgaagtttcagtgggcttattgcggctggttcacaacgagttctttagaagggccaagttcaagagcctgaccgtggtctcgaccttcgagctgggcacagaggaaggatccgtgctgcagttgaccgaggcctcaagatggagcgagtcccttctagaagtggtccagaccagaccaatcctcatttcactatggatcctgattggtagcgtgctcggggggctcctgctcctggccctccttgtcttttgtctgtggaaacttggattctttgcccacaagaaaatcccggaagaggagaaacgcgaagaaaagcttgagcagtag

SEQ ID NO: 26834 - DNA, 3288 bp, Artificial Sequence
  Description of Artificial Sequence: Synthetic coding sequence
atgaatattacacacgcttatagccagggtcaccaaaaactcaatctagatactgtcagttacaatatgcttggcgttgattctgacgggtgttggtgggccccacctgggatgggactgcaagccacaggcgggggcgctcacaacgcaccatgtgcaaagggccacctcggggattatcagctgggcaactcgtcgcatcctgccgttaacatgcacctgggtatgtctctcttagagaccgacggggatggaggttttatggcgtgtgctccactgtggtcaagggcctgtggatcctccgtgtttagctccggcatttgcgcaagggtggatgccagcttccagccgcaggggagcctcgcgcctacggcccaacgctgccccacctacatggatgtggttattgtgctggacggcagtaatagcatttacccttggtcggaagtgcagaccttcttacgaaggcttgtgggaaaactgtttattgatcctgagcagattcaggttggtctggtccagtacggggagtcccctgtccatgagtggtccctgggggattttcgaacaaaagaagaggtggtcagagccgcaaaaaatttatcgagacgcgaggggagggagacaaaaaccgctcaagccattatggttgcttgcacagaaggcttctcgcagagtcacggtggcaggccagaggctgcccggttgctggtggtggtaaccgacggggaatcccatgatggtgaagagctccctgccgctctcaaagcctgcgaggctggacgggtgacaaggtacggtattgcagtcctggggcactacctgaggaggcagcgagatccctccagcttcctgagagaaatccgcaccatcgcctctgatccagacgaaagatttttttttaacgtaaccgatgaagctgcattaacagatatcgtggatgcgctgggagaccgcattttcggcttggaaggcagccacgctgagaatgagtcgagctttggactcgagatgtcccagattggattctctactcatcgcttgaaggacgggatcctcttcgggatggtcggagcatatgactggggaggttcagtattgtggctcgaagggggccacaggctcttcccgccccgaatggctttggaggacgagtttccaccagccctgcagaaccacgctgcatacttgggctatagcgtgagctcaatgctgctgcgaggggggcgaaggctgttcttgtctggcgcgcccaggttccgacaccgaggaaaggtgattgcctttcagttaaagaaggacggcgccgtccgagtcgcccaaagcctccagggcgaacaaatcgggtcatactttggctctgaactgtgtcccctggataccgatagggacgggaccactgacgtccttctcgtcgctgccccaatgtttctaggtccccagaacaaggaaacggggagagtctatgtgtacttggttggccaacagtctctgctgaccctgcagggcaccttacagccagagccaccgcaggacgccagattcgggttcgccatgggagctctgcccgatttgaaccaggacggatttgcagacgtggccgtcggagccccactggaggatgggcaccagggggctctatacctctaccacgggacccagagcggagtgcgtccacatcctgcccagagaattgctgctgctagcatgcctcatgctctatcctacttcggccggtctgtagatggacgcctggacctagacggcgatgatctggtggacgtcgctgtgggtgcccaaggtgcagccatcttgctgtcatctcggcccatagttcacctcaccccttcactggaagtgactccccaggccatctccgtggtgcaacgtgattgtcgccgcaggggacaagaggccgtctgcctgaccgcagctttatgctttcaagtcacctcacgcaccccggggcgatgggaccaccagttttatatgaggttcaccgcaagcctcgacgagtggacagcgggagccagggcggcattcgacggcagtgggcagcggctgagtccccggcgtctgcgtctgtccgtgggaaacgtgacttgtgagcagttgcatttccacgtccttgacaccagcgactatctgaggcctgttgctctcacagtcacattcgctctagacaacacaactaagccgggacccgtgctcaacgagggctctcctactagcatccaaaaactggtgcccttttcgaaggactgcggccctgataacgaatgtgtgaccgacctggtgctgcaggttaacatggatatacggggctcccggaaggccccattcgtagtgcggggggggcggcgcaaagtcctcgtatccaccacacttgaaaacaggaaggagaatgcttataacacatcacttagccttatcttctctcgcaatttgcacctggcttccctcacccctcagagggagtcccctattaaagtggagtgcgccgctccaagcgctcacgccaggctttgttcagttggtcatcccgtctttcagactggggccaaggtgaccttccttctcgagtttgagtttagctgcagttcactcctctctcaggtatttgtgaaactgactgccagctccgactctctcgagagaaacggaacactgcaagataatacagcccagacttccgcttacattcaatatgaaccacacctgttgttcagttctgagtcaaccctgcatcggtacgaggtgcatccctatggcacattaccggtgggtccgggcccagaatttaagacaacactgagagttcagaatctgggatgctacgtggtctctgggttaataatctccgccctactccctgcggtcgcccacggcggtaattactttctgagcctgtctcaagtcataacaaataatgctagctgcatcgtgcagaatctgaccgaacctcccggccctcccgtgcacccggaggagctgcagcataccaatcgtctggcgaaattcaagagcctcacagtcgtgtcaactttcgaactgggaacggaagaaggcagcgtccttcagcttaccgaggcttcaagatggagtgagtccctgctcgaggtggttcagaccaggccaatcctcatttccttgtggattctgatcggtagcgttcttggcggcctgttacttttagcgttgttagttttctgcctgtggaagcttggatttttcgctcataagaagataccagaagaggagaagcgagaggagaagctcgagcagtag

SEQ ID NO: 26835 - DNA, 3192 bp, Artificial Sequence
  Description of Artificial Sequence: Synthetic coding sequence
atgtcccctggcgcctctaggggaccacgaggcagccaagcacccctgatcgccccgctctgttgcgccgccgcggcgctcggcatgctgctgtggtctcctgcttgccaggcttttaatctagatgtggaaaaactgactgtctatagtggtccgaaaggctcttacttcggatacgcagtggatttccatattcccgacgcccgtactgcctccgtcttagtgggagcgcctaaagctaacacaagtcagcctgatatagtggaaggcggggctgtgtactactgtccctggcccgccgaggggtcagcccagtgccggcaaatacccttcgataccaccaacaatagaaagatcagagttaacggaactaaggagcccattgaattcaagagcaaccagtggttcggggccactgtcaaggcccacaaagggaaggtggtggcctgcgcccctctctatcattggcgcacactgaagccaactcctgagaaggatccagtcggcacctgctacgtagccatccaaaacttctcagcatatgctgagttctctccttgtcgaaacagcaatgctgaccccgaagggcaggggtactgccaggctggcttctctctcgacttttacaaaaatggtgatttgattgttggcggtccgggatcattctattggcagggccaggtcatcactgctagtgtcgctgacataatagcaaattactcttttaaagatattctgagaaaactggcaggcgaaaagcagaccgaggtggcaccggcttcttacgacgattcctatttgggatacagtgtagccgccggcgagttcacgggagactcccaacaggagttggttgccggaatccccaggggcgctcaaaattttgggtatgtgtccataattaatagcaccgacatgacctttatacagaatttcacaggtgaacaaatggcctcgtacttcggttacacggtagttgtctcagatgttaattctgatggtctagacgatgtgttggtgggcgccccgttgttcatggagcgtgagtttgaaagcaatcctagggaagtgggacaaatctacctgtatctccaggtgtctagtttgctgttccgcgatcctcagatcctgaccggtactgagaccttcgggcgatttggctccgcaatggcacacctaggtgacctaaatcaagacggatataacgatatcgctatcggcgtgccgttcgcagggaaagatcagcgcggaaaagttcttatttacaatgggaataaggatggtctgaacacgaagccgtcccaggtcctccagggggtatgggcctcccacgcagttccaagcggtttcggcttcacgctgcggggggatagcgacatcgacaagaacgactaccccgatctaatcgtgggtgcctttgggaccggcaaggtggccgtatacagggctcgtccggtcgtcactgtcgacgcccagcttctccttcatccaatgattattaatctggaaaataagacgtgtcaggtgccggattcgatgacatctgcagcatgtttttctctgagagtgtgcgcgagcgtcaccggccaatcaatcgccaataccatcgtcctcatggcagaggtgcagttggatagcctgaagcaaaagggcgccattaagagaacgctatttctggataatcaccaggctcaccgagtcttcccccttgtcattaaacgtcagaaatcccatcaatgccaagactttattgtttacctgagggacgaaaccgaattcagggataagctctcacccatcaacatcagtctcaattacagcctggatgagtccacttttaaggaggggcttgaggtcaaacctatcctcaactattaccgggaaaatatcgtgagcgaacaggcacatatcctagttgactgcggagaggacaatctgtgtgtgcctgacctgaagctatctgcacgccccgacaagcaccaagtgatcatcggcgacgagaatcatctaatgcttatcataaacgccaggaacgagggtgagggagcttacgaagctgaactgtttgtgatgatcccagaagaggcagattatgtgggaatagagagaaacaacaagggattcagacctctgtcctgtgagtacaaaatggaaaacgtgacccggatggtcgtctgcgacctgggaaacccaatggtgagtggaactaactattccctaggcctgcgtttcgccgtgcccagacttgagaaaactaacatgagcattaacttcgacctgcagatacgttccagcaacaaagataatcctgactccaatttcgtcagcctccagattaacattaccgccgtagcccaggtggaaatcaggggagtgagtcatcctcctcagatcgtcttgcccatccataattgggaacccgaggaggagccacacaaggaggaagaagtgggtccactggtggagcacatctacgaactgcataatatcggaccctctactataagcgatactatacttgaggtcggctggcccttcagcgctcgcgatgagtttctattatatatatttcacatccaaacattggggcccttgcagtgtcagcctaatccaaacattaatcctcaggacataaagcctgcggctagccccgaggacaccccagagcttagcgccttcttaaggaatagcacaatccctcatctcgtcaggaagcgcgacgtccacgtggtggagtttcacaggcaaagcccagcaaagattctgaattgtactaatatcgagtgccttcagatctcatgcgctgtgggacgcttagagggcggtgaatccgctgtgttgaaggttcgctctcgactttgggcacatacttttttacaacggaagaacgatccttatgcgttagcctccttagtgagtttcgaggtgaagaaaatgccctacacagatcaaccggctaaactgcccgaaggcagcatcgtgataaagacatctgtcatttgggctaccccaaatgtcagtttctccattccattatgggtcattatcctggcaatcctgctaggactattagtcttagccatcttaactctagccctgtggaaatgtggatttttcgatcgggcccggccgccacaagaggacatgacagacagagaacagctcacgaatgataagacccctgaagcctag

SEQ ID NO: 26836 - DNA, 3147 bp, Artificial Sequence
  Description of Artificial Sequence: Synthetic coding sequence
atgtcgcctggggctagtcgggggcctcgcggatcccaggccccactgatcgcccccctttgctgcgccgctgcagctctgggcatgcttttgtggagtcccgcatgccaggcatttaaccttgatgttgagaagctcaccgtgtactcgggcccaaaaggctcatacttcggttacgcagtggattttcatattccagatgcaagaacggctagtgtcctggtgggcgcgcccaaggcaaatactagtcagcctgacatcgtggagggtggagccgtgtactactgcccctggcctgctgagggttccgcccaatgccgtcagataccattcgacaccacgaataacagaaagatcagagtgaacggtaccaaagagcccatcgagttcaaaagcaaccagtggtttggggcaaccgtgaaggctcataagggtaaagtcgtggcatgcgcccctctgtatcattggcggaccctgaagccgactccagagaaggaccccgtgggaacttgctatgtggcaattcaaaacttttccgcatacgccgaattcagcccatgcaggaacagcaatgctgatccagagggtcagggctattgtcaggccgggttcagccttgacttctataaaaacggagacctgatcgtgggcggacctggtagcttttattggcaaggtcaggtaattactgcgagtgtggcagacattatcgcaaactatagcttcaaagatatattgcgcaagctggccggtgagaagcagaccgaagttgccccagccagttacgacgattcatacttggagttggtagccggtattcctagaggagcccagaacttcggttacgtgtccatcattaattcaacagatatgacctttatccagaactttacaggcgaacagatggctagctactttggctatacagttgtggtttccgatgtaaactccgacggcctagacgacgtgctcgtgggagcccctctctttatggagcgggaattcgagtccaacccgcgcgaggtggggcagatatatctgtacctgcaggtgagttcactccttttccgggacccgcagattttgaccggcaccgagactttcgggcggttcggatcagctatggctcacttaggagacctgaaccaagacggctataatgatattgccatcggagtgcccttcgcgggtaaggatcaacggggcaaggtgctcatctacaacggaaacaaagacgggctcaacacaaagcctagtcaggttttgcagggagtgtgggcatctcacgcagtgcccagcggctttggttttactttgcggggcgattctgatatcgacaaaaacgactatcctgacttgatagtcggggcattcggcacgggcaaggttgctgtgtatagagcccggcccgtagttacagtggacgcccagcttctgctgcatcccatgattatcaacctagagaacaaaacctgtcaagttcctgactccatgacaagcgctgcttgcttctccctgcgagtttgcgcaagtgtgactgggcaatcaatcgccaatactattgtgcttatggctgaggtccagcttgattccttgaagcagaaaggcgccattaagagaaccttgttcctggataatcatcaggcccatagggtgttccctttggtgatcaaacggcaaaagtcacatcagtgtcaagattttatcgtctatctgagagacgagaccgagttcagggacaaactcagtcctataaacatcagccttaattatagcctcgacgagtctacctttaaggagggactggaggtgaaacccattctcaattactaccgagaaaatatcgttagcgagcaagcgcacatcctggtagattgcggagaggataacctgtgcgtgcctgacctaaagttatcggccaggccagacaaacatcaggttattattggagatgagaaccacctgatgctgatcattaacgcacgtaatgagggagagggagcctacgaggccgaactttttgtcatgatcccggaagaggcagactacgtcggcatcgagcgcaataacaaagggttccgcccgctgagctgtgaatacaagatggagaatgtgactcgtatggttgtctgtgatctgggaaatccaatggtgagcggaaccaactactctctcggtctcagattcgcagttcctcgcttggagaagacgaatatgtctataaacttcgatctgcagattcgatcctcgaataaagacaacccagacagcaatttcgtgagcctccaaatcaacatcaccgcggttgcccaagtcgagattagaggggtttctcacccccctcagatcgtcctgcctatacataattgggagccagaagaagagccccataaagaagaagaggtgggacccttggtggagcatatatacgagttgcataacatcgggccttccaccattagcgacacgattcttgaagttggatggcccttttcagcacgagatgagttcttgctatatatctttcatatccagaccctgggtcccctgcagtgtcaaccgaacccgaacatcaatcctcaagacataaaaccagcggctagccccgaagacacaccagaactttcagcctttcttcgtaactcaaccattcctcatctggtccgcaagcgtgatgtccacgtcgttgagtttcatcgacagagccctgctaaaatcctgaactgcaccaacatcgaatgtctgcaaatttcatgtgccgtgggacgcttggaaggaggagagagcgcagtgctgaaagtccgttcccggctgtgggctcacactttcctacagaggaagaatgacccatacgctctagctagcctcgtgtctttcgaggtcaaaaaaatgccttacacggatcaacctgctaaactgccagagggatcaatcgtcatcaaaacatccgttatatgggcaacacccaacgtctccttcagtatccccctctgggtgattattctggccatcttgctgggcctccttgttctggccattctgaccctcgctttgtggaagtgcggatttttcgacagggctagaccacctcaggaggacatgacagacagggagcaactcaccaatgacaaaacgcctgaagcctag

SEQ ID NO: 26837 - DNA, 3540 bp, Artificial Sequence
  Description of Artificial Sequence: Synthetic coding sequence
atgtggctgttccacactctgctctgtatagcaagtctggcgctcctggccgcttttaatgttgacgtggcccgtccttggttgactccaaaggggggcgccccttttgttctatcaagcttgttgcatcaagatccctcaacaaaccaaacctggctgctggtcaccagtcctagaaccaagaggacccctggcccattgcatcgctgcagcctggtccaggacgaaattctgtgccacccggtggaacatgtgcccatccctaaagggcgacaccgcggagtgaccgtcgttcgctcccaccatggagtgttaatctgcatccaggtgcttgtgcggcgcccccactctttgagcagcgaactcaccggtacgtgtagtctcctcggtccggacctgcggccacaagcccaggcaaacttctttgatcttgaaaacctgttggaccccgacgcccgcgtggatactggggattgttattctaataaggagggaggtggtgaggatgatgtgaatacggcacggcagagaagagccctggagaaggaggaggaggaggacaaggaggaagaagaggacgaggaggaggaggaggctggcaccgagattgcaatcatcctagacgggagcggttcgattgatccaccggatttccagcgcgccaaggacttcatttctaatatgatgaggaacttttacgagaagtgcttcgaatgcaatttcgctcttgtgcagtacggcggggtgatccagactgagttcgacctccgcgattcgcaggacgtgatggcatccttggctagggttcagaatattacacaagtgggtagcgtcacgaaaacagcatccgctatgcaacacgtgctggactccatatttacgtcatcacacgggtcacgcagaaaggccagcaaagtgatggtggtcctgacagatgggggcatcttcgaagatcccctaaacctgacaactgtcattaactctcctaagatgcagggcgtggaaaggttcgctattggggtgggagaagagttcaagtccgcccggactgctcgggagctgaatctgatcgctagcgatcctgacgaaacacatgctttcaaagttacaaattacatggctctcgatggactgctgagtaagttacggtacaatatcatcagtatggaggggactgtgggtgacgctttgcactaccagcttgcacaaatagggttttccgcacaaattttggacgaaagacaagtcctactgggcgcagtgggtgcattcgattggagcggaggggctttactgtacgataccaggagcaggagagggagattccttaaccaaaccgcagccgctgccgccgacgcggaggctgctcagtacagttaccttggttatgcggtggctgttctccataaaacatgcagcctctcttacatagccggagctccaaggtataagcatcatggagcagtgttcgagctacagaaggagggacgtgaagcctcttttctgcccgttctggagggcgagcagatggggtcttacttcggctctgaactgtgtcctgtggatatagacatggacggtagcacagactttttactggtggccgcccccttttaccacgtacacggcgaggagggtcgtgtctatgtgtaccgactatcagaacaagatgggtccttttccctcgctaggatcctctccggccatccagggttcaccaacgcgcgcttcggctttgccatggctgctatgggggatctttcgcaggataagctgacagatgtggcgatcggcgctcccctcgagggattcggtgcagacgacggcgcttcctttggtagcgtatacatctataatgggcactgggacgggctgtcagccagtcccagccagagaattcgggcctccactgttgctccaggactgcagtactttggtatgtccatggcgggcggttttgacatttccggagatggcctggctgacatcaccgttggaaccctgggacaggccgtggtttttcgcagccgtccagtggtgcgattgaaggtgagtatggccttcacacccagtgctctgcccattgggttcaacggcgtggtgaacgttcgtttatgtttcgaaatttcctccgtgacaaccgccagcgaaagcggactgcgcgaggcattgctgaacttcacacttgacgttgacgttggtaagcagaggagaaggttgcaatgctctgacgtgaggagttgcctcggatgtttacgggagtggagttcggggagccagctctgtgaagacctgctgctaatgcccacagaaggagagctgtgcgaagaggactgcttttcaaatgctagcgtcaaggtctcctatcagctccagaccccagaggggcagacagatcatccccaacctattctagatcggtataccgagccttttgccattttccaactaccctatgaaaaagcatgcaagaataagctattttgcgtggctgagctccagctggctactactgtttcacaacaggagttagtggtaggactgacaaaggaactcacgcttaacataaacctgactaatagtggggaggactcctacatgacttcaatggcattaaattacccgcggaacttgcagcttaagcgcatgcagaaaccaccatctcctaatattcagtgcgacgatccccagccagtcgcctccgtcctgataatgaactgtcgcatcggccatcccgtcctcaaacgatccagcgctcatgtgtccgtggtgtggcagctggaagagaacgcatttcccaaccgcacagctgatatcacagtaacggtgactaatagcaatgaacgcagaagcctggctaacgagacgcatacactgcagttccggcatggttttgtggcagttctgtctaagccatccattatgtacgtcaatacaggccaagggctgtcacaccacaaggagttcctctttcacgtgcacggagagaatctatttggagctgaataccagctccagatatgcgttccaactaagctgagaggactgcaagtggtcgccgtcaagaaactgactagaacccaggctagtaccgtgtgcacatggtcacaagagcgcgcttgcgcatacagctcagtccagcatgttgaggaatggcactccgtgtcctgcgtcatcgccagtgacaaggaaaacgtcacagtggctgcagagatcagctgggatcatagcgaggagctcttgaaagacgtaaccgaactccagatactgggtgaaatctcatttaataagtctttgtatgaaggcctaaacgccgagaatcacagaacaaaaatcacagtcgtgtttctgaaggacgagaagtaccatagtcttcccatcatcattaaagggtcggtgggtggcttattagtcctgatagtcattctagtcatcctgttcaagtgtgggttcttcaaaaggaagtatcagcaactgaacctagagtcaataaggaaagcgcagctgaaatcagagaatcttttggaggaagagaactag

SEQ ID NO: 26838 - DNA, 2400 bp, Artificial Sequence
  Description of Artificial Sequence: Synthetic coding sequence
atgccgcgggcccccgcccccctatacgcctgccttcttggtctctgtgcccttcttccccgactggctgggcttaatatttgcacgtccggctctgccacttcctgcgaagaatgcctgctcatccatccaaaatgtgcttggtgtagcaaagaagattttgggtccccccgctccattaccagccgttgcgatctccgggccaaccttgtcaaaaacggatgcgggggagaaatcgagagtcccgcatcttccttccatgtgctcaggagccttcccctctcaagcaagggatcaggatcagctgggtgggacgtgattcaaatgacgccacaagaaatcgcggtgaacctcaggcccggcgacaagacgacattccagctgcaggtgcgacaggtcgaggattacccagtcgacttatactatctgatggacttgtctctgtcgatgaaagatgatctggataacatccgctccctcggaacgaagttggctgaggagatgcggaagctaacttctaactttcgcctagggttcggctctttcgttgataaagatattagtccattttcttataccgctccacgctatcagaccaatccttgcattgggtacaagctgtttccaaactgcgtgcccagttttggcttccgccacttacttccccttactgaccgtgtggacagctttaacgaggaggtcagaaaacaacgggtttcaagaaatcgtgacgctcccgagggaggattcgacgcggtgctccaagccgccgtttgcaaggaaaaaattggatggcgcaaagatgcgttgcacctcctcgtcttcactaccgacgacgtgccccacattgctctcgatggtaaactcggaggtctggtgcaaccccatgacggccaatgccatctgaacgaggcaaacgagtacacggcctccaaccagatggactacccctctctggcactgctcggcgagaagctggctgagaacaatatcaacttgatttttgccgtgacaaaaaaccactacatgctttacaagaactttaccgcactgattccaggtaccaccgtggagatcctagatggggactccaaaaacattatacagctgattataaatgcctacaactcaattcgctccaaggttgagctgtctgtctgggatcagccagaggacttaaacctgttcttcactgctacatgtcaggacggggtttcatatccagggcagagaaagtgtgaaggccttaaaattggggataccgctagtttcgaggtgtccttggaagctagaagctgcccatcgcgccataccgagcatgtctttgctctgaggcctgtggggttcagggattctcttgaggtgggcgtgacctataactgcacatgcgggtgctccgttggactcgagccgaactctgctcgatgtaacggttcgggcacctatgtctgtggactgtgcgagtgctccccaggttacctggggactcggtgtgaatgccaggacggtgaaaaccagtcagtttatcagaacttgtgtagagaagcagagggcaagcctctgtgctccggtaggggtgactgctcttgtaaccagtgctcttgttttgaaagcgaattcggcaagatttacgggcccttctgcgaatgcgacaacttctcttgtgctcggaataagggcgtgctctgttctggccatggggaatgccattgtggcgagtgcaagtgtcatgctggttatattggcgataactgcaattgctctactgacatttcaacctgcagaggaagggatggtcagatctgtagtgagcgcggacactgtctctgtggccaatgccagtgtacagaaccgggtgctttcggagagatgtgtgaaaagtgtccaacctgcccagacgcgtgctctacaaaacgggactgcgtggagtgcctcctgctccactctggtaagcctgataatcaaacctgccatagtttgtgtcgggatgaagtgatcacttgggtggatactatcgtcaaagatgatcaagaggcggtcttgtgtttctataagaccgccaaggattgtgtcatgatgttcacatatgtggagctgccctcaggcaagagcaacttgactgtgctgcgcgaacccgagtgcggcaacacaccaaacgccatgaccatattgctcgctgtggttgggagcattctgttagttggcctggccctgctggctatctggaagctgttggtcaccatacatgaccgacgagagttcgcaaaatttcaatccgaaaggagccgggccagatacgagatggcctccaacccgctctacagaaagcccatctcgactcatactgtggacttcacttttaataaatttaataaatcatacaatggtacagtcgactag

SEQ ID NO: 26839 - DNA, 1065 bp, Artificial Sequence
  Description of Artificial Sequence: Synthetic coding sequence
atgggtcgcctggtggcagtgggactgctggggatcgcactggctctgctaggagaacgtctcctcgccctgcgaaaccggctaaaggcgtcacgggaggtggagagcgtagacctgcctcactgccatctcatcaaggggatcgaggccggctccgaagacatcgatattctgcctaatggtttagcctttttcagcgtggggctgaagtttccaggcttgcattcctttgcaccagacaaaccggggggcatcttaatgatggatctgaaagaggagaaaccaagggcgcgcgaacttaggatcagtagaggtttcgacctggcttcattcaatccccatgggattagcacctttatagataacgacgataccgtctatctgttcgtggtgaaccaccccgagtttaaaaatacagtggaaattttcaaattcgaagaggcagagaatagcctgctccacctgaagaccgtaaagcacgagctgctgccttctgttaacgacattactgcggttggccccgcacacttttatgccacgaatgatcactacttcagcgacccatttctgaagtacctggaaacttatctgaatctgcattgggcgaatgtggtttactacagcccaaacgaagtcaaggtcgtggcggaaggcttcgattcagccaatgggatcaacatctcccctgacgacaagtacatatatgtggcggatatcttagcccatgaaatccatgtgctggagaagcataccaatatgaatcttacacagctgaaggtgctggagctcgacactctggtggataacctgagcatcgacccttcctcaggcgacatttgggtgggctgtcaccctaatggccaaaagctgtttgtgtatgatcccaacaatcccccttcttccgaagtcctacggatccagaacattctttccgagaaacccaccgttaccacagtttacgctaacaacggtagcgtcctccagggaagctcagtcgcgtccgtgtatgatggaaaattactgatcggcactctgtaccatagggcactatattgtgagttatag

SEQ ID NO: 26840 - DNA, 1905 bp, Artificial Sequence
  Description of Artificial Sequence: Synthetic coding sequence
atgcttaaggtgcacccgctcaaaaagtaccccgtcgatctgtattatttggtggatgtaagcgcctccatgcacaacaatatcgagaaactgaactccgtaggcaatgatcttagccgaaaaatggcctttttttctcgtgattttagactgggattcggcagctacgtcgacaagaccgtgagcccctacatctccatccatcctgaacgcattcacaatcagtgtagcgattacaatctggactgcatgcccccccacggttacatccatgtcctatcactgacggaaaatataaccgagttcgagaaagctgttcacaggcagaagatctccgggaacatcgacaccccagaagggggctttgacgctatgttacaagctgcagtctgcgagagccatattggctggcgcaaagaggcaaaaagacttcttctggttatgacggaccagacttcccatctggccctcgacagtaagcttgctggtattgtggtgcccaacgatggcaattgtcaccttaaaaataacgtgtatgtcaaatccacgaccatggagcatcccagcttgggtcagttatctgaaaagttaatagataacaatatcaatgtgatcttcgccgtacaaggcaagcaattccattggtacaaggacctcctgccactgcttcccgggactatcgcaggagaaattgagtcaaaggcggctaacctgaataatctagtcgttgaggcataccagaaactcattagtgaggtgaaggtgcaagtggaaaatcaggtgcagggaatttactttaatattactgccatttgtccagacggatcccgtaaacctggcatggaaggatgcagaaatgtcacgtctaacgacgaggttctgtttaacgtgaccgtgactatgaagaagtgtgatgtgaccggagggaaaaattatgcgataattaagccaatcggcttcaacgagacagcaaaaatccatatccaccggaattgtagttgccagtgtgaagataaccgcggaccaaagggcaaatgtgtggacgagacttttcttgattctaagtgtttccagtgcgatgagaataaatgccattttgacgaagatcagtttagcagcgagagctgtaagtcacacaaggatcagccagtgtgtagtggccgaggcgtatgtgtctgcggtaagtgctcttgccacaagattaaacttggtaaggtgtatggaaaatattgcgagaaggacgactttagctgcccctatcatcatgggaacttgtgtgcaggccatggggagtgtgaagcaggacgatgccagtgcttctccgggtgggagggagatcggtgccaatgcccttcggcagccgcccagcactgtgtgaacagcaaaggccaagtctgtagcggccgggggacttgcgtgtgtggcagatgtgaatgtaccgaccccaggtccatcggacgattttgtgagcattgcccaacctgctataccgcctgcaaggagaattggaattgcatgcagtgccttcacccccataatctgagccaggccatcctggaccaatgcaagacctcttgtgccttgatggaacagcaacattacgtggatcaaacatccgagtgctttagcagccccagttatctgcgtatttttttcatcatttttatcgtaacattcttgatcggcttgctcaaggttctaatcatcagacaggtcattcttcagtggaactccaacaaaataaagagctcaagtgactatagagtttccgcgtccaagaaggataagttaattctgcaatcggtatgtactagggcggtgacctacagaagagaaaagcccgaggagatcaagatggatatcagcaagctgaacgctcacgagactttccgctgtaacttctag

SEQ ID NO: 26841 - DNA, 1314 bp, Artificial Sequence
  Description of Artificial Sequence: Synthetic coding sequence
atgacttcctatatggccattgacggatcagctcttgtgccgctgcggcagaagcccagaaggaaaactcagggcttcttaacaatgtcacgccggcgaatcagctgtaaggatctcggtcacgcagactgccagggctggttgtacaagaaaaaggagaaaggcagctttctctctaacaagtggaagaaattctgggtgattctaaaagggtcgagcctgtattggtactctaatcagatggcggaaaaggccgatggattcgtaaaccttcctgattttaccgtcgagcgcgcatctgaatgtaagaagaagcacgcattcaagattagccacccccagatcaagacattttatttcgctgccgagaatgtacaagagatgaacgtctggttaaacaaactgggtagtgccgtgattcaccaggaaagcacaactaaggatgaagaatgctactctgagtcagagcaggaggacccagagatcgccgccgagacccctcctcctccccacgcatctcaaacacagtccctcactgcccagcaggcttccagcagtagtccatcattgtccgggacgtcctatagctttagttccttggagaacaccgttaaaaccccgagctcgttcccttcatcactcagcaaggaacggcagagcctacccgatacggtgaattcactgtcagccgccgaagacgagggccagccgatcacctttgctgtgcaggtccactcacctgtgcccagtgaggccgggattcacaaagccctcgagaactcttttgtgacctcagaatccgggtttctgaattcactaagcagtgatgacacctcctctttatcatccaatcacgaccatctcacagtgccggacaagcccgcgggctccaaaatcatggataaggaagaaacaaaagtgagtgaggatgatgagatggagaaactgtacaagtctctggaacaagcatctctcagccccttaggagacaggcggccgtctacgaagaaggagcttcgaaaaagctttgtcaagcgatgcaagaatccctccatcaacgagaaactgcacaaaatacgcactctcaactctacactcaagtgcaaggagcatgacctggctatgatcaatcaactccttgatgatccaaagctgacggcacggaaatatagggaatggaaggtgatgaatactctccttattcaagatatctatcagcaacagcgggctagccctgcgcccgacgacacagatgacacgcctcaggagctcaagaagtctccctcatctccttccgtggagaactcaatctag

SEQ ID NO: 26842 - DNA, 1317 bp, Artificial Sequence
  Description of Artificial Sequence: Synthetic coding sequence
atgaccagttatatggcaatcgatggtagtgcccttcaggttccactgcgacagaaacctaggcgaaagacccaaggattcctgaccatgtcgaggaggaggattagctgcaaggacctcgggcacgcagactgtcagggatggttgtacaaaaagaaagagaagggatcttttctgtctaataaatggaagaaattttgggtaatcctcaaaggttcctccttatattggtattctaaccaaatggcggagaaagctgacgggtttgtgaatctccccgattttaccgtggagcgcgcctccgaatgtaaaaagaagcatgccttcaaaatatctcacccccagatcaaaacattttattttgccgccgagaacgtgcaggaaatgaatgtctggttgaacaaactcgggtctgccgtgattcatcaggagtccaccacaaaagacgaggaatgctattctgagtcggagcaggaggatccagagattgccgctgaaactcctcccccaccccatgcttcacaaactcaaagcctgacggcccaacaggcttcctccagtagcccaagtttatctggaacttcgtattccttttcctcactcgaaaatactgtgaaaaccccaagtagctttccctcaagtctgagcaaggagaggcagtcgctaccagacacagtgaactctctgtccgctgctgaagacgagggacagccgataacgttcgcagtccaggtgcatagcccagtgccatccgaagccgggatacataaggctctcgaaaactcctttgtcacctccgaaagcggatttttgaattctctgtcttccgacgacaccagcagcctctcatcgaaccatgaccacttaacagtgcctgataagcccgccggcagtaagatcatggataaagaagaaaccaaagtaagcgaagacgatgaaatggagaagctgtataaatcacttgagcaggcctcactgagccctcttggcgaccgcagaccatctactaagaaggagctgcggaaaagctttgtgaagagatgtaaaaacccctctatcaacgagaagttgcacaaaattaggactctcaacagtacactgaaatgtaaagagcacgacctggctatgataaaccaactgctggacgaccccaagctgactgcgcgtaagtaccgcgagtggaaggtgatgaataccctcctgattcaggatatctaccaacagcaacgtgctagtcccgcacctgatgatacagacgataccccgcaggagctaaagaaaagcccatcatctccctctgttgagaatagcatatag

SEQ ID NO: 26843 - DNA, 1317 bp, Artificial Sequence
  Description of Artificial Sequence: Synthetic coding sequence
atgactagctatatggccatcgacggaagtgcactgcaggtgcccctccgccagaagccccggcgcaagacccaagggttcctcaccatgagccggcgcagaataagctgcaaggacttgggtcatgcagattgtcagggttggttgtacaagaaaaaggagaaaggtagctttctctcaaataaatggaaaaaattttgggttatcctaaagggcagcagcctgtactggtattcgaaccagatggccgagaaagccgacgggtttgtcaatcttcccgattttaccgttgagcgtgcaagcgagtgcaaaaagaaacatgctttcaagatctcgcatcctcagattaaaacattctacttcgccgcggagaacgtgcaggaaatgaacgtctggttgaacaaactcggcagcgccgttattcaccaagagtctactactaaggacgaagaatgctattctgagagcgaacaggaagatcccgagatcgcagccgaaactccaccaccccctcatgcatcccagactcaatctcttaccgcacagcaggcctcaagttcatcgccatcccttagcggcacctcctactcattctcaagtcttgagaacacagtgaagaccccctcgagtttcccttcttccctctcgaaggaacggcagtcactgccagacacggtcaactcgctgagtgcagcagaagatgagggccagccgattacatttgccgtacaggttcactcaccggtgccatccgaggcaggcatccataaggcccttgaaaattcctttgttacctcagagagcggctttctgaacagcctgagctcagacgatacctcctcactgagttccaaccatgatcatctgactgtgcctgacaaacctgccggcagcaaaataatggataaggaggagaccaaggtgagcgaagacgacgagatggagaagctgtacaagagtcttgaacaggcttccttaagtcccctgggcgatagacgtcctagtaccaaaaaagagctgagaaaatcattcgtgaagcgctgtaagaacccaagtatcaatgagaaactgcataaaatccgcactttgaattctactctgaagtgtaaggagcatgaccttgctatgattaaccagttgctcgacgaccccaagctgacggcccgcaagtaccgagagtggaaagtgatgaatactctcctgatacaggatatctaccaacaacaaagggccagcccagcccctgacgacacagatgacacacctcaagagctcaaaaaaagcccgagttcccctagtgtcgagaactcaatctag

SEQ ID NO: 26844 - DNA, 237 bp, Artificial Sequence
  Description of Artificial Sequence: Synthetic coding sequence
atgacaagttacatggcaatcgacggatccgctttggtccccctacggcagaaaccaaggaggaagacacaggggttcctgaccatgagtcgcagaaggatctcttgcaaggatctggggcacgccgattgccagggctggctctacaagaagaaggagaagggcagctttcttagtaataaatggaaaaaattttgggtaatattaaaggggtcaagcttgtactggtactcttag

SEQ ID NO: 26845 - DNA, 396 bp, Artificial Sequence
  Description of Artificial Sequence: Synthetic coding sequence
atgttctctgataactcccactgtccagactgtgggcagcagtggtttccatctcttgaactcggacactggctctatcaaactgaactcgtcgagaacgaatgttatcaagtgttcctggacaggatcaatcgcgctgactattgtcctgaatgctacccagacaatcctgcgaaccgctccctggtattgccgtggtcttttccgctggaatgggctccgcaaaatctcactcgctggactttcgaaaaagcctgtcacccttttctcttagggccccctctcgtgcgcaagcgaatccacgacagcagagttgcaggcttcaatcccgccctgcaactgattctgacacgcactgacaaaacactgaataagaagcttggacaaaataagtag

SEQ ID NO: 26846 - DNA, 687 bp, Artificial Sequence
  Description of Artificial Sequence: Synthetic coding sequence
atgcgagaagggaaacggggaccaccttgcatcctgagctttaggggaaccttggaaagagtggaggcacagtgggagctggaggcgcagggaccagggcaatgccccgctcctctgggtgaccctgcgagcacaacagacggtgcacaggaggcacgggtccccctcgacggtgctttctggattcctagaccgcccgccggtagccccaagggttgctttgcttgtgtcagcaaaccccccgccctgcaggcccctgccgccccagccccagaacctagcgcttctccccccatggcacctacactcttcccaatggaaagcaaaagttctaagacagatagcgtcagggccgcgggcgctccccctgcatgcaagcacttagcagagaagaagacaatgactaacccgactactgtgatcgaggtgtatcctgacaccactgaagtcaatgattattacttgtggtcgatttttaatttcgtgtacctgaatttctgctgtctggggttcatcgcactggcctatagcctaaaggtccgcgacaagaaacttcttaacgacttgaacggtgctgtggaagatgctaagacagcacggctgtttaacataacctcatccgctttggctgcctcatgtatcatcctcgtgtttattttcctgagatatccgctgacagattactag

SEQ ID NO: 26847 - DNA, 399 bp, Artificial Sequence
  Description of Artificial Sequence: Synthetic coding sequence
atggacacagcctacccccgcgaggatacccgcgccccgacgccttcgaaggctggagcacacactgcgttaacactaggagctccccacccaccacctagggaccacctcatctggtcagtcttctctacactttatttaaacctgtgctgcctcggtttccttgcattagcctacagtataaaagcaagggatcagaaggttgttggagatctggaggccgctcgtagatttggctcaaaggcgaaatgttacaacatcctggccgctatgtggacgctagtgcctccattactgctgctcgggctagtggtgactggagcactccacttggccagacttgccaaggactccgctgcattcttctccaccaagtttgacgatgcggattacgactag

SEQ ID NO: 26848 - DNA, 1551 bp, Artificial Sequence
  Description of Artificial Sequence: Synthetic coding sequence
atgcctgtccccgagaggccagccgccgggcccgacagtcctaggcctggcaccagaagggcagctcccagggtactattcggagagtggttgctgggggaaataagctcagggtgctacgagggtctgcagtggctcgatgaagctcggacatgctttcgagtgccctggaaacactttgcccgcaaggatctgagcgaagctgacgcaagaatctttaaagcctgggccgttgccagaggacggtggccaccatcatcaaggggcggaggaccaccccctgaggcagaaacagccgaaagggcaggctggaagaccaatttccggtgcgccttaaggtctactaggaggtttgtgatgttgcgtgataatagcggtgacccagctgatccccataaagtatacgccttgtcccgagagctgtgttggagagagggacccggcactgaccagacagaagctgaggccccggctgccgtccctcctcctcaggggggccccccaggcccttttctggcacatacacatgcgggactccaggctccaggcccacttccagcacccgcaggggacaagggagatctgttgcttcaagcagtccagcaatcttgtcttgccgaccatctgctgactgcatcatggggcgccgatcccgtgcctaccaaggctccgggcgagggccaggagggcctccctctgacaggcgcctgtgccgggggccccggacttccagctggcgaactatacggatgggctgtggagactaccccctcacctggtcctcagcccgccgcactgactaccggcgaggctgcagctccggaaagtccacatcaagcggagccgtacctgtctccctctccctccgcctgtacagccgtgcaagagccctctcccggcgccttagatgttaccataatgtataaaggcagaacagtgttacagaaggtggtagggcacccaagctgcacttttttatacggcccccctgaccccgccgtccgggcgacagatccgcagcaagtggccttcccgtccccggctgaattgcccgatcaaaagcaactccgttacaccgaggaactgctacgccacgtagccccgggactgcacctagagctgaggggcccccagctctgggcacggcggatgggcaagtgcaaggtgtattgggaagtgggcggtcccccagggagcgcctctccttctacccctgcctgtttgttgcccagaaattgtgacacacctatcttcgacttcagggtcttctttcaggagttggtggagttccgggcccgccagcgtcgagggtctccccgctacactatctacctgggttttggacaggacctgtctgcaggcagacccaaggaaaagagtctggttctggtcaaattggaaccatggctgtgtcgggtacacctggagggcacccagagagagggcgttagctcactagatagctcctcccttagtctctgtttgagctccgccaactccctctatgatgatatcgagtgctttttgatggagctggagcagccggcttag

SEQ ID NO: 26849 - DNA, 1425 bp, Artificial Sequence
  Description of Artificial Sequence: Synthetic coding sequence
atggcgttggcaccagagcgggctgctcctcgggtcctgttcggggagtggttactaggagaaatctccagtgggtgctacgaggggcttcaatggctcgatgaagcgcgcacctgcttccgtgtaccctggaagcactttgcccggaaggatctgtctgaagctgatgcccggatctttaaggcctgggctgtagctaggggcagatggcccccgtctagtcgaggggggggacccccacctgaagccgaaaccgctgaacgcgccggatggaagactaatttcaggtgcgcactgcggagcactcgccgatttgtcatgttgagagacaattccggggacccagccgatccgcataaggtatacgccctgagtagagaactgtgttggcgggaaggtccaggcaccgatcagacagaggccgaagctcctgccgcagtaccaccaccccaggggggtcctcctgggcccttcctggctcacactcacgcaggcctgcaggcccctggcccactgccagcccctgctggggataagggagatttgttactccaggccgtacagcaaagttgcttggctgatcatttgttaactgccagttggggggctgaccctgtgccaaccaaagcgccaggagaagggcaggaaggactacctctcaccggtgcatgcgccggtggtgaggcagcggctcccgagtcaccacaccaagccgagccctacttaagtccctctccttctgcttgtacagcagttcaggaaccgtcccctggggcacttgacgtaaccattatgtacaaaggcagaacagtactgcaaaaggtggtgggccatcccagctgtaccttcctctatggacctcccgatcctgcggtgcgggctactgatccccaacaggttgcctttccttcacccgcagaattgccagaccagaagcagctgagatacacagaagagctcctgcggcatgtcgcgcctgggcttcaccttgaactgcgcggaccgcagttgtgggctaggagaatggggaaatgtaaagtttattgggaagttggtggacctccgggctctgcctctcccagtactcctgcctgtctgctacctagaaattgtgacacgcccatttttgatttccgggttttttttcaggaactggtcgagtttcgagcacggcaaagacgagggtcacctcgatacaccatctacctaggctttggccaagatctgtcagccggtcggcccaaagagaagtcattggtgctggtcaaactggagccatggctatgccgagtccacttagagggaacccagcgggagggggtgtcatcgctggactcctcctcacttagtctgtgcctcagctcagcaaattccttgtacgatgatattgagtgtttcctaatggagcttgagcagcctgcatag

SEQ ID NO: 26850 - DNA, 633 bp, Artificial Sequence
  Description of Artificial Sequence: Synthetic coding sequence
atgtacaaaggacggacggtcctgcagaaagtggttggacatccttcctgtacttttttgtatggcccgccagaccccgcagtcagggcaacagacccccaacaagtcgcctttcccagtcctgcagaactgccagaccagaagcagctgagatacactgaggaactacttaggcatgtggcaccaggcctccacctggagttgcgtgggccacaactctgggctagaagaatgggcaagtgcaaagtctactgggaggtaggcggcccacctgggtctgcctctcccagcacaccagcttgtctgctgcctcgaaactgcgatacgcctatctttgattttagggtgttcttccaagagttggtggaatttagagctagacagagacgcggctctccgaggtacactatttatctgggctttgggcaggacctctctgccgggcggccgaaggagaaaagtctggtattagtgaaactggagccttggttatgtcgtgttcacttggaaggtacccaaagggaaggggtgtcaagtttagatagctcctccctgtcactgtgtctcagcagtgccaattctctctatgacgatatcgagtgctttttgatggagctggagcagccagcttag

SEQ ID NO: 26851 - DNA, 1551 bp, Artificial Sequence
  Description of Artificial Sequence: Synthetic coding sequence
atgcccgtgcccgaacgccctgctgctggccctgactcccccagacctggcacccgccgggctgctccgcgtgttttattcggggagtggctgcttggcgagatctcgagtggatgctatgaggggctgcagtggctcgacgaggctcgcacgtgtttccgtgtgccatggaagcacttcgcaaggaaggatctgtccgaagcggatgctcgaatcttcaaggcctgggccgtcgccagaggaagatggcccccgtcctcacggggagggggtccccccccggaggcagagaccgcagaaagggccggttggaaaactaatttcagatgtgcattacgatccaccaggaggttcgtgatgctgagggataattctggcgatcctgccgatcctcataaagtatacgctttgtcaagggagctctgctggcgggaggggccaggcacggaccaaactgaggccgaagccccagccgcggtgccccctccacaggggggccccccagggcctttcctggcacacacacatgcaggcttgcaagcccccggtccactcccagcccctgctggtgataaaggggacctgctactccaggctgtgcaacagagctgcctcgcagaccatctgctcacagcctcctggggagccgacccagttccgacaaaggctcccggggaaggacaggaaggactacctcttaccggggcctgtgccggtggacccgggctacccgctggcgagctgtatgggtgggctgtagagaccacaccgtctcctggccctcaacccgccgccctcactaccggggaagcagccgcccccgagagtccgcaccaagccgagccataccttagtccaagtcccagtgcatgcactgcggtgcaagaaccctcccctggcgcactggacgtgaccattatgtataaaggacgtaccgtgctgcagaaggttgtgggacacccatcttgtacattcctttacggcccacctgaccctgctgttagagccacagatccacaacaagtggctttcccaagcccagctgaactgccagatcagaagcagctgcgatatacggaagaactgctcaggcatgtagcgccaggactccacttggaactgcgggggccacagctatgggcgaggcggatgggcaaatgtaaagtgtattgggaggtgggcggtcctcccggcagcgcctccccctctacacccgcctgcctgctgccacggaactgcgatacgcctatcttcgatttcagggtgttcttccaggaactggtggagttccgcgctcggcagcgacgtggctccccccgctatactatctacctgggatttgggcaagatctttctgccgggaggccaaaggaaaaaagcttggtcctggttaagctcgagccgtggttgtgcagggttcacttagaaggtacacagagggaaggcgtgtctagcttggattctagtagcctatctctttgtctctcttccgccaactctctgtacgacgacatcgagtgttttctgatggaattggaacagcctgcatag

SEQ ID NO: 26852 - DNA, 1425 bp, Artificial Sequence
  Description of Artificial Sequence: Synthetic coding sequence
atggctctggcaccagaacgcgccgctccccgcgtccttttcggcgagtggctcctgggggagatctcttcagggtgttatgaggggctgcaatggctcgatgaagcaagaacatgtttccgtgtaccgtggaaacactttgctcgaaaagatctgagtgaagctgatgcacgcatctttaaggcatgggctgtcgcacgggggcgctggccgccatcttcccgtggcggagggcccccacctgaggctgaaactgccgagcgggctggctggaagactaacttccggtgcgccctcagatcaactagacgcttcgtaatgctccgcgataactcgggcgatcccgccgacccccacaaggtctatgccctatcccgggagttgtgttggagggaaggccctggtaccgatcagacagaagcggaagctcctgccgccgtgccccctcctcaaggcggcccacccggcccttttcttgctcacacacatgctggattacaggctccaggaccccttcctgcaccagctggcgataaaggggatctgttgctgcaggcggtgcaacagtcttgcttggctgaccacctgctgacagcttcgtggggggctgacccagtacctacaaaagcacccggcgagggccaggagggcctcccactcacgggggcatgcgccgggggcgaagccgcggcccccgagtctccacaccaggcggagccctacctgtctcccagtcccagcgcctgtactgcagttcaagaacccagcccgggagccctggatgtcaccataatgtataaaggaagaaccgtgctgcagaaggtggtgggccacccaagttgcacttttctctacgggcctccagatcccgctgtgcgggcgacagatccacaacaagtggcttttccttctccagcggagcttccagatcaaaagcaactgagatatacagaggaacttcttagacacgttgcccctggattgcatctcgagttaagagggcctcagctatgggcccggaggatgggcaagtgtaaagtctattgggaagttgggggacctcccgggtctgcctctccaagcactccagcctgcctgctgccacgcaactgtgacacgcctatttttgatttccgtgtcttctttcaggaactcgtcgagttccgcgccagacagagaagaggaagccctagatacaccatctacctcggttttggacaggaccttagtgctggacgtccaaaagaaaagtccttggttctggttaaactcgagccttggctctgccgcgtgcatctggagggtactcagagggaaggcgtttcttcccttgatagctctagcctctcactgtgcctttccagtgcaaatagtctctacgatgatatagaatgtttcctaatggaactggagcaaccggcatag

SEQ ID NO: 26853 - DNA, 1512 bp, Artificial Sequence
  Description of Artificial Sequence: Synthetic coding sequence
atggccttggcccctgagcgcgccgcccctagggtcctgttcggggaatggcttttaggagagatcagttcgggctgttatgagggcctgcagtggctggacgaggcccgcacctgctttagggtgccatggaagcacttcgccaggaaggatctcagcgaagccgacgcaaggatcttcaaggcctgggcagtcgccagggggaggtggcccccatcctcgcgaggcggaggcccgcctcccgaggccgaaaccgccgagcgggcaggatggaagacaaattttcgttgcgccctcaggtctactcggagattcgtaatgctcagagacaatagcggcgatcctgccgatccgcacaaggtatatgccctcagtagggagctgtgttggagagaaggccccggcacagaccaaaccgaagctgaagctcccgccgcagtaccacctccacaaggcggcccccccgggccgtttcttgcacatacccatgcgggtttacaggccccagggccgctacccgcccctgctggtgataagggggaccttcttcttcaggcggttcagcaatcttgcttggctgaccacctcctgacagcctcttggggtgcagacccagtgccaactaaggcgccaggcgaggggcaggaaggcctaccattgacaggcgcgtgcgccggaggccctggcctcccggccggggagctctacgggtgggcagtggaaaccacgcctagccccggtcctcagcccgcggctctaacgactggcgaggctgctgcccccgagtcgccacaccaggctgaaccttatctgtcaccctcaccatctgcatgcactgcagtgcaggaacccagccctggtgccctggacgttaccatcatgtacaaaggacgcactgtgctccagaaggttgtgggacaccctagttgtaccttcctgtatgggcctccagaccccgctgtgcgtgcgacggatccgcagcaagtcgccttcccatcacctgccgaactgccagatcagaagcagctgcgctatactgaggagctattacgacatgttgctccgggacttcacctggagctgcgcgggcctcaactgtgggctcggcggatgggaaagtgcaaagtctactgggaagtcggcggcccgccagggtcagcctccccctctacccctgcatgcctgttaccgcgcaactgtgacaccccaatctttgacttccgcgtgttttttcaagagctggtagagttccgggcacgacagagaaggggtagccctcggtacacaatttacctgggatttggccaagatttatcggctgggcgcccaaaggagaaatctctggtgctcgtgaaactggagccttggttgtgtagggtacacctggaggggactcagagagaaggcgtgtcctccctggactctagtagcttgtcactatgtctctcttccgcaaattcgctgtatgacgatatcgagtgcttcttaatggagctagagcagcccgcatag

SEQ ID NO: 26854 - DNA, 315 bp, Artificial Sequence
  Description of Artificial Sequence: Synthetic coding sequence
atgggaaaggagtcaggctgggattcaggcagggctgcagtggccgccgtggtgggaggtgtcgttgccgttggaaccgttctggtggctctgtcggctatgggcttcacatccgtaggtatagcagctagctcaattgctgcaaaaatgatgtccaccgccgctattgctaatggcggcggcgtggcagcaggctccctagtggcgattcttcaatcggtcggagccgccgggctgtccgtaactagcaaagtaattggaggattcgctggcaccgcgcttggagcctggctgggatcaccaccttcttcctag

SEQ ID NO: 26855 - DNA, 315 bp, Artificial Sequence
  Description of Artificial Sequence: Synthetic coding sequence
atgggaaaggagtccggatgggattcaggcagggccgcagtggccgcagtggtcggtggagtcgtcgcggttggcaccgtgctcgtggctttgtccgcgatgggcttcacttcagtgggcatagccgcaagttctattgcggctaagatgatgagcaccgccgctatagctaatggcgggggtgtggcggctgggtctctggtagcaatcctgcagtcggtgggcgcggctggactcagtgtgacctcaaaagtcatcggaggctttgccggcaccgccctgggagcttggctgggttcaccccctagttcctag

SEQ ID NO: 26856 - DNA, 393 bp, Artificial Sequence
  Description of Artificial Sequence: Synthetic coding sequence
atgatgaagagggccgccgcagccgccgtgggcggtgcactggcagtaggtgccgtgcccgtcgttctgtcggccatgggattcactggcgccggcatcgctgcttccagcatcgcggcaaagatgatgagtgctgctgccatcgccaacggcggtggcgtgagcgccggcagcttggttgccactctgcagagcgttggtgccgctgggttgtccacaagctctaatatcttacttgcatctgtgggaagtgtgctgggagcttgcctcggcaactcacctagctccagtcttcccgcggagccggaagcgaaggaggatgaagcccgtgagaacgtcccacagggcgagcctcctaagcctcctctgaaaagtgagaaacacgaagaatag

SEQ ID NO: 26857 - DNA, 417 bp, Artificial Sequence
  Description of Artificial Sequence: Synthetic coding sequence
atgcggcagaaagcggtcagcctgttcctctgttacctcctactgtttacctgttctggagttgaggccggggagaacgctgggaaagatgcaggcaaaaaaaaatgcagtgaaagttctgactcaggatctggattctggaaagcgcttacctttatggccgtgggaggggggctagccgttgccggcttacccgcactgggtttcacaggcgcgggtatcgctgctaactctgtggctgctagcctcatgtcatggagcgctatcctgaacggaggtggcgtgcctgcaggaggactggtagctacattacaatccctgggtgctggcggatctagtgtcgttatcggtaacatcggcgcactaatggggtacgccactcacaagtatctcgactctgaggaagacgaggaatag

SEQ ID NO: 26858 - DNA, 393 bp, Artificial Sequence
  Description of Artificial Sequence: Synthetic coding sequence
atgcgtcagaaagccgtttctttgttcctgtgctatctgttgctatttacatgttcaggcgtggaagctggcaagaaaaaatgtagcgagtctagtgacagcgggagcggcttttggaaggcccttacatttatggcagtgggaggcgggctagctgttgccggactccctgcactgggctttaccggcgccggaatcgccgccaactcagtcgccgcctcgctgatgtcttggagtgcaatcctgaacggtggaggagttcccgctggtgggctggttgcaaccttacagagtctgggcgcaggaggatcttcagtggtcattggcaacattggggcacttatgggctacgccacccataaatacctggactccgaggaggacgaagaatag

SEQ ID NO: 26859 - DNA, 405 bp, Artificial Sequence
  Description of Artificial Sequence: Synthetic coding sequence
atgcggcagaaagccgtgagtctgttcttgtgctacctcctgctgtttacatgctcaggagtggaggccggagagaatgctgggaagaaaaagtgcagtgaatcatccgatagtggttcaggcttctggaaagctttaacattcatggcagttggaggcggccttgccgttgccgggctgccggccctcggattcaccggtgccggaatcgccgccaattctgttgctgctagcctcatgtcttggtccgctattcttaacggaggtggcgtgccagctggcggattggtggctaccctccagagcctcggggctggggggtcctccgttgtaattggaaatataggcgctctgatggggtacgctactcacaaatacctcgatagcgaggaggatgaagagtag

SEQ ID NO: 26860 - DNA, 978 bp, Artificial Sequence
  Description of Artificial Sequence: Synthetic coding sequence
atggcatggagcctgggaagttggctagggggatgtttgctggtctccgcccttggaatggtcccccccccagagaacgtgaggatgaattctgtcaattttaagaacattttgcagtgggagagtccagcattcgctaagggcaacctgacatttaccgctcaatacctgtcatacaggatcttccaggacaagtgcatgaataccaccttaacagagtgcgatttcagctccctgagtaagtacggcgaccacacccttcgggtgagagcggaatttgctgacgagcacagtgattgggtaaatattacattttgtccagttgacgacacaataatcggaccaccggggatgcaggtggaggttttagccgattctcttcatatgaggtttctggcccccaagatcgagaatgagtacgagacttggacgatgaagaacgtctataactcctggacgtacaatgtgcagtactggaagaacgggacagacgagaagttccagatcaccccacagtatgactttgaggtccttcgaaatctggagccgtggaccacctactgcgtgcaggttcggggatttctgccagacagaaataaggccggagagtggagcgagccggtgtgtgagcagacgacccacgatgagactgtcccttcttggatggttgccgttattttgatggcctccgtctttatggtgtgcctggccctgctgggatgcttcgcccttctatggtgtgtctataagaagaccaaatacgccttttctccgcggaattcgttgccccagcacctgaaagagtttctgggtcatcctcaccacaataccctgctgttcttttcgttccccttgtcagatgagaacgatgtgttcgataagctgagcgtaatagccgaggatagcgagtccggcaaacagaatccgggggacagttgttctctgggaactcctcctgggcagggtcctcagtcttag

SEQ ID NO: 26861 - DNA, 969 bp, Artificial Sequence
  Description of Artificial Sequence: Synthetic coding sequence
atggcgtggtctctgggtagttggctgggcggctgccttctggtgtctgcactgggaatggtacccccacctgagaacgtccgcatgaatagcgtgaattttaagaatatcctgcagtgggagagtcccgcctttgccaaaggcaacctgactttcacagctcaatatctttcatatcggatttttcaggataaatgtatgaacacgaccctaaccgagtgcgattttagctccttgagtaaatacggggatcatacactgagagtcagagcggagttcgctgacgagcattctgactgggtgaacatcaccttctgtcccgttgatgacacaatcataggaccgccaggcatgcaagtggaggttctcgccgacagtttgcacatgagatttttggcgcctaagatagaaaacgaatatgagacatggactatgaagaacgtgtataacagttggacatataacgtacagtattggaaaaacgggacggatgagaagtttcagattacgccacaatatgacttcgaggtgttacggaacctggagccctggaccacctactgcgtgcaggtcaggggcttcttacccgacaggaacaaagcgggcgagtggagcgagcctgtgtgcgagcagaccacacacgacgagacagtgcctagttggatggtggccgtgatactaatggcctccgtgtttatggtatgcctagcgcttctgggctgttttgcgctactttggtgtgtgtacaaaaagaccaaatacgctttcagtccccggaactccctcccccagcatctgaaggaatttctgggacacccccaccataacacactactcttttttagtttcccacttagtgacgagaatgatgtcttcgacaagttatccgtgatagcggaagactcagaaagtggtaagcaaaatccgggcgattcacccacgtcgagaacaccaaggccctggacttag

SEQ ID NO: 26862 - DNA, 444 bp, Artificial Sequence
  Description of Artificial Sequence: Synthetic coding sequence
atgaaacacctgctgatgtggtcaccggtgatcgcacccggcgagactgtgtattattccgtcgaataccagggcgaatacgaatcactctatacctcacacatttggattccttcctcatggtgctccctaaccgaggggcctgagtgcgatgtgacggatgatataactgccacggtgccctacaaccttagggtgcgcgccaccttggggtctcaaacaagtgcttggtccattttgaaacacccattcaaccgcaacagcacgattctgacacgtcccggcatggaaatcactaaggatgggtttcatctggtcatagagctggaggatttgggaccacaatttgaattcctggtcgcttactggaggagggagcctggcgccgaagaaagacctttcccatggtactggccgtgcctgcccctgctggcctcctgttag

SEQ ID NO: 26863 - DNA, 936 bp, Artificial Sequence
  Description of Artificial Sequence: Synthetic coding sequence
atgcaaacttttactatggttctcgaagaaatatggacgagtctgtttatgtggtttttttacgctttgattccgtgtctgctgaccgacgaagtggccatcctgcctgctccccagaacctgagcgtcctgagcacgaatatgaaacatctgctcatgtggagccccgtaatcgcaccgggggaaacagtctattactctgtggagtaccagggagagtacgaaagcctctatacgagccatatttggattccctcctcatggtgtagcctcaccgaaggacccgaatgtgatgtgactgatgacattaccgccacagttccgtataacttacgcgtgcgcgccaccctggggtctcagacaagtgcctggtccatcctgaagcacccttttaaccgtaattctacgatcctgacacggcccgggatggaaataaccaaagatgggttccacctcgtcatcgagttggaagatctgggccctcagttcgaatttctcgtcgcttactggagaagagagcccggtgccgaagagcacgttaagatggtcaggtctggaggtatccctgtgcatctggaaacgatggaaccaggtgccgcgtactgcgtcaaggcgcagacattcgtgaaagccataggacgatactccgcattcagccagaccgagtgcgtggaggtacagggcgaggctattccgctggttctcgcgctgttcgccttcgtgggcttcatgttaatattggtcgtggttcccctgttcgtgtggaaaatgggaagactactgcaatactcctgctgcccagttgtcgtcctgcctgataccctgaaaataaccaactcacctcagaaactgatatcatgtagacgagaagaagtggatgcttgcgccaccgctgtgatgtcaccagaagagctcctccgcgcctggatctcgtag

SEQ ID NO: 26864 - DNA, 1725 bp, Artificial Sequence
  Description of Artificial Sequence: Synthetic coding sequence
atgagaacgctgctcaccattctcaccgtgggcagcttggccgcacatgcccctgaggacccctccgatctgcttcaacatgtgaaatttcaatctagcaacttcgagaacatcctcacctgggacagcggtcccgagggaacccccgacacggtatacagtatcgaatataagacttacggcgagagggattgggtcgccaagaaaggttgccaacggattacgcgcaaatcttgtaatttgaccgtagagactggcaacctcaccgaattgtattacgctcgcgtgactgccgtaagcgctggagggcgttctgcaacgaagatgactgatagattttcctccctccagcacacaaccttgaaacccccagacgtaacttgtatttctaaggtgaggtcaatccaaatgatagtccacccaacccctacccccatacgtgctggggacggtcatcgactgaccctggaggatattttccacgatttgttttatcacctagagcttcaggttaacaggacgtaccagatgcatctaggtggtaagcaacgggagtacgaatttttcggccttacgcctgacacagaatttctggggactattatgatatgtgttccgacgtgggctaaggagagtgccccttatatgtgcagagtgaagacactaccagacagaacttggacatacagcttcagcggggcattcctgttctctatgggtttcttggtagctgtgctgtgttatctgtcgtacagatatgttacaaagccacctgcaccacccaactccttaaacgttcagagggtgctgacattccagcccctgcggttcatccaggaacacgtgctaatccccgtgttcgatttaagcggaccaagttcgctggctcaacccgtccagtatagccagatcagggtgagcggtccccgtgaacctgcaggagccccacagcggcattctttatccgagatcacgtatctcggtcaaccagatatctcaattctgcaaccctcaaacgtacctcccccccagatcctgagtccactgtcatatgcgcctaatgccgcgccagaagtgggcccaccctcttatgccccgcaggtgacacctgaagcccagttcccattctatgctccgcaggctatcagcaaagtacagccatccagttacgctccgcaagctacacccgacagctggccgcccagctacggcgtgtgtatggaagggagcgggaaggacagcccaaccggcacactttcatcccctaaacatctcaggcctaagggccagctacagaaagagccaccagctggatcctgcatgctgggtggcctgtccctccaggaagtgaccagcctggcaatggaggaaagccaagaagcgaagagcctgcaccagccccttggcatctgcaccgatcgtacatcagatcctaacgtgcttcacagtggcgaggagggaacaccgcaatacctaaagggtcaactaccactattatccagtgtacagattgaaggccatcccatgtcacttccactgcaaccacccagtcggccctgttccccctctgatcagggtccctccccctggggacttctggagtctcttgtttgcccgaaggacgaggctaaaagccctgctcccgagacgtccgacctggaacaaccaactgagctggattccctgtttcgcgggctggcactgactgtccaatgggagagctag

SEQ ID NO: 26865 - DNA, 1911 bp, Artificial Sequence
  Description of Artificial Sequence: Synthetic coding sequence
atgagaggggggcgaggcgcaccgttctggctctggcctctgccaaagctggcactgctgcccttgttgtgggtcctgttccagcggacccgaccccagggcagcgctggccctctgcagtgctacggggtgggcccgctcggagacctgaattgttcttgggagccactgggggacttgggcgcaccaagtgagctgcatcttcagtcccaaaagtataggtccaataaaacccagaccgtcgccgtggctgcggggagatcctgggttgcgatcccccgagaacagctgactatgtctgacaagctgctggtgtggggcaccaaagcaggtcagccactctggccccccgtgttcgtgaacctggaaacgcaaatgaaacccaatgctcccagacttggacctgacgtggactttagcgaggacgacccgctcgaggcaactgtacattgggcccccccaacttggccttcccataaagttttaatttgtcaattccattataggcggtgtcaggaggcagcttggacattgctagagccagagctcaaaacgattccacttacccctgtggagattcaagatcttgagttagccacaggctacaaggtgtacgggaggtgccgcatggaaaaagaggaagacctctggggggaatggtcccccattttatcatttcaaacgccaccctcggcccctaaagacgtgtgggtttcaggcaacctgtgcggcactcctggcggggaggagcccttactgctgtggaaagctccaggcccgtgtgtgcaggtcagttataaggtttggttctgggtgggagggcgcgagttgtctcctgaaggcattacctgttgctgttccctgatcccatccggcgccgaatgggcccgcgtgagcgctgtcaacgctacaagctgggagcctctcaccaatctctcgctcgtttgtctggattcggcgtctgcaccaagatcagtggcggtctctagcatcgccggctccactgaactcctggtgacctggcagcctggccctggagaacctctggagcatgtcgtggactgggctcgcgacggggaccctctggagaaattaaactgggtgcgcctgcccccaggcaatctgtccgcgcttctgccgggcaacttcaccgtgggggtcccatatcggatcaccgtgaccgcagtctcagcctctgggcttgcctctgcctcctctgtgtgggggtttagggaggaactggcccctctggtcgggcccaccctgtggcgcctgcaagatgccccccccggaacacctgcaatagcctggggtgaagtgcccagacatcagctccgcggccacctcacacattacaccctctgtgcgcagagcggaacaagtcctagtgtttgtatgaatgtaagtgggaacacacagagcgtgacccttccagatcttccctggggaccgtgcgagctgtgggtgactgcttccaccatcgctggacaggggcccccaggcccaattctgagactgcacctgcctgacaatactctgagatggaaggtgttacccggaatactgttcctctggggactgtttcttcttggatgcgggttatcactggcaactagcgggaggtgctatcacctacgtcacaaggtacttcccaggtgggtttgggagaaggtgccggaccctgcaaacagctcctccggtcagccgcatatggagcaggtgccagaagctcagccattaggggatcttccaatcctggaagtagaagaaatggagcctcctcctgtaatggagtcctcgcagcctgctcaggcgacggcacccctggacagcgggtacgaaaaacatttcctgccaacgccagaggagctgggacttctggggccccctcgtccgcaggtattggcctag

SEQ ID NO: 26866 - DNA, 453 bp, Artificial Sequence
  Description of Artificial Sequence: Synthetic coding sequence
atgaccattctgggcacaacctttggcatggtcttttcactcctgcaggtggtttcaggagaatccggatatgctcagaacggcgatctggaagacgccgagttggatgattacagcttttcctgctatagccagttagaggtcaacgggtctcagcatagcctgacctgtgcgtttgaagatcctgacgtgaacatcacaaacctcgagtttgaaatctgcggcgccctggtcgaagttaagtgcttaaactttagaaagctgcaggaaatctattttatagagacaaaaaaattcctgctaatcggcaagtccaacatttgtgtgaaagtcggtgaaaagtcactgacatgcaaaaagatcgatcttacaaccatcgggaagaaactttacatcaaagtatggctcagcctcctgggttatctgaaaacactgtgtctggacattctgtag

SEQ ID NO: 26867 - DNA, 543 bp, Artificial Sequence
  Description of Artificial Sequence: Synthetic coding sequence
atgaccatcctgggcactaccttcggcatggtgttcagcttgctccaggtagtgagtggagaatcagggtacgcacagaatggcgatctcgaggatgccgagttggatgactatagctttagctgttattctcagttggaggtgaatggcagccagcactccctcacttgtgccttcgaggacccagacgttaacattacgaatctcgagttcgagatatgcggcgcgttagtcgaagtcaaatgcctaaacttccgcaagctgcaggaaatctacttcattgagaccaagaagttcttgctaataggcaagtctaacatatgtgttaaagtgggtgaaaaatcgctgacctgcaaaaaaatagacctgacgactatcgtgaagccagaagccccttttgatctctcagtggtctaccgggaaggcgccaacgactttgtagtaacctttaacacctcacacctgcaaaagaaatacgtgaaggtgctgatgcacgatgttgcttacagacaggagaaggatgagaacaaatggaccgattag

SEQ ID NO: 26868 - DNA, 1893 bp, Artificial Sequence
  Description of Artificial Sequence: Synthetic coding sequence
atgcccctcggcggtagggctagcctgacaccccaaaaactgtggctgggaaccgcaaagcccggtagtttaacccaggcattaaactctcccctgacatgggagcatgcctggactggcgtgcctggcggaactcccgattgtcttaccgatacattcagggtcaaacggccccacctcaggcgtagcgcatctaatggacacgtgcctggtacaccagtgtatagggagaaggaggatatgtacgacgagattattgaactaaaaaaaagcctccacgtccagaaaagtgatgtggatctgatgaggacaaaactaagacgtctagaagaagaaaactccagaaaggatcgtcagattgaacagctgctcgatccaagtagggggacggactttgtcaggacattggctgagaagaggcccgacgcctcctgggttatcaatggtctcaagcagagaattcttaagcttgagcagcagtgtaaagagaaggacggaaccatttcaaaattacagactgacatgaagaccacgaacctggaagagatgcgcatcgcgatggagacttactacgaggaggtgcataggcttcagacactgcttgccagctcggaaacaacaggcaagaaaccgctcggggaaaagaagacgggcgctaagagacagaaaaagatgggatctgcattgctctcgcttagccgcagcgtacaggagctgactgaggagaatcagtccctgaaggaagacctggatcgagtccttagcacaagcccaactatttcaaagacccagggatacgttgagtggtctaaaccgagattattaaggaggatcgtcgagctggagaaaaaactttccgtgatggaaagctccaagagtcacgccgccgagcccgtgaggagtcacccccctgcctgcctcgcttcctcctccgccctgcaccgccagccacggggagataggaacaaagatcatgagcgcttgagaggcgccgttcgcgacttaaaggaagaaaggactgctctacaggaacagctactgcaaagggacctggaagtgaaacaactcctccaggccaaagccgatctggaaaaagagttagagtgcgcacgtgaaggagaagaggagcggcgcgaaagggaagaggtgttaagagaagagatacagacgctcacctcaaagcttcaggaactccaggagatgaagaaagaggaaaaagaggactgtccggaggtgccccataaggcacaagagctgcctgcgccaactcctagtagcagacattgtgaacaagactggcctcctgacagctcagaagagggactgccccgcccaaggagtccatgttccgatgggcggcgcgatgctgccgctcgggtgctgcaagctcagtggaaagtgtataagcacaagaagaaaaaggcagtcttggacgaggccgctgttgtcctgcaggcggcttttcgagggcacctaacccgcacaaaactattggcaagcaaagcacacggctcagagccgccttctgtacctggcttacctgaccaaagctcgccagtgcccagggttccgtctcctatcgctcaggcaaccggatccccagtccaggaggaagcaatagttatcatccagtcagcgctgcgcgcacacctggccagggctcgccatagcgcaacggggaagcgaaccacaacagctgcatccacgagacggaggtccgctagcgctacccatggtgacgcatcatctccaccattcttagctgccctgcctgacccaagcccgtccggacctcaagcactggcccccctcccaggtgacgacgtgaatagtgacgactctgatgacatcgtgattgcaccaagtctgcccaccaaaaatttccccgtgtag

SEQ ID NO: 26869 - DNA, 2088 bp, Artificial Sequence
  Description of Artificial Sequence: Synthetic coding sequence
atgttcctgggaaccggggagcccgcccttgataccggtgacgactctctgagtgctgtgaccttcgattcagatgttgagacaaaggcaaaacggaaagcctttcataaacctccccctacgtcccccaaatctccatatctgagcaagcctagaaaggtagcgagttggcgcagccttagaactgccggttcaatgcctctcggcggccgcgcaagtctaacaccgcaaaagctgtggctcggtactgcaaagcctggctctttaacacaagccctgaattctcctctcacatgggagcacgcatggaccggtgtcccaggcggcactccagactgtctgactgatacgttcagggtaaaaagacctcacctacgaagatctgcctccaacggccacgtccctggcactcctgtgtatcgggagaaagaagacatgtatgatgaaatcatcgaattaaagaaatccctccacgttcagaaaagcgacgtcgatttaatgcgaacaaaattacggaggcttgaagaggagaacagccgcaaggacagacagattgagcagctgctggatccgagccgcgggactgatttcgtgagaaccctggccgagaagaggccggacgcgagctgggtcatcaacggcctgaaacagcggattctgaaactagaacagcagtgtaaggagaaagacggcacaatctccaaactgcaaaccgacatgaaaacaaccaacctggaggaaatgagaatagctatggagacctactacgaggaggtgcatcggctgcagacactgctggcttcctccgagacgacaggtaagaagccgctcggggagaagaaaaccggcgccaagcggcagaagaaaatgggcagcgctctgctcagcctttctcgatctgtacaggaacttaccgaagagaatcagtcactgaaggaagatctggaccgggtgttgagcaccagccccaccatcagcaaaacccagggttacgtggagtggtcaaaacccagactcctcagaagaattgttgaactggagaagaagctaagtgtgatggaaagtagtaagtcacatgccgctgagccagtgcgcagccaccctcctgcgtgtctggctagcagttcagctttgcaccggcagcccagaggcgaccggaataaggatcatgaacggctgaggggtgcagtcagagacctgaaagaggagagaacagcacttcaggagcagttactgcaaagagacttggaggtgaaacagctgctccaggccaaggccgatctggagaaggagttggaatgtgccagggaaggagaggaggagcgaagagaacgcgaggaggtcttaagggaagaaattcagaccctcacgtccaagctgcaggagctgcaagagatgaagaaggaagagaaagaggattgtccagaggttccacacaaggcccaggagctgcctgcaccaaccccttcctctcgccactgcgagcaggattggccccccgacagctcagaggaaggcctgccacggccaagaagcccttgctcagatggccggagggacgctgcggcccgcgtgctacaagcacaatggaaggtttataagcataagaaaaagaaggccgtgctggatgaagcagccgttgtgctccaggcggcgtttagaggtcatctcacacgcactaagcttttggcaagcaaagcacatggatccgaacctccgtctgtcccagggctcccagaccaatccagccccgtaccaagagtcccttctcccatcgcccaggccactgggtctccggtccaggaagaggcaatagtgatcatacagtcggcgctgagagcgcacctcgcgagagcccgacacagcgccacgggcaaacgaaccacgacagcggcatccacaagaaggcggtctgcttcggcaactcatggtgacgcctccagtcctcctttcctggctgcactcccagacccgtccccttccggcccccaggctctggccccactccccggggacgacgtgaattcagacgattccgatgacattgtcattgccccatcccttccaaccaaaaactttcctgtctag

SEQ ID NO: 26870 - DNA, 1935 bp, Artificial Sequence
  Description of Artificial Sequence: Synthetic coding sequence
atgtttctgggcaccggggagcctgctctcgacacctctcacctgattagcctgtcacgcgcgtcactgacacctcagaagctgtggctgggaaccgccaagcccgggagccttacccaggctctgaatagtccccttacttgggaacacgcctggaccggtgttccgggcggaacccctgactgcctaaccgacacattcagggtgaaacgcccacatctgcgaagatcagcctcaaacggtcatgtgccaggcacaccagtgtaccgcgagaaagaagacatgtatgacgagattatcgaactcaaaaagagtctccatgttcagaagtctgatgtggatctgatgcggacaaagctgcgcagactggaagaggagaactcacgaaaagacagacagatagagcagctcctggatccatccaggggcaccgactttgttagaacactcgctgagaagcggcccgatgctagttgggtgattaacggattgaagcagcggattctgaagctggagcagcaatgcaaggaaaaggatgggactatctcgaagctccagactgacatgaaaactacaaatctcgaggagatgagaatcgccatggagacgtactacgaagaggtccatcgcctccagacgcttctcgcctcctcagaaaccactgggaaaaagccactgggggagaagaagacaggggcgaagcgacagaaaaaaatggggtccgctctcctcagcttatctaggagcgtccaagagctgacagaggagaatcaaagccttaaggaagacctggaccgcgtgctatcaacaagcccaacaatcagtaagacccagggctacgtggagtggtcaaaacctcgcctgcttcgaaggatcgtggaattagagaaaaaattaagtgtaatggaaagctctaaatctcacgccgctgagcccgtgaggtcccacccccctgcttgcctcgcaagcagctccgccttacaccgccaaccgcgaggggaccgcaataaagatcacgaaaggctgcggggggcggttcgcgacctcaaggaagagcggacagcactacaggagcagctcctacagagagatctagaggtgaagcagctgcttcaagccaaggccgacctggaaaaggagttggagtgtgcaagagagggagaagaagaacgtagggagcgcgaggaggtcctcagggaggaaatccagactctgacttccaagctgcaggagttgcaggagatgaagaaagaggaaaaggaggattgccctgaagtacctcacaaggcccaagagctaccggcgcctaccccatcctcccggcactgtgaacaggattggcctcctgacagtagcgaggaagggctgccccgaccccgctctccttgctccgacggcaggagagacgccgcagccagggttcttcaagcccagtggaaagtgtacaagcacaagaaaaagaaagctgtcttggatgaagcagccgtggtacttcaggctgcttttcgaggtcatcttacccggactaagctccttgcctctaaggcacacggctctgagcctccctccgttccaggcctcccagaccagagctcccccgtgccgagagtgccaagccctattgcccaggccaccgggtctcccgtgcaggaggaggccattgtgatcatccagtcagccctgagggcacacctggccagggccagacactctgcaactggcaagcggactacaacagccgccagtactcgcaggaggtccgcatctgccactcacggcgacgcttcaagcccaccattcctcgctgccttaccagaccctagcccaagtgggccccaggccctggctcccctccctggcgacgatgtcaacagcgacgattccgacgatatcgtcattgcccccagtcttccaacaaaaaacttcccagtttag

SEQ ID NO: 26871 - DNA, 387 bp, Artificial Sequence
  Description of Artificial Sequence: Synthetic coding sequence
atgcccttagggggtcgggcgtcactgactccacagaagctgtggctcggcacagcgaagccagggtcgcttactcaagccctgaatagtcccctcacatgggagcacgcctggactggcgtcccaggtggcactcccgattgcttgactgatacattcagggtcaaacgtccccatctgcggcgttccgcaagcaacggacacgtgccgggtacccccgtgtacagagaaaaggaggacatgtatgacgagattatcgagctgaagaagtctctgcacgtgcagaaatccgacgtggacctgatgcgcactaagctgcgccgcctagaggaagaaaacagcagaaaagacaggcagattgagcagctgcttgacccttctcggtag

SEQ ID NO: 26872 - DNA, 387 bp, Artificial Sequence
  Description of Artificial Sequence: Synthetic coding sequence
atgcctctcggcggcagggcttcccttaccccacagaagttatggctcgggacagcaaagcccggctcactgacccaggccctgaactctcccctcacatgggaacatgcatggacaggcgtaccgggcggaactccagattgcctgactgatacctttcgggtgaaacgcccgcatctgaggagaagtgcatctaacggacacgtgcctggaacacctgtgtaccgtgaaaaagaagacatgtatgacgagatcattgaactaaaaaagtctttgcatgtgcagaagtcagacgtggaccttatgcgcacgaaactgcgcaggctcgaggaagagaattcccggaaggatcggcaaatcgaacaactcttggaccctagccgatag

SEQ ID NO: 26873 - DNA, 2040 bp, Artificial Sequence
  Description of Artificial Sequence: Synthetic coding sequence
atgtttctcggaacaggcgagccagcactggataccaaagccaaacgcaaggcgttccacaaacccccacccacctcaccaaagtcgccttatttatccaagccccggaaggttgctagctggcgttcattgcgcactgcgggatcgatgccactcggcggacgcgcatcattaacaccccagaaactgtggctgggaacagccaagcctggcagcctgactcaggctctgaactcacctctcacttgggaacatgcatggaccggggtgcctggcgggactcccgactgccttactgacaccttccgagtcaagagaccccatctcaggcgatccgcctccaacggccacgtccctggaacccctgtatatagggaaaaggaggatatgtatgacgagattatcgagctgaagaagtctctgcacgtgcagaagagcgatgttgacctaatgcgtactaagttacggaggctggaagaagaaaattcaagaaaggatagacagatcgaacagttgttagacccatcccggggcacagatttcgttcgcaccctggcggagaaacgccccgatgcttcatgggtgatcaacggtctcaagcagcgaatccttaagcttgagcaacagtgtaaggagaaggatgggacaattagcaaacttcagactgacatgaagacgaccaatttagaggaaatgagaattgccatggagacctattacgaagaagtccacagattgcagacactgctcgccagctccgagaccactgggaaaaagcccctgggggaaaaaaagacaggtgctaaacggcagaaaaagatgggcagtgccctgctgtctctgtctcgctcagttcaagagctgacggaagagaatcaatcccttaaggaggacctcgatagagtcctttctactagccctacaatttctaaaacacaggggtatgtggagtggagtaaacctaggctgctccgcagaattgtcgagttggagaaaaagctctcagtcatggagtcatcaaagtctcatgccgccgagcctgtgcggtcgcacccacccgcttgtctggccagctcttctgccctgcaccgccaaccacgaggggaccgcaacaaggaccacgagagactcaggggggctgtgcgagacttgaaagaagagcggaccgccctgcaggaacagctcctgcaaagggatttagaggtcaagcagctgctccaggccaaggccgacctcgagaaggaactggaatgcgcacgggaaggggaggaagagagaagggagcgggaagaggtgctgcgggaagagatacagacactcacgtccaagctgcaagagctgcaggaaatgaaaaaggaggagaaggaagattgcccggaagtgccacacaaggctcaagaactgccagcgcccaccccctctagccgacactgtgagcaggattggcctccagatagctccgaagaaggcctgcctagacccaggagtccctgcagcgatggccggagagacgccgcagcccgggtgctccaggcccagtggaaggtgtataaacacaagaagaagaaggctgtcctcgacgaagccgcagtggtactgcaggccgccttccgggggcacttgactcggactaagctcctggcttctaaggcacacggttccgaaccacccagtgtcccaggcctgcccgaccagtcttcccccgtgccgagagtgccctctccaatcgctcaagctacaggcagtcccgttcaggaagaggcgatcgttattatccaaagcgcactgagagcccacttggccagggctagacactccgccactggcaagcgaaccaccacagccgcctcaaccaggcgtaggagcgcgtccgctacgcatggtgatgcctcttctccgccctttctcgccgccctgcctgatccatcccccagcggtcctcaagccctcgccccgttgccaggagatgacgtcaattcagatgatagcgatgatattgttattgccccgtcccttcccacgaagaacttcccagtgtag

SEQ ID NO: 26874 - DNA, 4896 bp, Artificial Sequence
  Description of Artificial Sequence: Synthetic coding sequence
atggagcggcgagctgctggccctgggtgggctgcctacgaaagactgacagctgaggagatggacgagcagagacgccaaaacgtggcctaccagtacttgtgccgcctagaagaagcgaagagatggatggaggcgtgcctcaaagaggagttgccgagtcccgtggaactggaagaaagtcttagaaacggtgttttactggcgaaactcggccattgcttcgcgccatccgtcgtgcccctgaaaaagatctatgatgtggagcagctaagatatcaggccaccggcctccatttccggcacacagacaacattaacttttggttaagcgccattgcacacataggtttaccttctaccttcttccccgaaaccacagacatttatgacaagaagaatatgcctagggtcgtgtattgtatacacgcactttctctctttctattcaggcttgggctcgcccctcaaatacatgatctttacggcaaagttaagtttaccgctgaggagctgagtaacatggcatctgagctagcaaaatacgggctacagttgccagctttcagcaagataggcgggatattggccaatgagctgtccgtggacgaggcggcggtccacgctgccgtgctggcgattaacgaagccgtggaacggggagtcgtggaagataccttggctgcccttcagaacccaagcgcattgttagaaaacctgagagaacctctggctgctgtgtatcaggagatgctggcacaggccaaaatggaaaaggctgcgaatgcgcgaaaccatgatgatcgggagtcccaagatatttatgaccactatctcacccaggcagagattcaaggcaatattaatcatgtgaacgtccacggtgctctcgaggtggtagatgacgctctggagagacagagccccgaggctcttctcaaggctctccaggaccccgcattggccctgcggggagtgcggagggatttcgccgattggtacctcgaacaacttaactctgaccgcgaacaaaaagcgcaggagttgggcctggtcgagctgctggagaaagaagaggtccaggctggcgtcgccgccgccaacactaaaggagatcaggagcaagcaatgctgcatgctgtccaacggattaataaggcaataagacgtcgcgtggccgcggacactgtgaaggagctgatgtgccccgaggcccagcttcctcctgtctacccggtggcctcatccatgtatcagcttgagttagccgtcttgcaacagcagcagggagagctcggccaggaggagctatttgtggctgtcgagatgctgtcggccgtggttctgattaaccgcgcgctcgaggcacgggacgcaagcgggttctggagcagcctggtgaaccccgccacaggccttgcggaagttgaaggtgaaaacgcccagcggtacttcgacgcactcctgaaactaagacaggagcggggcatgggtgaggactttctgtcatggaacgacctgcaggctaccgtttcccaggtcaacgcacagacccaggaagaaaccgatcgcgtgttagctgtgtccctgattaatgaggctctagacaagggatctcccgagaagacgctgagtgctctgctcttgcccgccgccggtctggacgatgtctctttgccagttgcccctagatatcaccttctgctcgtggcagccaaacggcaaaaagcacaggttactggcgacccgggtgccgtcttgtggttggaggagataaggcagggggtggtccgcgctaatcaagacaccaacaccgcccaaagaatggcccttggcgtagccgcgattaatcaggcaatcaaagagggaaaggccgctcagactgaacgggtgcttcgcaatccagccgtggcactgagaggtgtggtccccgactgtgccaacggctaccagcgcgctttagagagcgcgatggctaagaagcagcggcctgcggataccgcattctgggtgcagcacgatatgaaagatggcacagcttactacttccatctccagacattccaggggatctgggagcagccccccgggtgtcctctgaacacctcccacctcaccagggaggagattcaaagtgccgttacaaaggtcacagccgcctatgacagacaacagctttggaaggctaatgtagggttcgtcatccagctccaggctcggcttcgcgggttcctggtacgccagaaattcgccgaacattctcactttctccgcacttggctccccgccgtaatcaagattcaagcccactggcgcggctaccgccagcgaaagatatatctggaatggctgcagtattttaaagcgaacctggacgccataatcaagatccaggcctgggcaagaatgtgggctgctaggcggcagtatctgagaaggctccactacttccagaaaaacgttaatagcatcgtcaagattcaggcattctttagagctagaaaagctcaggacgactatcgcatacttgtgcatgcacctcatccccccctcagtgtggttagaaggtttgcccacctgctcaaccagagccaacaggatttcctggcagaagctgaattattgaaactgcaagaggaggtggtgcgcaaaataaggtcgaaccagcagctggagcaagatttgaatatcatggacattaagatcggactcctggtgaagaataggatcacactgcaagaggtggtgtcccactgtaagaaacttactaaacggaacaaggaacaactcagcgatatgatggtgctggacaaacagaagggcttgaaaagtctcagcaaggagaaacggcagaaactggaggcatatcagcacctgttctatctgcttcagacccagcccatctatttggcaaagctgatctttcaaatgccccagaacaaaacaacaaagtttatggaggccgtcatcttttcactgtataactacgcctcgagtcgacgggaagcttacctgttactccagctgtttaagacggcgttacaggaggagatcaaaagtaaagtggagcagccgcaggacgtcgtgacaggcaaccccaccgtggtgaggttagttgtcaggttttatagaaatgggcgggggcagtcagcgctccaggaaatccttgggaaggtgattcaggatgttctcgaagataaggtccttagcgtgcacactgatccggtacacctctataagaattggattaaccagacggaggcgcaaaccggacaacgatcacatctcccatatgacgtgacgcccgagcaggcactatctcatcccgaggtccagagacgactggacatcgctctgaggaacctcctcgcaatgacagacaagttcttgttggccataaccagttctgtggatcaaattccatatggtatgaggtacgtggcaaaagtactaaaggcgacccttgccgagaagtttcctgacgcaaccgattccgaagtttacaaggtcgtgggaaatctgttgtactaccgatttctgaatccggcggtggtggcgcctgatgccttcgacatagttgccatggcagcgggcggcgccctggccgccccccagcgccatgcacttggagctgtggcccagcttctacagcatgctgctgccggcaaggctttctccggacagtctcaacaccttcgggttttgaatgactatctggaagaaacacatcttaaatttagaaagttcattcatagggcatgccaggtcccagaacccgaggagcgatttgcagttgacgagtactcagacatggtcgcagtggcaaagccaatggtgtacatcaccgtgggcgagttggtcaacacacaccgtctgctgttggagcaccaggactgcatcgctccggaccaccaagatcccctgcacgaacttctggaggatctcggggagctgccaacaattcctgacctgataggggaatcgatcgcggcagatggccatacagacctctcaaagttggaagtctccttgacattgaccaataaatttgagggactcgaagcagatgctgacgattctaacacacggagcctgctcttgtccacgaagcaactgctagctgatattattcaattccatcctggtgataccctgaaagagatcctgtccctgagcgcatcccgcgaacaggaggccgcccacaaacagttaatgagtaggcggcaggcttgtactgcccagaccccagaaccgctgaggcgccaccggtccctgacagcccacagcctgctcccccttgccgagaagcaaaggagagtcctcaggaacctccggagactagaagccttaggcttggtctcggcacgcaacggctaccaagggctcgttgatgaactagcaaaggatattcggaaccagcatagacacaggcaccgaagaaaagctgaattggttaagctgcaggccacgctgcagggcctctccaccaagacaacattctacgaggagcagggcgattactattctcagtacatccgcgcatgcctggatcacctcgccccagattctaagagttctggcaagggtaaaaagcagcctagtcttcactacacagctgcccagctgctggaaaaaggtgtactggttgaaatcgaggatctgccagctagccactttcggaacgttatatttgacatcacccccggtgacgaagccggcaagttcgaggtcaacgccaaatttctgggagttgacatggagagatttcagctgcactaccaggacctcctccagctccagtatgagggagtggctgtaatgaaactgtttaataaggcaaaggttaacgtgaatctgctgattttcctcctgaataagaagttccttcgaaagtag

SEQ ID NO: 26875 - DNA, 465 bp, Artificial Sequence
  Description of Artificial Sequence: Synthetic coding sequence
atggcggccgcctggggctcatccttgaccgctgccacgcagagagcagtgacgccctggccccggggccggctgttaacagccagtctcggtccccaggcccgaagggaagccagctcctcttcgccggaggctggcgaaggacagattcgcctgacagacagctgcgtccagcgtctcctcgagatcacagagggatctgagtttctgaggctccaggtcgaaggcggtggttgctccggctttcagtataagttttcgctggatactgtcattaaccccgatgacagagttttcgaacagggtggggcccgtgtggtggtggacagtgactccttagcctttgtgaagggcgcacaggtggactttagtcaggagttgattagatcttctttccaagtactgaacaatccccaggcccaacaagggtgttcatgcggaagctccttctccattaaactgtag

SEQ ID NO: 26876 - DNA, 666 bp, Artificial Sequence
  Description of Artificial Sequence: Synthetic coding sequence
atgccacttgcgctcaccctccttctgttgtcaggattgggagctcctgggggctggggctgtctccaatgcgaccctctcgtgttagaggccttaggacacctgaggtccgctttgatcccaagtcggtttcagctggagcaattgcaggcgagggcgggcgctgtccttatgggaatggaaggccccttttttcgggactatgcccttaacgtgtttgtgggcaaggtggagactaaccagctggacttagttgccagctttgtgaagaaccagacccaacacctcatgggcaatagtttaaaggacgaacccctgctcgaggagctggtgacgcttcgcgccaacgttattaaagaattcaagaaagtcctgattagctatgagctgaaagcatgcaaccccaagctgtgcaggctgctgaaggaggaggtgttagactgcctccactgccagcggattaccccgaaatgtatacataagaaatattgcttcgtcgatagacagcctcgagttgcactgcagtaccaaatggactcaaaatacccacggaatcaggcgcttctcggcattctgatctccgtgtctctggcagtgttcgtttttgttgttattgtcgtgagcgcctgtacataccggcaaaatcggaagctcttgctccagtag

SEQ ID NO: 26877 - DNA, 579 bp, Artificial Sequence
  Description of Artificial Sequence: Synthetic coding sequence
atgccactggctctgaccttactgcttctgagcggcttaggggctccagggggatgggggtgcctgcagtgcgatcccctggtcctggaggctctggggcacctccggagtgcgctaattccttctagatttcagctagagcaacttcaggcccgggccggcgccgtgctgatgggaatggagggcccttttttcagggactatgccttgaacgtgttcgtgggcaaggtggagaccaaccagctggatctagtggcctcattcgtgaaaaatcagacacaacacctcatggggaactctctcaaagacgaaccacttctcgaggaacttgtcacgctccgggccaatgttattaaagagttcaaaaaggttttgatatcttacgaactgaaggcgggtaaccccgcctggccctgtagtaccagatggacagccaacaccagggggacaaggcgctgttgggcgtcctccttcctgtgcctttggcttagtctcagttcatggagtagctggtcccgacttgtccataccgacaagacagagaatagttgttgttcaaggactgtggtttggggctag

SEQ ID NO: 26878 - DNA, 720 bp, Artificial Sequence
  Description of Artificial Sequence: Synthetic coding sequence
atgggggatttatggttattcttgctgctgcccttatccgctttccacggagtaaaagggtgtcttgaatgcgaccccaagttcatcgaggacgttgggtctctgctcgggaacttgattcctagcgaggtcccaggtaggactcaactgcttgagagacagattaaggaaatgatacatctgagcttcaaggtttcccatagtgataaaaggctgagagttttagcagtgcagcaagtcgtcaagctcagaacttggctgaagaacgaattttataagctgggtaacgaaacttggaagggcgtttttatctaccagggtaagttgttggatgtctgccagaatctggagagcaaactaaaggaactgctgaagaatttcagtgagatcgcttgtagcgaggactgcatcgttgtggaaggccccatattggattgctggacttgcctgaggatgacgaatagatgtttcaagggtgagtactgtggcgatgaagatccgcgtaaagcggaaaatagggaaattgctctttttctcatcctcttggctaccgctgtgatactcgggtccgcagtgctgctatttcacttctgtatcttccaccgccgcaagatgaaagctattcgacggtcactcaaagagtatgtagaaaaaaagctggaagagctcatgggaaagatagatgagaaggaagaaaaagactttagacttaggaagtag

SEQ ID NO: 26879 - DNA, 1053 bp, Artificial Sequence
  Description of Artificial Sequence: Synthetic coding sequence
atgggaccgcacttcactttgctctgtgccgcactggccggatgtctcctccctgcggagggatgtgttatatgcgatccatctgtcgtgctggcattaaaatcattggagaaggactatctacctggtcacctggatgcaaaacaccacaaggcgatgatggaaagagtggagaatgccgtgaaagactttcaggaactcagcctaaatgaagacgcatatatgggagttgtggatgaagccacactgcagaagggaagttggagtctgcttaaggacctgaaacgcatcaccgactccgatgtaaagggggatctattcgtgaaagaactgttttggatgttacatctccaaaaggagacgtttgccacatacgtggcacgatttcagaaagaggcatactgcccgaacaagtgtggtgtcatgctgcaaacgctgatctggtgtaagaattgcaagaaagaagtgcacgcctgccgaaaatcctatgattgtggagagcggaacgtggaagtgccccagatggaggacatgatcctggattgtgaactaaactggcatcaggcaagcgaaggacttaccgattattcattctatagggtatggggcaacaatacagaaactttagtgagtaagggtaaggaagctaccttaaccaaacccatggtgggtccagaagatgctggatcgtatcgctgcgaactaggctcagtgaatagctccccagccacgatcattaacttccacgtcactgtgctccctaagatgattaaagaggagaaaccctcacccaacattgtgacacctggcgaagccaccaccgaaagttctatctctctgcagcctttgcagcctgagaagatgctggccagtcggcttcttggcctgctgatatgcggctccctcgccctgatcaccgggctcacctttgcaatctttaggcgcagaaaagttatcgacttcattaagtctagcttgttcgggctgggctctggcgcagctgaacagacacaggtccccaaggagaaagccaccgattcccgccaacagtag

SEQ ID NO: 26880 - DNA, 552 bp, Artificial Sequence
  Description of Artificial Sequence: Synthetic coding sequence
atggccagccgcgccggtccgagggctgcaggcacagatggatcagattttcaacaccgcgagcgcgttgctatgcattaccagatgtccgttaccctgaagtatgaaattaaaaaactgatctatgtgcatttagtgatttggcttcttctggtcgccaagatgagtgtgggtcatctgcgactgctgagtcacgaccaagtcgccatgccctaccaatgggagtacccctacctcctctctatcctgccctcactcttggggttgctctcatttccccggaataacatcagctatctagtcctctctatgatcagtatgggtctcttcagcatcgcccccttaatctacggatccatggagatgtttcctgccgcccagcagttgtaccgtcacggcaaggcctatcgattcctgtttggcttctctgctgtgagtattatgtatctggttttggtgctcgctgtgcaagttcatgcgtggcagctgtactattctaagaagcttcttgacagctggtttacctccactcaggagaagaagcacaagtag

SEQ ID NO: 26881 - DNA, 546 bp, Artificial Sequence
  Description of Artificial Sequence: Synthetic coding sequence
atggctagccgggccgggccaagagccgccgggaccgatggctctgacttccaacatcgagaacgcgtcgcgatgcattatcagatgtcagtgaccctgaagtatgagattaagaaacttatctatgtacacctggtgatttggctgctcctcgtggctaagatgtcagttggccacttgaggttgctttcccatgaccaggtggctatgccttaccagtgggagtacccttaccttttgtcgatcctgcccagccttctgggactgctttctttcccaagaaacaatatatcctacctagtgctgtccatgatctctatggggcttttccatagatccacgcatctttggcaacacggtgacgtgccatgttgcactgccgctacagcaatggcaagacctaccgtctcctcactggtctttcttccctttcccatgtacctggtcttggtgctcgcagtccaagtacatgcctggcagctgtattattctaagaagctcttggactcatggttcaccagcactcaagagaagaagcacaagtag

SEQ ID NO: 26882 - DNA, 1881 bp, Artificial Sequence
  Description of Artificial Sequence: Synthetic coding sequence
atgtcgaagaaaggaagaagtaaaggagaaaaacctgaaatggagacagacgctgtccagatggccaacgaagagctccgggcaaagctcacgagcatccagatagagttccagcaagaaaagtctaaggtcggaaaattgagggagagacttcaagaagctaaactggaacgtgaacaagagcagaggagacacaccgcatatattagtgaactcaaggccaaattgcacgaagaaaagaccaaggagttgcaagctctgagagaggggttgattagacagcacgagcaggaggcggctcgaacagccaaaatcaaggagggagagctccaacgcctgcaggcgacacttaatgtgctgcgagacggggccgccgacaaggtgaagactgcccttctcacagaagctcgcgaagaagccagacgagcattcgatggggagagactcagactgcagcaggaaatcctcgagctgaaagcagcacgaaagcaggcggaagaagccctctcaaattgcatgcaagctgacaagaccaaggctgccgaccttcgggccgcctatcaggcccatcaggacgaggtacaccggatcaagagagagtgcgagcgagacatccggcggctgatggacgagataaaaggcaaggatcgcgtgattctagcacttgaaaaggagctgggcgtgcaggcgggacagacccagaagcttctgctgcaaaaagaggccctggatgaacagctcgtacaagttaaagaggctgagcgacatcatagctctcctaaaagggagcttcctccagggataggcgacatggtggaactgatgggcgtgcaggatcagcatatggacgagcgtgatgtaaggcgcttccagcttaaaattgcagagctgaatagcgtaattagaaagctcgaggaccgaaacactctcctcgccgatgagcgtaacgagctgttaaagaggagcagagagactgaagtacaactgaagcctctagtggagaagaataagcggatgaacaagaagaatgaagatctgttacagagcatccaacgcatggaggaaaaaataaagaatcttacgagggaaaacgtagagatgaaggaaaaactgagcgcccaggccagcctgaagcggcacacttccctcaacgacttatcacttaccagggacgagcaggagattgaattcctgcggctgcaggtgcttgagcaacagcatgtgattgatgacttatctctggaaagggaaaggttgctccgatcaaagcgtcaccggggaaaatcacttaaacccccaaaaaagcacgtagttgagactttttttgggtttgatgaggagtctgtggacagtgaaaccctgtctgagacaagctacaataccgaccgtaccgaccggacaccggcaacaccggaggaggacctggacgacgctacagcccgtgaagaggcggaccttagattttgccaactgacccgggagtaccaggctttgcaaagggcatatgcccttctccaggagcaagtgggtggcaccttggatgctgaacgggaagcgaggacaagggagcaactccaagctgatcttctgaggtgccaggccaaaatcgaagatcttgagaagcttctggtggagaagggtcaggattctaaatgggtcgaagagaaacagctactcattagaaccaaccaggatcttttggagaagatttacagactggaaatggaagagaaccaacttaaaaatgagatgcaggacgccaaggaccaaaacgagctgctggagttcagagtgctggagctggaggtgagagattcaatatgttgtaaactctccaacggtgccgatattctttttgagcctaagctgaaattcatgtag

SEQ ID NO: 26883 - DNA, 2496 bp, Artificial Sequence
  Description of Artificial Sequence: Synthetic coding sequence
atgtctaaaaaaggcagaagtaaaggggagaagcccgagatggaaactgatgcagtccaaatggccaatgaggagttgagggccaagctgacaagcattcagatcgagtttcagcaggagaaaagtaaagttggaaagctgcgagaacggcttcaggaggccaaacttgagagggagcaggagcagcgccgacataccgcctacataagcgagctcaaagccaaactgcacgaggaaaaaaccaaagaactgcaggctctgagagagggcctcatccgacagcatgaacaagaggctgctcgaaccgccaaaattaaagaaggtgagctgcagcgcctgcaggcaactctcaatgtgttgagagatggtgcagccgataaagtaaaaacggcgctcctgaccgaggcccgtgaagaagcccgccgcgcattcgacggtgagcggctgcgactgcagcaggaaattctggaattgaaggccgctagaaaacaggccgaggaggccctcagtaattgcatgcaggctgacaaaacaaaagctgctgacttaagggcagcctatcaggctcaccaggatgaggtgcaccgaatcaagcgggagtgtgagagggatattcgaagactgatggatgagatcaagggcaaggaccgggttatcctggccttggagaaggaactgggcgtgcaggccgggcagactcagaagcttttactccagaaggaggccctggacgaacagctggtgcaggttaaggaggccgaaaggcaccattcatcccctaagagagagttgccacccggtatcggcgatatggtggaactgatgggggtgcaggaccagcacatggatgaaagagatgtcagaagattccaacttaaaattgccgagcttaattctgtgatccgcaaactggaggatcgtaatacgctgttggctgacgagaggaacgaactccttaaaagaagcagagagacggaagtgcaactgaaacctctggtggagaagaataagcgaatgaataagaaaaacgaagacctgctacagtccatccaacgcatggaggagaagatcaaaaacctgacaagggaaaatgtagagatgaaagagaaactttccgcacaggcaagtttaaagcgtcatacctccctgaatgacctgtctctgacccgcgacgaacaagagatagagttcttgagactccaggtgttggagcagcaacacgtgattgacgacctgtcactcgagcgagaaagactgctgcggagcaaacgccatagaggaaaaagcctgaagccacccaagaagcatgtagtggaaacatttttcggatttgacgaggaatccgttgactctgagaccctgtcggaaacatcatataacacggataggactgaccgcacccctgctacacctgaggaggatcttgacgacgccacagctcgggaggaagcagatctccgcttttgtcagctgactagggaataccaggccctgcagcgggcctacgctctcctgcaggaacaggtggggggaactctcgatgctgagagagaggctcgtacccgggagcagctgcaggccgacctcctccgatgtcaagccaagatagaggatctggagaaactcctggtcgagaaggggcaggactctaaatgggtggaggaaaagcagctccttatcaggactaaccaggacctgttggagaaaatatatcggctggaaatggaggaaaaccaattaaagaatgaaatgcaggacgccaaggaccagaatgaattgttagaattcagagtgttggagctggaagagagggaaagacggtccccagcctttaatctacagatcacgacatttcctgaaaaccattcgtccgctctgcagctgttctgccatcaagagggagtgaaagatgtcaatgtgtccgaactgatgaaaaaactggacatccttggagacaacggaaacctgaggaacgaagaacaggtggctattatacaggcggggacagttttggccctctgtgagaaatggcttaaacagatcgaaggcacagaggctgcactcacgcaaaagatgctggatctcgagaaggaaaaagacctattctcacggcagaaaggatatctcgaagaagagctggattaccgtaagcaggcactcgatcaggcatacctgaaaatccaggatttggaagcgaccctctatacggctttgcagcaggagcctggtagaagggccggcgaggcactttcagaaggccagcgggaggatctccaagccgcggtggagaaggtgagacgccagattctccgacaatcccgcgaattcgatagtcaaatactgcgggaacggatggaattgcttcagcaggcccagcagcgcattcgggagttagaagacaagctggaattccagaaacggcacctgaaggaacttgaggaaaagttcctctttctcttcctattcttttccctggctttcattctctggccatag

SEQ ID NO: 26884 - DNA, 1941 bp, Artificial Sequence
  Description of Artificial Sequence: Synthetic coding sequence
atgtccaagaagggccgcagtaagggcgagaagcctgaaatggaaactgacgcggtgcagatggcaaatgaggagctgagggcaaaactgacttctatccaaatcgagttccagcaggagaaatctaaaatggatgagattaaagggaaggatcgggtgatccttgcactggagaaagaactgggagttcaggcgggccagacacagaaactgctgctgcaaaaggaagccctcgacgagcaactggtgcaggtgaaggaagctgagcgccaccactcctctcctaaacgcgagctgccacctggcattggggacatggtagaacttatgggcgtgcaggaccaacatatggacgagagggatgtaagacgtttccaactcaagatcgctgagctgaatagcgtgataagaaagttagaagaccggaataccttactggctgatgaaagaaatgaactgctcaagcggtcccgcgaaacagaggtccagctgaagccattggtagagaagaacaaaagaatgaacaagaagaatgaagatttgttgcagtcaatccagcgtatggaggagaaaatcaagaaccttacccgcgagaatgtggagatgaaggagaaactctctgcccaggctagcttgaaacggcacacaagcctgaacgacctctccctgactcgagacgagcaggaaatcgagttcttacgtctgcaggtactagagcaacagcatgtcattgatgatctgtccctcaagcacgtggtcgagactttttttggttttgatgaggagagtgttgactctgagactctaagtgaaacctcttacaacactgacagaacggaccggaccccagccactcctgaagaagacttggacgacgccacagcacgcgaagaggccgatctaaggttttgtcagttgacccgagagtaccaggcgctccagagggcttacgccctgctgcaggaacaagtggggggcaccctagacgccgaaagagaagcgcgaacccgggagcagcttcaggcggatctgctcaggtgtcaggccaagatcgaagacctcgaaaagcttctcgtggagaaaggacaggattctaaatgggtggaggaaaaacagttgctgattcggaccaatcaggacctgctggagaaaatataccggcttgagatggaggagaatcagctgaagaatgaaatgcaggacgccaaggaccagaatgagctgcttgagtttcgggtgctggagctggaggaacgggaacgaaggagtcccgcttttaatctgcaaattaccactttcccggaaaaccacagctccgcactccagctgttttgccatcaggagggagtcaaagacgttaacgtgagcgagctaatgaagaagctcgatattctcggggacaacgggaacctgagaaacgaggagcaggtggcaatcatacaagccggtaccgtgctcgcactgtgcgagaaatggctaaaacagattgaggggaccgaagccgccctaacccagaagatgctggatctggagaaagagaaggatctgttttcaagacaaaaaggctaccttgaggaggaattagattatagaaagcaggccctcgaccaggcatacctcaagattcaagacctcgaggccacattgtataccgcccttcagcaggaaccagggcgtcgcgccggcgaagccctctccgaaggccagcgtgaagacctccaggcggccgtggaaaaggttcgtcgacagatcttgcggcagtccagagaatttgattcccagattcttcgggaacgcatggaactcctgcagcaagcacagcagcgaatcagagagctggaggacaaactggaatttcagaaaaggcatctgaaggagctggaagaaaaatttctctttctcttcttgtttttcagcctggccttcattctgtggccatag

SEQ ID NO: 26885 - DNA, 1881 bp, Artificial Sequence
  Description of Artificial Sequence: Synthetic coding sequence
atgtccaagaaggggcgctccaagggtgaaaagcccgagatggaaaccgacgccgtgcagatggcaaatgaggaattgcgggccaaactcaccagtattcagattgaatttcagcaggagaaatccaaggttggtaagctgcgagagcgcctgcaggaggcgaaacttgaaagggagcaagagcagaggagacacacagcttatatcagcgaacttaaggctaaactccatgaggagaaaacaaaagagctgcaggcccttagggagggtctgattaggcagcatgagcaggaagccgcacgcaccgcaaaaatcaaggagggggagttgcagagactgcaggctacactcaacgtactgcgagatggcgcggcggataaagtgaagacagccctgttgactgaagcaagggaggaagctcgcagggccttcgacggagagcggttgagactgcagcaggagatcctagagctgaaggcagccaggaagcaggcggaagaggcactatccaactgcatgcaggcggacaagactaaagccgccgacctacgggcggcctatcaggcacaccaggatgaagttcatcgaattaagagggagtgtgaacgggacatacgccggctcatggacgaaatcaaaggaaaggatcgcgtgatcctcgccctcgagaaggagctcggcgttcaggccggccagacacaaaaacttttgctgcagaaagaggcccttgatgagcagctcgtgcaggtgaaagaagctgagcgccaccactcgagccccaaaagggagctccctccgggtataggcgatatggtggagcttatgggtgtgcaggaccaacacatggatgaacgcgatgtccgcagattccagctcaagatcgccgaactgaattccgtgatccgcaaactggaagatcgaaacacactcttggccgacgaacgtaatgaactgctgaaaaggagcagggagacagaggttcagctgaagcctcttgttgagaaaaacaagcgcatgaataagaaaaatgaggacctcctgcagtctatccaacgtatggaggaaaaaatcaaaaatctcacaagggaaaatgtagaaatgaaggagaagctgtccgcgcaggctagtctgaagaggcataccagcctgaacgacctgtccctcacacgggacgagcaggagattgaatttctgcgtctccaggtgctggagcagcagcatgtaatagatgacctgtcactcgaaagagagcgactcttaagaagtaagcgtcaccggggtaaatctttgaaaccacccaagaagcatgttgtggaaactttcttcggattcgacgaggagagtgtcgacagtgagactctgtcagagacttcttacaacaccgatagaaccgatagaacacccgcgacacccgaggaggacctggacgacgcaaccgccagagaagaggcagatctgcggttttgccagttaacccgggagtaccaggcgttacagagagcttacgcattgctgcaggaacaggtgggcggcaccctcgatgccgagcgggaagcacgtactagagagcagcttcaggcagatctgctgcggtgtcaagccaaaattgaggatctggagaagctgctggttgaaaagggacaggacagcaaatgggtggaagagaaacagctattgatccggacgaaccaggatctgctagagaagatctatcggctggaaatggaggagaatcagctcaaaaatgagatgcaggatgccaaggatcaaaacgagcttcttgaatttcgggtcctggagctagaagtgcgcgacagcatctgctgtaaactgtcaaacggggccgatattctgttcgagcctaagctgaagtttatgtag

SEQ ID NO: 26886 - DNA, 1296 bp, Artificial Sequence
  Description of Artificial Sequence: Synthetic coding sequence
atgagcaagaagggccgcagcaagggcgagaaaccggaaatggagaccgacgcagtccaaatggcgaacgaagagctacgagccaaactgacatctattcagatcgaattccagcaggaaaaatccaaggtcgggaaacttcgggagcgcctgcaggaggcaaaactcgagcgtgagcaagagcaaaggcgtcatactgcctacatctccgagcttaaggctaagcttcatgaggagaagactaaagagctccaggccttgagggaaggacttatcaggcagcacgaacaggaggctgcacgcaccgcgaagataaaagaaggcgagctccaacgcctgcaggccactctcaatgtccttagagacggagctgccgacaaagtgaagacagccctgctgacagaagccagagaagaggccagaagggcattcgatggcgaacggttgcgcctgcagcaggagattctcgagttaaaagctgctcgcaagcaagccgaggaggcactgagcaactgtatgcaggccgacaagactaaggccgctgatcttagagccgcatatcaggctcatcaggatgaggttcacagaattaaacgcgagtgcgaacgcgatataaggaggctgatggacgagattaaagggaaggaccgcgtaatattggctctggagaaagaactaggagtgcaggcaggacagacccaaaaactcttactgcagaaggaagccttggatgaacagctggtgcaggtgaaggaggcagagagacatcacagctctccaaagcgggaactaccgccggggataggggatatggttgaactcatgggggttcaagaccagcacatggacgaacgggacgtgaggcgcttccagttgaagattgccgagctgaacagtgtgattcggaagctggaggacagaaataccctgctggctgatgagagaaacgagttactgaagcggtcaagagaaactgaagttcagttgaagcccctggttgaaaaaaacaagcgaatgaacaaaaagaatgaagatctgctgcagagcattcagaggatggaagaaaaaataaaaaacctgaccagagagaacgtggaaatgcccgacccggcaggcgcccatggtgcggcagcagctggccccgcagagaaccctaggacaggaggccagaccggtgtctctgaggctgcaccagagcgcacaggaggaaaagtgttcgtccctttttttgtgttcctcaccagcattcatagcgttgcgctcatgacatcagtgtcccaggaactgggcctctag

SEQ ID NO: 26887 - DNA, 1710 bp, Artificial Sequence
  Description of Artificial Sequence: Synthetic coding sequence
atgtctaagaaaggcagatccaagggagaaaagcctgaaatggaaactgatgcggtccagatggcaaatgaagagctcagggctaagctcacttctatccagattgaatttcagcaagagaagtccaaagttggaaaactaagagaaagacttcaggaagctaaactggagcgggagcaggagcaaaggcgacacaccgcttatatctcagaattgaaagctaaattgcacgaggaaaaaaccaaggagttacaggccctgcgcgagggcctgatccgccagcacgaacaggaagccgccagaactgccaagatcaaagagggcgaactgcagcggttgcaggctaccttgaatgtgctgcgcgatggagccgcggataaggtcaaaactgccctgctgaccgaggcccgcgaggaagcacgcagagccttcgatggagagcgcctgaggctgcagcaggaaatcctagagcttaaagcagctcgcaagcaggccgaggaagccctgagcaattgtatgcaggcggacaagaccaaggctgctgatctgcgagctgcatatcaggctcaccaggatgaggtacaccggataaagcgggagtgcgagagagacataagaaggcttatggacgaaatcaagggcaaggaccgcgtgatcttggctctggagaaggaattaggtgtccaagccggtcagactcaaaagctgctactgcaaaaagaagcgttggacgaacagctcgtacaagtcaaagaagccgaacgccatcactcaagcccgaagagggagttacccccggggatcggagatatggtggaactcatgggcgtccaggaccaacatatggatgagagagacgtaaggcggtttcagcttaagattgcagagcttaactctgtaatccgcaaactcgaggatcgaaatacacttctagctgacgagagaaacgagctcctgaagcgtagtagggagaccgaggtccagctcaagcccctggtggagaagaacaaacgtatgaacaagaagaacgaggatctcctgcagagtattcagcgtatggaggagaagatcaagaacctgacccgggagaatgtggagatgaaagaaaagttaagcgcacaggcttccctgaagaggcacacctcacttaatgacctgtccctcactcgggacgagcaagaaattgaatttctgcgcctacaggtcctcgaacagcagcatgtgattgatgacctcagcctagagcgcgagagacttcttaggagcaaacggcatagagggaaatcactgaaaccacccaagaaacacgttgttgaaacctttttcggcttcgatgaggagagcgtcgatagcgagaccttaagcgagacaagctataatactgaccggaccgataggacacccgccacacctgaggaagacctggatgacgctactgcacgtgaggaagccgatctgagattctgtcagttaactcgggaggacttgcaggccgccgtggaaaaagtaaggagacagatactcaggcaaagtcgagaattcgacagtcaaattctcagagagcggatggagctgctccagcaggcacaacagaggatccgcgaactggaggataaactggaatttcaaaagcgtcacctgaaggaattagaggagaagttcttgtttctgtttctcttcttctcactggctttcatcctgtggccttag

SEQ ID NO: 26888 - DNA, 1557 bp, Artificial Sequence
  Description of Artificial Sequence: Synthetic coding sequence
atgtctaagaaaggaaggagtaaaggagaaaagcctgagatggagactgacgcagtacagatggctaatgaggcccttcgtgagggactcattagacagcacgaacaggaagcggcaagaactgccaaaataaaagagattttggagctgaaagcggccagaaagcaggccgaggaggcactttccaattgcatgcaggccgacaagacgaaggccgccgacctacgggcggcctatcaagctcaccaggacgaggttcaccgcattaagcgggaatgtgaacgtgacattcggagattgatggacgaaattaagggcaaagaccgcgtcattctggctcttgagaaggagcttggagtccaggcaggtcagacacaaaaactcctgttgcagaaggaggccttggacgagcagctcgtgcaagttaaggaggctgaaaggcaccactcctcccccaagcgcgaactccctccgggcattggggatatggtggaactcatgggcgtgcaggaccagcacatggatgaacgcgatgtacgtcggttccagctcaagattgctgaactcaattcggtgatcaggaagttagaggacaggaataccctcctggcggatgagaggaacgaactgctgaaaaggtcccgtgagacggaagtgcaactgaaacccctggtcgaaaaaaataagagaatgaacaaaaaaaacgaagatcttctccagtccatccagagaatggaagagaagataaagaaccttacgagagagaacgtggaaatgaaggaaaagctcagcgcccaggctagccttaagcgccacacttccctcaatgatctgtctcttacacgggacgagcaggaaattgagtttttgcgattacaggttcttgaacaacaacatgtcattgacgatctgtcgctggagagggagcgcctcctgcgctcgaaaagacacagggggaagagccttaaacccccaaagaagcacgtggtagaaacgttctttggcttcgatgaggagtccgtggactctgagacgttgagcgagaccagctacaacaccgatcgaactgatcggactccggctacccctgaagaggacttagatgatgcaaccgcacgggaggaggccgacctgagattttgtcagcttactagagaataccaggctctgcagcgagcctacgccctacttcaggaacaggtgggtggaacgctggatgccgaaagggaggccaggaccagggagcagctgcaggcggatctcctgcggtgccaggctaagatcgaagatctggagaagctgttggtggagaaagggcaagatagtaaatgggtggaggagaagcagctgctgatccgaacaaaccaggatctgctggagaaaatttatagacttgagatggaggaaaaccagctgaaaaatgaaatgcaggacgcaaaggaccagaatgagctgctagaattcagagtgctcgagctggaagtgcgggacagtatttgctgcaagctctccaacggagccgatatcctctttgagcctaagctcaagtttatgtag

SEQ ID NO: 26889 - DNA, 2433 bp, Artificial Sequence
  Description of Artificial Sequence: Synthetic coding sequence
atgtccaaaaaaggcaggaataaaggagaaaagcccgaagccctgatcgtcgcgctacaagctgccaatgaagaccttcgtacaaagcttactgacattcagatcgagcttcatcaagaaaaatcaaaagtgagcaagctggaaagagaaaaaacccaggaggctaagcgcattcgcgaacttgagcagagaaagcatacagtcctggttaccgaactcaaggccaagctgcatgaggagaaaatgaaagaacttcaagccgttcgcgagaacctgatcaaacaacatgagcaggagatgtcaaggacggttaaagtgcgtgatggcgagatccagagactcaagtcagccttgtgcgccctgagggatggatcatctgacaaggttcggactgcactgactattgaggccagagaggaagcccgcaaattattcgacacagagcggttaaagctcctgcaagagatcgccgacctaaaaacagccaagaaacaggtcgatgaagccctcagcaatatgattcaggcggacaaaattaaggctggtgacctccgatctgagcaccaatctcaccaggaggccatttctaagatcaagtgggagtccgaacgtgatattagacggctgatggacgagatcaaagccaaggatcgaatcatctttagtcttgaaaaggaactggagacccagacaggctacgttcaaaaacttcaacttcagaaggaagccctggacgaacagttgttcctcgtaaaagaagctgaatgcaatatgtcctcgccgaagagggagatcccagggagagctggtgatggcagtgagcattgtagttctcctgaccttcgacgcaaccaaaagcgaattgcggagttaaatgccaccatccgcaagttggaagatcggaacaccctgctgggagacgaacggaacgagctgttgaagagggtccgcgagactgagaaacagtgcaagcctcttcttgagcgtaacaagtgtttagccaagagaaacgacgaactcatggtgagtttgcaaagaatggaagagaagctgaaagctgtcacgaaggagaacagtgaaatgcgtgagaagattacatctcatcctccactaaaaaaactgaaatcactaaacgacctggatcaggctaacgaggagcaggaaaccgaattcttgaaactccaggttatcgaacagcagaatattatcgacgaactgacgcgggacagagagaaattaattagaagacgaaagcacagaaggagttctaagcctattaaacgtccggttctggatccctttattggctacgacgaagatagcatggatagcgaaacctcatccatggcgtcatttcgaactgacaggacaccagccacaccagacgatgacctggacgagagccttgccgccgaggagagcgaactgaggttccgacaactgacaaaggaatatcaggcgctgcaacgggcctacgccctgctgcaggaacagacagggggaataatcgacgccgaacgcgaagctaaggctcaggaacaactgcaggctgaggtgctcagatataaagccaaaatagaagacctggaagcgactttggcgcaaaagggacaggactcccactgggtagaagacaaacagttgttcatcaagcggaaccaggagctcctcgagaagattgagaagcaagaagcagaaaaccatcgacttcaacaggagctgcaggatgcacgcgatcagaacgaactactggaatttcggaatctggagttggaggaaagagaacgtcggtctcctcctttcaatctgcagatccatcccttcagcgatggcgtgtctgccctacagatctattgcatgaaagagggagtgaaggatgtgaacatacccgacctgattaaacagcttgacatccttggagataatggtaatctccgaaacgaagagcaagtagctattattcaggccagtactgtgctgtccctggccgagaagtggattcaacagattgagggtgccgaggccgcgctgcatcagaaaatgatggagctggagagcgacatggaacagttctgtaagattaagggctatctagaggaagagctggactatcgtaaacaagctctggatcaagcttacatgcggattcaggaactggaagccacattgtataacgccttgcagcaggagacggtgattaaattcggggagctgctgtccgagaagcagcaagaagagctcagaacagccgtcgagaagctgcgccgtcagatgctgagaaaatcccgagagtatgattgccagatcctgcaggagcgcatggagctcctgcagcaagcacatcaaagaatccgtgacctggaagacaaaacagacattcagaaacggcagatcaaagacctagaggagaaaagcaatcggaaacatggatag

SEQ ID NO: 26890 - DNA, 2337 bp, Artificial Sequence
  Description of Artificial Sequence: Synthetic coding sequence
atggtgtcaaaactcgaaagggaaaagacacaggaggctaagcgcattcgggaactggaacagagaaagcatacagttctggtgactgaattaaaggccaagctccatgaggaaaaaatgaaagagcttcaggccgttagggagaatctcatcaagcagcacgagcaagagatgtcaagaaccgtcaaagtgagggatggcgagatacagcgtctcaagagcgccttatgcgcactgcgcgacgggtccagcgataaggtgaggactgctctgacaattgaggccagagaagaggcccgcaagctgttcgacactgagcgcttgaaactgttacaggaaattgcggatctcaagacagccaaaaaacaggtagatgaagcactctccaatatgatccaggccgataagatcaaagccggagacttaaggagtgagcaccaaagccaccaggaagctatttctaagatcaaatgggaatcagagagggacattcggaggcttatggatgagataaaggccaaggacagaattatcttcagcttagagaaagagttggagactcagacggggtacgtgcaaaagcttcagctccagaaggaggccctggatgaacagctgtttctcgtaaaagaggctgaatgtaacatgtcttcgcccaaacgagaaatcccgggacgggccggagacgggtcagaacattgttcgagtcctgatctgcgcaggaaccaaaaaaggattgccgaactcaatgcgactattagaaaattggaggatcgaaatacattgctcggagacgaaaggaacgagctgttgaagcgggtgcgagagacagagaagcaatgcaagcctttgctcgaaaggaacaaatgcctggccaagcggaatgacgagctgatggtatcactgcaacggatggaagagaagctgaaagctgtgaccaaagaaaacagcgagatgagggagaagatcacatcacatccgccactaaaaaaactgaaaagcctgaacgatctagatcaggccaacgaagagcaggaaaccgagtttttaaaactgcaggtcattgagcaacagaatattatcgatgagctgacaagggaccgagaaaaactgataaggcgacgaaagcatcggcggtccagcaaaccaattaaacgccctgttctcgacccattcatcggctacgatgaggactctatggacagcgaaacctctagcatggccagcttcaggacggacaggacacctgccactcctgatgatgatctggatgaaagcttagccgcagaagaatccgagctgcggttcaggcagctaacaaaagagtatcaggctctccagcgcgcctatgccctgttacaggaacagaccggtggaatcatagacgccgagagggaggctaaagcacaagaacaactgcaggcggaggtactaaggtacaaagcaaagatagaggacctcgaggcaacactggctcagaagggtcaggactctcactgggtggaagacaaacaactgttcattaagcgtaatcaagaactcctggagaagatcgaaaaacaggaggccgagaatcaccgactccagcaggaacttcaggacgcgagggatcagaatgagctcctggaattccgaaatctggaattagaagagcgcgaacggagatcccctccatttaatctgcagattcatccctttagcgacggagtgtccgccctgcagatctactgcatgaaggagggagtcaaggatgtcaatattcctgacctgattaaacagttggatatcctgggtgacaacgggaatctgcggaatgaagagcaggtggccatcatacaagccagcaccgttctaagcctggctgaaaaatggatccaacaaatcgagggagccgaggccgcgctgcaccagaaaatgatggaactggagtcagatatggaacaattttgtaaaataaagggctatctggaggaggaattggattatagaaagcaggccctggaccaggcctacatgcggattcaggagctcgaggccactctatacaatgccctgcaacaggagacagtgatcaagttcggcgaacttctgtcagagaagcaacaggaggagctgaggaccgcggtcgaaaaactgcggcgtcagatgctccggaagtcaagggagtacgactgtcaaatcttgcaggagcgaatggagctgttacagcaggcacaccaacgtatccgtgatttggaagataaaactgatattcagaagagacaaattaaagatctcgaagagaagttcttgtttctttttcttttcttctccctcgcttttattttgtggccgtag

SEQ ID NO: 26891 - DNA, 2400 bp, Artificial Sequence
  Description of Artificial Sequence: Synthetic coding sequence
atgtccaagaaaggacgaaataagggagagaagcccgaagccctgatcgtcgcactgcaggccgccaatgaagaccttcggactaagctcacagacatacagattgagctccaccaagaaaagtcaaaggtttcgaagctggagcgggagaagacccaggaggccaagagaattcgcgaactcgaacaacgcaagcatacggtgcttgtaacagagctcaaagcaaaattgcatgaagagaaaatgaaagagttgcaggcggtgcgagaaaatttgatcaaacagcatgagcaggagatgagccgaacggtgaaggtgagggatggcgagatccagagactgaagagcgccctgtgtgccctgagagatggatcatccgacaaggtgaggaccgctttaacaatcgaggcgcgtgaagaggcccggaaactgttcgacactgaacgcctgaagctcctgcaggagattgccgacttgaagaccgccaagaaacaggtggacgaggcactgagcaatatgatacaggctgataagattaaggcgggagatctgcggagcgagcaccagtcacaccaggaggcaatttctaaaattaagtgggagtctgaaagagatataaggagattgatggatgaaatcaaagcaaaagatcgtatcatcttcagtctcgagaaggaattagaaacccagaccgggtacgtccagaagttacagcttcagaaagaagctctggatgaacagttgttcctggtgaaagaagccgagtgcaacatgtcgtccccgaagagagagattcctggacgtgcgggggacggatccgaacactgctcatctccagacctccgtcgcaaccaaaagagaatagccgaactcaacgccaccattcgaaaactggaagaccggaacacactgctgggggacgagcgaaacgagctgctcaagcgagtgcgagagacagagaagcaatgtaagccactgctggagaggaacaagtgccttgccaaaagaaacgacgagctcatggtctccctgcagcggatggaagagaagttgaaggccgtgaccaaagagaattccgaaatgagggagaagataacttcccatccacccctcaagaagcttaaaagcctgaacgacttagaccaggctaacgaggagcaggagactgagtttcttaaactccaagtaattgaacaacagaatatcatcgacgagttgacgagggacagggaaaaactcattcgcagaaggaaacaccgcaggagtagtaaaccaataaaacgtcccgttctcgatcctttcatcggctatgatgaggactcaatggacagtgaaaccagctccatggctagcttccggactgaccggactcccgcaaccccagatgacgaccttgatgagagcctggccgcagaagagagtgaactccgattcaggcagctgacaaaagagtatcaagctctacaacgcgcctatgccttgctccaggagcagaccgggggcataattgacgccgaaagagaagcaaaggctcaagaacagttgcaagccgaggtcctgcgctacaaagcaaagatcgaagacctggaggccaccttagcacagaaggggcagatcgaaaagcaggaggctgaaaaccatcgattacagcaagagctgcaggacgcccgcgaccagaatgagttgctcgagttcagaaacctcgagctggaagagagggagcgccgatcccctcccttcaatctccagattcatcctttcagcgacggagtatctgccctacagatctactgcatgaaggaaggggttaaggacgtaaatattcccgaccttataaagcagcttgacatactaggcgacaatggcaatctccgtaatgaggaacaggttgccatcatccaagcctccaccgtcctctcacttgccgagaagtggattcagcagatagaaggagccgaggccgcactgcatcagaaaatgatggagttggaatctgacatggaacagttttgcaaaattaaggggtatctagaagaagaacttgattatcgcaagcaggccctggatcaggcctacatgcggatccaagagctggaggcgacactgtacaacgctttacaacaagagactgtaatcaaatttggagaacttctgtctgaaaagcagcaggaggaactcagaactgctgtggagaagcttaggcgccaaatgctgaggaagtctagggagtatgattgccagattctgcaggaaaggatggagctactgcaacaggcacatcaacgaataagagatctcgaggataaaacggatattcagaagaggcagataaaggatctcgaggagaagttcctgttcctatttctatttttttctctcgcctttatcctctggccctag

SEQ ID NO: 26892 - DNA, 2370 bp, Artificial Sequence
  Description of Artificial Sequence: Synthetic coding sequence
atgagtaagaaaggccggaataagggggaaaaacctgaggctctcattgtagcactgcaagccgccaatgaagacctgcgcaccaaattgaccgacattcagatcgagctacaccaggaaaagtcgaaggtaagtaagctcgaacgagagaagacacaggaggctaaaagaattcgagaactcgaacagcgcaaacacaccgttctggttaccgaactcaaagccaaacttcatgaggaaaaaatgaaggaattgcaggcagtcagagaaaacctcattaaacagcatgaacaggaaatgtcccgcacagtgaaggtgcgcgacggagagattcagagactgaaatccgccctctgcgcattacgggatggatcgtccgacaaggtgcggaccgccttgactatcgaggccagggaggaagctcggaagctcttcgatacggaaaggcttaagttgctgcaagagattgccgacctcaaaacagctaaaaaacaggttgatgaagccctgtctaatatgatccaggccgataagatcaaggctggagatctcagatcagaacatcagagccaccaggaggcaatttccaagataaaatgggagagtgagcgggacattcgccggctaatggacgagatcaaggccaaagatcgcatcatctttagtctggaaaaggaactcgagacccagacaggctacgtgcaaaagctgcagttgcagaaggaggcattggatgagcaactcttcctggtgaaggaggccgaatgcaatatgagttctcctaaacgagaaatcccgggacgcgccggcgacgggtccgaacattgcagcagccccgacctcagacggaaccagaaaagaatcgccgagctgaatgctactatacggaagctcgaggaccgaaacacactactgggcgacgaacggaacgaactgctgaaaagagttcgagaaactgaaaaacaatgcaaaccactgttggagagaaataagtgcctcgccaaaaggaacgacgagctcatggtgtccctgcagcgtatggaagagaagttgaaggccgtgaccaaggagaacagtgaaatgcgagagaagatcacaagccacccccctctaaagaagcttaagtctctgaacgacttggatcaggctaacgaggaacaggaaactgagttcctgaagctgcaggtgattgagcagcagaatatcattgatgaactgacccgcgaccgagagaaacttataagacgaaggaagcatcggagaagcagtaagcccatcaaacgccccgtgctggacccctttatcggttatgatgaagattctatggatagtgaaactagctctatggcttcgtttaggaccgataggacccccgctacacccgacgatgacctcgacgagagtctggccgccgaggaaagtgagttgcgttttaggcagcttaccaaggagtaccaggcactccagcgcgcttacgctctgctgcaggagcagacaggaggaataattgatgcggagcgggaggcaaaagcacaggagcagttacaggccgaggttctcagatacaaagctaagattgaagatttggaagcaacacttgcgcagaagggccagatcgagaagcaggaggcagagaaccacaggctccaacaagagctgcaagacgcgcgtgatcagaatgaattgttagagttcaggaatctggagttggaagaaagggaacgacgttctcctccttttaaccttcagatccatccgtttagcgatggcgtcagcgccttacagatctactgcatgaaggaaggtgtgaaggatgtcaatattcccgatctcatcaagcaactggatatcttgggcgacaatggcaacctccgaaatgaggagcaagtcgccataatccaggctagtacggtgctgtctctggccgaaaagtggatacagcagatcgagggtgccgaagccgctctccatcagaagatgatggagcttgaatccgacatggagcagttttgcaagatcaagggctacttggaggaggagctggactatagaaagcaggctttggatcaagcatacatgagaatacaagaactcgaggctaccctgtataatgcccttcagcaggagacggttatcaagttcggggagctacttagcgagaaacaacaagaagaactgaggactgccgtggaaaagctgcggaggcagatgttgagaaagagccgcgagtatgattgccagattctgcaggaaaggatggagctgctgcaacaggcccatcagcgaatccgtgatctagaggacaaaactgacatccagaagcgccaaattaaagatctggaagagaagtctaaccgcatgcccgcttag

SEQ ID NO: 26893 - DNA, 2535 bp, Artificial Sequence
  Description of Artificial Sequence: Synthetic coding sequence
atgagtaagagggggatgagcagtagagcaaaaggcgacaaagccgaagcactcgccgccctacaagcagcaaatgaggatcttcgtgcaaaacttacagatatccagatcgagttgcagcaggaaaagtcaaaggtttccaaggtggagcgcgagaagaaccaggaacttaggcaggtccgcgaacatgagcagcacaaaactgctgtgcttctgactgaactgaagacaaaactgcatgaagaaaagatgaaggagttgcaggccgtcagagagacgctgctgcgccaacatgaagctgaactgctgcgcgtgattaagattaaagataatgaaaatcagcgcctgcaggcactcctcagcgcactcagagatggcgggccggagaaagttaaaacagtgctgttaagtgaggctaaggaagaagccaagaaaggatttgaagtggagaaggtcaagatgcaacaggagatttccgaactgaaaggtgctaagaggcaggtggaggaagccctgacactcgtcatccaagctgacaagattaaagcagccgagattcgatcggtgtatcacttacatcaggaggagataacaagaattaaaaaagaatgtgagcgtgaaatccgccgcctgatggaggaaatcaagttcaaagatagagcggtcttcgtgttagagagagagctcggggtccaggcaggacatgcgcagcggctgcagctgcaaaaagaggcactggacgagcagttgtcacaagtcagagaggccgatcggcacccggggtcaccacgccgtgagctgccacatgcggccggagctggggacgcaagcgaccacagcggcagcccagaacaacagctcgatgaaaaggacgcccggaggttccaactcaagatcgctgagctatccgcgatcatccgcaagctggaagaccgaaatgcactgctttctgaagaacgcaatgaacttctgaaacgcgtgcgggaagctgagtcccagtataaaccgctgctggataaaaataaaaggctttctaggaagaacgaggacttgtcacatgcactgaggcggatggagaacaaactaaagtttgtgacccaggagaatattgaaatgcgtcagcgcgctgggataatcaggcggccttcctcattaaacgatctcgatcagtctcaggacgagcgtgaagtggacttcctcaagctccagattgtggagcagcagaatttaattgacgagctctctaaaactctagagactgcaggatatgtcaagtccgtcctcgaaagggataagctcctgcggttcaggaaacaacgaaagaaaatggctaaattacccaagccagtggtggtggaaacattctttgggtacgatgaggaagcctcactggagagtgatgggtccagtgtttcataccagacagaccgcaccgaccagacaccatgcacaccagacgacgacctagaggagggtatggcaaaggaggagactgaactacggtttcggcagctgactatggagtaccaggccctccaacgcgcatatgcattgctccaggagcaagtaggaggcactttagacgctgagagggaagtcaagacgcgtgaacaactgcaagccgaggtgcagcgagcccaggctaggatcgaagatctggagaaggccctagcggagcagggccaggacatgaaatggatcgaggagaagcaggctctttacaggaggaaccaggaactggtagagaaaattaagcagatggaaacagaggaggccaggttgaggcacgaggttcaggacgcgcgggaccagaatgagctcctggaatttagaatactcgaactcgaggaacgggagcgaaaatcccccgctatctcatttcaccacacaccttttgtggacggcaagtcaccgctccaggtgtattgcgaggcggaaggcgtcacagacattgtggttgccgagttaatgaaaaaattagacattctgggcgacaacgcaaacctgaccaacgaggagcaggtagtggtgattcaggcacgcacggtgttgaccttggccgagaaatggctccagcaaattgaggagacggaagccgccctgcagagaaagatggtggatctggagtccgagaaggagctatttagtaaacagaagggctacctcgacgaggaactggactatcgtaagcaggcgctggatcaggccaacaagcacatactggagctggaagctatgctttacgatgctctgcagcaggaagccggcgccaaggtggccgaactgctcagcgaggaggagagagaaaaactgaaggtagccgtcgaacagtggaagcgacaagttatgtcggagctgagagaaagagatgcccagatccttcgtgaaagaatggaactccttcagctcgcccagcagcggattaaagagctggaagagagaatcgaggctcagaagaggcaaatcaaggagctggaagaaaagttcctgttcctgttcctgtttttctccttggcttttatactctggagctag

SEQ ID NO: 26894 - DNA, 996 bp, Artificial Sequence
  Description of Artificial Sequence: Synthetic coding sequence
atgagtatgacaactagagcctgggaagagttggacggagggctgggctcttgtcaggccctcgaggatcacagcgccttggccgaaacacaggaggatcgagcctcagccactcctaggctggccgattccggttcggttccccacgactctcaggtggcggaagggccttcagtggatacacggcccaagaaaatggaaaaggaaccagcagcacggggaacacccgggaccggtaaggagaggctgaaggccggcgctagtccaaggtccgttccggccaggaaaaaagctcagaccgcgcctcctctacagcccccaccccccccccccgcactctctgaggagctcccatggggagacctcagcctgaacaagtgcctggtgctcgctagtctcgtggccctgcttggcagcgcatttcagctttgcagagatgctgtgcctggcgaagctgctctgcaggctcgggttccagagccttgggtgcctccttcctcagccccacgcgaaccgtcgagtcccctgcccaagtttgaggcccaagcccctcccagcgccccacccgcacccagggccgaagcagaagtgcggccaaagatcccaggaagccgggaggccgccgaaaatgatgaggaagagcctggggaagctacaggcgaggcggtccgggaagacagggtcaccctggcggatagaggcccaaaggagcggccacggcgcgagggaaagccacgcaaggagaagcctaggaaagaagaacgccccaaaaaagagcggcccaggaaggaggagcgacctagggccgcaagagaaccaagggaagcccttcctcaaaggtgggagagcagggagggcgggcataggccgtgggcgcgggactcaagagatgccgaacctcgtaagaagcaggcctgggtgagtcctcggcgccctgatgaggaacagagacccggttccagacagaagctgcgcgctgggaaggggagggactag

SEQ ID NO: 26895 - DNA, 1887 bp, Artificial Sequence
  Description of Artificial Sequence: Synthetic coding sequence
atgtccccaggggggaaattcgactttgatgacggaggctgttacgtgggggggtgggaagccgggcgagcacatgggtatggcgtatgtactggccccggcgctcagggcgaatactctggctgctgggctcacggctttgaatctttgggggtctttactggtcccggtgggcactcctaccagggccattggcaacaggggaagcgggaggggcttggcgtagaacggaagagccggtggacttatcgaggagaatggctcggtggcctgaaagggcggagcggtgtttgggaatccgtctcgggactgaggtatgctggactctggaaagacgggttccaggatgggtacggcaccgaaacatatagcgacggaggtacctaccagggacaatggcaggctggcaagaggcacggatacggcgtgaggcagtccgttccataccatcaggcagcgcttctcaggtctccaaggcgtacaagtcttgactccggccatagtgatccgccaacgccgcctcccccactgccgcttcccggggacgaaggcggaagtcccgcctctggcagcagggggggtttcgtcttggcaggaccgggagatgccgatggtgctagtagtagaaaacgaacccctgccgccggtggcttttttcgacgcagtcttttgctgtccggcttaagagctggtggacgaagatccagcctcgggtccaaaagggggagtctgaggtcggaggtcagctctgaagtggggtccaccgggcctcccggcagcgaggccagcggcccgcccgccgcagctccccctgccctgatcgaggggtccgcaaccgaggtttatgccggcgagtggcgcgcggacagacggtcagggttcggcgtgagccagcgcagtaatggactgagatatgagggtgagtggctaggtaatcggaggcacggatacggccgcactacacggcccgatggtagccgagaagaaggaaagtataaacgcaatagacttgtgcatggtgggagggtgcggtccctgctgcccttagcactgcgacgtggaaaggtgaaggagaaggttgatcgcgcagtcgagggagcgagacgagctgtctcagccgcacgacagcgtcaggaaattgctgcggcccgcgccgctgatgccctgctaaaggccgtagccgcttcgtctgtggctgagaaagccgttgaagccgcgaggatggcaaagcttatcgcccaagatctgcagccaatgcttgaggcccccggacgcagaccccgtcaagactcagagggatcagacaccgagcccctcgacgaagactcccctggcgtttatgaaaatgggctgaccccttccgaggggagccctgagcttccgagctctccagcttcctccagacagccttggcggccaccagcctgccgcagccctctgccgcctggaggagatcaggggccatttagcagtccaaaggcttggcccgaagaatggggcggggccggcgcccaggctgaagaactggctggatatgaggccgaggatgaagctggaatgcaaggccctggcccaagggacggctctcccttgcttggaggctgttcagactcatccgggtctctccgggaagaggaaggtgaagacgaggaaccactaccacccctcagagcaccggcaggcacagagccagaacccatcgctatgcttgtcttgcgggggtccagctccaggggccctgacgctggatgcctcaccgaggagctgggtgaacccgcagcgaccgaaaggccagcccagcctggcgcagccaacccattagtggtgggcgcagttgccctgctcgacctgagcctggcctttctgttctcacaactgctgacatag

SEQ ID NO: 26896 - DNA, 1887 bp, Artificial Sequence
  Description of Artificial Sequence: Synthetic coding sequence
atgagccctggtgggaagttcgacttcgatgacggaggttgttacgtgggtgggtgggaagcaggcagagcccatgggtacggggtctgcactggcccaggtgcacaaggtgaatactctggctgctgggcccacgggttcgaatcacttggagttttcacgggacctggcggtcactcttaccaggggcactggcagcaaggcaaaagagaaggactgggcgtcgagcgaaaatcgcgatggacttaccgcggggagtggctcggcggactgaaagggagatccggggtttgggagtccgtgtcagggctccgctatgcgggcctctggaaagatggatttcaagacggctatggcactgaaacctactccgacggaggtacctaccagggccagtggcaagcaggtaagcggcatggttatggggtgcggcaatctgtgccgtaccatcaagcggcccttttgaggagtccccgtcgaactagtctcgacagcggccatagcgatcccccaacaccacctccgccactgcccttaccaggggacgagggcggatccccagccagcgggagtagagggggcttcgtgctcgctggacccggcgatgccgatggggcttcctctcggaaacgaactcctgcggcaggtgggttttttagaagatccctgttgcttagcgggctgcgggcgggagggaggaggtcaagcttgggaagtaagagaggatcactgagatctgaggttagttccgaagtcggatccacaggcccccctggctccgaggcctctggtccccctgccgccgctccacccgcattgattgaaggctctgctacagaggtgtacgcgggcgagtggagggcagacagaaggtccgggttcggcgtgtctcagcgctccaatggactgcggtacgaaggcgagtggttagggaatcggcgccacggctacggcaggactacacgcccggacgggagccgagaggaaggcaaatataaacgaaatcgtttggtgcatggggggcgcgtcagatccctgctgcccctggctctccggcgaggcaaagtaaaagaaaaggtcgaccgcgctgtcgagggtgcgcggcgtgcagttagtgcggcccggcagaggcaggaaatcgccgcagcgcgcgcagccgatgccttgctgaaagcagtggctgcgagctccgtcgcagaaaaagccgtggaggctgctcggatggcaaagctgatcgcacaggatcttcaaccaatgctagaagctcccggcagacggccacggcaggattcagaggggtctgatacggagcccctggacgaggactcccctggggtgtatgaaaacggactcaccccgagcgaaggtagccctgaactgcctagcagccctgccagctccagacagccatggagaccccctgcctgccgatcgccactgcccccagggggcgatcaaggtccatttagctcgcccaaggcctggccagaagagtgggggggtgccggtgctcaagctgaggaactcgcagggtatgaagccgaagacgaggctggcatgcaggggcccggcccgcgggacgggagccctctgttgggaggatgctcagatagttcaggctccctgcgtgaagaggaaggtgaggacgaggaaccacttccacccttgcgagctccagcaggcactgagccggagcctatcgctatgctggtgttgaggggtagtagttctcggggacccgacgcaggatgcctgaccgaagagctgggcgaaccggctgccacggaacgtcccgctcagccgggagccgccaatccactcgtggtgggtgcagtggctctcttagacctgtctcttgccttcctttttagccagcttctgacatag

SEQ ID NO: 26897 - DNA, 1887 bp, Artificial Sequence
  Description of Artificial Sequence: Synthetic coding sequence
atgtcacctgggggcaaatttgacttcgacgacggtggctgctacgtgggaggctgggaggccggccgcgcgcacggatatggcgtgtgtactggccccggcgcgcagggcgaatattctggctgttgggcccatggatttgagagtctgggcgtcttcactgggccaggcggccatagctaccagggccactggcagcagggcaagcgtgaaggtttgggcgtggaaagaaagtccaggtggacataccggggggaatggctcgggggccttaaaggaaggagtggtgtttgggagtccgtgagtgggctgagatacgcaggtctctggaaggacgggtttcaggatggctatggtacagaaacatattctgatggtggaacttaccagggtcagtggcaagccggaaagaggcacggatatggggttcgtcagagcgtgccctaccaccaggctgctttgctccggtcccctagaagaaccagcttagacagtgggcactctgacccaccaacacccccacccccactgcccctgcctggagatgaaggaggaagtccggcttccggttctaggggaggatttgttttagcaggtcccggggatgctgatggcgcctccagccggaagcgcactcccgcggctggtggctttttcaggcggagcctgctcctttctggcctacgtgctggcggccgcaggagcagtctcggttccaaaagaggatccctccgctccgaggtcagcagcgaggtgggttctacagggccacctggatcagaagccagtggaccgccagccgcggcccctcccgcgcttatcgagggcagcgctaccgaagtgtatgcaggcgagtggcgcgcagaccgaaggagcggctttggtgtctcccagcggagcaacgggctccggtatgaaggagagtggctggggaacaggagacatggatatggacgaacaacaaggcctgatggatctagagaagagggcaaatacaagcgcaaccgcctcgtccatgggggccgcgtccgctccttgctgcccttggcattacggaggggcaaggtgaaagagaaagtagacagggccgtagaaggagcgaggagggctgtgagcgccgcaagacagagacaagagattgctgccgctagggctgcggacgcgctgcttaaagccgtcgccgccagctctgtagctgaaaaggccgtcgaggccgccaggatggcaaagcttattgctcaggatctgcaaccaatgctcgaggcccccggtcggagacccaggcaggactccgagggctccgacacggagcctcttgatgaagatagtcccggagtgtacgagaacggattgacgccctccgagggtagccctgaactaccttctagcccagcctccagtagacagccttggcgacctcccgcttgtaggagtccactcccgcccggaggagatcagggcccgttcagtagcccaaaagcttggccagaggagtggggaggagccggtgcccaggcggaagagctggctggctatgaggccgaggatgaagccggaatgcagggtccaggtccaagagacggttcccccctcctcggcggctgttcagacagtagcggttccctgagggaggaggagggagaagatgaggagccactgccaccactccgtgcacccgccggtaccgaacctgaacctatcgcaatgctggtcctcaggggctcctcttcaagaggccctgatgccggttgtctcacggaggaactcggagagcccgctgctactgagaggcctgctcagcctggtgccgcaaaccccctggttgtgggcgccgttgctctactggacttgtcactggcttttctgttttcacaactcctgacgtag

SEQ ID NO: 26898 - DNA, 1524 bp, Artificial Sequence
  Description of Artificial Sequence: Synthetic coding sequence
atgcggaggctgccccgagcactacttttgcagttacggctcgctttgctggttgccgcaggagcgcctgaggttttagtctcagcacccaggagcctggtgtgggggcctggcctccaggccgccgtggtgttaccagtcaggtacttttacctgcaagcagtgaacagcgaagggcaaaatctcacccgatcgcccgccggggagacaccctttaaagtcgtcgtcaagagcctgtctcctaaagagctggtgcggatacacgtgccgaaacccctggatcggaatgacggaactttcttgatgcggtatcgcatgtatgagacagtcgatgaaggactgaagatcgaagtgctgtatggggatgaacacgtggcacagagcccttacattctgaagggcccagtttaccacgagtattgcgagtgcccggaagacccccaggcatggcagaaaaccttgagctgccccaccaaggagccacaaatcgccaaggactttgcctcttttccttcaatcaacctgcagcagatgttaaaggaagtacctaaaagattcggcgatgaacgtggcgctattgttcactataccatcctgaacaatcacgtttaccgcagatccttaggaaagtatactgattttaagatgttttccgacgaaattctgttatccttgacacggaaggttctgctccctgatttggagttctacgttaatctgggtgactggcccttggagcatcgtaaggtgaatgggacacccagcccgatcccaattatcagctggtgcggatccctggactcacgagatgtggtcctgccaacctatgacatcacccattcaatgctggaagctatgcgaggcgtgacaaacgatctgctcagcatccaaggcaataccggcccctcgtggataaataagacagagcgggctttcttcagagggcgcgatagtcgtgaagagcgactacagctggtgcagctgtcgaaggagaaccctcagctattggatgctgggatcacaggatacttcttcttccaagagaaggaaaaggagctgggcaaagcaaagcttatgggctttttcgacttctttaaatacaaatatcaggtgaatgtcgacgggaccgtcgcagcttaccgctatccttaccttatgctaggcgacagcctggtgcttaaacaggattctccatattacgagcacttctacatggcactggagccatggaagcattacgtgccaatcaaaaggaatctctctgacctgttggaaaaggtgaaatgggccaaggagaacgatgaggaagccaaaaaaatcgccaaagagggtcagctgatggcacgggacttgttacagcctcacaggctgtattgctactactaccaggttctacagaagtatgcagagcgccagtcaagcaagcccgaagttcgcgacggaatggagctggtcccacagcctgaggactccacagctatctgtcagtgccaccggaagaaaccttcaagggaagagttgtag

SEQ ID NO: 26899 - DNA, 1230 bp, Artificial Sequence
  Description of Artificial Sequence: Synthetic coding sequence
atggtagaactgtttatcttcctgttcttactcggcgaaacccctttcaaggtggtcgtcaaaagcctgtcacctaaagaactcgttaggattcacgtgcccaagcccttagacaggaatgacggcacatttctgatgcggtaccgcatgtacgaaactgtcgatgagggcctgaagatagaagtcttatacggcgatgagcacgtggcacagtcaccttacattctgaaagggcctgtgtaccacgaatattgtgaatgcccagaggacccacaggcatggcagaaaacactcagttgcccaacaaaagagccccagattgccaaggattttgcctctttcccatccattaaccttcaacagatgctcaaagaggtgcccaagcggttcggcgatgagaggggggccatagtccactataccatcctgaacaatcacgtgtaccgccgctcactgggtaaatatacagatttcaagatgttttccgatgaaatactgctgagcctgaccaggaaggtgttactgcctgacttagagttctatgtgaaccttggggattggcctcttgagcaccgcaaggtgaatgggactccatctccgatacctattataagctggtgcggctcgctagacagtagggatgtggtcctgcccacgtacgacattactcatagcatgctagaagccatgcggggggtgaccaacgacctgctgtcaattcagggcaacacagggcccagctggatcaacaaaaccgagcgggcgttttttagaggtagggattctagagaggaaaggctccagctggtgcagctgagtaaggagaaccctcaattgctagacgcaggtataacaggatattttttcttccaagagaaggaaaaggagcttggaaaagccaaactcatgggcttttttgatttctttaaatacaagtaccaggtgaatgttgacgggacggtggccgcataccggtacccctacctgatgttaggagacagcctcgtgctgaagcaggattcaccttattacgagcacttctacatggcattggagccttggaagcattatgtgcctattaagaggaacctgtcggatcttctggaaaaagtgaaatgggccaaaagtttcacactgtcccctagactggagtgctccggcactatatccacccactgtaacctttgcttaccgggtagccggaactttgtgccccaacctcccgagtag

SEQ ID NO: 26900 - DNA, 1356 bp, Artificial Sequence
  Description of Artificial Sequence: Synthetic coding sequence
atggtggagctctttatcttcctgttcctcctcggtgagacacctttcaaagtggtggtgaaaagtctctctccaaaagagcttgtgcggattcacgtgcctaaacccctcgatcgcaacgatggcaccttccttatgagataccgcatgtacgaaactgtggatgaaggtctgaaaatagaggttctttacggagatgagcacgtggcacagagcccgtacatcttgaaaggaccagtgtaccacgagtactgtgaatgtcctgaagatccccaggcatggcagaagactctgtcatgtccaaccaaagaacctcaaattgctaaagacttcgccagcttccccagcataaacctgcaacagatgctcaaggaggtgccaaaaagatttggagatgagcgtggcgccatcgtgcactatactatcctcaacaaccacgtgtataggagaagtctcggcaaatatactgattttaaaatgttctcagatgagatactgctaagcctcacccgcaaagttctgctgcccgacctcgagttttatgtgaacctgggggattggcccctagaacacagaaaagttaatggaacgccaagtccaattccgatcatatcctggtgtggctcgctcgacagccgagacgtcgtgctcccgacatacgacattacccactcgatgctcgaagctatgcgcggcgtgacaaatgatttgttatcaatccaaggcaataccggtcctagctggataaataagactgaacgtgccttcttccgaggaagagattccagggaggagcgactccagctggtgcagctgtcgaaagaaaatccacagctactggacgcaggtataaccgggtacttcttctttcaggagaaggaaaaggaacttgggaaggccaagctgatgggttttttcgatttctttaagtacaagtatcaggtgaatgttgatggaactgtcgccgcttaccgctacccatatctcatgctcggcgatagtctagtgctgaagcaggattcaccctactacgagcatttctacatggccctggagccttggaagcactacgtgcctatcaaaagaaacctgagcgacctgctggagaaggtgaagtgggccaaggaaaacgacgaggaagccaaaaaaattgccaaagaggggcagctcatggctagggatctgctgcagccccatcgactatactgctactactatcaggtcctccagaaatacgctgagcgccagtcaagtaagcccgaggttcgcgacggtatggagctggttcctcagcctgaggattcgaccgccatatgccagtgccatcgtaagaaaccaagtcgcgaggagctctag

SEQ ID NO: 26901 - DNA, 639 bp, Artificial Sequence
  Description of Artificial Sequence: Synthetic coding sequence
atgaacttatttagatttctgggggatttgagccacctcttagccatcatactgctccttttgaaaatttggaagagtcggtcttgcgctgggatctcaggaaagtcacaggtcctgtttgctgtggtctttaccgctcgatacctggacctctttaccaactacatcagcttgtataacacatgcatgaaagtggtctacatagcttgctcctttacgactgtttggctgatatactcaaaattcaaagcaacatacgatggtaaccatgacacctttcgtgtggaatttttggtggtgccaactgcaatactggccttccttgttaaccacgactttacaccgctagaaattctgtggacattttcaatctacctggaatccgtggcaatattgccccaactgtttatggtcagcaagaccggggaggctgagactataacttctcactacttgtttgcccttggagtgtaccggaccctttatctgttcaactggatttggcgctaccacttcgagggatttttcgacctcattgcgatagtggccggcttggtgcagaccgttctgtactgtgatttcttctacctctacataacaaaagtgctgaaaggcaaaaagctctccctgcccgcctag

SEQ ID NO: 26902 - DNA, 639 bp, Artificial Sequence
  Description of Artificial Sequence: Synthetic coding sequence
atgaatatctttcggttgacaggggacttatcacatctggccgccattgtaatcttgttgctgaaaatatggaaaactaggtcctgcgctggcatctccgggaagtcccagctgctgttcgccctagtattcactactcggtatctggatctgttcacctcttttatatccctgtataatacttccatgaaggttatctacctggcctgctcatatgccaccgtgtatttaatctacctgaaatttaaagctacctatgacggtaatcacgatacattccgtgtcgagtttcttgtggtccctgtgggaggcctgagcttcttagtgaaccacgatttctctccacttgagattctctggacattctccatctatctcgagagtgtggcgatattgccccagctgttcatgattagcaaaaccggggaagctgaaactatcacaacacactacttgttcttccttgggctgtaccgggccctgtacctcgtaaactggatctggcgcttttacttcgaagggttcttcgatctcatcgccgtcgtagctggcgttgtccagactatcctttattgcgacttcttttacctgtacatcacaaaagttcttaaaggcaaaaaattgagcctgcccgcttag

SEQ ID NO: 26903 - DNA, 561 bp, Artificial Sequence
  Description of Artificial Sequence: Synthetic coding sequence
atgaatatcttccgcctcaccggagatctgtctcaccttgcggccatagtcatacttttgttaaaaatttggaagacacgttcctgtgccggcatctccgggaaatctcagcttctgtttgccctcgtgttcacaaccagatatttggacctgttcacaagctttatcagtctgtacaacaccagcatgaaggtcatatacctggcttgctcatatgccactgtgtacctgatctacttgaagttcaaggcgacctatgacgggaaccacgacacattccgcgtggagttcctggtcgtgccagtagggggcctgtctttcttagtaaaccacgacttttcccctctcgagtatagccgagaaagatcatcagtgtgtcagcataaatgccaaaggccgtctcctgcatccgtcctccagggagctcggactgaatttctacctcagcagcgccacaagatgctcgacaccgagaaccagaaacttaacagttttgtagcagattctcaccaatggttgtgcaagaacgctgaggaaaagtcccaaaaagtcagtgtgtag

SEQ ID NO: 26904 - DNA, 543 bp, Artificial Sequence
  Description of Artificial Sequence: Synthetic coding sequence
atgtcagtcctgcgccctcttgacaaactgcctgggcttaacaccgcaaccatcctgcttgtggggacagaagacgccctactccagcagctggcagacagtatgctcaaggaggattgcgccagtgagctaaaagtacacctggccaagtccttgccactaccctcctccgtcaaccgcccaaggatagatctaatagttttcgtcgtcaacctgcactccaagtattccctgcagaatacagaagaatctctgcggcatgtcgatgccagtttctttctgggaaaagtctgcttcctcgccacgggcgctgggcgggagagtcactgtagcattcaccggcacaccgtggtgaaactggctcacacatatcagtctccattgctgtattgcgacctggaggtcgaaggattccgcgccaccatggcccagagactcgtccgcgtgctccagatttgtgcggggcacgtgcccggtgtgtcagctctgaacctgctatcactgctgcgaagcagtgaagggccttccttggaggacttgtag

SEQ ID NO: 26905 - DNA, 663 bp, Artificial Sequence
  Description of Artificial Sequence: Synthetic coding sequence
atgaacgtgttccggatccttggcgacctgtcccatttgctggccatgatccttctactgggcaagatctggaggtcaaagtgctgcaagggtatttccggcaaatcccagatcctctttgcattagtttttactaccagatacttggacctgttcaccaacttcattagtatttacaacacagtaatgaaggttgtcttcctgttgtgtgcgtacgtgacggtgtacatgatttatggcaagttcaggaaaacctttgactcagagaatgacacgtttcggcttgagttccttttggtccccgtgatcggactgagcttcctcgagaactactctttcaccctgctcgagattctgtggaccttctccatctaccttgagagcgtcgcaatcctgccccagctctttatgataagcaagaccggtgaggcagaaacaatcacaacccactatctgttcttcctcggattgtaccgcgccctgtaccttgccaattggattaggaggtatcaaacagagaatttttacgatcagattgcagtggtctcaggcgtcgtgcagactatcttctattgcgatttcttctacctgtatgtgactaaggggagatcttgggatgactctaatgctgacactgggcttcgctcctatagtagtatctag

SEQ ID NO: 26906 - DNA, 2334 bp, Artificial Sequence
  Description of Artificial Sequence: Synthetic coding sequence
atgtttccgcgcggcgccgaggcccaggactggcacctggatatgcagttgaccgggaaagttgtattgtccgcggccgctcttctcttagtgactgttgcctaccggctgtacaaaagccgacccgccccagcccaacgatggggtgggaacggccaggctgaggccaaggaggaggcagagggctcgggccagccagctgtgcaggaggcaagccccggagtgttactgcgcggccccagaagacgcagaagctcaaaacgcgccgaagcccctcaaggatgttcctgtgagaaccctcgcggcccatacgtccttgtgacaggcgccacatccactgacaggaagcctcagagaaaaggatccggagaggagcgcggcggacagggcagcgactctgagcaggtgcctccctgctgtccaagccaggagacccgaactgctgtgggtagcaatcctgaccccccccactttccccgcctggggtctgaacctaaatcgagcccagctggcctgattgccgcagccgacggctcctgcgctggcggagaaccttcgccctggcaggactccaagccaagagaacaccctggactggggcaactcgaacctcctcactgccattatgtcgccccgttgcagggcagcagtgacatgaaccaaagttgggtctttacacgggtgattggagttagtagagaggaggctggcgcactagaggctgcttccgacgttgacctgaccctgcatcagcaggagggggctcccaactcctcctacacctttagctccattgcacgggttagaatggaagagcacttcattcagaaagcagaaggagttgaacctaggctgaaggggaaagtctatgactactacgtggagtcaacctcacaggcgatctttcaggggaggctggccccacgaacagcagctctaactgaagtcccctctccacgccctccacccggttccttgggcacgggggccgcctccggcggccaggctggggacacgaaaggtgcagcagaacgggccgcgtccccccagacggggccttggcccagtacaaggggattcagtcgaaaagagtcgctgctgcagatcgcagagaacccggagctgcagctgcaacctgatgggtttagactcccagcccctccctgcccagaccctggggccctgcccggcctcgggcggtcttcacgcgaaccacatgtgcagccagtggccggcaccaactttttccacatcccattgactcctgccagcgcccctcaggttagactggaccttggaaactgttatgaagtgctcacattggctaaacggcagaacctagaggcccttaaggaagcagcctataaggtaatgtctgagaactatctgcaggttttacgatcacccgatatctacggctgcctgtccggggccgagagggagctgattctccaacggcggctgaggggacgccagtatttggttgtggccgacgtatgtcccaaagaggatagcggaggactgtgctgttatgacgatgagcaggacgtgtggaggcccctcgcgcggatgccaccggaggccgtctcaagggggtgcgcgatttgttctctctttaactatctgttcgtggtgtctggctgccaggggcccggacaccaaccctcaagcagggtcttctgctacaatccattaaccggtatctggagcgaagtttgcccgcttaatcaggcccgacctcactgccgccttgtggccctggacggacacctgtacgccattggcggggaatgccttaactccgtggagaggtacgacccccggcttgatcgttgggatttcgctcccccactcccaagtgatacattcgccctggcccacacggcgaccgtgagggctaaggaaatattcgtcaccggcggttctctgcgttttctactatttcgcttttccgcacaggagcagaggtggtgggcaggacccaccgggggaagcaaggatcgcacagcggaaatggtcgccgtgaatgggtttctctatcgcttcgacctgaacaggtcacttggcatcgccgtctaccgttgctccgcatccaccaggttgtggtacgagtgtgcaacataccgcacaccgtatcccgacgccttccaatgtgcagtggttgacaatctaatttattgtgtgggccgaagatccacattatgttttctggcagatagtgtttccccccgcttcgtaccaaaggagttgcgttcttttcccgccccacagggtaccctcctgcctaccgtgcttaccctgccaaccccagacctcccgcagacaagggtatag

SEQ ID NO: 26907 - DNA, 2088 bp, Artificial Sequence
  Description of Artificial Sequence: Synthetic coding sequence
ggtcagcctgctgtgcaagaggcctcccctggtgttcttttgcgggggcctcgacgtcgcagaagttccaaacgcgcagaggctcctcaaggctgttcttgtgagaacccacgggggccttacgtgctggtaacaggggccacaagtactgataggaaaccacaaaggaaaggcagcggcgaagagcgcggtggtcaaggaagcgacagcgaacaggtacctccctgctgcccgtctcaggagacaagaaccgccgtcggctccaatcctgatccaccacacttcccgagactgggcagtgagcctaagagctcacctgcagggcttatcgctgctgctgatgggtcttgcgctggaggcgagccaagtccttggcaggactcaaagccacgcgagcaccccgggctggggcagctggagccaccacattgccactacgtggcacccttacaaggatcctccgatatgaaccagtcatgggtatttacacgggtgattggcgtctcaagagaagaggcaggcgccctggaggcggcctcagatgtggatctcacactgcatcaacaggaaggggccccaaacagcagctacaccttttccagtatagcaagggtccgcatggaggagcactttattcaaaaggccgagggtgtcgagccacggctcaaggggaaagtttacgattactatgtggagagtacgtctcaggccatttttcagggccggctcgcccctcgcaccgctgcgctgacggaggtgccaagcccccgccccccacctgggagcctaggcacgggtgctgcctcagggggccaggccggcgacactaaaggggctgctgaacgtgcggcatctcctcagacgggtccttggccatccacacggggctttagtcgtaaggaatcattattgcaaatcgccgagaaccccgagcttcagttacagcccgacggcttccggttgcctgcgccaccctgccccgatcctggcgctctgcctggattaggtagatccagtagagagccacacgtgcagccagtcgccggaactaacttcttccatatccccctcaccccagctagtgcgccccaggtgcgactggacctgggaaattgctatgaggtcctcacgctcgccaagagacaaaatttggaagccttgaaggaagctgcctataaggtgatgagcgagaattatctacaggttttacgttctcctgatatctacgggtgtctgagcggagccgaaagggagcttattctgcaaagaaggttaaggggccgtcagtacctcgtagtcgcggatgtgtgtcccaaagaagattccggcggtctctgctgctacgatgatgagcaagacgtttggcgccccctcgctagaatgcctccagaagcagtctcgaggggttgtgccatttgctccctttttaattatttgtttgtagtaagcggctgccaaggtccggggcaccagccctccagccgcgtgttttgttataacccattaacgggtatttggtccgaagtatgcccgctgaatcaggcccgcccacactgccgcttggtcgccctggatggtcacctgtacgctattggcggagagtgtctgaactccgtcgagagatacgatcccaggcttgacagatgggattttgcgcctcctctgccgtcagatacatttgccctggcacacacagctaccgtcagggccaaggaaatctttgttacgggtggctctctgaggtttctcctgttccgattctctgcacaggagcagagatggtgggcggggcccactgggggctctaaagaccgcacggcagagatggtagctgtgaacgggtttctctacaggttcgatctcaaccgctcactgggcatcgcggtttatcggtgcagcgcaagtacccggctgtggtatgaatgtgctacataccggaccccctaccccgacgcatttcagtgtgctgtcgttgacaatctgatctattgtgtcggaaggagaagcaccctctgttttctggctgacagtgtctcgccaagggaggcggcaatcgtaccttcgtatctactggtggaggtctgctag

SEQ ID NO: 26908 - DNA, 1929 bp, Artificial Sequence
  Description of Artificial Sequence: Synthetic coding sequence
atgcaacctcgaagtgagagacctgctggacgcacacaaagtccggagcacggatcccccgggcccggacccgaagcacctcctccaccacctcctcagccacctgcccccgaggcagagcgtacaagaccgaggcaggcccgcccggcggccccaatggagggcgcagtgcagttgctttcgagagagggccactccgtggcgcacaattcaaagcggcattaccatgatgctttcgtagccatgtctagaatgcgccagaggggcctgctatgtgatatagtgttacacgttgccgccaaggagatcagagcacacaaggtggtgcttgcaagctgctcaccatatttccatgcaatgtttactaacgagatgtcagagtccaggcaaacgcatgtaacactccatgacatagatccccaggctctagatcagttggtgcaattcgcctatactgccgaaatagttgtgggcgagggaaatgtccaaacgctgctccctgcggcttccttgctgcaactgaacggcgtgagggacgcgtgctgcaaatttctgctatcccagctcgacccttccaattgcctgggcatccgggggttcgcagacgcgcactcctgctccgatctactcaaagccgcgcaccggtacgtgcttcaacatttcgtggacgtggctaagactgaagagtttatgctgcttcctctgaagcaggtgcttgaacttgtatcaagcgatagtctcaacgtaccctctgaggaggaggtctaccgagccgtgctatcatgggtgaagcatgacgtcgacgcccgccggcagcacgtgcccaggttgatgaaatgcgtgcgtctcccacttctgtccagagactttctgctggggcatgtggacgccgagtccttggtccgccatcatccggactgcaaggatctcctgattgaggctttaaagtttcacttattgcctgagcagaggggcgtgctcggtactagcagaactcggcccagaaggtgcgagggcgccggccccgtcctctttgcagtggggggtggttcactgttcgcaattcacggggattgtgaggcatacgacactcgcacagatcgctggcatgtggtcgcctctatgagcactaggagggcccgtgtgggcgttgcagctgtgggcaaccgtctttatgccgttgggggatatgatggcacatccgatctcgccacagttgagagctatgatcctgttactaatacctggcagcctgaagtgagcatgggcaccagacggtcttgcctgggcgtcgctgcccttcatgggctgctgtactcagccggcggctacgatggcgcgtcgtgcctcaatagcgccgagaggtacgatcctctgaccgggacgtggacctccgttgccgcaatgtccacaagaagacggtacgtgagagtggcaactttggatggtaacctctacgcggtgggtggctatgacagcagttcccatctggccaccgtagagaaatacgaaccgcaagtaaacgtttggagccccgtcgccagcatgctgagcaggcgcagcagtgcaggagtggctgtgctggagggagcattgtacgtggctgggggcaatgacggaaccagttgcctcaatagtgtggagaggtactcaccaaaggctggagcctgggagtcggtcgctccaatgaacattcggcggtccacgcacgacctggtagcaatggacggatggctctacgccgtgggagggaacgacggctcaagctccctgaatagcatagagaagtataacccccgaacaaataagtgggtggccgcctcttgcatgttcaccagaaggagctcagtcggagttgccgtccttgagctgctaaatttcccgcctcctagctccccaactctttcagtttcatcaaccagtctatag

SEQ ID NO: 26909 - DNA, 1557 bp, Artificial Sequence
  Description of Artificial Sequence: Synthetic coding sequence
atgtcagagtctcgtcagacccacgttaccctgcatgatatcgatccccaagccctagaccaactggtgcagttcgcctatacagccgagatcgtggtgggtgagggcaatgtgcagaccctgttgccagccgcatcactgttgcagctcaacggggtgagggacgcatgctgtaaatttttgttgtcacagctggatccctccaattgtctaggaataagaggcttcgccgatgcgcatagctgtagcgaccttctcaaagccgcccaccggtacgttctgcagcacttcgtcgacgttgcaaagaccgaagaattcatgctgctgcccctcaaacaggtcctggaactcgtctctagtgacagtttgaatgtgcccagcgaggaagaggtgtatcgggcggttttatcctgggtgaagcacgacgtggacgccagaagacagcacgtcccccgcttaatgaagtgtgttcggctgcctcttctgtccagggactttctgttaggccacgtggatgctgagtcacttgtccgacaccaccccgactgtaaggatttattaatcgaggctttgaagttccacctgctgccagaacagagaggcgtgctggggacctcccggacgaggccacggagatgtgaaggggccggccccgtgttatttgcagtcggggggggttcattatttgctattcacggggactgcgaggcctacgacacacgcaccgaccggtggcacgtagtcgcttccatgagcacccggcgcgcaagagtgggcgtcgccgccgtggggaatagactgtacgcggttggaggatacgatggcaccagtgatctggctacagtggaaagttacgacccagtaaccaatacatggcagcctgaagtatctatgggcaccagaaggtcctgtctcggagtcgcggctctccacggacttctctatagcgctgggggctacgatggcgctagttgtctaaatagtgctgagaggtatgatccactcaccggaacatggacctccgtggcggcaatgtccacgaggcgccggtacgtgcgagtggcaacactagacgggaacctctatgcagttggcggctatgattcctctagccacctggccactgtagagaaatacgaaccccaggtcaacgtgtggtcacctgttgcatctatgctgtcacggagatcgtctgcgggagtggccgtcctggaaggagccttgtacgttgctggtggcaatgacgggacgagctgcctgaatagtgtggaacggtacagccctaaggcaggcgcttgggagtccgtcgccccaatgaacattagacggagcacccatgacctagtcgcaatggacggttggctgtatgccgtgggaggtaatgacggtagtagctcattaaactcaatcgagaaatacaaccctaggaccaacaagtgggttgctgctagttgtatgttcactagaagatcctcagtgggcgtcgcggtcttggagctgctgaacttccctccaccgtcctcccccactctgtccgtgtcaagtacctcactgtag

SEQ ID NO: 26910 - DNA, 678 bp, Artificial Sequence
  Description of Artificial Sequence: Synthetic coding sequence
atgaagtgcgtgaggcttccactgctgtctagggattttttgctcggtcacgtggatgcggaatccctggtgcgtcatcaccccgactgtaaagacctgctgatcgaggcgctcaagttccaccttctccctgaacagcggggggttctgggcacgtctcggacccgcccgcgccggtgcgaaggagctggccctgtcctcttcgctgttggaggagggagcttattcgctatccacggggattgcgaggcttatgacacaagaacggacagatggcacgtcgttgctagcatgtccacacggcgtgccagagtcggagttgctgccgttggaaacaggttgtatgcggtgggaggctatgatggaacctccgacctggccacagtggaaagttacgatccagtgactaatacttggcagccagaggttagtatgggaactcgccggtcatgtctgggtgtggcggcactgcatggtttgctgtatagtgcaggtggctatgacggcgcctcttgtctcaatagtgctgaacggtatgatccactgactggaacatggactagtgtggccgccatgtccacccgccgcagatacgtccgcgttgctacactagatgggaatttgtacgcagttgggggatatgattcaagttcccacttggccacagtcgaaaagtag

SEQ ID NO: 26911 - DNA, 489 bp, Artificial Sequence
  Description of Artificial Sequence: Synthetic coding sequence
atgcgcatcgcaaaccgcactagattttcttcaccttttctcgcccgtggagcagggtggacccatggcaggggaatgatggttgtcggcaccgggaccagcctcgccttgtctagcttgttgtccttgctcctctttgctggaatgcagatgtattccagacagcttgcatcaacagaatggctgactattcagggcggtttgcttggctctggcctctttgtgttcagcctaactgctttcaacaatcttgagaatctagtgtttggaaaaggattccaggccaaaatctttccagagattctactttgtcttctccttgccctgtttgcgtccgggctcatccatcgggtgtgcgtgactacctgcttcattttcagtatggttggactctactatattaacaagatcagttcaacactctaccaggcagcagcccccgtcctgacccctgcgaaggtaacagggaagtccaaaaagagaaactag

SEQ ID NO: 26912 - DNA, 723 bp, Artificial Sequence
  Description of Artificial Sequence: Synthetic coding sequence
atgcggaggtgttcactttgcgctttcgacgccgctcgaggtcctcggagactgatgcgcgttgggctcgccctgattctggtagggcacgtaaacctcctgctgggagccgttctgcacggtacggtgttgcgacatgttgccaacccacggggtgccgtaaccccggagtataccgtcgctaatgtgatatcagttgggtcaggcctgctcagcgtgagtgtcgggctcgtggctttgctcgcctcgcggaacctgctgcggccccccttgcactgggttcttctggctctggcgctggtcaatctcctcctatcagtagcttgctcacttgggcttctgttggcagtgtctctgactgtcgctaatggaggtaggcggctgattgccgattgccacccaggactcctggatccccttgtgccgctagatgaaggtccgggacatacagactgcccttttgatcccactcggatttatgataccgccctggccctgtggatcccatccctccttatgtccgcaggggaagccgccctgtccggctactgctgcgttgctgctttaacattacgtggagtggggccttgcagaaaagacggcctgcagggccagctggaggaaatgacagagctggagtctccaaaatgcaaaagacaggaaaatgagcagttactggaccagaatcaggaaattagggcttcccagaggagttgggtgtag

SEQ ID NO: 26913 - DNA, 669 bp, Artificial Sequence
  Description of Artificial Sequence: Synthetic coding sequence
atgagggtgggcttggctctcatattggtggggcacgtgaatctgctgcttggtgctgtgctccatggcaccgttctgcggcatgtcgcaaaccccaggggagccgtgacccctgagtacaccgtggctaacgtcatttccgtgggtagcggcctgctcagtgtaagtgtgggcttggtcgctctgctcgccagcaggaatttgctgaggccacccctccattgggttttactggcgttggctctagtcaatctcttgttgtccgtggcatgctcactgggcttactgctcgcagtgagtcttacagtggcaaatggaggcagacggctgattgcagactgtcatccagggcttttggacccactcgtgcccctggacgagggccctggacataccgactgcccctttgaccctacccgtatctacgacacagccttggcgctgtggattccaagcctgcttatgagcgctggggaggcggccttgagcggatattgttgcgtggccgctttgacactcaggggagtaggaccgtgtcgaaaggatggcctgcagggtcagctggaagagatgaccgaactggagtcacctaagtgcaagaggcaggaaaatgaacagcttcttgaccagaaccaagagatcagggcctcacagagaagttgggtatag

SEQ ID NO: 26914 - DNA, 189 bp, Artificial Sequence
  Description of Artificial Sequence: Synthetic coding sequence
gctctcagcgggtactgttgtgtcgccgcgctgacactgcggggggtcggtccatgtcgaaaagatggccttcagggacagctggaggagatgactgagctggagagccccaaatgtaaaaggcaggagaacgagcagttgctggaccaaaatcaggagatccgcgcaagtcagcggtcctgggtgtag

SEQ ID NO: 26915 - DNA, 723 bp, Artificial Sequence
  Description of Artificial Sequence: Synthetic coding sequence
atgcgccggtgctccctatgtgctttcgacgcagcaaggggccccaggcgccttatgagagtgggactggctctgatattggtgggacatgtgaacctccttctgggggcagtgctgcacgggaccgtgcttaggcacgtggccaacccacggggggcggtaacaccagagtataccgtggcaaatgtgatctccgtgggtagtggtttattgagcgttagcgtggggcttgtagctcttctcgcaagtaggaacctactgcgtccacctctacactgggtgctcctggctctagcacttgttaatctcctgcttagcgttgcatgttccctgggtctgttgcttgcggtcagtctgacagtggctaacgggggccgacgactgatcgctgactgtcatcccggattactcgaccctctggtgccattagatgagggccctggccatactgattgtccttttgaccctactagaatttatgataccgccctggctctgtggattccatcattgctcatgagtgctggcgaggcagcgctatccgggtactgttgcgttgccgccttgacacttcgaggagtagggccatgtaggaaagacggactccaagggcagctagaggagatgacagaactcgaaagtccaaagtgtaaaagacaagaaaatgagcagcttcttgatcagaaccaggagatccgggccagccagcggtcctgggtgtag

SEQ ID NO: 26916 - DNA, 2982 bp, Artificial Sequence
  Description of Artificial Sequence: Synthetic coding sequence
atggctgcggaatgggcaagcagattctggctttgggcgaccctgctcattcccgctgcggctgtttatgaggaccaggtcggaaagtttgattggcgacagcagtacgtgggcaaagtaaagtttgcatccctagagttctcccccggttcgaagaagcttgtcgtggcgaccgagaaaaatgtaatcgcggctctcaatagtagaactggcgagatcctgtggcggcacgtggacaaaggcacagcagagggggccgttgacgccatgctgcttcacggacaggacgtcatcacagtgagcaatggcgggcggattatgcgctcctgggaaacaaacattggaggcctcaactgggaaattacgttggattcagggagctttcaggccttgggcctggtgggcctgcaggagagtgtacgctacattgctgtgcttaagaagacaaccctagccttgcaccatctctcatctggtcacctgaagtgggtggagcacctgccagagtccgactcaattcattatcagatggtctatagttacgggtcgggtgttgtgtgggcattaggcgtggtgcccttttcacatgtgaatatagtcaagttcaacgttgaggatggggagatcgttcaacaggtgagagtgtccacaccttggctgcagcatctctcaggcgcctgcggcgttgtggatgaagccgtgttggtgtgcccggacccgagctctcggagtctgcaaacgcttgcccttgaaactgagtgggagttaagacagatcccactacagagcctcgacctggagttcggaagcgggttccagcctcgggtgctacccacgcagcctaatcccgttgatgcttctcgtgcgcagtttttcttgcacctcagtccatcccactacgccctgttacagtatcactacggcaccctgagtcttctgaagaattttccacagactgccctcgtgtcctttgcaaccacgggtgaaaagactgtggccgcagtgatggcttgcaggaacgaggtacaaaaaagctcctcatcggaggatggttctatgggtagtttttcagagaagtcgtcaagcaaggactccttggcctgtttcaaccagacatatactatcaacctctacttggtggagacgggcagacgcctgctagatacaaccataacattttcccttgagcaatcgggtacccggccagaacgcttatacatacaggtgtttctgaaaaaagatgatagtgtgggctacagggctctggtacagactgaagatcatctgttgttgttcttgcagcaactcgccggtaaggtagtattgtggtctagagaagagtctctggccgaggtagtgtgtttggaaatggtagaccttccactgaccggagcccaagccgaactcgagggagagttcggcaagaaagccgacggcctcctgggaatgttcctgaagcgtctgtccagccagctgattctgcttcaggcctggacctcacacttgtggaagatgttttatgatgcccggaaaccaaggtcccagattaaaaacgaaataaacatcgatacactggccagggatgaatttaatcttcagaaaatgatggttatggtaaccgcttcaggcaagttgtttggaattgagtccagtagtggtacaatcctgtggaaacagtatctgcccaacgttaagcccgattcttctttcaaactgatggttcaaagaacaacagcccactttcctcacccaccgcaatgtacgctactggtgaaagacaaggagtctggaatgtctagtctgtatgtctttaacccaatttttgggaaatggagtcaggtggcccccccggtgctcaagcgaccgatcctgcagtcgctgctgctccccgtcatggaccaggattatgctaaagtgctcttgctcattgatgatgaatacaaggtgacggcatttccggccacgagaaatgtactccggcaactacatgaactggccccaagcatattcttctacttggtggacgccgagcaggggaggctctgcggttacagattacgtaaggatcttacgaccgaattgagttgggagctaactatccctccagaagtgcagagaatcgtcaaagtgaagggaaagaggtcctctgaacacgtgcattcacagggcagggtgatgggggaccggagtgttctgtacaagtcccttaatcctaatttactggccgtggtgactgagagtacggacgcacaccacgaacgaacatttattgggattttcctgattgacggggtcacaggcaggattatccactcatcagtgcaaaagaaggccaaaggaccagtgcatatcgtccattcagaaaattgggtggtctaccaatattggaatacaaaggcacgaaggaatgagtttaccgtgctcgaactttatgaaggaactgaacagtacaatgctaccgctttctcgagcctagacagaccacagctgcctcaggttttgcaacagtcctatatattcccgtcgagcatctcggccatggaggccacaattaccgaacgcgggatcacaagtcgacacttactgatcgggttgcccagcggagcaattctcagtttgccaaaggcgctgcttgatcctcgtcgccccgaaatccccactgagcagtcccgggaagaaaatctaatcccatatagccctgacgtccaaatccacgctgagcgcttcatcaattacaaccagaccgtctcgcgaatgaggggcatatacactgcccccagcggcttagagtccacttgcctggtcgtggcatacgggttggatatttaccaaactcgcgtgtatcccagcaaacagttcgacgtactgaaagatgattacgattatgtactgattagcagtgttctgtttgggttagtgtttgcaactatgatcactaagagactggcccaggtgaagctgctgaatcgcgcctggcgttag

SEQ ID NO: 26917 - DNA, 4071 bp, Artificial Sequence
  Description of Artificial Sequence: Synthetic coding sequence
atggaccttaaggaaaaacacttgggggagcctccatccgctctgggcctgagtacccggaaggccctaagcgttctgaaggagcagctcgaggccgttttagaggggcatctccgcgagaggaagaagtgtctgacctggaaagaagtctggagatcatcatttctccaccactctaaccgctgcagctgcttccattggcccggggctagcctcatgctacttgctgtcctgcttctgcttggttgctgtggcggccaaccggcgggcagcaggggcgtcggtctcgtgaacgcctccgccctgtttcttttacttctgttgaatctggtgcttatcggaagacaagacagactgaagcgcagagaagtcgagaggcgtctcaggggcattatcgaccagatccaggatgccctaagagatggcagagagattcagtggccttccgccatgtacccagatttgcatatgcctttcgcaccctcgtggtccctccactgggcgtacagagacggtcatctagttaacctgccagtgtctctactggtcgagggggatatcatcgccttgcggccaggacaggaatcttttgcatctctgcgcggtattaaagacgacgagcacattgtgctcgaacctggtgatttatttcccccttttagtcctccgcctagccccaggggggaagttgagcggggaccgcagagccctcagcagcacagactatttagggtcctcgaaacccccgtgatagacaacattcgctggtgcctggacatggccttgtctcgacccgtgaccgctctcgacaacgagcgattcactgttcagtctgtcatgttacattatgctgttcccgttgtgctggctggtttccttataaccaatgctctgcggtttattttcagcgcgccaggggtgaccagctggcagtatactcttctccaactccaggtaaacggtgttctcccaattctacctctgctttttccagttctctgggtgctggctaccgcctgtggggaagcccgcgtcttggcccagatgtccaaagcctccccttccagcttattggccaagttctcagaggacacgctgagtagctacaccgaggccgtctctagtcaggagatgctcaggtgtatctgggggcacttcctgcgagttctgggagggacttcccctaccctcagtcattcttcaagtctgctccactctctgggtagtgtcacggtgttgtgctgcgtcgataaacaggggatcctgtcttggcccaacccttctcccgaaactgtgctgtttttctcggggaaagtcgagcctccacacagtagtcatgaggacctgactgatggcctctcaaccaggtccttttgccaccctgagcctcacgagcgggacgctctgttagctggcagcttgaacaacacattacacctgtccaacgaacaagaacggggggactggcctggggaggcgcctaagcctcccgaaccctactcacaccacaaggctcacggaaggtctaaacacccaagtggctccaacgtgtccttcagccgcgacacagaaggcggagaggaggaaccttcaaagacacagcccggaatggaatctgatccctacgaagctgaagattttgtgtgtgactaccatctcgagatgcttagtttatctcaagatcagcaaaaccctagttgtattcagtttgacgacagtaattggcagctacacctgacgtccctgaaaccgttggggctcaacgtgctccttaatctgtgtgacgccagtgtgacagagagactgtgtcggttcagcgaccacctgtgcaacatcgctctgcaagagtcccattcagcagtgctgccagttcacgtcccctggggcttgtgtgagctggcccggctgatagggttcacgcccggggctaaagagcttttcaagcaagaaaatcatctcgccctttatagattgcccagtgccgaaacgatgaaagagacttccctgggtcgtctgagctgcgtgactaagcgtcgcccgcctctgtcccacatgatatccctcttcattaaggataccacaactagcaccgaacagatgttgagccatggaactgctgacgttgtgcttgaggcatgtacagatttttgggacggcgccgatatctaccccctgagcggctccgatagaaagaaggtacttgatttctatcagcgtgcctgcctgtccggttattgcagcgcattcgcctataagccgatgaactgcgctctgtccagccagctgaacggaaagtgtattgaactggtgcaggtccctggccagtcttctatcttcaccatgtgcgagcttcccagcaccatcccaattaagcagaacgcacgaagatcctcttggtcctccgacgaaggtattggtgaggtgcttgagaaagaggattgtatgcaggcccttagcgggcaaatcttcatgggcatggtgtcatctcagtatcaggcgcgcctggatatagtgcgcctgatcgatgggctggtgaatgcctgcatccgattcgtgtacttttctctggaagacgagcttaaaagcaaggttttcgcagaaaagatgggattggagacagggtggaattgccacatttccttaacccctaatggagatatgcccggctctgagatacctcccagtagtcctagtcatgccggaagtttacatgatgacctgaatcaggtcagccgggacgacgcggaaggattactcctgatggaggaggagggccatagtgatttgatctcatttcagcccaccgacagcgacatccctagttttttggaagactcaaacagggcaaagctcccgcgggggatacaccaggttcggccacatttgcaaaatatagacaacgtccccctgcttgttccgctgttcaccgactgtacgccggaaacaatgtgcgagatgattaagattatgcaggagtacggcgaggtgacctgctgccttggatcctccgccaacctgcgaaattcctgtctgtttcttcagtcggatatctccattgcgctggacccattgtatccctcgcggtgttcttgggagacattcggctacgcaacctccatctccatggcccaggcctcggatgggctcagccccctgcaactgagcgggcagcttaacagcctgccctgctcccttacctttagacaggaggaaacaatctcaattattcggctgatagaacaagctcgccatgcaacttatggcatcaggaaatgttttttatttttgctgcagtgccagctcaccctggttgtcatccagtttctgagttgtttggtgcagcttccacccctcctatcaaccactgacatcttgtggctttcatgtttctgctatcctctcctgtctatttcattgttggggaaacctccccactccagcatcatgtccatggcaaccggaaagaatctacagtccatccccaaaaagacccagcattatttcctcctgtgtttccttttgaagttttctctgacaatctcatcctgcctcatctgttttgggtttacactgcagtctttttgtgacagttcgagggatcggaatctgactaattgtagctccgtcatgcttccttccaacgacgacagagctcctgcttggttcgaagatttcgccaacgggcttctctccgcacagaagcttaccgccgcgcttatagtgctccacacggtgttcattagtattacacatgtccacaggacaaagccactttggagaaagtcccccctgactaacctgtggtgggctgtcaccgtcccagtggttttgcttggtcaagtcgtccagacagcagttgatctccagctctggacccatagagacagccacgtacacttcggactcgaagacgttccccttctgacgtggctgttagggtgtctctctcttgtgcttgtcgttgtcacaaatgaaatcgtgaagctccatgagattcgtgttcgagttcgctatcaaaagcggcagaaactgcagttcgaaacaaagctcggcatgaacagcccgttttag

SEQ ID NO: 26918 - DNA, 912 bp, Artificial Sequence
  Description of Artificial Sequence: Synthetic coding sequence
atgtgccatggccgcattgcacctaagagcacctctgtgtttgctgtggcctctgttggacacggcgttttcctcccgctcgttattctgtgtacattgctcggagatggtctcgcatccgtttgtcctctcccaccagagccagaaaatggtggatatatttgtcacccgcggccctgtagggaccccctgactgctggctccgtgattgagtatctctgcgcagaaggctacatgctgaagggcgactacaaatacctgacctgtaagaacggtgaatggaaacctgcaatggagatttcatgtcgattaaacgaggacaaagatacacacacttccctgggcgtccccaccctgtctattgtcgcctccacagcaagttctgtcgcacttatcctattgttagtcgtcctgtttgtcctgctccagcctaagttaaagtctttccatcattctcggagggatcagggcgtcagcggcgaccaggtttcaattatggtagatggagttcaagtggcattgccctcatatgaggaggcagtgtatggaagcagtgggcactgtgtcccaccggcagatcccagagtccaaatagtgctgagcgagggaagcgggccctccggaagatcggtgccgcgtgagcagcagttaccagaccagggtgcatgcagcagtgccggcggggaggacgaagcacccggccagtccggactttgcgaggcctgggggagccgggccagcgagactgtcatggtacaccaggctacaacctcttcatgggttgcagggtccgggaatcgccagctcgcccataaggagaccgcagattctgagaacagcgatatacagagcctgctgagcctgacttccgaagagtacactgacgatatccccctgcttaaagaagcctag

SEQ ID NO: 26919 - DNA, 2472 bp, Artificial Sequence
  Description of Artificial Sequence: Synthetic coding sequence
atgttctacgtgataggagggatcaccgtaagcgttgtagcatttttttttacgatcaagtttctcttcgaactggccgcccgcgttgtctcattcttacagaacgaggatcgcgagcgcagaggtgaccgaacaatttacgactacgtaaggggcaattacctcgacccacggagttgtaaagtatcctgggattggaaagatccgtacgaggtgggccactcaatggcgttccgcgtacaccttttttataaaaacggccagccatttcccgcacaccgtccagtgggattgcgcgtacatatctctcacgtcgagctggctgtggagatacccgttactcaggaagtgctccaagaacccaacagtaatgtcgtgaaagtagcattcactgtccgaaaagctggccgctatgaaataactgtgaaacttggcggcctgaacgtagcctactctccctactataagatcttccagcccgggatggtggtgccatccaaaacaaaaatagtctgtcatttctcgactctggtattaacatgtggtcaaccacataccctccagatcgtgcctagggacgagtacgacaatccaactaataactctatgagtctgcgggacgaacacaactacaccttgagtatccatgagctcgggccgcaagaggaggagagcaccggggtttcatttgaaaagagtgtgacctccaatagacagacgttccaggtctttttgaggctcaccctgcattctcgtggctgttttcacgcctgtatttcttatcagaaccagcccatcaataatggagagttcgacattatagtgctgtccgaagacgaaaaaaacatagttgaacgtaacgtctccactagcggagtgtctatctacttcgaggcttacctgtataatgccaccaattgctcctcaacgccttggcatcttcctcctatgcatatgacaagttcccagcgtcggccctccaccgcagtagacgaagaagatgaagattccccttccgagtgtcataccccagaaaaggtcaagaagccaaaaaaggtgtactgctacgtaagtccaaagcagttctcggtaaaggagttttacctcaagattatcccctggagattgtacacctttcgggtgtgccccgggaccaagttctcctacctcggacctgaccctgttcataagctgcttacgttggtggtcgacgatggtatccagcctcccgtagaattgtcgtgtaaggagagaaacatcctggccgccacattcatccgctccctacacaagaatattggaggcagcgaaactttccaagacaaggtgaacttctttcagcgcgaactcagacaggtgcacatgaagagaccacactccaaggtgacccttaaggtgtcccgccacgcgttgttagagagcagcttgaaagcaacacgtaactttagtatatcagattggtccaagaattttgaggtggtgtttcaggatgaagaggccctggactggggaggacccagacgcgagtggtttgaactgatctgtaaagccctcttcgacacgacaaaccagctgttcacacgcttttccgataacaaccaggcacttgtgcaccccaacccaaaccggccagcacatctaagactgaagatgtatgagtttgccggtcggcttgttgggaagtgcctgtacgagagctctcttggtggggcctataagcagctcgtgagagcgcgcttcactcggagcttcttagcgcagataatcggacttagaatgcattacaaatatttcgagactgatgatcctgagttttacaagagcaaggtctgcttcatccttaataacgacatgtcggagatggagttagtcttcgccgaagagaagtacaataagagcggacagctggataaagtggtcgagcttatgaccgggggcgctcagactccagttaccaatgcaaataagatattctatcttaacctgctggcacaatatcgattagcctcgcaagtgaaggaagaagtggagcacttcctaaagggccttaacgaactggtccccgagaacctgcttgcaatcttcgacgagaatgagctcgagttgctgatgtgtggcacaggtgacattagtgtcagtgatttcaaagcccatgctgtggtggtgggtggctcatggcacttccgtgagaaagttatgaggtggttttggactgtggtaagcagcctcacacaggaggaactcgcacggctgctgcaattcactacaggctcaagccagcttcctcctggtggtttcgctgccctgtgcccaagctttcagatcattgcagctccaacccattcaaccctcccaacggcacacacatgctttaatcagctgtgtctcccgacctatgacagctacgaggaggttcaccggatgctccagctggcaatctccgagggttgcgaggggttcggtatgctgtag

SEQ ID NO: 26920 - DNA, 3150 bp, Artificial Sequence
  Description of Artificial Sequence: Synthetic coding sequence
atggaaaaaagactcggggtgaagcccaacccggcatcctggatcctctcgggctactattggcaaacctctgctaagtggttaagaagcctatatttgttctacacgtgcttctgcttttcagtactgtggctttcgacagacgcgagtgaaagcagatgccagcaaggcaagacacagtttggagtaggccttcggtctgggggagagaatcatctctggctgttggagggcactccctcactccagtcatgttgggcagcctgttgtcaggattccgcgtgccatgtattctggtggctggaaggaatgtgtatccaggctgattgttcacgtcctcagagctgtcgggcttttagaacccattcttccaattccatgcttgtgttcctgaaaaagtttcagacggcagacgaccttggctttctccccgaggacgacgttcctcacctgctgggcttagggtggaattgggctagctggcgccagtctccgcccagagcagccctgaggccagccgtaagctcatcagatcagcaatcattgatacgaaaactgcagaaaaggggtagcccttcagacgtcgtaacaccaattgttacacagcatagcaaggtcaatgattccaatgagctgggcggcctgaccacatctggctcagcagaggtgcacaaggctataactatttccagtcctctgaccaccgacctcaccgcggagctcagcggcggacccaaaaacgttagcgtccagcccgagatatccgaagggcttgccacgacgccctcgacacagcaggtgaaaagtagcgagaaaacacagatcgctgttcctcagccagtggctccctcttacagctacgccactcccacacctcaggcaagctttcagagtacctccgccccatatccagtcatcaaggaactggtggttagcgccggggaatctgttcaaattacactcccgaaaaacgaggtccaactgaacgcctacgtactgcaggagccccctaaaggggagacctatacgtacgactggcaactgatcactcaccctcgggactattccggggaaatggaggggaaacactcccagatcctgaagctcagcaagctgacccccggtttgtacgaatttaaggtgattgtggagggacaaaacgcacacggcgaggggtacgtaaacgtgactgtcaaacccgagccaagaaaaaatcgcccaccaattgccatcgtgagtcctcaatttcaggaaatcagcctgcctacgacttccacagtgattgacggtagtcagagcacagatgacgataaaatcgtccagtaccattgggaggagctcaaggggcccctgcgcgaggagaaaattagcgaggacactgccattctcaagttatcaaaactcgtccctgggaattacaccttctcacttaccgtggtagactccgatggtgccacaaactctacaactgctaacttaacggtaaacaaagcggtggattatccaccggtggctaatgccggccccaatcaggtcataacactaccccagaactcaatcaccctctttggaaatcagtcaacagatgatcacggcataactagttatgagtggagtttatctccctcttccaaaggaaaagtggtggaaatgcagggtgtgagaacaccgacgctgcagctgagcgctatgcaagagggcgattatacatatcagttgacggtcactgacacgataggtcagcaggctacggcgcaagttacagtgatcgtgcagcctgaaaacaataagccaccccaggccgatgccggaccagacaaggaactgactctgccggttgattcgaccaccttggatggttccaagtcaagtgacgatcaaaagatcatcagttacttatgggagaaaactcagggccccgacggcgtacaactggagaatgcgaattcctctgttgcaaccgtaactggcctgcaagttggtacgtatgtttttacactgacagtcaaagatgaaaggaatctgcagagccagtcatccgtgaacgttatcgttaaagaggagatcaataagccacctatcgcaaaaatcacgggcaacgtcgtaatcaccctgcctactagtacggccgaacttgacggctctaaatcatctgacgataagggcatcgtgtcttacctctggaccagggatgagggaagcccagcggcaggagaggttctgaatcattctgaccatcatcctattttgtttctaagcaacctggttgaaggcacttacaccttccacctcaaagtgaccgacgcgaaaggagaatccgacactgacaggactacagtggaagttaaaccggatccaagaaagaacaatctcgtcgagatcatcttggacatcaacgtcagtcaactcaccgaacgtctgaaaggcatgtttattcgccagattggagtcctcttaggcgtgctcgattctgatatcatagtgcagaagatccaaccatacaccgaacaaagtaccaagatggtattctttgtgcaaaatgagcccccacatcagattttcaaaggacacgaggttgccgccatgctcaaatccgagcttagaaagcagaaggctgatttcctgatttttagggccctggaggtcaatactgtaacatgtcagctgaactgtagcgatcacggacattgtgatagcttcactaagcgctgcatatgtgatcctttttggatggagaactttatcaaagtccagctccgggatggcgactcaaactgcgagtggagcgtgctctacgtgataatcgccacgtttgtcatcgtcgtcgccttggggattttatcatggacagtaatttgttgttgcaagcgccagaaagggaaaccgaaacgcaagagcaagtataaaattttggacgcaacagaccaggaatccttggaattgaaacccacgagccgtgcaggaattaagcagaagggacttctcctcagctcttccctcatgcacagcgagtctgaattggacagcgacgacgctatcttcacctggccagatagggaaaagggcaaattgctgcacggtcagaatgggtcagttcctaacggccaaacccccctgaaagctcgcagtcctcgggaagagatattatag

SEQ ID NO: 26921 - DNA, 4830 bp, Artificial Sequence
  Description of Artificial Sequence: Synthetic coding sequence
atggcaggactgagacgccctcagcccggatgttactgtcggaccgccgccgcagttaacctgctcctgggcgtgttccaggtcctcctgccgtgctgtagaccaggcggggcgcagggccaggccatcgaacccttgccgaacgtggtcgagctatggcaggctgaggaaggagagctcctcctcccaacacagggggattcagaggaaggtttagaggaaccatcccaggaacagagctttagcgataaattattctctggaaagggcttgcattttcagccttctgtactggacttcggcatacagtttcttgggcatcccgttgcaaagatcctacatgcatacaaccccagtcgggactccgaggtggtggtgaactccgtgttcgccgccgccggccacttccacgtgccacctgtgccatgcagggtgatcccggctatggggaaaacatcttttcgaattatttttctccccactgaggaaggttccatcgagtcttcactgtttataaacaccagctcatatggtgtgctctcctaccacgtgtctgggatcggcacaaggcgcatctccaccgaggggtccgcaaagcaactgccgaatgcctacttcttgctgcctaaagtccagtccattcagctatcccagatgcaagccgaaactaccaacaccagtctgctacaggtgcaactagaatgttctctccacaataaagtatgccagcagctgaaaggctgctatcttgagtccgatgacgttctccggttacagatgtccattatggtcaccatggagaactttagtaaagaattcgaagaaaacacccagcatctactggatcacttgtcaatcgtatatgtggctacagatgagtcagagacttctgatgatagcgccgtaaatatgtacatcctccacagcgggaacagtcttatttggattcaagacataagacacttttctcaaagagacgccctgagtctccagtttgaaccggtgcttcttcccacgagtaccacaaacttcactaaaattgcaagctttacctgcaaggctacatcttgtgattccggcatcatcgaggacgtgaagaaaaccacccacactcccaccctgaaagcttgcctgttctcttcagtggcccagggctattttagaatggacagcagcgccacccagttccatatcgagactcatgagaacacgagcggcctgtggtctatatggtaccgcaaccactttgatcggagcgtggtcctgaatgacgtgtttctatctaaagagacaaagcacatgctgaagattcttaattttactggtccccttttcctgcccccaggatgttggaacatcttcagcctgaagctggctgtcaaggacatcgcgatcaacctttttactaacgtctttcttaccacaaacattggcgccatattcgctatcccactgcagatctacagcgcccccaccaaggaggggagtctggggtttgaagttatcgcgcactgcggtatgcactatttcatgggtaagtcaaaagccggcaaccccaattggaatggatccctgagtcttgaccagtccacctggaacgttgattctgagctggcaaataagttgtatgagcgctggaagaaatacaaaaacggggacgtgtgtaaacgcaacgtcctgggaaccacaagattcgcccacttaaaaaaaagcaaagagtccgaatccttcgtctttttcttgcctcggctgattgccgaacccggcctcatgctgaacttctccgcaactgccctgcgtagccggatgatcaaatattttgtggtccaaaacccatcatcttggcctgtctctttacagctgctgcctctttcactgtaccctaagcccgaagctttggtccaccttctacacagatggttcggtacagatatgcagatgatcaattttaccacaggcgagttccaactgaccgaggcttgcccataccttggtactcattccgaagaatccaggttcggcattctgcacctacatttgcagccactggaaatgaaacgcgtgggagtggtctttacacctgcagactacggaaaagttacttccctgatcctcatccgaaacaacctgaccgtcattgacatgataggtgttgaaggctttggagcgcgcgagctgctgaaggtgggcggcagactacccggcgctggaggaagtctccgcttcaaggttcccgaaagcacattgatggattgtaggagacaactcaaggactctaaacagattttgtcaatcacgaaaaacttcaaggtggagaacatcggcccattgccaatcacagtgtcctcattaaagatcaacggttacaattgccagggttacgggttcgaggtgctggactgtcaccagttttccctcgacccgaatacatctcgcgacatcagtatagtgttcacaccagactttaccagtagctgggtgatccgtgacctcagcttggtgactgccgccgacctcgagttccgattcacactgaatgttacccttccccaccatctcctgccactgtgtgcagatgtcgttcctggtcctagctgggaagaatccttctggcgtctcactgtgttcttcgtgagcttgagcctgctgggcgtcatcctcatagcttttcaacaggcgcagtatatcctcatggagtttatgaaaacacgacagagacagaatgcctccagttccagtcaacaaaacaatggccccatggacgtcatcagtccccattcttacaagagcaattgcaagaacttcctggatacttacggtccaagtgacaaaggcaggggtaaaaactgtctcccagttaatacaccccagtcaagaattcagaacgctgccaagaggagcccagcaacctatggccacagccagaagaaacataaatgcagcgtttactatagcaaacacaaaaccagcactgccgctgcttcttctactagtaccacaacggaagaaaagcaaacatcacctctggggtcctctcttcctgctgccaaggaagatatttgcaccgacgccatgcgagaaaactggattagtctgagatacgcgtcgggtattaatgttaatctgcagaagaatttaaccctgccaaagaatctcctgaacaaggaggaaaacacattgaagaatacaattgtcttctccaaccccagctctgaatgtagcatgaaggaggggatccaaacctgcatgttcccgaaggagactgacataaagacatctgagaacacggctgaattcaaagagagagaactctgccccctcaagacttccaagaagttgcccgagaatcacctgcccagaaattcacctcagtatcatcagcctgatctgccagaaattagtagaaagaacaatgggaacaaccagcaggtgcctgtgaaaaatgaagtggatcactgtgaaaatttgaagaaggtggacaccaagccatctagcgaaaagaagatccacaaaacatcgcgagaggatatgtttagtgaaaaacaggatatcccctttgtggaacaagaggacccgtataggaaaaagaagttgcaagaaaagcgagagggtaatcttcagaacctgaactggtctaagagccgcacctgtcgcaagaataaaaaacgtggcgtggccccagtgagccgcccacccgagcaatccgacctgaagctagtgtgttccgatttcgagcgatctgaacttagtagcgacattaacgtccgcagttggtgtatccaggagagtacccgggaagtatgcaaggcggacgcagaaatagcctcgtctctgcctgcagcccaacgggaagccgaggggtactaccagaagcccgaaaaaaaatgcgtcgacaagttctgctcagactctagcagtgattgcggctcatcttcgggctccgtcagggcctcaaggggttcatggggaagctggtcatctacctcttctagcgatggcgacaagaagcctatggtggacgcacagcatttcctaccagctggtgattcagttagccaaaatgattttcccagtgaagcacctatcagcttgaatctctcacacaacatctgcaacccaatgacagtgaacagcttgccgcaatatgccgagccctcctgtccaagcctcccagccgggccaaccggagtcgaggaggataagggactgtactctcccggagatctgtggcctacccccccggtgtgtgtcacctcatccctaaactgcacactcgagaatggagttccatgcgtcatccaagagtccgcccccgtgcataacagtttcatcgattggtccgctacgtgcgaagggcaattctctagtgcatattgccctcttgaactcaatgactataatgcctttcccgaagaaaacatgaactatgcaaatggctttccctgccccgcagacgtccagacagacttcatcgaccataactcgcagtcaacctggaacacaccgcctaatatgccagccgcgtgggggcatgctagctttatttccagtcctccttaccttactagcacacggagtctgagtccaatgtccggtctgtttggaagtatttgggccccacagagcgacgtttacgagaactgttgtcccatcaaccctactactgaacattctactcatatggagaatcaagcagtagtttgtaaggagtattatccgggtttcaatccctttagggcttacatgaaccttgacatttggacgaccaccgcaaatcgtaacgccaattttccactaagtcgggactcctcatattgtgggaacgtgtag

SEQ ID NO: 26922 - DNA, 4212 bp, Artificial Sequence
  Description of Artificial Sequence: Synthetic coding sequence
atggcaaactgttctcaggaagaattggatgaggaattcgaacagttcatgaaagaattatctgacgatagctttgagaacagtgataagacagcccgtcaatccaagaaggagatgaaaaaaaaggacactgtgccctggtggatcacagaggacgacttcaaagatgacggtctattgggcacaaatgtaagctatctgaagacaaaaaaaacctcccaaccagtcatggagatcgaggaagaaagtgcggagaagattcagtttttaaagagtagtgggacttccttgctcagcaccgatagtctagagaccaacgaactggtcgtcagtgagctgaatcactccagtttgggcgtagggctggacactctggaggagcaagaagaaaaagagcagttcttcgcacgtcttgaaaagggcttaacatcttcaatcgattacagtaggctgaataaggagcttgacagtaatgattctacccacttcaaggccctccattcaaatcaggctaacgcagaactgactgacgacgaacatgagaatgaatcgaagcatgaggagttggccgaaaattacagcgacgatttcgaggacgaatatgtgggagccccgctaaccaccaaagatgaggaaatgcctagtaaagaaaattcgaaaagtgaaaagatttcggtgcctaaacaggaggaggagaaaaccggcatgctggcaaacgtagtgctgctggactccttagactctgtcgcagaggtgaatctggatgagcaggacaagatcacccccaaaccgcgttgtctccctgagatgaccgagaacgaaatgacgggcacaggtgtgagctacggccaatcttcatctgatgtcgaagccctgcaccaggcatattgccatatcgctcatagcctgggtgacgaggacaagcagaagatagaaagcaataccgtggaggatatcaagagcagcgtgaaggggcacccacaggaaaacgaggaaaattcaaagaacatttcaaccatggagtcagatctgcccactgttgaagagttgatgaagccaattagaatcgattccttcggaatctcagggtttgacttgcagcctgtgagctccgagaaagttgccgaaagaaaggagactgaattcttcagttctctgcccctgaagatgaacccaaatatcctcagtcaggattcccagcatgttaacctgttcttcgacaaaaacgatgaaaatgttatcctgcagaagacgaccaatgaatcaatggagaattcctgtccacaggtcactgaggtcaccgccactgaggagcatgtagataagatgtacttaaatatcctccgtaagaagataacggtgaactcctctagcctttcacaggacgataaaattaacaagacttatcggagccaactttcaagtgaggaggaaggtgcagtcatgggcaaacaagtgccgtataaaaaagcacgctccgctcctcccctgctcaagcgaaagccccagtctggcctgtatgcatctgtgagatccagcgggtatggaaaaccaagctctcctctcaagatgtttagtactctggaaaaaaaaacctccgaagatattattaagagcaagaacctgcggagcatcagcacgagtaaccagccccgaaagaaagagatcctgtctggtactaagctgattaaacccgccgctctggacaagcccgcacacaagactgagagctgtctgagtacacggaagaagagcgagaatccaacagaaaccgactcgtgcatacagtttcaaactgactctctgggatactgcggcgaaaataaggagaagaaactgctgatgttcaaaagggttcaggaggcggaagacaagtggcgcggcgcccaagctttgatagaacagattaaagcaacattcagcgaaaaggagaaggaattggagaacaaattggaagaactcaagaagcagcaagagaaagagctgtttaagctgaatcaagataattacatcctgcaggctaaacttagcagttttgaggagactaataaaaagcaacggtggcttcatttcggggaggctgccgatccagtgaccggcgagaaactgaagcaaattcagaaagaaattcaggagcaggagactctgctgcagggatatcaacaagaaaatgaaagactttacaatcaggtcaaagatctgcaggaacagaataaaaaaaatgaagaacgcatgttcaaggagaatcaatctctattttccgaggtggcctccctgaaggaacaaatgcataaatctagatttcttagccaggtggttgaagactcagaacctactcgcaatcaaaactttaccgacctcttggccgaattaagaatggcccagaaggagaaggattcccttttggaggatataaaaagactcaaacaggataagcaggctctcgaagtcgacttcgaaaagatgaaaaaagagcgcgaccaggccaaagatcaaatagcctacgtgacgggtgagaaactgtatgagataaagatcctggaggagactcacaagcaggaaatctccaggttacagaagaggctgcagtggtacgctgagaaccaggagctgcttgataaggatgctcttaggctgcgggaggccaacgaagaaatagaaaaactaaagctggaaattgagaagcttaaggcagaaagcggcaatccctctatcaggcagaaaatccggctcaaggataaggccgcagacgctaagaaaattcaggatcttgagcgccaagtgaaagagatggagggaatcctgaaacgtcgatatccgaactcgctcccagcactgatcctcgcagcttccgctgctggagacacggtagacaagaacacagtcgaatttatggaaaagaggatcaaaaaacttgaggccgacttggaaggaaaggacgaagatgccaagaaaagcctgagaactatggaacaacagttccagaagatgaagatccagtacgaacagagacttgaacagcaagaacaactccttgcttgtaaactgaatcagcatgattcgccacgaataaaggcactggaaaaggaactggacgatattaaagaggcccaccagattaccgtgagaaatttggaggccgagatagatgttctaaaacaccaaaacgccgagctcgatgtgaagaaaaatgataaggacgatgaagattttcaatctattgaattccaggtggagcaggcacacgctaaagccaagctggtgaggctcaacgaggagttagcagccaagaagcgtgagattcaagatttgtctaaaacagtcgagcgcctccagaaggacagaaggatgatgctaagcaaccagaattctaaaggccgcgaggaaatgtcggccaaacgtgcaaaaaaggacgtgctgcacagctcaaaagggaacgccaactcatttcccggaaccctggacagcaagctgtaccagccccacaccttcacagattcacacgtgtcagaagtgctgcaagaaaactaccgcttgaaaaatgagctcgaggggctcatatcagaaaaaaatgaacttaagatgaagtccgaggctgtcatgaaccaatttgaaaacagcatgagacgcgtcaaggaggacactgccgcccacattgcctctctcaaagcatcgcatcaaagagagatagagaaattgttatgccagaacgccgtggagaactccagttctaaagtggctgagttaaacagaaaaattgcaactcaggaggtcttgattcgccactttcagtctcaggtaaacgaactgcagtctaagcaggagtcacttgtggttagcgaggtgcgtgaagaaattcttcagaaggagattactaagttgctcgaggagttgcgcgaagccaaagagaatcatacacccgagatgaagcattttgtggggctcgagaagaagatcaaacaaatggagatgcggcacgcccagagggaacaggagctccaacaaataatacagcagacacatcaggtggtggagactgaacaaaacaaggaagttgagaagtggaaacgcctagctcagctgaagaaccgtgagctggagaagtttagaacagagctggattccatcctggacgtccttcgcgagcttcaccgtcagggcgtagttgtccccgttgcatttgccgatgaaatgaacgctcctgagtattag

SEQ ID NO: 26923 - DNA, 2751 bp, Artificial Sequence
  Description of Artificial Sequence: Synthetic coding sequence
atggaaacaagccaggagacatcccttttcttggtaaagatattggaggagctggactcgaaacaaaataccgtgagctatcaggacctgtgcaagagcctttgcgccaggtttgatttatcgcagctggctaaattgaggtctgtactcttttataccgcttgcctggacccgaacttcccggctacactctttaaggacaaaatgaagtgtaccgtcaataaccaacagagcaaaaagatcatggtggccgcggacatcgtgacaatattcaacctgatccagatgaacgggggcgccgccaaggaaaaacttcctacaggccgccagaaagtgcgcaagaaagaagccagctttgagagttgccgcagtgacactgaaatttgcaacgctgcagaatgcgagccgctgaactgtgagctcagcgaacgcagcttcagccgcggatatcccattaggcaaagcagcaagtgcaggaaaatggattgcaaagattgcccacagtttgtacccgcgagcgagcccaatttcctgttgggtgtgagcaaggaggtgaaaaatcgagccgcgagtctcgatagattgcaagctctggccccctatagcgtgacctcgccacaaccttgcgaaatgcaacggacatatttccctatgaatatcgagaatgaaagcatttcggatcaagactccctcccgatcaaccagtctatcaaggagaccttcatttctaatgaagagcccttcgtagtgcagtcgtgtgtgcagaagagaaacatatttaaggaggattttcacaacctgatggctgtgagcccatccttagtggggcccatcagcaaggcagagaacgagcatagggagcctcagagccggaaggagccccacaagcctcccttctttaaccactcatttgaaatgccatacaatagccaatatcttaacccggtgtattccccagttcccgataaaagacgagctaaacacgagagcctcgatgacctgcaagccagcacgtatttcggcccaacccccgtcatgggcactcaagaagcgcgccgctgtctcggcaaacctaataagcagactccgtggcctgcaaagtcctggagtttgaacactgaggaagtgcccgacttcgaacggtcgttctttaataggaatccatccgaagagaaacttcactatcctaacgcaagtagtcaaacaccgaatttcccggcccccgagaggagacccacttacctggtgccaaaagatcaacagcctatcctgccgatcgcatatgcagctaagcagaacggcttgaaaagcaaagagatcagtagcccagtggacctcgagaagcacgagcccgtgaagaagtttaaggacaagagtattaactgcaccagcggccagctgagctctgataccagctctgtgggtacccaaaccgaacacgtgctggaacccaagaagtgtcgggacctatgtaccagcggacaggggaagtactctgatcgacatactatgaagcatagcgatgatgactccgaaatcgtgtcggatgatatctcagacatcttccgttttctggacgacatgagcatctccggcagtaccggcgtcatccagagttcatgttacaattcaactggctcattgagtcagttgcacaagagtgactgtgacagtagccctgaacacaatctgacaaagatcgcaaacggggtccccaattcaaagggagacaagggcaataggcctgagaatactcaccatagtgaagaagaactgaaaacctcagtgtgcaaactcgtattacggataggtgagattgagagaaaactcgagtctctgagtggggttcgagacgaaatcagtcaggtgctggggaagctgaacaaactcgaccagaaaatgcaacagccagagaaggtaagcgttcagattgatctgaactctctgacaagtgaggggccatctgacgattccgcaagtccaaggatgttccacgctcatagcgggagccacggacccaagctcgagaacaaccccgattggtgctgtagcgatgctagtggctcgaactctgaaagcttgcgggtgaaagctttaaaaaagtcattgttcacacgcccgagctcacgctcgctcaccgaagagaactccgcgaccgaatccaagatcgcctccatctcaaactcaccgagagactggcgcactatcacatataccaaccgcgtggggttgaatgaggaagagatcaaggacaccggccctggggacaacaaagattggcaccgtaaatccaaagaagcagaccggcagtacgatatccccccacagcacagactaccaaagcagccaaaagacggctttctggtggagcaggtgttctccccccacccttatcctgcgtctctgaaggcacatatgaaaagtaatcctttgtacacagatatgcggttaaccgagctggcagaggttaagcgcggacagcctagctggactattgaggaatacgcgaggaatgcaggcgataagggcaagctgaccgcactcgatctgcagacacaggaatcattgaatccaaataacttggagtactggatggaagacatctatacccctggctacgattctctactgaaacgcaaggaggcagagttcaggcgagcgaaggtgtgcaaaatcgctgcgctgatcgctgctgccgcctgcacggtgattcttgttatcgttgtgccaatctgcaccatgaagagttag

SEQ ID NO: 26924 - DNA, 6534 bp, Artificial Sequence
  Description of Artificial Sequence: Synthetic coding sequence
atggaggaaatactgcggaaactgcagaaggaagcctcaggaagcaagtacaaggcgatcaaggagtcttgcacttgggcattggaaactctgggcggcctcgatactatcgtgaaaataccacctcatgtcttacgcgaaaagtgtctacttcctctgcagctggccttggagtccaaaaacgttaaactggcacagcacgccctggccggaatgcagaagcttttgagtgaggaaagattcgtctctatggaaactgactcagacgagaaacagttgctgaaccaaatactcaacgcagtgaaggtcaccccatcactgaatgaagacttgcaggtagaggtcatgaaggttctgttgtgtattacttatacacccacttttgatctgaacggttctgccgtgctgaaaattgcagaggtctgtatagagacttatataagcagctgtcatcaacgaagtataaatactgcagtgcgggccactctgtctcaaatgcttagtgacttaaccttgcaattgagacagcgacaggaaaacactatcattgagaaccctgacgtgccccaggactttggcaatcaagggagcacagtggagagcctgtgcgatgacgtggtgtcagtcttgaccgtcctctgcgaaaaactccaagccgcaatcaatgactcacagcagctgcagctgttgtacctggagtgcatccttagtgtgttaagttcatcttccagcagcatgcacctgcaccgtcgtttcaccgacctgatctggaagaatctgtgccccgcgctgatcgtgattcttggcaacccaattcacgacaagacaataacgtcagcccacaccagttcaacctccaccagtcttgaatccgactcagcttctcctggggtcagtgatcatggaagaggcagtggctgttcctgcaccgctcctgccctgtcaggtccggtagctagaaccatatactatatcgcggctgagctcgtaagacttgtaggttcagtggactctatgaaaccggtactacagtcactctaccatagggtgctactatatcctcccccccagcatagggttgaggcaatcaaaattatgaaagaaatcctgggctcaccccaacgactctgcgacctggccggacccagttccacagagtctgagtcccgcaaacgtagcattagcaaacggaaatcacacttggacctgcttaagctcattatggatggaatgaccgaagcgtgtattaaaggcggaatcgaggcttgctacgccgccgtatcatgtgtgtgcaccctactgggagcgctagacgagctttctcaaggaaaggggctttctgaagggcaggtgcaacttttgcttctgaggttggaagaactcaaagacggcgctgaatggtcacgagactcgatggaaataaacgaggccgatttcaggtggcaaaggcgcgtcttatctagcgagcacaccccttgggagagtggtaatgaacgatcgctggacatttccatttctgtgacaaccgataccgggcagacaacccttgaaggtgaactcggacagactacaccagaggaccactcaggtaaccacaagaactctttgaaatcgcccgccatccccgagggtaaggagacgctatccaaggtgctcgagactgaggccgttgatcaaccggacgtggttcaaaggtctcatactgtcccataccccgatatcaccaatttcctgtctgtggattgccggacaagaagttacggctctcgatacagcgagtcaaacttctcggtcgacgatcaggacctgtccagaactgaattcgattcctgtgatcaatatagtatggccgcagagaaggactccgggagatctgatgtctccgacatcggtagcgacaattgtagccttgccgacgaggagcagacacctagagactgcctgggtcacaggtctctgcggaccgcagccctgtctctgaagctcctcaaaaaccaggaggcagaccagcatagcgctcggctgtttattcaatctctggagggcctcctgccacgcctgctatcgctaagcaatgtcgaagaagtggacactgcattacagaactttgccagcacattttgttccggtatgatgcactctccgggatttgatggtaacagcagcctgtcctttcaaatgttaatgaacgctgacagtctctacacggctgcccactgcgcattgctgctgaatctgaaattatctcacggcgattattacaggaaacggcctactctggcccctggcgtgatgaaggactttatgaaacaggtgcagaccagtggggtgcttatggtattcagccaggcttggattgaagaactctatcatcaagtgctggataggaatatgctgggtgaggccggatactggggatctccggaggacaatagcctgcccctgattacaatgctcactgacatcgacgggttagaaagctctgctatcggcggacagctgatggcctctgcagccaccgaaagcccattcgctcagagcaggaggattgatgactccactgttgccggagtcgccttcgcccgatatatcctggtcggatgttggaagaacctgatcgataccctgtctacccctttgactggccgcatggctggttcatcaaaaggtctggcctttatactgggtgccgaggggattaaagagcaaaaccaaaaagagagggatgccatctgtatgtctctcgacggactgagaaaagcagcacgcctcagttgtgccttgggcgtcgctgccaactgcgctagtgccctggcacagatggcagctgcgagctgtgtgcaggaagaaaaagaggagcgtgaggcacaggaacctagcgacgctatcacgcaggtgaagctaaaagtggagcagaaactcgagcagatcggcaaagtacagggtgtctggctgcatacagctcatgtcttgtgtatggaggctattttgagcgtgggcctggaaatgggatcccacaaccctgactgctggccccatgtcttccgagtgtgcgaatacgtgggaacattagaacacaaccactttagtgatggggcatcccaaccccccctgacaattagccagccacaaaaggccacaggaagtgctggtctgctgggggaccctgaatgcgaggggtcccccccagagcactctcccgaacagggacgctctctgagtaccgccccagtcgtgcaacccctttctattcaggatctggtccgcgaggggtcccgcggaagagctagtgactttaggggcggctcgttgatgtccggtagtagcgccgctaaagtggtgctgactctgagtacgcaggcggacagactttttgaggacgccacagataagctgaaccttatggccctgggaggattcctttaccagctgaaaaaagcatcacaatctcagctgtttcactctgtgacggacacagtggactattcccttgccatgccgggagaagtcaaatctacacaggatcggaagtcagcactccacctttttaggctgggcaatgctatgctacgtattgtgagatctaaggcccgccctctgctacatgtaatgagatgttggtccctggttgcccctcacttagtggaggccgcctgccataaggaacgacacgtcagtcagaaagctgtaagcttcatccacgatatactgaccgaagtacttacagactggaacgagccacctcattttcactttaacgaagctttgtttaggccattcgagagaataatgcagctggaactatgtgacgaggatgtgcaggatcaagttgttaccagcatcggagaactggtagaggtctgcagtactcagatccagtccgggtggagacccctgttctcagccctggagacggtccacggcggtaataaatctgaaatgaaggaatacttagtcggcgactacagcatgggaaagggtcaggctcctgtgtttgacgtgttcgaagcttttttaaatactgacaacattcaggtgttcgccaacgccgctacatcgtacattatgtgcctgatgaaattcgtgaaggggctcggcgaagttgactgtaaagagatcggcgactgtgcccccgccccaggtgcaccatctaccgacctttgtcttccagctctcgactatctccggagatgctcacagcttctagctaaaatttacaagatgccacttaaaccaatttttctgagtggacgtctggccggactccctcgcaggttacaggaacaaagtgcctcttccgaggacggcatcgaaagtgtactctcggactttgatgatgacaccgggcttatcgaggtttggattatattactcgagcagttaactgccgccgtttctaattgcccgaggcaacatcagccaccaaccctggacctgctgttcgaactgctgagagatgttaccaaaactcccggcccagggttcgggatctacgcagtagtccatctgcttctccccgtgatgagcgtttggttgcgcagaagccataaagaccactcctactgggacatggcatctgccaatttcaagcatgctatcggtctgtcttgcgagctggtggtggagcacattcaatcttttctccactctgatatacgctatgagtcgatgataaataccatgctgaaggacttattcgagctgctggtggcttgcgtcgccaagcctacagagacgatttcgagggtcgggtgttcctgcatacgatatgtgttggtgacagcaggccccgtgttcaccgaagagatgtggcgcctggcctgttgcgcgttgcaggacgcattttcagctacactaaagccagtgaaggacttgcttggctgttttcatagcggcaccgagtcattctccggggaaggctgccaggtcagggtcgccgctccgtcttcatcaccatctgcggaggctgaatattggagaatcagagcaatggcccagcaggtctttatgctagatacccagtgcagtccaaagaccccaaacaacttcgaccacgcccaatcctgccagctgatcatcgaattgccccccgatgagaaacccaacggccatactaagaagagcgtcagcttccgggaaattgtagtttccctcttgtcccaccaggtattgctgcagaatctgtatgatattttgttggaagaatttgtgaaggggcccagtcctggggaggagaagaccattcaggtaccagaggccaaactggctggatttctacgatatattagcatgcagaatctagccgttattttcgatcttctgctggactcttaccgcacggctcgggaatttgacacatcgcctggtcttaaatgtttgctgaagaaggtgagcggtataggcggagctgccaatctgtacagacagagcgcaatgagctttaacatctacttccatgccctggtgtgtgcagtcctaaccaaccaggaaacaattactgctgaacaggttaaaaaagtgctgttcgaagatgatgaacggtctacagactcctctcagcagtgctcctccgaggatgaagatatttttgaggagacagctcaggtgtcaccaccccgtggtaaggagaaacgccaatggcgcgcaaggatgcctctccttagtgtccagcccgttagcaatgcagactgggtgtggttggtcaaaagactgcataagttatgtatggagttgtgtaacaattatatacagatgcacctcgaccttgagaactgtatggaggaacctccaatattcaaaggagacccctttttcatactgccgagttttcaatccgaatctagcacaccttccaccgggggatttagcggtaaggagaccccgtctgaagacgacagaagtcagtcccgtgaacacatgggcgagtcattaagcctgaaggccggagggggagatttgctgctgccccctagtccaaaagtggagaaaaaagacccttcacgtaaaaaggagtggtgggagaacgccgggaataagatctacacaatggcagccgacaaaaccatttccaaattgatgaccgaatataagaaacggaaacagcaacacaatctctcagcatttccaaaggaggtgaaagtggaaaagaagggcgagcctctggggccaaggggacaagactccccacttttgcagaggccacagcatttgatggaccaggggcagatgaggcattccttttctgccgggcctgaattgctgcgacaggacaaacgccctcgctcaggcagtacgggctcatctctctctgtctcggtgagggacgccgaagcccaaattcaggcatggacgaacatggttctgacagttctcaatcagattcagatacttcccgatcagacgtttaccgctttgcagccagccgttttcccctgcataagccagctgacctgccacgtgaccgacatccgagtccgccaggctgtgcgggaatggctcgggcgggtgggaagagtctatgacatcatcgtatag

SEQ ID NO: 26925 - DNA, 3042 bp, Artificial Sequence
  Description of Artificial Sequence: Synthetic coding sequence
atggccgagccagggcacagccaccacctatccgcccgggtccgaggccgaactgagcgaaggatccctcgcctgtggcggctgctcctgtgggccggcactgccttccaggtaacacagggaacgggccctgaactgcacgcctgcaaggaaagcgaatatcattatgaatacactgcatgtgactcaacaggctccagatggcgggtggcagtgccacacacaccggggttgtgcacttcactgcccgatccaattaaaggcactgagtgctccttttcctgtaacgctggcgagtttctggatatgaaagaccaaagctgtaagccatgcgccgagggccgctattctctgggtaccggaatcaggtttgacgagtgggatgaacttcctcatggttttgcctccctctccgccaatatggagctggatgacagcgccgcagaatcaacggggaattgtacatcttccaagtgggttccgcgcggggattacatcgcctcgaacactgatgagtgcaccgcaacactaatgtacgccgtgaatctgaaacaaagcggtaccgttaacttcgagtactattatcccgatagtagcattatctttgaatttttcgtccagaatgaccaatgccagcccaatgcagatgacagtcgctggatgaaaactacagagaagggctgggagtttcactccgtcgaactgaatcgaggaaacaacgtgctgtactggcgcactaccgccttctccgtgtggacaaaggtccctaaaccagtcctcgtcagaaacattgccatcactggggtcgcctacacctctgaatgtttcccatgtaagcctggaacgtacgcggataagcagggtagtagcttttgcaaactctgtccagccaattcctacagcaacaagggtgaaacaagctgccaccaatgcgatccagacaagtacagcgaaaaaggctcttcttcctgtaatgtgagacctgcctgtacggacaaggactacttttatacccataccgcgtgtgacgcaaatggcgaaacccagctaatgtacaagtgggccaaaccaaaaatttgctcagaagatttggagggagcagtgaaactgccagcaagcggggtcaaaacacactgtcctccttgcaacccagggttcttcaagactaacaatagtacatgccaaccctgtccttacggctcatattcaaacggctcggattgtacacgctgtcctgccggcacagagccagcggttggcttcgagtacaagtggtggaacacactccccacaaatatggaaacaactgtcttgagtggcattaacttcgagtataagggtatgacgggatgggaagtggctggtgaccacatctacaccgctgccggggcgagtgataacgactttatgattcttaccctggtggttcccgggttccggcctccccaatcagttatggcggacactgagaacaaggaggtcgcgaggataacatttgtcttcgagactctgtgctctgtgaattgcgaactgtattttatggtaggcgtgaattcaagaacaaacaccccagtggagacatggaaaggaagcaaaggcaaacagagctatacctacatcatcgaggaaaacacgacaacctctttcacctgggcctttcaacgaacaacattccatgaagcaagccggaagtacacaaatgacgtggcgaagatctatagtattaacgtcacaaatgtcatgaatggagtggcttcctattgtcggccatgcgcacttgaggcgagtgatgttgggtcttcttgcacttcttgcccagccggatattacattgatagggactcaggcacatgtcacagctgccccacaaacacaatcctaaaggcccaccagccctacggggttcaggcctgtgtgccatgcggccctggcaccaaaaataataaaatccacagcctgtgttataatgattgcaccttcagcaggaacacacccacccggacattcaattacaactttagcgccctggccaacaccgtgacacttgccggaggtccgagtttcacttctaagggcctgaaatacttccaccatttcacactgtctctctgcggcaaccagggccggaagatgagcgtgtgcactgacaacgttactgacctccggattccagagggggaaagcggcttttcaaagtcaatcactgcgtacgtctgccaggccgttattatacctcccgaagtcaccggctacaaagccggggtgtctagtcagcctgtttccctggctgatcgtctgattggcgtcacgaccgacatgaccttggacggaataacctccccggccgaactctttcatctggaaagcctgggcatccctgatgtaatcttcttctaccggagtaatgacgtcacccagtcctgtagctctggcaggagcaccaccattcgggtgcgttgttcaccccagaagaccgtgcccggctcactccttctccccggcacatgtagcgatggtacctgtgatggttgtaactttcattttttatgggagagtgcagccgcatgtcctttgtgtagtgtagcagattatcacgctatcgtttcgtcctgtgtggctggtatccaaaaaacgacctacgtctggcgagagcccaaactttgtagtggcggcataagcctgccggagcagcgagtcactatctgtaaaactatcgacttctggttgaaggtcggtatttcagcaggtacgtgcaccgccatcctcctcaccgtccttacatgctatttctggaagaagaatcagaagctcgagtataaatattcaaagctggtgatgaacgctacactaaaggattgtgatctccctgccgcggacagctgcgccataatggaaggggaggacgtcgaagatgacttaattttcacctccaagaagtccctgttcggcaaaatcaaatctttcactagcaagcgcacccccgacggatttgactccgtgcctctgaagacctctagtgggggactcgacatggatttgtag

SEQ ID NO: 26926 - DNA, 1869 bp, Artificial Sequence
  Description of Artificial Sequence: Synthetic coding sequence
atggctacagtgttgtcccgtgcattgaaactgccaggaaagaaaagccccgacctgggcgagtacgatcctctcacccaggccgatagtgacgaatccgaagatgatcttgtattgaacctgcagaagaacggaggcgtcaagaatggaaagagccctcttggagaggcccccgaacctgacagtgacgccgaagtggccgaggctgccaagccacatctgagcgaggttacaactgagggctatccatctgagccccttggtggcctggagcagaaggcagcctctagcctcgtgtcttacgtcagaacctctgtgtttctgctcactctaggcatctctatgatcctcgtcctgctctgcgcttttctgattccatgtccacctcgggatctccattccacttggtcaagacatcttggtagtcagggagggggggatctgagcccactggaactggccgacgtgaacggcgacggtctcagggacgtccttctgtcttttgtcatgtcaagaaacggaagcgcagtaggcgtgtccaggccagccgccaacctggtttgcctgtccggaatgaacgggagcacactatggtccagtcttttgccagaggaggctcgcgatattacttgtctggagctgatgcctggcagcctcgccgaaaccatttgcttagtaacgggcacccataagatgctctccgcttttaacgcaacaagtggtaaggcgatctggactctcaatccgaattacctgagtaacggcaccctggctgctccagtcgtcgtgctgcccgatctcgacgaagacggcgtgcgggacttggtcgttttggcaataggcgaactccagcctgatctctgcttcctgctggtcagcgggcggactggcaacccggtgggtagacctgtaaagtacaacattgtgggcgttggcaatctgatcgggccacaggtgtatatcactactaacggcgctgtgtacattctctttggcttcggcaacattcaggctgtagcgctgagagatatatttgtgcaggcgcagaatcgggactcttcacctccatccctccaaatagaagagccagagtgggagaaacgtcgatctatcaatttgtctgaactgatcgacgtgtattcagatggagtggaactacttcaaatggttaaagccccagattccaactgcagcaacctcctgatcacaacgcggcagtctctagttctgctccgggggcaaaatcttaccccatactgggcactgcgattgcagggactgaggagccagcctactccggggtattttactgatgatcagaccttggatttcctgcttcagattcaggacggtgtgggaatgaaaaagatgatggtcgttgatggagactctggcagcatcgtgtggtcttatcgcgccccctgccacatgaaagaaacaccagccaccagcgctgtgacctctgatcagaagagtgtttttcttttctgggctgagggcctctctgctgcctctcctaattcagacataatcctcggcactgaaccaccctccttgcatcatttgtatctgttgcatcctgcctttccctccatcctccttgacctggcaaatactacaggaaccgtcaccgcatccgaagtggggattaatgatttatggaaagatgcgttctatgttaccaggacaaccgggccctccagcgaaggccatcctgccgctctggtggtcagtaagttgtctcttagatgggcacttatggaaggacaaatggcccagcttcaggaaagtactccaaaaatcgggcgcggagaactccgaagatttctgtccagaatcaaatttgtggaggcaccatacgagatatag

SEQ ID NO: 26927 - DNA, 1869 bp, Artificial Sequence
  Description of Artificial Sequence: Synthetic coding sequence
atggcgacggtgctgagccgggccctgaagctgccagggaaaaaatcacctgacctgggagagtacgacccattgacccaggcagattcggatgagtcagaggacgatttggtactgaacctgcagaaaaacggcggggtgaagaatggaaaatctccattgggagaagcgcctgagcctgatagcgatgccgaggtagctgaagccgcgaagccacacctgagtgaagtgacaacagaggggtacccaagtgagccattgggcggacttgagcaaaaggctgcctcatccttggtcagttacgttcgaacatcagtgttcttgcttaccctgggtataagcatgatcctggtgctgctgtgtgcctttttgatcccttgtccccctcgcgatcttcattccacctggtcccggcatctggggtctcagggcggtggggacctgtcacctttggagctggcagatgtaaacggcgatgggttacgcgacgtcttgttatcttttgtgatgtcaaggaatgggtccgccgtgggtgtgagtaggcctgcagcgaatctcgtttgcctgtccggcatgaacgggagcacactgtggagcagccttctgcccgaagaagcaagggacatcacatgcctggaactcatgcctggttccctggctgaaacgatttgcctagtaaccggcacgcataaaatgctatccgcatttaatgcaacgagcggtaaggccatttggacattgaacccaaactaccttagtaatggcacgctggcggctcccgtggtcgtcttaccagatctggatgaagatggagtgagggacctcgtcgtactggctatcggggagctgcaacccgatctctgcttcctgttggtttctggcagaaccggcaatcccgtgggcagacccgtcaaatataatatcgtgggcgtgggaaacctgataggcccccaggtttacataaccaccaacggcgccgtgtacattctatttgggttcggcaacatccaggctgtggcacttagagatatttttgttcaggctcagaatagagactcgtctcccccttccttgcaaatcgaggagcccgagtgggagaagcgtcgtagtatcaatttgagcgagctaatcgacgtctatagcgacggtgtggaactgttgcagatggtgaaggccccagatagcaattgcagtaacttattaatcaccaccaggcagtcactggttctgcttcgtggccagaacctgaccccgtattgggctttaagactacaaggattgcggtcacagcctaccccaggttatttcactgacgatcaaacacttgacttcctcctccagatccaagacggggtggggatgaagaaaatgatggtggtcgacggggatagcgggtccatcgtgtggtcatatcgggctccatgtcacatgaaagaaactccagctaccagcgcagtcacgagcgatcagaagtccgtgttcctcttttgggccgaaggcctttcggcagcctcaccaaattccgacattattctgggaactgaacccccctcactgcaccatttataccttctgcaccccgcttttccctcaattctgttggatcttgcgaatactacggggactgtgactgcctcagaggttggcattaatgacctctggaaagatgccttttacgtgactagaaccacaggcccttcaagtgagggccatcccgccgctctcgtggtcagcaagttgtcactcagatgggcactgatggaaggtcagatggctcagctgcaggaatccacgccaaaaatcgggcgcggtgaattgcgaagatttctctcccgtattaagttcgtggaggctccctacgagatttag

SEQ ID NO: 26928 - DNA, 600 bp, Artificial Sequence
  Description of Artificial Sequence: Synthetic coding sequence
atgacctcatgtggccagcagtccctcaacgtgctggctgttctgtttagccttctcttcagtgccgtgctgagcgcccactttcgggtatgcgagccctatacagatcacaaggggagatatcactttggcttccattgtccaaggcttagcgacaacaaaacattcatactgtgctgccaccacaacaacacagtgttcaaatattgttgtaatgaaacggagttccaggcggtaatgcaggctaacctgacagcctcctctgaaggatatatgcacaataattatacggcactgttaggtgtctggatttatggattcttcgtgctaatgctcctagtccttgacctcctgtactactccgctatgaactacgatatttgtaaagtgtatttagctagatgggggatccagggtaggtggatgaaacaagatccccgacggtggggaaacccagcccgtgcaccgcggccagggcagcgggcaccccaaccccagcccccacctggtcccctcccacaggctcctcaggcagtccatacactgcggggagacgcccacagtcctccactgatgacctttcagtcttccagcgcctag

SEQ ID NO: 26929 - DNA, 3543 bp, Artificial Sequence
  Description of Artificial Sequence: Synthetic coding sequence
atgacattgcaaggcagggccgacctgtcagggaaccagggcaacgccgccggacggcttgctacagttcatgagcctgttgtgacccagtgggcagtgcatcctcctgcaccagcccatcccagcttgctcgacaagatggagaaagcccctccccagcctcaacatgaagggctgaagagtaaggaacacctgccacagcagcccgctgagggcaaaacagccagccggagagtgccccggctgagggctgttgtcgagtcgcaggctttcaaaaacatactggtggacgagatggatatgatgcatgcacgggccgcaacactaatccaggccaattggcgtggctactggctcagacaaaaactgataagtcagatgatggccgctaaggcaatccaagaggcctggcgtaggttcaataagcgtcacatcctccactccagtaagtctttagtgaagaagaccagggctgaagaaggagacatcccgtaccacgccccccagcaggtccgattccaacaccctgaggaaaacaggctcctctctcctccaatcatggtgaataaggagacacagttccctagctgcgataacctcgtcctttgccgcccgcagtcctcgccactgctgcagcctcctgctgcccagggcacccccgagccctgcgtgcagggcccccatgcggcacgagtgaggggactcgcctttctgccgcaccaaacagtgacgattagatttccctgcccggtctcccttgatgcgaagtgccagccctgcctcctgacgcgcactattaggagtacctgcctcgtgcacatcgaaggcgacagtgttaagactaaaagggtgagcgcccgtaccaataaggctagggccccagagacaccactgtctaggagatatgatcaggctgtgactaggccctctcgagcacagacgcagggccctgtgaaagctgaaactcctaaggccccatttcagatttgtccaggccccatgattaccaagacactactgcaaacgtacccagtcgtaagcgtgacactgccccagacatatcccgcatcaaccatgactaccactccgccgaagacttcacccgtccctaaggtcaccattataaagacccccgcccaaatgtaccccggccccaccgtcaccaaaacggcgccccacacatgtcctatgcctactatgaccaagatacaggttcatcccacagcatcccggacagggacccctcgacagacttgcccggccacaataactgctaagaatagacctcaggtgtctctgcttgcgagcattatgaagagcctcccgcaggtgtgtcctggacccgccatggctaaaacaccgccccagatgcatccagtcaccactccggcaaagaatccgctgcagacctgcctctcagcaacaatgtcaaagaccagtagtcaacggagcccagtgggagttactaaaccctcacctcaaacaaggttgcccgctatgatcacgaaaacacctgcccaactgaggtctgtggccacgatcttgaaaaccctgtgcctggccagccctacagtggctaatgtgaaagcacctccccaggttgcggtggcagctgggacccccaacacctccggcagtattcacgaaaatcctcccaaggccaaagctactgtcaacgtgaaacaggccgctaaggtggttaaagcttcatctccttcttatctcgcagaggggaaaattagatgccttgcacagccccacccaggcaccggggtcccccgggctgctgcagaactgccactggaagccgagaaaatcaagactgggacacaaaagcaagctaaaaccgatatggccttcaagacttccgtggctgtcgagatggcaggagcgccttcatggaccaaagtggcagaggaaggagataagccaccccatgtgtatgtgccagttgacatggcagtgactctgcccaggggccagctggccgctcccctcaccaatgcttcctcgcagcgccatcctccttgcctatcccaacgcccactggccgcaccactgaccaaggctagttcccaaggccacttgcctactgagctcacaaagacaccttctctggcacatctggatacgtgtctttcaaagatgcactctcagacccacctcgcaactggcgccgtaaaagtgcagagccaggccccactggccacttgcctcacaaagactcagtcaagaggtcagcccataactgacattaccacatgcctgattccagctcaccaggcggccgatctctcctctaatacccactcacaggtactgctgaccggatccaaagtttccaaccatgcctgccagcgcctgggcggattgagtgctcctccctgggcaaaacccgaagaccgccagacacagccccagcctcatggccatgtgccggggaagacaactcagggcgggccttgtcctgccgcttgtgaggtacagggcatgctggtaccgcctatggcaccaaccggccactctacttgcaatgtggagtcttggggcgataatggcgccacccgcgctcagccgagtatgcctgggcaggctgtgccctgccaggaagacaccgggccagccgatgccggcgtggttgggggccagtcgtggaatcgggcgtgggagcctgctagaggggccgcaagctgggacacttggcggaacaaagcggtggtgccccccaggcggtcaggcgagcccatggtcagtatgcaagctgcggaggagattcggatcctggctgtgattacaatccaagctggcgtacgtggctaccttgcacggcggaggataaggctgtggcacagaggtgctatggtgattcaggcaacttggagaggttaccgggtccgccgcaacctagcacatctgtgcagggctacaacgaccattcagtctgcttggcgcgggtattccacaagaagggatcaggcgcgccattggcagatgctccaccccgttacttgggtggaacttggctcccgggcgggggtcatgtccgatcgatcctggtttcaggatggcagagctagaacagtgtctgaccaccggtgtttccagagttgccaggcccacgcctgtagcgtgtgtcatagcctgtctagcagaataggatctcctccgagcgtggtaatgctggtgggtagttccccgcgtacctgtcacacctgcggtaggacacagcctacccgggttgttcaagggatgggccagggaaccgaaggtccaggagccgtttcctgggcttccgcctatcagctcgctgcacttagtcctaggcagccgcatcggcaagataaggctgcaacggcaatccagtctgcttggcgcgggttcaaaattaggcagcagatgcgacagcagcagatggccgccaaaattgtgcaggcgacttggcgcggacaccacaccagatcctgtctgaaaaataccgaagccctattaggtccagcggatccaagtgccagctcacggcacatgcactggcctggaatttag

SEQ ID NO: 26930 - DNA, 5406 bp, Artificial Sequence
  Description of Artificial Sequence: Synthetic coding sequence
atgtccgacgatatcagaaagcgcttcgaatttcctaatagcttaattcaatcacaggctgtcgggcacctaattgccgcagtcctcaaagaaaacggcttctcagaaaagatacaccagtctaccaaccaaacccccgcccttaacctcctgtgggagaagtgctgttctgacaatgttgttgtgagaacagcttgttgcgagggactagtggcactggtcgcgcaggaccacgccgaattcagttacgtgttaaacggtatactgaatcttattccttcgacacgcaacactcacggcctgattaaggctatcatgcacctcctgcagatgcaagcactgaaggaaggtcagggtggcgaaaagaatatccaatccatttacacaataaggaatcatccacacccgcttatcaccgtgctggagcatcggcccgactgttggcccgtatttctgcagcagctcaccgctttttttcagcagtgcccagaaaggcttgaagttagctgcatccaaatcatggcgccctttctttggtacctgtactgcgagcctagccaactacaggaatatgctaaattgcggctcgccctgctgaaagtgctgttacaaccccaggtcctctgtgacaaagatcagcctagcatactggagcagcagattctgcagttatgttgcgatatagtgccatgtctgcaggtgaaggatctcatccaaaccactgaggctatgatgttcatagaagaggtctgccttagccttttaaggcaccctgtgttttggaagattcagttgactcagatgagcttacagcttttatgcgtgtccgaggtctccctgaagatcaccggtgaatgctcttcctccatacatctgctcgaacacagcgtcgagttgctcaaagaggatttcccggtggaactcgtcataattgggattgccttactgctgctgcaaactccggcttcccagcagaagcccatcctcaacctcgcccttaagttgttatcggtaaccgaagaccagaaaatccctaagtcatccttgctgctggtcatgcccatcctgcagatcttgagctcaaccgccttggaggattgtatttctgtcgatgaagagggaccaagccgccagcagttagccctcaatctgctggagatgatccagcaggagtgctaccgcgatgatcaccagaagctttcttacaaactggtgtgtcccgtgacaagcatgtatggtaccatatttactgcatggagaatcttggaagtaatgaccgacagctctgctgcatctgactggctggcctctgtagaaagtctcctgccaatcaccgccgtgataccagcacccgcattcttactcctggctcatctacttgtggaggataaagggcaaaatttacaccagattttgaaagtgactacagaactggctcaggctgattcatcccaggtgcccaatctgatacccgtgctaatgttcaaacttggtcgacccctggagcctatactgtataatgatattctgtatactctcccaaaattgggcgtccataaggtttgtattgggcagattctgcgcatcatccaacttctgggtaccacccctaggctgcgggctgtgacgctgagactccttaccagcctgtgggaaaagcaggacagggtatacccagagctacagcggttcatggcagtgtccgacgttccatccttgagtgttggaaaggaagtacagtgggaaaagttaatcgccaaagcagcatccatccgggacatatgtaagcagaggccatatcagcatggggccgatatgctggctgcgatctcccaggtcctgaacgagtgtaccaaacccgatcaagccacgccggccgccctggtcttgcagggattgcacgcactttgtcaggccgaagtagtgtgtatccggtccacctggaacgccctctcccccaagcttagttgtgatacgcgccccctcatcttgaagacactgtccgaactctttagtcttgtgccatccttgacagtaaatacaaccgagtacgaaaactttaaggtgcaggtgctctcgtttctctggacacacacccagaacaaggatccgattgtggccaatgctgcatataggagcttagcgaatttcaccgctggggagcacaccattctacatctgccagagaagattcggcctgagattcccattcctgaagaactcgacgatgatgaggatgtggaggacgtcgatctgtccgtgccagggagctgttacttaaaactcttatccctcactccacccctggtgttaccagcactggaggagtttttcacgtcactcgtgaaacaggagatggtcaatatgcctagagggatttaccacagcgccctgaaaggtggcgctaggagcgaccaggggaagactgtcgctggaatccctaatttcatccttaaaatgtacgaaaccaacaaacagcctgggttgaagcctggcctcgccggcggcatgctgttttgctacgacgtgtctatgtatcagagcaaggatggcaaacccctgaacagattgatggccagccgcggtaggtccttcaagcagacgagcttagcgttggtccatgaagtgcatattcagctaagcgagtggcacagggctatcttcctgccccaggcctggttagcatacatgaacagggcatatcatgctatactgcagggcagactgggtgagcttgaactccagctgaaacacggcaaagaggaaccagaagaggtccagtataagaaatcgactgcctggctgtgggtccgagacatgctgacagatgagatcaccaaagctgctgccaaggaaagccccgtggttaaaggaaatgctctgctggcactttccagccttgcagtagttgtttcccggcacgaagcaagcttgtcctctgactcggacggactgctggaagtgcagcctaatttccttagcatgaaagagtgggtgtctatggtcttggataccctcttggtgatcgtggattcccattaccagcctaggggccaactcctctcttggttttactataagtcatacagcggtgagaacaccgcatccgcgatcgccaggagcgctgccgctactgcattgtcgctcctggtcccggtcttcattatcagctgcaaagagaaagtggaggagatattaaacatgctcaccgcgcggctcccaggaaagcctagcgccgatgaaagccaggccgtgcagatccatatgggccttgctctcgggatgttcctgtctagactgtgcgaggaaaaactgtctgatatcagcggacaggagatgaatttgttacttatgaagtcgcttgacgcccttgaaaactgctgttttgacactagcctcgaatacaacactggctgtattcttggcgtagggctcgtcctctctcttatgagccactcctctcaaatgcaaagtagagtgcacgtcgcagccctgctgcgtaagttgtctgcccacgtggacgatagtggttcacaaagtaggaccttccaagaggtgttggcttacacactgagctgcgtgtgcaccagcgctttcagcgcaggaattatagaagccactgaggccgaggatgtgatgaataagttgcgcttactggttgagaacagtcagcagaccagcgggttcgcccttgcacttgggaacatcgtgcacggccttagcgtatgtggccacggcaaagcagaggatcttggatccaagctgctgcctgcttggatccgcatagtgctgaccgaggggaccccaactatgctgtgcctggcagcgctccatggcatggtcgcactggtcggcagcgaaggagacgttatgcagctgaaaagtgaggctattcagactagccactttcagggccgtctgaatgaggttatacgtacactgactcaagtgattagtgtgtccggcgtaatcggactgcagagcaatgctgtgtggctgctgggccatctccatcttagtaccctgtcatcatctcagtctagggcctcggtgcctacagattacagctacttgcctgaatcgtcatttatcggagcagccatcggctttttcatcacaggaggcaagaagggcccagaatctgtccctccatcactacttaaggtggtgatgaagccaatcgccacagttggcgagagctaccagtacccccccgtaaactgggcagctctgctatccccactcatgaggctgaacttcggggaggaaattcagcagctctgcctggagataatggttacacaggcccagtccagccagaatgctgccgcactgctgggactatgggttaccccccccctcatccatagcttgtcccttaacacaaagaggtatttgctaatatccgcacccctgtggatcaaacacatttccgacgagcagatcttgggctttgtggagaatctcatggtcgctgtttttaaggcagcttcaccactcggctcgccggaactgtgtccaagcgccttgcacgggttgtcacaagccatgaagttgccctctccagcccaccacctttggtccctcctgagtgaggcaactggaaaaattttcgatctgttgcccaacaaaatccggagaaaagatctagaactctacattagcatcgccaagtgcttgctcgaaatgactgacgatgatgcaaaccgcatcgcccaagtaacgaaaagcaatattgagaaggccgcctttgtgaagctgtatctcgtaagccaaggcagatttccactggtaaatcttacagatatgctaagcgtagcagtgcaacacagggagaaagaggtgttggcttggatgattttgcacagcctgtaccaggcccgcatcgtttcccatgctaatactggggtcctgaagcgcatggagtggctgctggagttgatgggctacatacgcaatgtagcgtatcagagtactagctttcacaacactgctctggataaggctctggacttctttttattgatattcgcaaccgctgtggttgcctgggcagaccatactgctccactactcctcggactcagcgcttcctggctgccctggcaccaagagaacggacctgccggaccagttccatccttcctcggaaggtctccaatgcaccgtgtcacactgcaggaggtccttacattattgcccaactctatggctctgttgctccagaaagagccatggaaagaacagacccagaagttcatagattggctgttcagtattatggaatccccgaaagaggccctatccgcccaaagcagagaccttttgaaggctacactcctgtctctccgggtgctgccggaattcaaaaaaaaggccgtgtggactcgagcttatgggtggtag

SEQ ID NO: 26931 - DNA, 5406 bp, Artificial Sequence
  Description of Artificial Sequence: Synthetic coding sequence
atgagtgacgatattaggaagcgcttcgagttcccaaattctttaattcagtcccaagccgtcggccacctgatagccgccgtcctcaaggaaaacggctttagtgaaaagattcatcaatccaccaatcaaacaccagccctgaacctgctatgggagaaatgctgttccgataatgtagtcgttcggacggcatgctgtgaaggtcttgtggccctagtggcacaggaccacgccgaattttcatacgtgctaaatggaattctaaacttaatcccctcaaccaggaacacccatggcctgatcaaggctattatgcacctgttgcaaatgcaggccctcaaggagggccaggggggcgagaaaaacattcagtcaatatataccatccggaaccatcctcatcctcttataacagttctggagcataggcccgactgctggccggtttttctgcaacagcttaccgctttcttccagcagtgcccagaacgcttagaggtgtcctgcatccagattatggccccatttttatggtacttgtattgcgagccatcccagctccaggaatatgcaaagctgcgactcgccctgctgaaggtgctcttacagccacaggtgctatgcgacaaggaccagccatctatcctcgagcagcagatattgcagctgtgctgtgatatagtgccctgtcttcaagttaaagatctgatacagacaacagaggcaatgatgtttattgaggaagtctgtctaagcctgctccgccatcctgtgttctggaagatccagcttacgcagatgagtttacaattgctgtgcgtgagcgaggtttctctcaaaattacaggtgaatgcagttccagtatacacctgctcgaacattcagtcgaattgttaaaggaggacttccccgttgaacttgtcattatcgggattgcactacttctgctacagaccccggcaagtcaacagaagcctatactgaatttagccctcaagcttctgtcggtcaccgaggatcagaagataccaaagtcttccttgctcctggttatgccaattctgcagatactgagttcaaccgccttggaagactgcatttcagtggacgaggagggaccttcccggcaacaactggctctgaatctgctcgagatgatccagcaagaatgctacagagatgatcaccagaagttaagttataagctggtgtgcccggttactagtatgtatgggacaatcttcaccgcatggcgtatcctcgaggtcatgacagacagtagtgccgcctctgactggctggcgtcagtggaaagcctcttgccaataaccgctgttattcctgcccctgcatttcttctcctggcacacttattagtggaggataaaggtcagaatctccatcaaatacttaaggtgaccacagagcttgcacaggcggactcgagccaggtgccaaatttgattcccgtcttgatgttcaaattaggccgccctctggaacccattttgtataacgacatcctctatacgcttcccaagttaggggttcacaaggtatgcattggccagattctgcggattatccagctgctgggaacaactccacgcttacgagctgtaaccctcagattgctcacttctctctgggagaagcaggatcgcgtgtaccccgagctgcaacgctttatggcagtgagcgacgtgccatctctgtccgtgggaaaagaggtccaatgggagaaattgatcgccaaagcagcgagcatccgggacatctgtaaacagagaccataccagcacggtgccgacatgcttgcggccatctctcaggtactcaacgagtgcacaaaaccggatcaggccacgcctgccgccttagtgctgcaaggtctgcacgccctgtgccaagcagaggttgtctgtattcgctccacctggaacgcactgagccccaaactatcttgtgatacaagacccctgatactgaagacgcttagtgagttatttagcctggtcccttctctcacagtaaatactactgagtatgaaaactttaaggtgcaggtcctatctttcctctggacgcacacccagaacaaggatcccattgtagccaatgccgcttatagatctttggctaactttacagctggagaacatactattcttcatcttcccgaaaagatccggcccgagattccgattcccgaggagcttgacgatgacgaagacgtcgaggatgtggatctcagcgtccctggtagctgctatctgaagctgctgagtctcactcctcctctcgtactccccgccttagaagagttctttactagcctggtaaagcaagaaatggtgaatatgccgagaggcatttaccatagcgcgctaaaaggtggcgcccgctctgaccaaggaaagacagtggccggcattcctaatttcatcctgaaaatgtatgagactaataagcaacccggcctgaagcccgggctcgcaggaggtatgctgttctgttatgacgtgagcatgtatcagtcaaaggacggcaagccccttaatcgactgatggcgtcccgcgggcgttctttcaagcagacctcgctggcccttgtgcacgaggttcatattcagctaagcgaatggcatcgggccattttcctgccccaagcttggttggcgtatatgaatcgggcgtatcatgcgattctgcaggggcggttgggggagctggagctccagctgaaacacgggaaagaggagcccgaggaggtgcagtacaagaagtctaccgcttggttgtgggttcgtgacatgctgaccgatgagattactaaagccgcagccaaagagagtcctgttgtgaaagggaatgccctgcttgctttaagttctctcgccgttgtggtgagccggcacgaggcttcactgagcagcgatagcgatggactcctggaggtccagccgaatttcctttcaatgaaagagtgggtgtctatggtgctcgacactttattggtgatagtcgattcacattatcagccccgcggtcaactgttgagttggttctattacaaatcttattctggagaaaacacggcttccgccattgccaggagtgctgccgccaccgccctgtccctgcttgtgccggtgtttataatttcatgtaaagagaaggtggaggagatcctcaatatgctgaccgctaggctcccaggaaaaccttctgcagatgagagtcaggcagtccagattcatatggggttggccttagggatgttcctcagccgattgtgcgaagaaaaactgtcagatatctcaggccaagagatgaacctgctactgatgaaatccctggatgccctggaaaactgctgttttgacacatccctggaatacaacacaggttgcattctcggcgtggggctggtcttatcccttatgtcacactcttctcaaatgcagtcccgcgtgcacgtcgccgccctgcttcggaagctgtccgctcatgttgatgactctgggagtcagtccaggacttttcaggaagtactcgcttacacgctgtcttgcgtgtgtacgtccgccttctcggcaggcatcattgaggcgaccgaggcagaggatgtgatgaacaagctgagactgctcgtcgagaacagccagcagactagtgggttcgcgctggcactggggaatattgtccatggactttcagtgtgcgggcatgggaaggccgaggacctcggcagcaagctgctgccagcatggattagaatagtcttgacggaaggaacacctactatgctttgtctcgcagccctccatggcatggtcgccctggtgggaagcgagggcgacgtgatgcagctgaaatcagaagccatacagactagccactttcagggacgattgaatgaggtaattcgaacactgacccaggtgatctccgtatctggggtcattggcttgcagagcaatgcagtgtggctcctagggcacctgcatctgagtacactctcaagttcccagtcacgggcctctgtgcccacagattatagctacctccctgagagctcgtttatcggcgccgctatcggcttcttcatcacaggaggcaaaaaaggccccgagagtgttcctccttcccttttgaaggtggtgatgaagcccatagctactgtaggagagtcgtatcagtaccccccagtgaattgggctgccctgctaagtcctttgatgagactcaacttcggggaagagatccagcagctttgcctagagataatggtgacgcaggctcagagctcccaaaatgcagctgctctccttggtctatgggtgacaccgcctctgattcacagcctatctttgaacaccaagcgctacctcttaatatccgcacccctgtggatcaagcatattagcgatgagcagatactcggcttcgttgagaacctgatggtcgccgtgtttaaggcagccagccccctggggagcccagaattgtgtccgagtgcattacatggactgtcccaggccatgaagctgccgtcccccgcacatcacctttggtctctcctcagtgaagccaccggtaagattttcgacctcttgccaaacaagattcgccgcaaggacttggaattatacataagcatagcaaagtgtcttctggagatgaccgacgacgatgctaacaggattgcacaggttaccaagtctaatattgagaaagccgcttttgtgaagttatatttggtatcccagggaagattcccattggtgaacttgaccgatatgttgagcgtggcggtccagcaccgggagaaggaagtccttgcctggatgattctgcattccctgtaccaggccaggattgtatctcacgccaacactggggtcctgaagaggatggagtggcttttagaactcatgggatatatccggaatgttgcataccaaagcacgtccttccacaatacggcactcgataaggccctggatttcttcctgctgatctttgcaactgccgttgtggcatgggcagatcatactgcgccattgttgctgggtctcagtgcttcatggctcccttggcaccaggagaacgggcccgccgggcccgttccttccttcctgggtcggtcacccatgcacagagtgaccctgcaggaggtgttgactttacttcccaactccatggcattactactacaaaaggaaccatggaaagaacagactcagaaattcatcgactggttgtttagcatcatggagtcgcccaaggaggccctttcagcacagtcacgtgatctgcttaaggcgacactgctgagtctgagagtactaccagagttcaaaaagaaagccgtgtggacaagggcctatggctggtag

SEQ ID NO: 26932 - DNA, 1557 bp, Artificial Sequence
  Description of Artificial Sequence: Synthetic coding sequence
atgctatgtgcctcatttctgggattagggctgagcgtcgctatcgtcgggccgacctttcaggacctcgcgaccaatgtgaataggaacatatcgagtctttcttttatcttcgtgggccgcgccctgggttatctgagcgggtcagtcattggtggttttctcgtagatgtgatgaactatttcctgttgctgggcatttcaatgagcgctaccacagtgggtctctaccttgtccctttttgcaaaactgctatcctgctcactgttatgatgtctatctttggcgttagcatcggaattcttgacaccgggggaaacgtattaatcttggcaatctggggagacaagggcgccccgcatatgcaggccctgcacttttcgtttgccctaggggccttcctggccccactgctggcaaaactggccctaggaccgactgcgagcgctgaaaatcacacagagtcggactttcacccagcactgaatcagtcatctgacgcagactctgaggctctcttcggagttcctaacgataagaatttattgtgggcctatgccgtaataggaacatacatgttcctcgtatctgtgatcttcttctgcctgttcctgaagaattcgtccaaacaggagaaagctagagcctccgctgaaacattccggcgcgctaaatatcacaatgcactgctctgtctcctgtttctgttcttcttcttttatgtcggggccgaagtcacatatggaagctacgttttcagctttgctaccacacatgctggcatgaaggagtcagaggcggccgggctgaactccatcttttggggaactttcgctgcctgcaggggtctggccattttctttgccacgtgcctgcagcccgggactatgatcgtgctgagcaatatcggtagcctgaccagctctctgtttttggttctctttgacaagaaccctatttgcttatggatcgccacctctgtttatggggccagcatggcaaccactttcccgtctggggtctcttggattgagcagtacactaccattcacggaaagagcgccgccttctttgttatcggtgcgtctcttggtgagatggccattcccgccgttatcggcattctccagggtaaatacccagacttgcctgtggtgctctacacatccttgggcgcttctatcgcgacaggcattctcttccccgtgctctataaactggcgacgtccccattggatagacaacgcaaagaggatcgcaaatccgaagatcaaaaggctttactgtcaagtagtggacttaacgagtatgaggaggagaacgaggaggaagacgcggaaaagtggaacgagatggattttgaaatgattgagactaacgacacaatgcgccatagcatcattgagacaagcaggtccagcctgacggagccaacggcagaggtctataaccagtaccctagcaatgccctggttttcgaatcatcccctttcaatacgggctcagcacacgtcaaacaccttcccgaaactagaacaaagggaacgaacgtatag

SEQ ID NO: 26933 - DNA, 1905 bp, Artificial Sequence
  Description of Artificial Sequence: Synthetic coding sequence
atgtggctccagcagcgactcaagggcctacctgggctgttatcctctagttgggcccgccggttgctgtgtttgttgggactgctgctgctgcttctgtggtttgggggctcaggcgcaagacgcgcagcaggagggctccacttgctgccgtggtcccgtggcgagccaggtgccgcggaacctagtgcatgcttagaagccgccacacgcgcatggaggggactacgcgaacgcggagaggtcgtgcctttgggcccaggtgtacccgcgctggttgcaaatggattcctggcactggatgtcgctgccaatcgtttatgggtgactcctggagaacgcgaacctgccgtggcacccgattttgttccctttgtccagttgcgccccttatcagccctggccgaggctggggaggcagtcctcttattacgcgagggcctgctcagacgcgtgcggtgtttgcagctcggtagcccgggacccgggcccgtggctgccggccctggcccagccagcgtgagcggcttagctgccggctccggaagagattgtgttttgcttcaggaagatttcctcgcacaccgggggcgaccccatgtgtacctccaaaggattcagcttaacaatccgacagagcgggttgcggccctccagactgttggcccgacggccggacccgctcctaaggcattcaccagcaccctggagaaggtgggagatcaccagttcttgctgtatagtggccgaagcccgccaacacctactgggctggtgcatctagtagtggtggcggcaaaaaagctcgtgaacagactgcaggtcgctcctaagacccagctggacgaaaccgtgctctgggtggtgcatgttagcggaccaattaatcctcaggtgttaaaaagcaaggctgctaaggagctgaaggcattgcaggatctggcaaggaaggagatgctcgaactccttgacatgcctgcagctgaactcctgcaagaccaccagctcctgtgggctcagctgttctccccaggagtggagatgaagaagattacagacactcataccccgagcgggttgacggtcaatctcaccctatactatatgctgtcctgtagccctgcacccttactctccccttcgctttcccatagggagcgcgaccagatggaatccactttaaactacgaagaccattgcttcagcgggcacgctaccatgcacgctgagaatctgtggcctgggaggctcagcagtgttcagcagatattgcagctgtccgacctgtggcggctgacgctgcaaaagcggggctgcaaaggactcgtgaaggtcggcgcccctggtatcttacaggggatggtgctttctttcggtggcctgcagtttacagaaaatcatttgcaatttcaagcggatccggatgtgttgcacaattcttacgcgcttcacgggatacgatacaagaacgaccacatcaatctggccgtgctggcagatgcagagggcaaaccttacctccacgtttctgtcgagagccgcggacagcctgtcaaaatctatgcgtgtaaagctgggtgtttggacgagcccgtcgaactgacctcggcacctactgggcacactttctccgtcatggtcacacagcctattacaccactgctctatatctccacggatctcacgcacctgcaggatctgagacacaccctgcacctcaaagcaatcctcgctcatgatgagcatatggcacaacaggaccctgggcttcctttcttgttctggtttagcgtcgcttcattgatcacactgtttcacctcttcctgtttaaattgatctacaatgagtactgcggaccaggcgcgaagccgctgttcagatccaaagaagacccctctgtgtag

SEQ ID NO: 26934 - DNA, 1233 bp, Artificial Sequence
  Description of Artificial Sequence: Synthetic coding sequence
atgagtctgatggtggtctctatggcctgcgtgggttttttcctgctagaggggccctggccacacgtaggaggccaggacaagccattcctgtccgcctggcctggaaccgtagtgtccgagggccaacatgtgaccctacagtgtaggtcccggctggggttcaatgagttctccctctcgaaagaagacggcatgcccgtgccggaactgtacaacaggattttccgaaacagtttcctgatgggacctgttactcctgctcacgcagggacctacagatgttgctcttcccatcctcatagcccgacaggctggagcgctccaagcaatcctgtggtgataatggttaccggagtacaccggaaaccttcattactggctcaccccggcccattggtgaaatcaggggagacagttattctccagtgttggtcagatgtaaggttcgaacgctttttgcttcatagagaggggatcacggaagatccactacgtctcgttggacagctgcacgacgccggcagccaggtgaactactcaatgggtccaatgacgccggccctcgccggcacttatcgctgttttggatctgtcacccaccttccctacgaactgtccgccccctctgatccgctcgatattgtggtggtaggcctgtacggaaaacctagcctgagcgcgcagccaggccccacagtgcaggccggagagaacgtgaccctgtcgtgctcttcacgttccttatttgacatctaccacctctcccgggaggcagaggccggtgagctccggttgactgccgtcctccgcgtgaatggcactttccaggctaacttcccactgggacccgtgacacatggtggcaactataggtgctttggtagttttagggcgctccctcatgcctggtcagacccatccgaccctctccccgtatccgtgaccggaaactcaaggcacctgcacgtacttattgggactagcgtggtgatcataccttttgccatcctgttgttttttttactacatcgctggtgtgccaacaaaaagaacgccgtagtgatggatcaggagcctgcgggcaaccgcacagtcaatcgtgaggacagcgacgagcaggatccacaagaggtgacctatgcgcaactgaatcattgtgtgttcacacaaagaaagatcacacgtcctagtcagaggcctaagaccccccccaccgatacctctgtgtag

SEQ ID NO: 26935 - DNA, 624 bp, Artificial Sequence
  Description of Artificial Sequence: Synthetic coding sequence
atggagaacgaagacggatatatgaccctgtcatttaaaaacagatgtaagtctaagcagaagtctaaggattttagtctgtacccgcagtactactgtctgctccttattttcggttgtatcgtcatattgatctttatcatgactggaattgatttgaagttttggcataagaagatggacttttcccagaatgtgaacgtcagctcactgtccggacacaactatctttgtccgaatgattggttactgaacgagggcaaatgctactggttttctacttcttttaagacttggaaggagtcccagagggattgcactcagttacaggcccatctcctcgtcattcagaatcttgacgagcttgagttcatccagaactctttgaagcctggccatttcgggtggataggcctatatgttacttttcagggcaatctctggatgtggatcgatgagcactttttggtgcccgagcttttctcagtgatcggccccactgacgaccgctcctgcgcagtgattaccggcaattgggtctactcagaggattgttccagcacctttaagggcatctgccagagagacgcgatcctgactcacaatgggacttctggagtgtag

SEQ ID NO: 26936 - DNA, 1230 bp, Artificial Sequence
  Description of Artificial Sequence: Synthetic coding sequence
atggaggagtcttgggaggccgcgcccggaggtcaggctggcgccgagctgcctatggagccagttggtagccttgtccccaccctggagcaacctcaagtgcccgccaaagtgagacaacccgagggccctgaatcctctcctagccctgctggcgcagttgaaaaagccgccggagcaggactcgagccctcctccaaaaagaagccccctagtccgaggcccgggtcacctcgggttcctcctcttagcttggggtatggagtgtgtccggagccacccagtcctgggcctgcactggtgaagttgccacgcaatggcgaggcaccaggggctgaaccagctcctagcgcatgggcccccatggagcttcaggtggacgtccgggtcaagcctgtcggggctgcggggggttcttcgaccccttcaccacggccatctacgagatttctgaaggtgccagtgcccgaatctcccgccttttcacgacacgccgaccccgcacaccagttgctgcttcgagctcctagccagggggggacctggggcaggaggagtccgctggcagccgcaaggacggagagcgggtgtgatgccgagggaagagcatcaccagcggaaggttccgcaggcagccccggctctccaacatgctgccgctgcaaagaactgggtctggaaaaggaggacgccgctctgttgcccagggctgggctggatggcgatgaaaagctaccccgggctgtgaccttgaccggcctgcccatgtacgtgaagtctttatattgggcactggccttcatggccgtgcttcttgcagtatccggggtagtgatagtggtcttagcttccagggccggcgcccgctgtcagcagtgtcctcccggatgggtgttgtccgaagagcactgctactacttttccgccgaggctcaggcgtgggaagcttcacaggctttctgctccgcctatcatgctaccctgccccttctgtcgcacactcaggatttcttgggcagatatccggtcagccgccactcctgggtcggagcttggcgcggcccacagggctggcactggatcgatgaagcaccccttcctccccaactcctccccgaagacggggaagacaacctggacatcaactgtggagctttggaagagggcaccctggtagcagccaattgcagcactcctagaccctgggtgtgtgctaaaggcacacagtag

SEQ ID NO: 26937 - DNA, 945 bp, Artificial Sequence
  Description of Artificial Sequence: Synthetic coding sequence
atggaagagagttgggaggctgctcccggcggtcaggctggagccgagttgccgatggagccagtgggttccttggtgcccacactcgaacagccccaggttcctgctaaggtgagacaaccagaggggccggagtctagcccctccccggctggagccgtggagaaggcagccggcgctggactggaacctagtagcaaaaaaaaaccaccgagccctcgccctgggtcaccacgcgtacccccactctcattaggctacggtgtgtgtccagaacctccaagtccggggccggcgcttgttaaattgccacgaaacggggaggcgcctggtgctgagcctgctcctagcgcttgggctccgatggaattacaagtcgatgtgcgggtgaagcctgttggcgccgcaggtggcagttctacgccgtcaccccgtccatccaccaggttcttgaaggtcccagttccagagtctcctgccttcagccggcatgctgaccccgcacatcagctcctgcttcgcgcgcctagtcaagggggcacttggggcaggcgcagtcctctcgccgccgccagaacagagtctgggtgtgacgcggaggggcgggcttctccagccgagggctccgcaggatcacccggctcacccacctgttgccgctgtaaggaactgggacttgagaaagaagatgcagcgctgctccctcgcgctgggcttgatggggatgaaaagcttccaagagccgtaacactgactgactctttgaggaccgctaggacgatctggatatccaccgtggggccttggaggaaggcaagatggtggctgcaaactgcagcgctgcaggacccaggcagcgtgccgcgcggaccctcagatctagggtccgcctggtcttctgcgtgtcaggctgacgcagctcctccaaccggggaagcttcatag

SEQ ID NO: 26938 - DNA, 2274 bp, Artificial Sequence
  Description of Artificial Sequence: Synthetic coding sequence
atgctttcccttttagtctggatcctcacactctcagatactttttcccaaggcacccaaactaggttcagccaggaacccgctgatcagaccgtggtcgcaggccagagagccgtcctgccctgcgtgctgcttaattatagcggtatcgtccagtggaccaaggacgggctggcgttgggcatgggtcagggcctgaaggcctggccccgctaccgcgtggttgggagcgctgatgctggtcaatacaacctggaaatcaccgacgcagagctgagtgacgacgcgagttacgaatgtcaggccacagaggcagccctccggagccggcgcgcaaaattgactgtgttgatcccaccagaggacacacgcatagacggcgggccagtgatcttgctgcaggctggcacgccgcataatttgacttgccgagctttcaacgcaaaacccgccgcaacgataatttggttccgtgatgggacccagcaagagggtgcggtggccagtactgagctgctaaaagatggcaaacgagagacaaccgtcagtcagttactgattaatcccactgacctggacatcggtagggtttttacatgcagatccatgaacgaagcaatacctagcgggaaggaaacaagcattgaactggatgtgcaccaccctcccactgtgacgctttctatcgaaccacagactgtgcaggagggggagagggttgtttttacatgccaggccactgccaacccggaaatccttggttaccgatgggcgaaaggaggcttccttatagaggacgcccacgagtccaggtacgaaactaatgtggactactctttcttcacagagcccgtcagctgcgaggtccacaataaggtggggtctactaatgttagcaccctggtgaatgtgcactttgcccctcgcatagtggtagaccctaagccaactaccacagacattgggagcgacgtgactctgacctgtgtgtgggtgggcaaccctccactgactctgacatggacgaaaaaagacagcaatatggtcctgtcaaactctaaccagctcctcctcaaaagcgtgacccaggccgatgccgggacatacacgtgcagggccatcgtcccaagaatcggggtcgctgaacgagaggttcctctgtatgtaaatgggcctccgatcattagttccgaagcggtccaatacgccgtgcgtggcgacgggggcaaagtggaatgcttcattggtagcaccccccctcccgatagaatagcctgggcatggaaggagaacttcctggaggtgggcacactggagcgctataccgtggaacggactaactccggcagtggcgtactaagtactctgacgatcaataacgtgatggaagctgatttccagacacattataactgtaccgcctggaactccttcgggcccggaacggccattattcagctcgaagagcgcgaggtcctgcctgttggcatcattgctggcgccaccattggagcttcaattctcttgatcttcttttttatcgctctagtttttttcctgtaccgaaggcgtaaagggtctagaaaagatgtgactctgcggaagctggatataaaagtcgagactgtgaacagagagcctctcaccatgcattcggatcgggaggacgacacggccagtgtgtctaccgctacgcgtgtaatgaaggccatttattcttcgttcaaggacgatgtcgatctgaagcaggatttgcggtgcgacaccattgatacaagggaagagtatgagatgaaagatcccactaacggctactacaatgttcgggctcatgaggacagacccagctctagggcagttctttatgctgattatcgcgccccaggtccagcccgattcgatggaagaccctcttccaggctctcgcatagtagtgggtacgcccagctgaacacctacagtcgcggccccgcgtctgactacggaccggagcctacaccaccaggccccgccgcaccagccgggactgataccacatctcagctcagctatgagaattacgagaaattcaacagtcacccttttcccggcgctgcaggctacccaacctaccgccttggctatcctcaagctccccctagtggcttagagagaactccttacgaagcctacgacccaatcggtaaatacgccaccgccaccagatttagttacacaagccagcactctgattacggccagcgatttcaacagaggatgcaaacccatgtttag

SEQ ID NO: 26939 - DNA, 1782 bp, Artificial Sequence
  Description of Artificial Sequence: Synthetic coding sequence
atggggcagggcctgaaggcctggcctaggtatcgagtggtagggtcagcagacgccggccaatacaatctggagattaccgacgccgaactgagtgacgacgcttcttacgaatgtcaggcaaccgaagcggccctccgcagtcgacgtgcaaaactgacggtactcaacccaccaaccgtgaccttatcaatcgaaccacagaccgtgcaggagggggagcgcgtggttttcacgtgtcaggctacagctaatcccgaaattctgggctaccgttgggcgaaaggggggtttttaattgaagacgctcacgagtcgcggtacgagacgaatgtggactactccttcttcactgagcccgtgtcttgcgaggtgcacaacaaagtcgggtccactaacgttagcacccttgtaaatgtgcatttcgctcccaggatcgtggtggatcccaagccaacaacaaccgatatagggtcagatgtaacactcacatgcgtctgggtcgggaacccgcccctcactctcacctggaccaaaaaagactccaacatggttctttcaaacagcaatcagctcctgcttaagtccgttacgcaggctgacgctggaacttacacctgccgggccattgttccacgcattggcgtcgcggaaagggaggttccgttgtacgtgaatggcccacctatcatctcctccgaggcagtacagtatgccgttaggggggacgggggtaaagtggagtgttttatcggctccactcctcctcccgaccggatagcctgggcatggaaggagaactttcttgaagtgggtactcttgagcgttataccgtcgagcgaacaaacagtggctcgggcgtgctgtccaccctgaccataaataacgtcatggaagccgactttcagactcactataactgtaccgcgtggaactcctttggacccggcaccgcgatcatccaactagaggagcgggaagtgttacccgttggcattattgctggggcaacgattggagcctccatcttgctcatattttttttcatagccttagtattctttctgtatcgacgcaggaaagggtcccggaaggatgtgacgctgcgtaaactagacataaaagtggaaacagtcaacagagagccattgacaatgcactccgatcgcgaagatgataccgccagcgtgtctacagcaaccagggtgatgaaagcaatctacagctcattcaaggacgacgtcgatctgaagcaggatctgcgatgtgatacgatcgacactagagaggaatacgagatgaaagatcccacaaatggttactacaacgtaagggctcatgaggacagacctagttcgagggccgtcctctacgctgattatcgcgcacctgggccggcaaggtttgacgggaggccttctagtcgcctgtcacacagttccggctacgctcaactgaatacttacagtaggggtccggcctccgactacggccccgagcccacaccaccaggtcccgcagcacccgccggcactgatacaaccagccagctcagctacgaaaactacgaaaagttcaactcccatcccttccccggagccgccggataccctacgtacagattgggctacccgcaagctcctccaagcggtcttgagagaaccccatatgaagcatatgaccccatcggaaagtacgctaccgctacaaggttttcttatacctctcagcatagcgactacggccagcggtttcagcagcggatgcaaacacacgtctag

SEQ ID NO: 26940 - DNA, 2322 bp, Artificial Sequence
  Description of Artificial Sequence: Synthetic coding sequence
atgctatctttgctggtgtggatccttactctttctgataccttttctcaagggacgcagactcgcttttctcaggagcctgccgaccaaaccgtggtagcgggacagcgggccgtgttgccatgcgttctgcttaactattccgggatcgtgcagtggaccaaggatggactggccctgggcatgggacagggactaaaagcgtggcccagataccgagttgttggctcggcggacgccgggcaatacaatctggaaatcactgatgcagagttatctgatgatgcatcatacgagtgccaggccaccgaggccgccctcaggagccgtagagcgaaacttacagtgttaatcccccccgaagatactcgaattgacggcggcccagtgatcctcctgcaggcaggcacaccccacaacctaacctgtagggcattcaatgccaagcctgctgcgactataatctggttccgggacgggacacagcaggagggcgcagtggcatccacagaacttttgaaagatggcaaacgtgagaccacggtgtctcagctgctgatcaaccctaccgatttagacattggcagagtatttacatgtcgctcaatgaacgaagccattcccagcggtaaggagactagtattgagttggacgtccatcatccccctaccgtcaccctctcaatcgagccccaaacagttcaggagggcgagagagttgtctttacgtgtcaggccacagcaaaccctgaaatcctcggataccggtgggctaaggggggctttttaattgaggatgcccatgagtcccggtacgaaacgaacgtcgactactctttttttaccgaacctgttagttgtgaggtccacaacaaagtgggatccacaaatgtgagtactcttgtcaacgtgcacttcgccccgaggatagtggtggaccccaagcctacaacaacggatatcggctccgacgtcactctgacttgcgtgtgggtaggaaacccacctttaactctcacgtggacaaagaaggattcaaatatgggaccaagacccccaggatcgccgcccgaggctgccctctcagcacaggtcctcagcaacagcaaccagctgcttctgaagtcagtgactcaggcggacgcgggaacctacacatgtagagccatcgttcctaggataggggtggccgaacgagaagtgccattgtatgtcaacgggccgccaatcattagttccgaggcagtccaatatgccgtgaggggcgatggaggaaaagtggagtgcttcattggttccacccccccgccggacagaattgcctgggcatggaaggaaaacttccttgaggtaggcaccctggaacggtacaccgtagaacgaactaactccgggagcggagtactttctactcttacaataaacaatgtaatggaggccgatttccaaacacactacaactgcactgcatggaactccttcggtcctgggacagcaataattcagcttgaagagagagaagtcctgcccgtgggcatcattgccggagcgaccatcggggcctcgattctcttgattttttttttcatcgccctcgttttcttcctgtaccgccgcagaaaaggatccagaaaggacgttacactgcggaagctcgatatcaaggtggaaacagtgaacagagagccactcactatgcattccgaccgagaggacgatactgccagcgtgtctacggctacaagagtgatgaaagccatctacagcagctttaaagacgatgtggacctcaagcaagatttaaggtgtgatactatcgatacaagggaggaatacgagatgaaagaccccacgaacggatactacaacgtgagagcacatgaggaccgacccagctcccgggcagtactgtacgctgactacagggcccccggacctgcgcgttttgatggtagaccctccagcaggctgtctcattcttctggttacgcacagcttaacacatattcccgcggtcccgcatcggattatggaccagagccaaccccccccgggcccgctgctcccgcaggcactgatactacgtcacagcttagctacgagaactatgaaaagttcaattctcaccctttccccggcgcagctggctaccccacataccggctgggttacccccaggccccgccatctgggctggaacggacgccttatgaggcttatgacccgattgggaaatatgccacggcaacacggttctcctacaccagccagcacagcgattacggccaacggttccagcagaggatgcagacccacgtatag

SEQ ID NO: 26941 - DNA, 1965 bp, Artificial Sequence
  Description of Artificial Sequence: Synthetic coding sequence
atgctgtccttactagtctggatcctgactctgtcagacaccttctcccagggaacacagactagatttagccaagaacctgccgatcagactgtggtagcggggcagagggctgtgttgccttgtgtgctgctgaactactccggtattgtacagtggactaaggacgggttagcacttggcatgggccagggtctgaaggcatggccacggtatcgtgtggtgggctccgctgacgccggccagtataatctcgagatcactgatgccgagttatctgatgacgcaagctatgaatgccaggccaccgaggccgcactgcgatcccggagagccaaactgacagtcctgaatcctccaacggtgactctaagcattgagccccagacagtgcaagaaggtgagcgcgtagtgttcacttgccaagcgacagctaatccagagattctgggctatcgctgggcaaagggaggcttcctgattgaagatgctcacgagtcccggtacgaaacgaatgttgattattcgttttttaccgaaccggtgtcatgcgaagtgcataataaggtcgggtccaccaatgtatctactctagtcaatgtgcattttgctcctcgcatcgtagtcgaccctaagcccacaactactgatatcgggtctgatgtgaccttgacttgtgtctgggttggtaatccacctcttactcttacctggactaaaaaggatagcaacatggtgttgagcaactctaaccagttactgctcaaatctgtgacccaggccgatgctggtacatatacttgtcgagccatagttccaagaatcggtgtggcggagagggaggtacccctgtacgtaaatggcccaccaatcattagtagcgaggctgtgcaatatgctgtacgcggagatgggggcaaagtggaatgctttattggtagcactcctccccccgaccggatcgcctgggcttggaaggaaaatttccttgaggtgggaactctggagcgctacacagtcgaacgtacaaattccgggtctggagttctcagcacacttaccattaacaatgtcatggaagcagacttccagactcactataattgcacggcttggaattctttcggcccaggcaccgccatcattcagttggaagagcgggaagtgctgcccgtggggatcatcgctggggcaaccatcggggcctccattctcctgatattttttttcatagcccttgtcttcttcctctaccggcgaagaaagggatctcgtaaagacgtcacgttgcgtaaattggacattaaggtcgaaactgtgaatcgcgagcctctaactatgcactcggacagggaagatgatacagctagtgtctccacagccacacgcgtgatgaaagctatctattcctcatttaaggacgatgtcgacctcaagcaggacttgcggtgtgatacaatcgatacacgagaggagtacgagatgaaagaccctaccaacggatattataacgtgcgcgcgcacgaggacaggccgtcttcccgagcagtgctctacgcggattaccgagccccaggtcccgccaggttcgatggcaggcccagttctagactttcccatagcagcggttacgctcaactgaacacgtacagcagagggccagcttccgactacgggcctgagcccacaccaccgggcccagcagcccctgcaggaacggacaccacaagccagctctcttatgagaattacgaaaagttcaatagccaccctttcccgggtgcagcaggttacccaacttatcggctgggctatcctcaggcacctccatccggtctggaacgtaccccatacgaggcctacgaccctatcggcaagtacgccaccgcgactcggttctcctataccagccagcacagcgactacggacagagattccagcagagaatgcagactcatgtctag

SEQ ID NO: 26942 - DNA, 1974 bp, Artificial Sequence
  Description of Artificial Sequence: Synthetic coding sequence
atgctttctttgctggtgtggattctgacactgagcgacaccttttcacaagtacccccagaggacacccggatcgacggcgggcccgtgatcctgctgcaagctggaaccccacataaccttacgtgccgggcattcaacgcaaaacctgctgctactatcatttggtttcgcgatggaacacaacaagaaggcgctgttgcgtctacagagcttttgaaggacggtaagcgcgaaaccacggttagccagctgctgattaatcctacagacttggacatcggcagggtttttacatgccgcagtatgaacgaggccattccatccggcaaagagacctctattgagctcgatgttcatcacccaccaactgtaacccttagcatcgagcctcaaaccgtgcaggagggcgaaagagtggtctttacatgtcaggctactgccaatcctgaaatccttggatacaggtgggcgaaggggggctttttgatcgaagatgctcacgagagcagatacgagactaatgtggactattccttctttacagaacctgtatcttgcgaagttcataataaagttggctccacaaacgtgagcaccctggtgaacgtgcattttgctccacgtatcgtggtcgatcccaagccaaccactacagacatcggaagcgacgttactttgacctgcgtttgggtcggcaatcctcccttgacactgacttggacaaaaaaggactcaaatatggtcctgtctaattctaaccagctcctgctcaagtctgtcactcaagctgacgctggcacctacacttgccgagctatcgttccgcggataggggttgccgaacgggaagtgccgctgtatgtgaacgggccgccaatcatcagctctgaggccgtgcagtatgccgtgcgcggcgatggtggaaaggtggagtgttttataggatccacaccacctcccgaccgcattgcctgggcctggaaggaaaatttcctcgaggtcggaaccctcgagcggtataccgtggaacggaccaattcagggagcggagttctatcaaccttgaccattaataacgtcatggaggcggattttcagacccattacaactgtactgcatggaacagcttcggcccaggcactgccatcatacagctggaggaacgggaagttttacccgtcgggataattgccggagccacgatcggagctagcatcttgctcatctttttctttattgctctagtgttcttcctgtaccggagacgcaagggctctcgaaaagatgtaaccctcaggaagcttgatattaaagtggagacagtgaacagggaacccctcaccatgcacagcgatagggaggacgacaccgcttccgtttcaactgcaacaagagtgatgaaggcaatctattcaagcttcaaagatgatgtagacctaaaacaagacctaagatgcgatactattgacacaagagaggagtatgagatgaaagaccctaccaatggatattataacgtcagagcacacgaggaccgcccgtctagtagagccgttctgtacgctgattatcgcgcccctgggcccgcgagatttgatgggcgcccttcatctcgcttgtcacacagcagtggctatgcccaattaaacacatattctcgggggccggcaagcgattacggacccgaaccaacgccaccaggcccggctgcccctgcggggactgacacgacctctcagctctcttacgagaattacgaaaagtttaattcacacccattccccggagctgctgggtaccctacttaccgcctcggttatcctcaggccccaccatcaggactggaacggaccccttacgaggcatacgatcctatcggaaagtacgccacagctacgagattcagctacactagccaacactctgactacggccagcggttccagcagcgaatgcagactcacgtatag

SEQ ID NO: 26943 - DNA, 5316 bp, Artificial Sequence
  Description of Artificial Sequence: Synthetic coding sequence
atgagcgtgcttatctcacagtcagttattaactacgtggaggaagagaatatcccagctctgaaagctttgctggagaagtgcaaagatgttgatgaacgtaatgaatgcggtcagacacccctgatgattgctgccgaacaaggcaatcttgaaatcgtaaaagagctaattaaaaatggggccaactgcaacttagaagacttggacaactggactgctctgatatcagccagcaaggaggggcatgtgcacattgtggaagagttgttgaagtgcggcgtcaatttagaacacagagatatggggggatggacggcccttatgtgggcatgctacaaaggccggaccgacgtggttgagttacttctgagtcacggggcaaatccctccgttactggactttactcagtgtatccgatcatctgggcagccgggcggggccacgccgacattgtccacctgttactgcagaatggtgcgaaggtaaattgctccgacaagtatggcacgaccccactagtctgggccgctcgcaaagggcatctggaatgcgtcaaacacttgctggctatgggagcggacgtggaccaggagggggctaacagtatgaccgccttgattgtggcggtgaaaggaggatacacccagagcgtcaaggagattctgaaaagaaacccaaacgttaacttgactgacaaagacggaaacaccgctctcatgattgccagcaaggagggtcacactgagattgtgcaggatctgctggacgccggcacctatgtgaacatcccagaccgaagtggcgacaccgttctcatcggtgccgtgagaggcgggcacgtggaaatcgtgagagccctgctgcagaagtacgcggacattgacatccgtggacaggacaacaaaacagcactatattgggcggtggagaagggtaacgccacaatggtcagggacatcctgcagtgcaatcctgatacggagatttgcactaaggacggagagactccactgatcaaagctaccaagatgcgcaacatcgaagtcgtcgagctgctcctggacaaaggtgcaaaagtctctgctgtcgacaagaagggcgacactcctctgcacatcgcaatccgagggcggtcccgtaaactagctgagctgctcctccgaaatccgaaggatggccgtcttctgtacaggcccaataaggcaggagagactccctacaacattgactgtagccatcagaagtctatcctgacacagatttttggcgccaggcatctttcgcccacagaaactgacggggacatgttggggtatgacctttattcttccgcactggcagacattctatccgaacccacgatgcaaccacccatctgtgtaggcttatatgcccagtggggcagtggcaaatccttcttattgaaaaagcttgaggacgagatgaaaactttcgctggtcagcaaatcgaaccactttttcagttctcctggctaatcgtatttttaactctgttactttgcggaggccttgggctcctgtttgctttcaccgtgcaccccaacctgggaattgccgtgagtctctccttcctcgccctcttatatattttcttcattgtcatctacttcggcggcagacgtgagggtgaaagttggaattgggcgtgggtgctgtctacccgactagcacgccacatcggatacctggaactccttctgaagttaatgttcgtcaacccccctgagcttccagaacagactaccaaagccctgccagtccggtttctgtttaccgactataatcgtctgagcagtgtgggtggcgaaacttccctcgccgagatgattgcgacactctctgatgcgtgtgaacgggaatttggattcctagccacccgcctgttccgtgtttttaaaacagaagacacacagggcaagaaaaagtggaagaaaacctgctgtctgcccagttttgtgattttcttgtttataatcgggtgcatcattagcgggataactctacttgctatattcagggtggatcctaagcatctgactgtcaatgcggttttaatatccatcgcctcggtcgttggcctggcgtttgtgctcaactgccgcacctggtggcaagtgctcgactccctgctcaactcccaaaggaagcgcctgcacaacgcagcctccaagttgcacaagttaaaaagtgagggcttcatgaaagtcttaaagtgcgaagtggagcttatggccaggatggccaagactatcgattctttcactcaaaatcaaacccggttagtggtgatcatcgacgggctggatgcttgcgagcaggacaaggtcttgcagatgttagataccgtgagagtgctcttcagcaaaggaccatttattgcaatcttcgccagcgatcctcatatcatcattaaggccattaaccagaatcttaattccgtactccgggatagcaatataaacggtcatgactacatgcgaaatattgttcatctccccgtgtttctgaacagccggggcctgagcaacgctcgcaaattcctggtgacatctgctactaacggcgacgtcccatgcagcgataccaccgggatccaggaggatgccgatcgcagggtctcccagaattcgcttggcgaaatgaccaaactgggctctaaaactgcgttgaaccgccgagatacttatcggcggagacagatgcagcggacaatcaccagacagatgtccttcgatctaaccaagttactggtaacagaagattggttttctgatatatcccctcagacgatgagacgattgcttaacattgtttcagtgaccggtagactgctgcgagctaatcagataagctttaactgggatcgcctcgcttcttggatcaatctaacagagcaatggccctatagaacatcctggctcattttgtatttggaagagacagagggtatccccgatcagatgacactgaagactatctatgaaagaatctccaaaaatatccctactacaaaggacgttgaaccgcttttagagattgacggcgatatccgcaacttcgaggtgttcctctcatcgaggaccccagtgttggttgcacgagatgtaaaagtcttcttgccttgcaccgttaatctggaccctaagttacgtgaaataatcgcggacgtaagggcagccagggaacagatttccatcggaggactggcgtacccacctctaccgctccatgaagggccacctcgggcaccttctggctattctcaaccaccatccgtgtgcagttccacaagttttaatggccctttcgctggaggagtggtatctcctcaacctcactcaagctactatagcggtatgacggggccccaacaccccttctacaatcgcccgttttttgcaccgtacctgtacacccccaggtattacccaggaggttcacagcacttaatttctcggccatctgtgaaaacatcgttacctagagaccagaacaacgggcttgaagtcattaaagaggacgctgccgagggcttgtccagccccaccgattcctcaaggggctccggtcccgcacctgggccagtggttctgttaaattcactcaacgtggatgccgtttgtgaaaagttgaagcaaattgaaggcctcgatcaaagcatgctgccacaatattgcactacaataaagaaggccaacatcaacggacgagtattagcgcagtgtaatattgacgaactcaaaaaggagatgaatatgaattttggagactggcacctcttccgctctaccgttcttgagatgaggaatgccgagagtcatgtcgtccccgaggaccctcgttttctgagtgagtccagctcaggacccgccccacacggtgaacccgcaaggcgcgcaagccataatgagctgccacacaccgagctgtccagtcagactccatatacactaaatttctcctttgaggaactgaatacattgggcttagatgaaggggctcctcgacattctaatctgtcttggcaatctcaaacccgccggacaccctccctgagttctcttaactcccaggatagcagcattgagatctcaaaacttacggacaaggtgcaggcagagtaccgggacgcgtaccgcgagtacatcgctcaaatgagtcagcttgaaggaggacctgggtctaccaccatatccggccggagcagtccacactcgacatattacatgggccagtcctcatccggtggatccatccacagcaatcttgagcaggagaaaggcaaagactccgaacctaaacccgatgatggccgaaagagtttcttgatgaaaaggggagatgtgattgattattcatcttcaggagtgtccaccaatgatgcgtctccgctcgatcctataactgaggaggatgagaagagcgatcagagcgggtccaagctgctgcctgggaagaaaagctctgagaggtcctctctattccagacagacctaaagctgaagggaagtggactacgctaccagaaacttccgtctgacgaggatgaatccggaactgaggagagcgacaacacccctctgctgaaggacgataaagatcgcaaagctgagggaaaggtggaaagagtgccaaagtcccccgagcactctgctgagccaattagaacgttcataaaggccaaggaatatctcagtgacgcgttgttggataaaaaggactctagcgatagtggggtgcggagcagcgaaagtagccccaatcattctctccacaatgaagtcgccgatgacagtcaactagaaaaggcaaacctcatagagctagaggacgatagccacagcggcaaacgcggcattccccattctttatctggtctccaggatcctatcatcgccagaatgtcgatctgttcagaggacaaaaagagtccatctgaatgctcccttattgcgagcagccccgaggaaaattggcccgcctgccagaaagcgtacaacttgaaccgcactcctagcaccgtgacgctgaataataactcagctcctgccaatagggctaatcagaattttgatgagatggaaggaatccgggaaacttcacaggttatcctcaggcctagctccagcccaaatccgacgacgatccaaaacgagaatcttaagtccatgacgcataaaagaagccagcgaagcagctacaccagactctctaaagatccaccagagctacatgccgctgcctcaagtgagagtaccggcttcggtgaggaacgggagtccatcctctag

SEQ ID NO: 26944 - DNA, 3096 bp, Artificial Sequence
  Description of Artificial Sequence: Synthetic coding sequence
atgtctgtccttatatcacagagcgtgattaactatgttgaggaagaaaacatccctgccctgaaggccttgctagaaaagtgcaaggacgtcgacgagcgcaacgaatgcggccagacgccactcatgatcgctgccgaacaaggtaatctcgagattgttaaggagctgatcaaaaatggggcaaactgtaatttggaagacctcgacaactggaccgctctcatctcagcctcaaaagaaggacacgtccacatcgttgaggagcttttgaagtgtggggtcaatttagagcatcgtgacatgggagggtggactgccttaatgtgggcttgttacaaggggaggacggatgtagtcgagctgctcctgtctcatggggcaaatcctagcgttaccggcctacaatatagcgtgtaccctattatttgggcggctggccgagggcacgcagacattgtgcatctactcctgcagaacggcgccaaggttaactgttccgataaatacggtacgacaccccttgtctgggcagccaggaaggggcatctggaatgcgtgaagcacttgctcgccatgggagccgacgtcgaccaggagggcgctaacagcatgaccgcactcattgtggcagtgaagggaggttacactcaatccgtcaaggagatcttaaaaagaaaccccaatgtgaatctcaccgacaaagatggtaatacagctctgatgatcgcctctaaggaaggacacaccgagatcgtacaggatctcctggatgcgggcacctacgtaaacatccccgacagatcaggggatacagtcctgataggcgcagttcggggaggacatgttgagatcgtgcgggccctgctgcagaagtacgcggacattgacattcggggtcaggacaataaaacagccctatactgggccgtggagaaagggaatgctacaatggtgagggatatcttgcagtgtaatcctgataccgagatatgtactaaggatggggaaaccccactgataaaagcaacaaaaatgagaaacatcgaagtagttgaactcctccttgataaaggagcgaaagtctccgccgttgataaaaagggagacactcctcttcacatagctatacgaggtcggtccagaaagctagccgagctgttgctaagaaatcctaaagatggcagactcctgtaccggccgaacaaagcgggagagaccccctataacattgactgttcccaccaaaaaagtatacttacccagatcttcggagcccgtcacctgagtcctactgaaaccgacggcgacatgttgggctacgatttgtatagttctgccttggcggacatcctgtccgaacctaccatgcagccacccatctgtgtgggattgtatgcccagtggggaagcggcaagagtttcctgctcaagaaattggaagacgaaatgaagaccttcgctggtcagcagatagaacctctttttcagttttcttggctgatcgtttttttaactctgttgttgtgcggagggctcggattgttatttgcctttaccgtccacccaaatttaggcattgcggttagcctgagtttcctagcgctgttatacatctttttcatcgtgatctacttcggggggcgccgcgaaggcgaatcttggaactgggcatgggttctcagcacaagactggcacggcacattggctaccttgagctgcttctgaagctgatgtttgtcaatccaccggaactccccgaacagaccaccaaggcgcttccggtccggttcctgttcacagattataataggctgtcaagtgtgggtggagagacttccctagccgagatgattgccaccctgtccgatgcatgtgagagggaatttggctttctggcaacaagactatttcgagtctttaagaccgaggacacccaggggaagaagaaatggaaaaagacttgctgccttcctagcttcgtgatcttcctgtttattatcggttgtatcattagcggtatcactctgctggcaatctttagagtcgacccgaaacaccttactgttaacgccgtgctgatcagcattgcttccgtggtggggttggcgtttgtattgaattgtaggacatggtggcaggtcctggacagtttgctgaacagtcaacgtaagaggttacataatgcggcctcgaagcttcataagcttaagtctgaaggatttatgaaagtcttgaaatgcgaggtcgaactaatggcccgcatggctaagactatcgattctttcacccaaaaccagacacgactggttgtgattatcgacgggctcgacgcctgtgagcaagacaaagtgctgcagatgttggatacagttcgtgtactgttcagcaagggtccgttcatcgccatatttgcttccgaccctcatatcatcataaaggctatcaatcagaacctcaactcggtcctgagggactccaatatcaacggtcacgactacatgagaaacattgttcacctccctgtattcctgaattcacgtggcctgagtaatgcccgtaaattcctcgttacatctgccaccaatggggatgtgccctgttcagacaccactggcattcaggaggacgccgataggagagtgtcacagaacagtttaggagagatgaccaagctgggtagtaagaccgcactaaatcgccgggacacctaccgaagaaggcaaatgcaacgaactatcactcgacagatgagcttcgatctgactaagcttctggtgacagaggactggtttagcgatatctccccccagaccatgcgtcgattgctcaacattgttagcgtaacgggccggctgctgcgagccaatcagatctccttcaactgggatagactggcttcttggataaacctgaccgaacagtggccatataggacaagctggctgatcctgtatttggaagagaccgagggtatacctgaccagatgactctaaaaacaatttacgagcgctgctgtggagctgatagttgcgaccgggaccggattgggatcagcaaatccgtcctcgtggccatgctaatggagagttag

SEQ ID NO: 26945 - DNA, 5019 bp, Artificial Sequence
  Description of Artificial Sequence: Synthetic coding sequence
atgatcgctgctgaacaaggaaacctcgaaattgttaaagaactgattaaaaatggagccaactgtaaccttgaggacttagataattggactgcactgatctccgcaagtaaagagggccacgtccatattgtggaagagttacttaaatgtggcgtcaatctggagcaccgggatatggggggctggaccgcgctcatgtgggcttgttacaaaggtcgtactgatgtcgtagaactgctgctttcacacggcgccaacccgtctgtgaccggattgtacagtgtgtaccctatcatctgggccgccggtcggggtcatgcggacatagtgcacctgctgctgcaaaacggagccaaggtgaactgtagcgataaatatggtactactcccctagtctgggctgcgcgaaaagggcatctcgagtgtgtaaagcatctccttgccatgggcgccgacgtagaccaggaaggggcaaactcgatgaccgcactgatcgttgccgttaagggggggtatactcagagcgtgaaagaaatccttaagcgaaatccgaacgtaaatctgacagacaaagacgggaatacagctctgatgatcgcctccaaggaaggccatacagagatcgtccaggatcttttggatgctggcacctacgtgaacatcccggacaggtctggagatacagtgttaatcggagccgttcgcggcgggcacgtagagatcgtccgggcgctcttacagaaatacgctgatatcgatattcgaggccaggataacaagacagcactatactgggcggtcgaaaaaggcaacgctactatggtgcgggacattcttcagtgcaatcctgacacggagatatgtacgaaggacggcgaaacacctctgatcaaagccactaagatgagaaacattgaagtcgtggaactactgctcgacaagggcgcgaaggtgtctgcagtcgacaaaaagggggacacacccttacacatcgccattcgaggcaggtcaaggaaacttgccgaactgcttctcagaaaccctaaggatggaaggctgttgtacaggcctaacaaggccggtgagactccttacaacatcgactgtagtcatcagaaatctatccttacacagatctttggggccagacacctgtctccaaccgaaaccgatggggacatgctcggctacgacctatacagttccgctctggctgatatcctatccgagcccacaatgcagcctcctatttgtgtgggactgtacgctcagtggggctctggaaaatcctttctgttgaaaaaactcgaggatgaaatgaagaccttcgctgggcaacagatcgagcctctgtttcagtttagctggttgatcgtcttcttaacactgctcctgtgtggcggcctgggcctgttatttgcgtttacagttcatccgaacctgggcatcgctgtaagcctgtcttttctcgcattgctctacatcttcttcatagtgatttacttcggaggacgtcgggagggcgagagctggaactgggcatgggttctgtctacccgcctggctagacacattgggtacctggaactattgctgaagctcatgttcgtaaacccccctgaactgcctgagcaaacaacaaaggcgctccccgtgcgattcctcttcacagactacaatcggctttcttctgtcggcggtgagacttccctggcagaaatgattgccaccctgtctgacgcttgcgaacgggagttcggttttctcgccacaagactgtttagagtgtttaagacagaagacacccaggggaagaagaagtggaaaaagacctgctgcctaccatccttcgtcattttcttgttcatcatagggtgtattatttctggtattacactgctggccattttccgcgtggatcccaagcatctcacggtcaacgccgtactcatctcaattgccagtgtggtggggctcgccttcgtcctcaactgtagaacctggtggcaggttctggatagtctcctgaatagccagagaaagcgcctgcacaatgccgcctctaaactgcataagctaaaatctgagggctttatgaaagttctgaagtgcgaagtggaattaatggcgagaatggccaaaaccattgactcgttcactcagaaccagacaagactcgtagttatcatagacgggctggatgcctgcgagcaagataaggtcctgcagatgttagacaccgtccgggtcctgttctcaaaggggcccttcattgccattttcgcgtccgacccccatatcattattaaggccattaaccaaaacctgaattccgtgctgagagattcaaatattaacggccacgactacatgagaaatatcgtgcacttgccagtgttcctgaactcacgcggactcagcaatgctcgcaagtttctggttaccagcgccaccaatggtgacgtgccttgctcggacacgactggcattcaggaagatgccgatagacgggtcagtcaaaactcgctcggcgagatgaccaagctcggttctaagactgcactcaatagaagggacacatatcgaaggcgtcaaatgcagcggactataacaagacagatgagcttcgacctcacaaagctgttggtgaccgaagactggttttccgacattagccctcagactatgcggagactgctgaacattgtgagcgtgaccggaaggctgctccgcgctaatcaaattagtttcaattgggaccgcctggcttcttggatcaacctgacggagcagtggccttaccgaacttcctggctaattctgtatttggaagaaactgaaggaattcctgatcaaatgactctcaaaactatctacgagcggatcagcaagaacattccgaccaccaaggacgtggagcctctgctcgaaatagacggcgatatcaggaattttgaagtgtttttatcttcacggacgcctgtattggtggcacgggatgtgaaggtattcttgccatgcaccgtcaatctcgatcccaaattgcgtgagatcatcgccgatgtgcgagcagcgcgggagcaaataagcattggggggctggcataccccccattgcccctccatgagggtcccccgagagcccccagtggttactcccagcctccgtctgtttgcagctcaacatcctttaacggcccctttgccggcggtgtggttagccctcagccgcactcctcatactactccggaatgaccggcccccagcacccgttttacaacagaggatctgggccggcccccggccctgttgttctattgaactccttgaatgtcgatgcagtttgcgagaaattgaaacagatcgagggattggaccagagtatgctccctcagtactgcactacaataaaaaaggcgaatatcaacggacgggtcctggcgcaatgcaacattgatgagttgaaaaaggagatgaatatgaattttggggattggcacctctttagaagcacagttctagaaatgcggaatgctgaatcccatgtagtgccagaagatcctagattcctgtctgagtctagttccgggcctgcaccacacggcgagcctgcgcggagggcttctcacaacgagttgccccacacagagctgtcgtctcagacaccatacacactcaacttttcatttgaagaactcaatacattaggactcgacgaaggcgccccccggcattctaacctaagctggcagagtcagacccgccgcacacccagcttgtccagccttaattcacaagattcgtctattgagatatccaagcttaccgataaagtccaggcagagtacagggacgcctaccgcgagtacatcgcccagatgtcacagctggagggcggccccggtagtactaccatctcaggtcgcagttctcctcactctacctactacatgggtcagagctcatctggaggatctatccatagcaacttagagcaagagaagggcaaggactccgaacccaaaccagatgacggtaggaaaagctttctgatgaaacggggcgacgttattgactattcctcttccggggtttcaacaaacgacgcctctcctctggaccccatcaccgaggaagatgagaaaagtgaccagtccggctcaaaactcttgcctgggaagaaatcttctgagaggagctccctgttccagactgacctaaagttgaagggctccgggctccgttatcagaaactgccatccgacgaggacgaaagcgggacggaagagtcagacaatacgccactgctgaaagatgacaaggacaggaaagcggaagggaaagtagaaagagtgcccaagtctccggagcatagcgcagaaccaattcggacatttattaaggcaaaggaatatctgagcgacgccctcttggataagaaagacagctcagactccggggtccgcagttcagagtcatctcccaatcattccctgcataacgaagtggcagacgactcacagttagagaaggcaaatctgatcgaactggaggatgattcccattccgggaaacgagggatccctcattcgctatctgggctccaggacccaataattgccaggatgagcatttgctctgaggacaagaagtcaccttcagaatgctccttgatcgctagttcaccagaggagaactggcccgcttgtcaaaaagcctacaatctcaacagaactccatcaaccgtgaccctaaacaacaactcagcgcctgctaacagagcgaatcagaattttgatgaaatggagggtattcgcgaaacatctcaagtaatattacgcccgtcgagttcccctaaccctacaacgatacaaaatgagaacctcaaaagtatgacccacaaacggagccaacgctcatcctatactcgactgtcgaaagatccccccgagttgcatgccgccgctagttctgagagcacaggttttggagaagagcgggagtccattctctag

SEQ ID NO: 26946 - DNA, 5259 bp, Artificial Sequence
  Description of Artificial Sequence: Synthetic coding sequence
atgtccgtgctgatctctcagtccgtgatcaattacgttgaggaggagaatatcccagccctcaaggctctgttagagaaatgtaaagacgtagacgagcgaaacgagtgtggccagacacctctcatgatagcagcagaacagggtaacctggaaatcgtcaaggaactcatcaagaacggagctaattgtaatttagaggatctcgacaactggacggctctgatttcagcctctaaggagggacatgtccacatcgtagaggagctgctcaaatgtggggttaatttagagcacagagacatgggcggctggaccgccctgatgtgggcgtgctataagggccgtactgacgtggttgaattgctgctcagtcacggggccaatccatctgtcacaggactgtatagtgtatatcctattatctgggcggcaggaagaggtcacgccgatattgtgcacctgttactgcagaacggagctaaggtcaattgctctgataagtatggaactacgcctctagtatgggcggcaagaaaggggcatctagagtgcgtgaaacacttacttgccatgggggcagacgtggatcaagaaggggccaattcgatgactgcgcttatcgtcgccgtcaagggaggctacacacagtcagtgaaggaaatactgaaaagaaacccaaatgtgaaccttactgataaggacggcaatacagccctgatgattgcatccaaggaaggtcacactgaaatcgttcaggacctcttagacgcaggaacatatgtgaacatcccagaccgatcgggtgacacagtactcattggcgcagtgagggggggtcacgtcgagatcgtccgtgccctgctgcaaaagtatgccgatattgatataagaggacaggacaacaaaaccgccctttattgggcggtcgagaaggggaatgccacaatggtgagagacatcctacagtgtaatccagatactgagatttgcactaaggatggagaaacacctttaatcaaagccaccaaaatgcgcaacattgaggtggtcgagcttcttctagacaaaggcgccaaggtgtcagctgtggataagaagggagacactccactgcatatagctatcagagggcgttcaagaaagctggccgaattactcctcagaaatccaaaggacggccgcctgctgtataggcctaacaaagccggtgaaaccccttacaacatcgactgcagtcaccaaaagtccatcctaactcagattttcggggccaggcatctgagcccgactgagaccgatggcgacatgctgggatatgatctttactcctcagccttggccgacatactcagcgagcctactatgcagcccccgatctgtgtggggctatacgcacagtgggggagcggcaagtcctttctactgaagaaattggaggatgagatgaaaacattcgccggacagcaaatagagcctttgttccaattctcatggctgattgtgttcctgaccctgctgctttgcggaggcctgggacttcttttcgcttttaccgtccaccctaacctgggcattgccgtgtccttgtcatttcttgccttgctgtacatcttcttcattgttatctacttcggaggacgtcgagaaggcgagagctggaattgggcctgggtgcttagtacacgcctggctcgccacataggctaccttgaactactgttgaaactgatgttcgtcaacccgccagaactgcccgaacagacaacaaaggccctccctgtgaggttcctgttcactgactataaccgactatccagcgtggggggggagacctctctggcagagatgatcgccaccttgtctgatgcatgcgagcgcgagttcggctttctcgccaccagactctttagagtgttcaaaactgaggatactcaggggaagaaaaaatggaagaagacgtgctgcctcccctcgtttgtgatctttctgttcatcatagggtgcattatctctgggattaccttactggcgatctttagagtggatcccaagcacctgaccgtgaatgcggtactgataagtattgcatcagttgttggacttgctttcgttctgaactgtcgtacttggtggcaagttctggactcgttgctgaattcccagcgcaagaggcttcacaatgccgccagcaagctgcacaagctaaagagcgaaggatttatgaaggttttaaagtgtgaagtcgagctgatggctcgcatggccaagactatcgactcctttactcaaaaccagacaagactggtcgttataatagatgggctggacgcatgcgagcaggataaagtcctacagatgttggatactgtgagggttttgttttcaaagggtccatttatcgccatatttgcaagtgacccgcacatcattataaaagctattaaccagaatctcaattccgtgttgagggactctaacattaacggacacgactatatgagaaatattgtgcacctcccagttttcttgaacagcagaggcctctccaatgccagaaaattcctggtgaccagcgccacaaacggtgacgtgccgtgttccgatactactggcatacaggaagacgccgacaggcgggtgtctcagaattcactaggcgagatgaccaaactggggtctaagacagccctgaatcgaagagacacgtaccgccgtaggcagatgcaaagaaccattaccagacaaatgtcatttgacttaaccaagctccttgttacagaagattggttttctgacatcagccctcaaactatgcgcaggttgctcaacattgtatccgtgactggccgacttctgagagcaaaccagataagtttcaattgggaccgcctcgcttcttggattaatctgaccgagcaatggccttacaggaccagttggcttatactctatctggaggagaccgagggcatcccagaccagatgaccctgaagacgatctacgaaaggataagcaaaaatatcccgacaaccaaggatgttgagccactcctggaaatagatggtgacatcaggaattttgaagtctttttaagcagccgaacacctgtgctcgttgctagagatgtaaaagtcttcctgccatgcacagtgaaccttgatccgaaactgcgggaaatcatagctgatgtgcgggccgctcgtgaacagataagcatcggggggctggcctacccgcccttgcctctgcatgaaggtcctccccgggctccatctgggtactcacagcccccatccgtgtgctcctcaacgtcttttaacgggccctttgcagggggggtggtttctcctcagccacactccagctactatagtggcatgacaggccctcaacaccctttctacaacagaccattcttcgcaccctacctttataccccccgctattatcctgggggttctcaacatctgattagcagaccatctgtgaagacttcactccctcgggaccagaacaacggtctgggaagcggtcccgcaccaggacctgtcgttttactgaattccctgaacgttgacgctgtctgcgagaagctcaaacagatcgaaggcctggatcagagtatgctgccccagtattgcacaacaataaagaaggccaacattaacgggagggttctggcacagtgcaacattgatgaactgaagaaagaaatgaatatgaattttggggattggcacctcttccggagtactgtcttggagatgcgcaacgcagaatcacatgtggtccctgaagaccctagatttctctccgagagttccagtgggcccgctccacatggggaacctgccagacgtgccagccataatgagctgccccatactgagttgagctctcagactccctacaccttaaacttctctttcgaggagttgaatacactgggcttggacgagggagcaccgaggcactctaatcttagttggcagtcacagacccgccgcactccctcgttgagctccctgaacagccaggatagcagcattgaaatttccaaactgaccgataaagtgcaggccgagtaccgcgacgcatatagagaatacatagcacagatgtcacagctagaggggggaccagggagcaccacgatttctggccggtctagcccacacagcacctactatatgggccagtcttccagcggcggatcaattcatagtaatttagaacaggagaaggggaaggacagcgagcccaagcccgatgacggaaggaaaagctttctaatgaagcgcggtgacgttattgattattcctcctctggcgtttccacgaatgacgcaagccctctggatcctattaccgaggaagatgagaagtctgatcaatccgggagcaaactgcttcccggcaaaaagtccagtgaaagatcctccctgtttcaaaccgaccttaaattgaaaggctctggactccggtatcaaaagctgcccagtgacgaggatgagtctgggaccgaggaatctgataatacccccctgctgaaagatgacaaagatcgcaaggctgaagggaaagtggagagagtgcctaaatcaccagagcactctgccgaacccattagaacgttcattaaagcaaaggaatacttgtctgatgctctgctcgacaagaaggacagctcagatagcggtgtccggagttccgagagcagcccaaatcactctctccataatgaagtggcagacgacagtcaattggaaaaggctaacctgattgaacttgaggacgattctcactccgggaaaagaggaatcccgcattccctttccggacttcaggaccccatcattgctcggatgtcaatctgttcagaagataagaaatccccaagtgagtgctctttgatcgcgtcttcccccgaggagaattggcccgcatgtcaaaaagcctataatctaaatcgcacaccttctaccgtgaccttgaacaacaactcagcacccgcaaaccgggcgaaccagaatttcgatgagatggagggcatcagagagacgagccaggtgattctgcgcccttcatccagtccgaaccccacaactatccagaatgagaatctcaagagtatgacccacaagcgttctcagagatcttcctacacgcgactgtctaaggacccccccgagctccacgctgcagccagttcggaaagcacaggattcggtgaagagagggaatcaatactgtag

SEQ ID NO: 26947 - DNA, 5259 bp, Artificial Sequence
  Description of Artificial Sequence: Synthetic coding sequence
atgtctgtcctgatcagccagagcgtcattaactacgtggaggaagagaacatccctgcactgaaggcccttctagaaaagtgtaaggacgtcgatgagcgcaatgaatgtggccagacaccgttgatgatcgctgccgaacaaggtaacctggaaatagtcaaggaactgataaaaaatggcgccaactgcaacctcgaggacttagacaactggacagctttgattagtgcaagcaaagagggacatgtccacattgtggaggagctccttaagtgtggtgtgaatcttgagcatcgcgacatgggagggtggacagcacttatgtgggcttgttacaaaggcaggacagatgtggtggaactgctactgtctcatggcgcaaacccatctgtgaccggtctctactctgtgtacccaattatatgggccgcagggagaggccatgctgacatcgtgcatttactgctgcagaacggtgctaaagtgaattgctcagataaatacggcacaactcccctagtctgggcggcccgaaaaggtcacttagagtgtgtgaaacatttattggccatgggagctgacgtagaccaggagggcgctaattctatgactgcactgattgttgccgtgaagggggggtatactcagtctgtgaaagagattcttaagcgcaatccaaatgtgaacctgaccgataaggatggtaatacggccctgatgatcgcatctaaggagggtcacacagagatcgtgcaggatttgcttgacgcaggtacctatgtgaatatacctgaccgctccggcgataccgttctgattggtgccgttaggggagggcatgttgaaatcgtccgtgcactgctgcagaaatacgccgacattgacatcagaggacaggacaataagactgccctatactgggccgttgagaagggaaatgctaccatggttcgagacattctgcaatgcaatcctgacaccgagatctgtacgaaagacggggagacacctctgatcaaagcgacaaaaatgcgcaatattgaggtcgtcgaattgctgttggataagggtgcaaaagtttctgccgtcgataagaagggagacacacccctccatattgcgatccgaggccgttctagaaaacttgctgaacttctgctaaggaatccaaaagatggtcggctcctgtacaggcctaataaagcgggggagacgccatacaacatagattgtagccatcaaaagagtatcctcacccagatttttggcgcaaggcacctgagcccaacggaaaccgatggtgatatgctcgggtacgacctgtattcgtcagctctggcggatatcttatccgagcccacaatgcagccacccatttgcgtaggactctacgcacagtgggggtctggcaagtcttttctgctcaagaaacttgaagatgagatgaaaacctttgctggacagcagattgagcccctgtttcaattttcatggctgattgttttcctgaccctcctgttatgcggaggactagggctgctgttcgcttttacggttcatcccaatctcggcatcgccgtgagcctctcattcctggcgctgctgtatatctttttcatcgtgatttactttggagggcggagggaaggggagtcctggaactgggcctgggttctttccacccggttagcacgccatattggctacctggaactcctgctgaaattaatgttcgtgaacccccccgaattgccagaacagactacaaaagctctcccggtgaggtttctctttacggattacaacagactgtcatctgtcggcggtgagaccagcctggcagagatgatagccacccttagcgatgcctgtgaacgcgagtttggcttcctggctactcgtcttttcagggtgtttaaaacagaggacactcaaggcaagaaaaaatggaaaaaaacatgctgtctgcccagttttgtcatattcctatttatcatcggctgcataatttccggcatcactctcttggctatatttagagtcgaccccaaacacctgactgtcaacgccgtgcttattagtattgccagcgtcgtggggctggcctttgtcctaaattgtcgtacgtggtggcaagttctggactctctcttgaacagccagcgcaagagactgcacaacgccgcaagcaaactgcataagttaaagtccgaagggtttatgaaggtgctgaaatgtgaggttgagctcatggctaggatggcaaaaaccatcgactcatttacccaaaaccagacaaggctcgtagtgataatcgacggtttggatgcctgcgaacaagataaagtgctgcagatgttggacaccgtaagagtgctattctctaagggacccttcattgcgatctttgcctccgacccacacattattattaaggccataaaccaaaatctgaattccgtgctccgagattctaatatcaatggtcatgattacatgcgcaacatcgtgcaccttcccgtgtttctgaactccagaggcctgagtaacgctagaaaattcttagtgacatccgccactaacggagatgtgccctgcagtgatacgaccggtatccaggaggatgccgacaggcgtgtgtcccagaactccttgggcgagatgactaagctgggcagtaaaaccgcactgaacagacgcgatacttaccggcgaaggcaaatgcagaggaccattactcgacagatgtccttcgatttgacgaaacttctagtcaccgaggattggttcagcgacatctcaccccaaacgatgcggcgactgttgaacattgttagcgtgaccggcagactgcttcgtgctaaccagattagcttcaattgggatcgcctagccagctggattaacttgacggagcagtggccctatcggacatcttggctgatcctatatctggaagagaccgagggaatacctgaccagatgacactgaagaccatctatgagcggatttctaaaaatatccctaccaccaaagatgtggaaccactgttagaaatcgatggagatatacgcaatttcgaagtgtttctctcatctcgcactccagttctggtggcccgcgacgtgaaagtgtttcttccatgtactgtgaatctcgaccctaaactgcgcgagattattgccgatgttcgggccgcacgggagcaaatatccatcggtggcctcgcatatccacccttgccactccacgaaggccctcctcgcgccccgtcaggctacagccaaccgcctagtgtgtgctctagcacctcatttaacgggccatttgctggcggcgttgtgtccccgcagccccacagcagttactatagcggcatgaccggccctcagcatcctttctacaaccgccccttcttcgcaccgtatctctataccccaagatattacccaggggggtcacagcacttaatttctaggccatccgttaaaacaagcctgcccagggatcagaacaatggcttaggaagtggcccagccccaggccccgtggtgttgctcaattcactcaatgtcgatgcagtttgtgagaagctgaagcagattgaggggctggatcagagcatgctgcctcagtattgcaccactatcaagaaggcaaacattaacgggagagtcttggctcaatgtaacatcgatgaactcaaaaaagagatgaatatgaacttcggagactggcatctgtttcgctccacggtcctggagatgcgtaatgcggagagccacgtggttcccgaggacccaaggttcttgagcgagagctctagcgggcccgccccccacggtgaaccagcccgaagagcctcccacaatgagctccctcacacagaactttcatcacagaccccatacactctgaacttctcgtttgaagagttgaatactttggggcttgacgaaggcgccccgaggcactctaacctgtcctggcagagccagactaggagaactccaagtctgtccagcctcaattcccaagacagtagtattgaaatatccaaactcacagacaaagtgcaagccgagtacagagacgcatatagggaatacatcgcacagatgagccagttagaaggcgggcctggctccaccacaatatcgggacggtcaagtccccactccacctactatatgggtcaaagctcttccggaggcagtattcactcaaatcttgaacaggaaaaggggaaggactccgagccgaagcctgatgatggaaggaagtcattcttaatgaagcgcggggatgtgatcgactacagctcttctggggtgtcaactaatgacgcttcgccactggatcccatcactgaggaggacgagaaatctgatcaatcgggatcgaagttgctgccagggaagaaatcatccgaaagaagtagtttgtttcagacggatctaaaactgaaggggagcggtttgaggtatcagaagttgccctccgatgaagatgaaagcggaactgaggagagcgacaatacaccgttgctgaaggatgacaaagataggaaggcagaagggaaggtcgaacgcgtgccgaagagccccgaacattcagcggagccaattcgcacatttattaaagctaaagagtacctttccgacgctctgctggataagaaggacagcagcgatagcggcgtgaggagtagcgaatcctccccaaatcactctctccacaacgaggttgccgacgattcccagttggagaaagcaaacctcatcgaattagaggacgactctcactctggcaaaagaggaataccacattccctgagcggcctccaggaccccattatcgccagaatgtcaatctgttcagaggacaaaaagtctccaagtgagtgctcactcattgctagctcgcctgaggaaaattggccagcctgtcaaaaagcttacaacctcaatcggaccccatcgacagtgacactcaacaacaactctgcaccagcaaatagggctaatcagaactttgacgagatggagggcatccgggaaacatcccaggtgatactgaggccatcctcctcacccaacccgacgactatacagaacgaaaatctgaaatcaatgacccacaagcgatcccaacgttcaagttatactagattgtccaaagacccgcccgaattgcatgcagcagcatccagcgagtccaccggtttcggcgaagaaagagaatctattctgtag

SEQ ID NO: 26948 - DNA, 2985 bp, Artificial Sequence
  Description of Artificial Sequence: Synthetic coding sequence
atggtgcgggatatcctgcaatgcaatccagacaccgaaatttgcacgaaggacggggaaaccccattaattaaagcaacgaaaatgcgcaacattgaagtggtggaattactcctggataagggcgcgaaggtttcggcagtggataagaagggggacactcctctccacatcgcgatccgaggtaggtcacgaaaactggctgagttactgctcaggaacccaaaggacggccgactcctgtatagaccaaacaaagccggagagacaccttataatatcgactgttctcatcagaaatcaattctgacacagatttttggcgcacggcatctcagccccacagagacggacggggacatgctgggttacgacctttactcttccgcgctcgctgacattctgtctgaacccaccatgcagccccccatctgcgtcgggctctatgcacagtggggatcaggcaaaagtttcctgctgaaaaagctagaggacgagatgaagactttcgctgggcagcaaatcgagccgctgttccagttttcttggttgattgttttcttaacgttgctcctttgtggggggcttggactactgttcgcattcaccgtccatccaaatctaggcatcgctgtttccttatcatttttggcactgctgtatatcttctttatcgttatctattttggcgggcgccgcgagggagagagctggaattgggcctgggttcttagcacaaggttagctcgtcacattgggtatttagaactgctcctgaagctgatgtttgtcaatccccccgaactcccggagcagacgacaaaggcacttcctgtgaggtttctttttaccgattacaaccgcctctcttccgtagggggggaaaccagccttgccgagatgatcgccacactcagcgatgcctgtgaacgcgagttcggattcctggccacacggctcttccgagtgttcaaaaccgaggatacccagggaaaaaaaaagtggaagaagacatgttgcctgccatcctttgtaatattcctattcattattgggtgtattattagtggaattacgctcctcgcaatattccgagtggatccgaagcatctgacagtgaacgctgttttgattagcatcgctagcgtggtggggttagcctttgtgcttaattgccggacgtggtggcaggtgctggactccttacttaactcccagagaaagcgcttgcacaatgctgccagtaagctacacaaactaaagagcgaggggttcatgaaggtgcttaagtgtgaggttgagctgatggcacggatggccaagacgattgattcctttacgcagaaccagacccgcttagtggtaataattgacggattggatgcgtgtgaacaggataaggtcttacagatgctagacaccgtgcgggtcttattcagcaagggaccattcatagccatcttcgcatcagatccccacatcataatcaaggcaattaatcagaatctcaattccgttctgagggacagcaacattaatggacatgattacatgcgaaacatcgttcatcttcctgtgttcctgaacagccgcggtctgagtaacgctagaaaattcctggtgacctctgcaacgaacggtgacgttccatgctctgacacaactgggatacaggaagatgccgataggcgcgtctctcagaattcattaggagagatgactaagctcggatcgaagaccgccttgaatcggcgagacacttaccgccgccgccagatgcagagaaccatcactcgacagatgagctttgacttaactaagctcctcgtaacggaggactggtttagcgatatttcacctcaaaccatgcgaagattgctgaacattgtgagcgtgactggacgcttgcttagagctaatcagatcagtttcaactgggataggctggccagttggatcaacttgacagagcaatggccctatcgcactagttggctcattctctatctagaagaaactgaagggataccagaccagatgactctgaaaactatctatgaaaggatttcaaagaacatcccaactactaaagacgtagaaccacttttggaaattgacggggatatacggaactttgaggtgttcctctcatctcgcacaccagtactggtggctcgtgacgtgaaggttttccttccttgcacagtgaacttagaccccaaactgcgcgagatcattgccgacgtcagggcggccagggagcagatcagtattggcggcctggcctacccacccctacctctgcacgagggtcctccccgagccccgtctgggtactctcagccgccttctgtgtgcagctccacttcgttcaacgggccctttgccggaggagtcgttagccctcagccccactctagctactactcaggcatgacaggcccgcagcaccccttctataatagggggtcaggtccagctcccgggcccgtggtccttcttaattcactgaacgttgatgctgtgtgcgagaaactgaagcagatcgaggggctggaccagagtatgctgccacaatactgtactactatcaagaaggcgaatataaacgggagggtactggcacaatgcaatatcgatgaactcaagaaggagatgaacatgaatttcggagactggcacctgttccgttctaccgtactggagatgaggaacgccgagagtcatgtggtgcccgaagatcccaggttcctgagcgagagttcaagcggtcccgcaccacacggtgaaccagcccggagagcatcccacaacgagttgccccacactgaactcagttctcaaactccatacacactgaatttcagcttcgaagaactgaacactctgggtctagacgagggcgccccacggcactctaacctaagctggcaggaagagaatgctggcctagagatcgattcttccagtgaagatcccgactag

SEQ ID NO: 26949 - DNA, 3954 bp, Artificial Sequence
  Description of Artificial Sequence: Synthetic coding sequence
atggcttccgtcaaagtggcagtaagggttagacccatgaaccgacgtgaaaaagacctcgaagcgaagtttatcattcagatggagaagtccaaaaccacaattacaaatctgaaaatccccgaaggggggacaggcgacagcggccgcgagcgtactaagacgttcacatacgacttctccttctattccgccgataccaaaagcccagactatgttagccaagaaatggtcttcaagacacttgggacagacgtcgtgaaatcggctttcgaagggtacaacgcttgcgtctttgcctatggacaaactggatccggcaagtcttataccatgatgggaaactccggcgattctggcctcatcccacggatctgtgaaggcttgttttcacgcatcaatgagacgacgcgttgggacgaggcctcattccgcaccgaagtgtcctacctcgaaatatacaacgaacgggtaagggacctcctacgcaggaaatcctctaaaacattcaacctgcgcgtgcgcgagcatccaaaggaaggcccatatgtggaagatctgagtaagcaccttgtccagaattacggtgacgtggaagaactgatggacgccggaaatatcaatagaacgacggcggcaacaggcatgaatgacgtgtcttctcggtcccacgctatattcacaattaaattcactcaggccaaatttgatagtgaaatgccctgtgaaacagtgagtaagatccacctggtagacttagccgggtctgaacgcgccgacgccaccggggcaacgggcgtgagactaaaggagggaggcaatatcaacaaatccttggttacactgggcaatgtgataagtgccttggctgacttaagccaggatgcagccaataccttggccaagaagaaacaggtcttcgtgccctaccgcgactctgttttgacatggttacttaaggacagcttaggcggcaattctaaaactattatgatagccacaatcagcccggccgatgtaaattacggtgaaaccctaagcacactcagatacgcaaatcgcgccaaaaacataattaacaaacccaccatcaacgaagacgccaacgttaaactgatccgcgaactgcgcgccgaaatcgcacgcctgaaaacccttctggctcagggtaatcagatagccttgttagacagccctactgctctgtctatggaggaaaagctgcagcagaacgaggccagagtccaggaactgacgaaagaatggactaacaaatggaatgaaacccagaacatccttaaagagcagacactagcattaagaaaggaaggaattggtgtggtcctggacagtgagctgccgcacctgatcggcatcgatgacgacctgctctctacgggaataattctgtaccacctaaaggagggtcaaacctatgtcggaagggacgatgcctctactgagcaagacattgtgcttcacggtctcgacctggagtccgaacattgcatttttgagaatataggcgggaccgttacactaatcccattgtccggatctcaatgcagtgttaatggcgtgcagatcgtcgaggcaacgcaccttaaccaaggcgctgtgattctgcttgggaggacaaatatgtttaggttcaatcatccaaaagaggccgctaagctgcgggagaaacgcaagtccggcctgctgtccagcttttcgctgagcatgactgacctctcgaagagtagagagaatctgtccgcggtaatgctatacaatccaggcctggagtttgaacgtcaacagagagaagagttggagaagctcgagtcaaagcgcaagttgattgaggagatggaagagaagcagaagtcagataaagccgaactcgaacggatgcaacaggaggtggagacccagagaaaagagactgaaatcgtgcaactgcagatacgcaaacaggaggagagcctgaagcgtcggtctttccacatcgaaaataaactgaaggacctgcttgcagagaaggagaaatttgaagaggaaagactccgggagcagcaagaaatcgaactgcagaagaagaggcaagaagaagagacgtttctccgagttcaagaggagctacaacgcctgaaagagctcaataacaacgaaaaggcagagaagttccagatttttcaggaactggaccaacttcagaaggagaaggatgagcagtatgcaaagctcgagctggaaaagaaaagactcgaggaacaggaaaaggagcaggtcatgctggtcgcacacctggaggagcaactccgcgagaagcaggagatgattcagctgttgaggagaggcgaagtgcagtgggtcgaagaagaaaaacgtgacctcgaaggaatacgggagtctttgttgcgtgtgaaggaggctcgcgccggcggggacgaagatggagaagagcttgaaaaggcacagttaagatttttcgagtttaaacggcgacagttggtcaaattggtgaatctggaaaaagacctggttcagcaaaaagatatcctgaagaaagaggtgcaggaagagcaggaaattttggaatgcctcaagtgtgaacacgacaaagagagccggcttctcgagaagcacgatgagtctgtcactgatgtgactgaggtgccacaggacttcgagaaaataaaacccgtggaataccgactgcaatataaggaaaggcaactgcagtacctgctacaaaaccaccttcctacactgttggaagaaaaacaacgcgcatttgaaatactggatcgggggccgctgtccctggacaacactctatatcaggtcgaaaaagagatggaagaaaaagaggaacagttggcacagtatcaggctaacgctaaccagctgcaaaagctgcaagccactttcgagtttactgccaacatagcacggcaggaagaaaaagtgagaaagaaggagaaggagattcttgaaagtagggagaagcagcaacgagaggcccttgaacgggcattagcacgcctcgaacgcagacactccgcactccagcgacattctaccctcgggatggagatcgaggagcagcggcagaaactggcctcacttaactcgggttctagagaacagtctgggcttcaggcctctttagaggcagaacaggaggccctggaaaaggaccaggaaaggctcgaatacgaaatccaacagctaaaacagaaaatctacgaagtggatggtgtgcagaaggaccaccacggtactctggagggtaaggtggccagcagttctctgcccgtctccgctgagaagagccaccttgttccgttgatggatgctagaatcaatgcgtacatcgaagaggaggttcagcgccggctgcaggatctgcatcgagtcatctctgagggttgttctacgtcggcagacaccatgaaggataatgagaaactgcataatggaactatccaacgcaagctgaagtacgagcgcatggtgtcacggtccctaggcgctaatccagacgatctcaaggacccaattaaaatctccatacctagatacgttctctgtggccagggcaaggacgcacattttgagtttgaagttaagattacggtcctggatgaaacttggaccgtcttccgccggtacagtcgattcagggagatgcacaaaacattgaaactgaagtatgcagagctcgcagctctggaatttccaccaaagaaactttttgggaacaaagatgagcgagtcattgctgagaggagaagtcacttggaaaagtatctccgcgatttcttctcagtcatgctgcagagcgccacaagtcctctccatatcaacaaggtgggtctaaccttatctaaacatacaatatgtgaattctcgccttttttcaagaaaggcgtatttgattatagcagccatggcaccggctag

SEQ ID NO: 26950 - DNA, 3864 bp, Artificial Sequence
  Description of Artificial Sequence: Synthetic coding sequence
atggccagtgttaaggtcgcagtcagagttcgaccgatgaacaggcgagaaaaggatctggaggctaaattcataattcagatggaaaagtccaaaaccacaatcactaatctgaagataccagaaggcggcactggggacagcggtcgagagagaacaaagaccttcacctacgatttttctttctatagtgctgacacaaagtcacctgactacgtcagccaggagatggttttcaaaacgctgggcacagatgtcgtgaagagcgcgttcgaaggctataacgcatgtgttttcgcctacggtcagactggttctggaaaaagttacacaatgatgggtaattcaggtgatagcgggttaattcctagaatatgtgaaggactgttttccagaatcaatgaaactactcgctgggatgaggcaagttttcgaacagaagtgtcttatctggaaatctacaatgagcgggtcagggacctgttacggaggaagtcaagtaaaactttcaatctgcgggtcagggaacaccctaaggagggaccatatgtggaagatctttcaaagcacctggtgcagaattatggggacgtggaagagttaatggatgccggaaatatcaatcgcacgacggcagcaacagggatgaatgatgtttctagcagaagtcacgcaatttttaccatcaagtttacgcaagctaagtttgactccgagatgccttgcgagacagtctctaaaatccaccttgtagatttagccggtagcgagcgagcagacgccactggagcaaccggcgttagactcaaagaaggcggaaatattaacaagagtctggttactctcggaaatgtcataagcgctttggccgatctgtcccaggatgctgccaacaccctagcaaaaaagaaacaggtgtttgtaccatatcgggattccgtgctgacctggttgctgaaagactctctcgggggcaacagcaaaaccattatgattgcaactattagtccagctgacgttaattacggggaaaccctcagtacgcttaggtacgccaatcgcgcgaaaaacattattaacaagccaacaatcaacgaggacgctaacgtgaagctgatccgggaactgagggcggaaattgctcggctaaaaacgttgctggcacaggggaaccagattgccctgctcgattccccgactgccctttctatggaggaaaaactgcagcagaacgaagcacgggtccaggagttaactaaggagtggactaataagtggaatgaaacccagaatatcctaaaagagcagacactggcgctcaggaaggaaggcatcggcgttgtgcttgattccgagctaccacacctcatcggcatcgacgatgatcttcttagcaccggcatcatactgtatcatcttaaggagggccagacatatgttggccgagacgatgcatcgaccgagcaggatatcgtcttgcatggcctcgacctggaatctgagcactgcatatttgaaaacattggtgggaccgtcactttgattccgctgtcagggtcacagtgttccgttaacggagtccagattgtcgaggccacccacctgaatcagggagccgtcatcctcctggggcggaccaacatgttcagatttaaccatccaaaagaggccgcgaagttgcgtgaaaaacggaaaagcggcctgttgagctcattcagtctgtctatgacggatctgtcaaaaagccgggaaaatctgagcgctgtgatgttgtataacccaggtctagagttcgaacgacagcagagggaagagttggaaaaattggaaagtaagcgcaaactgatcgaagaaatggaagagaaacagaaatccgacaaggctgagctggaacgcatgcaacaggaggtggagacccaaagaaaggagaccgagatcgtgcaactccagatcagaaagcaggaggaaagcttgaaacggaggagctttcatattgaaaacaagttaaaggacctgctagccgaaaaggaaaaatttgaagaggagagactgcgcgaacaacaagagatcgaactgcagaagaagcgccaggaggaggagacattccttcgggttcaagaagagctgcagcggctgaaagagcttaacaacaacgagaaggccgagaaatttcagatcttccaggagctcgaccagctgcagaaggagaaagacgaacagtacgccaaattagagctggagaagaagcggctggaagaacaggagaaagagcaggtgatgctcgttgcccacctggaagagcagctgagggagaaacaggagatgatccagctgttacgacgaggcgaagtccagtgggttgaagaggagaaaagagacctagaaggcatacgcgaatccctgctgagagtgaaggaggcccgggctggaggcgatgaagacggtgaggagctggaaaaggcacaactacgctttttcgaatttaagaggcgtcagctggttaaactcgtcaacctggagaaagacttagtccagcaaaaagacatactcaaaaaggaggtccaggaggagcaggagatcctcgaatgtcttaaatgtgagcatgacaaggagagcagacttctggaaaagcatgatgagagcgtgactgatgtgactgaggtgcctcaggatttcgagaagataaaacccgtagagtaccgactgcagtacaaggagcgccagctgcagtacctgctgcagaaccacctacctacactgctcgaggagaagcagagggcttttgagattctggaccgcggacccctatccctggacaacacgctgtatcaggtagagaaggaaatggaggagaaggaagaacagctggcccagtatcaggcgaacgccaatcagctgcaaaagttgcaggcgacctttgagtttacagcaaacattgcacgtcaagaggaaaaggttcgcaaaaaagagaaggagattctcgagtcacgcgaaaagcagcagcgagaagcccttgagagagccctggcccgcttggagcgacgtcatagtgccctgcagcgccactccaccctgggaatggagatcgaggagcagcggcagaaattagcctctctaaattccgggagccgggaacaatccggcttgcaagcgtcattggaggctgagcaggaagcgctggagaaagatcaggagcgcctggagtatgagatacagcagctgaagcagaagatttatgaagtcgatggtgtacagaaagaccaccatgggactctcgagggaaaggtagccagctcctcactgcccgtgagcgcagagaaatctcatctggtgccactcatggatgcacgaattaacgcgtacatcgaagaagaagttcagaggcgcttacaagacctgcaccgcgtgataagcgagggatgctccacttccgcagataccatgaaggataacgagaaattacacaacggcactatacaaaggaaactcaagtatgaacggatggtttctaggagtttgggggccaatcctgacgatttaaaagatcccatcaagatctccattcctagatatgtcttatgcgggcagggcaaagacgcgcacttcgaattcgaagtcaaactcgccgctcttgagttccctccaaaaaagctgtttggtaacaaggacgaaagagtgattgccgagaggcgttcccacctggaaaagtaccttagagatttcttctccgttatgcttcagtcggccactagccctctgcacattaacaaagtgggactgaccttatcgaaacacaccatttgcgaattcagcccattttttaagaagggcgtcttcgactatagcagtcacggaacagggtag

SEQ ID NO: 26951 - DNA, 3486 bp, Artificial Sequence
  Description of Artificial Sequence: Synthetic coding sequence
atggcttccgttaaggtcgctgttcgcgttagacccatgaatagacgagagaaggacttggaagcgaagtttatcatccaaatggagaagagtaagactacgattacaaatctgaagattcctgagggcggaaccggagatagtggccgcgagcgtaccaaaaccttcacgtacgattttagcttctactcagcggataccaaaagtccagattatgtgtcccaggagatggtcttcaagaccctgggcacagatgtagtcaaaagtgcttttgaaggctacaatgcttgtgtgttcgcatacggccagacgggctcaggaaagagttataccatgatgggtaacagcggcgattccggtttgattcctagaatttgtgagggactattctccagaattaacgagaccaccagatgggacgaggcatcctttcgaaccgaggtgagctacctcgaaatttataatgaacgcgtaagggatctcttgagacgaaagtcctccaagaccttcaatcttcgcgtgcgggagcatcctaaagaagggccttacgtagaggacctgtcgaaacacctggtccagaactacggcgatgtagaagaactgatggacgccgggaatatcaatcggacgaccgccgctaccggtatgaatgatgtgtccagccgctcccatgcgatttttaccattaagtttactcaagccaagtttgatagcgagatgccatgcgaaacagtgtcaaagattcacctagttgatctcgcaggatctgagcgcgccgatgccaccggcgccactggcgtgcgactgaaagagggcggaaatatcaataagtccctggttacactcggtaacgtcatcagtgccttggcggacctgtcccaagatgctgccaatacgttggccaagaagaaacaggtgtttgtcccctatcgtgattccgtgttaacgtggttactcaaagattctctcggtgggaactctaagactataatgattgcgaccattagtcctgcggatgtcaattatggcgaaacccttagtaccctgcgctacgctaaccgggcgaaaaatatcatcaataagcctactattaacgaggacgccaacgtcaagttgatcagagaactgcgggcggagatcgcgcgactgaaaaccctcctcgcccagggcaaccagatcgccttgctagattcacccaccgcactctccatggaggaaaagttgcaacagaacgaagcaagggtgcaggagctgaccaaagaatggactaacaaatggaatgagacacagaacatcttgaaggaacagacacttgccctgcgcaaagaggggattggggtggttctcgatagtgagctcccccacctcattgggatcgatgacgatctgctgtcaaccggaataattttataccacctcaaggaaggccagacctacgtggggagagacgacgcatcaaccgagcaggacatcgtactgcacggacttgacctggagagcgagcattgtatctttgagaacatcggaggtacagtgactttgatacctctgtccggctcccagtgcagtgtcaacggcgtgcagatagtcgaagcaacccatttaaatcagggcgccgttattctgctgggacgcactaacatgtttagattcaaccatccgaaggaggccgccaagttgcgggagaaacgaaaatccggtcttctctcctctttcagcctgtccatgaccgacctgtcaaaatcccgagagaatctctccgccgtaatgctctataacccaggcctggaattcgaacgccagcagcgtgaggaactcgagaaactcgaaagtaagcgtaagctgattgaggagatggaagagaaacaaaagagcgataaggctgagctggaacggatgcagcaggaggtggagacccaacgcaaggaaaccgaaattgtgcagctgcaaatacgaaaacaggaagagtcactcaagagaaggagctttcatatcgagaacaaactcaaagacttgctcgctgaaaaggaaaaatttgaggaagagcgcctgaaggacctggtgcagcagaaagatatcctgaagaaagaggtgcaggaagagcaggagattctggaatgtttgaagtgcgaacacgacaaggagagcagactgctcgaaaagcatgatgagtcagtgacagacgtaactgaagttccgcaggactttgaaaagattaaaccagtggaatatagattacaatacaaggaacgccaactccagtatctcttgcagaatcatctacccaccctcctggaggagaagcagcgggcatttgaaatccttgatcgggggcccctaagtctcgataatacattgtaccaggtcgagaaagagatggaagagaaggaggaacagttggctcaataccaggccaatgcgaatcagttacagaaattgcaggcaaccttcgaatttacagccaatatcgctaggcaagaggagaaggtccgcaagaaagaaaaggaaattctggaatcccgggaaaagcaacaacgggaagccctggagagagccttggccaggctcgagaggcggcactccgccctgcagcggcactcgacgctgggtatggagattgaagagcagcgacaaaagctggccagcctgaatagcggctccagggaacaatccggccttcaggcaagtctagaagccgagcaggaggctcttgagaaggaccaggaacgcctcgaatatgaaattcagcagctcaagcagaagatttatgaggtcgacggggtgcagaaggatcaccatggaaccctggagggcaaggtagccagctcctcactccctgtctccgctgagaagagtcacctggtcccactcatggacgctcggatcaatgcatatattgaggaggaagtacagcgccgactgcaggacctacatcgtgtcatctccgaagggtgttcaacgtctgcagacactatgaaagacaatgagaaattacacaatggaaccatacagaggaaactgaagtatgaaaggatggtgagtcgcagcctgggcgcaaacccggatgacctcaaggaccctattaagatctcaattcctagatatgtgctctgtggacaaggcaaggatgcacatttcgagttcgaggtgaaaatcacagtgttagatgaaacttggacggtgtttagaaggtatagcagattcagagagatgcataaaacactgaagttgaaatacgcggaactcgctgccctggaattccctccaaagaagttattcgggaataaggatgagagagtgatcgcggagcgtcgctctcacctggagaaatatctgcgggacttcttctctgttatgctgcagtcagcaactagccccctccatatcaataaggtcggccttacactgtctaagcacacaatctgtgaattctccccgttctttaagaagggcgtgttcgattattcaagccatggaacaggatag

SEQ ID NO: 26952 - DNA, 1509 bp, Artificial Sequence
  Description of Artificial Sequence: Synthetic coding sequence
atgattcagcttttgcggaggggcgaggtacaatgggtcgaggaagaaaagcgagacctggaaggtattcgagagtcactgctgcgcgtaaaggaagccagagctggcggagacgaagatggggaagagctggaaaaagcccagctgcggttctttgagtttaagaggaggcagttagtcaagcttgttaacctagagaaagatctggtacagcagaaggacatcttaaaaaaggaagttcaggaagaacaagagattttggaatgcctgaagtgcgagcacgataaagagtccaggctacttgaaaagcatgacgagagtgttacagatgtcacagaggtgccccaggattttgaaaagattaagcctgtggagtatcgcctccagtacaaagaacgacaactgcagtacctgctccagaaccatctcccaacgcttcttgaggaaaaacagagagcctttgagatcctggacaggggtcccctgtcccttgacaatactctgtaccaagtagagaaagaaatggaggagaaggaagagcagctggcccagtaccaggctaatgcaaaccagctccagaagttacaggccacctttgagttcactgccaatattgcccggcaagaggaaaaggtccgaaagaaggagaaggaaatcctagaatcaagagagaagcagcagcgcgaagctcttgaacgggctctggcccggttagagcgccgccactccgccctccagcgtcactctaccctgggcatggagattgaggagcagcgtcagaaacttgccagcctgaattcgggtagccgcgagcaatcaggcctgcaagcctccttggaggctgaacaagaggcactggagaaggatcaggagagactggagtacgaaattcagcagctgaagcaaaaaatttacgaagtcgatggggtgcagaaggatcaccatggcactctcgaggggaaggtcgccagtagttctctgcccgtgtcggcagagaaatcacacctagttcctcttatggacgccaggatcaacgcctacatcgaggaggaggtacagagaagacttcaggatctgcaccgcgtcattagtgaagggtgttccacatcagctgacacgatgaaagataatgagaaactgcacaatggcaccatacaaagaaaactgaaatatgagatcaccgttctggatgaaacctggaccgtgttccgtcgttacagcagatttcgagaaatgcataagaccttgaagttgaaatacgcagagctcgcagccctcgaattcccgcctaaaaagctttttggcaacaaagatgaaagagtgatcgccgagcgtcggtcacacctggaaaagtatctgcgcgattttttttctgtaatgcttcagtcggctacaagtccactccatattaacaaagtgggtttaaccctatccaagcataccatctgcgagttttcccccttctttaaaaagggcgtcttcgactacagttcccacggaactggatag

SEQ ID NO: 26953 - DNA, 4179 bp, Artificial Sequence
  Description of Artificial Sequence: Synthetic coding sequence
atggcgagtgtgaaggtggccgtacgggtcagaccaatgaacagacgtgaaaaagatcttgaagcaaaattcataatacaaatggaaaagtctaagacaacaattacaaacctgaagatcccggagggcggtacaggggactctggacgagaaaggaccaagacctttacctacgatttctccttttactctgccgatacaaaatccccggattacgtgtcccaagagatggtattcaaaacattggggacagacgtcgtgaagagcgccttcgagggctacaatgcctgcgtgttcgcatatggtcagacgggaagtgggaaatcctacaccatgatggggaattccggagactctggtttgattccccgcatatgtgagggcctgttcagtcgaatcaatgaaacgaccagatgggatgaggccagctttcgaacagaggttagctatctcgagatttacaatgaaagggtccgcgatctgcttcgcaggaaaagttccaagacatttaatctcagagtgcgcgaacaccctaaggaaggaccctacgttgaagatctttccaagcacctggtgcagaactatggcgacgttgaggagttaatggacgcggggaatatcaaccggaccaccgccgccacgggcatgaacgacgtctctagtaggtcccacgctattttcaccattaagttcacccaggctaaattcgactccgaaatgccatgcgagaccgtgagcaagattcacttggtggatctggccggctctgaaagagcggacgctactggggccaccggagtgcggttgaaggaagggggcaatatcaataagagtctggtaaccctcggaaatgttattagtgccttagccgatctgtcacaagacgcggcgaataccctggctaaaaagaagcaagtcttcgtgccctatcgggactctgtgctgacctggttgcttaaggattccctaggggggaattcgaagactattatgatcgccacaatcagtcccgcagacgtgaattacggcgaaactctgtcgaccctgaggtacgcgaaccgagccaagaatatcatcaacaagccaacaatcaacgaagacgccaacgtcaagctgataagggagcttagagcagagatcgcacggctaaagactctgcttgcccagggcaaccagatcgccctgcttgacagccccaccgcattatctatggaggagaagctgcagcagaatgaggcacgggtgcaagaattgacaaaggagtggacgaacaagtggaatgagactcagaacatcttgaaggagcagactctcgcgctacgtaaggagggaattggagttgtactcgatagcgaactgccgcatctgattggcattgacgatgacctcctcagcacaggaattattctctatcacctaaaagagggtcaaacatatgtgggcagggacgacgcctcaacagagcaagatatcgtactccatggcttggatctggagagcgagcactgcatcttcgaaaacatcggcggcacagttacgctgattcccctgagcggaagtcagtgctctgtcaacggcgttcagattgttgaagctacgcacttgaaccagggggctgtgattttactaggacgcaccaatatgttcagattcaaccatcccaaagaagccgcaaagctgagggagaagagaaagtcagggcttctgagttctttcagcctttctatgaccgatttatcaaaatcccgcgagaatttaagtgccgtcatgttgtacaatccgggtctagagtttgagaggcagcaaagagaggagttggaaaaactcgagtccaagcgcaagctgattgaagagatggaagagaagcagaagagcgacaaagctgagctggagaggatgcagcaggaggttgagacgcagcggaaagagactgagatagttcagctgcaaatccgcaagcaagaggagagcctcaagcgccgatctttccatatcgaaaataagctgaaagacctgctggccgagaaagaaaagtttgaagaagagagattgagggagcagcaggagatagagcttcagaagaaacggcaggaggaggagacttttttgcgggttcaggaagagttacagagacttaaggagctgaacaacaatgaaaaagccgagaagtttcagatcttccaggagctagatcagctccagaaagagaaagatgaacagtacgctaaactcgagctggaaaagaagcggctggaggagcaggaaaaggagcaggttatgctggtagcacacctggaagagcagttgcgcgaaaaacaggaaatgatccaactgctcagacggggcgaagtgcaatgggtagaagaggagaagagagacctagaggggattagagaatctctcctacgcgtcaaagaggcaagagccggcggggacgaggatggagaggaactggagaaggcccagctgagattcttcgaattcaaaagacgccaacttgtgaagctcgtgaacctggagaaagatttggtgcaacagaaggatattctgaagaaggaggtacaagaagagcaagagattctcgagtgcctcaaatgcgagcacgacaaggagtctaggcttttggagaaacatgacgagtctgtgactgatgttacagaggtcccacaggacttcgaaaagattaagccagtagaatataggttacagtacaaggagcggcagctccagtatcttcttcagaaccacctgcccacgcttcttgaggagaagcaaagggctttcgagattcttgaccggggccccttgtccctggacaatacactgtaccaagtcgagaaggagatggaagagaaggaagagcagctggctcagtaccaggcgaacgcaaatcagctgcaaaaactacaggccacctttgaattcactgctaatattgccaggcaggaggaaaaagttagaaagaaggaaaaagagatcctcgagtccagggagaagcaacaacgggaggctttagaaagagctcttgcgcgactggaaaggagacatagtgccctgcaaagacacagcacactgggaatggaaatcgaggagcagagacagaagttggcgtccttgaacagcgggagccgggaacaaagtggattgcaggctagcctggaagcagagcaggaagccctggaaaaggaccaagagagactggaatatgagattcagcagctgaagcaaaagatatatgaagtggacggggtgcagaaggatcaccatgggacacttgagggaaaggtggccagcagctcactgcctgtgagcgctgagaaaagccacctcgtcccacttatggacgctcgcataaacgcctatatagaggaagaagtacaacgaaggcttcaagatctccatcgggtaatctcagagggttgcagtacctctgctgacaccatgaaggacaacgaaaagctccataacgggacaattcagaggaaacttaagtacgagttatgcagagacctattgtgtgttcttatgcctgagccggatgctgccgcctgcgcaaatcacccattactgcagcaggatctggtgcagctcagtctcgactggaaaactgagattcccgatctcgtgctgcccaacggtgtccaggtaagtagcaagtttcagacgaccttggttgacatgatctatttcctgcatggtaatatggaggtgaacgtcccgagtctcgccgaagttcagttactactttacacaactgtgaaggtcatgggcgattctggtcacgaccagtgtcagagtctggttctgctcaatactcatatcgccctggtgaaagaagactgcgttttttacccgcgaatccggtctcgcaatataccaccaccaggtgcgcaatttgatgtgatcaaatgccatgccctgagcgagttccgctgtgtggtggttcccgagaaaaaaaatgtgtcaaccgtggaactggtgttcttgcagaagctgaagcccagcgttgggtcacgtaattctccaccggagcatctccaagaggcaccaaacgtacagttgtttaccaccccattgtacctgcaggggagtcaaaacgtcgcccctgaggtgtggaaactgacttttaatagtcaggatgaggctttgtggctgatttctcacctaacccgtctttag

SEQ ID NO: 26954 - DNA, 2697 bp, Artificial Sequence
  Description of Artificial Sequence: Synthetic coding sequence
atgagcgtaactgaagaggatttgtgtcaccacatgaaagttgtggtgcgggtgcgacctgaaaacacaaaggagaaggccgcaggcttccacaaagttgtgcatgtggtggacaagcacattctcgtctttgaccccaaacaggaagaagtctcattctttcatggcaagaaaaccacaaatcagaacgtcattaaaaaacagaataaggatcttaaatttgtcttcgacgctgtgttcgatgaaacgagcactcagtctgaggtttttgaacacacgactaaacccatactgcgctccttcctgaatggatataattgtactgtgcttgcctatggcgccaccggcgccggcaagacccacaccatgctgggcagtgctgatgaacctggagtgatgtatctgacgatgctgcatctgtataagtgtatggacgaaataaaggaggagaaaatctgctccaccgccgtaagttacctggaagtgtacaacgagcaaatcagagatttgttggtaaacagtggaccactagccgttagggaggacacacagaagggtgtagtcgtccatggtttgactttacaccagccaaagtccagcgaagagattttgcacttgttagacaatggcaataaaaataggactcagcatcctaccgatatgaacgcaacttcgtcccgatctcacgctgtatttcagatttatcttcgccaacaggacaagacagcgtccatcaaccaaaacgtgcgcatcgccaagatgtccttgatcgacctggctggctccgagcgggcatctacatcaggtgctaaaggaactcgcttcgtggagggaaccaatatcaacagaagcctgttagccctgggcaacgtaattaacgccctagccgattccaagaggaaaaaccagcacatcccctatcgcaatagtaagctgacccggttgttaaaggacagcctgggcggcaattgtcaaacaataatgatcgccgcggtgtcacctagctccgtattctacgacgacacctacaacacattaaaatatgctaatcgggcaaaggacattaaatcctctctcaagagtaatgtcctgaacgtgaacaatcacataactcagtatgtgaaaatctgcaacgaacagaaagccgaaattttgctgctgaaggagaagttaaaggcctacgaagagcaaaaagcctttacaaatgagaatgaccaggccaaactgatgatttccaatcctcaggagaaagaaattgagcggtttcaggagatcctgaattgcttgtttcaaaaccgagaagaaattagacaagagtacctgaaactggagatgttgctgaaagaaaacgagctgaaatcgttttaccaacagcagtgtcacaagcagatcgagatgatgtgtagtgaggacaaagtcgagaaagccacaggtaaacgtgatcatcggcttgcaatgttaaaaacgcggcgatcttacttagaaaagcgacgggaggaagagctgaagcagtttgacgagaatacaaactggctgcatagggtcgagaaggaaatgggcctactgagccaaaacggccatattcccaaagagctgaaaaaggatctgcactgccaccatctccatcttcagaacaaggaccttaaagcgcaaattcgacacatgatggacttggcgtgcctacaggagcagcaacacaggcaaaccgaagcagtcctgaacgcacttttgccaactctgcgcaaacagtattgtactctcaaagaggctggcctatccaacgccgcttttgaaagcgatttcaaagagatcgagcaccttgtggagcgcaagaaggttgtcgtgtgggctgaccagaccgccgaacaacccaagcagaacgacctccctggcatctctgtgctgatgaccttcccccagctgggacctgttcagcctatcccatgctgctctagctccggcgggacaaatctggtcaagatcccgaccgagaaaaggactcggcgaaaactaatgccctcgcccctgaaggggcaacacacgctgaagagtcctccatctcagtccgtgcagctcaatgacagccttagcaaggaattgcagccgattgtgtacactcctgaggactgtagaaaagcttttcagaatccgtcgacggtgacactgatgaaaccaagcagcttcaccacctccttccaggcgattagctccaacattaacagcgacaattgtctcaagatgctctgcgaggtggccataccccacaatcggcgcaaagagtgtggccaggaagatttggattcaactttcactatctgcgaggatattaaaagttcaaaatgtaaacttcctgagcaagagtccctacccaacgataacaaggatattttacaaagactggacccctcgagtttctcgaccaagcactcaatgccagtgccctctatggtgcccagctatatggccatgactacagcagcgaagagaaaacgaaagctcacttccagcacatcgaactcttctctgacagcagacgtcaactcaggtttcgctaagcgggtccggcaggacaattcttctgagaagcacttgcaagagaataaaccaacaatggagcataaaagaaatatttgtaagatcaatcctagcatggtgaggaagtttggccgcaatatctctaaagggaatctcagatag

SEQ ID NO: 26955 - DNA, 1479 bp, Artificial Sequence
  Description of Artificial Sequence: Synthetic coding sequence
atggctccccccgccgccagactcgcgctgctgtctgctgccgccctgactcttgccgcaaggcccgcaccgtcccctgggttgggccccggccccgaatgtttcacagccaatggcgctgactaccgagggacacagaattggaccgcactgcagggcggaaagccctgcctgttttggaatgagacctttcaacacccctataatactctcaaatacccaaacggagagggaggcctgggagagcacaactattgtcgtaaccccgatggcgatgtcagtccgtggtgttatgttgcagagcacgaagacggggtttattggaaatattgtgaaatccctgcctgccagatgcctgggaaccttgggtgctacaaggaccacggaaacccaccccccctcaccgggacctcaaagacttctaataaactgacaattcagacctgcattagcttttgccggtctcagcggtttaaattcgccggaatggagtctggctatgcctgcttttgcggcaacaacccagactattggaaatatggtgaagcggcttcaactgaatgcaatagcgtgtgttttggggaccatacacagccctgtggcggggatggacggatcattctattcgatacactggtaggcgcatgtggaggaaactattcggctatgtcgtcagttgtgtactcccccgattttcctgacacctatgccactggaagagtgtgctactggaccattcgagtcccaggagccagccatattcacttctctttccctctgttcgacatacgcgatagcgccgacatggtggagctcctggatgggtatacacacagagtgctggcccggttccatggacggagcagaccacccctttccttcaacgtgtctctagacttcgtaatcctctacttcttttccgataggataaatcaggcccagggtttcgctgttttataccaggcagtgaaagaagagcttccccaggaacgtcctgcagtgaaccaaactgtggcagaggtgatcacagagcaggccaatcttagcgtctctgccgcaagaagttctaaagttctgtacgtgataactacgtccccctctcaccctcctcagacagttcccggaagtaactcgtgggccccgcccatgggagctggctctcatcgggtcgagggctggacggtctacgggttggcaaccctgctcatcttaacggtgacggccatagtggccaagattctgcttcacgttacattcaagagccatagagttccagcttctggcgatctgagagactgccaccagcccggaacttctggtgagatctggagcatattctacaaaccatccaccagtatttccatcttcaagaagaaacttaagggccagtcacaacaagatgacaggaacccacttgccatccaggatagcgaagtgacgtccctgatttggagccagggacagccccgatccatctag

SEQ ID NO: 26956 - DNA, 1377 bp, Artificial Sequence
  Description of Artificial Sequence: Synthetic coding sequence
atggcccctccagcagccagacttgcactgctgtcagcagctgctcttactttagccgcccgccctgcaccatcgccgggactgggacctggtcctgaatgtttcactgctaatggagctgactacaggggcactcagaattggaccgctctgcaaggaggaaaaccatgcctcttttggaatgaaacgtttcagcacccttataacaccctgaaatatcccaacggagaaggcggacttggtgagcacaactactgccgcaacccagatggcgacgtttccccatggtgttatgtggccgaacacgaggatggcgtgtattggaaatactgcgagatcccagcttgccagatgcccggaaatcttgggtgttataaagatcatggaaatcctccgccacttactgggacttcaaagacgagcaacaaactgacaattcaaacctgtattagtttttgccgctctcaaagatttaaatttgccggtatggagtcaggctacgcatgtttctgcggcaataatccagattattggaaatatggagaagccgcctccactgaatgcaactctgtctgtttcggtgaccacacccaaccttgcgggggggatgggcggatcattctgtttgatacgctagtcggagcctgtggagggaattatagtgcaatgagctctgttgtttatagccctgacttccccgatacctatgccacgggtcgggtctgctactggacgatacgtgtgccgggggcgagccacattcacttctcattcccactgtttgatattagggattctgctgacatggtggaattactcgacgggtacacgcatcgggtccttgctcggttccacggaagatcccgaccgccactgagcttcaatgttagcctcgactttgttattctttatttttttagcgataggatcaaccaggcgcagggcttcgccgtgctctaccaagctgttaaagaggagctgccacaggagcgccctgcagtcaaccagaccgtggccgaagtcatcaccgagcaagcaaatctctctgtgagtgccgcccgctcgtctaaagtactctacgtcattactacttcacctagccatcccccacagaccgtcccaggatggacagtatatggtcttgctacactcctaatcttgacagtgaccgcgattgttgctaaaattctactacatgtgacattcaagagtcatagggtgccggcatccggtgacctcagggattgtcaccagccgggcacttctggcgagatctggtctattttttacaaaccaagcacgtcaatcagcatttttaagaagaaattgaaagggcagtctcaacaagacgacagaaatcccctggtcagcgactag

SEQ ID NO: 26957 - DNA, 1428 bp, Artificial Sequence
  Description of Artificial Sequence: Synthetic coding sequence
atggccccacccgcggcccggttagcacttctgtcggctgccgctcttactctagccgcgcgcccagctccctcccctggcctgggtccaggccccgaatgctttaccgcgaacggggccgattatcgaggcacccagaattggaccgctctacaggggggtaagccgtgtctgttctggaacgaaaccttccagcatccctacaatactctgaagtatcccaacggggaaggcggcctgggcgaacataattattgtagaaacccagacggcgatgtgtctccttggtgttatgtagccgaacacgaggatggcgtgtattggaagtattgtgagatccctgcttgccaaatgcctggaaacctgggctgctacaaggatcacgggaatccgccccccctgaccggcacaagcaagacctctaataagctcactatacagacatgcatatccttctgccgctcccagaggttcaagtttgcgggaatggagtcagggtacgcatgtttttgtggaaacaaccccgactattggaagtacggcgaagcagcaagcacagagtgcaatagtgtatgctttggcgatcatactcagccttgcggcggcgacgggcgcattatactgtttgatacactagtcggagcatgcggcgggaattacagcgccatgtcaagtgtcgtgtattccccggatttcccggacacatacgctactggcagggtatgctactggactattcgtgtgcctggtgcgagccacatccatttcagttttcccctgtttgacataagagattcagcggacatggtcgagctcctggatggctacacgcaccgagtcctggccagattccacggtagatcgcgcccccccctctcattcaatgtctccctcgattttgtaatcctttacttttttagtgatcgaatcaaccaggcccagggctttgcggtcttatatcaagccgtgaaggaagaactcccccaggaaaggccggcagtcaaccagacagtagcagaagtgattactgaacaagccaatcttagcgtgtccgccgccaggagctctaaggtgttatacgttatcactaccagcccttcccatccaccccagaccgtccccggaagtaactcctgggcgccacctatgggggcaggttctcatcgggtggagggctggactgtttacggactggccactctcctgatcctgactgtgaccgctattgtggccaagattctgctccacgtcactttcaagtcccatagagtgcccgctagcggagacctccgtgactgccatcaacctggcacatcaggtgagatctggtccatcttctacaaaccctccacttccattagcatcttcaaaaagaaacttaagggccagtctcagcaagacgatcgcaaccctctggtttctgactag

SEQ ID NO: 26958 - DNA, 1422 bp, Artificial Sequence
  Description of Artificial Sequence: Synthetic coding sequence
atggcacccccggctgcccgcctagctcttctgtcggctgccgcactgaccctggccgccaggccagcaccatctccggggctgggacccgagtgtttcaccgcgaacggagctgactacaggggcactcagaattggactgcacttcagggcggcaaaccttgcttgttttggaacgagacattccagcacccctacaacactctaaagtatcccaacggtgaaggcgggttaggggagcacaactactgtaggaaccctgacggggacgtgtctccctggtgttacgtagcggaacatgaggatggtgtttattggaaatactgcgaaattcccgcctgccagatgccagggaacctggggtgctacaaagaccatggcaaccctcctcctctgacgggtacgagtaagaccagcaacaagctgaccattcagacctgcatcagcttttgcaggtctcaacgcttcaaattcgcaggtatggaatccggctacgcatgtttctgtggaaacaatcctgactattggaagtacggcgaggcagccagcacggaatgcaattcagtctgttttggggatcatacccagccatgtggcggtgacggacggattatactattcgatacactggttggagcctgcgggggcaactacagtgcaatgtcatccgtcgtctacagcccagacttccctgacacttatgctacagggcgtgtctgctactggactatcagagtccccggagctagtcacatccatttcagctttccattgttcgacattagagacagcgccgatatggttgagctgctggatggctacacacaccgcgtgctcgctcgatttcacgggcgatccaggccccctctctcttttaacgtctccctggactttgtgatactttactttttctcagacagaattaatcaggcacagggctttgctgtgctctatcaagccgtaaaagaagaactgcctcaggagcgccccgccgtgaaccagacagtggcagaagtgatcacggagcaggccaatctctctgtgagtgccgccaggtccagcaaagtgctgtatgtaattaccaccagtcccagtcacccaccccagaccgttcccggatcaaattcgtgggccccccctatgggcgcaggcagtcaccgagtagaaggctggactgtctatggtttggcgaccctcctcatcttgactgtaacagctatcgtcgccaaaattctcttgcacgtgacctttaaaagtcacagggtacctgcttcgggcgacctgcgcgattgccaccaacccgggacctccggagaaatttggagtattttttataagccttcgacaagtatcagcatctttaagaagaagctaaaaggccagtctcaacaggatgaccgaaaccccctggtgagtgattag

SEQ ID NO: 26959 - DNA, 867 bp, Artificial Sequence
  Description of Artificial Sequence: Synthetic coding sequence
atggcagcagtccttcaacgagttgagcgcctgtctaaccgagtcgttagggtgttgggctgcaatccgggtccaatgaccttgcagggcacaaacacctacttggtgggcacgggcccccggaggattctgattgataccggagaaccagcaattccagaatacatctcctgccttaagcaggctttgacagaatttaacaccgcgatacaggaaatcgtggtgacacattggcaccgggatcattcaggcggtattggggatatctgtaagtctatcaacaacgatactacatactgcatcaaaaagttgcctaggaatccacaacgagaagaaataattggcaacggagagcagcagtatgtatacctcaaagacggcgacgtaatcaagaccgaaggcgcaacactgcgggttctgtatacccccggccataccgacgatcatatggctttgctcctcgaagaggagaacgcaatctttagtggcgattgcatcttgggggagggtaccaccgtgttcgaggacctctacgactacatgaattcactgaaggaactgcttaagattaaagccgacattatttaccccggtcatggaccagtgatccacaacgccgaggccaagatccagcagtacatcagtcacagaaatattagagagcagcagatactgactctgttccgcgaaaacttcgaaaagtccttcactgtcatggaactcgtgaagattatttataaaaatactccagaaaaccttcatgaaatggctaagcataatttactcctgcacctcaagaagctggaaaaggagggcaaaatcttttccaacacagatccagacaagaagtggaaagcccacctttag

SEQ ID NO: 26960 - DNA, 867 bp, Artificial Sequence
  Description of Artificial Sequence: Synthetic coding sequence
atggctgcagtgctccagagagtagaaaggctatccaacagagtggtgcgggttcttggctgcaaccctggacctatgacacttcagggcaccaacacctaccttgtcggaacaggcccaaggagaatcttaatcgataccggtgagccggccatacccgagtacatatcttgccttaagcaagcactgaccgaattcaacaccgccattcaggaaatcgtggtcacacattggcatcgtgatcactctggtgggattggtgacatctgcaagtctatcaacaatgacacaacctactgtatcaaaaagcttccgcgtaatccccagcgagaagagatcatcggaaacggtgagcagcagtacgtctatctcaaggacggtgatgttatcaagaccgagggtgccacactgagagtactatacacgccaggacatactgacgatcatatggcccttttgctcgaggaagagaatgcgatctttagcggagactgcattctgggtgaaggcacgacagttttcgaggatttatacgactacatgaactccctgaaagaacttcttaaaatcaaagctgatataatttaccctggtcacgggccagtgatccacaacgctgaggcaaaaatccagcagtatatctcccataggaatattagagaacagcagatcctcacccttttccgggagaatttcgagaaatctttcaccgtcatggagctggtgaaaatcatctacaaaaacacgccagaaaatcttcacgaaatggccaaacacaatctcctgcttcatcttaagaagctggaaaaggaaggtaagattttcagcaacaccgaccccgataagaaatggaaggcccacctgtag

SEQ ID NO: 26961 - DNA, 1704 bp, Artificial Sequence
  Description of Artificial Sequence: Synthetic coding sequence
atgaaacccgtatgggtggcaactttgctttggatgctgctcctggtaccgcggttgggcgcagctcgaaaaggctcacctgaggaggcctccttttattacggaacattcccattggggttctcatggggagtgggatcttctgcatatcagaccgagggtgcatgggatcaagatggaaaaggaccttctatttgggacgtgttcacacattcagggaaaggtaaagtgctggggaacgagaccgcagacgtggcctgtgacggctattacaaggtccaagaagacatcatacttctcagagaattgcatgttaatcactatcggttcagcctctcatggccaaggctgttgcccactgggataagagccgaacaagtaaacaagaagggcatagagttctactctgacctgatagacgcgttactttcatctaacattaccccaatcgtcacgctgcaccactgggatctgcctcagctcctgcaagtgaagtatggtgggtggcagaacgtttctatggcaaattacttcagagattatgcgaacttgtgctttgaggccttcggcgacagggtgaagcactggatcaccttcagcgaccctagagccatggccgagaagggatatgaaacgggccatcacgcgcctgggttgaagcttcggggtaccgggctttacaaagccgctcaccacattatcaaagctcacgccaaggcctggcacagctataataccacctggcggagtaaacaacaaggacttgtggggattagtttgaactgtgattggggggaaccagttgacattagcaatccaaaagacctggaagctgcagaaaggtacctgcagttttgtctaggctggttcgccaaccctatctacgctggagactacccccaggtcatgaaggactacatcgggcgaaagtccgcggagcaggggctcgagatgagccggcttccggtcttttccctccaggagaagtcctatataaaaggtacctccgatttcttaggtcttggccatttcacgacgcggtacatcactgaaaggaattatcccagtagacagggtccttcttatcagaatgatagggatctcatagagctggttgatcctaattggcctgatttgggctccaagtggctgtatagcgtgccttggggattccgcaggttactcaactttgcccagacacagtacggcgacccaccgatatacgtgatggagaacggagcttcacagaagtttcattgtactcagctgtgtgatgaatggcgaattcagtatttgaaggggtatatcaacgaaatgctgaaagcaattaaggacggggccaatatcaaggggtacacatcttggagtctgctggacaaatttgagtgggagaaaggatacagtgataggtatgggttctattacgtggagttcaacgacagaaataaaccccgctatcccaaggcttcagtgcagtattacaagaagataattattgccaatggctttcctaatcccagggaagtggagagttggtatctgaaggctctggagacgtgttctataaataatcagatgctcgcggcggaacccctgctgtctcacatgcaaatggtgacggagattgtggtccctactgtgtgtagtctgtgcgtgctgattactgccgtgcttttgatgctgttactgaggcgccaatcgtag

SEQ ID NO: 26962 - DNA, 1185 bp, Artificial Sequence
  Description of Artificial Sequence: Synthetic coding sequence
atggcgaattacttccgcgattatgccaacctgtgctttgaagcattcggcgatcgagtgaagcattggatcactttttcagacccgcgggccatggccgaaaaagggtacgagacaggccatcatgcccctggtctgaaactcagaggaacaggcctgtataaggcagctcaccatattattaaggcccacgcaaaggcctggcactcctataacacaacttggcgaagtaaacagcaaggacttgtgggcatttccttgaattgcgattggggggagccagtggacattagtaatcccaaggacctcgaagcggcagagcgatacctccagttttgccttggctggtttgctaatccaatctacgctggagactatccacaggtgatgaaagattacatcggcagaaagtctgctgagcagggcctggagatgtctcgcctgccagtgttctcactgcaggaaaagagttatataaaagggactagcgactttctcgggctgggtcactttaccacacgttacattacggagagaaattaccctagcagacaaggaccatcctatcaaaacgatcgggaccttatcgagctggtcgacccaaattggccagatctgggcagcaagtggctatactcagtgccttggggatttcggagattattgaacttcgcgcagacacagtatggcgaccctccaatttatgtgatggagaatggcgcctcccagaaattccattgcactcagctgtgtgacgagtggagaatccagtacttgaagggctacattaacgagatgctgaaggcaatcaaagacggagccaatattaaggggtatacctcctggtctcttctggacaagttcgagtgggagaagggctactcagatcgctacgggttttattacgtggaattcaatgatcgcaataaaccgcggtaccctaaggcttctgtccagtattacaagaagattattattgccaatggattcccgaatccaagagaggtcgaatcctggtatctgaaggctctcgagacttgctcgatcaacaaccaaatgcttgctgccgaaccgctcctgtcccacatgcagatggtgaccgagattgttgtgccgacggtttgtagcttgtgtgtcctcatcaccgcggttctgctgatgctgctgctccgtagacagagctag

SEQ ID NO: 26963 - DNA, 1446 bp, Artificial Sequence
  Description of Artificial Sequence: Synthetic coding sequence
atggcggcctcctggagccttctggtgacacttagaccgctggcccagagtcccctgcgaggcagatgtgtcggatgcggcgcatgggccgccgcactggcaccactggctactgccccgggtaagccattctggaaagcatatacagtgcagacgtctgaaagcatgacaccaacggcaacttccgaaacttatttaaaggctctggccgtgtgccatggaccacttgaccactacgactttttaataaaggcacacgagctcaaggatgacgagcatcagaggagagtgatacagtgtctgcaaaaactgcatgaggaccttaaaggctataacattgaggcagaggggctcttcagcaagctgttctcaaggtctaagccacccaggggcctatatgtgtatggcgatgtcggcacaggcaaaaccatggtgatggatatgttctatgcgtacgtcgagatgaagcgtaagaaaagggtgcactttcatggttttatgttagatgtgcataagagaatccaccgcttaaaacagagcctgcctaaacgaaagcctggattcatggcaaagagctacgatccaattgcccccattgccgaagaaattagcgaagaagcgtgcttgctctgctttgatgaatttcaggtgaccgacattgcagatgcaatgatcctgaaacagctttttgagaatctgttcaaaaatggcgtagtcgtggtagctacatctaatcgcccccccgaggatctgtataaaaatgggctgcaacgcgccaactttgtcccttttatcgccgtcctgaaagagtactgcaacaccgtgcagctggactccggcatcgattatcgaaagcgggagttaccagctgcaggcaaattatactatctgacgagcgaggccgatgtggaagcggtcatggataagcttttcgatgagcttgctcagaagcaaaacgaccttaccagaccgcgcattctgaaggtgcagggtagagagctccgcctgaacaaagcgtgtgggacagttgcagattgcaccttcgaggagctctgtgaaaggccccttggcgctagcgattatctggagctgtcgaaaaattttgacacgattttcctccggaatattcctcagtttacccttgcaaaccgtactcagggtcggaggtttatcacgctaattgacaacttttatgatctgaaagttcgtattatttgttctgccagcacccctatctcaagtctcttcctccaccagcaccacgatagcgagctggaacaatcaaggatcctcatggacgacttggggcttagccaggactccgccgagggcctgtctatgtttacaggggaagaagagatcttcgcctttcagcgtacaatatcaaggctgactgagatgcagacagaacagtactggaacgaaggagatcgcaccaagaaatag

SEQ ID NO: 26964 - DNA, 486 bp, Artificial Sequence
  Description of Artificial Sequence: Synthetic coding sequence
atgggctgctgctactcttcagaaaatgaggattctgatcaggaccgggaggaacgaaagctcttgctcgaccctagctcaccaccaaccaaagcactcaacggcgccgagcctaattaccactcactaccttctgcccgcacagacgaacaagcactgttatctagcatccttgctaaaaccgcaagtaatatcatagacgtctccgctgcagacagccagggtatggagcagcacgagtatatggatagggcaagacaatactctactaggctggcagtgttgagctcctctctcacccactggaagaaactgccaccactgcccagtctgacgtctcagcctcaccaggttctggcgtcagaacccattccgttttcagacctgcagcaggtgtcaaggatcgcagcctacgcttactccgcccttagccagatccgggtagatgctaaggaagagttagtggtgcagtttggcattccctag

SEQ ID NO: 26965 - DNA, 453 bp, Artificial Sequence
  Description of Artificial Sequence: Synthetic coding sequence
atgcttcggcctaaagcactcacccaggtcctctcccaggctaatacagggggggtccagagcaccctgctcttaaataacgaagggtctttactcgcatactccggctacggtgacactgatgccagagtaaccgccgctatagctagcaacatatgggcggcatatgatcgaaatggcaaccaagcgttcaatgaagacaatcttaaatttatcctgatggattgcatggaaggcagagtagcaattacgcgtgttgctaacctgcttctttgcatgtatgcaaaggagacagtggggtttgggatgttgaaggctaaggcagtgtgtggaacagacctatgttccccaagcgcaggacctggtttcggagctgttcccgggggggcaccccacccatccggcgggatcttgaccgccctagtcgaggcaggcgtgcgaaaggagaaatag

SEQ ID NO: 26966 - DNA, 288 bp, Artificial Sequence
  Description of Artificial Sequence: Synthetic coding sequence
atgctgaggcctaaggctctgacgcaggtcctaagccaagccaatacaggcggtgtccaatctacactactcctgaacaacgagggcagtctgctggcctatagtggctacggagatactgacgctcgcgttaccgcggctatcgcttccaacatttgggctgcctacgataggaacggaaaccaggcttttaacgaggacaatctcaaattcatcttaatggattgtatggctcaggccctggtacagtatttggaggagcccctcactcaggtagcagctagttag

SEQ ID NO: 26967 - DNA, 378 bp, Artificial Sequence
  Description of Artificial Sequence: Synthetic coding sequence
atgctcagaccgaaagctctgacacaggtgctgtctcaggccaatacaggtggagtgcaaagcacgcttctgcttaacaatgagggatctttgctggcatactcggggtacggtgataccgacgcccgtgtgaccgctgccattgctagcaacatttgggcagcctatgacagaaacggtaaccaggccttcaacgaggataacttaaagttcatcctaatggattgcatggaaggacgcgtagctatcacccgcgtagcaaatctgctgctgtgcatgtacgctaaagaaactgtgggattcggtatgttgaaagcaaaggcccaagctctggtgcagtatctggaagaaccactgacccaagtagcagcctcctag

SEQ ID NO: 26968 - DNA, 375 bp, Artificial Sequence
  Description of Artificial Sequence: Synthetic coding sequence
atggccgatgatcttaaaaggtttctgtataaaaaactccccagcgtcgagggcctgcatgcgatcgtcgtcagtgaccgcgatggggtccccgtaattaaagtggccaatgacaatgctccagagcatgccttgcgacctgggttcctttctactttcgcattagccactgatcagggttccaaactcgggttgtcaaagaataaaagcattatctgttactataatacctatcaggtggtccagtttaacagacttcccctggtggtgtcgtttatcgcctccagcagtgccaatactggccttatagtgtctctagaaaaggaactcgctcccctgttcgaggaactccgacaggtggtggaggtgagctag

SEQ ID NO: 26969 - DNA, 4425 bp, Artificial Sequence
  Description of Artificial Sequence: Synthetic coding sequence
atggctagactcgcagcagtattatggaacctgtgcgtaaccgctgtcttagtcacaagcgcgacacagggactgtccagggccggacttccttttggcttgatgcggagagagcttgcttgcgagggctaccccatcgagctccggtgtcctggatccgacgtgatcatggttgagaatgcgaactatggtaggaccgatgacaagatctgtgacgcagacccatttcaaatggaaaatgtccagtgctacctgcctgatgcctttaagattatgtcacagcgctgcaacaaccgaacccagtgtgtcgtcgttgccggcagtgacgcctttccagacccttgccctggtacctacaagtatctggaggtgcagtacgactgcgtgccttacaaggtcgagcagaaagtgtttgtttgtcctgggacgcttcaaaaggtgctcgaacccacctctacccacgaatcagagcatcagtctggtgcctggtgtaaagacccccttcaggcaggggatcgtatatatgtgatgccctggatcccgtaccggacggacacattgaccgaatacgctagttgggaagactacgtcgctgcgagacacacaacaacatatagactccctaacagagttgacggcacaggttttgtggtttacgacggcgcggttttctataacaaagagcggacgagaaacatcgtcaagtacgatctccgcactcggatcaagagcggcgagaccgtgataaataccgctaactaccatgatacttccccctacagatggggcggaaaaacagacatcgatctcgcagtagacgagaacggcctatgggtgatctacgccacagaaggaaataacggcaggctggtggtgagtcagctgaatccctatactttgaggtttgaaggcacatgggaaaccggctacgacaaaaggtcagctagtaatgctttcatggtgtgtggcgttttgtatgttcttcggtccgtgtacgtggacgatgactctgaggcagcaggaaatcgggttgattatgcattcaataccaacgccaatcgggaggaacccgtcagtctgacgtttcccaatccataccagtttatttcatccgtggattataatccccgagacaaccagctgtacgtatggaataactactttgtggtcaggtactctttggaatttggtccccccgacccttctgccggcccagcaacatcccccccactgtccacaacaaccaccgctcgaccgacccctttgactagcaccgcttcccccgcagccactacccccctccggcgcgcacctctgaccacgcaccccgtgggtgccattaaccaactgggtccggatcttccgcccgccacagcgcccgtgccctctacaagaagacctccagctcccaatcttcatgtgagcccagaactgttttgtgagcctcgcgaggttcggcgtgtacagtggccagccacccagcaagggatgctggtcgaacgcccctgtccaaaaggtacccgaggtatcgcatcttttcagtgtctcccagcactaggcctgtggaacccccggggtcctgatctgagcaattgcacttcgccgtgggtcaaccaggtggcacaaaagattaaatccggtgaaaatgcggccaatatcgcatcagaattggccaggcatacaagaggttctatttacgcgggcgatgtcagcagttcagtcaaactgatggagcagttgctagatatcttagatgcccagctgcaagctctgcggccgatcgaaagggagtcagcagggaagaactacaacaagatgcacaaaagagagcggacatgcaaggattacattaaagcggtcgtggaaacagtagataacctgctacggcctgaagcgttggaaagctggaaagatatgaacgctaccgagcaggttcacactgctacaatgctgctggacgtactcgaagaaggagcttttctgctcgccgataacgtcagggaacccgccagatttctcgcagctaaggagaacgtggtgctcgaagtcactgtactgaatacggagggacaggtccaggagttggtgtttcctcaggaggagtaccccaggaagaactccatccaactgagcgcgaaaacaataaaacagaatagtcgtaatggcgtcgtgaaagtggtgtttatcctatataataatctcggcctgtttctgagtactgagaatgccacagtgaagcttgctggggaagccggccccgggggcccgggaggggcatcactggttgtgaacagccaggtgatcgcagcatccataaacaaggaatcctctcgagtgttcctgatggaccccgtaatatttactgttgcacacctcgaggacaaaaaccactttaatgctaattgctctttctggaattactcggagcgatccatgctgggctattggtcaacacagggctgtcgactggtggaatctaacaaaactcacacaacttgtgcttgttcgcatttgactaacttcgctgtgctgatggcccacagggaaatctaccagggcaggattaacgaactgctgctttctgtaattacgtgggtgggcatcgtcatcagtctcgtttgcctcgccatatgcatctctaccttctgcttccttcgaggcttgcagactgaccgcaatacgatacacaagaatctatgtattaacctttttttggcagaactgctgttcctggtcggaattgataagacccagtatgagatcgcatgcccaatcttcgcgggactacttcattatttttttctcgcagcctttagctggctctgtcttgaaggagtacacctttacttgctgctcgtggaggtctttgagtcggagtattcaaggactaagtactattacctaggcggctattgcttccctgccctcgttgtaggaatcgcggcagccatcgactaccgatcttacggcactgaaaaggcctgttggctaagggtggacaattactttatatggtctttcatcgggccggtgagctttgtgatcgtcgtgaacctggtctttctgatggtcacattacataaaatgatccggtcaagcagtgtactgaagcccgactctagccgcctggacaatatcaagtcgtgggccctgggagcgatagcccttttgttcctcctgggcctcacttgggcttttggcctgcttttcattaacaaagagtccgtggtaatggcttacctcttcactactttcaacgcctttcaaggcgtgtttattttcgtctttcactgtgccctgcagaaaaaagtacacaaggaatattccaagtgcctccggcatagttactgttgtatccggagtcctccaggaggcacgcacgggagcctgaaaacgtctgccatgcgcagtaataccaggtactacacggggacgcagtcccgcattagacgcatgtggaatgataccgtgaggaagcaaactgaatcaagctttatggcgggggatatcaattccaccccaaccctgaaccgtggcacaatgggcaaccacttgctgactaatcccgttctacaacctaggggcggaacatccccctataataccttgattgctgagtcagtcgggttcaatccctcctcccctcctgtgtttaactcaccaggatcttaccgggagcccaagcatcctctgggcgggcgagaggcatgtgggatggacacactgcctttgaacggaaactttaacaatagttacagcttgcgatccggggactttccacccggcgatggtggtccggagcctccccgtggcagaaacctcgctgacgctgcggccttcgagaagatgatcatatcagaattggtccataataacctccgggggtctagcagtgcggctaagggtcctcccccacctgaacccccggtgccacccgtacccggcgggggtggcgaggaggaggcgggcggacccggcggcgcggacagagccgagatagaactactgtataaggccttggaggagcctctgttgcttccacgggcccaatctgtactctatcaaagtgacctggatgagtcagagagctgcaccgcagaggacggagcaacctctagacccttaagcagtcctcctggccgcgatagcctgtatgcctctggcgcaaacctgcgcgatagcccatcataccctgactctagtcccgaaggaccgagcgaggctctgcccccccctccccccgctccaccaggcccacccgagatttactacacatccagaccccctgccctcgtggctcgaaatcccctgcagggatattatcaggtgcgacggccatctcacgaaggctacttagccgcccccggcctggagggtcctggccccgacggagacggtcagatgcagctcgttaccagcctatag

SEQ ID NO: 26970 - DNA, 4410 bp, Artificial Sequence
  Description of Artificial Sequence: Synthetic coding sequence
atggccagacttgccgccgtgttgtggaacctctgtgtgacagcagtgttggtgacaagcgccacgcaggggctctccagggccggcttacctttcggcttgatgaggcgggaactcgcctgtgagggctaccctatcgagctgcgatgtccaggaagcgatgtgatcatggtggaaaacgccaactacggcaggacggacgataaaatttgcgatgccgaccctttccaaatggaaaacgtccaatgctacttgcctgatgcattcaagataatgtcccaacgttgcaataataggacgcagtgtgtggtggtggccggttccgacgctttccccgacccttgccccggaacctataagtatctggaagtgcaatacgattgtgtgccatatatattcgtgtgcccagggacactacagaaagtgctggaaccaacatcaacacatgagagcgagcatcagtcaggcgcgtggtgcaaggatccccttcaggccggagatcgaatctatgtgatgccttggattccttatagaacagataccttgaccgaatatgcctcctgggaagactatgtggcagcccggcacacgacgacgtatcggctgccgaatcgtgtggatggaacaggctttgttgtgtacgatggggcagtcttttacaataaggagagaacgagaaatatcgtcaagtatgatctccgcactcgaatcaagtccggagaaactgtcatcaatacggctaactaccacgacacgagtccctacagatggggtggcaagacggacatcgacctagcagtggacgaaaacggcttatgggtgatttacgcaaccgagggcaataacgggcgtttggtcgtatctcaactgaacccatataccttgagattcgagggcacctgggaaactggttacgacaaaaggtccgctagcaacgcttttatggtgtgtggggtcctctacgtgctccgttccgtgtacgtcgacgacgactcagaagctgctggtaacagggtggattacgctttcaacactaacgctaacagagaggaacctgtttcactcacgttccccaacccgtatcagtttataagcagcgtggactataacccaagggataaccagctgtatgtttggaataactactttgtggttcggtactcactcgaatttggcccgcccgatccatccgccggccctgccacatcaccgcctctgagtaccactaccactgcacgtccaaccccccttacctccacagcctctcctgccgctacaacccccctcagaagagctccacttaccacacatccagttggagccattaaccagctagggcctgacctgcccccggctaccgcccctgtgccaagcacacgccggcccccagccccaaacttgcacgtatctccagagttgttttgtgaaccccgcgaagtccggagggtgcaatggcccgctacacagcagggtatgctcgtagaaaggccatgccctaagggtacgcgagggatcgcttcatttcaatgcttacccgccttaggcctttggaaccctagaggaccggacctgtccaattgcacctcaccatgggtcaaccaggttgcccagaaaatcaaatcaggtgagaacgccgccaacatcgccagcgagctggccaggcacactagaggctctatatacgcgggtgatgtctcatcgagcgttaagctgatggagcagctcctcgacatcctagacgctcagctgcaggccctgagacctattgaacgcgagtccgcgggaaagaactataacaaaatgcataagcgtgagcggacttgtaaggactatatcaaggcggtggtggagactgtggacaacttgctgcggccagaggccctagagtcatggaaggatatgaatgccaccgaacaggtgcacaccgccactatgctgctcgatgttctggaggagggcgctttcctgttggctgacaacgtgagagagccagcgaggttcttggccgctaaggagaatgtcgtgcttgaagtaaccgtgcttaatacggaggggcaggttcaagagttggtcttcccacaggaggagtatcccaggaagaacagtatccaacttagcgctaagactatcaagcaaaatagtcgaaatggggtcgtgaaggtggtgtttattttgtataataacctgggtctgtttcttagtaccgagaatgcaacggtaaagcttgcgggtgaagctggaccaggtggccctgggggtgcgtcactggttgttaattcacaagtcatagcggcttctataaataaggaatcttctagagttttcctgatggaccctgtgatcttcacggtggcgcacttggaagataagaatcacttcaatgctaattgttcattttggaactacagcgagcgaagtatgctaggatattggtcaacacagggttgtaggctggttgagtctaataagacccatacgacatgtgcttgtagtcatttgaccaattttgccgttctgatggcacaccgcgagatttatcagggccgaatcaacgagctactgctctctgtcataacatgggtaggcatcgttatcagcctggtgtgtctagccatatgcatcagcactttctgttttctgagagggctgcagacggatagaaacaccatccataagaatctgtgtattaatttatttctcgcagagttgttgtttcttgtcgggatcgataagacacagtacgagattgcgtgtcccattttcgccggcctgttacactacttctttcttgctgcctttagttggctatgcctggagggggtacatctttacctcttgctggttgaagtgttcgagtctgaatattctcgcactaagtactactacctcggtggctattgttttcctgccttggtggttggaatcgctgccgcaattgactaccgcagctatgggacagagaaggcttgctggttgcgcgttgacaactattttatttggtcatttattggcccagtttctttcgtgattgtggtcaatctggtctttcttatggtgactttgcataagatgatcagaagcagcagtgtgctcaagcctgactcttctcgactggacaatataaaatcttgggcactgggagcaatagctcttctgttcctgctggggttaacctgggcatttggcttgctgtttatcaacaaggagtcagtggtcatggcttacctgtttacaacctttaatgcattccagggagtcttcatctttgtgtttcactgcgctttacagaaaaaagttcacaaggagtactcgaaatgcctgcgacacagttactgttgcattaggagccctccaggaggaacacacggcagcttgaaaacctcagcaatgaggagcaatactcggtattacaccggcacccagagtcggattaggagaatgtggaatgatacagttaggaagcagactgagagtagtttcatggccggcgatatcaactcaacacctacactcaatcggggcacgatgggcaaccacctgctgacaaatcctgttctacagcctcggggggggaccagtccttacaatactctcatagccgagagtgtggggtttaatccctcaagtccgcccgtcttcaactctcctggaagctatagggaacctaagcaccccttagggggccgagaggcttgcgggatggacacactgccactgaacggcaatttcaataactcttacagcttgagaagcggcgactttcccccaggtgacggcggaccggaaccccctcggggccgaaatctggctgacgccgcagctttcgaaaagatgataatctccgagctggttcacaataacctgaggggctcctccagtgccgcgaaggggcctccccctccagagccacctgtgccccctgtgcccggtggcggcggcgaagaagaggcaggcggaccaggcggcgccgaccgcgcagagattgagcttttgtataaggcgctggaggaacccctcctgttgccacgcgcccagagtgtgctgtaccaatcagacctcgatgagtccgagtcatgcaccgcagaagacggtgccacctctcggccacttagctcaccacctgggagggatagtctgtacgcctccggtgctaatctccgggacagcccttcttaccccgactcttctccagagggcccctccgaggcactgccccctcctcccccagcacccccgggaccgccagaaatttattacaccagtcggcccccagcccttgtggcgcggaaccccctgcagggatactaccaggtccggagaccttcccacgaaggctacctggccgcaccgggcctcgaaggaccaggcccagacggcgatggccagatgcaattagtcacaagtctctag

SEQ ID NO: 26971 - DNA, 4296 bp, Artificial Sequence
  Description of Artificial Sequence: Synthetic coding sequence
atggtgagttccggatgcaggatgcggagtctctggttcattattgtgatatctttcttgcctaacaccgagggcttctcgagggccgcacttccctttggattggtcaggcgggaactgtcttgcgaggggtactctatcgatctgagatgtcccgggagtgatgtcattatgatcgaaagtgcaaattatggccggacagatgacaagatctgcgatgcggaccctttccagatggaaaacacggattgttatttgccagacgcattcaagatcatgacccaacggtgtaacaaccgtacacagtgcatcgtagtgaccggcagcgacgttttccccgacccctgtcctggaacgtataagtatctggaggtacaatatgagtgtgtaccttacatctttgtgtgcccaggcacgctgaaggccatcgtcgatagcccctgcatttacgaggcagagcaaaaggcgggcgcatggtgtaaagaccccttgcaagcagcggacaaaatctatttcatgccttggaccccctatcggaccgatacgctgatagaatatgcaagtctcgaagattttcaaaattcacgtcagacaactacatacaagctgcccaatagggtggatggtactggttttgtggtgtatgacggcgctgtgttcttcaacaaggagagaactagaaatattgtcaagtttgacctaagaaccaggatcaagtcaggcgaggcaattatcaattacgctaattatcatgatacaagtccttataggtggggtggaaaaacagacattgatcttgcagttgacgaaaatggactgtgggtgatctatgccactgaacagaacaacggaatgattgttatctcccagttgaacccttatacgttgcgttttgaagctacatgggaaacagtctacgataagagagccgcttccaatgctttcatgatttgcggcgtgctgtacgtggtacgcagcgtgtaccaggataacgagtctgagaccgggaagaactcaatcgattacatttataacacacgactgaatcgcggagaatacgtggatgtccctttccccaatcagtaccaatatattgcagcggtggactataatccccgagataatcagttatacgtctggaataataactttatcctgaggtatagcctggaattcggcccacccgatcctgctcaggttcctactacagccgtcaccatcacctcatccgctgagctgtttaaaaccataatcagcactacatcgactacgtcccagaaaggacccatgtctaccacagtggctggctcccaggaggggtctaagggaaccaagcctcctcctgcagtttctactaccaaaatcccgccaattactaacatctttcccctgcccgagagattctgcgaagctctggattcaaaagggatcaagtggcctcagactcagagaggcatgatggtcgaacggccctgcccaaaaggaacacgcggaacggcttcctacctgtgtatgattagtactgggacttggaatcctaaagggcctgatctttctaactgcacttcccattgggtgaaccagctggcacagaagattcgctctggagaaaacgcggccagcctggctaacgagctggccaaacacaccaaaggccccgtctttgccggtgacgtgagtagttcagttcggctgatggagcagttggtcgacatccttgacgcgcaacttcaagaattgaaacccagtgagaaagattccgctgggagaagttataataaactgcaaaaacgcgaaaagacttgtagggcctatctaaaagctattgtggacacagtagataatctcctgcgtccggaggcgctcgaatcctggaagcacatgaacagcagtgaacaggcacacacagctacaatgctgctcgatactctggaagaaggggcttttgtcctggctgataacctactcgagccgacacgtgtcagtatgcctactgaaaacatcgtgctagaggttgccgtgctcagcaccgaaggacagatccaggattttaagttccccctgggtatcaaaggtgctggctcttcaatccagctcagcgcaaatactgtcaaacagaatagcagaaatggactcgcgaagctagtttttatcatttatcgatctctgggccaattcctgtcaacggaaaacgccaccattaagctaggagcagatttcattggcaggaattctacaatcgctgtgaatagtcacgtcatatcagttagcattaataaggaatcaagccgggtgtatttgactgaccctgtcctgttcacccttccgcatattgatcctgataactactttaatgcgaattgttctttttggaactattccgagcgaaccatgatggggtactggtctacccagggttgcaaactggtggacactaataagacacgtacaacatgtgcttgcagtcatcttacaaactttgccattctgatggcccatagggagatcgcatataaggatggagtgcacgagcttctgctaacagtaatcacatgggtaggcatcgtgataagtttggtctgtctcgccatttgtatctttaccttctgcttttttcgcggattacagagcgatcggaacacaattcataaaaacctatgcattaaccttttcatcgccgaatttatattccttatcgggatcgacaagactaaatatgccatcgcatgtcccattttcgccggattgctccactttttttttcttgctgcattcgcttggatgtgtctcgaaggtgtacagctatacctcatgttggttgaggttttcgagtcagagtattccaggaaaaagtattattacgtcgcaggctaccttttccctgcaactgtggtgggagtgagcgcggccatcgattataaatcctatgggacagagaaagcatgctggctccatgtggataattatttcatctggagttttattggccctgtgaccttcattatcctgctgaatattatcttcctcgtgatcaccttgtgtaagatggtcaagcacagcaatactctcaaaccagatagctcccggctggagaatatcaataactatcgggtgtgcgacggctattacaacacagatctgccaggatcatgggtccttggggcctttgcacttttgtgtctcctcggtttgacttggagttttggcctgcttttcatcaatgaggagacaatcgtcatggcttacctgttcactatcttcaatgcctttcagggggtgttcattttcatattccattgcgctttgcagaagaaggtcagaaaggaatatggcaagtgtttccgccactcctactgttgcggcggcctcccaactgagagcccacacagctctgtgaaggcatctaccacccgaacctccgctaggtattctagtggcacgcagtcacgcatcagaagaatgtggaatgacactgtcagaaagcaaagcgaatcgagctttataagtggcgacatcaacagcacctctacactgaaccagggtcactccctgaataatgctagagacacctccgctatggatactctccctctaaacggtaattttaataactcttattcgctccataagggagactacaacgactccgtgcaagtggtggactgcggcttaagcttaaatgacacagcatttgagaaaatgattatcagcgaactggttcacaacaacctccgtggctcaagtaaaacacacaacctagagctaactcttccagttaagcctgtcatcgggggctcttccagcgaggacgacgccattgtcgccgatgcctccagcctcatgcattcagataatcctgggctggagttgcatcataaggagctcgaagctcccctgataccacagcgtacacacagcctgctttatcagcctcagaaaaaggtgaagtctgagggtactgattcatatgtctcacagctgaccgctgaagccgaggaccatctgcagagccccaatagggactccctgtatacgtcaatgcctaacctcagggactcaccctacccagagagcagcccggacatggaagaggacctgtcaccttctaggcggtccgagaatgaggatatatattacaaatctatgccgaatcttggtgctggtcaccaactccaaatgtgttaccagattagtagagggaatagcgacggctatattatccctattaacaaagagggatgcatcccagaaggcgatgtgcgtgagggacagatgcaactggtcacatcgctttag

SEQ ID NO: 26972 - DNA, 4212 bp, Artificial Sequence
  Description of Artificial Sequence: Synthetic coding sequence
atggtaagttcaggatgtaggatgaggagtttgtggttcataatagttatttctttcctgccaaacaccgagggcttttcccgggccgccctgcccttcgggctggtcagaagggagctttcctgtgagggttattctatagacctcagatgccccggcagtgacgtcatcatgatagaatcggcaaactatgggcgaaccgatgacaaaatatgcgacgccgatccgtttcaaatggaaaatacagattgttatttgcccgatgccttcaaaatcatgacccagagatgcaacaaccgaacccagtgcatcgttgttacgggatccgacgttttccctgacccttgtcccgggacatacaagtatctggaggtccaatacgaatgcgtgccgtacatctttgtgtgccctgggaccctcaaggcaatcgtggatagtccatgtatctatgaagcagagcagaaggccggcgcatggtgcaaagatccactgcaggcggctgacaaaatttactttatgccttggaccccgtatcgtactgacacactaattgagtacgcatccctggaggactttcagaactccagacaaacaacaacctacaagctgccaaaccgcgtagatgggaccggcttcgtggtgtacgatggcgctgtgtttttcaataaagagcgaactcgaaacatcgtgaagttcgacctgcggacacggatcaagtccggagaggccatcatcaattatgcgaactaccacgatacaagtccttataggtggggaggaaaaaccgatatcgaccttgccgtagacgagaatggattgtgggtcatatacgccaccgaacagaacaatggtatgatcgtgatatctcaattaaacccctacacactacgcttcgaggctacctgggaaaccgtgtatgataaaagagcggcctccaacgctttcatgatctgtggcgtgctctatgtggtacggtccgtgtatcaggataatgagtccgagacaggcaagaactctattgattatatctataatacacggttgaacaggggcgagtatgtagacgtaccttttcccaaccagtaccagtacatcgcagccgtcgattacaaccccagggacaaccagctctatgtttggaataacaattttatcttgagatattcattggagtttggcccaccggatcctgcccaggtgcccaccaccgcagtgaccataacatcatcggctgaactgttcaagaccataatttcgaccacatctacaacctcacagaagggccctatgtccacaactgtggccgggagccaggaaggatctaagggcaccaaacctccacctgcggtatccaccacgaagatacctccaattacaaacatctttccccttcccgaacgattttgcgaggccctggattcgaaaggtattaaatggccccaaactcagaggggcatgatggtcgagcgcccctgcccaaagggcacaaggggaacggcatcatacctgtgtatgatctctaccggaacttggaaccctaaggggcctgatctgagcaactgtacaagccattgggttaaccagttagctcagaagattcgcagtggcgaaaacgcggctagtctggcgaatgagctagctaagcataccaaaggtcctgtgtttgccggggatgtgtccagctcagtgcggctgatggaacagctagtggacattcttgacgcccagttgcaggagctcaaacccagtgaaaaggattcagctggtcggtcttacaataaagcaatcgtggacactgtagataacctcctcagacccgaggctttagagagttggaagcatatgaatagcagcgagcaggcacacaccgctaccatgctcctggacactctcgaggagggggcgttcgtgctggcagataatcttcttgagcccacgcgggtttcgatgcccacagagaatattgtgctggaagtggccgtgctgtcaaccgaaggccagatccaggatttcaagttcccattgggaatcaagggtgcagggtcttcaatccagctgtccgcaaacacggtcaaacagaattctaggaatgggctcgccaagctggtgtttatcatctacagatcccttggacaatttctgtctaccgaaaacgctacaatcaaactcggagctgactttataggcagaaatagtaccatagctgtgaactcgcacgtcatcagtgtgtcaatcaacaaggagagctctcgtgtgtacctgaccgaccctgtgctgtttactctgccacacattgatcctgataactatttcaacgcgaattgttccttctggaattacagcgagagaacaatgatggggtactggtccacccagggatgtaagctggtggacacgaataaaactcggaccacctgtgcatgcagccatctgaccaattttgctatactgatggcccacagggagattgcctataaagatggcgttcatgagctcctgttgaccgttatcacttgggtgggcattgtgatctctttggtttgtttagctatctgtatattcacattctgtttctttagggggttgcaaagtgatagaaatacaatccacaaaaacctgtgtatcaacctgtttattgccgaatttatttttctgatcggcatcgacaagacaaagtacgcaattgcgtgtcctatatttgccggactccttcacttttttttccttgcggcattcgcatggatgtgcttggaaggggtccaattgtacctgatgctcgtcgaggtgtttgagagtgagtacagtcgcaagaaatattattacgtggccggctatctgttcccagccaccgtggtcggggtaagtgccgccatcgattataagtcctatgggacggagaaagcctgctggttgcatgtagataattattttatttggtcgtttattgggcccgtaaccttcattatcctattaaatattatttttttggtcattacactttgtaagatggtcaaacattcaaacactctcaaacccgattcctcaaggctcgagaacattaagtcgtgggttctcggcgctttcgctctgttgtgtcttctgggactgacgtggagcttcggccttctcttcatcaacgaggagacaattgtgatggcttacctgtttacaatcttcaacgcattccaaggggtattcatcttcatttttcattgtgcccttcagaagaaggttagaaaggaatatgggaaatgcttccgccattcttattgctgtggaggtctccctactgaatctccacactcatctgtaaaagcaagcacaacccggacctccgcccgatattcctccgggacacagtctcgcatcaggcggatgtggaacgatacagtgagaaaacaatccgaaagctcgtttatatccggagatatcaactccacctccactctcaatcagggacattcactcaataacgctagggataccagcgccatggacaccctcccattaaacggtaactttaacaatagctatagcctgcacaagggggactataatgattcagttcaggttgtggattgtggactgagtttaaatgacacagctttcgaaaagatgattatctctgaactagtccacaacaatctgaggggctctagcaagacccacaacctggagcttacgttgcctgttaagcccgtgatagggggctcctcaagtgaggatgatgctattgtcgccgatgcctctagtttgatgcatagcgacaatcccggtctggagttgcaccataaagaattggaagctccactcattcctcaacggacccatagcttgctgtatcagccacagaagaaggttaaatcggagggaacagattcctacgtgagccagctcacggccgaggccgaagaccatttgcaatcaccaaacagagattcactgtataccagcatgcctaacctcagggattccccctaccccgagtcctcccccgatatggaagaggatctgtcgccctccagacggagtgagaacgaagatatttactataaaagtatgcctaacctgggcgctggacatcagctgcagatgtgctatcagatcagccgcggcaattctgatggatatatcattcctatcaacaaggaaggatgtattccggagggggatgtcagggaaggccagatgcaattagtgaccagcctgtag

SEQ ID NO: 26973 - DNA, 4251 bp, Artificial Sequence
  Description of Artificial Sequence: Synthetic coding sequence
atggttagttcagggtgtaggatgcgatctttgtggtttattatcgtcattagttttctgccgaatacagaaggcttcagccgcgcggcgctcccgtttggattagtcagaagggagcttagctgcgagggttactctatagatctacgttgtccgggctccgacgtcatcatgatagaatctgccaattacggccgaacagacgacaaaatttgtgacgccgatcccttccaaatggaaaatacggactgctatctgcctgatgcattcaagatcatgactcagcgctgcaataaccgcacccagtgcatcgtggtcacaggaagtgacgttttcccggacccctgccccgggacatacaaatacctagaggtacaatatgagtgtgtaccctatattttcgtctgtcccggaacactcaaagccatcgtggactccccgtgcatctatgaagccgagcagaaggccggtgcatggtgcaaggacccgctgcaagccgcggataagatatattttatgccatggacaccctaccgcaccgacacactgattgagtacgcatctctcgaggattttcaaaattctcgccaaacaactacttataagttgccaaatagggttgatggaacaggcttcgtagtctacgacggggccgtgttctttaacaaagagaggacacggaacatcgtaaagttcgatcttcggacgagaatcaaatcaggagaggccatcataaactatgctaactatcacgacacctctccataccgctgggggggtaagacagacatcgacttagcagtggacgagaatggcctgtgggtgatttacgccacagagcagaacaacggaatgattgttatcagtcagctgaatccatacacactgagatttgaggcaacttgggagaccgtgtacgacaagcgcgctgccagcaatgccttcatgatatgtggagtcctttatgttgtccgatctgtgtaccaggacaacgagtctgagactggaaaaaattctattgactacatctacaacactaggcttaacagaggcgaatatgtggacgtgcctttcccgaatcagtatcagtatatagctgccgtagattacaaccctcgcgataatcagctttacgtctggaacaacaacttcatacttcgctactcactggaattcggcccaccggaccctgcccaagtgccgacaaccgccgtcaccattacctcttccgcagagctgttcaaaaccatcatcagtactacttccaccacttcacagaaggggccaatgagcacaacggtcgcgggctcccaagagggtagtaaggggaccaaacctcctcctgcagtgtctaccacaaagattccacccatcacaaacatctttcccctccctgagcggttctgtgaagccctggactcgaagggcatcaaatggccccagacccaaaggggtatgatggtggagagaccgtgtccaaaggggactcgtggcacagccagctacctatgcatgatttccactggaacctggaacccaaagggtccagacctgtccaattgcacttcccactgggtgaaccagctggcccagaaaatccgctctggcgagaatgctgcgtccctcgcaaatgagttggcaaagcacaccaagggacccgtcttcgcaggcgatgtatcatccagtgtgagacttatggaacagttagtggacattctggatgctcaacttcaggaactcaaacctagcgagaaggacagtgcgggacggtcctacaataaactgcagaaaagggagaagacctgccgggcatatctgaaagctattgttgacacagtggataaccttctgcgccccgaagccctggagtcatggaagcacatgaatagtagcgagcaggctcatactgccactatgttattggatacacttgaggagggagctttcgtcctggccgacaatctgcttgagcccacacgggtttcgatgccaaccgagaatattgttcttgaggtggctgtcctatccacagaaggacaaattcaggactttaaattcccactgggtattaaaggcgccgggtcctcaattcagctctccgctaatacagtgaagcaaaactcccgcaatggcctggcaaaactcgtgtttattatctatcgaagtctgggtcagttcttatccaccgagaatgccactataaaacttggggccgattttattggacggaacagcacaattgcagtcaacagccatgtcatctcagtcagcattaataaggagagttccagggtttacctcaccgatcccgtattattcacattacctcacatcgatccggataactatttcaacgcgaactgctccttctggaactattccgagcgcactatgatgggctactggagtactcagggctgtaagctggtcgacactaacaagacacgaacgacatgcgcatgttcccacctcacaaattttgccatcctaatggcacaccgggagatagcctacaaggacggcgtccacgaattactcttaacagtaattacctgggttggcatcgttatatcactggtgtgtttagccatatgcatattcaccttttgctttttcagaggtctgcagtcagaccggaacaccatccacaaaaacctctgtattaacctcttcatcgccgaatttatttttctcatcggtatcgataaaaccaagtacgccatcgcgtgcccaattttcgctggtctacttcatttcttttttctcgcagccttcgcctggatgtgtttggaaggcgtgcagctctatctcatgctggtcgaggtctttgaaagcgagtatagcaggaaaaagtactattatgtggccggttacctttttcctgcaacggttgttggggtgtcggccgcaatcgattacaagtcctacggtaccgaaaaggcctgctggctccatgtggataactacttcatttggagcttcattggccctgtaacttttatcatcctgctcaatattatattcctggtgatcacactctgcaaaatggtgaagcactctaatacgctgaagcccgactcctcaagactagaaaacatcaaatcgtgggtcctgggcgcctttgctctgttatgtctgctcgggttgacctggagcttcggactgctctttatcaatgaagagactatcgtgatggcgtatctcttcacgatattcaatgccttccagggggtcttcatcttcatttttcactgtgccctgcagaagaaagtgaggaaggagtatggcaagtgcttcagacactcctactgttgtggcggcctccccaccgagtctccccatagctccgtgaaggcgtcgacaacacgaacttcggctcggtactcctctgggactcagagtaggatacggcgcatgtggaatgatactgtgcggaagcagagcgagtcatcttttatctccggagatattaattctacatccactctgaaccaaggccattccctcaacaacgcccgggacacaagcgctatggatacactgcctctgaacggaaacttcaataatagctatagcttgcacaaaggcgattacaacgattccgtgcaagtcgtggactgcggcttatcccttaatgatacagcctttgaaaagatgattatcagcgagctggtgcataataatctgcgtggttcctccaaaactcacaatctggagctgacccttccagttaagccggtcatcggcggatcatcatcggaggatgacgctatcgtggccgatgctagctccctcatgcatagcgataaccctgggctcgagctgcaccataaagaattggaagccccgttgatcccccagcgtactcattctcttctgtaccagccacaaaaaaaggtcaaatccgaagggaccgacagttacgttagtcaattgacggcggaagctgaggatcacctgcagtctcctaaccgggactccttatatacctctatgcccaatctgagggacagcccttacccagaatcatctcccgatatggaagaagatctgtctcctagcaggcgaagcgagaacgaggacatctattacaagagtatgcctaatctgggagctggccatcaactgcagatgtgctatcagatcagtagaggtaactctgatggatacatcattcctatcaacaaggaaggatgcatcccagaaggggacgtgagagagggccagatgcagctggtaacatccctgtag

SEQ ID NO: 26974 - DNA, 4212 bp, Artificial Sequence
  Description of Artificial Sequence: Synthetic coding sequence
atggtgagctccggttgtagaatgaggtcactttggtttatcatcgtaatcagcttcctccctaataccgaggggttctcccgggcagccctgccctttggattggtgaggcgggagctttcgtgcgagggttatagcatcgaccttaggtgtcctggcagcgatgtgattatgatcgagtccgcgaattatggcagaactgacgacaagatttgtgatgcagacccctttcagatggagaacaccgactgctatcttcctgacgcatttaagatcatgacccagcgttgcaataaccgcacacagtgtattgtcgtgaccggatctgacgtatttcctgatccgtgccccgggacatacaagtatctggaagtccagtatgaatgcgtaccctatattttcgtgtgccccgggactctcaaagccatagtggacagcccctgtatctacgaagctgagcaaaaggccggcgcatggtgtaaagacccactccaagctgctgataaaatttactttatgccttggacaccgtatcgcacggacaccctcatagaatatgcctccctggaagactttcagaacagccgtcagacaacaacgtataaactgcccaatcgcgtcgatgggacagggttcgtagtatatgatggcgccgtgtttttcaacaaagagagaacaaggaatatagttaagtttgatctgagaacaaggatcaagtccggggaagctatcatcaactatgccaactaccatgatacaagcccctaccgatggggaggcaagactgacatcgacttagctgtagacgaaaacggtctctgggttatctacgcgacagagcagaataatggcatgattgtaatctcccagctaaatccttacacactgcgattcgaggccacctgggagacagtgtatgacaaacgagccgccagtaatgccttcatgatatgtggagttctctacgtggtgcggtcagtgtaccaagataatgagagcgagacaggcaagaattccattgactacatctacaacacccgactgaataggggcgaatacgtggacgtcccctttcccaatcagtatcagtatatcgccgccgtggattacaatcctagggataaccagctttatgtgtggaacaacaactttattctccgctattccctggagttcggaccccctgaccctgcacaagtgcccaccacggctgtgacaatcacctccagcgctgagctttttaaaaccattatatctaccacaagcacaacgtcgcagaaaggccccatgagcactactgtcgccgggagtcaggagggctcaaagggaaccaagcctcctccggcagtgtcgacaacgaaaattccgccaattaccaacattttccctctacctgagcgattctgtgaggcactcgatagcaagggaatcaaatggccacaaacccaacgaggaatgatggtggagaggccctgtcccaagggaactaggggaactgcaagctacttgtgtatgatttcaactggaacttggaatcccaaagggcctgacctgagcaattgcaccagccattgggtgaatcagttggcgcaaaagatcagaagtggagaaaacgcagcctctctggcaaatgaacttgcaaagcacactaaaggccctgtgtttgcaggcgatgtgtccagcagtgtccgactgatggagcaacttgtggatattctcgatgctcagcttcaagagcttaagccctctgaaaaggactctgcaggtaggtcttataacaaagccatcgtcgatacggtggataacctgctgcggcctgaggccttagagagctggaagcacatgaatagttcagaacaggcacataccgccactatgctgctggacaccttggaggaaggggcttttgtgctggctgataacctgctggagcctacgcgggtatctatgccaactgagaacatagtcttggaagtggctgtcctgagtacagaaggccaaatccaggatttcaagttccccttaggcataaaaggcgcaggctccagcatccagctgtctgccaatactgtcaagcaaaactctagaaatgggttagccaaacttgtattcatcatatataggtctctcggccagttcctgtccaccgagaatgctactataaagctgggagcagatttcattggccgcaattcaacaatcgcggtgaacagccacgtgatttccgtgagtattaataaggagtcatcacgggtctacttgacagatccagtattgttcacgctgccccacatagacccagacaattatttcaacgcaaattgtagtttttggaactacagtgaaagaaccatgatggggtattggagtacccagggctgcaagctggtcgatactaataaaacccgcactacttgtgcttgttcccatttgacaaactttgccatcctgatggcccatcgcgaaatcgcgtataaagacggagtacacgaattgctgctgactgtgatcacctgggtcggaatagtgattagtctggtgtgcctggccatttgcatcttcacattctgcttcttcagaggtctgcaatctgaccgtaacactatccacaagaatttgtgcattaatctgtttattgcagaatttattttcctcatcgggattgacaagaccaaatatgcaatcgcgtgcccaatattcgccggcctgttgcactttttctttcttgctgcattcgcatggatgtgtctggagggagtccagctgtatttgatgctggtggaagtcttcgagtccgaatacagcagaaaaaaatactattatgtggccgggtatctgtttcccgcgaccgtggtaggggtgtccgctgcaatcgactacaaatcatatggaactgagaaagcctgttggctgcatgtggacaactattttatttggtccttcattggccctgttacctttataattctgctaaatattatctttctagtcataaccctgtgcaagatggtgaagcactcaaacacgttgaaacctgattctagccgcctggaaaatatcaagtcttgggttctcggagcatttgcacttctttgccttctgggcctaacatggtcgttcggactcctgtttatcaatgaggagactattgttatggcgtatctgttcaccatcttcaatgccttccagggagtattcatcttcatattccattgcgccctgcagaagaaggtaagaaaggaatacggaaagtgtttccggcattcgtattgctgtggaggcctgcctacagagtcacctcactcctccgtgaaggcttcaacgaccagaacgagtgcgcgatactccagcgggacacagtcccgtatcagaagaatgtggaacgacaccgtccggaagcaatcagagagctcattcatctccggtgatatcaatagtacatcaaccctgaaccagggccatagcctgaataatgcacgcgatacctcagctatggacaccttgcccttaaatgggaatttcaacaatagctacagcctccataagggtgactacaatgattccgttcaggtagtcgactgtggcctctcattgaacgatacggcctttgagaaaatgatcatatccgaactcgtccacaataacttgaggggctcatccaaaacccacaacttggagctcactctccccgtcaaacctgtgattggtggaagtagctcagaggacgacgccatcgttgctgatgctagctcactgatgcattccgacaatccggggctggagctgcatcacaaggaactggaagcaccactgataccccagcgaacacactcactcctgtaccaaccacaaaagaaagtcaaatcggagggaacagatagctatgttagtcaactcactgcagaagccgaggatcaccttcagtcacccaatcgagattcactgtacacgagtatgcctaacctcagagattccccatatcccgagagttcccctgatatggaggaggacctgtccccgtcacggaggtctgagaatgaagatatatattataaatctatgccgaatctgggcgcggggcatcaattgcagatgtgctatcagatatctagaggcaactcagatggatacatcatacctatcaacaaggagggatgcatccctgagggagatgttcgagagggacagatgcagctggttacatctctgtag

SEQ ID NO: 26975 - DNA, 3372 bp, Artificial Sequence
  Description of Artificial Sequence: Synthetic coding sequence
atggtgtcttcaggatgtcggatgaggtctctctggttcattatcgtgatctcctttctcccgaacacggagggctttagtagggctgccctacccttcggcctcgtccgaagagagctctcctgcgaggggtatagcattgatctcagatgccccggctctgatgtgataatgattgaaagcgcaaattacggcaggactgatgacaaaatctgcgacgctgaccctttccaaatggagaacactgactgttacctccccgatgctttcaaaatcatgactcagagatgcaacaaccggacacaatgcattgtcgtgacaggctctgatgtattcccagacccctgccccggtacttataaatatctcgaggtacagtacgagtgtgtaccctatatttttgtctgtccaggaactctcaaggccattgtggatagtccatgcatttatgaagcggagcagaaagcaggcgcctggtgcaaagatccgctgcaggcagctgataagatttatttcatgccctggaccccttacagaaccgacacattaattgaatacgcttcgctcgaagattttcaaaattcacggcagaccactacgtataagcttcccaatcgcgtggatggcactggatttgtggtttatgatggcgctgtgttcttcaacaaggagcgaaccagaaacattgtcaaattcgatctgcggactcgtatcaagtctggtgaagcaatcattaattatgccaactatcacgatacttccccttaccgatggggcggaaaaaccgatatagatctcgctgtggacgaaaatgggctctgggtcatttatgctaccgagcaaaacaatggaatgatcgtgatcagccagcttaatccatataccctgcggtttgaagctacctgggaaactgtgtacgataaaagagccgcaagcaacgcatttatgatctgcggagtgctctacgtggtgcggagcgtgtaccaagataatgaatccgaaacgggcaagaatagcattgattatatatacaacactcgtctgaacagaggcgaatacgtggatgtgcccttccccaatcagtatcaatacattgccgcggtggactataacccgcgcgataaccagctgtacgtgtggaacaacaactttattctccgttatagcttagagttcggcccaccggacccagcccaggtccccacgaccgccgtgaccattacctcaagtgctgaactattcaagacgatcatcagtaccacgtcgaccacatcacagaagggaccaatgagcacaacagtcgcaggcagccaggagggaagtaagggaacaaagcctccccccgccgtaagcactacgaagataccccctattaccaatattttcccactgcctgaacgtttctgtgaggcactcgactctaagggcatcaagtggccacagactcagcgcggtatgatggtggagcggccatgcccaaagggcactagggggacagcatcatacctgtgtatgatctccacaggcacttggaacccaaaaggtcccgatctaagtaattgtacttcacactgggtgaaccagctcgcgcagaaaatcagatctggcgaaaacgctgctagtctcgccaacgaactcgccaagcacacgaagggccccgtgtttgcgggtgatgttagctcctcggtgcggctgatggagcagcttgtagatattctggatgctcagttacaggagttgaaaccttctgagaaggactccgctggacgctcgtacaataaggcaattgtggataccgttgacaatctacttaggccagaggctctcgagtcatggaagcacatgaacagctctgagcaggctcataccgcaactatgttgttagacaccttggaggaaggggcctttgtcctcgccgacaacctgttagagcccacccgtgtcagcatgcctactgagaacattgtcctggaggtagccgtattatcgactgagggacagatccaggacttcaaattcccactcggaataaagggcgcagggtcaagtatccagctgagtgccaatactgtgaagcagaatagcaggaacggccttgccaagctggtatttatcatctatcggtctctaggccagttcttatccacagagaacgccaccatcaagctcggtgcagactttattggtagaaactctacaatcgctgtgaatagtcatgtaatcagcgtctcaatcaataaagagtcttcccgcgtttacctgaccgaccccgtgctattcaccctaccacacatagaccccgataactactttaacgccaactgtagcttttggaattactcagaaagaacaatgatgggttactggtctactcaagggtgcaagttggtggacacaaacaagactagaacaacctgtgcctgcagccatttaacaaatttcgcaattctaatggcccacagggagattgcttacaaggatggagtgcacgaactgcttctcactgttataacctgggtcgggatagtgatatcattagtgtgccttgcaatttgcatttttacattttgctttttcaggggcctccagtcagacagaaataccattcacaagaacctctgcatcaatcttttcattgcagaattcatctttctgatcggcatcgacaagaccaaatacgcgatagcatgccccattttcgccggcctcctgcactttttctttttggctgcttttgcctggatgtgtttagaaggggtccaactgtatctgatgttggttgaggtgttcgaaagcgagtacagcaggaagaagtactattacgtggcgggttacctttttccggctaccgtcgtgggagtgtcagcagccatcgactacaagagttacggaaccgagaaagcatgctggctgcacgtggacaattacttcatatggtcattcattggcccagtcacgtttatcattctgttgaacatcatattcctcgtgatcacgttgtgtaagatggtcaaacactccaatactctgaagccagattcctcccggttggaaaatataaagagctgggtattgggtgcgttcgcacttctgtgtctactggggctgacttggtcattcggtctgctcttcattaatgaggagactattgtgatggcctacttgttcaccatcttcaacgcattccagggggtgtttatcttcatcttccactgtgctctccagaaaaaggtaaggaaggagtatggcaaatgcttcaggcactcctactgctgcggaggcctgcccactgagtctcctcactctagcgtcaaggcctcaacaactcggaccagtgcaagatattcttccggaactcaggatatccactag

SEQ ID NO: 26976 - DNA, 3534 bp, Artificial Sequence
  Description of Artificial Sequence: Synthetic coding sequence
atggtaagctctggctgccgcatgaggtccttatggttcatcatagttatttctttcctccctaacacagaggggttctctagggccgccttgccatttggcctcgtcaggcgggaactctcgtgcgaggggtactcgatcgaccttcggtgtccaggatctgacgtgatcatgattgagtccgctaattacgggaggactgatgacaaaatttgtgacgctgaccccttccagatggaaaacacagattgctacctcccggatgcatttaagataatgacacagcggtgcaataaccgtacacagtgcatcgtggtgaccggatccgatgtctttcccgatccttgtcctggcacttacaagtatctggaggtgcaatatgagtgtgtgccgtacatatttgtgtgcccaggcactctcaaggcaattgtggacagtccctgcatctacgaggctgagcagaaagcgggtgcctggtgtaaagatcctcttcaggccgcagataagatctactttatgccatggactccctaccggactgacacattgatcgaatacgcatccttagaggactttcagaattcacgccagacaaccacgtataagttgcccaaccgggttgacgggaccggatttgttgtatacgacggagccgtattcttcaacaaggagcgcacgcggaacattgtgaaattcgatctgcgaacacgaatcaagtctggagaggctattataaactacgcaaactaccacgatacatctccatatcgctggggaggcaagacagatattgatctcgcagtcgacgaaaatggactgtgggttatctatgccaccgagcaaaataacggcatgatagtgatatcccagctgaacccttacacactccgctttgaggctacctgggagaccgtgtacgacaaaagagcagcatccaatgcctttatgatttgcggagtgttatacgttgtacgctctgtctaccaagataacgagtcggaaaccggtaagaactcaatagactatatatataacacgcgtctgaacagaggcgagtatgttgacgtcccctttccaaatcagtatcagtacattgccgccgtcgactacaatccaagggataatcagctgtacgtttggaataataatttcatcctccgctacagtctggaatttgggccccccgatcccgctcaggtgcccacaactgctgtgactattaccagcagcgcagagctttttaagaccattatctccacaacttctactactagtcaaaagggacctatgagcacaacagtggccggttcacaagaaggatcaaaggggactaaaccccccccagccgtgtccaccacaaagatccccccaatcaccaacattttcccactaccagagagattctgcgaagcactggattccaaggggatcaagtggcctcaaactcagcgaggcatgatggtggaaagaccatgtcccaagggtacacggggtactgcatcttacctgtgcatgataagcacgggtacttggaatcccaaggggcccgatctttcaaactgcacctctcactgggtgaaccaattggcccagaagatacgctcaggtgagaacgcagccagcctagccaacgagctggcaaaacacacaaagggaccagtgtttgccggagatgtcagctcttccgtgcgcctcatggaacagcttgtggacattctagacgcccagctgcaggagctgaagccctccgagaaggattctgccggcagatcgtacaacaaagccatcgtcgacaccgtcgacaacctccttagaccagaagctttggaatcttggaagcatatgaattcttctgaacaggcccataccgcgacaatgctcttggacaccttggaggagggtgcattcgtgctggctgataatctgctggagccaacaagggtctctatgccaaccgaaaacattgtcctggaggtagccgttctgtcaaccgaggggcaaattcaggattttaagttcccacttggaattaagggggcagggtccagtattcagctgtcagctaacacagtgaagcagaactcgagaaatggcctggccaaactggtattcatcatttacaggagtcttggccaattccttagcaccgagaacgctaccattaagttgggagctgatttcattggtcgaaattcaaccattgctgtgaacagccacgtgataagcgtgtcgattaacaaagagagctcccgggtgtacttaacagacccggtactgttcacgcttccccacattgatccagacaactactttaacgcgaactgctccttttggaattactccgaaagaacgatgatgggctattggagcacccaaggatgtaagctcgtggacactaataagacaaggaccacctgcgcctgtagtcacctaacaaactttgctatactgatggcacacagggagatagcctacaaagatggagtgcacgaactgttgttgacggtgatcacctgggtgggtatagttatcagtcttgtatgcctcgccatatgcatttttaccttctgttttttccgcggtctgcaatctgaccgcaacactatccataagaatctttgtatcaacctattcatcgcggagttcatcttcttaataggtattgataaaaccaagtacgccatcgcctgcccaattttcgcggggttgcttcattttttttttctggccgcatttgcttggatgtgtttagagggggtgcagttgtatctgatgttggtagaagtcttcgagtctgaatactctaggaagaagtactactatgtcgctggctacctgttcccagctaccgtcgtcggtgtatcagcggcaattgattataaatcttatggtaccgagaaggcatgctggctacatgtcgataactatttcatctggagctttattgggccagtaactttcattattctgctgaatattatctttcttgtcattacactctgtaagatggtcaagcactctaacactctgaaacctgattcttcacgccttgaaaacattaaatcttgggttctgggagcgttcgctcttctctgcctgctgggactgacctggagcttcgggctcctgttcattaatgaggagaccattgtcatggcctacctgtttacaatctttaatgcttttcagggagttttcatcttcattttccattgcgcactccagaagaaggtgcgaaaggagtacgggaagtgctttagacactcctactgctgcggcggccttcctaccgagagcccacactcatccgtcaaggctagtacgacgcgaacatccgcacgctattcgtcgggaacacagagccgaatcagacggatgtggaacgatactgtgaggaaacagagtgagtcctccttcatatctggggatatcaattctacttccacgctaaaccaggggctgacctctcacggactgagggcccatctgcaggatttataccacctggagcttctgcttgggcagattgcatag

SEQ ID NO: 26977 - DNA, 4425 bp, Artificial Sequence
  Description of Artificial Sequence: Synthetic coding sequence
atggtgtcatcaggctgccggatgaggtccctgtggtttatcatcgtgatctcttttctgcccaatactgagggcttttcgagagctgcactgcccttcggattagtcagacgagaactctcatgcgaaggttactcaattgatcttcggtgccccgggagcgacgtaatcatgatcgagagtgccaattacgggagaaccgacgacaagatctgcgatgccgaccctttccagatggagaacactgactgctatctcccagatgcctttaaaattatgactcagagatgcaacaacaggacgcagtgtattgtcgtgacagggtccgatgttttccccgacccctgccccggaacgtacaagtatctggaggtccagtacgaatgcgtcccatacatcttcgtctgcccaggtaccttgaaggcaatcgtagattcaccgtgcatctacgaggctgagcaaaaggccggggcgtggtgtaaggatcctctgcaagcagctgacaaaatctattttatgccttggacaccataccgcaccgatacactgatcgagtacgcatcactggaggactttcagaactccaggcagaccaccacctataagcttccaaaccgcgtcgatggcacgggattcgtcgtttacgacggggcggtgttttttaacaaggaacggactaggaacatcgtcaaattcgatctccggacaagaattaagtcaggggaggctataataaattatgctaattaccatgatactagcccctataggtggggcggaaagactgatattgacctggccgtagatgagaatggcttgtgggttatctacgctaccgaacagaataatggaatgatcgtgatctctcagctgaatccatacaccctacgctttgaagccacctgggagacagtgtacgataaacgagccgcctctaacgcctttatgatctgcggggtcctttatgtggtgcgctccgtctatcaggacaatgagtccgaaaccgggaagaacagcatcgattatatctataacacacggctaaatcggggtgaatatgttgatgtgccgtttccaaaccaataccaatacatcgccgccgtggattataacccaagggataatcaactgtacgtctggaacaacaatttcatactgagatacagcctggagttcggccctcccgatcccgcccaggtgcctacaacagccgtgaccattacctcatccgctgaacttttcaaaacaattatttctaccacatccacaacatctcagaaagggcccatgagcactaccgtagcaggttcacaggagggctctaagggcacgaaacccccccccgccgtgtctaccactaagatccctcccatcacgaatatatttcccttgcctgagaggttttgcgaagctttagactccaagggtatcaagtggccgcagacccagcgtggcatgatggttgagcgcccttgtcccaagggcaccaggggaaccgccagctatctgtgcatgatttctacaggcacatggaacccaaaagggccagatcttagcaattgcacttctcactgggttaaccaactcgcccagaagatacgatctggcgaaaacgctgcatctttggctaacgaactcgcaaaacacaccaaagggccagtgtttgctggcgacgtctcctcttcagtgcgactgatggaacagctggtggacattctcgatgcccagctgcaggaattaaaaccctctgaaaaggatagtgcagggaggtcatataataagctacagaaacgggagaagacctgtcgggcctatttgaaggctatcgtagacactgtagataatcttctccgcccagaggccctggagagctggaagcacatgaactccagtgagcaggctcatacggcaactatgctgctcgatacactggaagagggggccttcgtccttgcggataaccttctggagcccacccgcgttagcatgcccacagaaaacatcgtgctcgaggtggccgtgttatcaaccgagggacagattcaggactttaaattccccctcgggataaaaggagctggctcctccatacaactttctgctaacacagtgaaacaaaatagcagaaacggactcgctaaactggtgttcataatctataggtccctcggccagtttctgagcaccgaaaatgctaccattaaactaggggccgatttcatcgggcgcaattccacaatcgccgtgaatagccacgtcatctctgtgagtatcaacaaagaatctagtagagtgtacctgaccgaccctgttctcttcaccctgcctcacattgacccagacaattatttcaatgcgaactgctccttctggaattactcggagcggaccatgatgggctactggtcgacacagggctgcaaactcgtagatacgaataagaccaggaccacctgcgcctgttcacatctaactaatttcgcaatccttatggcgcatcgcgagatagcttataaggacggagtacacgagctgctcctcacagtgattacctgggtggggatcgttattagcttggtgtgccttgcgatctgcatattcacattttgctttttcaggggactgcagtccgatcgaaacactattcataagaatttgtgtatcaacttgtttatagcggaatttatcttcctcattgggatcgacaaaactaaatacgccatcgcgtgtccaatcttcgccggtctacttcacttcttcttcctggctgcttttgcttggatgtgtttggagggcgtccagctgtatctaatgttggtggaagtcttcgaatctgagtattcccgtaagaagtactactacgtagccggatatttattccctgcaacagtggtgggcgtgagtgccgccatcgactataagtcatacgggaccgaaaaagcttgttggcttcacgtggacaattactttatctggtctttcattggcccagttaccttcatcattctgctgaatataatcttccttgtcattaccctgtgtaagatggtcaagcattctaatactctgaagcccgactccagcagactcgagaacataaacaactaccgggtttgcgacggatactataatacagatcttcccggaagttgggtacttggcgcattcgcgctgctgtgtctgctggggctgacgtggagcttcgggctgctgtttattaacgaagagacaattgtcatggcttacctcttcacaatattcaacgctttccagggcgtctttatcttcattttccactgcgccctacagaagaaggtaaggaaagaatatggcaaatgcttcagacactcctattgctgtggcggcttgcctacagagagtcctcattcatctgtgaaggccagtaccacccgcacctctgcccggtacagctccggcacacagtcgaggattcgaaggatgtggaatgacacagttagaaagcagtcggaatcttcttttataagtggagacattaactctacctccactcttaatcagggcatgactggaaattacttgctgaccaatcccctcctgaggccccacggcactaataatccttataacactctcctggctgaaaccgtcgtctgcaacgctccctcagcgccagtgttcaacagtcccggccattccctcaacaacgctcgcgacacgtccgctatggatacgctgccgctcaacggaaatttcaataactcatattccctgcacaagggcgactacaatgatagcgtgcaggtcgtcgactgtggtctgtctctcaacgacacagcgtttgagaaaatgattatctccgaactggtgcacaacaatctaaggggctcatcgaaaacacacaacctggagctaaccctgcctgtgaagcctgtgataggcggaagctcctctgaagacgacgctattgtggctgacgcttcgtctcttatgcacagtgacaaccctgggttggagctgcatcataaggagcttgaagctcctctgataccacagcgcacacactccctgctctaccaacctcagaagaaagtcaagtccgagggaaccgatagctatgtgtcgcagctcaccgccgaggccgaagatcacttacaaagtccgaacagggacagcctgtatacaagcatgcctaatctgcgggattccccttatccggagagttccccggatatggaagaagacctgagtcccagtcgtcggagtgagaatgaggacatatattataagtctatgccaaacctcggggcaggccatcaattacagatgtgttatcagatttcacggggtaattctgacggctatatcatccccatcaataaagaaggctgcattcctgagggagatgtgagagaaggacaaatgcagctggtgacttctttgtag

SEQ ID NO: 26978 - DNA, 4155 bp, Artificial Sequence
  Description of Artificial Sequence: Synthetic coding sequence
atggtctcctcgggttgccggatgcgctccctttggttcatcatcgtcatcagcttcctgccaaacaccgaaggtttttcaagggcagccctgccttttgggctggtgcgccgcgaactgagctgcgagggatactccatcgatctgagatgccccggctctgatgttataatgattgaatctgctaactacgggcgcacagatgataaaatttgtgacgctgaccccttccagatggaaaacaccgattgctaccttcccgatgccttcaagattatgacgcagagatgcaataaccgtacacagtgcatcgtagttacagggtctgatgtatttcctgacccttgccccggcacctataagtatctggaagtccagtatgagtgtgtcccatatatggagcaaaaagtattcgtctgtcccggtaccctgaaagcgatcgtcgattccccatgcatctatgaggccgaacaaaaggccggtgcatggtgtaaagatcctctgcaggctgccgacaagatctattttatgccttggactccttacaggacggatacgcttatagagtatgcttctctggaggacttccagaattcacggcaaacaactacatacaagctacctaatcgtgtcgacgggactggatttgtggtatacgatggcgctgtgttttttaacaaggaacggacgagaaacatcgtgaagtttgacctgagaacccgaataaaaagcggtgaggctatcatcaactatgcaaattaccacgatacatctccttacaggtggggtgggaaaacagatatcgacctggcagttgacgaaaatggcctgtgggttatctacgccacagagcaaaataacggaatgattgtcatatcccagctcaatccttacactttaaggtttgaagccacatgggaaactgtgtacgataaaagggcagcatctaacgccttcatgatctgcggagtactgtacgtggtgcgtagcgtgtatcaggacaatgagtctgagactggaaaaaactccatcgattatatttacaacacccgtctcaataggggagaatatgtggatgtgcctttcccaaaccaatatcaatatatcgccgccgtcgactacaaccctagagataatcagttatacgtgtggaataataatttcatcctacgttatagcctcgagttcggccctccagatccagcacaagagaggttttgcgaagcactggatagcaagggtattaagtggcctcaaacacagagaggcatgatggtggaaagaccttgcccaaagggaacaagaggtaccgctagctacctctgtatgatctctactggaacatggaaccctaagggcccagacctttcaaactgtactagtcactgggtcaaccaactcgcccagaagataaggagcggcgagaacgcagcttccctggccaacgaacttgcgaaacacacaaagggtcctgtcttcgccggggatgtgagctctagtgttagactgatggagcagttggtcgacatcctcgacgcacagctgcaggaactaaagccgagcgaaaaggattctgctggccgttcttataataaggcaattgtggatactgtggataacctgctccggcctgaggccctggagagctggaaacacatgaattctagtgagcaggcccatacagccaccatgctgctggatactttagaggagggggctttcgttctagcagacaacctgcttgagcctacccgcgttagtatgcccacagaaaacattgtgttagaagtcgccgtgctgagcaccgagggacaaatccaggatttcaagttcccgttgggaattaaaggcgccggtagctcaatccagctgagtgcgaacaccgttaagcagaattcaagaaacggattggccaaactggttttcattatttaccggagcctggggcagtttttatctacagaaaacgccaccatcaaattaggcgccgactttatcggcagaaattccactatagcagtgaattcccatgtaatttccgtgtcaataaacaaggaatcgagcagagtatatttgactgaccctgtcctctttactttacctcatattgacccagacaattactttaatgccaactgttcattctggaattatagtgagcggacaatgatgggttattggtccacacaggggtgcaagttggtcgatacaaacaaaacgcggacaacgtgtgcatgcagccatctgactaacttcgctatattaatggcacatcgggagatcgcttataaggacggcgtccacgagctgcttctcacagtgataacctgggtcggaatagttatcagccttgtgtgcctagcaatttgcatctttaccttctgttttttcagaggcctccagtctgatcggaacaccatccacaagaacctttgtattaacctgtttatcgccgagttcatttttctaattggaatcgataaaactaagtatgcgatcgcttgccctatttttgctggcctgctgcatttttttttcctggcagcctttgcctggatgtgtttggaaggtgtccagctctacctcatgttggttgaggtgttcgaatccgaatatagtaggaaaaaatattactatgtagctggatacctgtttccggccacggtagtcggcgtctcggctgctatcgactataagagctacggtactgaaaaagcatgctggctccacgtcgataattattttatttggagttttattggcccagttacttttatcatacttctaaacataattttccttgtgatcacgctatgcaagatggttaagcacagtaacacgttgaaaccagattctagccgactggaaaatatcaagtcttgggttctgggcgcattcgccctgctatgcctgcttgggctaacttggtctttcggcctcctctttattaacgaggagactatcgtcatggcctacctattcactattttcaatgcgtttcagggcgtcttcattttcatcttccactgtgccctgcagaaaaaggttaggaaggaatatggcaagtgctttcgccactcttactgttgcggtgggctgcctaccgagtcccctcactcctctgtaaaggcgagcaccacccgcacatcagcccggtactccagtgggacgcagtctagaattcgccggatgtggaacgatacagtacgcaagcagtcagagtcctcttttatttccggcgatataaacagcacctcaacactgaaccagggcatgaccgggaactacctgctaactaaccccctgctgcgcccccacggtaccaacaatccttacaacaccctcctggcagagacagtcgtatgcaatgctcccagtgctcccgtcttcaactcccctggacatagtctcaataatgcacgggacactagcgccatggatactctccccctgaacggcaactttaataatagctatagcttgcataagggggattacaatgatagtgtccaggtggttgattgtggcctatccctaaacgacacagcctttgagaaaatgatcatctcagaattagtgcacaataaccttcgcggatcctccaaaactcataatctcgaactgactctgcccgtgaaaccagtgattggtggaagcagcagtgaagacgatgcgatcgtcgcagatgcgtcttcactaatgcattccgataatccaggcttggaactgcaccacaaggagcttgaagcgcctcttatccctcagcggacccattcacttctttaccaacctcaaaaaaaggttaagtcagaaggaacggatagctacgtctctcaactcactgcagaggccgaggatcacctccagtcacctaaccgcgactccctgtacacttcaatgccaaatctacgtgatagcccttacccagaatcctctcctgacatggaggaggacctttcccctagcagaaggagcgaaaatgaggacatctactacaaaagtatgcctaatttaggggccgggcatcagctgcagatgtgctatcagatttcgcgcggaaattctgatggctatatcatacctataaataaggagggatgcatcccagaaggtgacgtgagggaggggcagatgcagttggttacgtccctgtag

SEQ ID NO: 26979 - DNA, 4386 bp, Artificial Sequence
  Description of Artificial Sequence: Synthetic coding sequence
atggtctcctcaggctgtcggatgcggtccctttggttcattatagtgatttcctttctgcctaatacagagggattcagccgggcggcgcttccattcgggctggtgaggagagaattatcatgcgaggggtactcaattgatctcaggtgtcctggatcagatgtgatcatgattgaaagtgccaactacggacggacggacgataaaatctgtgatgcggaccctttccagatggaaaatacagattgttacctgcccgatgccttcaaaattatgacccagcggtgtaataataggacccaatgcatcgttgtcacaggtagtgacgtcttcccagatccctgtccaggcacttacaagtatctggaggtgcagtacgagtgtgtgccgtacatttttgtgtgccccggtacactgaaggctatcgtcgatagtccctgtatatacgaagccgagcagaaggccggtgcctggtgcaaggaccccctccaagcggctgataaaatctacttcatgccctggacaccgtaccggaccgatacacttatagagtacgcatctttagaggatttccagaattccagacagaccaccacctacaagttacctaaccgcgtcgacggaaccggattcgtggtttacgatggggccgtctttttcaacaaagaaaggacccggaatattgtaaaatttgatttacggacccgtatcaaatctggagaggcaattattaactatgcaaattaccacgatacttcgccatacagatggggcgggaagacagatatcgacctggccgtggacgagaatggtctctgggtgatttacgctaccgagcaaaacaatggaatgatagtgatctcacagctgaacccgtacacactaagatttgaagccacctgggaaacagtttacgacaaaagagctgcttcaaacgcgttcatgatctgcggtgtcttgtacgttgtgaggagtgtgtatcaggacaacgaatccgagacggggaagaacagcatagactacatctacaataccaggcttaatcggggagagtatgttgacgtcccttttccgaaccaatatcagtatatcgccgcagtcgattacaatccaagagacaatcagttatatgtgtggaacaacaatttcatcctccgctacagtctggagtttggcccccccgaccctgcccaagtgccaactaccgccgtgactattacgtcatccgccgaactgtttaagactatcatttcaacaaccagcacaacctctcaaaaaggacctatgagcactaccgtggccggctcccaggagggaagtaagggcactaaacccccccctgctgtatcaacgacgaaaatcccccccattaccaacatctttccactgcccgagcgcttttgcgaagctctcgattccaaaggtattaaatggccgcagacgcagcgcggcatgatggtagaacgaccctgtccaaagggcacgaggggtactgcatcttatctttgcatgatcagtaccggtacatggaatccaaaggggcctgatctctctaattgcacttctcattgggtgaatcaactcgcccagaagattaggagtggagaaaatgctgcatccttagctaacgaactggcgaagcacactaagggcccagtgtttgcgggcgacgtctctagtagcgtccgcctgatggagcagctcgtggacattctggacgctcagcttcaggaacttaagccaagtgagaaagattccgcaggtagatcctacaacaaagccatcgtagacactgtggacaatctgctccggcctgaagccctggagagctggaagcacatgaacagttccgagcaggcccacacagctacaatgttgctggatactctcgaggagggagcgtttgtgctggccgacaacttgctggagccaactcgagtgtctatgcctacagagaatattgtgcttgaagtggctgtcctttcaactgaaggacagattcaggatttcaaattccctttagggatcaagggtgcaggctccagtatccagctttccgccaacactgtgaaacagaactcgagaaacgggctggccaaactcgtgtttattatttaccgctctcttgggcagttcttgagtaccgagaacgcaacaatcaagctgggagccgatttcatcggacggaatagcacgatcgccgtaaactctcacgttatctccgtgtccatcaataaggaaagttctagagtataccttacagatcccgtgcttttcacattacctcatatcgacccagacaattacttcaacgcaaactgttcattttggaactattccgaacgcacaatgatgggctactggtcgacccaaggctgtaagctggtcgatacaaataaaacccgaactacctgcgcttgctcgcatcttaccaacttcgccattttgatggcacatagggaaatagcctacaaagacggagtgcacgagcttctgctaactgtcatcacatgggttgggattgtcatatccctggtctgtctggccatttgtatattcaccttctgtttcttcagggggctgcaatctgaccggaatactattcacaaaaacctttgcatcaacctgtttatcgccgagtttatcttcctgatcggtatagacaaaacgaagtacgccattgcctgtcctattttcgccggcttgctgcatttcttttttctggctgctttcgcttggatgtgccttgagggtgtacagctctacttaatgctcgtggaagtgtttgagagcgaatactctagaaagaagtactactacgtagcaggttacctcttccccgcgactgtggtgggggtgtctgccgcaattgattataaaagttacggaaccgaaaaggcatgctggctccatgtggacaattattttatatggtctttcattgggcctgtcacctttatcattctgctaaacatcattttcctcgttattactctgtgcaaaatggtcaagcacagcaatacgctaaagcctgatagctcccggctggagaatatcaataactatcgagtgtgtgacggctactataacactgatttaccaggctcatgggtattaggtgcattcgcactgctctgcctactgggcttgacttggtctttcggcctgctctttattaacgaagaaactatagtgatggcgtatttgttcacaattttcaacgccttccagggagtgttcatttttattttccactgcgcacttcagaaaaaggtgcgtaaagagtatgggaagtgttttaggcattcatactgctgcggaggcctgccgaccgagagtccacactccagcgtgaaagcctctaccacccgtaccagcgccagatatagtagcggaactcaatctaggattagaaggatgtggaacgacacggtgaggaaacagtcagagtcttccttcatttccggtgatattaactccacttccactttgaaccagggcatgacaggcaactatctcctcaccaaccccttactgaggccccatggcaccaataacccatacaacaccttgctggcggagactgtcgtgtgtaatgcacctagtgcacccgttttcaactccccgggccattccctgaataatgctcgggatacctcagctatggatactttaccactcaacggaaattttaataacagctacagcctccataagggggattataacgactccgtgcaggtcgtggattgtggactgtccttgaatgataccgccttcgaaaaaatgatcatctctgaactcgtgcacaataacttgagaggctcttctaaaacccacaatcttgagctgacgctcccggtgaagccagttattgggggaagcagtagcgaagacgacgcaattgtggccgacgcgtcttcactcatgcattccgataaccccggcctcgagctccaccacaaagagcttgaggcccctcttattccccagcggacacactctctgctataccaaccccaaaagaaagtgaaatctgaagggaccgattcctacgtcagccagctgaccgccgaagcagaggatcatctgcagtccccaaaccgagactccctttataccagcatgcctaacctccgggattcaccttaccccgaatcctctcctgatatggaagaggatctaagtcccagtagacgctcagagaatgaagatatttattacaagtcgatgccaaaccttggcgcgggccaccagctgcagatgtgctatcagattagcagaggcaactctgatggatacattattccgataaacaaagagggctgcatccctgagggggacgtccgggaaggtcagatgcagcttgtgacaagtctgtag

SEQ ID NO: 26980 - DNA, 4425 bp, Artificial Sequence
  Description of Artificial Sequence: Synthetic coding sequence
atggtgagcagcggctgcaggatgcggagcctctggtttattatcgttatctcctttttgcctaacaccgaaggtttttctagggcagctctccctttcggtctcgtaaggagggaactgagctgcgagggctatagcatcgatctgcgttgtcctggctccgatgtgattatgattgaatccgccaactacggtaggaccgacgataagatatgtgacgccgacccctttcaaatggagaacacagattgttacctcccggacgcattcaaaataatgacacagagatgtaacaacaggacccagtgtattgttgtgactgggtctgatgttttccctgacccatgtccaggcacttacaagtacctggaggtgcagtacgagtgcgtcccatacatctttgtatgtcctggaacgctgaaggccatcgtggattctccctgcatctacgaggctgagcagaaggcaggcgcctggtgcaaagatccactacaagccgctgacaagatctactttatgccctggaccccctaccggaccgatacactgattgaatatgcaagtctggaagacttccagaactctcgacagacaaccacctataaattgcccaacagggtggatggcaccggatttgtcgtttacgacggcgccgtcttctttaacaaggagcgcactaggaacatagttaagtttgatctgcggacaaggatcaaatccggggaggcaatcattaattatgcaaactatcatgacacctcaccctaccgctgggggggaaagactgacattgatttggcggtagacgagaatggtctgtgggtcatatacgccactgagcagaacaacggaatgatagtgatcagccagttgaacccatatactctgaggttcgaggccacatgggaaaccgtatacgacaagcgcgctgcatctaatgcgttcatgatctgtggagtactgtacgtggttcggtctgtgtatcaagataatgagtctgagacaggaaaaaattctatcgactatatttataacacgcgcctcaatcgcggagagtatgtggacgtacccttcccgaatcagtatcagtacatcgctgccgtggactataatccccgggacaatcagttgtatgtgtggaataacaattttattctccgatattcactggagttcggacctcccgaccctgcccaggtccccacgactgctgttactattacaagctccgccgaactgttcaaaacaattatttccaccacctccaccaccagtcagaagggccctatgtccaccaccgtggccgggtcccaggaggggtcaaaaggtactaaacccccacctgcagtgtctaccaccaagattcccccgatcaccaacatctttcctctgccagagaggttttgtgaagctttggatagcaagggtattaagtggccccaaactcagcggggcatgatggttgaacggccttgcccaaaaggcacgaggggaactgctagctacctatgcatgatctcaaccggcacatggaatccgaaaggtcctgacctcagtaattgtacgtcacactgggtgaatcagctcgctcagaaaattcgcagcggtgaaaatgcagcctctttggctaacgaactcgctaaacataccaagggcccagtgttcgctggagacgtgtcatcttcagtacgcctcatggagcagctcgtcgacatactcgacgcccagctgcaggagctgaaacccagtgagaaggactctgctgggagatcatataataaactgcagaagcgtgagaagacatgtcgagcctaccttaaggctatcgtggacactgttgataacttgctgagacccgaagcgcttgaaagctggaaacacatgaactcctcggagcaagcccatacggccaccatgcttctggataccctcgaggaaggcgcctttgtacttgccgacaacttgttggagccaacaagagtgtcaatgcctacagagaacatcgttctggaagtcgcagttctgagtacagagggacagatacaggactttaagtttccactgggaatcaagggagcgggctcctctatccagctgagcgctaatactgtgaagcagaactccaggaatggcttggccaaactggtcttcattatttataggtcactgggacagttcctgtcaacggagaatgctaccattaaactaggcgccgactttattggaaggaactctactatcgcagtgaattctcacgtaatctctgttagcataaacaaagaatcctctagagtgtatctgaccgatcctgtgctctttacacttccacatattgatcccgacaattactttaatgctaactgctctttctggaattacagtgagagaaccatgatgggttactggtctacccagggttgcaagctcgtggatacaaacaagaccagaactacctgcgcatgctcacatctaaccaattttgcaatactgatggcccacagggagatagcctacaaagatggcgtgcatgagctgctgctgaccgtgatcacctgggtcggcattgtgatctctctggtttgtctcgctatttgcatcttcacgttttgctttttcaggggcctgcagagtgataggaacactatccacaagaacctgtgcatcaatctgttcatcgctgagtttattttcctgatcggcatagacaaaactaaatacgctattgcgtgtccaatcttcgctggcctgctgcacttctttttcctggcagcatttgcgtggatgtgtcttgaaggggtgcagttgtacttgatgctcgttgaagtctttgagagcgagtattcacggaaaaagtactattacgtggctggttacctcttcccagctactgtcgtgggggtaagcgcggcaatcgattacaaatcatacggtactgaaaaggcctgctggcttcacgtagataattacttcatctggtcgtttatcggtccggtgacctttatcattctgctcaacatcatctttttagtaattacattgtgtaagatggtcaagcactctaataccctaaaaccagactctagcaggctcgaaaatatcaacaattaccgagtgtgcgatggttactacaacacggacttgccaggaagttgggtcttgggcgcattcgctctattgtgtttgctcggcctgacctggtcattcggactgttatttatcaatgaggagaccatagtcatggcgtatctttttacgatatttaatgcctttcagggagtctttatctttatctttcattgtgctcttcagaagaaggttcgtaaagagtacgggaaatgctttcgtcactcttactgctgtggcggtcttcccaccgaaagcccacacagttcagtaaaagcgtcgaccaccagaacctcagccagatatagcagcgggacccagtcccggattagaagaatgtggaacgatacagtgcggaagcaatcagagagctcgtttatttctggagacatcaattccacctccactcttaatcaaggtatgaccggaaactatctgctgaccaatccattgctgcgtccccacgggacaaataacccttataataccctcctggctgaaactgtggtttgtaatgctccaagtgcgccagtcttcaatagcccagggcactccctcaacaatgcaagggatacctcagctatggacacactcccgttaaatggtaacttcaataactcctatagtctgcataagggggattataatgattccgtgcaggtggtcgattgcggcctgtcacttaatgataccgcgtttgagaagatgattatctcagagctggtccataataatctccgtgggtcttctaaaactcataaccttgagttgacactgccggtgaagcccgttatcgggggatcctcctcggaagacgacgccatcgttgcggacgcgtcatcactgatgcattcagacaatccgggcctggaattacatcataaggaattggaggcaccactgataccacagcggacacattcacttctataccagccacagaagaaagtaaagtctgaggggactgattcctacgtgagccaactgaccgctgaggccgaagaccacctccaaagcccgaacagagattctctgtatacctcaatgcctaatctccgggacagtccctatcctgaaagctctcctgacatggaagaggacctctcaccgagccgaaggagcgaaaacgaagatatatactacaagagtatgcctaacctaggcgccgggcatcagctgcaaatgtgctaccagatttcacgcggcaactcagacggctacattataccgatcaataaggaagggtgcattccagaaggcgatgtgcgagagggacagatgcagctggtgacctctctgtag

SEQ ID NO: 26981 - DNA, 4296 bp, Artificial Sequence
  Description of Artificial Sequence: Synthetic coding sequence
atggttagcagtggctgtcgtatgaggagcctgtggtttattatcgtaataagttttctgcctaacacagaggggttcagcagagcagccttaccatttggcttagtacgacgggaattgtcctgcgagggatactccatcgatctaagatgtccaggatctgacgtgatcatgattgagtccgctaactatggcagaaccgacgacaagatatgtgacgccgatccttttcagatggaaaacacggactgttacctaccagatgccttcaagatcatgacccagaggtgtaacaatcgaacccaatgtatcgtggtgaccgggagtgatgtgttcccagacccatgccctggaacatacaaatatctggaggtgcagtacgagtgcgtaccttatatctttgtgtgtcctgggacactgaaagctattgtcgacagcccttgtatctatgaagcagaacagaaagccggggcttggtgtaaggatcctctacaggcagcagataaaatctactttatgccttggacaccctatcgcacagacactctgatcgaatacgcctcccttgaagacttccaaaacagcagacagactacaacctacaagctgcctaatagagtcgacggtaccgggtttgtggtatatgatggcgcagtgtttttcaataaagagcggacacgaaacatcgtcaagttcgacctccggacacgcatcaaatccggcgaagccattatcaactacgcaaactaccacgatacttctccctaccgatggggcgggaagaccgacattgacctcgctgtagacgaaaatggtttgtgggtgatctacgccacggaacaaaataatggaatgatcgtgatctcccaattgaacccttacacgctccggtttgaagcgacatgggagactgtttacgacaaaagggcagcatccaatgcgtttatgatatgtggggtactgtatgtggtccgaagtgtgtaccaggacaacgagtccgaaacaggtaagaactccattgactatatttacaacacacggctgaaccgcggggagtacgtcgatgttccatttcccaatcagtatcagtacatcgccgccgtcgattataatccccgggataatcaactctacgtttggaacaataacttcatactccgatattccctcgagttcgggccacctgacccagctcaggttcctaccaccgccgtgacaattaccagtagcgcggagctgtttaaaacgatcatctctacgacatccacgacaagccagaaaggtccaatgtctactaccgtggccggctcacaagaaggctcaaaaggtacgaagccaccccccgctgtgtccaccacaaagattcctcccatcacaaacatcttccctctgcccgagagattctgcgaggctctggattccaagggcattaaatggcctcagactcagcgaggtatgatggtcgagcggccttgccctaaaggaacaaggggcaccgctagttacctgtgtatgatctccacaggtacatggaatcctaaaggcccggacctgtcaaactgcaccagccactgggttaaccagctggcccaaaagattagaagcggtgaaaatgccgcctcattggccaatgagctggccaaacacacgaaaggtccagtgtttgcaggagacgttagctccagcgtgcgactcatggagcaactagttgacatcttggacgcccagctgcaggaattgaagccctctgaaaaagactccgcagggagaagctataataagcttcaaaaacgagagaagacctgtagggcttaccttaaagcgattgtggatactgttgacaatctcctgagacccgaggcactggagtcatggaagcatatgaattcatccgaacaggcccacacagctactatgcttctcgatactcttgaagagggagcatttgtgctggcagacaacctgctagagcccacacgggtctctatgccaacggaaaatatcgtcttggaagtagctgtgctgtctacagaaggtcagattcaggacttcaagttccccctggggataaagggggcaggaagctcaatacagctgagtgccaatactgtgaagcaaaatagccgaaatggccttgctaaacttgtctttattatctaccggagcctcgggcagtttctaagtaccgagaacgccaccatcaaattaggagcggacttcatcggacgcaattcaactattgcagtaaacagtcacgtgatttctgtgtccattaataaggaaagctctcgggtttaccttaccgaccccgtgttgttcacacttccccacatcgaccccgataactactttaatgctaactgctcattctggaactacagcgagcggacaatgatgggttactggtctacgcagggttgtaagttagtggacacaaacaagactcggaccacctgtgcctgttcccacctgactaactttgccatcctaatggcgcatcgcgaaatcgcttacaaggatggagtacacgaactgctcctcacagtaatcacatgggtcggaatcgtgatttctctggtttgtctcgccatttgtatctttacattttgtttcttccgcggactccaaagcgatagaaacacaatccacaaaaacctgtgcatcaatctattcatagctgagtttatttttctgattggaatcgataaaacaaagtatgctattgcctgccccatcttcgcggggctgttgcacttctttttcctcgcggcatttgcctggatgtgcctcgagggggtgcaactgtatttgatgctggtagaggtcttcgagagtgagtattctcgcaagaaatattattatgttgcaggttacctattcccagccacagtggtgggagttagcgcagctattgactataagtcctatggcacagagaaggcttgctggctgcatgtggataattacttcatctggtcttttatcgggcctgtgacctttatcattctgctgaatataatttttctggtcatcactctgtgcaagatggtcaagcactctaatacattgaagcctgactccagcaggctggagaacatcaacaattacagggtgtgtgacggctactataacactgatctgccaggttcctgggtgctgggcgcctttgcattgctgtgtctcctcgggctaacatggtcattcggcctgttatttattaacgaagagaccatcgtgatggcctacttgttcaccattttcaacgcttttcaaggtgtgttcatctttatattccattgtgcactgcaaaagaaagtacgtaaagagtacggcaagtgctttagacactcttactgctgcgggggtttaccgactgagagcccccactcgtccgtaaaagcctccaccacacgcacaagcgctcggtacagtagcggaacccagtctcggatacggaggatgtggaacgacacagtgaggaagcagtccgagtcttcctttatctctggcgatatcaactctacatctacattaaaccagggtcactccttgaacaacgctagggatacatctgcaatggatactcttccgttgaacggtaatttcaataacagctattccctgcacaaaggcgactataatgactctgtacaagtagtggattgtggactctctctgaatgacactgcgttcgagaaaatgattatcagcgagttagtgcacaacaacctgcgcgggtcatctaagacccataacctggaactcactctgccagtgaagccggtgatagggggaagttcatccgaggacgatgcgattgtggccgacgccagttctttgatgcactctgataatccaggtctagagcttcaccataaggaacttgaagctccactcattccccagaggacccactcattgttataccagccccagaagaaggtgaaatctgaggggactgacagctacgtatctcagttgaccgcggaggctgaggatcaccttcaaagccctaaccgtgattctctctacacgtctatgcctaacctgagggattctccttatccggagtcctctcctgacatggaggaggacctgagcccatctcgccgctccgaaaatgaagatatctattacaagtctatgcctaaccttggggccggccatcagctgcagatgtgttaccagatttcacgcggcaatagtgacggctacattatccctataaacaaagaagggtgtattcccgagggggacgttagagaaggccaaatgcagttagtcacatctttgtag

SEQ ID NO: 26982 - DNA, 4380 bp, Artificial Sequence
  Description of Artificial Sequence: Synthetic coding sequence
atggtctcatcaggatgccgaatgcgctcactctggtttatcatcgtgatctccttcctgccaaacacagaaggattttctcgggccgccctgccattcggcctggtaaggagggagctgagctgcgaagggtatagtatcgatttgaggtgcccaggatccgatgtcattatgatcgaaagtgctaactatggaaggacggatgataaaatttgcgatgccgacccgttccagatggagaataccgattgctaccttcctgacgcatttaaaattatgacacagcgctgtaacaatcggacccagtgcatcgtggtaactggcagcgatgtgtttccagacccttgtcctggaacatacaagtacctggaggtccagtacgaatgtgtgccttacatctttgtgtgtccagggacactgaaggccattgtggacagcccctgcatatacgaggccgagcaaaaagcaggtgcatggtgcaaggacccactacaggctgcagacaaaatctacttcatgccctggacaccctatcggaccgatacactcattgagtatgcatccctcgaagatttccagaattcccgccagacaacaacctacaagctgccaaaccgagtggacggcaccggatttgttgtgtacgatggcgctgtgtttttcaataaagagcgtactcgcaatatcgtgaaattcgacctccggacccggatcaagtctggagaagccattatcaactatgcgaattaccatgacacgagcccgtataggtggggcggaaagaccgacatcgatctggccgtcgatgagaatggtttgtgggtgatctatgccactgagcagaataatggaatgattgtaatctcacagttaaatccttatacactgcgctttgaggctacctgggagacggtctacgataaacgtgcagccagcaatgccttcatgatctgcggggtcttatacgtggtcagaagcgtctatcaagacaacgaatctgaaacagggaaaaatagcattgactacatctataacacacgtctcaatcgcggagaatatgtggacgtgccttttcccaaccagtaccagtacatcgctgccgtggattataacccacgcgataatcagctgtatgtctggaataataattttatcctaaggtactcgcttgaattcggacctccggacccggctcaggtgcccacgaccgcagtgaccattacatcatcagccgaactgttcaaaactattatttcaacaacatccacgacttcccagaaaggccccatgtcaacaacggtggcaggttcccaggagggctccaagggcacgaagccccccccagctgtatccacgaccaagatcccgcccattacaaacattttccccctgcctgaacgcttctgtgaagcgttagattccaagggcattaaatggcctcaaacccagaggggaatgatggtcgagaggccctgccctaaaggaactaggggtacagctagttacctgtgcatgatttcgacaggaacctggaatcccaaaggacctgacctgtctaactgcactagtcactgggtgaaccagttggctcagaagataaggtcaggtgaaaatgcagccagcctggcaaacgaactggccaagcacactaaaggcccagttttcgccggggatgtctcgtcaagcgttcggctcatggagcaattagtcgacatcctcgacgctcagttacaggaactgaagccaagtgaaaaagatagtgctggccgatcctacaacaaactccagaaaagggaaaagacatgtcgcgcgtacctcaaggccatagtcgataccgtggataatctgctgcgtcctgaggctcttgaaagttggaaacatatgaattctagcgagcaggcccataccgctacaatgctcctggacactctggaggagggagcttttgttcttgccgacaaccttctggaacctaccagagtgagtatgccaactgaaaatattgtcttggaggtcgctgtgctttctaccgaaggccaaattcaagactttaaatttcctctaggaatcaagggcgccggatcaagcatccagctgtcggccaatacagtgaagcaaaactcccgcaacggcttagccaaactcgtcttcatcatctacagatcgctgggccagtttctgagcactgagaatgctacaatcaaactcggcgccgactttatcgggcgaaactccaccatagcagtgaactcacatgtgattagtgttagcatcaacaaggagagcagcagggtctacctcacagaccctgtcctcttcactcttccacacattgatccagacaactatttcaatgcaaattgtagcttctggaactattccgaacgcacgatgatgggatattggtcaacccagggttgcaagctcgtcgacacaaataaaacacgtacaacgtgcgcttgctcccatttgaccaatttcgctattctgatggcccatagagagattgcttataaagacggggtgcacgaactgctgctcacagtgataacctgggtgggaatcgtgatttcacttgtctgtctcgccatttgcatcttcaccttctgtttctttcgcggtctccagtccgacagaaataccatccataaaaatttatgcattaacctgtttatcgccgagtttatcttcctgattggcatcgataagacaaaatacgccatcgcttgccctatcttcgcaggacttttacatttctttttccttgcagcgttcgcctggatgtgcctggagggcgtgcagctctatctcatgctggtggaagtgtttgagtccgagtacagccgcaagaagtattattacgtcgccggctatttgtttcctgccacagtagtcggggttagtgctgctattgactataagagttacggcacagaaaaggcctgctggctgcacgtggataactacttcatttggtcctttatagggccagttaccttcattattcttctgaatattatctttctggtcattacactctgtaaaatggtgaaacactctaacactttaaagcctgattctagccgcttggagaacataaagtcttgggtgcttggagctttcgccctcctgtgtctgcttggtcttacttggagcttcggactgctttttatcaacgaagaaaccatcgtgatggcgtacctctttacaatctttaatgccttccagggcgtgttcatctttattttccattgtgccttgcagaaaaaagtaaggaaggaatacggtaagtgcttccgtcacagttattgttgcggcggcctccccaccgagtctccccactcgagtgtcaaggcttccactacgcggacatcagcacgatactcttctggtactcaatcgcggatccgaagaatgtggaatgatactgtccgcaagcagagtgagagtagtttcatctccggggatatcaacagcacttctaccctgaaccaagggatgaccggcaattatctgctcactaatccattgcttcggcctcacggaactaacaacccatataatacactcctcgccgagactgttgtttgtaatgccccttccgccccggtgttcaactcaccaggtcatagcctcaacaacgcacgggataccagtgccatggataccctgcccctgaatggcaactttaacaactcttattcgctccacaagggagactataacgattccgtccaagttgtggactgcggcctttctctcaacgatacagcctttgagaaaatgataatcagcgagttagtgcataataatttacgggggagttccaaaacccataacctcgaactgacgctaccagtaaaaccagtcatcggcgggtcttcttctgaggacgacgctatcgtcgccgatgcgagctctctgatgcatagcgataacccgggcttggagttgcatcataaagaattggaggctcctctgatccctcagcgtacacactcattgttgtaccagccccagaagaaggtgaaatcagaaggcacagattcctacgtatcacagctcaccgccgaggccgaggaccacctccaatctcccaacagagactccctgtacacttcaatgcctaatctaagagacagcccttatcccgagtcttcacccgacatggaggaagacttgagcccgagtaggaggtcagagaacgaagacatttattacaaatccatgcctaaccttggtgctggacaccagcttcagatgtgttaccaaatctcacgcgggaactcggacgggtatataatccctattaacaaagagggctgtatcccagaaggcgatgtgagagagggtcagatgcagctcgttactagtctgtag

SEQ ID NO: 26983 - DNA, 4251 bp, Artificial Sequence
  Description of Artificial Sequence: Synthetic coding sequence
atggtgagctccgggtgccggatgcgttcgttatggttcataatcgttatctcgtttctgcccaatacggaaggcttttcccgagcggccctaccctttgggctcgttagaagggaactgtcatgtgaggggtactcgatcgatctccggtgccctgggagtgacgtaatcatgatcgagagtgccaattatggccgcacagacgataaaatatgtgacgcagacccttttcaaatggaaaacaccgattgttacctgccagatgcgtttaagataatgacccagcgctgtaataacagaacacagtgtatcgtggtgaccgggtcagacgtcttccctgacccttgccccggcacttacaaatacctagaggttcaatatgaatgtgtgccttacatttttgtgtgtcctggcactctgaaagccattgtcgattctccctgtatctatgaagctgaacagaaggccggcgcatggtgtaaagatccacttcaggcagcggacaaaatttatttcatgccctggacaccttaccgcacagacacattgattgagtatgcctccttagaggatttccagaactcccggcagacaaccacatataaactgcctaaccgggtcgacggcaccgggttcgttgtgtatgatggagcggttttcttcaacaaagagcgcacccggaacatagtgaaatttgacctgagaactaggatcaagagcggcgaagccattattaactacgcaaactaccacgacacgtccccttatcgatgggggggcaagaccgacattgaccttgctgtcgatgagaacgggctctgggtaatttacgccaccgagcagaacaacggtatgatcgtgatttctcagctaaacccttacacccttcgcttcgaggccacgtgggagaccgtgtacgataagcgtgcagcctcaaatgcttttatgatctgcggcgtcctctacgtcgttagatccgtctatcaggacaacgaatccgagaccggcaaaaattcaatcgactatatctataatacaaggctgaatagaggtgaatacgtggatgtcccgtttccaaatcaataccagtacatcgccgcagtggattacaatccaagagataatcagctctatgtttggaacaacaacttcatactgcggtactcgctggaatttgggcctcctgaccccgctcaagtgccgactactgccgtcacgatcacaagctctgcagagttgttcaaaaccatcattagcacgactagcaccacctcacagaaaggaccgatgtcgacgactgtggccgggtcgcaggagggatccaaaggaacaaagcctccacccgccgtgtccactaccaagatacctcctattaccaacatattccccctgccagagagattctgcgaagcactagactcaaagggcattaaatggccacagacacagagggggatgatggtcgaaaggccttgtcccaaaggtacacggggtactgcttcatatctgtgcatgatttcaaccggcacttggaatcccaaagggccagacctgagtaactgcacttcacattgggtgaatcagctggctcagaaaattagatccggcgaaaatgctgcgtcgcttgctaatgagttggcgaagcacacaaaaggaccagtcttcgcgggagacgtatccagttctgttcgactgatggaacagctcgtggatatcttagacgcacaactgcaggaactaaaaccatcagagaaagacagcgccggacgcagctataacaagctgcagaagagggaaaagacatgccgggcgtatctgaaagctatcgttgacacggtggacaacttacttaggcctgaggcactggagtcatggaaacacatgaatagcagtgagcaagcacacacagccacaatgctcttggacacactcgaggagggggcctttgtgctagcggacaatttactcgagcccacccgtgtaagcatgccgactgagaacatagtgctggaggtggccgtcctctccacggagggacagatccaggactttaagtttccattggggattaagggcgcaggctcatctattcaactctcagctaataccgtgaagcagaactcgagaaatggactggcaaagcttgtattcattatatacagaagccttggtcagtttctgagcactgaaaacgccacgatcaaactgggcgccgacttcattggacggaatagcaccattgcggttaactctcacgtgatctcagtaagcatcaataaagagagcagcagggtatacctcacggacccagtcttatttactctgccgcacattgatccggacaattattttaatgcaaactgctccttttggaactattcggagcggacaatgatggggtactggtcaacccagggctgcaaactggtcgacacaaataagacgcgtactacatgtgcctgtagccacctaacaaatttcgcgatcctgatggctcatcgcgagattgcatataaagatggggtccacgagctgctgctcactgttattacttgggtaggtattgtcatatcgctggtttgcctggcgatctgtattttcactttctgcttctttcggggcttacaaagtgacaggaacaccatacataaaaacttgtgtataaacctgttcatcgccgaattcattttcttgattgggattgataaaacaaagtacgccatcgcctgccctatcttcgcaggcctgctgcactttttcttcttagctgcattcgcctggatgtgcttggagggagtgcaattatatctgatgctggtggaggtatttgaaagcgaatactccaggaaaaagtactactatgtggccggttatctgttccctgcaacagttgtgggagtgtcagccgctattgactacaaatcatacggcaccgaaaaagcttgttggctccatgtcgacaactattttatatggtcgttcataggcccagtgaccttcattattttgttaaatataatctttctggtcattaccttatgtaaaatggttaagcattcaaacacactcaagcctgactcttcaaggcttgagaatattaagagctgggtcctcggtgcttttgccttgttatgccttcttggcctgacatggtccttcggcctgctctttattaatgaggaaacgatcgtgatggcctacctattcaccatctttaacgcttttcagggagtgtttatttttatttttcactgtgccctccagaaaaaggtccgcaaagagtacggtaaatgtttcaggcactcatattgctgtgggggactgccaacagaaagcccgcactcctcagttaaggctagcacaacacgcacgtcagcccgatactcatccggaacacaaagccgcatcagacgcatgtggaacgacacggtgcggaagcagtcagagtcatccttcatatccggggacataaacagtacaagcacgctcaaccaaggtcactccttgaacaacgccagagacaccagcgcaatggacacattgcctctgaacgggaacttcaacaacagctatagtctccacaagggagactacaacgattccgtgcaggtggtcgactgcggcctgagccttaatgacacggccttcgagaaaatgatcatctctgaactcgtacataacaatctccggggcagttcaaagacgcataatctggagctcacccttccagtcaagcctgtgatcggtggttcttcctccgaggatgatgccatcgtggcggacgcctcaagcctcatgcacagcgataatcctgggttagaactccatcacaaagagctcgaggcccctcttatcccccagcgcacacacagtctgctgtaccaaccccaaaagaaggtaaaatccgagggaacagacagttatgtatctcagctgaccgccgaagctgaagatcacctgcagtctcctaatagggatagcttgtacacaagcatgcccaatcttagagatagcccttatccagagtcgagtccagatatggaggaggacctgtctccatcgaggcgttctgagaacgaagatatttactataagtctatgccaaacttgggagcggggcaccaactccagatgtgttatcagatttcaagaggcaattcagatggatatatcatccccataaataaagaggggtgcattccagagggcgatgtccgggagggccaaatgcaactggtgacctcactgtag

SEQ ID NO: 26984 - DNA, 4386 bp, Artificial Sequence
  Description of Artificial Sequence: Synthetic coding sequence
atggtgtccagcggctgtcggatgagaagcctttggtttataatagtgatcagctttctgcccaacactgagggtttcagcagagccgcactgcccttcggccttgtacgacgtgaactctcttgcgaaggttatagcatcgatctgagatgccccggctcagatgtgattatgatagagagcgcaaactatgggcggacagacgacaagatatgcgacgcagatccttttcagatggaaaacaccgactgctacctgcctgatgccttcaaaataatgactcagagatgtaacaatcggacacagtgtatcgtcgtgacaggcagtgacgtattcccagacccctgcccagggacatacaaatatctggaggtgcaatacgaatgtgtgccttatatttttgtgtgtcccggcactttaaaggctatcgtggactccccttgtatttacgaagcagagcagaaagcgggcgcttggtgcaaggatcctttgcaggccgctgataaaatttattttatgccctggactccttatagaaccgataccctgatcgaatatgcaagcctcgaagacttccagaattcccgtcaaactacaacatacaaacttccaaaccgtgtggacggcacagggttcgtcgtgtatgacggcgctgtgttctttaataaagaaagaacccgtaatatcgtgaagtttgacctgcggacccgaatcaaatccggtgaagctatcatcaactacgcaaactaccatgatacttccccttatcgatggggggggaagacggacatagacctagcagttgacgagaatggcctgtgggtaatttacgcaacagagcagaacaacgggatgattgtcatctctcagctaaatccctacactttaaggtttgaggccacatgggagactgtttacgataagagagcggcttctaatgcattcatgatctgtggtgtcttgtatgttgttcggagcgtgtatcaagataatgaatctgaaaccggcaagaatagtattgactacatttataatacacggctcaacagaggcgagtatgttgacgtgccttttcctaaccagtaccagtatattgcggcggtcgattacaatccacgggacaatcagttgtacgtgtggaataacaattttatcctcagatactccctggagttcggtccaccagacccagcccaagttccgaccacagcagtaaccataacatcatcggccgagcttttcaaaactataattagtaccacatccactacttctcagaaggggcccatgagcacaacggtagccggtagtcaggagggtagcaagggcaccaagcccccccctgccgtcagcaccaccaagatcccgccgataacaaatatttttcccttacccgaacggttttgtgaggctctggactccaaaggaatcaaatggcctcagacccagcggggcatgatggtagaacgtccttgtcctaaagggacccgtggaacagcatcttacttatgtatgatcagcactggaacctggaacccaaaaggaccagatcttagcaactgcacttcacattgggtgaatcagctcgcacagaagattcggagcggcgagaatgcagcctccctggcgaatgagctagctaaacataccaagggcccagtgtttgcaggggatgtgtcctcatccgtacggctgatggagcagctagtcgatattctggatgcccaactgcaggagctgaaaccatccgagaaggactccgccggccggtcatacaacaaggctattgtggacacggttgacaatctgctgaggccagaggcgttggaatcgtggaagcacatgaactcgtctgaacaagcgcacactgccacaatgctgctcgatacactggaagagggtgcctttgtccttgccgacaacttacttgaaccaactcgcgttagtatgcccactgagaatatcgttctggaagtcgcagtattgtccacagagggccaaatccaggatttcaaatttcctctgggaatcaagggtgcagggtccagcatacagttgtcagcaaacacagtcaagcagaactcacggaacggcctggctaagctggtgttcattatctaccggagtttaggacagtttctgtctactgaaaatgctactatcaagttgggggccgactttattggacgcaattctaccatcgctgtcaacagccatgtcatttctgtctctatcaacaaagaatcaagcagagtttacctcacagaccccgtgctgttcaccctgccccacatcgacccagacaattactttaatgccaattgctctttttggaactactcggaaaggaccatgatgggctattggtccacccagggctgcaagctggttgacacaaataagactagaacaacttgcgcttgcagtcacctcacaaacttcgcaatattaatggctcaccgcgaaatagcttacaaagacggagtccacgagttgctactgacggtgatcacatgggtcggcattgtgatttccttggtctgcctggctatctgcatatttactttctgcttcttcagggggctccagtccgaccgtaataccatccacaaaaatctgtgtattaatctcttcatagcagagttcatcttcctgattggtatagacaagactaagtacgcaatcgcctgtcccatttttgccggcttactgcacttcttttttttagccgccttcgcctggatgtgtctggagggggtacaactctatctgatgctggtcgaggtgttcgaatctgaatattcccggaagaaatactactacgttgctggttaccttttccctgccacagtcgtcggcgtgtccgcagccatcgattacaagagctacgggaccgagaaggcctgctggctccatgtggacaattatttcatttggtcttttataggccctgttactttcatcatcctgctaaatatcatcttcttagtgataacactgtgcaaaatggtgaagcatagcaatacgcttaagccagactcatctaggctggaaaacattaataactatagggtgtgcgatggctattataatacagaccttccaggcagttgggtgctgggtgcttttgctctactttgtctgcttggcctaacttggtcctttgggctgctgtttattaacgaggaaactatcgtcatggcgtacctattcactatctttaacgcatttcagggggtcttcatattcatcttccattgcgccttgcagaaaaaggtgcgcaaggaatacggcaagtgtttcagacactcatattgctgcggcggtttgcctaccgagagcccccactccagcgtgaaggcctcgacaactcgaactagcgcccgctactcttctggaactcagtccagaatcaggcgtatgtggaatgacaccgtgcggaagcaatccgagtcatctttcatctccggtgatattaattctaccagcacgctgaatcagggcatgaccggcaactacttactcaccaacccattattacggcctcacggtactaacaatccgtacaacacactgctggctgagacagtagtgtgtaatgcacctagtgctcccgtgtttaattctccaggccactccctcaataacgcacgtgacacaagcgccatggatactcttcctctaaatggcaatttcaataacagctattccctgcataaaggggactataacgacagtgtccaggtagttgactgtgggctgtcgctgaatgataccgcctttgagaaaatgataatctctgagctggttcacaacaatttgaggggctcatccaaaacccacaatcttgaactgaccctgccagtgaaacctgtgatcgggggctcttcctcagaggatgacgcaattgtggccgatgcctcctccctcatgcattccgataaccccggcctagaactgcaccataaggaacttgaagcaccactgatcccgcagagaacccatagcctgctttaccagccccagaaaaaggtaaaatccgaggggaccgattcctacgtgtcccagttgactgccgaggccgaggatcacctgcagtcccccaatagggacagcttatacaccagtatgcctaatctccgggattcgccttacccagaatctagccctgacatggaggaggatctgtcgccctcgcggcggtcggagaacgaggatatctattacaagagtatgccgaatctgggcgctgggcatcagctgcaaatgtgttaccaaataagtagagggaattccgatggatatattataccaataaacaaggaagggtgcattcctgaaggtgacgtgcgtgagggacaaatgcaattggttacctctctgtag

SEQ ID NO: 26985 - DNA, 1416 bp, Artificial Sequence
  Description of Artificial Sequence: Synthetic coding sequence
taaattacattgtgtaagatggtgaagcattcaaacaccttaaagccagacagtagccgactcgagaacattaataattacagggtctgcgacggatattataatacagacctgccaggttcctgggtgttgggggccttcgctctgctttgcctactggggctgacgtggtcatttggtctcctgttcatcaatgaggaaaccattgtcatggcatatctcttcactatatttaacgctttccagggagtgtttatatttatttttcactgtgccctacagaaaaaagtgcgtaaggaatatggcaagtgtttcaggcactcttattgctgcggcggtctgcccacagagagcccccatagctctgtgaaagctagtaccacgcggacctcggccaggtacagctcaggcacacagtctaggatcagaagaatgtggaatgacaccgtacgaaaacaaagtgagtctagctttatttctggcgatatcaattcaacctctaccctgaatcagggcatgaccggcaactacctgttaacgaacccactgctgaggccccacggcactaataacccttataatactcttctggccgagaccgtcgtgtgcaacgccccctccgctcctgtgtttaattcaccagcaacgtatagagaaacccgacattccttgaataatgcgagagacactagcgcaatggacaccttaccattaaatggaaactttaacaacagctatagtttgcataagggagactataatgacagcgtgcaggttgtggattgcggcctgtcacttaatgatacagctttcgaaaagatgataatctccgaactggtccacaacaacctgcgaggtagtagcaaaacacataacttagagcttacgttgcctgtgaagcctgtgatcggtggctcttcgagtgaggatgacgcaattgtggccgacgcatcctccctcatgcatagcgataacccaggtctagaactgcaccataaggaacttgaagcgcctctcataccccagaggactcattcccttctgtaccagcctcagaagaaagtgaagtccgagggtaccgattcatacgtatcccagttgacagccgaggccgaggaccatcttcagagcccgaaccgcgacagcttatacacaagtatgcccaatctgagagatagcccttatcctgagagtagccccgatatggaggaggatttatctccttctcgtaggtcagagaacgaagacatctactacaagagcatgccaaatctgggcgctggccaccaactgcagatgtgttatcagatttcccgaggaaacagcgacggctacataattcccatcaataaggagggctgtatacccgagggcgatgtgcgggaaggacagatgcaactggtgacatccctgtag

SEQ ID NO: 26986 - DNA, 4056 bp, Artificial Sequence
  Description of Artificial Sequence: Synthetic coding sequence
tgattcgtgtgcccagggaccttgaaggctatcgtggactccccgtgtatctatgaagccgagcagaaagcgggcgcttggtgtaaggaccccttgcaggccgctgacaaaatctactttatgccctggaccccatatcggaccgatactctgattgagtacgcatcccttgaggactttcagaatagtaggcagaccaccacttacaagttgccaaaccgtgttgacggtaccggattcgtggtgtacgatggtgcggttttcttcaataaggagcgcacacgcaacatcgttaagttcgacctaaggacaagaatcaagtctggagaggccatcatcaactacgcaaactaccacgacacttccccatatcgatggggagggaagacggatattgacctggcggtcgacgaaaacggcctatgggtcatttatgcaaccgaacagaacaacggtatgatagttattagtcaactcaacccgtacactctgcggttcgaagcaacctgggaaaccgtatacgacaaaagggcagcaagcaacgcattcatgatctgtggagtactctatgtagtgcggtctgtgtaccaggacaatgagagcgagactggcaagaatagtatcgattacatttacaacactcgactgaatcggggtgaatacgtcgacgttcccttccctaaccaatatcagtatattgccgctgtggattataatccccgggataaccaactctatgtctggaacaacaactttatccttcggtatagcctagaattcgggccacccgacccagcccaagtgcccaccacggctgttactattactagttccgctgaattattcaaaacgatcatatcgactacctccacaacctctcagaaagggccaatgtctaccacggtcgccggctcccaggaaggcagcaagggaaccaaacctccccccgctgtgtccacaaccaagatccctcccattactaacatctttcccttacccgagcggttctgcgaggcactcgacagcaaaggtattaagtggccacagactcaaaggggaatgatggtcgagcgaccctgcccaaagggcacccgcgggaccgcaagctatttatgcatgatctccactggcacgtggaatccgaaggggccggatttgagcaattgtacctcacactgggtgaatcagttagcgcagaagattaggtcaggcgaaaacgccgcttcactggccaatgagctcgccaagcacacaaaagggccagtatttgctggagacgtcagctcatccgtccggttgatggaacagcttgtggacattctcgatgcacagctgcaagaacttaagccaagcgagaaggattctgctggccggagctacaacaagttacagaagagagagaagacttgccgagcttaccttaaggccattgtggatacagtggacaacctgctgagacctgaggcacttgaaagctggaaacacatgaatagtagcgagcaggctcacaccgcgactatgctgctcgatacacttgaggaaggcgcatttgtcttggccgacaatctgttggaacccacccgagtttccatgcctaccgaaaacattgttcttgaggtggctgtcctgtctaccgagggccagatccaggactttaaatttcccttgggtatcaagggcgccggatctagcattcagttgagtgccaacactgtgaagcagaattcacgtaacgggctggccaagttagtgttcattatatataggtcactcgggcagttccttagcaccgagaacgccactatcaagttgggagccgattttataggcaggaatagcactattgcagtcaattctcatgtcatcagtgtgtcaatcaacaaagagtctagtcgggtgtatctgactgatcccgtgttattcacactcccgcacatcgatcccgacaattacttcaatgccaactgctcattctggaactactcagaacggaccatgatgggttactggagcactcagggctgcaagttggtggatacgaataagaccaggaccacatgtgcatgcagccacttaacgaatttcgctatccttatggcacatcgagagatcgcctacaaagacggcgtccacgaacttctgctgaccgttatcacttgggtcgggatcgtgatctcattggtgtgcctggcaatttgtatatttaccttctgttttttccgcggtttgcagtccgaccgaaataccatccacaagaatttgtgcatcaacctgttcatcgccgaatttatcttcctcattggtatcgacaagaccaagtatgcgattgcttgccctattttcgcaggcctcctgcacttctttttcttagctgctttcgcctggatgtgcttagaaggagtgcagctgtacttgatgctggttgaggtattcgagtctgagtattctcggaaaaagtactactatgtggctgggtacctgtttcccgcaacggttgtaggtgtgtcagcggccattgattataagtcatacggaacagaaaaggcttgctggctgcacgtggataattatttcatttggtcatttattggcccggttaccttcattatccttctcaatataattttcctcgtcatcaccctctgcaagatggtgaaacactccaatacgttaaagcccgactcctccaggctggaaaatatcaacaactatcgcgtgtgtgatggttattacaacaccgatctgcccggctacgaggataataaacccttcattaaatcctgggtgctcggggccttcgccctgttgtgcctgctgggtctcacatggagctttggcctactgtttattaatgaggagaccatcgtgatggcttacttgtttaccattttcaatgccttccagggcgtgttcattttcatctttcactgcgcactgcagaaaaaggttcggaaggaatatggaaagtgctttcgacattcgtattgttgtggaggcctgccaaccgagtccccacatagctcggtaaaagcctccacaaccagaacctcagctcgctactcttccgggacacagtcaagaatccgtcgtatgtggaacgataccgtgagaaaacagagtgaaagctccttcatctccggagacattaattctacctctactctaaatcaaggaatgaccggaaactacctcttgactaaccccttgctcagaccccacgggaccaacaacccatacaacaccctgctcgccgagacggtggtctgcaacgccccctcagcaccagtgttcaactcgccaggacattctctcaataatgcgcgggacacctcggccatggacacactgcctctgaacgggaatttcaataacagctattccctacataagggtgattacaatgatagtgttcaggtggtggattgtggactgtccttaaacgacactgcgtttgaaaagatgattataagcgaactcgtgcacaataatttaaggggcagtagcaaaactcataacctggaattaacattaccagtgaagccagtaatcggtggatcatccagcgaagatgacgcgatcgttgccgatgccagttcattaatgcacagtgacaaccccggtttggaactgcaccataaggaactggaggctcccctgattccccaacgtacccattctcttctgtaccagccccaaaaaaaggttaagagcgagggcacggattcgtacgtcagtcagctgacagccgaggctgaggatcacctacagagtcccaaccgggattcactctacactagcatgcccaatctgagagacagcccttaccccgaatctagcccagacatggaagaagacctctcaccgtcccggcggtccgaaaacgaagatatatattataagtccatgcctaatctgggagccggacaccagctccaaatgtgttatcagatttcgagaggtaatagcgacgggtatattatcccgataaacaaggagggatgtattcctgagggagacgttcgtgaagggcagatgcaactggttacttcactgtag

SEQ ID NO: 26987 - DNA, 3723 bp, Artificial Sequence
  Description of Artificial Sequence: Synthetic coding sequence
atgtggccctcccaactcttgatcttcatgatgctgcttgcacccattatccacgctttctcacgagctcccattcctatggctgtcgtgcggcgggagctgtcttgtgaatcttatcccattgaactacgatgtcctggcacagatgtgattatgatcgagtctgccaactacggccgaactgatgataaaatctgtgatagcgatccggcgcagatggagaacatccgctgctatctaccagacgcatataaaatcatgtcgcagcgatgcaacaaccgcacccagtgcgccgtcgtggcgggtcctgacgtattccctgacccatgtccagggacttacaagtacctggaggtacagtatgagtgtgtgccctaccgagttgaccaaaaagtttttctgtgtccaggcttgctgaaaggcgtgtatcagtctgagcacctgttcgagagtgatcatcagagcggggcttggtgtaaggaccctctgcaggccagtgacaaaatctattatatgccttggactccataccgcactgatacccttactgagtactcgtccaaggacgatttcattgccggccgaccaacgactacatacaagttgcctcaccgtgtcgacggaacaggtttcgtggtatacgatggcgccctgttcttcaacaaagagcgcacacgaaacatcgtcaaatttgatctgcggacccgcattaaaagtggcgaagccataatcgccaacgccaattaccacgatacctccccttatagatggggcggtaagtcagatatcgatctggccgtggatgagaacgggttgtgggtcatttacgccaccgaacagaataacggtaaaatagtaattagtcaactcaacccctacaccctcagaatcgagggcacttgggatacagcttatgataaacgctccgcttccaatgcattcatgatatgtggtatcctctatgttgtcaaaagtgtgtacgaagatgatgataacgaagctacaggtaacaagatagattatatctataataccgaccagtcgaaggactctctcgtcgacgtacctttcccgaacagctaccagtatatagctgcagtggactataacccacgggacaatctgctatacgtgtggaacaattatcacgtggttaaatattccctcgatttcggccctctcgactcccggagtggtcaggcccaccacggccaggtctcctatatttcgcctcccatacacctggactcagagttagaacgccctagcgtcaaagatattagtacaaccggaccgttggggatggggtctactacgacttcaaccactctgcggaccactacactgtctcccggcagatctaccacaccatctgtgagcggacgcaggaaccgttctacaagcacaccctcccctgcagtcgaggtgcttgacgacatgacgacccaccttcccagcgcttcctcccagatccccgcacttgaggagagctgcgaagcagtagaagcgcgtgaaatcatgtggttcaaaacccgtcagggacaaattgccaagcagccttgtcctgctggtactataggcgtgtccacatatctgtgtctggccccagatgggatttgggacccccagggtcctgacctgtccaactgctcttccccctgggtgaatcatattacccagaagcttaaaagcggagagacggcagcaaacattgctagggagctcgccgagcagacgcgcaatcatttgaacgccggagacattacttactctgtgcgcgccatggaccagctggttggcctgctggatgtgcaactacgcaacctgacgcctggcggaaaggattccgctgccagatcactaaataagcttcagaagagggaacgctcatgtagagcctatgtccaggccatggtggaaacagtcaataacctcctacagccccaggcccttaatgcttggagagacctgacaacctccgaccagctccgtgccgctaccatgctacttcatacagtggaggaatccgcctttgttctggctgataatctgctaaagactgatatcgttcgtgaaaatacggacaacattaaattagaagtcgcaaggttgtccactgaggggaatcttgaagatctaaaatttccggagaacatggggcatggctctaccatccagctcagcgccaatacactgaagcaaaacgggcgtaatggggaaatccgggttgctttcgtgctttataacaatttgggaccctacctttctaccgaaaatgccagcatgaaattgggcaccgaagcactaagtacaaaccacagcgtcattgttaactcccccgtgatcactgctgccatcaacaaggagttctccaacaaggtctacctagcagatccagtcgtctttacagtgaagcacatcaagcagtccgaggaaaacttcaaccccaattgttctttctggtcatatagcaaaaggacaatgaccggctactggtccacacaaggatgccggctcctaaccacgaataaaacacacacaacctgcagctgcaatcacctaactaacttcgccgtcctgatggcacacgttgaggttaaacatagcgacgccgtccatgacctcttgctggatgtgatcacatgggtgggcatcttattaagccttgtgtgtctgcttatttgcattttcacattctgcttctttcgaggactgcagagtgaccgcaataccattcataagaacctgtgtatctcattgttcgttgctgaactcctgtttctgattggaatcaatcgaacagaccagcctatcgcatgcgccgtcttcgctgctctgcttcattttttcttcctggccgctttcacgtggatgttcctggaaggcgtccagctctacattatgctagttgaggtatttgaaagcgaacactccagaaggaagtatttctacttggtgggctacggtatgccagcactgattgtggcagtgtctgcagcagtcgactacagatcatacggaactgacaaagtgtgctggttgaggttggacacctactttatctggagcttcattgggccggcaacccttattattatgcttaatgtgatattcctgggcattgctctgtacaagatgtttcaccataccgccatcttaaagccagagagtggctgtctggataatattaactatgaggataacagaccattcatcaagtcctgggtaattggagctatcgcattactttgtctcctgggtctgacatgggcttttggcctgatgtacattaacgaatcaactgtcattatggcatatctcttcactatatttaactcccttcagggcatgttcatcttcatcttccattgcgtgcttcagaagaaagtcagaaaggaatacgggaaatgtctgaggactcactgctgctcaggtaagtctaccgaaagcagcatcgggtctggaaagacttccggctcaagaaccccaggtcggtactctacggggtctcagtctaggattcgccgtatgtggaatgacaccgttaggaaacagagcgaatcatctttcatcacaggcgatattaattcctctgcgagtctcaacagggaaccctacagagagacttcaatgggggtaaaattgaacatcgcctatcagataggggcctcagaacagtgccaaggctacaagtgtcacggttatagtacgaccgaatggtag

SEQ ID NO: 26988 - DNA, 4344 bp, Artificial Sequence
  Description of Artificial Sequence: Synthetic coding sequence
atgtggccatctcagcttctgattttcatgatgctgctggcccctatcattcacgctttctccagggcacccatccccatggctgtcgtgcgaagagagctgtcatgtgaatcctacccgatcgagttgagatgcccggggactgatgtgattatgattgaaagtgctaactatgggagaacggacgacaagatttgtgattccgaccctgcccaaatggaaaatataaggtgctatcttcccgatgcttacaaaatcatgtcgcagagatgcaataatcgcactcaatgtgccgttgttgcaggcccagatgtctttccggatccatgccccgggacatacaagtacctggaggtgcagtacgagtgcgtcccgtatcgagtcgatcaaaaagtattcctgtgtccagggctgctcaagggggtatatcagagtgaacatctgtttgagagcgaccatcagagcggcgcatggtgtaaggacccactacaggcatccgataaaatatactatatgccttggactccctacaggacggacaccctcactgagtattcatcaaaggacgacttcatcgcaggcagaccgactaccacctacaagctgccacatcgcgtcgacggaacagggttcgtcgtttacgatggagctctgtttttcaataaggagagaacccgcaatatagtcaagttcgatctgcgaacacgcataaagagcggcgaagccatcattgctaatgccaattatcacgatactagcccctacaggtggggagggaagagcgacatcgacttggcagtcgatgaaaacgggttgtgggtcatttacgctacagagcagaacaacgggaaaattgttatctcccagctcaatccgtacacactgaggatcgagggcacatgggatacagcttatgacaaaaggtcagcaagcaacgccttcatgatctgcgggatactgtatgtagtgaagtcggtgtacgaagacgacgataatgaggcgacaggtaataagattgattacatttataatacagatcaatccaaggactctcttgttgacgtaccgtttcccaatagttatcagtacattgccgccgtggattataatccccgcgacaatctactatacgtctggaacaattatcacgtcgtcaaatacagcctggacttcggccctctagatagccgatccggccaggctcaccacgggcaggtgtcctatatctccccacccatccatctagatagcgagctggagaggcccagcgttaaggacatttctaccactggtccgctgggaatgggaagcaccacgaccagtacaactttgaggaccaccactcttagccccgggcggagcaccaccccgtccgtgagcggcaggcgtaaccgcagcacatctacccccagtccagctgtcgaagtgctggatgacatgacaactcatcttccctcggctagttctcagattcctgccctcgaagagtcttgcgaagctgtcgaggcaagggaaattatgtggtttaagacacggcagggccagattgccaagcagccttgcccggctggaacaattggcgtttcaacatatctctgccttgcccctgacgggatttgggacccccaaggtcccgacctctctaactgcagctccccatgggtgaatcatattacgcagaaacttaagagcggagagacagcagccaacatcgcccgcgagctggccgaacagactcgaaatcacttaaatgcgggggacatcacatactccgtgagagctatggaccagctcgtggggttactcgatgtgcagctgcgcaatctgactcctggcggcaaggactctgcagctcgctccctaaataaagccatggtggagaccgtgaacaacctgctgcagccccaggccctcaatgcttggagggatctgactacttcagaccagcttagagccgcaaccatgcttctgcacactgttgaggagagtgcatttgtccttgccgataatctgttgaagacagatatcgtgcgcgagaataccgacaacatcaaactggaggtcgcccggctgagcaccgaggggaacctggaggacttgaagtttccagagaacatggggcatgggagtaccatccagctgagcgctaacacgttgaagcagaacggtaggaatggggagattagagtggcttttgttctgtacaacaatcttggaccttacctctctaccgagaacgctagtatgaagttaggaactgaagctctgtcaacaaatcacagtgtcattgtcaatagtcccgtgatcacggccgcgatcaataaggaattttccaacaaggtatacctcgccgacccagtcgtgtttaccgtgaaacatattaaacagagcgaagaaaatttcaacccaaactgtagtttttggtcttacagtaagaggacaatgaccggttattggagcacacagggctgtaggctgctcacgacaaacaagacacatacaacatgctcttgtaatcatctaactaatttcgcagtgctcatggctcatgtcgaagttaaacattccgatgcagtccatgacctcttactggacgtgatcacgtgggtgggcatcctgctgagcctggtgtgcctgctaatctgtatcttcactttctgtttctttcgagggctgcagagcgatcggaacacaatccacaagaacttgtgtattagcctcttcgtggctgagcttctttttctgatcggcattaatagaacagaccaacctatcgcttgcgccgtcttcgccgctttgttacactttttctttctcgctgcattcacctggatgttcctggaaggggtgcagctgtatataatgttggtggaggtttttgagagcgaacactccaggcggaagtacttctatctcgtgggctatggcatgcctgcgcttattgttgcagtgagtgccgccgtagactatcgatcttatgggaccgacaaggtctgttggttgcggctggatacctattttatatggtcttttataggccctgccaccttgatcatcatgttgaatgtgatcttcttaggcatcgcgttgtacaagatgtttcatcatacagcgatcctgaaacccgagagcggatgtctggacaacattaagagctgggtcatcggcgcaatagccctgttgtgtctgctcggcctcacatgggcattcggcttgatgtacattaacgagagcactgtaataatggcatatctgttcacaatctttaactcgttacagggcatgttcattttcatatttcattgtgtccttcaaaaaaaggtcagaaaggagtacggaaagtgcctgagaactcactgctgttctgggaagtccacagagagcagcattggatccggaaagacaagcgggtctcggacgcccggccggtattctacgggcagccagtctcggatccgccggatgtggaatgatactgtcagaaaacagtctgagtcctcctttatcaccggagacattaatagctctgcttccttaaaccgggaaggcttgttaaataacgcccgggacaccagcgtgatggatacactgccgcttaatgggaatcatggaaactcttacagcatcgcctctggagagtacctgagcaactgtgtccaaataatcgaccgaggctataatcacaacgaaaccgctctagagaaaaaaatccttaaagagcttacatctaactacataccttcgtacctgaacaaccacgagagatccagcgagcaaaatcgtaatttaatgaacaaattagttaacaacttgggctcaggtagagaggacgacgccatcgtgctcgatgacgcgacgtcattcaaccatgaagagtccctaggcctggagttgatccacgaggagagcgacgcccctctcctcccccctcgcgtgtattctactgagaaccatcagccacaccactatacacggagacggatcccccaggatcactctgagtcgttttttccccttctcactaatgagcataccgaggatctacagagcccacatagagactccctgtatacgagcatgcccactctggccggagtggcagctacagaaagcgtgaccacgtcaacacaaacagagccgccccctgccaaatgtggtgacgctgaagacgtgtactataaatcaatgcccaacctcgggtcccgcaaccacgtgcaccagttacacacctactatcagctaggtagggggtctagtgacggttttattgtgccccctaacaaagacggcaccccacctgaaggttcaagcaagggccctgcccatctggtgactagcctctag

SEQ ID NO: 26989 - DNA, 2757 bp, Artificial Sequence
  Description of Artificial Sequence: Synthetic coding sequence
tgatatctatgcctcgctccggacggcatctgggaccctcaaggtccggacctttcaaattgcagctcaccttgggtgaaccacattacccagaagctgaaatccggggaaaccgcagccaatatagctagggaactcgccgagcagactagaaaccacctgaacgcaggagatattacgtatagcgtgcgggctatggaccaactggtcggcctgctggacgttcagttacggaacttaactcccgggggtaaggatagcgcggccaggtccctgaataaggctatggttgaaacagtgaataacctactgcagccgcaggcactcaacgcttggcgggaccttaccaccagtgaccagttgagagcagctactatgcttttgcatacagtggaagagtctgcttttgtcttggctgacaacctgctgaaaacagatatcgtgcgcgaaaacacggataatataaaactggaagtggctcggctgtcaaccgaggggaacttggaagacctgaagtttcccgaaaatatggggcacggtagtacaatccaactgagcgctaatactttgaagcaaaatggacgtaacggggagatccgtgtggcttttgtgttgtacaacaacttaggcccctacctcagtactgagaacgccagtatgaagctgggaactgaggcactgagcacaaaccatagcgtgatagtcaatagtccagtgattacagccgctataaataaagagttctccaacaaggtctatttggccgatcccgttgtgtttaccgttaaacacatcaaacaatctgaagaaaacttcaatcccaactgcagcttctggagttactctaagcgaacaatgacaggctattggtctacccaagggtgcaggctccttacaaccaataagactcatacaacttgttcttgtaaccatctgactaacttcgccgtcctcatggcccatgttgaggttaaacacagcgacgctgtccacgacctgctactcgacgtgattacttgggtgggcatcttactgagcctggtgtgcctacttatctgtatattcaccttttgctttttcagggggctgcagtctgatagaaatacaatccataagaatctgtgcattagtttgtttgtcgccgagctgctcttcttgataggaattaatcgtacagaccaacctatcgcttgtgccgtttttgcagctttactacacttcttctttctggccgcttttacttggatgtttttggagggagtacaactttacatcatgttagtggaggtgtttgaatccgaacacagtagacggaagtacttctatcttgtgggttatggcatgccggcactcatcgtggccgtgtccgccgcagtggactatcgcagctacggaactgacaaggtctgctggctgaggctcgatacatacttcatttggtccttcatcgggccggctaccttgattattatgctgaacgttatcttcctgggcattgcactgtataaaatgtttcaccacaccgcgatccttaagccagagtccggatgcttggacaatattaaatcttgggtgattggtgcaattgcattgctttgcctgcttggcttaacctgggcttttggcttgatgtacatcaatgagagcactgtcataatggcctacctgttcaccatcttcaattctcttcagggcatgttcattttcatcttccactgtgttctgcagaaaaaggtgaggaaggagtacggaaaatgtttgaggacacactgctgttccggcaaatcaacagagtcctcgatcggctctggaaagacatccggctctcggacaccaggacggtacagtactgggtcccagagtagaattcgcaggatgtggaatgatactgtcagaaagcaaagtgagtcaagctttataacgggagacatcaactcctctgcctcactgaacagggaaggtttactgaacaacgctagggacacaagtgtcatggacaccctacctctgaacggaaaccacggcaatagctactccatcgccagtggggagtacctgtccaactgtgtgcagatcattgacagaggttataaccacaacgagacagcattggagaaaaagatcctgaaggaacttacttctaactacattcccagttacctgaacaatcacgaaaggagcagtgaacaaaatagaaacttgatgaataaactggtgaacaacctgggttcaggcagagaagatgacgccattgtacttgatgatgctacaagcttcaaccacgaagaatcactgggactcgaacttatacacgaggagtcagatgctccattgctgcctcctagagtatactctacagagaaccatcagcctcaccactacacgcgtcggagaataccccaggaccattcagaatccttctttccactgctgacaaacgagcatactgaggatttgcagtcaccccatcgtgattccctctacacttccatgcccaccctcgccggcgttgcagccactgagagcgttaccacatcaacccagacagagcctcctccggccaaatgcggcgacgctgaggacgtttattataagagcatgcctaatcttggctcgcgcaatcatgtgcatcagcttcatacctactatcagctggggcgtgggagttccgacggcttcattgtgcccccaaataaggacggaaccccacctgagggatcaagtaaggggccagctcacttggtcacttcactttag

SEQ ID NO: 26990 - DNA, 3852 bp, Artificial Sequence
  Description of Artificial Sequence: Synthetic coding sequence
atgtggccctctcagctgttaatcttcatgatgctcctggcccccattattcacgccttctcgcgcgctcctatccccatggccgtcgtgaggagggaactgtcctgtgagtcttatcctatcgagctcagatgccccggaaccgacgtaatcatgatcgaatctgctaactatggaagaactgatgacaagatctgcgattccgaccctgcccaaatggaaaatatccgatgctatctccccgatgcatataaaataatgtcacagaggtgtaacaataggacgcaatgtgcagtggtggctggtcctgatgtgtttccggacccgtgcccagggacatacaagtacctagaggttcagtacgagtgcgtcccgtacaaagtggagcaaaaggttttcctgtgtcctggcctcctgaaaggggtgtaccagagcgaacacctattcgagtccgatcatcagtccggagcctggtgcaaagatccgctccaagcgtctgacaagatttattacatgccttggacaccataccgcaccgataccctgacagagtactcaagcaaggacgattttattgcaggccgtccaactacgacatacaagttgcctcaccgggtggatggaacagggtttgtggtgtatgacggagctctgtttttcaataaggaacgaacccggaacattgttaagtttgatctgaggacccggatcaaaagcggagaagccataatagctaacgctaactaccatgacacctccccttatagatggggggggaagagcgacatcgacctcgccgtcgatgagaatggcttatgggtgatctacgcaacagaacaaaacaatggtaagatcgttatcagtcagctgaacccttacaccctgcgcattgaaggcacctgggacacggcctacgacaagaggtctgcctcgaacgccttcatgatttgcggtatcctttatgtggtcaaaagcgtctacgaggatgacgacaacgaggcaaccggaaacaaaattgattatatatacaatactgaccaaagtaaggacagtcttgtggatgttccctttcctaactcttaccagtatattgctgcagttgactacaacccacgagacaatctcctgtatgtgtggaataactatcatgtggttaaatattccctggattttggaccactggacagccgctccggtcaagcccaccacggacaagtgtcttatattagtcctcccattcacctggacagtgagctggaacgcccatctgtaaaggatataagcaccacaggccccctgggcatgggtagcaccacaacttctaccacactaaggacgaccacgttgtcaccaggcaggtctactactcctagcgtgtccggacgacgcaaccgctcaactagcacgcctagtccagcagtggaggtgttggacgacatgacaactcacctgccttccgcttccagtcaaattcctgcgctggaagagtcatgcgaggctgtagaggccagagagataatgtggtttaaaacccgccagggacaaatcgccaagcagccatgtccggccggcacaataggcgtgagcacatacctctgtctggcacctgacggtatctgggacccacagggcccagacctgagtaactgctcatcaccttgggtaaaccatataacacaaaaactaaagtcaggtgaaacagccgccaatattgcaagagaactggcagaacagactcgaaatcatctaaacgccggggacattacttactcagttcgagccatggatcaactagtgggtctgctggacgtacagttacggaacctgactcctggtggcaaagacagtgcggcaaggagtttgaacaaactgcagaaaagggagaggtcatgtcgggcatatgttcaggccatggtcgagaccgtaaacaacctccttcagccacaggccctgaatgcatggcgggatctgaccacttctgatcagctaagagccgccacaatgctgctacacaccgttgaggaaagcgctttcgtgctggccgataatctgcttaagacggacatcgttcgggagaacaccgacaacattaagttagaggttgctaggctatccaccgagggaaaccttgaagacctgaagttcccggagaacatgggccacggtagcacaatccagttgagcgcaaacacccttaagcagaacggccgcaacggtgagattcgcgttgcctttgtgctctacaataacttaggaccctatctttcgactgaaaatgcgtccatgaaactggggaccgaggcactctcaaccaaccactccgtgatcgtaaatagcccagtcattacagcagcgatcaataaagaattctccaacaaggtctatctagcagaccctgtcgtcttcaccgtaaaacacataaaacagtcagaagaaaacttcaatcctaattgtagtttctggtcctactctaaacgaacgatgacggggtactggtctacacagggttgtcggcttctcacaactaacaaaactcacaccacctgctcgtgcaatcacctcacaaattttgccgtgctgatggctcatgtggaggttaagcacagtgatgctgtacacgacttgttgctcgacgtgatcacctgggtgggtatcctgctcagcctggtgtgcctcctcatttgcatttttaccttctgtttcttcagagggttgcagagcgaccggaacaccatccacaagaatttgtgtattagcctgtttgttgcagaactattgtttctgataggaattaacaggaccgatcagccgattgcatgtgcagttttcgctgccctgctccatttcttctttctggcggccttcacctggatgttcctggaaggagtccaactctatattatgctggtcgaggtcttcgagtctgaacattccagacgcaaatacttttacctggtgggctatggaatgcccgcactcattgtggccgtctctgccgccgtggattatcgctcttatgggaccgacaaagtgtgctggctaagactggacacgtactttatttggagcttcattggccccgccaccttgataattatgttgaatgtgatttttctcggaattgcgctgtacaagatgttccaccacacagctatcctgaaacctgagtctggatgtctcgacaatattaattatgaggacaaccggccttttatcaaaagttgggtcattggtgctatagcactgctgtgcctgcttggactcacatgggcttttggactcatgtacataaatgaatccacagttatcatggcttacctatttactattttcaactcactgcaggggatgttcatcttcattttccactgcgtgctgcagaagaaagttcggaaggagtacggtaaatgtctgaggacacactgctgttccggcaagagtaccgaatcctcgattggatcaggaaagacctcaggcagccggacccccggacgctactctaccggctcacagagtaggattagaaggatgtggaacgatactgtgcggaagcaaagcgagtcctcattcataacaggcgacatcaatagttctgctagcctgaaccgcggggccatggcgaaccatttaatctccaatgctctgctgaggcctcacgggaccaacaatccgtacaatacactcttgggtgaaccagccgtatgcaataacccatccgtcagcatgtacaacgcccaggagccatatcgggaaacgtccatgggggtgaagctcaacattgcctatcaaatcggggcatctgagcagtgtcaaggatataagtgccacggctattccaccaccgaatggtag

SEQ ID NO: 26991 - DNA, 3696 bp, Artificial Sequence
  Description of Artificial Sequence: Synthetic coding sequence
atgtggccgtcgcagctactcattttcatgatgctgctcgctcccatcatacacgccttttctagagccccgattccaatggcagtcgtgcggagagagctgtcgtgcgagagctaccccatcgagctgcggtgccccggcactgacgtaattatgatcgagagtgcgaactatggaaggactgacgacaaaatctgcgactccgatcccgctcagatggaaaacattagatgttatctacctgacgcttataaaatcatgtcacagcgctgtaataaccggactcaatgtgcggtagtcgccggaccggatgtttttcccgatccctgcccagggacctacaagtatctagaagtgcagtatgagtgcgtgccctataaggtggagcaaaaggtattcctgtgccctgggctcctgaagggggtctaccagtctgagcacctgttcgaatccgaccaccaaagcggcgcgtggtgcaaagaccccttacaagcttcagacaaaatctactatatgccttggacaccataccgaaccgataccctaactgaatactcctccaaggatgacttcatagctgggaggcccaccaccacttacaaactcccccatcgcgtcgatggtactgggttcgttgtgtacgacggcgcactgttcttcaacaaggagagaactcgcaatatcgtcaaattcgaccttagaactcgaattaagagcggcgaggcgatcatcgcaaacgctaactatcacgatacgtcaccctaccggtggggcggcaaatcagatatcgacttagccgtggacgagaacggtctgtgggtgatctacgccacggaacagaacaacggtaagattgtgattagccagctaaacccttacacccttcgcattgaaggaacatgggatacggcctatgataaacgctccgcctccaacgcttttatgatttgtggcattctttatgtcgttaagagcgtgtatgaggatgatgataatgaggctaccggcaacaagatcgactacatttacaataccgatcagagcaaggactccctggttgacgtgccatttccaaacagttatcagtacattgccgctgttgattataatccgagagacaatcttctttatgtgtggaacaattatcatgttgtaaagtacagcttagatttcggccctctggacagccgctcagggcaggcccaccacgggcaggtttcctatatcagtcccccgattcacctcgattctgaactggaacgcccgagcgttaaggatatctccacaacagggcccctgggcatgggatcaacgacaacatccaccactctgcggactacaacactgtcacccggtaggagcacgacgccttccgtatccggcaggcgcaataggtccacttcaacaccaagcccagcagtggaggtgctggatgacatgacaacccatctaccttctgcctcttcacagatcccagccctggaggagtcctgtgaagccgtggaagcaagagaaatcatgtggtttaaaacccggcaaggccagattgcaaaacagccatgtccagctgggactatcggggtttccacctacttatgtctcgcacccgacggaatctgggatccccagggcccagatctcagtaactgctcatcgccttgggtgaaccatattacgcagaagttgaaatccggcgaaaccgccgcgaacattgcgagggaactggcagagcagacgcgcaatcacctgaacgctggcgatatcacatatagtgttcgcgctatggaccaactggtggggctgttggatgtgcagttacggaacctgacgcctggagggaaagattccgcagcaagaagcctgaacaaactgcagaaacgcgagagatcctgccgcgcttatgtgcaagctatggtggagactgtgaataatttgttgcagcctcaggctctcaacgcctggcgtgatctcactacgagtgaccagcttcgtgcagcgacgatgctgctccacacagtagaagagtctgcgtttgtcttagctgacaatcttctgaaaactgatatcgtgagagagaacactgacaatatcaaactggaagtggcccgactctctaccgaggggaatctggaggacctgaagtttcccgaaaatatggggcacgggagtaccatacagttgtcggccaatactctgaaacagaacggacgcaacggcgagattcgtgtggcatttgtactttataataatctgggaccatatctttctacagaaaacgcctcgatgaagctgggtaccgaagctctgtccaccaaccatagcgtgattgtgaacagccctgtaattactgctgctatcaacaaagagtttagtaacaaagtgtatttggccgacccggtcgtgttcaccgtgaaacacattaagcagagcgaagagaactttaaccccaactgctcgttttggagctactccaaacggaccatgaccggctattggagcacccagggctgtcgtctgctgaccaccaacaaaacccataccacatgttcctgcaatcatttaactaacttcgcagtgctgatggcccatgtggaggtgaaacattccgacgccgtacatgacctcctcctggacgtgattacatgggtcggaattctgttgtctcttgtttgcctccttatttgtatttttactttctgctttttccggggcctccaaagtgataggaacaccattcataagaacctgtgtatcagcctgttcgttgccgagctgttgtttctcatcggaatcaacagaacggaccagcccatcgcgtgcgcagtgttcgcggcactgctacactttttcttccttgccgccttcacatggatgttcctcgagggagtgcagctgtacattatgctcgtggaggtcttcgagtctgagcactctaggcgaaaatacttttatctcgtgggttacgggatgccagcactgattgtggccgtgagtgccgccgttgattacagaagctatggcactgacaaagtctgctggctgaggctggatacctactttatctggtcctttataggaccggctaccttgattatcatgctgaatgtaatttttctaggcatcgcattatacaaaatgttccaccatactgccattcttaagccagaaagtggttgccttgataacatcaagtcctgggtaattggcgccatcgctttgctgtgccttcttgggcttacatgggccttcggcctgatgtatattaatgagagtacagttattatggcctatctctttacaatctttaactccttgcaaggcatgttcatcttcatcttccactgtgtgcttcaaaaaaaggtcaggaaggagtacggcaagtgtcttcggacacattgctgtagcggcaaaagtacggaatcatccatcggctcggggaagacaagcggttcacggactcccgggagatattccactggctctcagagcagaattcgacgaatgtggaacgacactgtccgcaagcaatctgaatctagcttcattaccggcgatattaactcgagtgcctccctcaatagagaaccataccgcgaaacaagcatgggggtgaaactgaatattgcatatcagatcggggctagcgagcagtgccaggggtataagtgccatggatattccactactgagtggtag

SEQ ID NO: 26992 - DNA, 4743 bp, Artificial Sequence
  Description of Artificial Sequence: Synthetic coding sequence
atgtggccctcccagctgctcatctttatgatgctgctcgctccgatcatccatggagggaaacattccgagaggcaccctgcactcgctgctccccttcggcatgccgagagaagccccggtggagcacttccacccagacacctcctgcagcagcctgccgccgaaaggaccgctgcacatcgaggacagggcccccggggggctacaagaggcgtgcgtggacccggcgctcagggtgcccagatagccgcccaggccttcagccgggcacctatcccaatggcagttgtcaggcgcgagctgagctgtgaatcctacccaattgaactccggtgtcctgggacagacgtgattatgattgaatccgcaaattatggcagaacagacgacaagatttgcgactcagacccagctcagatggagaatatacgatgttacctgccagatgcctacaaaattatgtcccagaggtgtaataatcgcacccaatgcgccgtggtggcagggccggatgtcttcccagatccatgcccaggtacttacaaatacctggaagtgcagtatgagtgtgttccgtacaaggtagagcagaaagtcttcctgtgccccgggttgttgaaaggagtctatcaatctgagcacctcttcgagtcggaccaccaatccggtgcttggtgcaaggacccactgcaggcgagcgacaagatctactatatgccttggactccatataggaccgacacactcacggagtatagctccaaggatgacttcatcgcaggtcggccgaccacgacgtacaagcttccacatcgggttgacggcaccggctttgtggtgtatgacggcgccctcttctttaataaagagcggaccaggaatattgtgaaatttgacctcaggaccaggattaagtcaggtgaagccattattgcaaatgccaactaccatgacacatccccttatcgttggggagggaagtccgacatcgatctggctgtggacgagaatggcctgtgggtcatctacgccactgagcaaaacaacggcaagatagtgatcagccaactgaacccctacactcttcgaattgaagggacttgggacactgcctatgacaaacgcagtgccagcaacgctttcatgatatgcgggatactgtacgtggtgaagtctgtgtatgaagatgatgataacgaagctacaggtaacaagatcgattatatctataatacagaccagtcaaaggatagcctggtcgatgtgcccttccccaattcctaccagtatatagccgctgtggactacaatcctcgggacaacctcctgtacgtttggaataattaccacgtagtcaaatactccctggatttcggtcctctggattctcgaagcggtcaggcccatcacggccaggtttcttacattagccccccaatccatctggactcagagttggagcgaccttcagtgaaggatatttccacaactgggccactggggatgggaagtaccaccactagcacaactttaaggactactactttatcacctggtagatcaacaacaccttcggtcagtggccggcgcaaccgctccacctccacgcctagccccgctgtcgaggtgctggacgatatgacaacgcatctgccatctgctagctctcagatcccagctctggaggaatcatgcgaagccgttgaggcccgggaaattatgtggtttaagacgagacaaggccagatcgcaaagcagccttgtcccgccgggacaataggggtctctacatacctgtgcttagctcccgacgggatctgggacccccaggggcctgatctgtcaaattgtagttccccctgggttaatcacatcacacagaaacttaagagtggggaaacggccgcaaacatcgcccgggaactcgccgagcagacaaggaatcatctcaatgccggcgatattacatacagtgtgagagctatggatcagctcgtggggcttttggatgtacagttgcggaacctgaccccgggcggcaaggacagcgccgcacggagcctgaacaagttacagaagagggagagatcttgtcgcgcttatgtccaggctatggtggaaacagtcaataatctgctccagccccaagctctgaatgcttggcgagacctaaccacgtcagaccagttacgcgccgcaacaatgctcctccatactgtggaagagagtgctttcgtcctcgccgataacctgcttaaaacagacatcgttcgagaaaatacagacaacatcaagctggaagttgcgagactgagtactgagggcaacctggaagacttgaaattcccagaaaatatggggcacggttccaccatccagctctcagctaatactttaaaacagaatggaagaaatggcgaaatcagggtggcgttcgtcttgtacaataatctgggaccctacctgtccactgaaaacgcaagtatgaagctgggaacggaagctttgtctaccaaccattctgtcattgtgaactccccggtgataaccgccgcaattaataaggagtttagcaacaaggtgtacctggccgacccagtggtttttactgtgaagcatatcaagcagagcgaagaaaactttaacccaaactgttcattctggagttacagcaaaagaacgatgaccgggtattggtccactcagggttgcaggctcttaactactaataaaacgcatacgacctgctcttgcaaccatcttaccaatttcgccgtgctaatggcccacgtggaagtaaagcactctgatgctgtgcacgacctgctcctggatgtcatcacctgggtcgggattctcctgtcactcgtatgcttgctgatttgtatctttaccttctgcttctttagaggattacagagcgaccgaaacacaatacataagaacttatgtatctctctgttcgtggccgaactgctcttcctaatcggcattaaccgcacagaccagcccattgcctgcgcagttttcgcagcgctgttacacttcttctttctggccgcgttcacatggatgttcctggagggcgtgcaactctacattatgctggtagaagtttttgaatccgaacactcccggagaaagtatttctacttagtgggatacggcatgcccgccttaattgttgctgtcagcgcggcagttgactatcgcagttacgggacagacaaggtgtgttggttgagactcgatacttactttatctggtccttcattggtcctgccaccctgatcattatgctcaatgtgattttcctgggaatcgctctgtacaagatgtttcaccatacggcaattttaaagcctgagtcaggctgcctagataatattaattatgaagacaacaggcccttcatcaagtcctgggtgattggcgccatcgcactcttatgtttattggggttaacttgggcctttggcctcatgtatattaatgagtcaacagtaattatggcctacctgtttaccattttcaactccctccagggcatgtttattttcatttttcattgcgtcctgcagaaaaaggtccgcaaggaatacggcaaatgtctcagaacccattgttgctcaggaaagtctactgagtcatccatcggctccgggaaaacttctgggagcaggactccaggaagatactccaccgggagtcagtcgaggatcaggcggatgtggaatgacactgtgcgtaagcaatccgagtcctcttttatcacgggagacatcaattcctcagcatccctcaaccgtggcgctatggcgaaccacctgatctccaatgctctgctcaggccacacggtacgaataacccgtacaacacattgttgggggagccagccgtttgtaacaaccccagtgtcagcatgtacaacgctcaggaagggctgttaaataacgccagggatacaagcgtgatggacaccctgcccctgaacggcaatcatggaaatagttattcaatcgcttcaggagaatatctttcgaattgcgtccagatcattgaccgggggtacaaccacaacgagaccgctctggaaaaaaaaattttgaaagagctgacaagcaattatattccctcatatctgaataaccatgagaggtccagtgagcagaacagaaatctcatgaataagctggtcaacaacctggggagcggccgggaggatgatgctatcgtgttggatgacgcaacgagcttcaatcatgaggagtcgttgggactcgagctgatccatgaggaaagcgacgcccccctgctccctcctcgggtttattctacagagaaccaccaacctcaccattacactcggcggcgtattccccaggatcactctgagtctttttttcctctgctgacgaatgaacatacggaagatctccagtcaccacaccgcgatagtctatacacctctatgccaacattagccggcgttgctgccaccgaaagcgtgaccacctctacgcagacggagcccccaccagcaaaatgtggggatgcagaggatgtctattataaatcgatgccgaatctaggcagccgcaaccacgttcaccagctccacacttactaccagctggggagaggttcatccgatggctttatcgtgccaccaaacaaagatggaactcctcccgagggaagcagcaaaggccctgcccatctggtgaccagcttatag

SEQ ID NO: 26993 - DNA, 4716 bp, Artificial Sequence
  Description of Artificial Sequence: Synthetic coding sequence
atgtggccctctcaattgttgatctttatgatgctgctggctcctattattcacgggggcaaacacagtgagcggcatcccgccctggcagcgcctctgcgccacgccgagcgcagccctgggggcgccctgcctccacgccatctcctgcagcagcccgccgctgaacggacagccgcccacagagggcaaggaccaaggggtgctacacgaggtgtgagagggcctggggcacagggggcccagatcgctgcccaggctttcagcagagcccctattccaatggccgtcgtgcggcgcgaattgtcatgtgaatcttatccaattgagcttcggtgccctggtaccgacgtgatcatgatcgagtcggctaattacggcagaacggatgataaaatttgcgactctgaccccgcacagatggagaatatcaggtgctacctgcccgacgcctataagattatgagccaacgctgcaacaatagaacccagtgtgccgttgttgcggggccggatgtttttcccgatccttgtcccggcacatacaagtacctggaggtgcagtacgagtgtgtaccctataaggtcgaacagaaggtattcttatgcccaggactcctgaaaggggtataccagagcgagcacttattcgagtcagatcatcagagcggagcctggtgcaaagatccgctccaggcctctgacaaaatatattatatgccctggactccctatcgaacagacaccttgaccgagtactcttctaaagacgacttcattgctggtagaccaacaacaacatacaaacttcctcatcgggtcgacggaaccgggttcgtagtttatgacggtgccttgttttttaataaggagaggacacgcaatatcgtcaaattcgatctccgaactagaattaaaagcggcgaggccataatagcaaacgcgaattatcacgacaccagcccatacaggtggggaggaaaaagcgatatcgatctggccgtagatgaaaacggcctgtgggtaatctatgcgactgaacagaacaatggaaagatcgtgattagccagctgaatccgtacacattaagaatagaggggacctgggatacggcatacgacaagcggagcgctagcaacgctttcatgatttgtgggatcctctacgtggtcaaatccgtgtacgaagacgacgataatgaggccaccggaaataagattgattacatttacaacactgaccaaagcaaggatagcctcgttgatgtcccttttccaaattcataccagtatattgcggccgtggactataacccacgcgacaacttactgtatgtttggaacaactaccacgtggtaaagtactccctggatttcgggcccctcgattccaggtctgggcaggcccaccatggccaggtctcctacatcagccctcccattcacctggactctgagctggaacgcccttctgttaaggatatttcaactacaggaccactgggaatgggaagtacaacaacaagcacgactctcaggacaactacactgtctcctggtagatcgaccacgccttctgtttcgggcaggagaaatcggagtaccagcacgccgtctccagccgtcgaggttctggatgatatgaccacccatctgccttctgcttcttcacagatacccgccttagaggagtcctgcgaggccgtggaggcaagggaaataatgtggtttaaaactaggcaggggcagatcgccaagcaaccttgcccggctgggaccatcggtgtgagcacctatctgtgcttagcacccgacggaatctgggatccccagggcccggatttgagcaattgctcgagcccatgggtgaaccatattacacaaaagttgaaaagcggagagactgccgcgaatattgcccgggagttagcagagcaaactagaaatcacttaaatgctggcgatatcacttattccgtacgggcgatggaccagttagtgggtctcttagacgtgcaactgagaaatttgaccccggggggcaaggactccgccgcaaggagcctgaataaattgcagaagcgggagaggagctgtagagcttatgttcaggctatggtggaaaccgtgaataaccttctgcagcctcaggccctgaacgcttggcgggacctgacaaccagcgatcagctgcgggctgctacaatgctcctccacacagtggaggagagcgcgtttgtgctggccgacaatttgctcaagaccgacattgttagggaaaataccgacaacattaagctagaagttgctcggctcagtaccgaagggaacttggaggacttgaagttccctgagaatatgggtcacggcagcaccatccagctatccgccaataccctaaaacagaacggtaggaacggagagatccgagtggcattcgtcctttataataacctcggcccatatctgtcaactgagaacgcaagcatgaagcttggtaccgaagctctgagcacaaatcactcagttatcgtgaatagcccggtcattactgcggccattaacaaggagttttctaataaggtttaccttgctgatcctgtggtgtttaccgtaaaacacattaagcagtcagaggagaacttcaaccctaattgcagcttttggagctattccaaaagaactatgacaggctactggtccacacagggatgtcgcctcctgactaccaataaaacacatacaacatgtagctgcaatcatctcactaactttgccgtgctgatggctcatgtggaagtgaagcacagcgatgccgtgcatgatttgttgctggatgtcattacttgggtcgggattctactcagtctggtctgtctcttaatctgcatttttactttctgtttctttcgaggtctccagtccgacaggaatacaattcacaagaatctgtgtatctctttatttgtagctgagcttttattcttgattggaattaacagaacagatcagcccatagcatgcgccgtgtttgctgcgttgctacacttttttttcctcgcagcttttacctggatgttcctcgagggtgttcagctgtatatcatgctggtggaagtattcgaatccgagcattccagaaggaagtatttttatctggtcggatatggcatgcccgccctcattgtcgccgttagcgcagcggtcgactatagaagctacgggacagacaaagtgtgctggctcagactcgacacttactttatttggtcttttatcggtcccgctacattgattatcatgttgaatgtaatcttcctgggcattgccctctacaaaatgtttcaccacacggctatcttgaaacccgaaagcgggtgtctggacaacatcaagagttgggtcataggcgctattgccctgctctgcctgcttggcttaacatgggcatttgggctcatgtatattaacgaaagcactgtgatcatggcctacctttttaccatcttcaatagtctgcaaggcatgtttatcttcatattccactgcgttttgcagaagaaggtgagaaaggagtatgggaagtgccttcgcacgcactgttgctcaggtaaatcaaccgagagttccataggatcaggcaaaacatcaggcagccgaacgcctgggcgctattctaccggcagtcaatcccggatccggaggatgtggaacgataccgtaaggaagcagtccgagtcatctttcatcacaggcgatataaactcttcagcctccttaaacagaggtgccatggccaaccatctgatctcaaatgctcttctccgtccgcatggaacaaacaacccttacaacactttgctgggggagccggccgtttgtaacaacccttctgtgtctatgtacaatgcccaggagggcctgctcaacaatgccagagatactagcgtgatggacactctcccactgaacggtaaccacggtaactcatactccatagcctccggggaatatctcagcaactgtgttcaaatcattgaccggggttataaccataatgagacagctctggagaaaaagatactgaaagagttgacatccaattacattccctcctacctgaacaaccacgaacggtcctccgaacagaatcggaatcttatgaacaagttggtaaataatctgggttctgggagggaggatgacgctattgtgctggacgacgctacctctttcaatcatgaagaatccctcggcttagaactgattcacgaagaaagcgacgcacccttactgccgcccagggtgtattcaaccgaaaatcaccagccccaccattacacccgacgacgaatcccccaggaccacagcgaatcctttttccctctgctgacgaatgaacacacagaggacctgcagagcccccatagggatagtctctatacatctatgcctactctggccggcgtggccgccaccgagagtgtgaccacttctacccagactgagccaccgcccgccaaatgcggcgatgctgaggacgtctactacaagtccatgcccaatctgggaagcaggaaccatgttcaccagctgcatacttattatcagctcggacggggctcttcggatgggttcattgtgcctcccaataaagatggcacccccccagagggctcgagtaagggacccgcccatctggttacctctctatag

SEQ ID NO: 26994 - DNA, 4029 bp, Artificial Sequence
  Description of Artificial Sequence: Synthetic coding sequence
atgtggccgagccagctgctgattttcatgatgttattagcccctatcatacatggcggtaaacatagtgaaaggcaccctgcacttgcggctcctcttagacatgctgaaaggtcgcctggcggagccttacctccacgtcacctcctgcagcagcccgccgccgagcgaacagccgctcatcgcggacagggcccacggggagcaactaggggtgtgaggggccccggagctcagggtgcgcagatcgccgcgcaagctttctctcgggcccctatcccaatggctgtggtgagacgtgaactgtcctgtgaaagctatcccatcgaactgcgatgtccgggaacagatgttataatgattgagtcagccaattatggccgcaccgacgataaaatttgcgattccgatcccgcgcagatggaaaatatcaggtgctacttgccagatgcttacaaaatcatgtctcagcggtgcaataataggacacagtgcgccgttgttgcggggcctgatgttttccccgatccatgcccgggcacatataagtatctggaggtccagtatgagtgtgtcccttacaaggtggagcagaaggtctttttgtgccccggattactgaaaggcgtataccagtcagagcatctgttcgaaagcgaccaccagtcaggggcttggtgcaaggatcctctgcaagcttcagataagatctattacatgccctggaccccttatcgaaccgacaccctgacagaatacagcagtaaggatgactttattgctggccgccctactacaacctacaaattaccccatagagtggatggcacagggttcgtggtatatgacggcgccctgttcttcaataaagagcggactcggaatattgtcaaattcgacctgaggactcggatcaaatccggggaagcaatcatcgccaatgccaattatcacgatacctccccctaccgttggggtggcaagtcagacatcgacctagccgtggatgaaaacggcttgtgggtgatatacgcaaccgagcagaacaacgggaagatagtgatctcacagttgaatccatatacactcagaatagaaggaacatgggacacagcgtacgataagcgctccgcatctaacgcctttatgatttgcggaattctgtatgtcgtaaaatcagtctatgaggacgacgacaacgaggcaacaggcaataaaatagactacatctacaatactgatcagtcgaaagattctctagtcgacgttcctttccctaactcttaccagtacattgctgccgtcgattacaatccaagagataatttgctgtacgtgtggaataactatcatgtcgtgaaatatagccttgacttcggtccacttgacagtcgttctggccaggcacaccatggccaggtgagttatatatctcctcccatccacctcgactccgagcttgagcggccgagtgtgaaggacatctcaactaccgggcctctcgggatggggagcactaccacttcaacaactctccgtaccacaacactcagtccaggccgatctactacgcccagtgttagcggaaggaggaatcgctccacttccacaccgagtcctgccgttgaagtcctggacgatatgactactcaccttccatccgcctcctcccaaatcccagccttagaggagagctgcgaagcagtggaggcacgagaaattatgtggttcaaaacacggcagggacagatcgccaagcagccgtgtcccgccggtacgataggggttagtacttatctatgcctggccccggatggtatttgggatccccagggcccagatctgtcaaattgctcttcaccgtgggtcaaccatattacccagaagttgaagagtggagagacggccgccaacatcgcacgcgagctggccgaacagaccaggaatcacctcaatgccggcgatatcacgtatagtgtaagggctatggaccagttggtgggcttactcgacgtacagctccgtaatctgacccccggcgggaaagatagcgctgcacggtcgctgaacaagttgcaaaaaagggagcgtagctgccgggcttatgtgcaggcgatggttgaaaccgtgaacaatctactgcagcctcaggcgctgaatgcatggagggacctcaccacctctgaccagttgagagcagctactatgttgctccatacagtcgaggagtctgcttttgtgctcgccgacaacctcctgaaaacagacatcgtgagggagaataccgataacatcaaactcgaagtcgcccggctgtcaaccgaaggaaatttagaagatctgaaattccccgagaatatgggacacggcagcactatccagctctccgcaaacaccctgaagcaaaatggtcgcaatggagaaataagagtcgcctttgtgttgtacaacaatctgggaccatacctgtccaccgagaacgcaagcatgaagctggggactgaggccttgtctaccaaccattctgtaatcgtcaattctcccgtaatcactgccgcaataaacaaggaattttccaataaggtctacctggccgaccccgtagtctttaccgttaaacacattaagcagtctgaggaaaacttcaatccaaactgctcattttggtcctattctaaaaggacaatgacaggatattggagcacccagggctgccggctccttactaccaacaagactcacaccacatgctcatgtaaccatttgacaaacttcgctgtcctgatggcacatgtggaggtaaaacactctgacgctgttcatgaccttttgctggacgtgatcacatgggtgggaattttgctctctctcgtatgtctgttaatttgcatcttcacattctgcttttttagaggcctacagagtgaccggaacaccatccacaaaaatctttgtatcagtctcttcgtggctgagctgctgtttctcattggcatcaatcgcaccgatcagcccatcgcatgtgctgtgtttgcggctctgcttcatttctttttcctcgctgcattcacctggatgttcttggagggggttcagctttacattatgctcgtggaagtcttcgagagcgagcactcaaggaggaaatacttctacctggtcgggtatgggatgccggccctcatcgtggcagtttcagctgccgtggactacagatcctatggaacagataaagtttgttggctgagattagacacatactttatctggtcatttatcgggccagccacacttatcatcatgctgaatgtcattttcctgggcattgctctttataaaatgtttcaccacacagctatcctgaagccagaatccgggtgcctagacaatatcaagagttgggtgattggcgcgatcgcattactctgtctgctggggctcacatgggcctttggtttgatgtacattaacgaaagcaccgttattatggcataccttttcaccatctttaactcactgcaagggatgttcatattcatatttcattgcgtattacagaagaaagtgcgcaaagagtacggaaagtgcctaagaacacattgttgtagtggaaagagtaccgaaagctctatcggctccggcaaaacaagcggctcccggacccctgggcgctactctacaggatcacaatctcgcatcaggcgtatgtggaacgacacggtgagaaagcagagcgaatccagcttcatcaccggcgacattaactcatctgcatcccttaaccgcggcgccatggccaatcacctgatcagcaatgccttacttcgcccccacggcactaataacccctacaacacgctgctcggagaacctgcagtttgcaataatcccagcgtctccatgtacaacgcccaggagccttaccgcgaaactagtatgggagtgaaactgaacattgcataccagatcggggcgtccgaacagtgccagggttataaatgccatggctactcaaccacagagtggtag

SEQ ID NO: 26995 - DNA, 4587 bp, Artificial Sequence
  Description of Artificial Sequence: Synthetic coding sequence
atgtggccatcacaacttcttatcttcatgatgctgctggcgccaattatccacggaggcaaacacagcgagcggcacccggcactggcagctccattgcggcacgctgagcgatcccccgggggagcgctgccccctcgacacctgttgcagcagcccgctgccgagagaactgctgctcaccgggggcaggggcccaggggggccacacgaggagtccgggggcctggcgcacagggcgcccagatcgctgcacaagcgttcagccgcgctcctattcccatggctgtagtgaggagggagctttcctgtgaatcatacccaatcgaattgcgttgccctggtactgatgttatcatgatcgagtccgctaattacggtcggacagacgataaaatatgcgattctgatcctgcacaaatggagaacatccgctgttatctgccggacgcctacaagatcatgagccagcgttgtaataatcgaactcagtgtgcagtagtcgccggaccagatgtgtttcccgacccatgtccgggcacctataaatacctggaggtccagtatgaatgcgtgccctacaaagtagagcagaaagtcttcctgtgcccaggcttgctgaaaggggtctatcagagcgaacacctgttcgaaagtgaccatcagagtggtgcttggtgcaaggaccccctccaggcttccgataagatctactacatgccatggactccttatcggaccgacacccttactgagtattcaagcaaagatgacttcattgccggcagacctacaactacctataagcttccacacagggtggatggaactggctttgtggtttacgatggggccctctttttcaacaaggaacgtacacgaaacatagttaaatttgatctgaggactcgcattaaatctggcgaagccattattgctaacgctaattaccatgataccagcccctaccgatggggaggcaaatctgacatagacttggccgttgatgagaatggactgtgggtcatatatgctaccgaacagaataatggcaagattgtgatttcccagctgaatccctacacacttcggatagagggaacatgggacaccgcatatgacaagaggtcagcatccaatgccttcatgatctgtgggattctttatgtggtgaagtctgtgtatgaggacgacgacaacgaggccacaggcaacaaaattgactacatctacaatacagatcagtcaaaagattctttggttgacgtgcccttccctaatagctatcagtacatcgccgccgttgattataatccccgtgacaacctgctctacgtctggaataattatcacgttgtgaagtattccctggactttggtcccctggactcacgttccggccaggctcatcatggccaggtgtcttatatctcgcccccaatacaccttgactcggagctggaacgacctagcgtgaaggatatcagcactacaggacctctgggcatgggtagcacgacaacaagcaccaccttacgcactacgaccctgtcccctggacgatctacaaccccctcggtttccgggaggaggaatcggtctacttccaccccatctcctgctgtcgaggtgctcgacgacatgactacgcatcttcctagcgcctccagtcagatacccgcgcttgaagagtcgtgcgaggcggttgaggctagagaaattatgtggttcaagacacgacaagggcagattgcaaaacagccttgcccggccggaaccattggcgtgtctacatatctctgcctggcaccagatggtatctgggacccgcagggccccgacctgagtaattgttccagcccttgggtgaatcatatcacccagaagttgaagtctggcgaaaccgcggcaaatatagcccgcgagctcgctgagcagacacggaaccacctgaatgctggcgatatcacctactcagtgcgagctatggatcaactcgtgggcctgttggacgtgcagttgagaaacctgacaccgggcggcaaagacagcgctgccagatctctcaataagttgcaaaaaagggaacgcagttgtcgcgcgtatgtacaggccatggttgagactgtgaacaacttgttgcagccccaagctttgaacgcctggagggatttgacaacgtccgaccagctccgggcagctactatgctattacacactgtggaggaatctgcttttgtgctggctgacaacctgctgaaaaccgatatcgttcgcgagaatactgataacatcaagcttgaggtggcaagactatcaaccgaggggaacctcgaggatcttaagttccccgaaaatatggggcatgggagtactatccagctgtctgcaaacactctgaaacagaacgggcgaaacggtgaaatcagagtcgcatttgtgctctataacaatttaggcccctacctctctacagaaaatgcttccatgaaactcggcacagaggccctgagcacaaaccatagtgtcattgttaactcacccgtgatcactgctgctatcaacaaagaattttcaaataaggtatacctagcagaccccgtcgtgtttacagtcaagcacattaaacagtcagaggagaattttaatccaaactgctccttctggtcttactcaaaaaggactatgaccgggtactggtctacgcaggggtgtagacttctgacgaccaacaagacccatactacctgttcttgcaatcacctgaccaactttgcagtgctgatggcccacgtggaagtcaaacattcagatgccgtgcacgatcttctgctggacgttataacctgggtgggaatccttctgtcattggtgtgtttgttgatctgcatcttcaccttttgcttcttccggggcctccagtcagacagaaataccatccacaagaacctttgtataagcctctttgtggcagaacttctgtttctgatcggaattaataggacagatcagcccatcgcatgtgctgtattcgccgcccttctgcactttttcttcttagctgcattcacatggatgtttctggaaggcgtgcagctgtacataatgctagttgaggtgttcgaaagtgaacactctaggagaaaatacttctacctggtgggctacggaatgccagctctaatcgtcgccgtgtccgcggctgtggattatcggtcttacgggaccgacaaggtgtgctggctgcgactcgatacttactttatctggagcttcatcggcccagccactctgataattatgctaaacgtgatcttcctcggcatcgctctgtacaaaatgttccaccataccgccattttaaaaccagagagcggatgtctggacaacatcaagagctgggttattggcgccatcgcgctcctgtgtctcctgggcctgacctgggccttcggcctcatgtatattaacgagtcaacagtgattatggcttacctgttcacaattttcaattccctgcagggtatgtttatctttattttccactgcgtacttcaaaaaaaagtccgaaaggagtacggaaagtgtctacgaacgcattgctgttccggaaagtctacggagagttccatcggatcaggcaaaacctcaggctcgaggactcccggtcgatatagcacaggaagccagtcccgaatccgtcgtatgtggaatgatacagtccggaagcagtccgagagctctttcattactggcgatatcaattcctccgccagtctgaatagagaggggttattgaacaatgctcgggatacctctgtgatggacactcttcctttgaatgggaatcacggaaactcctacagtatcgcaagtggggagtacctctccaattgtgtccaaatcattgacaggggttacaatcataacgagaccgccctggagaagaagattctgaaagagctgacctcaaattacattccaagctaccttaataatcacgagcggagtagcgagcaaaaccgaaacctgatgaacaagctggttaacaacctgggttcgggtcgggaagacgacgctatagtgcttgacgatgccacaagtttcaaccacgaggagagcctcgggctagagctcatccacgaagagtcagacgcgcctctcctgccgccccgggtgtattccactgagaatcatcagcctcaccattacacccgccgacgaataccacaggaccattccgaatcttttttccctctgctgactaacgagcacaccgaggacttacagagcccccaccgcgactcactgtatacaagtatgcctacgctcgcgggggttgctgcaactgagtcagtgacaacttccacacagaccgaacccccgcctgccaagtgcggagatgctgaggatgtatattacaaaagcatgccaaacctgggatcaaggaatcatgtgcatcagctgcacacttactatcagctaggaaggggctcaagcgatgggttcattgtgccacccaataaagatggaacccccccagagggctcatcaaagggacccgcacaccttgtgacaagcctttag

SEQ ID NO: 26996 - DNA, 4056 bp, Artificial Sequence
  Description of Artificial Sequence: Synthetic coding sequence
atgtggccgagccagttactgattttcatgatgcttctggcccccatcatccatggcgggaagcacagtgagcgccatccagccctcgcggcacccctccgacacgccgagaggagcccaggtggcgcgcttccccctcgccatttgctgcaacagccagccgctgagcgtaccgctgcacacagaggacagggccccagaggagccacaaggggcgtccgcggacccggagcccaaggcgcacaaatagcggcccaggcattctcgcgcgcgccgattcccatggcagtggtcagacgggagttatcctgcgagagctatcctattgagcttaggtgccccgggacagacgtgataatgattgagtctgccaactacggccggaccgacgacaagatctgcgatagcgatccagcccaaatggagaatatcaggtgttacctccctgatgcatataagatcatgagtcagagatgtaataatcgcacacaatgcgccgtggtggctggaccagatgtcttcccagacccctgtccaggcacttataaatatttagaggtccagtacgaatgtgtcccttataaagtcgagcagaaggtgtttctttgtcctggtctgctgaagggagtgtaccagtcagagcacttatttgagagtgaccatcagagcggagcttggtgcaaggatcctctccaggcaagcgacaagatttactatatgccttggacaccatacagaacagacaccttgaccgaatactcatccaaggacgacttcattgctggcaggcctacaacgacatataagctgccacaccgtgtggacggaacaggattcgtagtatacgacggcgccctatttttcaacaaggagaggacccgcaacattgtcaagtttgacctgagaacccgcattaaatctggggaagcaattattgcgaatgcgaactatcatgacacctccccttaccggtggggggggaagtccgatattgatctggctgtggatgagaacggcttatgggtgatctatgccaccgagcagaacaacggcaaaatagtgatttcccagcttaacccatacaccctacgtattgaaggaacgtgggatacagcttatgacaagaggagtgcctctaacgcctttatgatctgcgggattctgtatgttgttaagagtgtctacgaggacgatgacaatgaagccactgggaataagatagattacatctacaacacggatcagagcaaggacagtctggtagacgttcccttcccaaactcttatcaatacatcgccgctgtggattacaacccccgcgacaatctgttgtatgtgtggaataattatcatgtagtgaagtactccctagacttcggtccactagactcaagaagtggtcaagcccaccatggacaggtttcttatatttccccacctatccatttggattccgagcttgaacgacccagcgtgaaggacatctccacgaccggacccctgggaatggggtcaactacaacatcgacgaccttgcgaacaactaccctttcaccaggccgctccactacaccaagcgtctcaggtcgacggaaccggtcaacttcaactccttcaccggccgtagaggtccttgatgatatgaccacacatttacccagtgcatcatctcagatccctgccctggaggaaagttgtgaggctgtcgaagcccgggagataatgtggttcaaaacccgacaaggacaaatagccaagcagccctgtcctgctgggacgatcggggtgagcacttatttatgtctggcccctgatggcatctgggacccccaggggccggacctctccaattgttcctctccatgggtgaaccacattacccaaaagctgaagtctggtgagacagccgccaacatcgcaagagagctggctgaacagaccagaaaccacctaaacgccggggacataacgtattccgtccgcgccatggatcagcttgtgggcttacttgatgttcagttgcgtaatttaacaccgggaggcaaggactcagccgcacgctcactgaataagctgcagaagcgggaacggagttgtagggcctacgttcaggccatggtcgaaacagtgaacaacctgttgcagcctcaggctctgaatgcctggagggaccttaccacctctgaccagctgcgcgccgccactatgcttctgcacacagtcgaggaaagtgcctttgtgctggccgacaacctgttaaagacagatatcgttagggagaacacagacaacattaagctcgaagtcgcccgtctaagcaccgaggggaacctggaagacctgaaatttcctgagaatatgggtcatggctccacaatccagctcagtgcaaacacactcaagcagaacggccgcaacggagaaattagagtagccttcgttctctacaataatcttgggccctatttatccacggaaaacgcaagcatgaaactaggcacagaggctctgagtaccaaccattcggtgatcgtgaatagccctgtgatcacagctgccattaacaaagagtttagtaacaaggtctacctggcagacccagtggtattcacagtcaaacatattaaacagtctgaggagaatttcaaccccaattgctctttctggagctattctaaacggaccatgacaggatactggtcgacgcagggttgtaggctgcttactaccaataaaacccacacaacttgcagttgcaaccacctgacaaactttgctgtactaatggctcacgttgaagttaagcactccgacgccgtccatgacctgctcctcgacgttataacttgggtcgggatcctgttgtcccttgtgtgtctgttgatctgcattttcacattctgcttttttcgaggtctgcagtccgatcgaaacacaattcacaaaaatctctgcatcagcctgttcgtggccgaactgctgtttttaataggtattaaccggaccgatcagcccatcgcgtgcgcggtgtttgccgcattgctccacttcttctttctggccgccttcacatggatgttcctcgagggtgttcagctgtatattatgctggttgaggtttttgagtcagagcattcccggcgaaagtatttctacctggtgggatacggaatgcccgctttgattgtggcggtttcagctgcggtagattaccgtagctacggcacagataaagtatgttggctgaggctcgatacctacttcatctggtccttcatcggccccgctaccctcataattatgttgaacgtaatctttttggggattgcactatataaaatgtttcaccacacagccatactgaagccggagagtgggtgtttggacaatatcaactacgaggataaccggcccttcataaaaagctgggtcatcggtgccatagcccttttgtgcctgttgggcctgacatgggcctttggccttatgtacattaatgagagtacagtgattatggcttacctttttactatttttaacagccttcagggaatgtttattttcatatttcattgcgtgctccagaaaaaggtgcgcaaagagtatggaaaatgtttgcgaacccattgctgctccggcaagtctacagagtccagcattggcagcggcaaaacctccgggagtcgcacacccggtcgctacagcacgggcagtcagtctagaattcgccggatgtggaatgacacagtcaggaagcagtctgaatcatccttcattaccggtgatattaattcctccgcctcgctaaaccggggagctatggctaaccatctcatcagtaatgctctgttacggccacacggcactaacaatccctacaataccctgctgggagagcctgccgtgtgcaacaacccgagcgtgagtatgtacaacgcgcaagagccgtatcgtgagacaagcatgggcgtcaagttgaacattgcctatcagatcggcgcctcggagcagtgccaaggatataagtgccacggttactctacaacggagtggtag

SEQ ID NO: 26997 - DNA, 4539 bp, Artificial Sequence
  Description of Artificial Sequence: Synthetic coding sequence
atgtggccaagtcagctgctcatcttcatgatgcttttagctcccattatacacgcctttagcagagctccaatccctatggctgtagtccgccgcgagctgtcatgcgagtcttacccaattgaactgcgctgccctggcactgacgtcatcatgatcgagagtgctaattatggtcggactgatgacaaaatctgcgacagcgatcctgcgcaaatggaaaacattcgttgctaccttccagatgcttataagattatgagccagaggtgtaacaataggactcagtgtgctgtggtggccggacctgatgtgtttccggatccatgccctggtacctataaatacttggaggttcagtacgagtgtgtgccctataaggtagagcaaaaggtgtttctgtgccctgggctgcttaagggagtgtatcaatcagagcacctgttcgagagtgaccaccagtccggggcttggtgcaaggatccactccaggcctccgataagatctactatatgccctggaccccgtatcgcacagataccctcactgagtacagttccaaggatgattttattgctggacggcccacgaccacatataaactacctcatagagtggatgggacaggtttcgtcgtgtacgatggagctcttttttttaataaggagcgtaccagaaatattgttaaatttgacctccgcaccagaataaagagcggcgaagccatcatagctaatgccaattaccatgatacatctccataccgatggggcgggaagtcggacatcgacctcgccgttgacgagaacggcctatgggtgatatacgccacagagcaaaacaatggaaagatcgtgatttcacagctgaacccatatactctgcggatcgagggcacttgggataccgcatacgataagcgatctgcgtccaacgcctttatgatttgtggaatattgtacgtagtgaaatctgtgtatgaggatgatgataacgaggcaactggcaataaaattgactacatctacaatacagatcagagtaaggactcacttgtggatgtgccctttcctaacagctatcaatacatcgcggcggtcgattataaccccagggataatctactctacgtttggaacaattatcacgtcgtgaagtacagcctggactttggccccctggattctcggagtgggcaagctcatcacggccaagtaagttatatcagtccacccatacacctggacagcgaactggaaaggccatctgtaaaagacatcagcactaccggtccactgggaatggggagtacaaccacgagtacaacccttcgaacaactactctgagcccaggccggagtacaacccccagcgtctctggcaggcgcaacaggagcacgagcacaccctcacccgcggtggaagtacttgacgacatgacgactcacctgccatctgcctcttcacagatacccgctttggaagagtcttgcgaggcagtcgaggcaagagagatcatgtggtttaaaaccagacaggggcaaatcgccaaacagccatgtccggccggcacaatcggagtatccacatatctgtgcctggcacccgatggaatatgggatccacagggccctgacctgtcaaattgcagcagcccatgggtcaatcacatcacacaaaagctcaaaagtggtgagactgccgctaacattgcgcgagagctggccgaacaaactcgcaaccacctgaacgccggcgacattacatattcagtgagagccatggatcagctagttgggctgcttgacgtacagcttcgtaatttgacgcctgggggaaaagatagcgcggcccgatcccttaacaagctgcagaagcgggagagatcgtgtagagcctatgtgcaggctatggttgagaccgttaacaatttactgcagccacaagctctgaatgcatggcgcgatttgacaacctccgatcaactccgggctgccacaatgctgctccataccgtcgaggaatctgcgttcgtcctggcagacaacctgctcaaaaccgacatagtgcgggaaaacacggataacataaagctcgaggtcgcgcgactgtcaacagagggcaatctagaagatctgaagtttccagagaacatgggccatgggagcacgattcagcttagtgcgaataccttaaaacagaatgggcgcaatggcgaaatacgggtcgcgttcgtgctgtacaacaaccttggtccttatttgtctacggagaacgcttctatgaagctcggaacagaggcgctgtctactaaccatagcgttatagtgaattcaccagtgatcaccgctgcaatcaacaaagagttttctaataaggtgtacttagctgatccagttgttttcacagtgaaacatataaagcagtctgaagaaaacttcaatcccaactgtagcttttggtcatattctaagaggacgatgaccggctattggtcaacacagggctgtcggctacttacgactaataaaactcatactacctgctcatgtaatcacctgaccaattttgcagtactcatggcacacgtggaggttaagcacagcgatgctgtgcacgatctactgcttgatgtcataacttgggtgggtatcctgctatctttggtttgtctgttgatctgtatcttcactttctgcttcttcagaggccttcagtctgatcggaatacaatccacaagaacctttgcatcagtctattcgttgccgaacttctcttcctcatcggcatcaacaggacggatcaaccaattgcgtgcgccgtctttgctgctcttctccactttttctttctggcagccttcacatggatgttccttgagggcgttcagctttacatcatgctggttgaagtgttcgagtctgagcactcacgtcgcaaatatttttatctggttggttatggcatgccagcgctgattgtggccgtcagcgctgccgtggactacaggagctacggcactgacaaggtctgctggctacgtttagacacttacttcatctggagctttattggccccgcaacattgatcattatgctgaatgtcatcttcctggggattgctctttacaagatgtttcaccacacagcaatactgaaacccgagtctgggtgtctggataatatcaactatgaggacaaccgaccctttatcaaatcttgggttataggagccatcgccctgctttgtctcctcggccttacatgggcttttggcctcatgtatatcaatgaaagcacagtaattatggcttatctgttcaccatcttcaatagccttcagggtatgttcatctttatcttccactgcgtcctccagaagaaagtgcgcaaggagtacggtaagtgcttaagaacccattgttgttccggaaagtctacggaatccagcatcggtagcggaaaaacttcaggatctcgaacgccgggacgctattcaaccggtagccagagtagaattagacggatgtggaacgatactgtgagaaagcagtccgagtcctccttcatcacaggagatattaattccagtgccagtctgaacagaggcgccatggcaaaccacctcattagtaacgcacttcttcgcccacacggcacaaacaatccgtacaacacgctgcttggcgaacctgcggtgtgcaacaacccaagcgttagcatgtataacgcacaggaaggcctcttgaacaatgcacgagataccagcgtcatggacacactgcctttgaacgggaatcacggaaacagctattctattgcttcaggcgagtacctatctaattgtgtgcagataattgaccggggctacaatcacaacgaaactgcactggagaaaaagatcctgaaagagctcaccagtaattacatcccatcatacttgaataatcacgagcgaagctccgagcaaaacaggaatctcatgaacaaacttgtaaataacctgggatccggtcgggaggatgatgcaattgtgcttgacgatgccacttcattcaaccatgaagaaagcctaggactcgaacttatccatgaggagtcagacgcacctctgctgccaccgcgcgtttattctactgagaaccaccagccacatcattatactagacgcaggattcctcaagatcactccgagagtttctttcccctgctgactaacgagcatactgaggatctgcagagcccacaccgagatagcctctacacgtcaatgccaacgctcgcaggtgtggccgccacagaatcagttactacatccacccagacggagccacctcccgctaaatgtggggatgccgaggacgtgtattacaaaagcatgccaaatctcggaagccgaaaccatgttcaccagctgcacacctactaccagctggggcgcggatcttcagacggatttatcgtgccaccaaacaaggatggcactccccccgaaggcagctccaagggacccgctcaccttgtgacctccctgtag

SEQ ID NO: 26998 - DNA, 3927 bp, Artificial Sequence
  Description of Artificial Sequence: Synthetic coding sequence
atgtggccaagccaactgttgatatttatgatgctgttagcaccgattatacacggcgggaaacatagcgaaagacatcccgccctcgccgcacctttacgacacgctgaaaggagcccaggcggtgctcttccccctcgccacctgttgcagcagcccgctgctgaaaggaccgccgcccacagaggccagggacctcgcggagctactcggggggttagaggcccaggtgcccagggcgcccagatcgcggcacaggcattttcacgagctccgatcccgatggccgtcgtccgccgtgagttgagttgtgagagttatcctatcgaactccggtgtccaggaaccgatgtgattatgattgagtctgcgaactatggaaggacggacgataaaatatgtgatagtgatccagctcaaatggaaaatatacggtgttaccttcctgacgcttacaagataatgagccaacggtgcaacaatcgcacacagtgcgccgttgttgcaggcccagacgttttccctgacccctgtccagggacatataaataccttgaagtacaatacgaatgcgtcccgtacaaggtagaacaaaaggtgttcttgtgtccggggcttctcaagggtgtgtatcagtcagagcatctgtttgagagcgaccaccagagtggagcatggtgtaaggacccactgcaggcctccgacaaaatctactatatgccctggacaccatatagaaccgatactttgacagaatattctagtaaggatgactttatcgcaggccgtccaacgactacttataaacttccgcaccgcgtagacgggactggttttgttgtctacgacggagcgcttttcttcaacaaggaacggactcggaacatcgtgaagttcgacctgcgcacacgaataaaatccggagaggccatcatagccaacgctaactaccacgacacaagcccctatcgctggggcggcaagtccgacatagacctggccgtcgatgagaatggcctgtgggtgatctacgcaacagagcagaataacgggaaaattgtcataagccaacttaatccttatacactccgtatcgaggggacatgggacacagcctatgataagagaagtgccagcaacgccttcatgatctgcggtatcctgtacgtggttaagagtgtctacgaggacgatgacaacgaagctacaggcaataagattgactatatttacaacacggatcagtccaaggacagcctggttgacgttcctttccccaattcctatcagtacatcgccgcggtggattacaatccccgtgacaacctgctgtacgtatggaacaactaccatgtggtcaaatactcacttgatttcggacctctcgactctaggagcggtcaagcccatcacggtcaggtatcatacatttcccctccgatccacctggactctgagttagagcggccctccgttaaggacatcagcaccacaggaccccttgggatgggcagcacaactacatcaacgacactaaggacgactaccctgagtccaggcaggagcaccacgccaagcgtgtcaggccgacgcaacagatcaacgtcaacaccttcccccgccgtggaggttctggacgacatgacgactcacttaccatccgctagcagccagatcccagccctcgaggaatcctgcgaggccgtggaggctagagagatcatgtggtttaagaccagacagggacagatcgccaagcaaccttgtcctgcaggcacaatcggtgtttctacatacctttgcttagctcctgacgggatatgggatccccagggtcctgacttgagcaattgtagctcaccttgggtgaaccacattacccagaaactcaagtctggggaaaccgcagcaaacattgctcgggaattagcagagcagaccagaaaccacctgaacgccggagacattacatactccgtacgcgcaatggaccagctggttgggttgctggacgtccagttgcggaatctgacaccaggaggtaaggattcagctgctcgcagccttaataaactccagaagagagaacggagctgtcgagcgtacgtacaagctatggtggaaacagtaaacaacctgttgcaaccccaggccctgaatgcctggcgcgacctaacgacaagtgatcagctgagagccgcaaccatgctgctccataccgttgaggaatcagccttcgtcttggctgataaccttttaaagactgacatcgtcagagaaaacaccgacaacatcaagcttgaagtcgctaggctctctactgaaggcaacctggaggacttgaaatttccagagaacatggggcacggttcaacaatccagctatccgcgaacaccctcaagcagaatggaaggaatggggagatccgcgtagcttttgtcctgtacaacaacttaggaccatatctgtccaccgagaatgcatctatgaagctcggcaccgaagcactatctactaaccactccgtgattgtcaacagtcctgttataactgccgctatcaacaaggaatttagcaataaggtttatctggcagatcccgtggtgttcactgtgaaacatattaaacagtccgaagagaactttaatccaaattgttccttctggtcttacagtaagcggaccatgacaggatattggtcaacgcagggttgtaggttgctaaccactaacaagacccacacgacctgcagctgcaaccacctgaccaatttcgctgtgctgatggctcacgtggaagttaaacattctgacgccgtgcacgatctcttactcgacgtaattacatgggtgggtatactgctgagcttggtgtgcctcctcatttgtatctttaccttctgcttctttaggggcctccagtcggaccgcaacacaatccataaaaatctgtgtatatctctgtttgttgcagagctattgttcctgataggaataaaccgcaccgaccagcccatagcttgcgcggtgttcgcagcacttctgcatttctttttcttggccgctttcacatggatgtttctggagggagtgcagttgtatatcatgctcgtcgaggtgttcgagtctgagcacagtcgccgcaagtatttctatttagtcggctacggaatgccagccttaatcgtggctgtgagcgccgccgtcgactacagatcctatggtactgataaggtgtgctggcttagattggatacatacttcatatggtcattcattggtccagcaacgctgatcatcatgctgaatgtgatcttcttagggatcgctctctataagatgtttcaccatactgctatcctgaagccggagtctggatgtctcgataacatcaattacgaggataatcgtcctttcatcaagagttgggtgattggcgcgattgccctactttgtttgctcggcctgacctgggcgtttgggcttatgtatataaacgagtccaccgtgataatggcctacctgtttaccatcttcaatagtctgcagggcatgttcatcttcattttccactgtgtactgcagaaaaaagttcgtaaggagtatgggaagtgcttgcggacccactgttgctctggcaaatccactgaatctagtatcggctccgggaaaaccagcgggagccggactcccgggcgctactctacgggaagtcaatcaagaataaggagaatgtggaacgatactgtccgcaagcagtcagaatcatcctttatcactggcgatattaattcatccgcctcactgaacagggaaccgtaccgcgagacaagcatgggtgtgaagctgaacatcgcctaccagattggtgcgagtgagcaatgccaaggctataaatgccacggttactccactaccgaatggtag

SEQ ID NO: 26999 - DNA, 3900 bp, Artificial Sequence
  Description of Artificial Sequence: Synthetic coding sequence
atgtggccgagtcagcttctcatatttatgatgctgctggcgccaattatccatgggggaaaacattctgagaggcatccggcccttgccgcccctctcaggcacgccgaacgtagtccaggtggtgccctgccccccaggcaccttctgcagcagcccgctgcagaacgcaccgcggctcatcgcggccaaggtcctcgcggagctacgcggggtgtaaggggccccggagctcagggagcgcaaattgccgctcaagcctttagccgcgccccaatccccatggccgtcgtccggcgcgagctgtcttgcgaatcatatcccatagaactaaggtgtcccggcacggatgtcatcatgattgagagcgcgaattacggtcgcacggacgataaaatttgtgacagtgatccggcgcagatggaaaatattcgatgttatttgcctgacgcctacaagataatgagccaacgttgcaacaacagaactcaatgcgccgtcgtcgccggacccgacgtgttccctgacccctgtcccgggacctataaatatcttgaggtccagtacgagtgcgtcccatataaggtggagcagaaggtgtttctgtgccccgggctgctgaagggcgtgtaccagagcgagcatctgtttgagagcgaccaccaatccggtgcctggtgcaaagatccactacaggccagcgacaagatctactatatgccatggactccatacagaacggatactctgacggaatattccagcaaagatgactttatcgctgggcggcctacaaccacatataagttgccccatagggtggacggcactggatttgtggtttacgatggcgcgctgttttttaacaaagaacggaccagaaatatcgtgaaatttgatctgcgcacacgcattaaatctggagaggctatcatagccaatgcaaactatcacgacacgagtccctacaggtggggcgggaaatccgacattgatcttgcagtggacgaaaacggcctgtgggtgatttatgccactgagcaaaataatgggaagatcgttatctcccagcttaatccgtacaccctgcgcatcgaaggaacctgggacacggcttacgacaaacggtctgcttccaacgcatttatgatctgcggcatcctgtatgtagtgaagtctgtatacgaggacgatgacaatgaggccaccgggaataagattgactatatatacaacacagaccagtccaaagacagtttggtagatgtgcccttccctaactcataccagtatattgctgccgtggactataacccccgtgataaccttctttatgtatggaacaactatcatgtcgtgaagtattctcttgattttgggcctctggactcacggtcagggcaggcccaccacggacaggttagttatatcagccccccaatccatctggacagtgaattggagagaccctcggtcaaagatatctccacgactgggcccttgggcatgggtagtaccactacttctactacactgagaactactaccttgtctcctggcagaagcaccacccctagcgtgagcgggaggaggaataggtctacatccactccaagccccgccgttgaggtgctggatgatatgactacacacctgccgtccgcttccagccagatcccagccttggaggagagctgtgaagcagtggaggcacgcgaaatcatgtggttcaaaacccgtcagggacagatcgcaaagcagccatgtccagccgggacgataggggtaagcacctacctgtgcctagccccagatgggatttgggacccccagggtcccgacctctctaactgtagttcaccttgggttaaccacatcacacaaaaactaaagagcggcgagaccgccgcaaatattgcacgtgagctggccgagcagacccgaaaccacctgaatgcgggggacataacctacagcgtcagggccatggaccagctggtggggcttcttgacgtccagcttagaaacctgacccctgggggaaaggattccgccgcccggagcttaaacaagctacagaaacgcgagcgctcttgcagggcgtacgtgcaagccatggtggagaccgtaaataacctgctccagccacaggctcttaatgcttggcgcgatctgaccaccagcgaccagctccgggcagctacaatgctgcttcatactgtggaagaatctgcttttgtgctggcagataaccttttaaagactgacatcgttcgggagaacactgacaatatcaagcttgaagtcgcgagactgagcaccgagggcaatctggaggatttgaagtttccagagaatatgggccacggctctacaattcaattgtccgccaacactttgaagcagaatggccgtaacggcgaaatacgggtcgcttttgttctctacaataacttgggaccatatctgtctaccgaaaatgccagcatgaagctgggaacagaagcactgtccacaaaccacagcgtcattgtgaacagcccggtcatcaccgccgccatcaataaggagttctcaaacaaagtctacctcgccgacccagttgtgtttactgttaagcacattaagcagagcgaagagaactttaatccgaattgttctttttggtcctactctaagagaacgatgacgggctattggtcgactcagggatgtaggttactcaccacaaataaaacccatacgacatgttcgtgtaatcacttgactaatttcgctgtcctcatggcgcacgtcgaagtgaagcactctgacgctgtccatgacctactcctggacgtcattacctgggtgggaattctgttgtctctggtgtgcctgctgatttgcattttcacattttgcttcttcaggggcctccagagcgaccggaatacgatacataagaacctgtgcatcagcttgtttgtggcagaacttctattcctgataggtatcaacaggactgatcaacccatcgcttgcgcagtctttgccgcccttcttcacttcttctttctggctgcctttacctggatgttcctggagggagtgcagctgtacatcatgttggtggaggtcttcgaatccgaacatagcaggcgaaagtacttttatctggtgggctatggcatgccagccctcatcgtggcagtgagcgccgctgtggactatcggtcctatggcacggacaaagtctgctggctgagactagacacgtactttatttggtctttcataggtccagcaacgctgataattatgcttaatgttattttcttggggatcgcgctgtacaaaatgttccatcatacagcgatccttaaaccagagagcggatgtcttgataacatcaaaagctgggttattggggctatcgcactgctttgtttgctgggactgacatgggcattcggacttatgtacatcaatgagtcaacggttatcatggcatacctttttaccatctttaattcactgcagggaatgtttatctttatctttcactgcgttctccaaaaaaaggttagaaaggaatacggaaagtgcctccggacacactgttgcagcggcaagagcaccgaatctagtataggcagcgggaaaacgtcaggttcccgcacacccggacgctattccacgggctcccagtcaaggatccgccgaatgtggaacgatacagttcgtaagcagagcgagagttcctttattaccggggacatcaactcttccgcaagcctgaatagagagccgtacagagagacatcaatgggggtgaagctgaacatcgcttatcaaattggggcttccgaacagtgtcagggttacaagtgccacggctattcaaccacagaatggtag

SEQ ID NO: 27000 - DNA, 3723 bp, Artificial Sequence
  Description of Artificial Sequence: Synthetic coding sequence
atgtggccaagtcagctcctgatcttcatgatgctgttagcgcccatcatacatgcgttcagcagggctcccattccgatggctgtggttagacgggaactgagctgcgagtcttaccctatcgaactcaggtgccctggtacggatgtgataatgattgagagtgcaaattacggcagaaccgacgacaaaatatgcgatagtgatcccgcacagatggaaaacatccgctgctatttaccggatgcctataagatcatgtcccaacgatgtaataacagaacccagtgcgccgtcgtagccggccccgacgtgttcccggatccctgtcccgggacatacaagtacctggaggttcagtatgagtgcgtcccatacaaggtagagcaaaaagtcttcctctgtcccgggctccttaagggggtgtaccaaagcgagcaccttttcgaaagcgaccaccagtccggtgcatggtgtaaagaccctctgcaagcatcagacaaaatctattatatgccatggactccataccgcaccgataccctcactgaatactcctccaaggacgattttatcgctggaaggcccactacaacctacaagcttccccacagagtggacggaaccggtttcgtcgtgtatgacggcgctctgttctttaacaaggaacgaacacgaaatatagtcaaatttgatttgcgtacgaggattaagtctggcgaggcaatcattgccaatgccaactaccacgacacctctccttatcgttgggggggaaagtcagatattgacctcgcagtggacgaaaacggattgtgggtcatctatgcaaccgagcagaacaacggaaagattgtgatttcccagctgaacccttatacccttcggatcgaaggaacgtgggatacagcatacgacaaacgtagtgctagcaacgcattcatgatctgtggcattctgtatgttgtgaagtccgtctacgaagacgatgacaacgaggccacgggcaacaagattgattatatttataacacagatcagtcaaaagattcactggtggacgtgccctttcccaattcgtaccaatacatagccgcagtggattacaaccccagagataatctgctctatgtatggaataactaccatgtggtcaagtatagcctcgactttggtccattggactctaggtcaggccaggctcaccatggacaggtgagctatatcagcccacctatacatctggacagtgaacttgaaaggccctctgtcaaggatatatcaacaacgggtcccctggggatgggttccactactacctctaccacgctacgaacgacgacgttgtctccgggccgctcgaccaccccctctgtgagcggacgaaggaaccggtcaactagcacccctagtccagcagtggaggtgttggatgacatgacgacccacttgcccagcgcctctagtcagatccctgctctggaagaatcttgcgaggcggtcgaggctcgtgaaatcatgtggtttaagactcggcaggggcagattgccaagcagccgtgtcctgctggtacaattggcgtgtcgacttacctttgcttggcacccgacggaatttgggacccccagggccctgatctgtcaaattgctctagtccatgggtgaatcacattactcagaaactcaaatctggggagaccgctgctaacatcgcgcgcgagttagccgagcaaacccggaatcacctcaatgctggtgatattacctatagcgtccgcgccatggatcagttggtggggctgcttgacgtgcaactccgcaatcttactcctggcggtaaggattcagctgcgcgctctttgaacaaattacagaaaagggagaggtcttgtagagcttacgttcaggccatggtggagactgtgaataatctgctccagccccaagctttaaacgcctggcgtgatctgacaacatccgaccaacttagagcagcaactatgctccttcatactgtggaggagtcagcttttgtgctggctgataatttgttaaagacagatatcgtccgggaaaacaccgataatatcaagctcgaggtggcacggttgagtactgaaggcaatctcgaggatctaaaattccccgaaaacatgggccatggatcaactatccagctttcagcgaatacactgaagcaaaacggaaggaatggtgaaatccgagtggctttcgtgctgtacaataacctcggaccctacttgtccacagagaatgcatctatgaaacttgggacagaggccctgtctactaaccatagtgtgatcgttaatagccccgttatcactgctgctatcaataaagaattctctaataaggtttacttagccgatccggtggtgtttaccgtgaagcatatcaaacaaagtgaagaaaatttcaaccccaattgttccttttggtcatatagcaagagaaccatgaccggctattggagcacccagggctgtcgcttgctgacgactaacaagacgcacactacgtgcagttgcaaccacctgactaacttcgcggttctgatggcccacgttgaggtgaagcactccgacgccgtgcacgacttacttctggacgttatcacttgggtgggcatcctcttgagcctggtttgtctgctgatctgtatattcaccttctgcttttttcgaggactacagagcgaccgaaacactatacataagaacctttgtataagcttgtttgtggccgagttgttattcctgataggaatcaaccgaactgaccagcccatcgcctgtgccgtattcgccgccctgttacatttttttttcctggctgcttttacgtggatgtttctcgagggtgtgcagctgtacatcatgttagtggaggtgtttgaatctgagcactctagacgtaagtacttttatcttgtcggatacgggatgcccgccctgatagtggccgttagcgcagccgtggactaccgctcatatgggacagacaaggtgtgttggctgcggctcgatacttactttatttggagctttataggccctgccactctaatcatcatgctgaacgtcatttttctgggcatcgcactttacaagatgttccaccacacagcaattctgaaacccgagtcaggatgccttgataacattaattacgaagacaaccgaccgttcataaaatcttgggtaattggagctattgctctcctgtgtctcctcggtcttacgtgggcttttggactaatgtacattaatgaaagcaccgtgattatggcttacttgttcacaatttttaattccctgcaaggcatgtttattttcatcttccattgtgttttgcagaagaaggtccgcaaggagtatggcaaatgtctgaggacccattgctgctccggtaagtctacagagtccagcattggtagcgggaaaacctccggaagtaggaccccgggccggtatagtaccggtagccaatctcgcatccgacgtatgtggaatgacacggttcgaaagcaatccgagtcaagctttattacaggagatattaattcctctgcctcactaaacagagaaccatacagagagacgagtatgggggtgaaattgaacattgcctaccagataggagcttctgaacagtgccaggggtataaatgtcatggctactcgacaacagaatggtag

SEQ ID NO: 27001 - DNA, 3825 bp, Artificial Sequence
  Description of Artificial Sequence: Synthetic coding sequence
atgtggcccagccagttactgatctttatgatgctactggcccctattatccacgcgtttagtcgcgccccaatcccaatggctgtggtcagacgcgaactgtcctgtgagtcttaccccattgagctgcgatgccccggcactgacgtgataatgatagaaagcgccaactatgggaggaccgatgataagatatgcgactcagaccccgcccagatggagaatatcaggtgctatctgccggacgcctacaagatcatgagtcaacggtgcaacaaccggacccagtgtgctgtggtggcaggccccgatgtattcccagatccttgccccgggacgtacaagtacttagaagtgcagtacgaatgtgtcccttacaaggtcgaacaaaaggtctttctgtgccccggacttcttaagggagtctaccaaagcgagcatttgttcgagtctgaccaccaatcaggcgcctggtgcaaggacccacttcaggcttccgataaaatctactacatgccgtggactccctaccggaccgacacactgacagagtatagcagcaaggacgattttatcgcaggtagacccaccactacctacaagttaccccaccgcgtggatggcacaggatttgtggtgtacgacggcgcattattctttaataaagagcggactcgaaatattgtcaagtttgacctgcgtactcgaatcaagtcaggggaagctatcattgccaacgccaattatcatgacacaagtccataccggtggggaggaaaaagtgacatcgatcttgcggtagacgagaatggtctgtgggtgatttatgctacggaacagaataacggaaaaatagtcatctctcagctgaacccatatactctgcgcattgaggggacctgggacacagcttatgataaacgtagcgcaagtaatgcatttatgatctgtggcatcctgtacgtagtcaagtccgtgtatgaagatgacgataatgaggctaccggtaacaagatcgactatatatacaacacagaccagtccaaagattccctggtggatgttccattccctaatagttaccaatatatcgccgccgttgattataatccacgggacaacctgctgtatgtgtggaacaattaccacgtcgtaaagtactcactcgacttcggacctctggactcgaggtctggacaggctcatcacggacaagtgagttacattagtccccctattcacctggatagcgaactggagagaccttcagtgaaggacatctccactactggccccttgggcatgggatctacaactacttccacgacgttacgcaccactacgctgtcacctggtcggtcaacaacacccagcgtaagcggccgcagaaacaggagcacctctactccttctcctgccgtagaggtcctagatgacatgactactcacctccctagcgcttcatcccagatcccagcactcgaggagtcttgcgaggccgtcgaagcaagggagataatgtggtttaagaccaggcaaggacagatcgctaaacagccttgccctgctggcacaatcggtgtgagcacctacttgtgcttggctccggatggaatatgggacccacagggacctgacctgtcgaactgctcctctccatgggtgaaccatatcacccaaaagctgaaaagcggtgaaaccgccgccaatattgctcgcgaactcgccgaacagaccaggaaccatcttaacgccggagatatcacctactccgtacgtgccatggaccagcttgtcggacttcttgacgtgcagctaaggaatttgactccagggggcaaggacagcgccgccagaagcttgaataaactacaaaaacgagaacgttcctgcagggcatacgtacaggcgatggtcgaaacagtaaataatctgttgcaaccacaggctctgaacgcatggcgagacctcaccacctccgaccagctgagagctgctaccatgctgttgcatacggtggaggagtccgcgtttgtgctggccgacaatctgctgaagactgatatcgtgcgcgaaaacactgataatatcaaattggaggtcgcgagactcagtacggagggcaatctagaggatctgaaattccctgaaaacatgggccacggatccacaatccagctgagcgctaacactctcaaacaaaacgggagaaatggcgaaatcagagtcgcctttgttctctacaataacctgggaccctatctgtccactgaaaatgcttcaatgaagctggggactgaagctctctccaccaatcattctgttatcgttaattcccctgtgatcaccgccgccatcaataaagaattctctaacaaggtctacttagccgatcccgtggtgttcaccgtcaagcacataaagcagagtgaggagaacttcaatcccaattgctctttttggagctattctaaaaggacaatgactggatattggtctactcagggctgtcgactgctgacaaccaacaagacccacactacatgctcttgtaatcatttaaccaactttgccgttctcatggcacatgtggaggtcaagcactccgacgcggtgcacgacttgcttctagacgtgatcacctgggtaggcatcttattatccctcgtgtgcctattgatctgtattttcaccttctgttttttcagggggcttcagagcgaccgcaacaccatccataagaatctatgcataagtctttttgttgcggaactgctgttcctgatcggaatcaacagaacagaccaacctattgcatgcgccgtatttgcagcgctgttgcacttttttttccttgctgccttcacctggatgtttttggagggagtccagctgtacattatgctggtggaggtgttcgagagcgaacattcacgccgcaaatacttttacctggtgggatacggtatgcccgctctaatcgttgccgtaagcgctgccgttgactatagatcctacggaacagataaagtgtgctggttacgcctggatacttacttcatttggagcttcattgggcctgctactcttattatcatgctcaatgtgattttcttaggcatcgctctctacaagatgtttcatcataccgcaattctgaaacctgaaagcgggtgtttagacaacataaaaagctgggtgatcggtgccattgctctgctgtgtctgctgggtctgacttgggcgttcgggcttatgtatattaacgaatccactgtcataatggcgtacctctttacgatcttcaattccctccagggcatgttcatctttatttttcactgcgtattacaaaaaaaagtacgcaaggaatatggcaagtgtcttaggactcactgctgctctgggaagtccaccgaaagtagcattggtagtggaaaaacatctggaagtcgtacccctggcagatatagtacaggtagtcagagtcggatcaggcggatgtggaacgacaccgtccgtaagcagtctgaaagttctttcataaccggagatattaactcttccgcgagtctgaaccggggcgccatggctaatcacctcattagcaacgcgttgctcagaccccacgggacgaacaatccttacaacactttgctgggagagccagccgtctgcaataacccttccgtctctatgtacaacgcccaagaaccttatcgggagacatcaatgggcgtcaagctcaacattgcctatcagatcggcgccagcgaacaatgtcagggctataaatgccatggttacagcaccacagagtggtag

SEQ ID NO: 27002 - DNA, 4410 bp, Artificial Sequence
  Description of Artificial Sequence: Synthetic coding sequence
atgtggcctagccagcttttaatctttatgatgcttctggcacctattattcatgccttttccagggctccaatccccatggccgtcgtacgccgcgagctgtcctgtgagtcgtacccaatcgaacttagatgtcccggcacagatgtaatcatgatcgaatctgccaattacggaaggactgatgataaaatctgcgacagcgatcccgcacagatggagaacatcagatgctacctgcccgacgcatataagatcatgtctcagaggtgtaacaatcggacccagtgcgcagtggtcgccggaccagatgtgtttcccgatccctgccctggaacatataagtatctggaggtacagtatgaatgcgtcccctacaaggtggaacaaaaagtgttcctgtgcccgggcctgctcaagggcgtgtaccagagcgagcaccttttcgaaagcgaccaccaatctggcgcgtggtgcaaggatcctctccaggcttccgacaaaatctactacatgccttggaccccctaccgaacggatacacttacggaatatagcagcaaggacgattttattgcaggacgccccacaacaacctacaaactgccccaccgggtggacggaaccggatttgtggtgtacgacggcgctttgtttttcaataaggaaagaacacgaaacatcgtaaagtttgacctacgaacacgaataaagagtggtgaagctatcatagcaaatgcaaactatcacgacacctcaccatacagatggggtggaaagagcgatatcgacctggccgttgatgaaaacggcttgtgggtcatttatgcaaccgaacagaacaatggaaagatcgtcattagccaacttaatccttatactctccggattgaggggacctgggatacagcgtacgataagagatcagctagcaatgccttcatgatctgcggcatcctgtacgtcgttaagtccgtctacgaggatgacgacaatgaagccactgggaacaaaattgattacatctacaataccgaccaatctaaggactccctcgtggacgtcccctttcctaatagctatcaatatattgctgctgtggattacaatcccagagacaaccttctgtacgtgtggaacaattaccacgtcgtgaaatatagtctggattttggtccactggactcacgttctggtcaagcacaccatggtcaggtgagctacattagtccccctattcatctggattctgagttagaaaggccatccgtaaaagatatcagcacaacaggtccccttggtatgggcagtactacgacctccactacacttcgtactaccaccttgagcccagggcgctccactactccatctgtgtccggccgcaggaatcggtctacttccactccttctcctgctgttgaggtactggacgatatgaccactcacctgcccagcgcctcttcacaaattcctgcgttagaggagagctgcgaagctgtagaggctagggagataatgtggtttaagacgcgccagggtcaaatcgccaaacagccatgtcccgctggaactataggggtgtcaacctatctgtgtcttgcaccagacggtatctgggacccccaaggtcccgacctgtccaattgttcctccccctgggtaaaccacattactcagaagctcaagtccggcgaaactgcagccaacatagctagggagttagcagaacaaaccagaaatcacctcaacgccggagacatcacctactcagtgcgagcaatggatcagctcgtggggctcctcgatgtccagctgcgaaacctgaccccgggcggtaaggattcagccgccaggagcctcaataagctgcagaagcgagagcgctcctgccgcgcctacgtacaagctatggttgagactgtgaacaacctgttgcagcctcaagctctcaacgcttggagagacctgacgacgagcgaccagctgagagctgccacaatgctacttcatacagtggaggagtctgcctttgtgctggccgacaatctgctcaagactgacatcgtgcgggagaatacagacaatatcaagctggaggtggctcggttgtcgacagaaggtaatctggaagatctgaagtttccagagaacatgggtcacgggagcaccatccagctgtccgccaacacacttaaacagaacgggcgaaacggggagattcgggtcgcctttgtgctgtataataacctgggtccctaccttagtacggaaaatgcatccatgaaactaggcacagaagccttaagcactaaccattcggtgattgttaatagtccggtgattacagcagccataaataaagagtttagtaataaagtgtacctggctgacccagtcgtttttacagttaagcatataaaacaatctgaggagaactttaaccccaactgcagtttctggtcctattcgaaacgcactatgaccggctattggtctacccaggggtgccgccttttgaccactaacaagactcacacaacctgcagctgtaatcacctgacgaattttgcggttctcatggcgcacgttgaggttaaacacagcgacgcggtgcacgatctccttctggacgtgattacatgggtggggatcctgctttcgctcgtatgcctgctcatttgcatcttcacattttgtttttttagaggcctccaatccgacagaaacacgatccacaaaaacctgtgtatcagcctgtttgtggcagaactcctgtttttaatcgggataaaccggaccgatcagcctattgcatgtgccgtgtttgccgccctacttcatttttttttcctggccgctttcacctggatgttcctggaaggtgtgcagctgtacatcatgctggtggaggtcttcgaaagtgaacactcgagacggaaatatttttatttagtaggctacggcatgcccgctttgatcgtcgccgtgtctgccgctgtggattaccgttcatatggtaccgataaagtatgctggctgaggctcgacacttatttcatctggtcgttcattgggcctgcaacgttgatcatcatgctcaatgtaatcttcctggggatcgctctgtataaaatgttccaccataccgctatcctgaaaccagaatctgggtgcctagataatataaactatgaggataacagacccttcattaagtcctgggtcatcggcgctattgcattactttgtctgctcgggttaacctgggcgttcggcctcatgtacataaatgagtcaaccgtgatcatggcatacctgttcactatctttaacagcctgcaggggatgtttatctttatatttcattgtgtgctgcagaagaaggtcagaaaagagtacggaaagtgccttcggacacattgttgcagcgggaagagcaccgagagcagcatcgggagcggtaagacttcagggtccaggacccctgggcgctattctactggttctcaatctcgcattaggaggatgtggaatgacactgttcggaagcaatcagaatcctccttcatcaccggagatataaactcctcagcaagcttgaatagagaaggactgctaaacaacgctcgtgacaccagcgtgatggacaccctgccactgaacggcaatcacgggaactcctattccatcgcgtcaggggagtatctaagcaattgtgttcagatcattgaccggggctataatcacaacgagactgccctcgagaaaaagatactgaaggagctcacttcaaactacattccgtcgtacctcaacaaccacgaacgatcatcagagcagaatagaaatctgatgaacaagctcgtgaataacctaggcagtggcagggaggatgacgccatcgtgctagacgacgccaccagttttaatcacgaggagtccctcggcctggagttaatccatgaggaaagcgatgcaccattgcttccacctagggtctatagcacagaaaaccatcaacctcaccactatacacggcgtcgcatcccccaagaccactctgagtccttcttccctctcctcaccaatgaacacacagaagatctccagagtcctcatcgcgactcattatatacctctatgccgactctggccggcgttgcggccactgagtccgtgacaacctcaacacagacggaaccacctcctgccaaatgtggcgacgctgaggacgtgtattacaagtcaatgcccaatctgggctctcgcaaccatgtgcatcagctccacacttattatcagctcggacggggaagtagcgacggcttcattgtacctcccaacaaagatggcactcccccagaaggttcgagcaaggggcctgctcacctggtgaccagtctgtag

SEQ ID NO: 27003 - DNA, 4512 bp, Artificial Sequence
  Description of Artificial Sequence: Synthetic coding sequence
atgtggccttctcagctgctgatctttatgatgcttttggcccctatcattcacgcttttagtagggcccccataccgatggccgtggtacgtagggaactctcttgtgagagctatccaatcgagctcagatgtccgggcaccgacgtgataatgatagagtccgcaaactatggccgcaccgacgataagatctgcgacagtgatcctgcccaaatggagaatatccggtgctacctgccagatgcttataagatcatgagccaacgttgcaataataggacccagtgcgctgtagtcgctggacctgatgtgtttcccgacccatgtcccggaacatataaatacctggaggtccaatatgagtgtgtgccatacaaggtcgaacagaaagtgtttttgtgccctggcctgcttaagggggtctaccagtctgaacatcttttcgagtctgatcatcaaagtggggcctggtgtaaagatcctcttcaggcatcggacaagatttattacatgccatggacaccttatcggacagacacccttacggagtactcttcaaaggacgacttcattgcagggcgccccaccactacttacaagctcccacaccgcgtggacgggaccggtttcgtggtgtacgatggggctctctttttcaataaggagcgcaccaggaatatcgtcaaatttgaccttcggacacgcatcaaatctggggaggccattattgccaatgcaaattatcacgacacctctccttaccgctggggtggcaagagcgatattgatttggccgttgacgagaacggactgtgggtcatttacgctacagaacaaaacaacgggaagattgtgattagccagctgaatccctacacgttgagaatagagggtacctgggatacagcttatgataaacgctctgcaagcaacgcatttatgatctgcgggatcctgtatgtggtgaaaagtgtgtacgaggatgatgacaatgaggcaaccggaaataagattgactacatttacaatactgatcagtctaaggactccttggtagacgtgcccttccccaattcctaccaatatatcgccgccgtggattacaaccctcgcgacaacttgttgtatgtctggaataattatcatgtcgtgaaatattcgctggacttcggacctctggatagtaggagcggacaggcacatcatgggcaggtgtcctatatatcaccgcccatccatttggactccgaactggagaggccatctgttaaagacatcagcaccactgggccactgggaatggggtccacgacaacttctaccacccttagaacaacgactctgagtcccggtcgcagcacgactccgtccgtatcgggtcgcagaaaccggtccacaagcaccccctccccagccgtggaggtgcttgatgatatgacaactcacctgccgtctgcttctagccagattccagctctggaggagtcctgtgaagctgtggaagcacgtgaaataatgtggtttaagacccgccagggccagattgcaaaacaaccttgtcccgcgggtactatcggcgtaagtacttacttgtgcctagctcctgacggcatctgggacccgcaggggccagatctgtccaactgttcaagcccctgggtgaatcatatcacccagaagctcaagtcaggtgaaacagccgccaacatcgcccgggaacttgccgagcaaactaggaaccacctgaatgcaggagacatcacctatagcgtgagagccatggatcagttggtgggcctgctggacgtacaattacgaaatcttactccaggcggtaaagactcggcggcgcgaagtctgaacaagcttcagaagagagaacgatcctgtagggcatacgtacaggccatggttgagacagtgaataatctattgcagccccaggctctgaatgcttggcgagacctgacgacatccgaccagttaagagctgctaccatgttgctccacaccgtggaagagtccgccttcgtcctggccgataaccttcttaagacagatatcgttagagagaacacggataatataaagctggaagtggcccgactgtccacagaaggcaatcttgaggatctaaagttccccgagaatatgggacatggaagcaccattcagcttagtgccaatactttaaagcagaacggccggaacggggaaatccgggtggcattcgtgctgtataataacctcggcccctatctctcaacggagaatgccagcatgaaattgggaacagaagccctcagtactaaccacagtgtgattgtaaactctccagtcatcacggctgctataaataaggaattttcaaataaggtatatctcgctgaccctgtagtctttacggtcaagcatattaagcaatcggaggaaaacttcaatccgaactgcagcttttggtcctacagtaagaggaccatgaccggctactggtctacacaggggtgcagattgctcaccactaataagacccacacgacttgtagctgtaaccacctgacaaacttcgctgtgctgatggctcatgtggaggtcaaacatagtgatgcagtgcacgaccttcttctagatgtcataacatgggtagggattctgttgtcattagtgtgtctcctaatttgtatattcactttttgcttcttcagagggctgcagtccgaccggaacacaatacacaagaatttgtgcattagcctgtttgtggcggaactgttatttttgatcggaatcaacagaaccgaccagcccatcgcttgcgccgtgttcgcagccttactgcatttcttttttcttgccgcattcacctggatgttcttagaaggggtccagttgtatattatgctcgttgaggtgtttgaatcagaacatagccgccggaagtatttctacctagtgggatatgggatgcctgcgttaatagtagccgtgtccgccgccgtcgattaccgttcatacggtaccgacaaggtttgttggctgagacttgacacatacttcatttggtccttcattgggcccgccacactgattataatgctcaatgtcattttcctgggcatcgctctctataagatgtttcaccatactgccatcctgaagcctgaatcagggtgtctcgacaacatcaaaagctgggtcattggtgccattgccctcttatgcctgctagggttaacatgggcctttgggctgatgtacatcaacgaatccaccgtcatcatggcttaccttttcacaatctttaacagtttgcagggcatgttcatcttcattttccactgcgtccttcagaaaaaagtccggaaagagtatggcaagtgcctgaggacacactgttgcagtgggaaatctacagaaagttctatcggctcagggaaaacttcgggttctagaacccccggcaggtacagcaccgggtcgcaatcacgcatcagaagaatgtggaatgacacagttcgcaaacagtcggagtccagctttatcacaggagacatcaacagctccgcctccctcaacaggggtgcaatggccaaccatctcatatccaatgccctgctccgtcctcatggcactaataacccatataataccctattaggcgagccagcagtctgtaacaatccctctgtgtcaatgtacaatgctcaggagggcctgctgaacaacgcaagagacacatccgtaatggatacactccctctgaacggcaatcatgggaactcctatagcattgcttctggagagtatctgtctaattgtgtccagatcatcgatcggggctacaaccataatgaaaccgcccttgagaaaaaaatccttaaagagctgacatcaaattatatcccgtcatacctgaacaaccacgagaggtccagtgaacagaatcggaacttgatgaataaactcgtgaacaatctgggatccggtcgagaagatgatgcaatcgtgctagacgacgcgaccagctttaatcatgaagagtccctggggctcgagctgattcacgaagagagcgacgcacccctgcttcctcccagagtgtactccaccgagaatcaccaaccccatcattacacccggaggcgtataccgcaagaccactcggagtcattcttcccactgttgacaaatgaacatactgaagaccttcagagcccccacagagactctctgtatacatccatgcccacgctggcaggggtggctgcaacggaatctgtgaccaccagtacccagaccgagccccctcccgctaaatgtggggacgcggaggatgtctactacaagagcatgcctaatctcggaagcagaaaccacgtccaccaactgcatacgtactaccaactggggagaggaagctctgatggcttcatagttccaccaaataaggacggaacgcctcctgagggaagtagtaagggccccgcgcacctcgtgacttccctttag

SEQ ID NO: 27004 - DNA, 2124 bp, Artificial Sequence
  Description of Artificial Sequence: Synthetic coding sequence
atgtggccctctcagctactgattttcatgatgctgttagcccccattattcacgcgtttagtcgtgcgcctatcccaatggcagtggttaggagggagctgagttgcgagtcttatccaatcgagttgagatgtcctggaaccgacgtgatcatgattgaatcagccaattacgggaggaccgacgataagatctgcgacagcgaccctgctcagatggagaacattagatgctatttaccagacgcctacaagattatgtcccagcgctgtaacaaccgcactcagtgcgccgtggtggctgggcctgatgtatttcccgatccgtgcccaggaacctacaagtacctggaggtccagtacgagtgtgtgccttatagagtggaccagaaagtcttcctctgccctggtctgttgaaaggcgtgtatcaatcggagcatttgttcgagagcgatcaccagtctggcgcttggtgtaaagaccccttgcaggcttccgacaagatatattacatgccttggactccttataggacggatactctgacggaatactccagtaaggatgatttcatcgcgggaagacctacgaccacttacaaattacctcaccgggtagacggcaccggattcgtcgtgtatgacggcgcactgttcttcaacaaagagcgcacccggaacatcgtcaagttcgacctgagaactaggattaaatcaggtgaggcgatcatcgctaacgccaactaccacgacacttctccgtaccggtggggaggcaagtcggatatagatttggcggtggatgagaacggactttgggttatctatgcgactgagcagaataatgggaagattgtgatcagtcaattgaatccatatacgctgcggatcgagggtacgtgggacaccgcctacgataaaaggagcgcctctaacgccttcatgatctgcggcatcctatatgtggtaaagagcgtatatgaggacgacgataatgaggcaacaggtaacaagattgattacatttacaacaccgaccaatcaaaagattctctggtagacgtgccattccccaattcctaccagtacatcgccgctgtcgattacaatccaagagacaaccttctctatgtttggaataattatcacgtggtcaagtacagtctcgatttcggcccccttgattctagatcaggtcaggctcaccacggccaggtgtcatacatctccccccctatacatttggattccgaactggagcgaccgagcgtgaaagacatctcgactacgggacctctgggaatggggtccaccacgacctccactacattgcggacaaccaccctgagcccaggcagatcgaccacaccaagcgtgagcgggaggagaaaccgctcaacgagcactccctccccagctgtagaagtactggatgatatgaccacacatcttccaagcgccagttcccagatacctgcactggaagagagctgcgaggccgttgaagcacgggagattatgtggttcaagacaagacaaggccaaatcgctaagcagccatgtcctgctggcacaattggggtgtcaacttatctgtgtctcgcccccgatgggatttgggaccctcaggggccagatctgtctaattgttcaagcccctgggtgaaccacattacccaaaagcttaaaagtggcgagactgccgccaacatcgctcgggagctggctgaacaaactagaaaccatctgaatgctggcgacatcacatactctgtaagagctatggaccagcttgtcggcctgctggatgtccagcttcgcaacctcacccccggaggtaaggatagcgcagccagatccctgaacaaggccatggtggaaactgttaataacctcctgcagccacaagctctcaatgcctggcgggatctcacaacctcagatcagctgagggccgcgactatgttgctgcacaccgtggaggaaagtgccttcgttctcgtgttgcaggtatgcctccccgtgagagagcagagtttccttccgttcttctccttctttattttttttttttcatttctcccatttatccctctcaaattccgcctggctaaaaacaaatag

SEQ ID NO: 27005 - DNA, 4410 bp, Artificial Sequence
  Description of Artificial Sequence: Synthetic coding sequence
atgtggccctcacagctgctgatcttcatgatgctgctcgcccccatcatccatgccttttctcgcgcccctatcccgatggcagtggtacgtagagaattatcctgtgagtcctacccgatcgaacttaggtgtccgggcacagacgtgatcatgatcgaaagcgctaattacgggagaaccgacgacaaaatctgtgatagcgatccggcccagatggagaacatcagatgctaccttcccgacgcttataagatcatgtcccagcgttgtaataaccgcacccagtgcgctgtcgtagctggcccagatgtgttcccagatccttgccctggcacttataagtacctggaggttcagtacgagtgtgttccatacaaagttgagcagaaagtgttcctctgccccggcctgttgaagggcgtttaccagtcggaacatcttttcgaatcagatcaccagtccggagcttggtgcaaggacccgctgcaggcaagtgacaaaatatactacatgccatggactccatataggactgatactctgaccgagtatagcagtaaagacgatttcatcgccgggaggcctacaacgacctacaaacttccacatagagtggacggaaccggtttcgtcgtgtacgatggcgctctctttttcaataaagaacgaacccggaatatcgttaagttcgacctccgtacacgtatcaagtccggtgaagcaatcatagcaaatgccaattatcatgatacaagcccctacagatggggcgggaaatcagacatcgacctagccgtggatgagaatgggctgtgggtgatttacgcaacggagcagaataacgggaaaatcgttatctcacagttgaatccctatactctgagaatcgaggggacttgggataccgcctacgataaaagaagtgcctcgaacgccttcatgatatgtgggatactttacgtcgtgaagagtgtgtatgaagatgacgataacgaggcgactggcaataagatcgactatatatataacacggaccagagcaaggattccctcgtcgatgtgccattccctaacagttatcagtatattgctgccgtggactacaatccccgtgacaatttgttgtacgtgtggaataattatcatgtcgtaaaatacagtctggactttggcccattggattccagaagcgggcaggcacaccacggccaggtgtcttatatatctccccctatacacttggatagcgaacttgagcgtccatcagtgaaggacatttcaacgaccgggccactgggaatgggctcaaccaccacctcgacgactctgaggacgaccaccctgtcaccggggcggagcacaacacccagcgtgtctggtcgcagaaatcggtccacctctacccctagccccgcagtggaagttctcgacgacatgacgacccacctgccctcggcatcctctcaaatcccagccttggaagagagctgtgaggcagtcgaagcgcgggaaatcatgtggttcaaaacacgccagggacagatcgccaaacagccctgtccagctggtacaatcggcgtgtcaacttacctgtgtctggcccctgatggaatctgggacccgcagggacccgacctcagtaattgcagttccccttgggtgaatcacataacccaaaagctcaagtccggtgagactgccgcaaatatcgcacgagagctggcagaacagacccgcaatcacctcaacgctggtgacatcacctactccgtaagagctatggaccaactagtgggattgctggacgtccaacttagaaacctcacccctggaggaaaggacagcgcggcaagatctcttaacaagttgcagaagcgcgagagatcctgcagagcttacgtgcaggctatggtagagacagtcaataatctgctgcagcctcaggcccttaacgcgtggagagacctgaccacgtccgatcagctgcgtgcggcgaccatgctgctgcatacagtggaggaaagcgcctttgtgctggccgacaacctgttaaaaaccgatatcgtgagggagaacactgacaatattaaactggaagtggctcggttatccacagaaggcaatctggaggacctcaaattcccagagaacatgggccacggaagtaccattcagctgtctgccaacactctgaaacagaacgggcggaatggcgagatccgggtggcttttgtattatataacaacctgggaccttacctgtccaccgagaacgccagcatgaagctgggcactgaggctctgtccacaaaccattccgtcatagtgaactcccctgtgataactgcggctataaataaagagtttagcaataaggtgtatctggcagatccggtggtcttcaccgtgaaacacattaaacagagtgaggagaactttaacccaaactgttctttttggtcttactccaagcggaccatgacagggtactggtctacccagggctgcagactcctcactaccaacaagactcatactacttgtagctgcaatcaccttacaaactttgccgttttaatggcccacgtggaggtgaagcatagcgatgctgtgcacgatttgctgctggatgtgattacctgggtagggatccttctgagcttggtgtgtctactaatctgtattttcaccttttgcttcttcagggggttgcagtcagaccgtaacacgatacataagaatctctgcatctccctgttcgtggctgaactcttattcctgattggcattaataggacggatcagcccattgcgtgtgcagtgttcgccgccctgctgcactttttctttctggccgcgtttacctggatgtttctggagggcgtccagctgtacatcatgcttgtcgaggtcttcgaatctgaacattcaaggagaaaatatttttacctcgtaggttacggcatgcctgccctcatagtggcggtctccgcggctgtcgactatagatcctatggcacagacaaagtgtgttggctgagactggatacgtattttatatggtcctttattggaccggccacactgattatcatgttaaacgtgatttttttgggcattgctttgtataagatgttccatcataccgccatcctcaaaccggagagcgggtgcttagacaacatcaattatgaggataataggcctttcattaagtcttgggtcattggcgccattgctctgctatgtcttctgggcttgacttgggcttttggcctgatgtatatcaatgagtcaactgtgatcatggcctacttatttaccatctttaactctctacagggcatgttcatttttattttccattgtgtgttgcagaaaaaggtccgcaaagagtatgggaaatgtttgagaacgcattgctgttctggcaaaagcacagagtcctcaatcggtagtggtaaaaccagcggctccagaacacccgggcgctacagcactgggagccaaagccggatcagaaggatgtggaacgatacagtgcgtaagcagagtgagagctcatttatcactggagatatcaactcctccgccagtctgaatagagaaggcctgctgaacaatgccagggatacttcggtgatggacacgctgccgttaaatgggaaccacgggaactcatattcaatagcctccggcgaatacttgtccaattgtgtgcagataatcgataggggctataaccacaatgagacagccttggagaaaaagatcttaaaggaactcaccagcaactacatccctagttatctgaacaatcatgagaggagctccgaacagaatagaaacctgatgaataaactggtcaataacctcggcagcggaagagaggacgacgccatcgtgctcgacgacgcgacgagctttaatcatgaagaatccctggggctagagctcatccatgaggaatctgatgccccgctcctgccaccaagggtgtactccacggagaatcaccagccgcatcactatacaagaagaaggattccacaggaccactccgagagcttttttccactgctgacgaatgaacacacagaagatcttcagtctcctcacagagattcgctatacacctccatgccgactttggctggggtagctgcgacagagtctgtcacgacttcaactcagacagagcccccgcccgcaaagtgcggagatgccgaggacgtgtattacaaaagcatgcctaacttgggtagcaggaaccatgtccaccagctgcacacctactaccaactgggcagaggatcatccgatggattcatcgtgccccctaacaaggatgggactccacccgaagggtcatctaaggggcctgcgcacctagtgacgagcctgtag

SEQ ID NO: 27006 - DNA, 1125 bp, Artificial Sequence
  Description of Artificial Sequence: Synthetic coding sequence
atgcggcccggcaccgctctgcaagcagtgttgctggccgtcctgttagtgggacttcgggccgcaacgggccggctgctgtctgggcagcccgtgtgtagaggtggtacacaacggccctgctacaaggtgatttactttcacgacacctcccgccggctcaatttcgaagaagccaaagaagcgtgcaggcgcgacgggggacaactggtgagcattgaatctgaagacgaacaaaaactgatagaaaagtttattgaaaacctgcttccatctgacggcgacttttggataggtctgcgccgacgggaagagaagcaaagtaattctaccgcctgccaagacctctatgcctggactgacggaagtatttcacagttccgcaattggtatgtggacgagccatcgtgtgggtcggaggtatgtgtggtcatgtaccatcagccgagtgcccccgctggaatcggcggaccttacatgttccagtggaacgatgatagatgcaacatgaaaaataactttatttgcaaatattcggacgagaaacccgctgtgcccagtagagaggcggaaggagaggagaccgagctaacaaccccagtgcttccagaagaaacccaagaggaagacgcaaagaagaccttcaaggaatctcgggaggcggcgctgaacctggcatacattttaatcccctctattccacttctcctcctccttgtggtgacaaccgttgtgtgctgggtgtggatttgccggaagcgaaagcgagagcaacctgacccttctacaaagaaacaacatacaatttggccatctcctcatcagggaaactcccccgacctggaggtgtacaacgtgatccgcaaacagagtgaggcggatctcgcggagacgagacctgacctcaaaaatattagtttccgcgtgtgtagcggggaggccacacctgacgatatgtcatgcgactatgataacatggccgtcaacccatccgaatcaggctttgtgactcttgtgagcgtggaaagcgggttcgttaccaacgatatctatgaattttctccggaccagatgggaaggtccaaagagtccggctgggtcgagaatgaaatctatggctattag

SEQ ID NO: 27007 - DNA, 1149 bp, Artificial Sequence
  Description of Artificial Sequence: Synthetic coding sequence
atgcgacccgggaccgccctgcaggctgtgctattggcggtgctgcttgtgggcctgcgcgccgctacaggccgattgctcagtgcatctgatctggatctcagaggagggcaacctgtgtgccgaggaggcactcagcgcccatgttacaaggtgatatattttcacgacacatctaggcgactcaattttgaagaagcgaaagaagcgtgcaggcgcgatgggggccagctcgtgtcaattgaatcagaggatgagcaaaaactgatcgagaagttcatcgaaaacctgctgccaagtgatggagacttctggatcggcctgcgacggagggaggagaaacaatcaaactcaacagcctgccaggacctgtacgcatggaccgacggctccatcagccaatttcggaattggtacgtcgatgaaccatcctgcggaagtgaggtgtgcgtcgttatgtatcaccaacctagcgctccagctgggatcggcggcccctacatgtttcagtggaacgatgaccgatgtaacatgaagaacaattttatctgtaagtactccgacgagaagccagcagttcctagtcgcgaagcagagggagaggagactgagctgacaacacccgtgctacccgaagagacccaggaggaggacgccaagaaaacctttaaagaaagccgagaggcagccctgaacttagcttatattctgattccttccattccactgctgcttctgctggttgttactactgtggtgtgttgggtgtggatctgcagaaagagaaaaagggaacagccagacccatctacaaaaaagcagcacactatctggccgagcccgcatcagggcaatagcccggatcttgaggtgtataacgtgatacggaaacagagcgaagccgatctggcagagacccggccagatttaaagaacattagctttcgagtctgctccggggaagccacgcccgacgatatgtcttgcgactacgacaatatggccgtaaacccttccgagtctggatttgtgactttggtgagtgtagaatctggcttcgttacgaatgacatctacgagttcagtccagaccagatgggtcggtctaaggaaagcgggtgggtcgagaatgagatctatgggtactag

SEQ ID NO: 27008 - DNA, 690 bp, Artificial Sequence
  Description of Artificial Sequence: Synthetic coding sequence
atggttacgtctggccttggaagcggaggagtgcggcggaacaaagctatcgcccagcccgcacggacatttatgctgggcctcatggcagcctaccacaatcttgagaagcccgccgtgccttcacgcgaagccgaaggggaagagaccgaactcacaacacccgttttgccggaagaaacacaggaagaggacgctaagaaaaccttcaaggagtcgcgcgaggccgcccttaatctggcatatattctgatacctagtatacccttactgctgctgttagttgtcaccaccgtggtttgttgggtgtggatatgtcgtaaacggaagcgtgaacagcccgatccctccacgaagaaacagcatactatctggccatccccccaccaaggcaactcaccggatctcgaagtgtataatgttattcggaagcagagtgaagcagacttggctgaaacacgcccagaccttaaaaatatcagcttccgtgtatgttccggagaagctacaccggacgatatgagttgcgattacgataacatggctgtgaatcccagcgagagcggatttgtcacacttgtgtccgtcgagtccggctttgtgacaaatgatatttacgagtttagtccagaccaaatgggccggagcaaagaaagcggctgggtggagaatgagatttatggctactag

SEQ ID NO: 27009 - DNA, 1014 bp, Artificial Sequence
  Description of Artificial Sequence: Synthetic coding sequence
atgcgccccggtacggccctacaggctgtgcttctggctgtcttgctggtgggcttgcgagcggctactggccggctgctgagcgggcaaccggtgtgtcggggcggaacacagagaccatgttacaaggtgatctacttccacgacaccagtcggagactcaacttcgaggaggccaaagaggcctgtcgtcgtcgagaagagaagcagtcaaattcaacagcctgtcaggatctgtacgcttggacagacgggtctatttcccaatttagaaattggtacgtcgacgagccctcctgtgggtctgaggtctgcgtcgtgatgtatcatcaaccatctgcgcctgcaggcattggaggcccatacatgttccagtggaacgacgaccggtgtaatatgaagaataatttcatctgcaaatacagcgatgagaagcctgcagtgccgagccgggaggcagaaggtgaggaaaccgagcttactacccccgttctgccggaggagacccaggaggaagacgccaaaaagacttttaaggagtctcgagaagccgccctgaacctagcttatatcctgatcccgagcattccgctcctcttactccttgttgtgaccaccgttgtgtgctgggtctggatttgccggaagagaaaacgtgagcaaccagacccttccacgaaaaagcagcatactatttggccaagcccacaccaaggcaatagtcccgacctggaggtttataacgttataaggaaacaatccgaggccgacctcgcagaaaccagacctgatctcaaaaacattagctttagggtctgctccggcgaggctacccccgatgatatgtcatgtgactatgataatatggcagtgaacccttccgaatccgggttcgtgactctggtgagtgttgagagcggtttcgtgactaacgatatttatgagtttagtccggaccagatgggccggtccaaggaatcaggatgggtggaaaacgagatctacggctactag

SEQ ID NO: 27010 - DNA, 405 bp, Artificial Sequence
  Description of Artificial Sequence: Synthetic coding sequence
atgaggcctggcaccgccctgcaggccgtgcttctagcagtcctgcttgttggactaagggctgcgacgggccgcttgctatccggacagcctgtgtgtcgaggcgggactcagcggccctgttataaggtgatctattttcacgatacatcccgcagactcaatttcgaggaggcaaaagaagcctgccgcagagatggcggccagttggtttctatcgagtccgaggacgagcagaagctcattgaaaaattcatcgagaacctgttgcccagcgacggtgatttctggatcgggctgcggcgccgcgaggagaagcagtccaactctacagcctgtcaggatttatacgcttggacagacgggtccatttctcagttcagggagacgtcttcctcattctag

SEQ ID NO: 27011 - DNA, 1071 bp, Artificial Sequence
  Description of Artificial Sequence: Synthetic coding sequence
atggcggccgagggctggatctggagatggggctgggggcgaaggtgcctgggtcgtcctgggctcttaggccccgggcctgggcccaccaccccccttttcttgctgctgctcctgggctctgtgaccgcagatatcaccgatggcaactctgaacacctgaagcgcgagcactctctgatcaagccataccagggcgtgggatcgagtagtatgccgttgtgggactttcaggggagtacaatgttgacaagccagtacgtgcggcttacgcccgatgaaaggtccaaagaagggtcaatctggaatcaccagccatgctttcttaaagactgggagatgcatgttcactttaaggtccacgggaccgggaagaaaaacctacatggcgatgggattgccctttggtacacacgcgatagactcgtgcctggcccagtgttcggttctaaagacaatttccatgggctggctatctttctcgacacctatccgaacgacgagaccaccgagcgtgtgtttccttatatctcagtcatggtcaataatggcagccttagttacgatcactcgaaagatggtcggtggaccgagctggcgggatgtaccgccgatttccggaaccgcgaccatgacacttttctggctgttaggtactcaaggggacggctcaccgttatgacggatctggaggataagaatgagtggaaaaattgcattgatattacaggggtgagacttcctactggctattactttggcgctagtgcagggaccggggatttgtccgataaccacgatatcatctccatgaaactcttccaactcatggtggagcataccccggatgaggagagtatcgactggactaagattgaacccagcgttaatttcctgaagagtccaaaggacaacgtcgacgaccctacaggcaatttcaggtccggtcctctgacaggttggcgggtgttcctccttctcctatgcgccctgctggggattgtggtgtgcgccgtcgttggggccgtggtcttccagaagcggcaggagcgaaacaaacgcttctactag

SEQ ID NO: 27012 - DNA, 858 bp, Artificial Sequence
  Description of Artificial Sequence: Synthetic coding sequence
atgccgctgtgggatttccaaggctccactatgttaacctctcaatatgttaggctgacccccgacgagcgcagcaaggagggtagcatttggaatcaccagccctgcttccttaaagattgggagatgcacgtgcattttaaggttcacggaacggggaaaaagaatctgcatggagatggaatcgccctctggtatacaagggatcgcttggtccccggacctgtgttcggatcaaaagacaacttccacggtctcgccattttcttggatacctaccccaacgacgagactaccgaacgggtgtttccgtatatcagcgtgatggtgaataatggctctctgtcctacgatcactctaaagacgggagatggacagagctggcagggtgcaccgccgacttccgtaaccgcgaccatgacactttcctcgccgtgagatacagtagaggacggttgaccgtgatgacagacctggaagataaaaacgagtggaagaactgcattgatattaccggagtccgacttcctaccgggtattattttggcgcctctgcaggcactggcgatttaagtgataatcacgatatcatctccatgaagctgttccaacttatggtagagcacacaccagatgaggagagtattgactggacaaagattgaacctagtgtgaatttcctaaagagccccaaggataatgtagatgatccaactggaaacttccggtctggaccgttgactggctggcgggtcttcctcctgctgctctgcgcccttctgggtatcgtcgtctgtgccgtggtcggagccgtggttttccagaaacggcaggagagaaataagcgtttctactag

SEQ ID NO: 27013 - DNA, 1047 bp, Artificial Sequence
  Description of Artificial Sequence: Synthetic coding sequence
atggcggccacactaggcccgctcggctcatggcagcaatggagaaggtgcctgtctgcacgggatggctcccggatgcttcttctcctgttgcttcttgggtctggacagggtccacagcaggtgggggcaggccagacttttgagtatctgaagcgcgaacactctctgtctaaaccctatcaaggcgtcggaacgggttcttccagcctttggaatctgatggggaatgccatggttatgacccagtacattagactcactcccgatatgcagtccaaacaaggcgcactttggaaccgcgttccttgttttctgagggattgggaactgcaggttcattttaaaatccacggccagggaaagaaaaacctacatggagatggcctcgcgatctggtatactaaggaccggatgcagcccggcccagtattcggtaatatggacaaatttgtggggctgggagtgtttgttgatacttatcctaacgaggaaaagcagcaggagagggttttcccttacatttcagccatggtgaataatggatctctctcctacgatcacgaacgagatgggcggcctacggaactgggaggctgtacagcaatagttcggaatctccactacgacaccttcctcgtcatcagatatgtgaagcgccaccttacaatcatgatggatatcgatggcaagcatgaatggagggattgcatcgaggtcccaggtgtcaggctgcccaggggatactacttcggcacttcgagtattaccggcgatctgtctgacaaccacgacgttataagcctcaagctgttcgaactcactgtggaaagaaccccggaggaggaaaaattgcacagagatgtattcctgccatctgtcgataacatgaagttaccggaaatgaccgccccactgcccccgctatcaggactcgcactgtttttaattgtatttttctcactggtcttcagcgtgttcgcgatcgtaatcggaatcattctgtacaacaaatggcaagaacagagccgtaaacgcttttactag

SEQ ID NO: 27014 - DNA, 1080 bp, Artificial Sequence
  Description of Artificial Sequence: Synthetic coding sequence
atggccgcaactctgggacccctggggagctggcagcagtggaggcgatgcctttctgcccgggacggatcgagaatgttgctgcttcttctcctgctgggatctgggcaaggaccacagcaagtgggggcaggccagacattcgagtacttgaaacgcgagcactccctgtctaaaccatatcagggcgtaggaacaggcagttcctctctgtggaatcttatgggaaacgccatggtcatgactcagtacattaggctcacccctgacatgcaaagtaagcagggagccctttggaaccgcgtcccatgttttctgagggactgggaactccaggtgcactttaaaatacatgggcagggaaagaagaatttacatggcgatggcttagctatctggtatacgaaggatagaatgcagccaggccccgtcttcgggaatatggacaagtttgtggggttgggtgtgttcgtggatacctaccctaatgaggaaaaacaacaggaggcgcagaaaagaagatactccccaggcgtgcagcgcgtcttcccatacatttcagccatggtcaacaacggctccctgagctatgaccacgaaagagacggtcgccccacggagctgggggggtgcaccgccattgttcgaaacttgcattacgacaccttcttggtgattcggtatgtcaagcggcatctaaccattatgatggacatcgatggtaaacacgaatggcgagactgtattgaggtccccggggtgcgcctgccccgtggctattacttcgggacatcaagcattacgggtgaccttagcgataatcatgatgtgatcagccttaagctatttgaactcaccgtggagagaactccagaggaggaaaagttgcaccgtgatgttttcctaccgtcagtggataacatgaaacttcccgagatgaccgcaccactccccccactttctggtctcgccctttttcttatagtgtttttctccctggtgttttccgtgttcgccattgtgattgggattatcctctacaataaatggcaggaacagagccgaaaacggttttattag

SEQ ID NO: 27015 - DNA, 645 bp, Artificial Sequence
  Description of Artificial Sequence: Synthetic coding sequence
atggataaagaacgaaggatatgtatggggatggcttggcagagcggtacacagcgcattggttgttcacaggcccaaaaacgtagatactctcctggagttcagcgtgtgttcccctatattagcgcgatggttaataatggctcgttgagctatgatcatgaaagggacggtcgaccaactgaacttggcgggtgtacggccatcgtgcgcaatcttcattacgatacattcttagtgatacgttacgtcaaacgacacctaacaattatgatggatatcgacggcaaacacgagtggcgggattgtattgaggtcccgggcgtgagactgccaaggggatactatttcggaactagctccattacaggggacttatcggacaaccacgacgtaatttccctcaagcttttcgagttaactgtagaacggacgcctgaggaggaaaagctgcatagagatgtgttcctgccttcggtggacaacatgaaactccctgagatgaccgccccgctgcctccactgtcaggtcttgctctgtttctgatcgttttcttttctctagtgttttccgtcttcgccatagttataggaataattctttacaacaaatggcaggagcaatcaagaaagaggttttactag

SEQ ID NO: 27016 - DNA, 612 bp, Artificial Sequence
  Description of Artificial Sequence: Synthetic coding sequence
atggataaggagcgaagaatttgtatggggatggcttggcagagcggcactcaacggatcggttgttcccagcgcgtttttccatacattagcgccatggtgaacaatggaagtttgtcttatgatcatgagcgcgatgggcgccctacagagctgggcggatgtacagccattgtccgcaacctccactatgacacttttctggtgattcggtatgttaagagacacttaacgatcatgatggacattgacggtaaacatgagtggagagattgtatcgaagtacccggagttcgcctccctcgtgggtactattttgggacaagttcaatcactggcgacttatctgacaatcatgatgtgattagcttaaaactgtttgaactgacggtcgagagaactccggaagaagagaagctacatcgtgacgtgtttctgccttctgtcgacaacatgaaacttcccgagatgaccgcccccttgcctccactcagcgggctagctctgtttctgattgtatttttcagcctggtgtttagcgtatttgccattgtgatcggcatcatcctctacaacaaatggcaggagcagtcacggaagagattctactag

SEQ ID NO: 27017 - DNA, 633 bp, Artificial Sequence
  Description of Artificial Sequence: Synthetic coding sequence
atgcagcccgggcctgtattcggtaacatggacaaattcgtagggttaggcgtctttgtagatacctacccgaacgaagaaaaacagcaagagagggtgtttccgtatatctctgctatggtgaacaacggatccctcagctacgatcacgagagggatgggcgtcccacagagttaggcggctgcacggccattgtgagaaatttacattatgataccttcctcgtgatacgctacgtgaagaggcatctgaccattatgatggatattgacggcaagcacgagtggagggactgtatcgaggtacctggggtaaggctcccacggggctattattttgggacctcatctattaccggtgacttgtccgataaccatgatgtgatctctcttaagctgtttgaattaaccgtcgagcgaaccccagaggaggaaaaattacatcgcgatgtctttctgccgtccgttgacaacatgaagctgccagagatgaccgccccgttgccaccgctgtccggactagctcttttcctcattgtcttttttagtcttgtgttttccgtctttgcgattgttatcggaatcattctttacaataagtggcaggagcagtctagaaagcggttctattag

SEQ ID NO: 27018 - DNA, 1581 bp, Artificial Sequence
  Description of Artificial Sequence: Synthetic coding sequence
atgcccgcggtgtccggacctggtccactgttctgtctcctgttgctcttgctggatccgcactctcccgaaacagggtgccctcctctgaggcgatttgagtataaactttcgttcaaaggaccaagattggcccttcccggcgcaggcatcccattttggagtcatcatggagatgctatactgggactggaggaggtgaggctcaccccgagtatgcgtaacaggtccggggcagtgtggtcaagggcttccgttcccttcagcgcttgggaggttgaggttcagatgcgggtaacgggacttgggcggcggggggcgcaaggcatggccgtctggtatactaggggcaggggccatgtgggttcagtgctcgggggtttggcctcgtgggatggaattggtatcttctttgatagcccagccgaggacacccaggactctccagccatccgcgttcttgcttcagacggtcacatcccttctgagcagccaggggacggtgcttcccaaggactcggttcttgccactgggatttccgtaacaggccacacccttttcgggcccgcattacctattgggggcagagactgcgaatgagtctgaattcagggttaactccctcagaccccggagagttttgcgtcgatgtcggccccctactgctggtgccggggggcttttttggggtgtccgctgcaacaggtacgctggctgacgatcacgacgttttgtccttcctgaccttctctcttagtgaaccttcacctgaagtgccccctcagcctttcctggagatgcagcagttgcggctggctcgccagctggaggggctttgggctcgcctgggcctcggcactcgggaagacgtcactccgaagtctgattcagaggctcagggtgagggggagaggcttttcgatctggaggagacccttggtcggcatcggcgtatcctgcaggctctgaggggcctgtcgaaacaactggcacaggccgagaggcaatggaaaaagcagctgggtccacctggacaggctaggcctgatggcggctgggcactggacgcaagctgccaaataccgagcacccccggccggggcggccatctgtccatgagtctaaacaaggacagtgcaaaggtgggtgcactgttacatgggcagtggaccctgctgcaggccttgcaagagatgcgcgacgccgccgttagaatggcagctgaagcccaggtgtcctatttaccggtcggcattgaacatcacttcctggaattggatcatatattaggtctgctgcaggaggaactccggggacccgcaaaggcagcagcaaaggcgccaagaccccccggtcagcccccccgggcatcaagctgccttcagcctggaatcttcctgttttatctcttaatccagacagtgggcttcttcgggtatgtccactttcgacaggaacttaacaagtcattacaggaatgtctgagcaccggatcacttcccctgggccccgcgccacacactcctcgggccctggggatccttaggcgccagcctttacctgcctccatgcccgcctag

SEQ ID NO: 27019 - DNA, 1545 bp, Artificial Sequence
  Description of Artificial Sequence: Synthetic coding sequence
atgcccgcagtctcaggcccgggacccctgttttgcctcctgctgttactgcttgatcctcatagccctgagacaggatgcccccctctccgcaggtttgagtacaaactgtctttcaagggcccacggcttgctttgcctggagccgggattccattttggtcccatcatggcgatgccatccttgggctggaggaggtaagattgaccccgtcgatgcggaaccgatcgggtgccgtgtggagccgtgcttccgtcccattctcagcgtgggaagtcgaggtgcaaatgagagtgaccggccttggaagacgcggggcccagggaatggccgtttggtatacacgaggtcgtggacacgtgggctccgttttagggggcctcgcctcctgggacgggatcggaattttttttgacagcccggcagaggatactcaggattcaccagctataagggtgttggcctctgatggacacatcccaagcgaacagccgggagacggcgcttcccaaggcctcggatcatgccactgggactttagaaaccggccccaccccttccgggccaggataacatactggggccagcgactccgaatgtcattgaatagcgggctgaccccatctgatcccggtgagttttgtgttgatgttgggccactgctcctggttcccggagggttcttcggggtgtcagctgctacaggtaccctggccggagaagatcccacaggacaggttcccccccagccattcttagagatgcaacagctcagactcgctaggcaactggaaggactttgggcccgtcttggtcttgggacccgagaggatgtgaccccaaagtccgatagcgaggcacagggggaaggtgagcggctgtttgatctggaagaaacactgggtcggcataggcgcattctccaggcactccgggggttaagcaagcagttggctcaggcagaacggcagtggaagaagcagctggggccgcctgggcaagcacggcccgatggagggtgggctctcgacgcatcatgccagatcccctcaactcccgggagaggcggccacttgtctatgagtctgaacaaggattcggctaaggtaggagccctgctgcatggtcagtggacattgctgcaggcactccaggaaatgcgcgatgccgccgtgagaatggctgctgaggctcaggtgtcctacctgccggttgggatcgaacaccacttcttggagcttgatcatattttgggcctcctacaggaggagctccgcggcccagcaaaggcggcagcaaaggccccaagacccccagggcagccaccccgcgcttcctcttgtctacaacctggcattttcctcttttacctactgatccaaacagtgggcttttttggctacgtgcacttccggcaggagctgaataagagtctccaagagtgtctctctacagggtcccttcccctaggccccgctccgcacacgccccgggctttaggcattttgcgaagacagcccctgccagccagcatgcctgcctag

SEQ ID NO: 27020 - DNA, 435 bp, Artificial Sequence
  Description of Artificial Sequence: Synthetic coding sequence
atgcgcaaccgttctggtgcagtttggtcaagagccagcgtgccattttcggcttgggaggttgaggtgcaaatgagggttacagggttgggaagaaggggagcccagggtatggacagtccggcaataagggtgctggctagcgacggtcacattcccagcgaacagcccggggatggggcctcacaggggctcggcagttgccactgggatttccggaacaggcctcatccattccgcgcccgcatcacctactggggtcaacggttacggatgagcctgaactccggtctgactcctagcgatcccggtgaattctgcgttgacgtgggcccccttctcttagtacccggaggctttttcggtgtctcagccgcaactggcaccttggcaggcgaagaccccacaggccaggtccgggcggaaggacagtag

SEQ ID NO: 27021 - DNA, 204 bp, Artificial Sequence
  Description of Artificial Sequence: Synthetic coding sequence
atggtggacgtgaagtgtctgagcgattgcaagttacagaatcaactggaaaagcttgggttcagccctgggccaattctgcgtggactgcaggagcaccaggcccccgagtcccacatgggactaagtcccaagagagaaacaacagcccggaaaactagactctcgcgggcgggagaaaagaaagtgtcgcagtgggcctag

SEQ ID NO: 27022 - DNA, 423 bp, Artificial Sequence
  Description of Artificial Sequence: Synthetic coding sequence
atggtggatgtgaagtgtctatctgattgcaaactgcaaaatcagcttgaaaagctcgggttctcgcccggtccgatcctgcaactaaatatcatcctgcaaggcaacattattctaagtactgaaaaaagtaagaaactgaagaagtggcccgaggcctctacaaccaaaagaaaggcagtcgatacatactgtctggattataagccttcaaaaggtcgcaggtgggccgcccgtgccccaagcacccgcatcacctacggcacaatcaccaaggagagagactattgcgctgaggatcagactattgagagctggagggaagagggctttcctgtagggcttaagttggcggtcctgggtattttcatcattgtggtgttcgtgtacctaacagtggagaataagagcctcttcggttag

SEQ ID NO: 27023 - DNA, 423 bp, Artificial Sequence
  Description of Artificial Sequence: Synthetic coding sequence
atggtggatgtaaagtgcctgtccgattgcaaactccagaatcaactcgagaagctcggctttagccctggaccgatccttcagctgaatatcatcctccaaggtaacataatcttaagtacagaaaaaagcaaaaagctgaaaaagtggcccgaagccagcaccaccaaacgaaaggcggtcgatacttattgtctcgactacaagccttccaaggggaggagatgggccgcaagggccccctctactcgtatcacttacggcacgataaccaaggagcgcgactattgcgctgaggaccagacgattgagtcctggcgcgaggaaggctttcctgtgggactaaaacttgctgtcctaggaatctttatcatcgtggtgtttgtatatcttaccgtggaaaacaagtccctgttcggatag

SEQ ID NO: 27024 - DNA, 546 bp, Artificial Sequence
  Description of Artificial Sequence: Synthetic coding sequence
atggtggacgtgaagtgcctgtccgactgtaaattgcagaaccagctcgagaaactgggcttctcaccaggaccaatcctgcccagcactcggaagctttacgagaagaaactcgtgcaactgctggtgagtcccccttgcgctcctcctgtgatgaacggaccacgggaacttgatggggcccaggattccgatgattctgaggagctgaacatcattctgcaggggaatattatcctgtctacagagaagagcaaaaaattgaaaaagtggcccgaagcaagcactactaagagaaaggcggttgatacttactgcctcgattacaaacccagcaaaggacgccgttgggcagccagggccccaagcaccaggattacctacggtaccatcaccaaagagcgggattactgcgccgaagatcagaccattgagagctggcgggaggagggattcccagtcggcctgaaactcgctgttttgggaattttcatcatcgttgtgttcgtctacctgacagttgaaaataaaagtctctttggatag

SEQ ID NO: 27025 - DNA, 327 bp, Artificial Sequence
  Description of Artificial Sequence: Synthetic coding sequence
atggtagacgtcaagtgcctgtcagactgtaagctgcaaaatcagctggagaagttaggcttctcaccagggcctattctaccatccactcgaaagctgtacgaaaagaagttggtgcagctgctggtgtcaccgccctgtgccccccctgtgatgaatgggcctcgcgaactggatggcgcccaggactctgatgattccgagggcggattgcaggagcaccaagcccccgaatcacacatgggtctctcacccaaacgcgaaactacagcaaggaagactcggctgtccagagctggcgagaagaaggtatcacaatgggcctag

SEQ ID NO: 27026 - DNA, 327 bp, Artificial Sequence
  Description of Artificial Sequence: Synthetic coding sequence
atggtggatgttaagtgcctgtcagattgcaagctgcagaaccagctcgagaaactgggcttcagtccagggccgatcctcccaagcactcgaaaattgtatgagaagaagctcgtccagctgctggtttctccaccatgcgctccacccgtaatgaacggaccacgtgagctggatggcgctcaggattccgacgactccgagggcggactccaggagcatcaggcccccgagtctcacatgggcctgtctccgaagagagagaccacagctagaaaaacccggctctccagagcgggcgagaaaaaagtcagccaatgggcatag

SEQ ID NO: 27027 - DNA, 1512 bp, Artificial Sequence
  Description of Artificial Sequence: Synthetic coding sequence
atggccggcctgtcggatctcgagttgaggagggagcttcaggcactaggtttccagcccggacctattaccgataccacgagggacgtttaccgcaataagctgagaagactgcgaggcgaggcgaggctgagggacgaggaacgtctgcgggaggaggcaagaccccggggggaagagcgcctgagggaagaggcccggttacgtgaagatgctccactgcgcgcgcgtcccgctgctgcttcaccccgggccgagccttggctcagtcaacccgcttctggcagcgcttatgctacccctggagcctatggcgacataaggccttcagctgcatcttgggtaggatctaggggccttgcataccccgcacgccctgctcaattgcgccggcgggccagcgtaagagggagtagcgaggaagacgaagatgcccgcactccagacagggcaacgcagggaccaggcttggctgcccggagatggtgggccgcctcgcccgcgcctgcgcgcctcccctccagccttctgggtcccgatccacgcccaggcctccgggcaactcgggcgggtcctgccggagcagctagggcacgacccgaggttggccgcagactcgaacgttggctgtcccgcctgttgctgtgggcaagtctgggcctgctgctcgtgtttctgggcatcttatgggtgaaaatggggaagccctcagccccgcaggaggcagaggataatatgaagctgttaccagtggattgtgaacgcaaaacagacgaattttgccaggccaaacagaaggcagccctgctggagttactgcatgagctctataattttctcgcgatacaggcaggcaattttgagtgcggcaacccagaaaacctgaaaagtaaatgtattcctgttatggaagcccaggagtacatagccaacgtgaccagctcttcctcagccaaatttgaagccgcccttacttggattctctcgagtaacaaagacgtgggcatatggctgaaaggcgaggaccagagtgagttagtgacaacggtcgataaggtagtgtgtttggagagcgcccatccacgaatgggagtgggctgcaggctatcacgcgcgctgttaaccgccgtcaccaacgtgctgatctttttctggtgcttggccttcctttgggggctcctcatcctactgaaataccggtggaggaaactggaggaggaagaacaagctatgtatgagatggtgaaaaagatcatcgatgtggtacaggaccattacgttgactgggaacaagatatggagcgatacccctacgtcgggatcttgcacgtgcgggattcactgataccccctcaaagtagacgaaggatgaaacgggtgtgggatagagctgtagagtttcttgcctcgaatgagtcccggatccagaccgaatcccacagggtcgcgggggaggacatgctggtgtggcggtggacaaaaccaagttctttttctgattccgaacggtag

SEQ ID NO: 27028 - DNA, 606 bp, Artificial Sequence
  Description of Artificial Sequence: Synthetic coding sequence
atggaggcccaagagtacatcgccaacgtgaccagcagctcatcagccaaattcgaagctgcactgacttggattttatcaagcaacaaggatgttggcatctggctcaaaggggaggaccagtccgagctcgtcaccactgtggataaggtagtgtgtctggagagtgcccaccctcggatgggagtcgggtgccgcctctctcgggcactgctaaccgccgtgacaaacgtccttatatttttttggtgccttgcattcttgtgggggttactcatcctgctcaagtacaggtggcgcaagctggaggaggaagaacaggctatgtatgagatggttaaaaaaatcatcgatgtagtacaagatcattacgtggactgggaacaggacatggagagatatccctatgtgggaattcttcacgtaagagattcattgatccccccacagtcccggcggcggatgaagcgcgtgtgggatcgggcggtggagtttctagcttcgaacgagtctcgcatccaaactgagtcccacagggtagccggtgaggatatgcttgtgtggcgatggacaaagcctagctctttttccgacagcgaacggtag

SEQ ID NO: 27029 - DNA, 165 bp, Artificial Sequence
  Description of Artificial Sequence: Synthetic coding sequence
atggaggcacaggaatacatcgcgaatgtcacctcatcatcctccgccaagttcgaagcagcacttacatggattctgagcagtaacaaggacgtgggaatctggctgaagggcgaggaccagagcgaactcgtaactaccgtagacaaggtggtctgcttgtag

SEQ ID NO: 27030 - DNA, 4470 bp, Artificial Sequence
  Description of Artificial Sequence: Synthetic coding sequence
atgcgccaagtgctgtggctttgcaatgtgtgcgtcacggctagagagacacgccatcacctccacctgccagcaattctggacaagatgcccgcaccaggcgctctcatcctcctcgctgcagtttctgcatccgggtgcctcgctagtccggcccatcccgatggatttgcactgggtagagctccccttgctcctccttatgccgtggtgttaatcagttgctccgggttgctggcttttattttcttactgctcacgtgtctttgctgtaaaagaggcgacgtcggctttaaagaattcgaaaatccagaaggggaagattgctccggggagtacactccccccgcggaagaaaccagctcctcacagtccctgccagacgtgtatattctgccccttgcagaggtcagtcttcctatgcccgccccacagcctagccacagtgatatgaccacgccccttgggttgtctaggcagcacctttcgtatcttcaggagattggcagcgggtggttcggcaaggttatactcggagagatcttcagtgactataccccagctcaggtggtcgtgaaggagctccgcgctagcgctggacccctggaacagcgaaaatttatcagtgaagcacagccatatcggtcactgcagcatccgaatgtcctacaatgccttggtctttgtgtggaaaccttgcccttcctacttattatggaattttgtcaattaggagacttgaagagatatctacgagcgcagaggccgccagaaggcctgagcccagaactgccaccccgagacctccgaacactccagcggatgggacttgaaatagcgaggggactcgcacatctgcacagccataattatgttcacagcgatctcgcactgagaaactgcctactgacctctgatctcacagttcgcattggtgactatggactggcacattccaattataaagaggattactatctcacccccgaacgtctgtggatccccctcagatgggccgctccagaactgttgggggagcttcatggaactttcatggtcgtcgaccagtcaagggagtcaaatatctggagcctcggagtgacgttgtgggaactgtttgaatttggagcccagccctatcgtcacctgtccgacgaggaagtgcttgcattcgtcgtgaggcagcagcacgtgaagctggcgcgacccagactcaaactgccttatgcagactactggtatgatatcctacagtcttgctggagaccgcccgctcagcggcccagtgctagtgacctccagctgcagctgacataccttctcagtgagcggcctccgcgcccccccccaccccccccaccccctagagatggcccttttccctggccgtggcccccggcgcattccgcaccccgacccggtactctgagcagtccgtttcctctcctggatggctttccaggcgcagatccagacgatgtactcacagttacagagtcctcccgtggtttgaaccttgaatgcctgtgggagaaagccaggcgaggtgctggaagggggggaggcgctcccgcttggcagcccgcgtctgccccccctgcaccacacgccaaccctagtaatccattctatgaggcgctttccacccctagtgtcctgcctgttatcagtgctcgaagccccagtgtgtcctctgaatactacattaggctagaggagcatggcagcccaccagagccacttttccctaacgactgggacccgttggaccctggagtccctgccccccaagctccacaggcaccgtccgaagtaccacagctcgtctctgaaacttgggcgtcacccctgtttccggcccccaggccattccccgctcaaagttctgcctccggttccttcctgctttccggatgggatccggagggacggggagcgggtgagaccctggctggagatcctgctgaagtattaggggagcggggcactgccccctgggtggaggaagaagaggaagaagaggaggggagcagccctggtgaggactcttcctccctgggtgggggtccaagccgacgggggcccctgccgtgccctctatgctctcgggagggggcatgtagctgcctgcctcttgaaagaggagacgccgtagctggttggggaggacacccggcgctcggctgccctcaccctcccgaagacgattcttctcttcgagctgagcgcggctctctggcggatctaccaatggctcctcctgccagcgctccccccgagtttctggatccgctgatgggggccgcggcgcctcagtaccccggcaggggccctcctccagcaccccccccccctcccccaccgccccgggcacccgctgatccagcggccagtccagaccctccatctgccgtcgcttcaccaggcagcgggctgagcagccccgggccaaaaccgggggattctggctatgagaccgagacccctttctcacccgagggcgcctttcctggcggaggcgctgcagaggaggagggagtaccccggccccgcgctccccctgagccacctgacccaggggccccccgccctcctcctgatcctggtcctctccctttacctggtcctagggagaaaccgacttttgtcgtgcaggtgtcaacagaacagctgctcatgtctctccgagaggatgtgacgaggaacctgcttggcgagaagggggccacagccagggagactggcccccggaaagccggccgcggcccgggcaacagagagaaagtcccaggtctgaacagagaccctacagttttgggtaacgggaagcaggcgcctagcttaagcctacccgtcaacggggtgaccgtccttgagaacggggaccagcgtgccccaggcatcgaggagaaagctgccgaaaacggcgctctgggttctccagaacgtgaggaaaaagtcttagagaacggcgagctgaccccaccccggagagaggagaaagcactggaaaatggcgaactccgatcaccggaagccggagagaaggtgttggtgaatggtgggctgacccctccaaagagtgaggataaggtgtctgagaatggtggcctgaggttcccccggaacaccgaacgcccacctgaaacaggcccatggagagcccctgggccctgggagaagacacctgagtcttggggccccgccccaacaattggagagccagcccccgagacttctctcgaaagagctccagctccatctgccgtggtatcctccaggaatggaggcgagaccgcacctggacctcttggtccagcccctaaaaatgggacactggaacccggcacagagcgtcgggccccagagacgggaggggcaccccgagcccccggtgcagggcgattggatctcgggtcagggggcagagcacccgttggcacaggaactgcccctggcggcggaccaggctctggtgtggatgcaaaggcgggctgggtcgacaatacgcggcctcaaccccctcctccgccactcccccctccccctgaggcacagcccagaaggctggaacctgccccaccccgggcacggcccgaggttgccccagagggagagccaggcgcacccgatagccgagccggtggagacactgccttatccggagatggggacccaccaaagccggagcggaaagggcccgagatgccaagactatttttagacctggggccacctcaagggaactccgagcagataaaagcccgcctctctaggctctcactggctctgccaccactaaccctcacaccgtttccaggcccgggtccacgaaggcctccttgggaaggcgccgacgccggggcagccggcggcgaggctggcggagccggcgctcctggccccgccgaggaagatggggaagacgaggatgaggacgaggaggaggatgaagaggcggctgcccctggagccgcagccggacctcggggtcccgggcgtgccagggcggcacctgttcccgttgtagtgtccagtgcagatgcagacgccgctcgccccttgaggggcctcctgaagtccccgaggggagcagacgagcccgaggatagcgagctggagcgcaagagaaaaatggtctcctttcatggcgatgttacagtatacctgttcgatcaagaaacccctactaatgaactgtcggtgcaggccccgcccgaaggagataccgacccctccacacctcccgctccaccaacgccaccacaccccgctacccccggggatggctttccatccaatgatagtgggttcggcggctccttcgagtgggccgaggattttcccctgctacccccccccggacccccactctgcttctcgagattttcagtgagcccggctctggaaacaccggggccgcctgcgcgggcccccgacgctagacccgccggcccagtggaaaattag

SEQ ID NO: 27031 - DNA, 1656 bp, Artificial Sequence
  Description of Artificial Sequence: Synthetic coding sequence
atgcacctgcagatgcgggaggacatggccaaatacagaaggatgagcggcgttcggcctcagtcctttagggatctggaaactcctcctcactgggcagcatacgacaccggactggaattgctggggagacaagaggccgggctggccctcccgcggcttgaagaggccttgcagggaagcttggcacagatggagtcgtgtagggctgactgcgaggggcctgaggagcagcaaggtgccgaggaggaagaggatggcgccgccagccagggaggcctgtacgaggctatcgctgggcattggattcaagtgctgcagtgccgccaaaggtgtgtcggcgagacagctactcggcctggccggtcttttcctgtccccgacttcctgccaaatcaattgaggagacttcatgaggctcacgctcaggtgggcaacctgtctcaagccatcgagaatgttctgtctgtcctgttattctaccccgaggacgaggctgcgaagcgcgcccttaatcagtaccaggcacagctgggcgaaccaaggcccgggctgggccccagggaggatatccaaagattcatactgcgttccctgggagaaaagcgtcaactctactatgccatggaacacctgggaacgtccttcaaagaccctgatccatggacacccgctgctttgatacccgaggctctgcgagagaagcttcgcgaggaccaggaaaagaggccatgggaccacgaacccgtaaagccgaagcctctgacttattggaaggacgtactgttactggagggggttacattaactcaggacagccgacagctgaatggttcagaacgggctgttctggacggacttctgacccctgctgaatgcggcgtcctactgcaattagcaaaggatgccgctggcgctggggccagatccggatacagggggaggcgcagtccacatacacctcatgagcgatttgaagggctcacggtcctcaaagcagcacaactcgcccgtgctggaacagtgggatcgcagggcgccaaattattgttggaagtgagcgaaagagtgcggactctgacacaggcttatttctcgccggagcggccactgcatctttcatttactcacctggtatgccggtccgccatagagggagagcaggaacagcggatggacctgtcacatcctgtgcacgccgataactgcgtacttgatcccgatacaggcgaatgctggagggaaccccccgcctacacatatagggattattctgggctgttgtatctgaatgacgacttccaaggtggtgatctcttttttaccgagcccaacgcacttacggttaccgcccgggtgcgaccacgctgcgggcgcctggtggcattttcttctggtgtcgaaaatccacatggcgtctgggcagtgacaagagggcgaaggtgtgccttggcactgtggcatacttgggcaccggagcatagagaacaggagtggatcgaggccaaggagctgttacaggaaagccaggaagaagaagaggaggaggaggaagagatgccttcaaaagacccctcgccagaaccccctagtagacgacaccagcgagttcaggacaaaactggcagagccccgcgcgtgcgtgaagaattatag

SEQ ID NO: 27032 - DNA, 2208 bp, Artificial Sequence
  Description of Artificial Sequence: Synthetic coding sequence
atgctcagactgctccgcccattgttgctgttattgcttctgccacctccagggtcccccgagcccccaggtctgacccaactgtcacccggggccccccctcaggccccagacttactgtacgctgatggccttcgcgcctatgcagcgggcgcatgggcgccagctgttgcactgttaagagaggccttgagatcgcaggcagccctgggtcgggtgcgactggactgcggcgcaagctgtgcagccgacccaggcgctgcgctgcctgccgtgcttttaggtgctccagagcccgatagtggccctgggcccacgcagggtagctgggagcgccagcttctgcgggcagctctaaggagagccgactgcctaacccagtgtgccgcccggagactgggccctgggggggccgctagacgagtcggatctgctttgagagacgcttttcgccggcgagaaccgtacaactatctgcagcgggcatactaccagcttaaaaagttagacctggctgcggcagccgcacacactttttttgtggccaatcctatgcatttgcagatgcgggaggacatggctaagtacagacgcatgagtggggtgcgccctcaatctttccgcgatttggaaacaccccctcactgggcagcatatgatacggggctggagctgttgggccgccaggaagccggactggctttaccccgattggaagaagcactgcaaggtagtttggcacagatggaaagttgccgggcagactgcgagggccccgaagaacagcagggagccgaagaggaggaggatggagcagcttcccaaggtgggctgtatgaagcaatcgcggggcactggatccaggtgctgcagtgccggcagcgatgcgtgggtgagacagccaccaggccaggccggtcctttcctgtgcccgactttctgcccaatcagttacgcaggctccatgaggcccacgcccaggtaggaaatttgagccaggccatcgagaacgtgctgtctgttttgctcttctaccccgaggacgaggccgccaagcgggcattgaaccaatatcaggctcaactcggcgaaccccggccagggcttggacccagagaagatatccagcggttcatcctcaggtctctgggcgagaagcgccagttatactacgctatggagcatctggggaccagctttaaggatcccgacccttggacccctgcggccctcatcccagaggccctgagagagaaacttagggaggatcaagagaaaaggccctgggaccatgaaccagttaagcccaagccactcacctattggaaggacgtgcttctacttgagggggtcaccctgactcaagacagccgtcagctgaacggaagcgaacgcgccgtgctcgacggcctgcttactccagcggaatgtggagtcctccttcaactcgctaaagacgccgcaggcgcaggagcacggtctggatacagggggaggcggagtccccacactccccacgagcgattcgaaggcctgactgtgctgaaagctgcccagctggcccgagccggcacagtcggaagccaaggcgctaaactcttgctcgaagttagcgaaagggtcagaactctgactcaagcatatttttcacccgagaggcccttgcatctcagcttcacacacctggtctgccgctcggcaattgaaggcgaacaggagcaacggatggacctctcacatccagttcacgctgacaactgcgtcctggatcccgatacaggggaatgctggagggagccacccgcttacacatatcgggactatagcggccttctttatctgaacgacgatttccaaggaggagacttattttttactgagccgaacgccctaactgtaaccgctagggtaagacctagatgcggccggctggtggcattttcatcaggcgtggagaatccccacggcgtgtgggcagttacacgaggccggcgctgtgcactggcgctctggcacacctgggccccagagcaccgagaacaggaatggattgaggctaaagagctgttacaagaatcacaggaggaggaagaagaggaagaggaggagatgccatctaaagacccctcaccagagccgcccagcaggaggcaccaaagggtgcaggacaagacagggcgggcaccacgggttcgagaagagttatag

SEQ ID NO: 27033 - DNA, 492 bp, Artificial Sequence
  Description of Artificial Sequence: Synthetic coding sequence
atgttacgtctcctgagaccgctgcttctcctcctgctgctccccccaccaggctcacctgaaccccccggcctgacccagttgtcacctggagctcccccacaagcacctgacctgctctacctcaacgatgacttccaaggcggcgacctgttctttacagagcccaatgccttgacagtaactgccagggttagacctcgctgtggccggctggttgcttttagcagtggcgtggaaaaccctcacggcgtatgggcagtaacacggggacggcggtgtgccctggccctctggcatacttgggcccccgagcacagagagcaggaatggatcgaggctaaagagctgctacaggaatcacaggaggaggaggaggaggaggaagaagagatgccatcaaaggaccccagtccggaacccccctcccgacgtcaccagcgcgttcaggacaaaactggccgggctccgagagtgagggaagaattgtag

SEQ ID NO: 27034 - DNA, 1083 bp, Artificial Sequence
  Description of Artificial Sequence: Synthetic coding sequence
atggctctgtctcgtgtgtgttgggcacgatcagctgtgtggggaagcgctgtgacccctggacattttgtcacccgaagacttcagctgggccggtctggcctggcctggggggccccccgtagttccaaactgcacctttcgccgaaggctgacgtgaagaatttgatgtcctacgttgttactaagacgaaagcgataaacggcaagtaccatcggtttctgggacgacactttccccgattttacgtcctgtataccatttttatgaagggcctgcagatgctctgggccgatgctaaaaaagcccgtagaattaaaaccaacatgtggaagcataatatcaaattccaccagctaccataccgcgaaatggaacacttaaggcagttcaggcaggatgttactaagtgtcttttcctcggcattatcagcatccctcccttcgccaactatctagtattcctgcttatgtacctattcccacgccaactcttgatcaggcacttttggacccccaaacagcagacagacttcctcgacatttatcacgcttttagaaagcagtctcatcccgagatcattagctatttagagaaggtgattccactcattagtgatgctgggctacggtggcgactgactgacctctgtactaagatccagaggggaacccatccagcgatccacgatatcctggctctccgggagtgcttctccaatcacccactcgggatgaaccagcttcaggcgctccacgtgaaagccctctctcgcgccatgttgttgacaagttaccttccccctcctctgctgcgacaccgcctgaaaactcacacgaccgtgatacatcaactcgataaggcactagcaaagctggggattggccaactcacagcccaggaggtgaaaagcgcctgctatctaaggggactaaatagcacgcacattggcgaagacagatgccgaacgtggcttggagaatggctccaaatatcttgctcgctgaaggaggcggagcttagcctgttgctgcacaacgtagtactattaagtacaaactacctgggcacgaggcggtag

SEQ ID NO: 27035 - DNA, 300 bp, Artificial Sequence
  Description of Artificial Sequence: Synthetic coding sequence
atggcactgtccagagtgtgttgggcccgatcagcggtttggggcagcgcggtcactcccgggcacttcgttacccggaggttgcagctgggtaggtccggcctggcctggggcgcaccacggtctagtaagctccatttgtcccccaaggcagatgtcaaaaacctgatgtcctacgtcgtcactaagaccaaggcaataaatggcaagtaccaccggtttctaggaagacacttcccgcggttctacgttctgtacacaattttcatgaagggaacatgctttccaggtaactattag

SEQ ID NO: 27036 - DNA, 822 bp, Artificial Sequence
  Description of Artificial Sequence: Synthetic coding sequence
atggccttgtctagagtatgttgggccaggagtgcagtctggggaagtgctgtgaccccgggacacttcgtcacaaggagattacagttgggtagatctggtcttgcatggggcgcaccccgaagctccaagctgcatctcagtccaaaggctgacgtaaaaaacctgatgagctacgtcgttaccaagacaaaggctatcaacggaaagtatcaccgctttttgggcaggcacttcccccgcttctatgtactgtacacaatcttcatgaaggggattatttcgatcccgcctttcgccaactacctggtgttcttgctgatgtatctgtttcctcgtcagttgctaatacggcacttttggacccctaagcagcagaccgatttcttagacatttatcacgccttccgcaaacagtcccaccccgagatcattagctatttggaaaaagttattccacttatttcagatgcaggtctccggtggcgcctgacagatctgtgcaccaaaattcagagaggcacccaccccgcgattcacgacattctagctctccgggagtgcttttcgaatcacccgctcggaatgaatcaactccaagctctccatgtgaaagccctgagtcgcgcaatgctactcacctcctatctgccccctcctctccttcggcaccgcctgaagactcatacgacggtgatccaccagcttgataaagccctcgcaaagctcggcatcggtcagctgaccgcactgcatcagttgccatgggataaggcccttaacgagccctggtccggctggcattgtcctgccgtggtgtag

SEQ ID NO: 27037 - DNA, 915 bp, Artificial Sequence
  Description of Artificial Sequence: Synthetic coding sequence
atgtcctatgtagtgacaaagacaaaagccatcaacggcaaataccaccgctttcttggtcgtcactttccccgtttttacgtgctttatacgatattcatgaagggactgcaaatgctctgggctgatgccaaaaaggcccgacggattaagactaatatgtggaaacacaatattaaatttcatcagctgccttatcgggaaatggaacatcttagacagttcaggcaagacgtgaccaaatgcttgtttctgggaatcatttccatccccccttttgctaattatctcgtgttcctgcttatgtatctgttcccacggcagcttcttatccggcacttttggacccccaagcagcagaccgactttctggacatctaccatgcatttaggaagcagtctcacccagagatcatcagctatctggaaaaagtgattccattgatctctgatgcagggctgaggtggaggctcacagacctctgtacaaagatccagagagggacccatcctgctatccacgacatacttgctttgcgggagtgttttagcaaccatccgttaggcatgaaccagttgcaggccctgcacgtcaaggccctgagccgcgcaatgctcctcacttcttacctcccgccccccttgctccgccatcgtctgaaaactcatactaccgtgatccatcagctggacaaagcgcttgccaaacttggaataggccagctcaccgctcaggaggttaagagcgcttgttaccttaggggtctaaattctactcatattggcgaggacagatgtcgcacctggctgggagagtggctgcagatctcatgctcacttaaagaagctgaactgagcctcctcctgcacaacgtcgtactgctctcaacgaattacctggggaccagaagatag

SEQ ID NO: 27038 - DNA, 1122 bp, Artificial Sequence
  Description of Artificial Sequence: Synthetic coding sequence
atggctttgagcagagtgtgctgggcaaggtcggcagtatggggatccgctgtaacgccaggacacttcgtcaccagaaggcttcagctgggacggtctggtctcgcctggggtgctcccagatcttccaagctgcacctgtctcctaaggccgacgtgaaaaatcttatgtcttatgtggtcacaaaaaccaaagccattaatggcaaatatcatcgattcctgggaaggcacttcccccgtttttatgtgctgtatacaatcttcatgaagggcttgcagatgctgtgggctgacgcaaaaaaggcccgccggatcaagactaacatgtggaaacacaatatcaagttccaccagctgccctaccgtgagatggagcacctaagacaagtgtgggccagaggtcgatatcccgaggtgcacggggaatttaggcaggatgtgactaaatgtctctttttggggatcatttccatccccccctttgccaattatcttgtctttttattgatgtatttgtttcccaggcaactgctgatccgtcatttctggacgcccaaacagcagaccgactttttagacatataccatgcattcaggaaacagtcacatccagagataatctcatatctggagaaagtgatccctctgatatcggacgcggggctgaggtggcggctgacggatctgtgtactaaaatacaacgagggacgcatcctgctattcacgacatccttgccctgcgcgaatgcttttcaaaccatcccttaggaatgaaccagctgcaagccctgcatgtcaaagctctttccagagcaatgcttctcacctcttacttgccaccacctctgctaaggcataggctgaagactcataccacagttatccatcagctggataaagcactggccaagttggggatcggccaactgactgctcaagaagtcaaatctgcctgttaccttcgcggactgaattccacccatatcggagaggacaggtgccggacttggttaggagaatggctgcagatttcttgcagcctcaaagaagcggagctaagcctgctcctccacaacgttgtgttactgtctactaattacctgggtacccgtagatag

SEQ ID NO: 27039 - DNA, 1782 bp, Artificial Sequence
  Description of Artificial Sequence: Synthetic coding sequence
atggatgccgcaactgcaccaaaacaggcgtggccaccttggcctcccctgcttttcctgcttctgctgcccggagggagcggaggctcttgcccggctgtctgcgattgcacgagtcaaccccaggcagtgctgtgtggccacaggcagctggaggcagttcccgggggtttacctcttgacactgagttgctggacctgtcaggaaacagactttggggcctccaacaagggatgctttctcggttgtccctgctccaagagttggatctttcttataaccagctgagcaccctggagcctggggcctttcatggattgcagtcattactcacccttaggctgcagggcaatcgtctgaggatcatgggacccggcgttttctcggggttatcagcactcacgctgctggatctaaggttgaatcagatagttctgttcctagacggagcattcggggagcttggatctttacaaaaactagaggtgggagataatcaccttgtcttcgttgcacccggggccttcgcgggactggccaaactttcgacactcaccctggagcggtgtaatttgtctactgtcccaggcctggctctcgctcgactgcccgcccttgttgcattgaggctgcgagagctcgacattggtcgcctgccggctggcgccctgagggggcttggccagctcaaagaactcgagattcatctgtggcccagtctggaggccctggatcctgggtcgcttgtgggactgaatctcagctctctcgcaattactaggtgtaacctctcatctgtgcccttccaggcactgtaccacctgagcttccttagggtcttggacctttcccagaacccgatctccgccattccggcccgtagactgtctcctcttgtccggctccaggaactgaggctgtctggagcctgccttaccagtatcgcagcccacgctttccacggattgacagctttccacctactggatgtggccgacaacgcactccagaccctggaggaaacagcctttccttcccctgacaagcttgtgacactcagactttcagggaatccactgacatgtgattgtcggcttctgtggcttctgcgtttaagaagacatctagattttgggatgagccctcccgcttgtgctggaccacatcatgtgcagggcaagagcttgaaggaattttccgacatactgcctccaggacacttcacatgcaaaccagccttgatcagaaagagcggtccacgatgggtgatcgccgaagaggggggacacgccgtatttagctgctctggggacggagatcctgccccgacggtgagctggatgcggccccatggagcatggcttggccgggccggcagggttcgcgtcttggaggacggcacactcgagatacgtagcgtgcagctgagagaccggggagcctatgtttgcgtggtctctaacgtggccggaaacgacagtcttaggacctggctcgaagtaatccaggttgaaccacccaatgggaccctgtccgatccaaatattaccgttccaggcataccagggcccttttttctggatagtcgcggagtggcaatggtgctcgctgtaggtttcctcccatttctgacttctgtcaccctttgctttggcctgatcgccctgtggtcaaaaggtaaggggcgggttaaacaccatatgacctttgattttgtggccccccgcccaagcggcgacaaaaactcaggcgggaatcgcgtgaccgccaagctattctag

SEQ ID NO: 27040 - DNA, 1746 bp, Artificial Sequence
  Description of Artificial Sequence: Synthetic coding sequence
atgccactgaaacactatctcttacttctggtcggttgtcaggcctggggcgctggccttgcttaccacggctgtcccagtgagtgcacctgcagtagggcttctcaggtggagtgtaccggtgctcgtatcgtcgcagtcccaactcccttgccttggaatgcaatgagtctgcagattctgaacactcatataacagagctgaacgagagtcctttcttaaatatctctgctttgattgccctgcgcattgagaagaacgaactgagtcggattacaccaggagcttttcggaatcttggatctcttcggtacctgtccctcgccaacaataagttgcaggtgctcccaataggcctcttccaggggctggacagcctggaaagcctgctattgtcctcgaaccagcttctgcaaatacagcccgctcatttttcccagtgtagcaacctgaaggagctccagctccacggcaaccacctggaatacatccccgacggtgcgtttgaccatttggtcggacttactaagctgaacctagggaagaatagcctgacacacatatctccacgcgtgtttcagcacctgggcaacttgcaggtgttgcgactctacgaaaatcggctaacagatattccgatgggaacctttgacggactcgtgaatctgcaggagctcgccctgcagcaaaatcagattggtctgctgtcacctggtctttttcataacaatcacaacctccagaggttgtacctttctaataaccacatcagtcagctgccaccatccgtttttatgcagctgccccagctgaatcgcctaacactgtttggaaactcactcaaagagctttctccaggcatttttgggccgatgcctaacctccgcgaactttggttatatgacaatcacatcagtagtctgccagacaatgtgttctctaacctgcgccaattgcaggtgctcatcctctcaagaaatcagatcagtttcatctccccaggtgcgtttaacggactaacggagctgcgcgaactctccctgcacacaaatgctctccaggatctggacggtaatgtgttccggatgcttgcaaacctccagaatatcagcctgcagaacaataggctgcgtcagttgcctggaaacattttcgcaaatgtcaatggacttatggccattcaacttcagaacaatcagctcgaaaacctgccgctgggcatttttgaccacctgggaaaactttgcgaactgcgcttgtatgacaatccctggcgatgtgattcggacattctgcccctccggaactggctcctactgaaccagccaaggctgggaactgacacagttcccgtgtgcttctccccagcgaatgttaggggccagtccctgatcattattaacgttaatgtggcggtcccctcggtccatgtgccagaggtgccatcttaccctgaaacaccttggtatcctgacacgccatcatatccagacaccacctccgtttcctcaactactgaactcacatcgccagtggaagactacacggacctgaccaccatccaggttaccgacgatcgctctgtgtgggggatgactcaagcccaaagcggactggcgatcgccgcaatcgtgatcggtatcgtggcccttgcgtgtagcttagcagcctgcgtgggatgctgttgttgcaagaagcgcagccaggcagtccttatgcagatgaaggctccgaatgagtgttag

SEQ ID NO: 27041 - DNA, 1764 bp, Artificial Sequence
  Description of Artificial Sequence: Synthetic coding sequence
atgccacttgacaaggcaatgcccctgaagcactaccttctgctgctggtcggctgccaggcgtggggtgcagggctggcctatcacggctgccccagcgaatgtacatgtagtagagcgtcacaggtggaatgtaccggcgcccgcattgttgctgtacccaccccactcccctggaatgcaatgagcctgcaaatcctcaacacccacattactgaactcaacgagagtccgtttcttaacatttcagccttaatcgccttgagaatcgaaaaaaatgaactgtctcgcattacccccggtgcatttcgcaacctcgggtctctcagatatctgagtctcgccaataataagttgcaggtgctccccattggcctcttccagggcttagacagccttgaatctttgttgctctccagtaatcaattgcttcagatccagccggcacactttagccaatgttccaacctgaaggaactccagctgcatggcaatcacctcgaatacatacctgacggtgcttttgatcatctggtcggactgacaaaattgaacctgggaaagaattccctcactcatatcagtcctagagtgtttcagcacctcgggaacctccaggttctgcggctgtatgaaaacagactcactgacattccaatgggcaccttcgatggactcgtgaatctgcaggaactcgccctgcaacagaaccagatcggactgctgtctcctggcctattccataacaaccacaacctgcagcggctgtatctcagcaacaatcatatttcacagctgcctcccagcgtattcatgcaactgccacaactgaaccgattaaccttgtttggcaacagtctgaaggaactgtcgcctggcatctttggtcctatgccaaacctgagggaactatggctgtatgacaatcacatttctagtctaccagataacgtgttttcaaacctccgacagctgcaggtgctcattcttagcaggaatcagatcagtttcattagtcccggagcctttaatggcttgaccgagttaagagaactcagcctgcacaccaacgcactgcaggacctggacggcaatgtgtttcggatgctggccaatttgcagaatatatcactgcagaataaccgcctcaggcagctccctggtaacatattcgccaacgttaacggcctaatggccatccagctccagaataatcagctggaaaatctgccactggggatatttgatcatctcggcaagctctgtgaactgcgactttatgacaatccttggcggtgcgattctgacatccttccgcttcggaattggctgcttctcaatcagccaagacttggcacggatacagtgccagtttgttttagccccgctaacgtgcgggggcagtctcttataatcatcaatgtgaacgtggctgtgcccagcgtgcatgtccctgaggtcccatcctaccctgaaacaccctggtatcccgatactccttcgtacccagacaccaccagtgtgtctagtacgactgaattgacttcacctgtcgaagattacacagatctgacaaccatccaggtgaccgatgacagatctgtgtggggtatgacccaggcacaaagcggcttagccatcgctgcgatcgtcatcgggatcgtagctctagcctgcagccttgccgcatgtgttgggtgctgttgctgcaaaaaacgtagccaggctgttcttatgcagatgaaggctcctaacgagtgctag

SEQ ID NO: 27042 - DNA, 1764 bp, Artificial Sequence
  Description of Artificial Sequence: Synthetic coding sequence
atgccccttgataaggccatgccccttaagcattacttactgctgcttgtgggatgtcaggcctggggagccggtttagcgtatcacggctgcccgtcagagtgcacgtgctcgagggcgtcccaggtggaatgcaccggcgcccgcatcgtggccgtgcctaccccgctgccatggaatgcgatgtcactgcagatcctgaacacccacattactgagctgaatgaatcaccctttctgaatatcagcgctctgattgctctccggattgaaaagaacgaactctcacgtatcacccctggcgcttttcgcaacctcggttccctccggtacctgagtctggctaacaacaaacttcaggtgttacccattggcctgttccagggacttgatagcctggaatccctgctgctttcctcaaaccagctgttgcagatccagccagcccacttcagccagtgtagtaatcttaaggaactgcagctacacggaaaccatcttgaatatatccctgatggggcatttgaccacctggtcggactgacaaaactgaatctgggcaaaaacagtctcacccacatttcccctagagtctttcaacatttagggaacttacaggtgttaagactctacgagaacaggctcaccgatatccccatgggtaccttcgacggccttgtcaacctgcaggagctggcacttcagcagaaccagatcggacttctctcccctggtctgttccacaacaatcacaatttacagcgtctttatctgtccaataatcacatttctcagctgccaccatccgtcttcatgcagctgccccagttgaataggttgaccctctttggcaattccctcaaggagctgtctcccggtatattcggccctatgccaaatttacgagagctgtggctttatgataatcacattagtagcctcccagacaatgttttcagcaatctgagacagctccaggtgctcatcctctccagaaatcagatctcttttatcagtcctggtgccttcaacggcctcacggaacttcgggagttgtctcttcacaccaacgctctccaggatcttgatggaaatgtttttagaatgctagccaaccttcagaatatcagtctgcagaataaccgcctgcggcaactgcccggcaatatctttgccaacgtcaacggtcttatggcaatccagctccagaataatcagctggagaatctgccattaggcatttttgatcacctcggaaaactgtgcgaattaaggctgtacgacaacccttggagatgtgattccgacatcctgcctctgcggaactggcttcttctgaatcagccacgactgggaacagatactgtgcctgtgtgtttcagtcccgcgaacgtccgcggccagagtttgatcattataaacgttaacgtggcagtcccaagcgtgcatgtgcccgaggttccaagctaccctgaaacaccttggtaccccgataccccctcctaccccgacacaacctccgtttcgagcacgacagagctgactagccctgtggaagactacaccgacttgacgaccattcaggtgaccgatgaccggagtgtttgggggatgacacaggcccaatcgggcttggccatagcagccatcgtcataggcatcgtggcgctggcctgttcgctggccgcctgcgtaggctgttgttgttgcaaaaaaagatctcaggccgtgctgatgcagatgaaagctcccaacgaatgttag

SEQ ID NO: 27043 - DNA, 1113 bp, Artificial Sequence
  Description of Artificial Sequence: Synthetic coding sequence
atgaaggtcactggaattacaatcctattctggcctctcagtatgattctattgagtgataaaattcaaagctctaaacgggaagtccaatgtaactttacggagaaaaattacaccttgattcccgccgatatcaagaaggatgtgaccatccttgatctttcgtacaaccagattacactgaacggaactgacacacgggttctgcagacttatttcctgctgacagagctgtatctaatcgaaaacaaggtgaccattctgcacaataacggttttggcaacctgtcgtccctggaaattctgaacatttgccgaaactctatttatgtaatccaacaaggggccttcctcggtttgaataaattgaaacaactttatctctgccagaacaagattgaacagctgaacgctgatgttttcgtgccgctaaggtccttgaagcttttgaatctgcaaggcaatctcataagctacctggatgttccccctctctttcatctcgaactcattacgctgtatgggaatctttggaactgtagctgtagcctatttaatctgcagaactggctgaacacaagcaatgtaaccctggagaacgaaaatatcactatgtgcagttacccaaattccctgcagagttacaatattaagaccgttccacacaaggccgagtgccatagcaagttcccatccagcgtcactgaggacctttatatccactttcagcccatttcaaattccattttcaactcttcctcaaacaacctgacacggaattctgagcacgaacccctgggaaagagttgggctttcctggtgggggttgtggtgacagtactcactacttcattgcttatttttatcgctatcaaatgtcctatttggtacaatatcttactgtcatataaccatcacaggttggaggagcatgaagctgaaacctacgaggacggattcacaggaaatcctagctccttgtctcagattccagagactaattccgaagaaaccaccgttatattcgaacagttacattcattcgttgtggatgatgacggtttcattgaggacaagtatattgatatccatgagctgtgcgaagaaaactag

SEQ ID NO: 27044 - DNA, 1542 bp, Artificial Sequence
  Description of Artificial Sequence: Synthetic coding sequence
atggcgttacgagcccctgcacttctgcccctgcttctgctgctgcttccacttagagccgctggatgccccgccgcatgtagatgctattccgccactgttgaatgcggtgcactcagattgcgagtggtcccactgggtattccaccagggacacagacgctgtttcttcaggacaacaatattgccaggttagaaccgggcgccttagcaccgcttgccgcactgaggaggctgtatctacataacaactccctccgggctctcgaagccggagctttcagagcacaacctcggttgcttgagctggcccttacctccaaccggttaaggggccttcgctctggagccttcgtgggactagcccagttacgggtactttacctggcaggcaaccaactcgccaggctgctcgactttactttccttcatctgcccagactacaggaactgcatctgcaggaaaactccattgaactcctagaagaccaagcactggccggtctaagtagcttggctctgttggatctcagcaggaaccagctgggtaccatcagccgtgaggccctgcagccattagcatctctgcaggtcctgcggctcacagagaacccttggaggtgtgactgtgctctgcactggcttggcgcctggatcaaggaaggtggccagagacttctcacatcccgtgaccggaagatcatgtgtgcggagcccccacgccttgccctgcagagcttgctcgatgtgagtcacagcagtctgatctgcataccgcctagtgtacacgtacagcctctcgaactgaccgcaaatctaggagaggatctacgcgttgcatgccaggcctcaggctacccacagcccctcgtgacctggagaaaggtcccccagccgcgagaaggccggcctagagcccaggcacaactggagggtggcctgctgggtcttggcggccatagtgccagcgacaccggatccgggatgttgttcctgagcaacatcacgctcgcccacgccggcaaatacgaatgcgaagcctctaacgccggcggcgccgctcgggtacctttcagattgcttgttaacgcaagccggcagcagccacaacagcccgctcagccacctccacccgccgccaggcccgcgggcagcgagccacgccccgaggctgggtcaatggccttcagagctctgggcgtcgcaactcagacggctattgccgccgcaatagctctattagctctcacagctttgctgcttgtcgctatgatctgtcgccgcaggcgtagaagaaaaaaagctcggggtcctccaggcgagggggccctgtttgtgaacgactacctggacggcccatgcaccttcgcgcagctggaggagctccgggacgagagggggcacgagatgttcgtgattaaccggtccaagcctctgttcgcagaaggacctgccgaagccccagcagactgcggacccgagcagggtgcaggccccggcctcagagtccctccccccgtggcatatgaaattcattgttag

SEQ ID NO: 27045 - DNA, 774 bp, Artificial Sequence
  Description of Artificial Sequence: Synthetic coding sequence
atgggaactgtgcgcccacctcggccatcattacttctggtgagcacgagggagagttgtctgtttctgcttttttgcctgcacctgggcgccgcctgcccccagccttgccgttgtccggatcacgcaggggccgtggcagtcttttgctccctccggggccttcaggaggtacccgaagatattcccgccaataccgtgctattgaagttggatgctaataagatctcgcaccttcctgatggggctttccagcacctccatcggttaagggagctagacctgtcacataacgccattgaggccattggcagtgcgacgtttgctgggctcgcaggcggactccgccttctggatctcagctacaatcggatacagcgtatccctaaggacgccctgggaaagctctctgccaagatcaggctgagccataatcccctgcattgtgagtgcgccctgcaggaggcactgtgggagctgaagctagacccggattctgtcgacgaaatcgcttgccataccagtgtgcaggaggaatttgttggcaagcctctggttcaggccctagatgccggagcaagtctctgctccgttccacataggacaacggacgttgccatgcttgtgaccatgttcgggtggttcgctatggtcatcgcttatgtcgtctactacgtgagacacaatcaggaggacgcaagaagacacctcgagtatttgaagtcacttccaagtgcacctgcctcaaaggatcccattggaccaggaccttag

SEQ ID NO: 27046 - DNA, 414 bp, Artificial Sequence
  Description of Artificial Sequence: Synthetic coding sequence
atgggcactgtgcgccctccaagacctagtttgcttctggtgtctacaagagagtcctgtttattcctgctgttttgtctgcacctgggcgcagcttgtccacagccctgccgctgccctgaccatgctggggctgtggcggtgttttgttcattacgggggctccaagaggttcctgaagacattcccgcaaacacagtcctgttgaaactggacgccaacaagatatctcatcttcccgacggcgcctttcagcatctgcatcggctgcgcgagctggacctgtcacacaatgcaatcgaagccatagggtccgctacgtttgccgggctggcggggggcctcagattgcttgaccttagttacaaccggattcaacggattcctaaggacccgattgggcctggaccatag

SEQ ID NO: 27047 - DNA, 1989 bp, Artificial Sequence
  Description of Artificial Sequence: Synthetic coding sequence
atgaggccacagattctgctgctactagcactattaacactaggcctggcggcccagcatcaggacaaggtgccatgcaaaatggtggacaagaaagtctcctgtcaggtactaggactgttgcaggtcccctcggtgctcccgccagatactgagaccctggacctttccggcaaccagcttcgaagcattctagcgagcccgctgggtttctacaccgccctcagacacctggacctctccaccaacgagatcagctttctgcagccaggcgctttccaggcattaacccatctggagcacctatccctggcccacaaccggctcgcaatggccaccgctctgtccgccggcgggcttggaccgctcccgagggtaacctctctcgacctgagtggaaacagcctttactcgggccttctggaacgcctgctgggggaggcccccagcctgcatacactatccctcgcagaaaattccctgacaaggttgactcgacacacatttagggatatgcctgccctcgaacaactggatctgcatagcaacgtgttgatggatatcgaggatggggcctttgagggcctgccaagactcacacacctgaatttgtctcgtaattccttaacttgcatttccgattttagtctgcaacagcttagggttctggacttaagctgcaattctatagaggccttccagactgctagtcagcctcaggccgaattccagctgacctggttagacctccgtgagaacaagctccttcactttcccgatctcgccgcactgccccgactcatttacctgaatctgagcaataatctgattagattaccaaccggtcctcctcaggatagtaaagggatccacgctcctagcgagggatggtccgcacttcctcttagtgctccaagcggaaacgcctctgggagacctctcagccagcttcttaatctggacttatcatataacgagatcgagctcatcccagatagcttcctcgagcacctgactagcttgtgctttctcaatctctctcgcaattgcttgcgcacatttgaggcccgaagactgggctccttaccgtgcctgatgctgctggacctatcacacaacgcacttgagacattggagctcggtgcaagggcactgggttccttacgtactttactactgcaagggaacgctctgagggaccttccaccctatacatttgcgaaccttgctagcctccaacgactgaatctacaaggaaatagagtctccccctgcggcgggccagacgagcccgggccatccggctgcgtggcattttcaggtatcacatctctacgaagcctcagcctggtggataatgaaatcgagttgcttagggccggagcattcttacatactcccctcacggagttggacctgtcttcaaaccccggactggaagttgccaccggggccctgggggggctggaggcgtccctggaggtgttggccttacagggaaacgggctgatggtactgcaggtagacctcccttgttttatctgcctgaaacggttgaatttagccgagaatcgcttgtctcatttaccggcatggacccaggccgtgtctctagaggtgctggacctgcgtaataattccttctctcttctgccaggctccgccatgggcgggctggaaacttccctccggaggttatacttacaggggaatcccctgtcatgttgcggtaacggctggttagcagctcagttacaccagggaagagtggacgttgatgccacgcaggatctgatatgcagattctcttcgcaggaggaagtcagtctgagtcacgtacgcccagaagattgcgagaaaggaggcctgaagaacatcaacttaattatcatactcacctttattcttgtctctgccatcctgctgactaccctggctgcctgttgctgcgttcgtaggcagaaattcaatcagcagtataaggcttag

SEQ ID NO: 27048 - DNA, 1989 bp, Artificial Sequence
  Description of Artificial Sequence: Synthetic coding sequence
atgaggccacagattctcctgctgctcgcacttttgacacttggcctcgccgctcagcatcaggataaggtaccctgcaagatggttgacaagaaggtgtcctgccaggtactagggttgctgcaagtgcccagcgtcctgccaccagacacggaaaccctggacctgagcggtaaccaactcagaagcatcttggcctctccactgggattctacaccgctctcagacatctggacttatctaccaacgagatttcattccttcagccaggggcttttcaagccttgacccacttggagcacctgtccctggcccataacaggttggctatggccactgcactgagcgccggagggttgggccctcttccacgcgtgacctcgctagacctgagtggtaattccctctatagcggcctgctggagcgcctgcttggcgaggctccttctctgcataccctgtcactggcagagaatagcctgactagattaactcgccatacattccgagacatgccagctctcgagcagttagatctgcacagcaacgtcctgatggatatcgaagacggcgcgttcgagggacttcccagactaactcatctgaaccttagccgcaatagtctgacatgcatctccgacttctctctccagcagctgcgggtgctggacctgtcatgtaatagcattgaggcatttcagaccgcctcacagcctcaggcagagtttcagctcacctggctggacctaagagagaataagctattgcatttcccagatctcgcagcacttccccggctgatttaccttaatttatctaataacctcatcagattgcctaccgggcccccacaggacagtaaagggatccatgccccgagcgaaggctggagcgctctgcctctgagcgccccatctggcaatgcaagcgggcgtccattgagccagctgctgaacctcgatcttagctataatgagattgaattgattcctgatagcttcctcgagcatttgacatccctatgttttcttaatctgtccagaaactgtctccgcacattcgaggcacgccggctaggctcccttccttgtctgatgctgctggacctcagccacaatgctcttgaaaccctagagctgggcgctcgggctctggggtccttgagaaccctgctccttcagggcaatgccctccgggatctccccccttacacctttgctaacctcgcttcactgcagaggctgaatctgcagggaaacagggtaagtccatgcggcgggcccgacgaacctggtccgtcaggttgcgtcgctttttccggaattacaagcctgcggtcacttagcttagtcgacaatgagatcgagttattgagagcaggagcattcctccatactccgcttaccgagttggatctcagttccaatcctggcctcgaggtggccaccggagcacttggaggcctggaggcatcgcttgaggtcctcgccctgcagggtaacggcctgatggtgctgcaggtcgatctcccatgctttatctgtttaaaaaggttgaatctcgctgagaaccggctgtctcatttaccagcctggacccaagccgtttctctggaagtgctggacctcaggaacaactccttttcactcctgccgggcagtgccatggggggcctagaaaccagcctgaggcggctgtatctgcagggcaaccccttgtcgtgctgcggtaacggatggctggcagcccagcttcaccagggcagggtcgacgttgatgcgacacaagatctcatctgtcgattctcctctcaggaggaggtgtcactgagccacgttaggccggaggactgtgaaaagggcggattaaagaacattaatttgattatcatcctcacatttattctggtgtctgccatactactgacaaccctagctgcctgctgctgcgtaagaaggcaaaaattcaatcagcagtacaaggcctag

SEQ ID NO: 27049 - DNA, 1989 bp, Artificial Sequence
  Description of Artificial Sequence: Synthetic coding sequence
atgaggccccagattctactgctgcttgctttgctgaccctcggcttagctgctcaacatcaggacaaagtgccttgcaaaatggttgataaaaaggtctcctgccaggtactgggcttacttcaggtgccatctgtgctgccccccgacactgaaacccttgacttatccggaaaccagctgagatcaatcctcgcatcaccactgggcttctatactgcgcttcgccaccttgatctctccacaaacgaaatttcattcctgcaaccaggagccttccaggctctgacacatcttgagcacctttctttagctcacaaccggctagccatggccaccgcgctatcagctggagggcttggcccactgccacgggtgacatcgttagacctgtcaggcaactccctatacagcggattattagaacgcctgctgggggaagccccatcattgcacacattatccttagctgagaactccttgaccagattgacccggcacacatttcgcgatatgcctgctctggagcagcttgatctgcatagcaacgttctcatggacatcgaggatggcgcgttcgaggggttgccgcggttaacccatctgaacctgtcaaggaattctctcacctgcatcagcgacttctctctgcaacaactccgagtactcgatctgagctgtaacagcatcgaagcgttccaaactgcatcccaaccccaagccgagttccaattgacatggctcgacctgagggaaaataagctcctgcacttccccgaccttgcagcacttccccggctgatttatctgaatctctctaacaacctcatcagactgcctacagggccaccccaggactctaagggcattcatgcaccctccgagggctggagcgccctgcccctgtcagcccccagcggtaatgcctcaggaagacccctcagccaactgctgaacctcgatctgagttacaatgagatcgaactgatcccagacagtttcctcgaacacctcactagcctctgttttctcaatctgagccgcaattgtctgcggaccttcgaggcccgccgcctggggtcattgccctgtctgatgctgttggacctgtctcacaatgccctggaaactctggaactcggtgcaagagcccttggctcactgcgcacattgttgctccagggcaatgctttgcgggacttgcccccttatacttttgcaaatcttgccagcttgcagagactgaacctgcagggtaatcgagtgagcccctgcggcgggccagatgagcccggaccctcaggatgtgtggccttcagcgggataaccagcctccgctctctcagtcttgtggataacgaaatcgaactgctgagggctggcgcatttctacacactcctctaaccgagttggatctgagttctaaccctggtttggaagtggccacaggtgcgctgggagggctcgaggcttcacttgaagtcctggccctccaagggaacggcctcatggtactgcaggtcgacctgccttgctttatatgcctaaaaaggctgaatctggcggagaatcggctgtctcatcttcccgcctggacacaggctgtgtcactagaggtgctagatctgagaaacaatagtttcagcctcctgccaggtagtgccatgggtggcctcgaaacatctctgcgccgcctgtatctgcaaggaaacccgttgtcatgctgcggcaacggatggctggctgctcagttgcaccagggccgtgtggatgtggatgccactcaggatctgatttgcaggttttcctctcaggaagaagtgagcctgtcgcacgtccggcctgaggattgtgaaaaaggcggactcaaaaatattaatctcattataatactgacattcattctcgtgtccgctatacttctcactaccctagcggcgtgttgttgcgtccgccgtcagaaatttaaccagcagtataaagcatag

SEQ ID NO: 27050 - DNA, 561 bp, Artificial Sequence
  Description of Artificial Sequence: Synthetic coding sequence
atgaggccacagatcctcctgctgctcgccctgcttacccttggactcgctgcgcagcaccaagataaagtgccatgcaagatggtggataagaaggtgtcgtgtcaggtgctgggcttgcttcaggtcccgagtgtgctgcctccagacacagagaccctggaccttagtggcaatcagctgcgttctattctcgcgagcccgttgggcttctataccgccctgcgtcaccttgatctctctaccaacgagatctcctttctgcagcctggagccttccaggctctgacccatctcgagcacttatccctcgcccacaataggttggcaatggcaaccgcactctctgccgggggcttgggacctctgccccgggtgaccagtttggatctttccggaaactccttatattcaggcctgttggagagactcctgggtgaggccccctctttacataccctctccttggctgaaaattccctgacccgccttaccagacacacctttcgggatatgccagccctggagcagctcgatctccacagtaacgtgctcatgtag

SEQ ID NO: 27051 - DNA, 2079 bp, Artificial Sequence
  Description of Artificial Sequence: Synthetic coding sequence
atggagctcctccccctctggctgtgccttgggttccatttccttaccgtaggctggcgtaatcgctctggaactgctacagctgcctcccagggggtctgcaagctcgttggaggagctgccgactgccggggtcagtcacttgctagcgtgcctagcagcctgcccccacacgctagaatgttaaccttggacgccaaccctctgaaaaccctctggaaccattccctccagccctatcctttattagaatcactatcgctgcacagttgccacctggaacgcattagccgcggagccttccaggagcagggacatctgcgcagcctcgttctgggtgataactgcctgtcggaaaattacgaagagaccgcggcagctctgcatgcacttccaggcctacggcggcttgacctgtcaggcaacgctctcacagaagacatggctgctctgatgctgcagaacctttctagccttaggagcgtctcactcgccgggaacacaattatgaggctagacgacagtgtgtttgaaggactcgaacgccttagggagctggatctccagcggaactatatctttgagatcgagggtggggctttcgacggactggcggaattgcgacacctcaatctggcattcaacaacttaccctgcatcgttgactttggcctcaccaggctacgcgtgcttaacgtgagctataatgtgctggagtggtttctcgccacaggtggcgaggccgcatttgagctagaaacactagacttgagccacaaccagttgctgtttttcccactgctcccccagtactccaagctgcgcacgctgctgcttcgagataataacatgggcttttatcgcgatctgtacaacacttcatcccctcgagaaatggtcgctcagtttctgctggtcgatggaaatgttaccaacatcacaactgtttccttgtgggaagaatttagttcatccgacctggctgacttgcgattcctggacatgtctcaaaaccaattccagtatcttccagatgggtttctgcgcaagatgccttccttatcccacctgaacctgcatcagaattgcttgatgactctgcacatacgcgaacatgagccacctggcgccctcaccgagctcgacctcagccacaatcagctgagcgagctacacctggctccggggctggcctcatgcctcggatcgctgcgtctgttcaatctgagctctaatcagctgttaggggtaccgccgggactgtttgcaaacgcacggaatatcaccaccctcgacatgtcccacaaccagattagtttgtgcccccttcctgctgccagcgaccgtgtcgggccgccgagctgtgtggactttcggaatatggccagccttaggtctctcagcctggaaggatgcggactcggggccctgcccgactgtcctttccaaggaactagcctgacttatcttgacctgagctcaaactggggagtccttaatggaagcctcgcccctttacaggacgtggctcctatgctccaagttttatcgctgaggaatatgggcctgcactcgagctttatggctctggatttttctggcttcggtaacctgcgtgatttggatctctctggaaactgtctcacaacatttcccagattcggaggaagtctagctctggagactctagatctcagacgtaactccctcacagccctcccacagaaagccgttagcgaacagctgtccagaggtctgaggaccatttatctctctcagaacccctatgactgttgcggagtcgatggatggggtgcattgcagcatggccagacagtcgcggattgggcgatggtcacgtgtaatctgagttccaagattatccgggtcactgaacttccggggggagtccctcgtgattgcaagtgggagcgactcgaccttgggcttctgtatctggtgctgattcttccgagctgcttgaccctgctggtggcttgtacggtgatcgtgctgacatttaagaagcctttgctccaagttataaaaagcaggtgccactggagcagcgtgtactag

SEQ ID NO: 27052 - DNA, 4905 bp, Artificial Sequence
  Description of Artificial Sequence: Synthetic coding sequence
atgactagcgctcagtgcccggcgctggcctgtgtcatgtcaccattgaggttctggggtccctggcctctactcatgtggcagctcttgtggttattggtgaaggaggctcaaccactggagtgggtcaaggatcctcttcagctgacatccaaccccctggggcccccagagccttggtcctctcacagttctcatttccctagggagagcccgcacgcccccacactgcccgccgacccttgggatttcgatcatctggggccttccgcctcttccgaaatgccagcaccccctcaggagagtaccgaaaacctcgtgcccttcctggacacctgggattcggccggcgaactgcccctcgagccggagcaattccttgcctctcagcaggacttgaaagacaagcttagcccccaggagagactgcctgtcagcccgaaaaagctgaagaaggatcccgcacagcggtggagcctcgccgaaatcattggcattattcatcaactctcaacaccgcagtctcaaaagcagacactgcagaatgaatacagcagcactgatacaccgtaccctggaagcctgcccccagagcttagggtgaagtctgacgaaccccctggaccgagtgagcaggtggggccttcccagtttcacttagagcccgagactcaaaaccctgagactctcgaggacatacagtccagcagtctccagcaagaggctcctgctcagttgccccagctgctggaagaggaaccttctagcatgcagcaggaggcgcccgctctaccacctgagagctcaatggagagtctgaccctgcccaatcacgaggtatctgttcaacctcctggcgaggaccaggcctactatcatctgcccaacatcactgtcaagcccgcagacgtggaggtcaccataacaagtgagcccactaatgaaacggagtctagccaggcccagcaagagacgcccattcagttcccggaagaggtcgagccttcagctacgcagcaggaagccccaatcgaaccccctgtcccccctatggaacacgagttgagcatcagcgagcagcagcagccagtacagcctagtgaaagtagtagggaggttgagtcctcccccacgcaacaggagactccaggtcaaccccctgagcaccacgaggtaaccgtttccccaccagggcatcaccagactcatcacctcgcctcaccttctgtctcagtgaagcctccagatgtgcaactgaccatcgcagccgaaccatccgccgaagtcggaactagtctggtgcatcaggaggcaacgacgcgtctcagtggctccggcaatgatgtcgaaccacccgccatacaacatggcgggccgcctctgctgcctgagtcttcagaggaggccggaccgcttgccgtgcagcaagagacctccttccagtcaccagaacctatcaataatgagaatccttctcctacacaacaggaggccgccgcagaacacccccaaaccgctgaagagggagaatcttcccttacccatcaggaagcgccagcccagacgccagagttcccaaacgtggtggtggcccagccccccgagcattcacacctcacacaggccactgtgcagcctctggacttggggtttacaatcacacccgaaagtatgacggaggtcgagctaagcccgacaatgaaagaaaccccaacccagcccccaaagaaagtcgtccctcagctgcgtgtgtaccagggggtaaccaatccaaccccgggccaggaccaagctcagcatccagtttcccctagtgtaaccgtgcagctgctggatcttggcttaaccatcactcctgagcccacaaccgaggttggacactcaactccacccaagagaactatagtctcccctaaacaccctgaggtaacgctaccccaccccgatcaggtccagacacagcactcgcatctgactcgggctaccgttcaaccacttgaccttggttttacgattacacctaagtccatgactgaggtggaaccatccaccgccctcatgactaccgccccgccgcctggtcacccagaggtgaccctccccccttctgacaagggccaggcacaacacagccatctgacccaggctaccgtgcagccactagatctggaactgacaattactacaaagcctaccacagaggtcaaaccctcacccaccacagaggaaacaagcacccagttgcctgacttggggctggcaatcattcctgagcctactaccgagacaggtcatagtaccgcgctggagaagactactgccccccgacccgatcgtgtccagactctgcaccggtctctcactgaagtgacgggccctccaactgagcttgagcccgcacaggattccttggtgcagtctgagagctatacccagaacaaggcgctgactgctccggaagaacataaagcaagcacttctacaaacatctgcgaactgtgcacctgcggtgatgagatgttgagttgcatcgacctgaaccctgaacagagactgagacaagtgccggtgcctgagcccaacactcacaacggcacattcacaattttaaacttccaaggcaattatatcagctacatcgacggaaacgtttggaaggcgtatagttggacagagaaactgattctcagagagaataatctaactgagctgcataaggactcatttgaaggcttgctgagtctgcagtacctcgatctatcttgcaacaagattcaaagtatcgaacgacacaccttcgagccattaccattcctgaaatttatcaatcttagctgcaatgtgataacagagctgagctttggtacatttcaggcatggcatggaatgcagtttttgcacaaactgattctcaaccacaaccctctgaccactgtggaggatccctacttgtttaagctgcccgcactaaagtatctggacatgggcacaactttggtgcctctcactaccctgaagaacatcctgatgatgacagtggagttggagaaactgatcgttccatcgcatatggcctgttgcctgtgccagtttaagaacagcatcgaggcggtctgcaaaaccgttaagttgcattgcaactcagcgtgtttgactaacacaacacactgtcctgaggaagcaagcgtgggaaaccctgagggagccttcatgaaggtgctccaggcccgaaagaattacaccagcactgaactgatcattgaacccgaagagccttccgatagttcgggcattaacctgagcgggtttggcagcgagcagctggataccaatgacgagtctgacgtcaccagcacactgagctacatcctcccttatttttctgctgtgaatctagatgttaagagtcttttgctcccttttatcaagttgcccaccacggggaattcgctggctaagatccagacagtgggaaagaatcggcagagactcaaccgcgtcttaatgggacccaggagcatccagaagaggcactttaaggaggtgggccgtcaaagcatccggagggaacagggagctcaagcatcagtcgaaaatacggcagaggagaaaagattggggtcccctgcaccaagggaactgaaacagccacatactcagcagggacccgaaaagctggcaggaaatgctgtttatacaaaaccctcattcacgcaggagcacaaggctgccgtttccgtgttgaaacctttttccaagggagcgccctccaccagttccccagccaaagctcttccacaggttcgcgatcggtggaaagatctgacacacgcgatcagcattctggagagtgccaaagctcgcgtgaccaacatgaaaacgagcaagccaattgtgcacagcagaaaaaagtaccgcttccataagaccaggagccggatgacacatcggacgcccaaggtcaaaaaaagtccaaaggtgcgtaagaagtcgtacctgtctagactgatgctttcgaaccggttaccattctctgccgctaaatcactcattaactccccatctcagggcgccttcagctccctgagggacctgagtccacaggagaacccctttctggaggtgtctgctcccagcgagcacttcattgaaaataacaacaccaaagacactacagcccggaacgcattcgaagaaaatgtgtttatggagaacaccaatatgccagaaggaaccatcagcgagaacacaaactacaatcatccgccagaagcagattccgctgggaccgctttcaacttggggccaaccgtgaaacagacggagaccaagtgggaatacaacaacgtcggaacagatttgagtccggagcccaaatctttcaactatcccttgctcagttcaccaggcgatcaatttgagatccagctgacgcagcagctgcagtcggtaattccgaacaataatgtgcgaagactgatcgcacacgtgattcgcacgctcaagatggactgctctggcgctcacgtccaggtgacctgtgctaagttggtgtccagaacgggacatctgatgaagcttttgtccggacagcaggaagtgaaggcatctaagatcgagtgggacaccgaccagtggaagacagagaactatattaacgagtcaacagaagcacagagcgagcagaaggaaaagtccctagagtttaccaaggagttacccggttatgggtacaccaaaaagcttatcctggctcttattgtcacaggcattctgaccatactgatcatcctcctttgcttaattgaaatatgttgccatcgtaggagtctgcaggaggatgaggagggcttttcaagagatagtgaagctcccacagaggaggaatctgaagcacttccttag

SEQ ID NO: 27053 - DNA, 4905 bp, Artificial Sequence
  Description of Artificial Sequence: Synthetic coding sequence
atgacctccgctcagtgccctgcccttgcctgtgtgatgtcgcccctgagattctggggaccgtggcccctcctcatgtggcagctactttggctgctcgtgaaagaggcccagccactggaatgggtgaaggaccctctgcagctcacaagcaatcctctcggccccccagagccgtggtcctcgcatagctcgcatttccctagagaaagccctcatgctcctactctccccgctgacccttgggactttgatcatttaggtccatccgccagctccgaaatgcccgctccacctcaggagagtacagagaacctcgtgccattcctggatacctgggactcagctggggagctcccattagagcccgaacaattccttgctagccagcaggacctaaaggataaattgagtccacaggaacgacttcccgtatccccaaagaagctcaaaaaagacccagctcagcgatggagtttggctgaaatcatcggcataatccaccagctgagtacaccacagtcccagaagcagactttgcaaaatgaatattccagcacggatactccctaccctggcagcctgccacctgaactgcgtgtaaagtctgatgagccaccaggaccatccgagcaagtggggccgtctcagtttcacctggaaccagagacacagaatccagaaaccctagaagacattcagtcctccagtttgcaacaagaagctcctgcccagctacctcagctgcttgaagaagagccttctagtatgcaacaggaggcccccgccctcccgcccgaaagctccatggagagcttaacattgcctaatcatgaggtgtcagtacagcctcccggggaagaccaagcatactatcacctgcctaatattacagtgaagcctgccgatgtcgaagtgactattaccagcgagcctaccaatgagaccgaatctagccaggcccagcaggagaccccgattcagttcccggaggaggtggagccaagcgccacccagcaggaggctcccatagaaccccctgtcccacccatggagcacgagttgagcatctcagagcagcagcagccggtgcagccatcggagtccagtagggaggtagagagttcccccactcagcaggagacaccaggtcagcctcccgagcatcatgaggtcactgtgagccctcctgggcaccatcagactcaccatctcgccagtccatccgtctcagttaaacctccagatgtccagctaaccatcgccgctgagccttctgcagaagtaggcacaagcctggtacatcaagaggctacaaccaggctgtcgggttctgggaacgacgtggaacctcccgcaatccaacacggcggtcccccgttgctccccgaatcttcagaagaggctgggcccctggccgtgcaacaagagacctcttttcagtccccagagcctatcaataacgagaatcctagccctacgcaacaagaagccgccgccgagcacccccaaaccgcggaggaaggagagtccagcctgacgcaccaggaggctcctgctcagacacctgaattccccaatgtggtcgtggcccagcccccagagcattctcacctaacacaggctacggtgcaaccccttgatttaggattcactatcaccccggagtccatgacagaggtggaactatcacccactatgaaagagacccccacccaaccaccgaagaaagtggtgcctcagttacgcgtgtatcagggggtaacaaatcctacaccgggccaggatcaagcccaacatcctgtttctccgtccgtcaccgtgcaactgctggatctggggctgaccattacccctgagcccaccaccgaggttggtcattctacaccgccgaaacgaacaatcgtgtctcccaagcacccagaagtgacactaccccatccagatcaagtacagacacagcactcgcacctgacccgcgctacggtgcagccactggatcttgggttcacgataacccctaaatcaatgactgaggtcgagccttccaccgcacttatgacaaccgcacctcccccagggcatcccgaggtgacactgccgcccagcgacaaagggcaggcgcagcactcacatctcactcaggccaccgtacagcccctggacttggaactcaccataactacaaagcctacaacggaggtgaagccttctccgacaacagaggagacatcaacccagctgcctgacctcgggctcgcaatcatacctgagccaacaacagagacaggacattccaccgccttagagaagaccacggcccctcgtcctgacagggtccagacactccatagatccttaactgaggtgacaggtccaccgaccgaactggagcctgcgcaggatagcctagttcaaagcgaaagctatacgcaaaataaagcactgaccgccccagaagaacacaaggctagcacgtctactaacatatgcgagctgtgtacctgtggtgacgagatgcttagctgcatcgatctcaatccagaacagagactgcgacaggtacctgttcctgagcccaacacacataacggcaccttcactattttgaatttccagggtaattatatttcttatattgatggtaatgtgtggaaagcatactcctggacggaaaaacttatactgcgggagaacaatcttactgagttacacaaagattcctttgaagggcttctttccttacagtacctcgacctgagctgcaacaagatccagtcaatcgagcggcacacttttgagcccctgcctttcttaaaatttatcaacctgtcctgcaatgttatcacagaactcagcttcggcacgtttcaggcctggcacggcatgcagttcctgcacaagctcatcctgaaccacaatccactgactactgtggaagacccctatctcttcaagctgccagcgctgaagtacctggacatgggcacaactctggtcccgcttactaccctgaaaaacatcctgatgatgacagttgagctagagaagctgatcgttccaagccacatggcctgctgcctttgtcaattcaaaaattccattgaagcagtgtgtaagactgtgaagttacactgcaactccgcctgtctcaccaataccactcactgccccgaggaggcttctgtgggaaaccccgagggggcttttatgaaggtgctgcaagctcgtaagaactatacctcaacagagctgattattgagcctgaggagcccagcgactcctccgggattaacctaagcgggtttggcagtgagcagttagatacaaatgacgagtcagatgtcacctcaactctgtcttacatccttccgtacttctccgctgttaacctcgacgtgaagtccctactcctgccatttattaaactccccaccacaggcaactcccttgccaaaattcagaccgtgggcaagaaccggcagaggttgaatcgggtcttgatgggcccaagaagcattcagaaaaggcactttaaagaggtaggacggcagagcattcgaagagagcagggagctcaagccagcgtggagaacacggcagaggagaaaaggttggggtcccctgcgccgcgcgaactcaaacagccccacacacaacaaggcccagagaagctggcgggcaacgccgtatacacaaaaccttctttcacacaggagcacaaggccgctgtatccgttctcaagcccttctccaagggcgccccatctacgtcgtcacccgcaaaggccctgccccaggtccgtgaccgctggaaagatctcacgcatgcaataagcatattggagtctgctaaagctcgagttacgaatatgaaaacctcgaaacccatcgttcactcacgcaaaaagtacaggtttcacaaaactcgcagtaggatgacacaccggacgcccaaggtgaagaagagtcctaaagtaagaaaaaagtcctacctgtctcgactgatgttgagtaaccgactgccgttcagtgctgcaaagtctcttataaattctccttcccaaggcgccttctcatccttgagggatctaagccctcaggagaatccattcttggaagtatccgccccaagcgaacactttatcgagaataacaacacgaaagacacgaccgctcgtaacgcctttgaggaaaatgttttcatggagaatactaacatgcccgagggtacgattagcgagaacaccaactacaatcaccctcccgaagctgactcagccggtaccgccttcaatctgggtccaactgtgaagcagaccgaaacaaagtgggagtacaacaacgtgggaaccgacctaagcccggaaccaaagtcatttaactatccactgctgtctagcccaggtgatcagtttgagattcagcttacccaacagctccagtcagtgattcctaacaacaacgtcagaagactgattgctcatgttattagaaccctcaaaatggactgtagcggcgcacatgtccaagtcacctgcgcaaagctcgtgagccggactggccatctgatgaaactattatcaggtcagcaggaggttaaagccagtaaaattgaatgggacaccgaccagtggaaaactgaaaattatatcaacgagtccacagaagcccagagtgagcaaaaggagaagagtctcgagttcaccaaagagctccccggatacggctacacaaaaaagcttattttggctctgatagtcaccggtattcttacaatactgattatcctcctgtgtctaatagaaatatgctgccacaggaggtcactgcaagaggacgaagaggggttttccagagactctgaagccccgaccgaggaggagtccgaggcattaccttag

SEQ ID NO: 27054 - DNA, 1836 bp, Artificial Sequence
  Description of Artificial Sequence: Synthetic coding sequence
atggcctgttgtctctgccagttcaagaacagcattgaagctgtgtgcaagacagttaagctgcattgtaacagtgcctgtctaacaaatactactcattgccccgaagaggcttccgtaggcaatcccgaaggggcctttatgaaagtcctgcaggctaggaagaactacaccagcactgaacttataatagaacctgaggagccctccgatagttctggaatcaacctgtccggcttcggctccgaacagctggataccaatgatgagtcagatgttactagcactttgagctacatactcccctatttttccgcagtcaacctggacgtgaagtccttactgctgcccttcatcaaacttcccactacaggtaactctctggcaaagatccagacggtgggcaagaacaggcagagactgaatcgtgtgctcatgggaccgcggagtatccaaaagagacacttcaaagaagtagggcgccagtccatcaggcgggagcaaggagcacaagcctctgtggagaacacagctgaagagaaacgacttggttcaccagccccacgagaactgaaacagcctcacactcagcaggggcccgagaaactggcaggtaacgccgtttacaccaagccctcttttacccaggagcacaaggctgcagtgagtgtcttaaaacctttttccaagggcgcgccgagcacctctagcccagcaaaagccctccctcaagtgcgtgatagatggaaggatctgacccatgccatttccatcctcgagtccgcaaaggctagagtgaccaacatgaagacatccaaacctatagtgcactctcggaaaaagtaccggtttcataagacaagatctcgaatgacccaccgtacccccaaggttaaaaagagccccaaagtgcggaagaagagctacttatcccggctgatgctatccaatcgccttcccttttccgccgctaagtcactgatcaactcgccctcccagggagccttctccagcctgagagatcttagccctcaggaaaacccattcctggaagtctccgctccctcagaacactttatcgagaataataatacaaaggacacaacggcgcgtaatgcctttgaggagaatgtgttcatggaaaacaccaacatgccggagggcacaatttcagagaatacgaactacaatcaccccccagaggcggattcagcaggaaccgccttcaacctcggcccgaccgttaaacagacggagaccaaatgggagtataacaatgtgggtacggacctcagccccgagcccaaatccttcaattacccgctgctgagttctcctggcgaccagtttgagattcagctgactcagcagcttcagagtgttattcctaataacaatgtgcgccggcttattgcgcatgttattaggaccctgaaaatggattgcagtggcgcacacgtgcaagtgacatgcgccaagcttgtctcccggaccggccacctgatgaaacttctgtccggacagcaggaggtcaaggcttccaagattgaatgggatactgaccaatggaagaccgaaaattatatcaacgagtcaacggaggcccaatcagaacagaaagagaaaagcctggagtttacgaaagagcttcccggctacggctatactaaaaagttgatactggcactgatcgtcaccggtatcctgaccatcctgataattctactgtgtcttattgaaatttgctgtcaccggcgaagcttgcaagaagacgaggaggggttttcgcgtgatagcgaagctcccacagaagaagagagcgaggctttgccatag

SEQ ID NO: 27055 - DNA, 2148 bp, Artificial Sequence
  Description of Artificial Sequence: Synthetic coding sequence
caccggaactttcaaggaaactatatatcgtacattgacggcaacgtgtggaaagcctattcatggaccgaaaagcttatattgagagagaacaatctgacggagctgcacaaagattctttcgaaggattgctgtcactccagtacttaatcctgaaccacaatcctttaaccaccgtagaagatccttatctctttaaactaccagccctgaaatacctcgacatggggactacgttggtgcctctgacgacgttgaagaacatactgatgatgacggtggagttagaaaaactgattgtgcctagtcatatggcctgctgcttatgccagtttaagaactccatcgaagcggtttgcaagaccgtgaaattgcactgcaattctgcttgtctcactaatactacccactgccccgaagaggctagcgtcggcaaccccgaaggtgcttttatgaaagtgctgcaagctaggaaaaactatactagtaccgaattgataattgagcccgaggaaccgagcgactccagtggcatcaacctcagtgggttcggcagtgaacagctagacactaacgacgagtccgatgtaaccagtacactttcctatattctgccatacttttctgccgtaaacctggatgttaagagtctactccttccatttattaaactgccaaccacagggaatagtctagctaagatccaaacagtgggaaaaaatcgccagaggctcaatcgggttctgatgggccctcggtcaattcaaaagagacacttcaaagaggtgggtaggcaatccatcagaagggaacaaggcgcccaggcttctgtcgaaaatactgccgaagagaaaaggctggggtcgcctgccccaagagaacttaagcagcctcatacccaacaaggcccggagaagcttgctggaaacgcagtttatacaaagccatcattcacccaggagcataaagccgccgtgagcgtgctgaagccgttctcaaagggtgccccttcgacaagctctcccgccaaggccctgcctcaggttcgtgatcggtggaaggacttaactcatgcaatctcaatactggagtccgcgaaggcccgggtgacaaatatgaagactagcaagcccatagtacattctaggaagaaatatagatttcataaaacccggtccaggatgactcataggactcctaaagttaaaaaatcccccaaagtgcggaaaaagagctaccttagcaggctgatgcttagcaaccggctccccttctcggcggccaagtccctgatcaactctccaagtcagggagctttcagctctctgcgagatcttagtccgcaggaaaacccgtttttggaagtgtctgctccttctgagcacttcatcgaaaataacaacacaaaggacacaactgcgcggaacgcttttgaagagaacgtgtttatggagaacacgaacatgcccgaggggaccatttcagagaatacaaattacaatcacccccctgaggccgactccgccggcacggcctttaaccttgggcccactgtcaagcagaccgagactaagtgggaatataacaatgtgggtactgacctctctcctgaaccaaagtcttttaattatccgttgctgtcgagtccaggtgatcagttcgaaatccagctaacacaacagcttcagagtgttataccaaataataacgttcggcgtctgatcgcgcacgttattcgcaccctgaagatggactgcagtggcgcacatgtacaagtaacttgcgccaagcttgtttctcgaacaggccacctcatgaaactgttgtctgggcaacaggaggtgaaggcaagcaaaatcgagtgggatacagaccaatggaaaacggaaaactacatcaacgagagcacagaggctcaatctgaacagaaagagaaaagcctggaattcaccaaagaacttcctggttacgggtacaccaaaaaacttattctggctttgatcgtcactgggatcctcactatcctcatcatcttgctgtgtttaatcgagatctgctgccatagacggagcctccaggaagacgaagaaggattctcacgcgactctgaagccccgaccgaggaagagtctgaggcattaccttag

SEQ ID NO: 27056 - DNA, 2019 bp, Artificial Sequence
  Description of Artificial Sequence: Synthetic coding sequence
atgcagtttttgcacaaactaatactcaatcacaacccactgaccaccgtggaggatccctacttattcaaattaccagccctgaagtatctggacatgggcactaccctggttccactcacaaccctgaagaatattctgatgatgacagtggagcttgagaaattgatagttccaagccatatggcctgttgcctttgccagtttaagaattctatcgaagccgtttgtaaaactgtgaagctgcactgtaactcagcgtgtctaactaatacaacccactgtcccgaggaggcatctgtcggaaaccccgaaggagcatttatgaaggtactacaggcccggaaaaattacaccagtacagaactgatcatagagccagaagaacccagcgacagcagcggaatcaacctctcaggatttgggagcgaacaattggatacaaatgatgagtctgatgtaacgtctaccttgtcctacatactgccttacttttcagccgtcaatttagacgtcaaaagcctgctccttccttttatcaaactgcctacaacagggaactccctcgctaaaatacagactgtgggcaaaaatcgccagaggctgaaccgcgtgctgatgggaccaaggagtatccagaagcggcacttcaaggaggttgggaggcagagcattcggagggaacagggcgctcaagcttctgttgagaacacagcagaggaaaaacggctgggaagtcccgcaccgcgggaactcaaacagccgcatacccagcaaggtccagagaagcttgccggtaatgcggtttacactaaaccttcttttacccaggagcacaaagctgcagtctctgtgctgaaaccattttctaaaggcgctccttcaacatcttctcctgctaaagcgctgccacaggtgcgagacagatggaaagatctcacacacgccatctcgatcctggagtcagccaaggcccgcgttaccaatatgaagacatccaaacctattgtgcacagcaggaaaaaatatcgattccacaaaacccggagccggatgacacacaggactccaaaagtcaagaagagcccaaaggtgcggaaaaaatcgtatctttccaggttgatgttatcaaaccgtcttccctttagcgccgcgaagagcttgataaattctccttcacagggcgcatttagtagtctgagggacctgtctccacaggaaaacccctttctcgaggtgagcgcaccatccgagcacttcattgagaacaacaacactaaggataccactgccaggaatgcttttgaagagaacgtcttcatggaaaacaccaacatgccagaaggcacaatcagcgaaaataccaactacaatcatcctccagaagcagactctgcagggaccgcatttaacttgggtccgactgtgaagcagactgagacaaagtgggagtacaataatgtcggaaccgatctcagtcccgagcccaaatcctttaattacccactgctcagctcccctggcgaccagtttgagatacagctgacgcagcagctgcagagcgtaatacctaataataatgttcgcaggctcatcgcccatgtcattaggactttgaaaatggattgttctggggctcacgtgcaggtaacatgcgccaaattggttagccgcaccggacatctcatgaaactcctgtcgggacagcaggaagtcaaagcctccaaaattgagtgggacactgatcagtggaagacagagaattacattaacgagagcacagaagcccaatctgaacagaaggagaagtccctggagtttactaaggagctccctggctacgggtacactaagaagcttatcttggctctaatagtcaccggaatacttacaatcctgatcattctgctttgcctcatagagatttgttgtcacaggagatcgctacaagaggatgaggaaggctttagccgcgattctgaggcccccacagaggaagaatccgaggccctgccgtag

SEQ ID NO: 27057 - DNA, 5103 bp, Artificial Sequence
  Description of Artificial Sequence: Synthetic coding sequence
atgagtagtgctcagtgcccagccctggtgtgcgtgatgagtagactgaggttttggggcccatggccgctgctgatgtggcagctactctggctactcgtgaaagaggcccagccacttgagtgggtgaaggaccctctgcagctgaccagtaatcccctgggaccacccgagtcctggtcaagccactctagccatttccctagagagtcaccacacgcgcctaccctacccgcagacccgtgggattttgaccatctgggaccttctgctagctcagagatgcctgcgccaccccaggaatctacagaaaacttggtgccatttctcgatacgtgggatagcgcaggtgagcaacccctcgaaccagagcaatttctggcttctcagcaagatttgaaggacaaattgtccccccaggagaggctccccgtgtcgcctaaaaaactgaaaaaggatcccgcccaaagatggtccctagcggagatcattggaatcacacgtcagctttcaaccccacagtcacagaagcaaaccctgcaaaatgaatactcgtcaaccgacaccccataccctgggtccctgcctccggagctgagggttaaaagcgatgagccccctgggccaagcgagcaggtgggcccctcccagttccacctggaacctgaaacccagaatccagaaaccctcgaggatatacagtcttcctctctgcaacaggaggcacccgcccagcttccacaactgttagaagaggagccttccagcatgcagcaggaggcccccgcccttccccccgagtcttcaatggagtccctgacccttcctaatcatgaagtcagcgtccagccccccggcgaggatcaagcatattatcacctgcctaacatcaccgtgaagccagcggacgttgaggtcactatcacaagcgagcccacaaacgagacggagtcctctcaggcacaacaggaaacaccaattcagtttccagaagaggtggagcccagcgctactcagcaagaggcccccatcgagccacctgtgcccccaatggaacatgagctgagtatttccgagcaacagcagcctgtccagccctctgagtctcccagagaggtcgaatctagtcccacccagcaggagacacctggccagccccccgagcaccacgaagttaccgtcagcccgccaggccaccatcagacacatcacttagcctcgccaagcgtgagtgtgaaacctcctgacgttcaactgaccattgccgctgaacccagtgccgaagtgggaaccagtctcgttcaccaagaagccacaacaagactgagcggttcggggaacgatgtagaaccaccagccatacagcacggcggcccccccctgctaccggaatcttcagaagaagcagggcctttagcagtgcagcaagagacaagtttccagtcccccgagccgataaataacgagaacccctcaccgacacagcaggaagccgctgccgagcatcctcaaacagcggaagaaggagagtcctctctaactcatcaggaggcccctgctcaaacgcctgaatttcccaacgtggtggtggctcagccccccgagcattctcaccttacccaggcgacagtccagcctctagaccttggttttaccattaccccggagagcaagaccgaagttgagttgagtcctacaatgaaggagacgcccactcagcctccgaaaaaggtagtgcctcagttacgagtgtatcagggtgtcactaaccccacgcccggccaggatcaggcccaacatccggtttcaccttccgttacagtccagctgctggatctgggcctgactatcacccctgagccaactacagaagtgggccattctacacctccgaaacgaacgattgtgagtccaaagcaccccgaagtaaccttaccgcaccctgaccaagttcagacacaacactctcacctgacgcgcgctacggtccagcctcttgatttgggattcaccattacacctaagtcaatgaccgaagtagagccaagtacggccttaatgacgaccgccccgccccctggccaccctgaagtgactctgcctcccagtgacaaggggcaggcccagcattcccacctgacacaagcaacagtgcagcctttggatctagagctcacaattaccacaaagccaacaactgaagttaaaccttcgcccaccacagaagaaactagcacacaaccccctgatttgggccttgcgatcattcctgaacccactaccgagaccggacacagtaccgctcttgaaaagaccacggcgcctcgcccagaccgagttcagactctgcaccggagtctcactgaggtgacaggacctcccacagaactggagcctgcccaggacagtctagtgcaaagcgaaagctacacccagaacaaggctcttactgcacccgaggagcataaagcatctactagtacgaacatctgtgaactgtgtacttgcggggacgagatgctgtcctgtatagatctgaaccccgaacagcgtctgaggcaagtgcctgtgcccgagcctaacacccataatggcacgtttacaattttgaactttcaggggaattacatttcttatatcgacggaaatgtctggaaagcgtattcctggaccgagaaactgattctgcgcgaaaataatctgaccgaactgcacaaagactctttcgaaggtcttctcagtttgcagtaccttgacctgagttgcaacaaaattcagtcaattgaaagacatactttcgagcccttacccttcctgaagttcatcaacttgtcctgcaacgttataaccgagctgagcttcggtacgtttcaggcatggcatggcatgcagttcttacacaagctgatcctcaatcataatcctctgaccaccgtggaagatccctacctgtttaagctccccgccctgaagtatctggacatgggcactaccctggtgcctttaactactctgaaaaatatcctaatgatgacagtggagctggaaaaactcatcctgccgtcccacatggcgtgttgcttgtgtcagtttaaaaactctatcgaagcagtatgcaagacagtgaaactgcattgtaactctgcctgtcttacgaacacaacccactgtccagaggaggctagtgttggcaaccccgagggtgcattcatgaaggttttacaggccaggaaaaattataccagcaccgagctcattgtcgagccggaggaaccctccgattcgtccggtattaacctgagtggctttgggtctgaacagctagacaccaatgatgaatccgatttcatcagtaccctctcatatatcttaccctactttagcgcagtcaaccttgatgtaaagagcttgctgctaccttttattaagttgccgacaacaggcaactcacttgccaagatccagactgttggacagaatcggcaaagggtaaaacgcgttctgatgggaccacgttccattcagaaaaggcacttcaaggaggtggggcgccaatcaatcaggagagagcagggtgcgcaagcttcggtggagaatgccgctgaggagaaaaggctcaccagtccggcccctcgcgaagtggagcagcctcatacccagcagggtcccgagaagctcgccggaaacgccgtgtatactaagccttctttcactcaggagcacaaggccgctgtgtcggtcctcaagcctttctccaagggcactccttctaccagcagtcccgctaaggccctgccccaggtaagagacaggtctaaagatctaacccacgctatctccatcctggagagtgccaaggcccgggtcacaaatacgaaaacttccaaacccatcgttcatgcccgaaaaaaatatcgctttcacaagacccgcagccacgtcactcacaggaccacaaaggtaaagaagtctccgaaggttcgtaagaaatcatacctaagtcggctgatgctggctaaccggcttccttttagcgccgccaaaagtttgatcaattcaccatctcaaggtgcattctcatccttaggggacctgtcaccgcaggagaacccatttctcgaggtttccgcgctgtctgagcactttatcgagaagaacaataccaagcatacaactgcccgcaacgcctttgaagagaacgactttatggagaacaccaatatgcctgagggaactatctctgagaacactaattataatcaccccccggaggcggactctgcgggtaccgccttcaatcttggccccacagtcaaacagaccgagactaaatgggagtacaataatgtggggactgatcttagcccagagcccaaatcctttaactaccccctactgagtagcccaggggaccagtttgagatccagttaacccagcagctacagtccctcattccaaataacaatgtgagacgactgatcgcccacgtaatcagaaccctgaagatggattgcagcggagcgcatgtacaggttacatgcgctaagctcatatcacgaactggccatctgatgaagctgcttagtggacagcaggaggtgaaagctagcaaaatagagtgggacaccgatcagtggaagatagagaactatataaacgagtccactgaagcccagtcagagcagaaagagaaaagtctcgaactgaaaaaagaagtgcctggctatggctatacagataaactaatcttggctttgatcgtgactgggattttgacaatccttattattctattctgcctgatcgtaatctgctgccataggcggagtctgcaagaggatgaagaaggcttctcccggggaatctttcggtttttgccctggaggggttgcagttccagacgggagtcacaggacggcttgtcttccttcggacagcccctgtggtttaaggatctctataagccgctgagtgcaacaaggattaacaaccacgcctggaaactgcacaagaaatcctcaaatgaggataagatcctgaacagggatcccggcgactcagaggcgccgactgaagaagaggaatctgaagctctgccctag

SEQ ID NO: 27058 - DNA, 5103 bp, Artificial Sequence
  Description of Artificial Sequence: Synthetic coding sequence
atgtcgtcagctcaatgcccagcactggtgtgcgtgatgtcccgccttagattttgggggccttggcctctcctgatgtggcaactcttgtggctcttagtgaaagaagcacagccactggaatgggttaaggaccctttacaactgacaagcaaccctctcgggccccccgagtcctggagttctcattccagccacttccctagggagtcaccacacgccccaacactgccagccgacccatgggacttcgatcaccttggaccaagcgcctcttccgagatgccggccccacctcaggaaagtaccgagaatctagtgccatttttagacacatgggactctgccggcgaacagccgctggagcctgagcagtttctagcctctcagcaggacctcaaagacaagttgagcccccaggaacggttgccagttagccctaagaaactgaaaaaggacccagcacagagatggtctcttgccgagatcataggtataactcgccagttgagtaccccccaaagccagaagcagactctccagaacgaatattcctccaccgacactccctaccccggaagcctgcctccggaattgcgagtaaaaagcgacgagcctccaggcccttctgagcaggtcggtcctagccagttccacctggagcccgagactcagaaccctgagactctggaagatatccagagctcttccttacagcaggaagcccccgcgcagcttccacagcttctcgaggaggagcctagctcaatgcagcaagaggccccagcactgcctcctgaatcatctatggagagcctgactctccctaatcatgaggtctcagtccagcctccaggagaagatcaagcctactatcacctccccaacatcaccgtcaagcccgctgacgttgaggtgacaatcacaagtgagcctacgaatgaaacagagtcgtcccaggcacaacaggagactcccattcagtttcccgaggaggtcgaaccatccgcaacccaacaggaagcacctattgaacctcctgtgccaccaatggaacacgagttatcgatctctgagcagcagcagcctgtgcagccgagtgaatcccctcgggaggtagagagctcacctacacagcaggaaacccccggtcaaccgccagaacaccacgaggtgacggtttctcccccgggacaccaccaaacacaccacttagcgtcaccgtccgtgtccgtcaagccacccgacgtgcagctcaccattgctgccgagccctcagccgaagttggcacctctttagttcatcaagaagctactacaagactctcgggctccggaaatgacgtggagccccctgccatccagcatggtggcccgcctctgctacctgagagctctgaagaggccgggccgctggcggtgcaacaggagacatcattccagtcccctgagccaatcaataatgagaacccttccccaactcagcaagaagcagccgccgagcacccgcagacagccgaggagggggagtcaagcctcactcaccaggaggcccctgcccagaccccagagtttcctaatgtggtggtagcccagccccccgaacactctcacctcacccaggctacagtgcagcccctggatttagggttcaccatcactcccgagagcaagacagaagtggagctgagccctacgatgaaagaaacacccacacagccacccaagaaggtagtgcctcagctgcgcgtgtatcaaggcgtaaccaaccctacccccggccaggaccaagcgcagcaccccgtgtccccatctgtgaccgttcagctgctggatctcggccttaccataactcctgagcccaccacagaagtcggtcatagcacaccacccaagcgtacaattgtaagccctaagcatccagaggttacacttccccacccagaccaggtgcaaacacagcattcgcacttaacgagggctacagtgcaacctctggacctcggattcaccatcaccccgaaatcaatgacagaggtggagccctctaccgctctcatgacaacagcgccccctcccggccatcctgaagtgacactcccaccaagcgataaaggtcaggcccagcatagccatctgacacaggccaccgtccagcctttagatctcgagctgacgatcactacaaagccaaccacagaggtaaagcctagtcctacaactgaggaaaccagtactcaaccgcccgacctgggcctggcgatcattcctgagcctactacagagaccggccactccactgctcttgagaaaactacggcaccacggccagatagggtgcagacactccatcggagtctgacggaagttactggcccccctacagagttggaacccgcccaggactctctagtccaaagcgaatcatacacacaaaataaggccctaacagcccctgaggagcacaaagcttccacttctaccaatatctgcgagttgtgcacttgtggtgatgaaatgctgtcctgtattgatctgaatcccgagcagagactccggcaagtccctgtgccggaaccaaacactcataacgggactttcactatcttaaatttccaaggtaattacatctcctatattgatgggaacgtttggaaggcctacagttggacggagaaactcattctgagagagaataatctaactgagctgcacaaagatagtttcgagggcctactctcgctgcaatatctggatctttcatgtaataagattcagagtattgagcgtcacacatttgagcccctgccttttctgaagtttataaatttgagctgcaatgtgattacagagcttagctttggcacatttcaggcctggcacggaatgcagtttctgcacaaactcatcctaaaccacaaccccctcacaaccgtagaggacccgtacctcttcaagctgcccgcactcaagtatctcgacatggggaccaccctcgtgccacttacgacactgaagaacatcctcatgatgaccgtagagctcgagaagctgatcctgccttcacacatggcttgttgcctatgtcaattcaaaaactcgattgaagccgtgtgcaagaccgtgaaacttcattgtaactctgcttgcctgacgaatacaactcactgcccagaagaggcatcagtcggaaatcctgaaggcgcgtttatgaaagtgttacaagccagaaagaattatacctcaaccgagctcatcgtagaacccgaggaaccatctgatagtagcggcattaacttgtctggatttgggagcgagcagctcgacaccaatgacgagtctgattttattagcacactttcatacatcttgccatacttcagcgccgtgaatctcgacgtgaagagtttactgctcccattcattaagctacccacaactggcaatagcctggccaagatccaaacagtgggtcaaaatagacagcgcgtaaagagggtgctgatgggacctcggtcaatccagaagagacatttcaaagaggttggaaggcagagcatccgaagggagcagggcgcccaggcaagtgtggagaacgcggccgaggagaaacggcttacttcacctgcaccccgagaggtggaacaaccacacacgcaacagggacctgagaagctggccggcaacgccgtgtacacaaagccttccttcacacaggaacacaaagctgccgtgagcgtgttgaaacctttctccaaagggacccccagcacaagctccccagccaaagccctgccacaggtgagggataggtcaaaggatttaacacatgcgatctcgattttggagtcggccaaggccagggtcacaaacaccaaaacttccaagcccatcgtacacgcccgaaaaaagtatagatttcacaaaacaagatcacatgtgacacacaggacgaccaaggtcaagaaaagccccaaagtgcggaagaaatcttatctcagccgcctaatgctggctaataggcttcctttcagtgctgctaaatcattaattaactcaccctcacagggggctttcagctccctcggcgatctgtctcctcaggagaacccctttttagaagtgagcgcactgtctgagcatttcatcgaaaaaaataataccaaacacaccacggcccggaatgcttttgaagagaatgacttcatggaaaatactaacatgcctgaggggaccatctccgagaacaccaactacaaccaccccccagaagccgattctgcaggtacagccttcaatttaggaccgacagtgaagcagacagagaccaagtgggaatacaacaatgtgggaaccgatctgtccccagagcctaaaagttttaattatcctctgttatcatctccaggtgatcagttcgagatccagcttactcaacagctgcaatctctgatacccaacaataatgtccgtcgccttatcgctcacgtgatccggacactgaagatggattgtagcggggcccacgtccaagtcacatgcgctaaactgatctctcggacgggacatctgatgaagttactctccggccagcaggaagtgaaggcctccaaaattgagtgggatacggatcagtggaagatagagaattatattaacgagtccactgaggcccagagcgaacagaaggagaagagcctggaactaaagaaagaggttcccggatatggctacaccgataagttgatactggccctgatcgtgaccggaatcctgactatcctgataattctgttttgccttattgtcatttgttgtcatcgcagaagtttacaagaagacgaggagggattctccagagggatttttaggtttctgccttggagggggtgctcatcaaggagggagagccaggatgggctctccagctttgggcagcccctgtggtttaaagatctttataagcccctgagtgcgaccaggattaacaatcatgcgtggaagctgcataagaaatccagcaacgaagacaagatcttaaacagagacccaggagattccgaggccccaaccgaagaggaagaaagtgaggccttgccatag

SEQ ID NO: 27059 - DNA, 2925 bp, Artificial Sequence
  Description of Artificial Sequence: Synthetic coding sequence
atggctcatgcttacaaggggcatgagcacttgcgggccgccaggatggcatttgctgagtgcattgctcctgcgtgcgtcatgagctggctgaggttttggggcccttggccccttctgacatggcagttgctgagccttttggttaaagaggctcaaccccttgtgtgggtgaaagatccactccaacttacctcgaatccactcggacccccagaaccctggagtagcagatcttcccacctcccttgggagtcgccacatgcacccgcccccccagccgcacctggcgattttgattatctcggaccatcagcttcatctcaaatgagcgcactgcctcaggagcccacagagaacctggccccctttctcaaagagttagattccgctggagaattaccattgggaccagaaccgttccttgccgcccatcaagacttgaacgataaaaggacccctgaggaaaggcttcccgaggtggtcccacttttgaacagggatcagaaccaagcacttgtccagttgcccagactaaagtgggttcaaactacggacttggatcgcgccgccggccaccaggccgatgagatactggtcccattggacagtaaagtgagtcggcccaccaagtttgtggttagccccaagaacctcaagaaagatttagctgagagatggtccttacccgaaatcgtgggaatacctcatcagcttagcaaaccccagaggcaaaagcagacgcttcctgacgattatctgagcatggatacgctgtaccctggtagtctgccgccagagcttcgcgttaatgcagacgagcccccaggcccccccgaacaggtgggattaagccaatttcacctggagcctaagtcgcagaaccccgagactctggaagatatccaatcgtcgtccctccaggaagaggctcccgcacaactgctccagttgcctcaggaagtggaacccagcacccagcaagaagctccggccctgcctcccgagagcagtatggaaagcctggcacaaactccactgaatcacgaagtcactgttcagccgcctggggaggatcaggcccattacaacctccccaagtttacagttaagcccgctgacgtcgaggttaccatgacatctgaaccgaaaaatgagaccgaatctacccaggcccagcaggaagccccgatccagccgccagaggaagcagagccttcctcaaccgcactcaggactacagacccaccacccgaacaccctgaggtgactttgccccccagcgataaagggcaggcacagcacagccacctgactgaagctaccgtgcagcctcttgatctggagctgagcattactaccgagcccaccactgaagtgaagccatcgcccaccaccgaagagaccagcgcgcagcctcccgaccccgggcttgctatcacaccggagcccaccactgagatcgggcacagcactgccttggaaaagacaagggctccccacccggaccaggtgcagacactgcacaggtctctcacagaggtgaccggcccaccgaccaaactggaaagtagccaggatagcctcgtccaaagcgagaccgcaccagaggagcagaaggccagcacgtccaccaacatctgcgaactgtgcacgtgcggggatgagactctcagctgcgttggtctgagccccaagcagcgcctccggcaggtccccgtgccagaacctgacacatacaatggtatttttaccacgctgaacttccagggaaactacatcagctacttggacggtaatgtctggaaggcatattcatggacggagaagttaattctttccgagaattacctcacggagctccctaaggacagttttgaaggactgctgtacctgcagtatcttgacctctcatgtaataagataagatacatcgaaagacaaaccttcgagagcttgccgttcctgcaatacatcaaccttgggtgtaatctgatcaccaagctgtccctgggcacttttcaagcctggcacggaatgcaatttctgcacaatctgatcctgaatcgaaatccccttaccaccgtggaggacccttacttgttcgaacttccggccctaaaatacctggatatgggcacaacacacattacgctgacaacacttaaaaacatcctgaccatgacggtggagttggagaagctgatcctacctagccatatggcctgttgcctctgtcagttcaaaaatagtatagaggccgtttgcaagacagtcaaactgcattgtaacaccgcctgcctcacgaattccatccactgccccgaggaagcttccgtgggcaaccccgagggagccttcatgaagatgttacaggcccgtaaacagcatatgtccacccagttgactatcgagtcagaggcccccagtgattctagtggcattaacctgagtggattcggaggagaccagctcgagattcaactgaccgaacaattgcgctctctgattccgaacgaggacgtacggaagttcatgtcacatgttatccgaactctgaaaatggaatgctcggagactcacgttcaggggagctgtgcaaagctcatgctgcggacaggcttgctgatgaaactcttgtccgagcagcaggaggctaaggccctgaacgtggaatgggatacggatcaacagaagactaactacattaacgagaacatggagcagaacgagcagaaggaacaaaagagcagcgaacttatgaaagaagttcccggtgatgactacaagaataaactcatctttgccatttccgttacagtaatactgatcatactcatcattatcttttgtctaatagaggttaactcccacaaaagggctagcgaaaaatataaagacaaccctagcatctcaggggcatag

SEQ ID NO: 27060 - DNA, 2844 bp, Artificial Sequence
  Description of Artificial Sequence: Synthetic coding sequence
atgagctggctgaggttttggggaccatggccattattgacctggcagctcctgtctcttctggtgaaggaggcccagccattagtttgggtgaaggaccccctgcagctgacaagcaatcccctaggaccccccgaaccgtggtctagccggagcagccacctgccatgggagagtcctcacgctcctgccccacccgcagcacctggcgactttgattacctgggtccgagcgcttctagtcagatgtccgccttgccccaggagcccacagaaaaccttgcccccttccttaaagagctagatagcgctggagaactcccattggggccggagccgtttctggcagcccaccaggatctgaatgacaagagaacccccgaggagagactaccggaagtcgtgcctttgctgaatagagatcaaaaccaggcactagtacagctccccagactcaaatgggtgcagactactgacttggacagggctgcgggtcaccaagccgacgagattttggtcccattggacagcaaagtgagtaggcctactaagttcgttgtgtccccgaaaaacttaaaaaaggacctcgcagagaggtggtcattacccgagatcgttggaatcccccaccagctgagcaagcctcaacggcagaaacaaactctgccggacgattacctaagtatggacacactgtatcccggatccctgccccccgaactgagggtgaatgcagacgaaccacccggaccccccgagcaggttggcttgtcgcaatttcacctggagcccaagagccagaatccagaaaccttggaggacattcagtccagtagtctgcaggaagaagcccccgctcagctgctacagctcccgcaagaagtcgagccgtctactcagcaggaggctccagcgctgccgcccgaatcaagtatggaatcattagcacagactcctctgaatcacgaggttacagtccagcctccaggtgaagaccaagcccattacaatctacccaaatttactgtcaagcccgccgatgtggaggtgacaatgacctctgaaccgaaaaacgagaccgaaagtacacaggcccagcaagaggcaccaatacagcccccggaagaggccgaacccagctcaaccgctctccgcaccactgaccctcctccagaacacccagaagtgacactcccgccatccgacaagggccaggcccagcactcccatctaacagaggctactgtccaaccgctggatctggagctcagcatcactacagaacctacaaccgaagttaagccttcgcccacgacagaggagacaagcgcccagcctcctgacccaggtcttgctatcacacccgagcccacgactgagattggccactcaaccgctctggaaaaaacgcgagcccctcatcccgatcaagtgcagaccctccacagatccttgacggaggtgaccggaccgccaactaagctggaatcttcccaggacagccttgtacagtctgagactgccccggaggagcaaaaggctagtacctccactaacatctgcgagctgtgcacctgtggcgacgagactttgtcctgtgtgggactctcccctaagcagcgcctacgtcaggtcccagtcccagagcctgatacatacaacgggattttcaccacactgaatttccagggaaattacatttcatacttagatgggaatgtctggaaggcatactcttggactgagaagctgatcctctcagaaaactacctcacagagctccctaaggactcattcgagggactattatatctgcaatacctggacctgtcttgtaacaaaatcaggtacattgagagacagacattcgagtctcttccattcctgcagtatataaacttggggtgtaacctgatcaccaagttgtcacttggcaccttccaggcctggcacggcatgcagtttctgcataatcttatcctgaatcggaaccctctgaccaccgttgaggacccataccttttcgagttacccgccctgaaatacttggatatggggactacgcacattaccctgactacgctcaagaatattttaacgatgacagtggagctggagaaattaatattgccaagccatatggcatgttgtctgtgtcagtttaaaaactcaattgaagccgtttgcaagaccgtcaagctccactgcaacacagcctgtctgaccaactctatccactgccccgaggaggcgagcgttggaaatccggaaggtgccttcatgaaaatgctgcaagcgaggaaacagcacatgtcaacccaactgaccatagagagcgaggctccatcagatagttcggggattaaccttagtggctttgggggggatcagctggagatccagctcactgagcagctaaggagcctgatcccaaacgaagatgtgagaaagttcatgagccacgtcattcggacactcaagatggaatgctcagaaacacatgttcaaggcagctgcgcgaagttgatgcttcggacaggtctgttgatgaagctcctgtccgaacagcaggaggctaaagctctgaacgtggaatgggacactgatcaacaaaagaccaattatattaatgagaatatggaacaaaatgagcagaaggaacaaaaatcaagcgaactaatgaaagaagtacctggcgatgactacaaaaacaagctgattttcgccatttctgtgaccgtgattctcattattctgatcattatcttttgtttgatcgaggtcaatagccataaacgcgcgagtgagaaatataaggacaatcccagtatcagcggggcgtag

SEQ ID NO: 27061 - DNA, 2691 bp, Artificial Sequence
  Description of Artificial Sequence: Synthetic coding sequence
atgagttggctgcgattctggggcccatggccactccttacatggcaactgcttagcctgttggtgaaagaggcccagcctctagtgtgggtgaaggatcctctacagctaacatcaaacccactgggacctccagaaccatggtcttcacgaagctctcacctgccttgggaatctccccacgcccctgcaccccctgccgctcctggagacttcgattacctgggtccgagtgcttccagccagatgtctgcattaccacaggaacccaccgagaacctggctccattcttaaaggaactggatagtgccggcgaactgcccctgggccccgaaccgttccttgctgcccatcaggacttgaatgataagagaactcctgaggagcggctgcccgaagtggtgccgctcctgaatcgcgatcagaatcaggcactggtgcaattaccaagactcaaatgggttcagacgactgatctcgacagggcagctggccatcaggcagatgaaattcttgtcccgttagactcaaaggtctcccgaccaactaagtttgtcgttagtccaaagaatcttaagaaggatctggcggaaaggtggtctctacctgaaattgttggcattccacatcagttatccaaaccgcagaggcaaaagcaaactctgccggacgactatctgtctatggataccctgtacccaggttcactgccaccagagctgagggtcaatgctgacgagccgcctgggccccccgagcaagtcggattatcacaattccatctcgaacccaagtcgcagaatccggagaccctcgaggatatccagagctcttcgctccaggaagaagcgcctgcccagctgcttcagctgccacaggaggtggaaccaagcacgcagcaggaggcacccgcccttcctcctgaaagttccatggagagcctcgcgcagacacccctcaaccacgaagtaactgtgcagcctccgggtgaggaccaggcgcactataacctgccaaagtttaccgtgaagcccgccgatgtagaggtgacaatgactagcgaaccgaaaaacgagacggaatcaacacaggctcagcaggaggcgcccattcagccccctgaggaggccgagccttcctcaacagctctaaggacaaccgaccctcctcccgagcaccctgaggtaacgctgccgcccagcgataagggccaggcccagcattctcacctgacagaggcaactgtgcaacctcttgacctggagctgtccatcacaacagaacccaccactgaggtgaaacccagtcccacaaccgaggagacttcagctcagccccccgatcccggcctggccattacccccgagcccactaccgaaattggccactccactgccctcgaaaaaacacgggccccccatcctgaccaagtgcagaccctgcaccgctccctgaccgaagtgactgggccacctactaaactagagtcctcacaggactcactagtgcaatctgagacggccccagaagaacagaaggcaagcacctcaacaaatatctgcgaactgtgcacatgcggggatgaaaccttgtcctgcgtaggactgtcacccaagcagcggctccgacaggtaccggtaccagaacctgacacctataacgggatttttacgaccttgaatttccaaggaaactacatcagctatctggacggcaatgtgtggaaagcctacagctggactgagaagcttatcctgagcgagaactacctcacagaactccccaaggactcgttcgagggcctcctctatctgcagtatctgattctcaatcgtaaccctttgacaaccgtggaggatccgtacctcttcgagctgccagctctgaagtacctcgatatgggcaccacgcacataaccctcactacactgaagaacatcttaacaatgacagtcgaattggaaaaattaattcttccatctcacatggcctgctgcctgtgtcagttcaaaaattcaattgaggcagtgtgcaagacagttaagttgcattgtaacaccgcatgtttgacaaactctatccactgtcctgaagaggctagtgttggcaacccagaaggagccttcatgaaaatgctgcaagctcgcaagcagcatatgtcaactcagttaacgatcgagtccgaggcgccgtccgactctagtggcatcaacctgtctggatttgggggcgatcagttggagatacaattgaccgagcagctgcggagtttgattccaaatgaggatgtgcggaaatttatgagtcacgtgatcaggacactgaaaatggagtgctcagagacacatgtccagggatcgtgtgccaagctgatgctcaggaccggccttctgatgaagctccttagtgaacagcaggaggcaaaggccttgaatgtcgagtgggataccgaccaacaaaaaacaaactacattaacgaaaatatggaacagaacgaacaaaaagaacaaaaatccagcgaattaatgaaggaagtgcccggcgatgattataagaacaagctcatttttgcaatcagcgtcacagtgatcctgatcatactgatcataattttctgtctgattgaagtcaattctcacaagcgtgcttctgaaaaatataaggataatcctagtatcagtggagcctag

SEQ ID NO: 27062 - DNA, 2598 bp, Artificial Sequence
  Description of Artificial Sequence: Synthetic coding sequence
atgagtgccctgccgcaggagcccacagagaacctggccccattcctaaaagagctcgattctgcaggggagctgcccctcggacctgagccttttttagccgcacaccaggacttaaacgacaaaaggacaccagaggagcgtctgccagaagtagtgccactgctgaaccgggaccagaaccaagctctcgttcaattaccccgcctcaagtgggtccagactaccgacctggaccgggcagcagggcatcaggctgatgagatcctagtgcctcttgattcgaaggtgagtcggccaacaaagtttgtggtaagtcctaagaaccttaagaaggacctcgcagaacgatggtcgctgcccgaaattgtggggatcccccatcagttatctaagccacagcgacaaaagcagaccctccccgatgattatttatctatggacaccctctaccccggcagcctgccacccgaattgcgggtcaatgccgatgaacctcccggcccaccagagcaggtaggactctcacagtttcacctcgaacccaagagccagaatcctgaaaccttagaggatatccagtcctcatcgttgcaagaggaggcccctgcacagctccttcagcttccacaggaggtggaacccagtacccaacaagaggctcccgcgttaccaccagaatcctctatggaatctctcgcccagacccctctgaaccacgaagtgaccgttcaaccccccggcgaagaccaggctcactataacttgccaaagttcacggtaaaacctgcagatgtcgaggtaactatgacaagcgaaccgaagaacgagacagagtcaactcaggctcagcaggaggccccaatccagcccccggaggaagctgagccctcctccaccgcactacggaccacggatcccccccctgagcatccagaggttacacttccacctagtgacaagggtcaggcccagcattcccacctcaccgaagccacggtgcagcctctggatctagagctgtccatcaccacagaacccacaactgaggtgaaaccttcacctaccaccgaggaaacctcagcccagccaccggatccgggattggcaattaccccagagcctacgactgagatcgggcacagcaccgctctggagaagacccgggcacctcatcccgaccaagtgcaaacactgcaccggagtcttactgaagtgactgggcctcctacaaagttggagagtagccaggattcccttgtacagtcagaaaccgctccggaggagcaaaaagcttccacatccacaaatatctgcgagttgtgcacatgcggtgacgagactcttagctgcgtgggtctgagcccaaaacaaagactcaggcaggtgcctgtcccagaacccgacacatataatggtatcttcacaacgctgaacttccaaggcaactatatatcctatctggacggcaacgtgtggaaagcatactcatggactgagaagcttatcttgagcgagaactacctcaccgaactcccaaaggatagtttcgaaggcctactgtaccttcaatatttagatctaagctgcaataagattcggtacattgagcggcagacgttcgagagcctgccctttcttcagtatatcaacctcggttgcaatcttattacaaagctgtccttgggtacattccaggcctggcatgggatgcagttccttcacaaccttatcctgaaccgcaaccctctaacaacggtggaggacccatacctgtttgagctccccgctctgaagtacctggacatgggtactacgcatattaccctgacaaccttgaaaaatatactgactatgacagtggagttggagaagctgatactgccatctcatatggcttgttgcctgtgtcagtttaagaactctattgaagccgtgtgcaagacagtgaaacttcactgcaataccgcctgtttgacaaactcaattcattgcccagaggaggcttcagtggggaaccctgagggtgctttcatgaagatgctgcaagcacgcaagcagcatatgtccacgcagcttaccatcgagtccgaggctccgagcgatagctctggaattaatttgtcaggttttggcggagaccaactggagatacaactgactgagcagcttcggtcactcatacccaatgaagatgtgcgaaagttcatgagccacgtgattcgcaccctgaagatggagtgttctgagacccacgtacagggcagttgcgcgaagcttatgcttagaacaggacttcttatgaaactgctgtcagagcaacaggaggctaaggccttgaacgtagaatgggatactgaccaacagaagacaaattacataaatgagaatatggaacagaacgagcagaaagaacaaaagagctccgagttgatgaaagaggtgcctggagacgactataaaaacaaattgatctttgctatctctgtcaccgtcatcctgattatactgatcataatattttgcttgattgaagtcaacagtcataagcgcgccagcgaaaaatacaaggataatcccagcatcagcggtgcctag

SEQ ID NO: 27063 - DNA, 885 bp, Artificial Sequence
  Description of Artificial Sequence: Synthetic coding sequence
atgcgtcctagggcccctgcttgtgctgccgctgccctcggactctgttctctgctgttactgttagctcccgggcacgcgtgcccagctggatgcgcttgtaccgatccccacactgtggactgtagagatcggggcctacccagtgttccagatccctttcccctggatgtcaggaaactgctcgtggctggaaacaggatccaacgaattccagaggatttcttcatattctatggcgacctggtgtatttagatttccggaacaacagcctgcggtcactggaagaagggacctttagtgggtcagccaaactggtgttccttgatctctcttataacaacctaacccagctgggagcaggagccttccgtagtgccggccgactcgtcaaactcagtttggccaataacaaccttgtaggtgtgcatgaagacgcctttgaaaccttggaatctcttcaagttctagagcttaatgacaataacctaagaagcttgagcgtagcagccttggctgccctcccagccctgagaagcctaaggctggacggcaacccctggctttgcgattgtgatttcgcacatcttttcagctggatccaggaaaatgcctctaaattaccaaaagggttagacgaaattcaatgcagcctgccaatggaatctaggaggatctctctgagggagctgtccgaggcctctttctccgagtgccgcttttcactgtcactgaccgacctgtgcatcattatcttttctggggtcgccgtcagtatcgccgcaattatttcctctttcttcctagccacagtcgtgcagtgcctgcagcgatgcgccccaaataaggacgctgaggacgaggacgaagataaagacgactag

SEQ ID NO: 27064 - DNA, 780 bp, Artificial Sequence
  Description of Artificial Sequence: Synthetic coding sequence
atgaacctggtggatctgtggttgacccggtccctgtcaatgtgccttcttctccagagttttgtgttaatgatcctttgctttcacagtgcgtccatgtgcccgaaagggtgcctctgctcttcctctggaggtttaaacgtaacatgttctaatgccaacctgaaggaaattcctagggacctccccccagagaccgtattgctatacctcgattctaatcaaattacctctattcccaacgaaattttcaaggacctccaccagctccgagtgttgaacctctcgaagaacgggattgagtttatcgacgagcacgcgttcaagggggtcgccgagaccttacagacattggacctttccgataatcggatacaaagcgtccacaaaaatgcctttaataatcttaaggccagggccaggattgctaacaatccctggcactgcgattgcacactgcagcaagttcttaggagcatggcctccaaccacgagaccgcacacaacgttatatgtaagacgtcagtgctggatgaacatgcaggacggccctttttgaacgctgctaacgacgctgatctctgcaacttaccgaaaaaaacgactgattatgcaatgttggtgacgatgttcggctggttcacgatggtcattagctatgtagtttactacgtgcgccagaaccaggaagacgcaaggcgacatcttgaatacttgaagtcactgccatctcgccagaagaaggctgacgaacctgacgacatttcaaccgtagtttag

SEQ ID NO: 27065 - DNA, 168 bp, Artificial Sequence
  Description of Artificial Sequence: Synthetic coding sequence
atgaatctggtggatctctggttgacacgcagcctgagtatgtgcctgctgttacagtcctttgtcctcatgatcctgtgctttcactccgccagtatgtgcccaaaaggatgtctgtgctcctcgtctggaggactaaatgtcacatgctccaacgcgaacctgtag

SEQ ID NO: 27066 - DNA, 780 bp, Artificial Sequence
  Description of Artificial Sequence: Synthetic coding sequence
atgaatctcgtcgatctctggctgacccgctctttgtccatgtgtctgctcctccagtccttcgtcttgatgatcctttgcttccactctgcctctatgtgccccaaaggctgcttgtgcagcagctccggtggcttgaatgttacatgctcaaatgccaatctgaaggagatccctagggacttgccaccagagaccgtcctgctgtatctggatagcaatcagattacctcaatacccaacgaaattttcaaagacttgcatcagttgagagtcttgaacctttcaaaaaatggcatcgaatttatcgatgaacacgccttcaaaggtgtcgcagaaacgctccagaccctggacttaagcgacaatagaatccagtcagttcacaaaaacgccttcaacaacttgaaggcacgtgctcggattgcaaataacccctggcactgtgactgtactctacagcaggtgctgcgctctatggcaagcaaccacgagacagcacacaacgtgatttgcaaaactagtgtcctagacgaacacgctggacggccctttctcaatgcagcaaacgatgccgatttatgcaatctgccaaagaagactaccgattacgccatgctggtgacaatgtttggctggttcacaatggtaattagctatgtggtttattatgtgcggcagaaccaagaagacgctcgcagacacctggagtacctcaaatctctccctagccgtcagaaaaaggccgatgaaccggacgatatttcaacagtggtgtag

SEQ ID NO: 27067 - DNA, 492 bp, Artificial Sequence
  Description of Artificial Sequence: Synthetic coding sequence
atgaatctggtggacctgtggctgacccggtctctaagcatgtgtctcctgttacagtcatttgtgttaatgatcctttgctttcattccgcctctatgtgtccaaagggatgtttatgcagtagctcagggggactgaacgttacatgctctaatgcgaacctgaaggagatccctcgagatctgccaccagaaaccgtgctgctgtatctcgactctaatcaaatcacgtctattcctaatgaaatattcaaagatctgcaccagctgcgagtattgaatctgtcaaagaatggtatcgaattcattgatgaacacgccttcaaaggcgtggcggagacactgcagacactcgacctctccgataacagaatccagagcgttcacaagaatgcattcaacaatctgaaggcacgcgcccgaattgctaacaatccctggcattgcgattgtacgctacaacaggtcttacggtcaatggcatccaattag

SEQ ID NO: 27068 - DNA, 780 bp, Artificial Sequence
  Description of Artificial Sequence: Synthetic coding sequence
atgaatctagtagatctctggctcacacgtagtctttccatgtgcctgcttttgcaatctttcgtgctcatgatcctttgttttcattctgcttcaatgtgtccaaaaggctgcctatgttcttctagtggtggcctgaatgtcacttgtagtaacgcaaacttgaaggaaattccacgtgacctgcctcctgaaacagtcttgctgtatttagattctaaccagataactagcatccctaatgaaatctttaaagacctccaccagctgagggtcttgaacctgtccaagaacgggattgagtttatagacgaacatgcatttaaaggcgtagccgaaactctgcaaacactggatctgtcagacaacaggatccaatctgtccacaagaacgctttcaacaacctgaaggctagggcccgcatagcaaacaatccgtggcattgtgattgcacgctgcagcaggtgctgcgctcaatggcatctaaccatgaaacagcccacaacgtcatctgcaaaaccagtgtcttggacgagcacgccggtagaccatttctgaacgccgcgaacgatgccgacctgtgcaatcttcccaaaaagacgactgactacgctatgcttgttacgatgtttggctggttcactatggtaatcagttatgtggtctattatgtccggcagaatcaggaagacgcccgcagacatctcgaatacctaaaatcccttccttccagacagaagaaggcagatgaacccgacgacataagcacagtagtgtag

SEQ ID NO: 27069 - DNA, 828 bp, Artificial Sequence
  Description of Artificial Sequence: Synthetic coding sequence
atgcgcatgactagcagcagttttgtgtcgtactgcacccctggtttatgccagttcatggcaatgctgcccactgccggacacctgttacctctcttactggtcatcggaaccgggggcactgtccctagcccgcaggtgcccccgcggggatgctatgtggccaaagaagccggcgagcgcacgtttaggtgttctcaggctggcctctctgccgtgccttccgggattccaaatgacactcgtaagctgtacctggatgccaatcagctggcctcagtccccgctggcgctttccagcatctgccagttcttgaggagctcgacctgagccacaatgcgctcgctcatctgtctggagccgcattccaaggactggagggaactctgaggcacctggatctgtccgccaaccagttggcgtctgtgcccgtggaggcattcgtggggctacagatccaggtgaacttatccgcgaacccttggcactgtgactgtgctctccaggaggtgctacgccaagtaagacttgttccaggaactggcacgggcattgtgtgtggttccggcgcaaggccagatctagttggacaggaattcttactattagccggagaggaagaactctgtgggtcgggatggggtggcgctagacgctcaaccgatgtcgccctcctcgtaactatgggcggatggctcacgctgatggttgcttacctggtgcattatgtgtggcaaaatcgggacgaaacacgccgctctctgaaacgcgcaccggtactgcctgttcgcagtgaggactcctctatccttagcacggtagtctag

SEQ ID NO: 27070 - DNA, 1962 bp, Artificial Sequence
  Description of Artificial Sequence: Synthetic coding sequence
atgaagctgctttggcaggttactgtccatcaccacacttggaatgccatattgttgccctttgtgtatctgacagcacaggtttggattttatgtgcagccatcgctgctgctgcaagtgccgggccccagaactgtcccagtgtgtgcagctgctccaatcagttctcgaaggtggtgtgcaccagaaggggcctgtcagaagtaccccaaggaatcccatctaatacgaggtatcttaacctgatggaaaacaatatacagatgatccaggccgacactttcaggcacttacaccatcttgaggtgctgcagctcggtaggaactcaattcggcagattgaggtcggcgcctttaacggcctggcgagcctcaatactttggagctgttcgataactggctgacagtaattcccagtggagcatttgagtatttgtcgaaattgagggaactctggctgcgcaacaacccgatcgagtctatcccttcttacgctttcaaccgggtgccttcgcttatgagactagatctcggggagctcaaaaaactcgaatacatatccgaaggtgctttcgaaggactatttaacctgaagtacctgaacctcggaatgtgtaacataaaagatatgccaaatctgacacccctcgtaggtctcgaggagctggagatgagcgggaaccattttcccgagattaggccagggagtttccacggtttgtctagcttaaaaaaattgtgggtgatgaactcccaggtcagcctaatcgagcgcaacgccttcgacgggctggccagcctcgtggaactgaatctcgcgcataacaacctgtcctcactgccccatgatctttttactcctcttcgctacctggtggagctgcacctgcatcacaacccttggaattgtgattgtgacatcctgtggctcgcttggtggttgagagaatacattcccaccaattccacctgttgtggaagatgtcatgccccaatgcacatgcgcggacgttatcttgtggaggtggaccaggcttcgtttcagtgttcggcccctttcattatggacgcgccaagggaccttaacatctcggaagggcgtatggccgaacttaaatgcaggacgccacccatgtccagtgtgaagtggctccttcctaatggtacggttctgtcacacgcatctaggcatccccgcatctctgttttaaatgacgggactctcaactttagccacgtgctgctgagtgacacgggggtgtatacatgtatggtcaccaatgtcgccggcaattctaacgcgagcgcctacctgaatgtcagtaccgctgagctgaacaccagtaattacagtttcttcactacagtaaccgtggagaccaccgagatctcacccgaggacacaactagaaaatataaacccgtgcctactacgagcaccggttaccagcccgcctacaccacttccactactgtactgattcagactactcgggttcctaaacaggtggccgtccccgcaaccgacacaaccgataagatgcagacttcactcgatgaggtgatgaagaccactaagatcatcatcggctgctttgttgccgtaaccctgttagctgcagcaatgctgatagtgttttataaactccgcaagcgccaccagcagcgaagtaccgttacagcagctaggacagtagaaattatacaagtagacgaggatattcccgcggctactagcgctgcggccactgcagctccaagtggcgtgagtggcgaaggggcagtggtcctcccaaccattcacgaccacattaactacaatacttacaagcccgcacacggggcgcactggactgaaaacagccttggcaacagcctacaccccacggtcaccaccatttctgaaccttatattatccagactcacacgaaggataaggtgcaggaaacgcagatttag

SEQ ID NO: 27071 - DNA, 285 bp, Artificial Sequence
  Description of Artificial Sequence: Synthetic coding sequence
atgaaactcttatggcaggtcaccgtccaccaccacacgtggaacgccatccttttaccttttgtgtacctcactgcccaagtttggatactgtgtgccgcaatcgcggcggcagcctctgctggaccccaaaattgtccaagtgtgtgtagttgctcaaatcagttcagtaaggtggtgtgtacacgccgcggactttctgaggttccccaagggatcccttcgaatactcgttacctcaacctgatggaaaacaacattcagatgatccaggcagatacgtag

SEQ ID NO: 27072 - DNA, 156 bp, Artificial Sequence
  Description of Artificial Sequence: Synthetic coding sequence
atgaaactcttatggcaagttaccgtccaccaccacacttggaatgccattctgcttccattcgtctacttgacagctcaggtgtggatattatgcgcagcaattgccgctgccgcctcagccggccctcagaattgtccttcagtgtgctcgtag

SEQ ID NO: 27073 - DNA, 2142 bp, Artificial Sequence
  Description of Artificial Sequence: Synthetic coding sequence
atggcgcgtgctcgcgggagtccatgtcccccactgccacccggcagaatgtcatggcctcatggcgccttacttttcctgtggttattctcacctccccttggcgccggtggtggcggagtggctgtgacgtcagccgctggagggggatcaccccccgcaacttcctgcccagtggcctgtagttgcagcaatcaagcttcccgcgtgatctgcaccaggagggacctggcagaagtaccagcttcaatcccagtcaatactcgatatttgaacctccaggagaatggcattcaggttatcagaaccgatactttcaagcatttgcgtcatctcgaaatcctccagctgagtaagaacctggtgcgcaagatcgaggtcggggcttttaacggactgccaagtctgaatacgctggagctgtttgacaatcgattgaccacagtccccacccaggcgtttgagtacctgagcaagctgagggaactgtggttgcgcaacaatcccattgagtctattccgagctatgcgtttaaccgcgttccttcattacgtaggcttgacctgggggaactcaagcggctggagtacatcagcgaggccgcattcgagggcctggtcaatctgcgctaccttaacttgggaatgtgtaacctgaaggacattccaaacctgaccgcattggtgcgcctggaggagctggagttgagcgggaaccgcctagatttaattcggcctggctctttccagggtctcacttcacttaggaagctctggttgatgcatgcacaggtggccacgatcgagcgcaacgccttcgacgatctgaagagcctggaagaactgaacctgtcccataacaatcttatgtcactgccgcacgacctcttcaccccactccatcgactagaacgagtccatttaaaccacaacccgtggcactgtaattgcgatgtactctggttatcatggtggttaaaggaaaccgtgccatctaataccacttgctgcgctcggtgtcacgcaccagctggcctgaagggaaggtatattggagaacttgatcaaagccattttacctgctatgctcctgtaatagtagaaccgcccacagatcttaacgttactgaaggcatggccgccgagctgaagtgccgcacaggcaccagcatgacaagtgtgaactggttaacgccaaatggcactcttatgactcatggctcttatagagtgcggataagcgtcctgcacgatgggactcttaatttcactaacgtgactgtccaggatacgggccaatatacatgcatggtgacaaactcggccggaaacaccaccgcctctgccactcttaatgtctctgcagttgaccctgtggctgcaggaggaaccggctccgggggcggaggccctggaggcagcggcggagtcggaggaggtagtggaggatatacttatttcaccactgtcaccgtggagacgctggaaactcagccaggagaagaggcactgcaacctagggggaccgagaaggaaccaccaggcccaaccacagacggagtttgggggggaggaagacctggtgacgctgccggccccgctagtagcagcaccacagcccccgcgcccagaagcagccggccgaccgagaaggcgtttacagtccccatcaccgatgttaccgagaatgcgctgaaagatctagatgacgtgatgaagacaactaaaattattattggatgctttgtggcaatcaccttcatggcagcagtgatgctcgtggctttttacaaactccggaaacagcatcaactccataagcaccacggccccactcgcacagtcgaaatcatcaacgtggaggatgagctcccagcagcctctgccgtcagcgttgcagcagccgccgctgtcgcctcgggtggaggggtcggtggcgatagccacttagcccttccggctctcgagagggatcacctgaatcatcatcactatgtcgctgccgctttcaaggcccattactccagcaacccatccgggggaggatgcggcggcaagggcccacctggcctaaactccattcacgaaccactactgttcaaaagcgggtcaaaagagaatgtgcaagaaacacagatatag

SEQ ID NO: 27074 - DNA, 1266 bp, Artificial Sequence
  Description of Artificial Sequence: Synthetic coding sequence
atggctagagccaggggctccccgtgcccgcctctccctccaggccgcatgtcttggccccatggagcactgttattcctctggctgttcagcccaccacttggcgccggtggcggaggagtagccgtcacttctgccgctggcggagggagccctcccgctacatcctgtccagttgcctgttcgtgtagcaatcaggcctcacgggtaatttgcacacggagggacctcgccgaagtgccggcatccatccccgtcaatactcgctacctcaaccttcaggagaatgggatccaggtaatacggacagacacttttaagcacctgagacatctagaaattcttcaactaagcaagaacctggtgcggaaaatcgaggtgggagcattcaacggcctccctagtttaaacacactggaactgttcgataatcgcttgacaacagtgcctacacaggcctttgaatacctgagtaagctgagggagctttggctgagaaacaatcccattgagagtattccttcttacgcttttaatagagtgcccagcctgcgccgcctggacctgggcgagctgaaaagactggaatacatttccgaagccgccttcgagggcctcgttaatctgcggtacctgaaccttgggatgtgtaacctgaaggatattcctaatttgacagctctcgtcaggctggaagagttggagttgtctggtaatcggcttgatttaatccgtcctggatcctttcaaggcctgaccagcttgcgcaagctttggcttatgcacgcccaggtggcaactattgaaagaaacgcttttgacgacttgaagagcctggaggaattgaacctgtcccataataaccttatgtcacttccccacgacttgtttacccccttacatcgccttgagagggtccacctcaatcacaacccttggcattgtaattgtgatgtcctttggctctcctggtggcttaaggagacagtaccatccaacaccacctgttgtgctcgatgccacgctccagcagggctgaaaggacgctacattggtgagttagatcagtctcacttcacttgttatgctccggtgatcgtggaaccccccactgatctaaatgtgactgaaggaatggcagcagaactcaaatgtcgaacgggcactagcatgacaagtgttaactggtggccgcagctgcatcctcggacatcagccctccaagaacggttacagggggaacgggctcgggatgctgatttgtag

SEQ ID NO: 27075 - DNA, 942 bp, Artificial Sequence
  Description of Artificial Sequence: Synthetic coding sequence
atgagccttgctagcggacccggcccaggctggttactattcagcttcggtatgggcctcgtcagtggatctaagtgcccgaataattgcctgtgtcaggcccaggaggtaatttgcaccggcaaacagcttacagagtatcccctggatatccccctgaatactagaaggctgtttctcaacgagaacaggatcacctctctgcccgctatgcatctggggctcttgagcgacctggtgtatttagactgccagaacaatcgcatccgcgaggttatggactatacattcatcggggtgttcaaactgatttacctagatctttccagtaacaatcttacatccatctcccctttcaccttctctgtgcttagcaacttagtacagctcaatattgccaacaatccacatctactcagtctccataaatttaccttcgctaacacgaccagcctgcggtatctggatctccgaaataccggccttcaaaccctggactccgcggccctttaccatctaacgaccttggagactctcttcctcagcggcaatccctggaaatgtaactgttcttttttggattttgctatttttctgattgtatttcacatggatccctcagacgatctgaacgccacctgcgtggagcctaccgaactcacaggctggcctatcaccagagtcgggaaccccctgcgatacatgtgcatcacccacctggatcacaaagactacatcttcttgctgctcatcggcttttgtatctttgctgccggtaccgtggcagcgtggctgactggggtgtgcgctgttttgtaccagaatacacggcacaagtcttcagaagaggatgaggacgaagcagggactcgcgtggaagtcagcagacgtatttttcagacccaaacttcatccgttcaggagttccctcagttaatttag

SEQ ID NO: 27076 - DNA, 1026 bp, Artificial Sequence
  Description of Artificial Sequence: Synthetic coding sequence
atgctgcggagccccactttcacagacgccggaccccggtgcagctgtttgccagtcagccagacgcttgattctatggacactgtactgatgggaagcctgcagcattgctgctgtcttctgccaaaaatgggggatacatgggctcagcttccttggcctggcccacctcaccccgccatgctgctgattagcttacttctcgccgcagggctgatgcatagcgacgctggtacttcttgccccgttctgtgtacttgcaggaaccaagttgtcgactgctcaagtcagcgtctctttagtgtacctcctgaccttcctatggataccaggaacttgtctttggcccacaacagaataaccgctgtgccaccaggctacctgacgtgctacatggagctgcaggtcttggatttacataacaactcccttatggaactgcccagaggcctgtttcttcacgcgaagagattagctcaccttgacctaagttataacaacttcagccacgtgcccgccgacatgtttcaagaggcgcatgggctggtgcatattgatttatctcacaacccttggctaagaagggtgcacccgcaagccttccaaggcttaatgcagctccgggatttagacctctcttatggaggcctggcctttctgtctctggaggctctcgaggggctgccaggcctggtgacgctccagataggcggtaacccttgggtgtgtgggtgtaccatggaaccccttctcaaatggctgcgtaataggatccaaagatgtacagcggacagccagttggccgagtgccgcggtcctccagaagtggaaggggcgccattgttctctctgaccgaagagagcttcaaagcctgccatctcaccctgacgctggatgactacctcttcattgcattcgtggggtttgtggtatcaatcgcttcagtcgccaccaacttcttgcttgggattacagccaactgctgtcacaggtggagcaaagcctcagaggaggaagagatctag

SEQ ID NO: 27077 - DNA, 447 bp, Artificial Sequence
  Description of Artificial Sequence: Synthetic coding sequence
atggcttctgtggtcctcgcattgaggacacgcaccgccgtaacaagtttattgtcaccgactcctgcaacggctcttgcagtgcggtacgcttccaagaagtctggtgggtcaagtaaaaatctcggggggaagtccagcggacggcgccagggtataaaaaagatggagggccactacgtccacgccgggaatattatcgccacccagagacacttcaggtggcacccaggtgctcatgtcggagtaggaaagaacaaatgtctctacgcacttgaagaagggattgtgaggtataccaaggaagtgtatgtgcctcacccgagaaacacagaagccgtagacctcataacgaggctcccaaaaggtgcagtgctttataaaactttcgtgcacgtcgtccccgctaagcccgaggggaccttcaaactcgtcgctatgctttag

SEQ ID NO: 27078 - DNA, 2643 bp, Artificial Sequence
  Description of Artificial Sequence: Synthetic coding sequence
atgaagaatctctatttcagagtgattactatcgtgatcggtttgtacttcaccgggattatgaccaacgcatcccgaaagtctaatatactgtttaatagtgaatgccagtggaacgaatacatcttgaccaactgtagctttacaggcaaatgtgatatcccagtcgacatcagccaaacagccgccacagtggatgtcagctttaactttttccgagtgctgctgcagagccacacaaaaaaggaggagtggaagatcaagcacctggatctcagcaacaatctaatcagcaagatcactctaagcccattcgcgtatcttcacgctctggaagtactcaacctgagcaacaatgctatacactccctgtcactggacttgctctcacctaagtccagttgggtaaagcgtcacagaagttcctttcgaaacaggttcccgttgctgaaagtcctgatcctccaaagaaataagctgtctgataccccaaagggactttggaagttgaagtcattgcagagcctggacctttcatttaacggaatcctccagatcggttggtctgatttccacaactgtctccagctcgagaacctgtgcttgaaatccaataagatctttaagatccccccgcaggcctttaaggatctgaagaagctgcaagttattgatttgagcaacaatgctctcattactatcctccccatgatgattatagcattggagtttccccatctggttgtggacctagcggacaataactggcaatgcgatgacagcgttgctgtttttcagaacttcatctctgagtcctggcgcaaaaaatggaatgtgatatgcaatcgatctatcggcagtgaagaggcaaacggcgggacaccacagtcgcgcatatctcgggaaaccaggcttcccccaatccacctgcaccggatgaaatctctgatccggtctaaagcagaacggccccaagggggaagacatactggcatctctacgctgggaaagaaggccaaagcagggagtggccttaggaagaagcagaggagactgcctcgaagtgttcggtccacacgcgatgtgcaagctgcaggaaaaaaagaggatgccccacaagacctggccctggccgtctgcctgagcgttttcattacatttctggtggctttctctctcggagcctttactagaccctacgtggaccgcttatggcagaaaaagtgtcagagcaaatctccaggcctggataatgcctactcaaacgaggggttttacgacgacatggaggcagctggacatactcctcatcctgaaacgcatttgcgacaggttttcccccacttgtctctgtatgaaaaccagaccccgttttgggtgacccagccacaccctcacgcaacggtaatccccgatagaacattggggagatctcgcaaagatccaggaagctcacagagcccgggacagtgcggcgacaacacgggagctggatccggaaatgacggcgccgtctatagcatattgcagaggcatccacatgcgggtaacagggaattaatgtctgcagcgcaggaccatatccataggaatgacatcttaggcgaatggacctatgagactgtcgcccaagaggagcctttatcagcacattccgtcggcgtgtcctcagtggcgggaaccagccacgcagtgagcggcagcagcaggtatgattctaatgaattagatcctagtctgtccggtgagataaccgctagcctctgtaaaatgctgacacacgcagaagcgcagcggacgggggactcaaaagagagaggcgggaccgaacagagtctgtgggactctcagatggagttttccaaagaacggcaagtgtcaagcagcatagatctgctatccattcagcagcctcgactgagcggagcacgagcagaggaggcactgtcagcccactattctgaagtaccctacggtgatccgagagataccgggccctccgtcttcccacccagatgggactccggcttggatgttacacctgccaataaggaaccggtacagaagtcgaccccctctgacacctgctgcgagctggagtccgactgcgattccgacgaaggcagcctgtttaccctgtcttccatctcttctgaatctgcccggtccaaaaccgaggaagcagtccctgacgaggagtctctgcaagatgaatctagtggggctagtaaggacaacgttacagcggtggacagcctggaggagaacgtcacctttcaaacaatccctggaaagtgcaaaaaccaggaggacccatttgaaaagccactgataagcgcccctgatagcgggatgtacaaaacgcacctcgagaacgcatcggataccgacagaagtgaaggattatcaccttggccgcggtcacccggtaattctcccttgggcgacgaattccctggcatgtttacttatgactatgatactgcattacaatccaaggcagctgaatggcactgttcgctgcgggacctcgagttcagcaatgtggacgtgctgcagcagacacccccatgctctgctgaagtccccagtgatcctgataaagcagcctttcacgaacgcgacagcgacattctgaagtag

SEQ ID NO: 27079 - DNA, 1869 bp, Artificial Sequence
  Description of Artificial Sequence: Synthetic coding sequence
atgtgcggcctccagttcagtctcccttgcctcaggctatttttggtggtaacatgctacctactgctgctgttgcacaaggaaatcctgggatgctcttccgtctgccagctgtgtactggacggcaaattaactgccggaatctgggcctgagctctatcccaaagaatttcccagaaagtactgtgttcctctatctcacagggaacaatatatcctacatcaatgagtccgagttgaccggactgcatagcctggtcgcactgtaccttgataattctaacatactgtacgtgtatcctaaagccttcgtccagcttcgccatctgtacttcctcttcctcaacaacaatttcataaagagactagatcctggtatttttaagggccttctgaaccttagaaatttgtacctccagtataatcaggtgtcatttgtcccccgtggggtgttcaacgatctcgtaagcgtccagtacctgaatttgcaaaggaatcgtctcacggtgcttgggagtggcacatttgttggtatggtagcacttaggatcctggatctgtccaacaacaacatcctccgcatttccgagagcggctttcagcatctagagaatcttgcctgcctgtacctgggatctaacaatctgactaaagtgcccagcaacgcttttgaagtgctgaaatcattgaggagactctctcttagccataacccgatcgaggccatccagccgttcgcattcaaaggactggcaaacctcgagtatcttttgttaaagaacagcagaatccggaacgtcacccgagacggtttttcaggaattaacaatttgaagcacctgatactcagtcacaatgacctggagaatctcaatagcgatacattcagcctgcttaaaaacctaatctatcttaaacttgatagaaataggataatcagtattgataatgatacattcgaaaacatgggcgcatctctgaaaatcctgaatttaagcttcaacaatctcacagctctgcatccccgcgtgctgaaacctctgtcttcacttatacatctgcaagctaatagcaacccctgggagtgtaactgcaagctgctgggcctgcgagattggctcgcttcctctgccatcacgcttaacatctattgtcagaaccccccctcgatgcggggaagagcactgcggtacataaacatcacaaattgtgtgaccagttccattaacgtttccagagcctgggccgtggtcaaatctccccatattcaccacaagacgactgccctgatgatggcatggcataaggttacaaccaacggcagcccattggaaaacactgagaccgaaaacattaccttctgggaacgcattcccactagtcccgctggcaggttcttccaggaaaatgctttcgggaatccactggaaaccaccgcagtgctccctgttcaaatccagctgaccaccagcgtgaccctgaacctggaaaagaatagtgctctgccgaacgacgccgcgtccatgtccgggaaaaccagcttaatatgcacgcaggaggtggagaagttgaatgaagccttcgatattctgttggctttttttatactggcttgcgtgctgatcatcttcctcatctacaaggttgtacagtttaagcagaagctcaaggcatctgagaatagtcgcgaaaatcggctcgagtactacagcttctaccagtcggcccgatacaatgtaactgcaagtatatgtaacactagcccaaattctttggagtcaccaggcttggaacagattcgactccataagcagattgtccccgagaatgaagcccaggtgattctgttcgaacatagtgctctgtag

SEQ ID NO: 27080 - DNA, 2151 bp, Artificial Sequence
  Description of Artificial Sequence: Synthetic coding sequence
atggcccggatgtcctttgtgatcgctgcttgccagctcgtcctggggctgctaatgacctcgttaacagaatcctccatacagaactccgaatgcccacaactgtgtgtttgcgaaatccgcccttggtttacaccccagagcacgtaccgcgaagctacaactgttgattgcaacgaccttcggcttacccgtatcccaagcaacttgtcaagtgatactcaggttcttctcctccagtctaataatatcgctaagacagtggatgaactccaacagctctttaatttaacagaacttgacttctcgcagaacaacttcacaaacattaaggaagtaggcctggccaatctaacccagttgactacactgcatctagaagagaaccagataacagagatgaccgactattgcctacaggatctgagtaacctgcaggagttgtacattaaccacaatcagatatccaccatctcggcacacgcctttgcgggtttaaagaacctgctgagactgcacctaaattctaacaagctaaaggtaatagatagccgctggtttgattccactcccaatttggaaatactgatgattggggagaatcccgtgatcgggattttagacatgaatttcaagcctttggctaatctgaggtccctggtactggccggaatgtacctgaccgatattcccggtaacgctcttgtgggcctggactcccttgagtcactttccttttatgacaataagctggtaaaagtgccccagctggcgctgcagaaggttcccaacctgaaattccttgacctcaataaaaaccccattcacaaaattcaagagggtgactttaagaacatgttgcgcctcaaggagcttggaatcaataacatgggcgagctggtctcggttgaccgttacgcccttgacaatttacctgagcttaccaagctggaggccaccaataatccaaagctgagctacattcaccgattagccttccgctctgtaccagcccttgaatccttgatgctgaataataacgcactgaacgccatatatcagaagaccgtagaaagcctcccaaaccttcgcgagattagtattcattcaaatcccttgcgttgcgattgcgtgattcactggattaactccaataaaacgaatattcgctttatggagcccttgtcaatgttctgcgccatgccgccagaatacaaaggacatcaagtgaaggaagtacttattcaagacagtagcgagcaatgccttcccatgatcagccacgattcgttcccgaacagattgaacgtcgatatcggaacaaccgtctttcttgactgtagggcgatggccgaaccggagcccgagatatattgggtgacacctatcggcaacaaaattacagtagaaactctaagtgacaagtataaactaagctccgaagggaccttggaaatctctaatatccagatagaggatagcggccgctacacctgtgtcgctcaaaacgtgcagggagccgacacccgggtggctacaattaaggtcaatggtaccctgctcgacgggacacaggtactcaaaatttatgttaagcagaccgagtctcattctattcttgttagttggaaagtcaattctaatgtgatgacgtccaatctgaagtggagtagcgccacaatgaagatcgacaacccccacatcacatacactgccagagtcccggtggatgtccacgaatacaatctgacccaccttcagccgtctaccgactatgaggtgtgcttgactgtgtccaacattcaccagcagacccagaaatcttgcgtcaacgtgactaccaagaatgctgcctttgcagtggacatcagtgaccaagagacatctacagccttggccgccgttatgggcagcatgttcgccgtgatatctctggctagtattgcggtgtattttgccaagcggttcaaacgtaaaaattatcatcatagtctcaaaaagtacatgcagaagactagcagcattccgctgaatgagctctacccccccttgattaatctctgggagggggatagtgaaaaggacaaagacggaagtgcagacaccaagccaactcaggtagacacatctcggagctactatatgtggtag

SEQ ID NO: 27081 - DNA, 2142 bp, Artificial Sequence
  Description of Artificial Sequence: Synthetic coding sequence
atgcgcctgttggtcgcccctttgctgctcgcctgggtcgccggagctaccgcagccgtgccagttgtcccttggcacgtcccctgcccaccacagtgcgcctgccaaattaggccatggtacactccccggtcttcatacagggaggcaaccactgttgactgcaatgacttgttcctgaccgctgttccaccagcacttccggcaggaacccagactctgctgcttcagagtaactccatcgtgcgggtggaccaatcagaactgggctacttggcaaatctgaccgaactcgatctcagccagaattccttttccgatgcacgggactgcgacttccacgcattaccgcaattgctgtcgttacatctggaagagaaccaattaacccgcttggaggaccactcatttgccggactggcatccctgcaagaactctatctgaatcacaatcagctttaccgaatcgcgccccgcgcatttagcggcctcagtaatctgctgcgactccacctcaacagcaacctgttacgcgctatcgactcccggtggttcgaaatgctcccaaacctggagatcctcatgatcggcggtaataaagtggacgccatacttgatatgaacttccggcccttggcaaaccttcgctcattagtgctggcaggtatgaacctgcgcgagatcagtgattacgccctagagggcctccagtctcttgagagcctgagcttttacgacaatcagcttgcccgggtgccacgacgcgctcttgagcaggtaccaggcctcaaatttttggatctgaacaaaaatccactgcaaagagtcgggcccggcgatttcgcaaatatgcttcacctaaaggagcttggcctcaacaatatggaggagcttgtgtcgattgataagtttgccctggtcaatctccctgagcttaccaagctggatataactaataatcctcggctttcattcatccaccctcgggcttttcatcatttgccccagatggaaaccttgatgctcaataataacgccctatccgctctgcatcagcagaccgtggaaagcttgcctaacttacaggaggtcggcctgcatggcaacccaatccgctgcgattgcgtgatccgatgggccaatgctacaggtacacgcgtgcgctttatcgaaccacaaagtactctttgtgccgagccgcccgatctgcaacggcttcctgttagagaagtgccatttagagaaatgactgatcactgcctgcctttaatttctccccgatcattcccgcctagtctgcaggtcgctagcggggagagcatggtgttacattgccgggctctggccgagcccgaaccagagatttactgggtgacgcccgccggcctgcggcttacccccgcacacgctggccggaggtaccgtgtctatcctgaagggacactggaactgcgcagagtgaccgcggaagaggccgggttgtacacatgtgtcgcacaaaacctggtgggagccgatacaaagaccgtgtcagtagtagtggggagagccctgctccagccaggtagggatgagggtcagggtttggagcttagggtgcaagaaacacacccatatcacattctccttagctgggtcacaccacctaataccgtaagcaccaacctgacgtggtccagtgcgtcttcactgcgggggcagggtgctaccgcgctggcacgcctgcctcggggcacccattcctataatattacccgtctgttacaagccaccgagtactgggcttgcctgcaggtcgccttcgctgacgctcacactcagctcgcctgtgtgtgggcacggactaaggaagcgacttcctgtcatcgagcgctcggagataggcctgggctgatcgccatcctggcattagccgtactgttgctggccgctggcttggctgcccatctgggaaccggccagccgcgaaagggcgttggtggtaggcgacccctcccacccgcctgggccttctggggctggtcggcaccttcggtgcgcgtagtatccgcccccctcgtgttaccctggaaccccgggaggaagctaccccgaagctctgagggggagactttgcttcctcctctgtcccagaatagctag

SEQ ID NO: 27082 - DNA, 2142 bp, Artificial Sequence
  Description of Artificial Sequence: Synthetic coding sequence
atgagactactggttgctcctcttctccttgcgtgggtcgcaggggcaacggctgcagtacccgtggtcccttggcacgtcccatgccctccccagtgcgcctgccagatcaggccctggtatacaccaagatcgagttatcgggaggccactaccgtcgattgcaatgacctgttcctgacggcggttccaccagcacttccggccgggactcagacactgctgttgcagtcaaatagcatagtgcgcgtcgaccaatcggagctgggttacctggccaatcttactgagttagatctctcccagaactcgtttagtgacgcccgggattgtgatttccacgcgctgccccaactgttgagtctgcacctggaagagaatcaactgacacgcctcgaggaccactctttcgccgggctcgcttctctgcaggaattgtacctgaatcataatcagctatatcgcatagccccccgcgcattctctggtctgagtaacctgcttcgcttgcacctgaattctaatctcttaagagccattgattcaagatggtttgaaatgctgccaaacctggagatcctgatgatcggcggcaacaaagtggacgccattctcgacatgaactttcgacctctggccaacctgcgctcattggtcctggccggaatgaatctgagagagatatcggattacgcgcttgagggattacaaagcttggaaagtctttctttttatgacaatcagctagcccgagtgccccggagagcactcgagcaggtgcccggcctgaaatttcttgacctgaacaagaaccctttacaacgagttggaccaggggacttcgcaaacatgctgcacctcaaagagctgggcctgaataatatggaagaactcgtgagcatcgacaagtttgccttagtgaacttgcctgaactcaccaaactcgacattaccaataacccaagactgagttttatccaccccagagcttttcaccatctgcctcaaatggaaactttaatgttaaacaacaacgctctctccgctctgcatcaacaaaccgttgagagcctaccgaatctccaggaggtcggactgcacggtaatcctatccggtgcgattgcgtgatccgttgggctaatgctactgggactcgggtgaggttcatcgagcctcaatccaccctttgcgcagagccgcccgatttacaaagactgcccgttagggaggttccattccgagagatgactgatcattgccttccactgattagtcctagatcattccctccgagcttgcaagttgcctccggcgaatcaatggtgttacactgcagggccctggctgaacccgagccagagatctactgggtcacaccggctggtctccgactaacaccagcgcacgccggcagaaggtacagggtgtaccctgagggtaccctcgaactgagacgggtgaccgccgaagaggctggcctctacacttgcgtagctcagaacctagttggcgccgacaccaagaccgtttcggtcgtcgtcggaagagctctgctacagcctgggcgcgacgagggtcagggactggaactgagggtccaggaaacacatccataccatattcttctgtcttgggttactccacccaacaccgtgtccactaaccttacatggtcctccgccagtagcctgcgtggccaaggcgctaccgcgctcgcccgcctcccacgaggaacccattcttacaatatcacacggcttttacaggccaccgagtattgggcatgcctccaagtcgcctttgcagacgcccacacccagctggcttgcgtgtgggccagaaccaaggaggctacaagttgtcaccgcgccttgggcgaccgtcccggtctaattgctatcctggctctggcagtcctgcttcttgccgctggcctggcagcccacttgggcaccggccagcctaggaagggcgtgggggggagaagaccacttccacccgcgtgggcattctggggatggtcagcgccctctgtgagagtggtatccgcccctcttgtacttccgtggaatcccgggcgcaagcttccccggagctccgaaggcgagaccctcttacctcccctgagccagaacagctag

SEQ ID NO: 27083 - DNA, 2142 bp, Artificial Sequence
  Description of Artificial Sequence: Synthetic coding sequence
atgaggttacttgtcgcgccacttctgctggcctgggtggccggggctaccgctgccgtcccagttgtcccctggcatgtgccctgcccaccgcaatgtgcttgtcagatccgcccttggtatacccctcgaagctcctacagagaggcaactacagtggattgtaatgatctatttctcaccgctgtaccaccagcacttccggccggaactcaaacacttctcttacaatctaactccattgtgcgcgtcgaccagagcgaactgggctacctcgcaaacctgacggaacttgatctcagccaaaattcattctctgacgctagggactgtgatttccacgcgctgccgcagctgctgtcactgcatcttgaggaaaaccagctgactagacttgaggatcatagcttcgccgggttagcttctttgcaggaactttatttgaatcacaatcagttataccggattgccccacgagcgttttccggattgtctaatctgctccgacttcatctaaactcaaacctgctgagagcaatcgatagcaggtggttcgaaatgttgccaaacctggaaatcctgatgatcggaggaaacaaggttgatgccatacttgacatgaactttaggcctctggccaatctgcgttcccttgtgcttgccgggatgaacctgcgagaaatcagcgattatgcactggaggggttgcaaagtctcgaatccttgtctttttatgacaatcagttggcaagggtgccgagacgcgctctggagcaagttccaggcctcaagtttcttgaccttaataaaaaccctctgcagcgcgtggggccaggcgattttgccaatatgttgcacttgaaggagctgggacttaacaacatggaggagctcgtaagtatcgataaatttgcccttgttaacctgccagaactaactaagctggatatcacgaacaaccccaggctctcgtttatccatccacgcgcttttcaccatctcccacagatggaaaccttgatgctgaacaacaatgcactgagtgccttacatcagcagaccgtggaatccctcccaaatcttcaggaggtcgggctgcatggaaaccctattaggtgcgactgtgttatcagatgggccaatgctaccgggactcgtgtgaggtttattgaaccacagagtaccttatgcgccgagcccccagacctccaacgactcccggtgagagaggtgcctttccgcgagatgaccgaccattgcctccccctgatctcacctaggtcgttccctccgtctctgcaggtagcctcaggtgaatcaatggtgctgcactgccgcgctctggccgaaccagagccggagatctactgggtgactccagctggccttaggttaacgcccgctcatgccggtaggcggtatcgcgtgtaccccgagggcacccttgaactcaggagggttaccgcggaggaggccggcctgtacacatgtgtggcccagaatcttgtgggagctgacacgaagactgtgagcgtcgtagttggtcgggccctcttacagcccggacgggatgaaggccaggggctggagctcagggtgcaagagacacacccctatcacatactgctaagctgggtgacaccccctaatacagtgtccacaaatctgacatggtcttcagcaagctccctgaggggacagggtgccactgcattagccagactgcctcgcgggacacacagctacaacatcacccggctgctgcaagcaaccgaatattgggcatgcctgcaggttgcctttgctgatgcccacacccagctggcctgtgtgtgggctcggacaaaagaagcaactagttgccatcgtgctttgggcgaccgccccggcctgatcgctattctcgcgctggctgtactcctgctcgccgctggattggccgcccacctgggtacaggacaacctaggaagggggtgggaggccggcgccccctccctccggcttgggccttctggggctggtcagccccctcagtcagggtcgtctcggcgcctctcgtactaccctggaatccaggccggaagctgcctcggtcatccgaaggagagactctgttgccgcctctgagccagaacagttag

SEQ ID NO: 27084 - DNA, 2127 bp, Artificial Sequence
  Description of Artificial Sequence: Synthetic coding sequence
atgaaagacatgcccctgagaatacacgtgctgctgggtctggcaattaccaccctagtacaggccgtagataagaaagtcgactgtccacggctctgcacgtgtgaaatccgcccttggtttacaccaagaagcatatacatggaggctagcactgtcgattgcaatgatctcggtctcctcacattccctgcccgtttacctgcgaatacccaaatactgctgcttcagaccaacaacattgctaagattgagtactccactgacttccccgtgaatctaacaggccttgatctctctcagaataatctgtcgagtgtgacgaacattaacgtgaaaaaaatgccccaactgttgtccgtctacctggaggaaaacaagcttaccgaactccccgagaagtgtctttcagaactgagtaaccttcaagagttgtacatcaaccataacctgcttagcactatcagcccaggcgctttcatcggactccataacttgctgaggctgcatttaaactccaatcgcttgcagatgattaatagtaagtggttcgatgcactcccaaacctggagatcctgatgattggcgaaaacccaattatccggattaaggacatgaactttaagccattgatcaacctacgcagcctggtgatagctggcatcaacctgacggagatccccgacaacgctctggtggggttagaaaacctagaaagcatcagcttttatgacaacagattgattaaagtgccacatgtagccctccagaaggtggtgaatcttaaatttctggatttgaataaaaatcccatcaaccggattcgccggggagatttcagtaacatgctgcacctcaaagagctggggatcaataatatgccagaactgatttcaatcgactcactggcggtagataatctgcctgacctccgcaaaattgaagctacgaataatcctcgtctgagctacattcaccccaatgccttttttagacttccgaagttggaaagcctgatgctcaactctaatgcattgtcagctttgtatcatggtactatcgagagcttaccgaatcttaaagaaattagtatccactccaacccaataagatgtgattgtgttattagatggatgaacatgaataagaccaatatccggtttatggagcctgacagcctcttctgtgtggaccccccagagtttcaaggtcagaacgtgcgacaagtgcactttagggacatgatggaaatctgcctgcccctgatcgcacccgagagctttcccagtaacctgaacgtcgaggcgggctcttacgttagtttccattgtcgggcgaccgcggagccccaacccgagatctattggataacccctagtggacaaaagttgctcccaaacacattaacggataagttttacgtgcattccgaaggcacacttgacattaacggggtaacgccaaaagagggcggactctatacgtgcattgccacaaatctggtgggggcggacctgaaatcggtgatgatcaaggttgacgggtcttttcctcaggacaacaatggatccctcaacataaaaattagggacatccaggccaactcagtgcttgtgtcttggaaggcaagctctaagatcctcaaatctagtgtgaagtggactgccttcgttaagactgagaacagccacgcagcccagtctgctcgcatccctagcgacgttaaagtttacaacctgacccatctgaacccctccactgaatataagatctgcattgacattccaactatttaccagaagaacaggaagaaatgcgtgaacgtcactaccaaggggctccacccggaccaaaaggagtacgagaagaacaacacgaccaccctcatggcatgcctgggaggcttactcggaatcattggggtgatctgcctgatatcatgcctcagtccggagatgaattgcgacggggggcactcctatgtgcgcaactatctgcagaaacccacattcgccctgggagaactgtaccccccacttattaacctctgggaggccggcaaggagaaatcaaccagtctgaaggtgaaggctacagttattgggttacccaccaacatgagctag

SEQ ID NO: 27085 - DNA, 2127 bp, Artificial Sequence
  Description of Artificial Sequence: Synthetic coding sequence
atgaaagacatgcctctgagaattcacgtgctccttggcttagcaatcaccactctggtgcaggcggtcgataagaaggttgactgccccaggttgtgcacatgcgaaatcagaccttggtttactccacggtcaatatatatggaggcgtctactgttgactgcaatgacttagggctgctgaccttccctgcacggctgcccgcaaacacccagatcctgctcctccagaccaacaatatcgcaaagatcgagtacagcaccgattttcctgtgaatctcacagggctcgacttatcccaaaataacctttctagtgtgactaatattaacgtcaagaagatgcctcagctactgtccgtgtacctggaggagaacaaactaaccgagctcccagagaagtgtctttctgagctatcgaacttacaggaactgtatataaatcacaacctgctcagcactatctctcccggtgcattcattggtctgcataatctgcttcggttgcacctcaattctaaccggttacagatgattaattctaagtggttcgacgcgctcccaaacctggaaatccttatgatcggcgaaaaccccatcattagaataaaggatatgaattttaaaccactgatcaatctgagatcattagtgatcgccggtatcaatttgaccgagatcccagataatgccctggtgggactggagaacctcgaaagtatctccttttacgacaaccggctgataaaggtgcctcacgtggcattacaaaaggtggtgaacttaaagtttctcgacctgaataagaatccgatcaacagaattcgccgcggggacttttcgaatatgcttcatttaaaggaactcggaattaataacatgcctgaacttatttctatcgattccctggcagtggataacttaccagatctgagaaagatcgaagcgaccaacaaccctagactctcatatattcatcccaacgccttctttcgcctccctaaattggaaagtctgatgcttaattccaatgctctttccgcactgtaccacggtaccattgagagtctacctaacctcaaggagatcagtattcactctaaccccatcagatgtgattgtgtcattcgctggatgaacatgaacaagaccaatatccgctttatggagccagacagtctcttctgtgtcgatcccccagaatttcaggggcagaatgtgcgacaggtacattttagagacatgatggagatttgcctccccctcattgccccagaatcatttcctagcaacctgaacgtcgaagcgggaagttacgtgtctttccactgcagggcaacagcagaaccccagcccgagatatattggatcacccctagtggccagaagcttttacccaatacgcttaccgacaaattttacgtgcattccgaaggaacactggacattaacggagttacccctaaggaaggcggcttgtatacatgcatcgctacaaacctggtgggagcagaccttaagtccgtaatgattaaagtggacggctcctttcctcaagacaataacggctctctgaatattaagatcagagatatccaggctaattctgttctggtgtcctggaaggcttcatccaagatccttaaatcctcggtgaaatggaccgcatttgtgaaaactgaaaacagccacgctgcccaaagcgctagaatcccctcggatgtgaaggtctacaatctgacccacctcaatcccagtacagaatacaagatatgtatcgacatacccaccatctatcagaagaaccgcaagaaatgtgtgaacgtgacaaccaaaggtctgcacccagatcagaaggagtatgaaaagaacaacacgacaacattaatggcctgcttgggaggactgctgggtatcatcggggttatctgcctaataagttgcctgagtccggaaatgaattgcgatggaggccatagctatgtgagaaactacctccaaaagccaacctttgccttgggtgagctttatccccctctgatcaacctttgggaggccggaaaagaaaaaagcaccagtctgaaagtgaaggccactgttattggccttcccactaatatgtcctag

SEQ ID NO: 27086 - DNA, 2127 bp, Artificial Sequence
  Description of Artificial Sequence: Synthetic coding sequence
atgaaagacatgccactgcggatacacgtcttgctgggtctggcaattactaccctcgtccaggcagtggataaaaaggtagactgccctcgcctgtgtacttgtgagattcggccttggttcacaccccgcagcatatatatggaggctagtaccgttgactgcaatgacctgggtttacttacttttcccgcgagactacctgccaatacccagatcctgctccttcaaaccaacaatatcgcaaagattgaatactccactgacttccctgtgaatctcactggtctggatttgagccagaacaatttatcatcagtgactaatatcaatgtgaagaaaatgccccagctcctctccgtgtatctggaagagaacaagctcactgagcttcctgagaagtgtctgtccgaactgtccaacctccaggaattatacatcaaccacaacttgttatctaccattagtcctggggcctttatcggattgcacaacctgttacgactacaccttaattctaacaggctgcagatgattaactctaagtggttcgacgctctgcctaatttggaaatactgatgatcggagagaaccctatcatcaggatcaaggatatgaatttcaagccccttattaaccttagatccctggtgatcgcaggaatcaacctcaccgagattcctgacaacgccctggtcggcctcgagaatctcgaaagtatcagtttctacgataataggttgattaaagtaccgcacgtcgcccttcagaaagtcgtgaacctgaaattcctggacctcaataagaacccgatcaaccggatccgccgaggcgacttttccaatatgctgcaccttaaggaactgggaattaacaatatgccagagcttatctcgatagacagtttggcagtcgacaatttaccagacctccgtaaaatcgaggccaccaataacccaaggttgagctacattcaccctaacgctttttttcgcctcccgaagctggaaagtctgatgctgaacagcaatgctctgagcgctctctaccacgggacaatcgaatccctgccaaaccttaaagaaatttcaatacattctaatcccattcgctgcgactgcgtaatacgctggatgaatatgaataaaactaacatcagattcatggaacccgattcactgttttgtgtcgacccgcccgagtttcagggtcaaaacgttagacaagtccattttcgggacatgatggagatttgcctcccccttatagcgccggagtccttcccgtctaacctgaacgtcgaagctggtagttatgttagttttcactgtagggctactgccgagcctcagcccgaaatatattggataactccgagcggccaaaagctcttaccaaacaccctgacagacaagttctacgtacacagcgaggggaccctcgacatcaacggagtgacccccaaagagggcggactttacacctgtatagctacaaatctcgtgggcgctgatctcaaaagtgtgatgatcaaagtcgacggcagtttcccccaagataacaatggtagtctgaacatcaagatccgcgacatccaggctaattcagtgctcgttagttggaaagcgtcgtctaagatcctcaaaagctccgttaagtggactgctttcgtgaaaacagagaatagccacgctgctcagtccgcccgtatcccctcagacgtgaaggtatataaccttacccatctgaatccaagcacagagtacaagatatgtattgatatccctacaatttaccagaagaaccggaagaagtgtgtgaatgttacaaccaaaggtctccaccccgatcagaaggagtacgaaaagaacaatacaaccaccctgatggcatgtttaggcggacttcttggaattatcggcgtgatctgtctcatcagttgcctgtcacccgagatgaactgtgatgggggccatagctacgttagaaattatcttcagaagcccaccttcgcccttggagagctgtacccgcctctgataaatctgtgggaggcaggaaaggagaagagtactagcttaaaggtgaaagcaacagttatcggtcttcccaccaatatgtcttag

SEQ ID NO: 27087 - DNA, 2223 bp, Artificial Sequence
  Description of Artificial Sequence: Synthetic coding sequence
atgagacaaactctgcctcttctgcttttaacagttcttagacctagttgggccgatccccctcaggagaaggttcccctgtttcgagtgacccagcaaggtccgtggggctcctcggggtctaatgcaaccgactctccctgtgaaggcttaccagccgccgatgccactgccttgacacttgccaatagaaaccttgaacgcctgcccgggtgtctcccacgcaccctccggagtttggatgcctcacacaatcttctgagggccctcagcacctctgaactgggtcacctcgagcagttgcaggtgttgaccttgagacataaccgcattgctgctctacggtgggggccgggcgggcccgccggcttacacaccctggatctatcttacaaccagttggctgcccttcccccctgcaccggtccggctctgagttctctgcgggctctggcactcgcagggaacccactgcgagcgctacaaccacgggcgtttgcgtgttttccagccctccagctactgaatttatcctgcaccgcactggggcgcggcgctcagggtggcatcgctgaagcagcttttgctggcgaagatggtgcccctctggttaccctcgaggttctcgatctgagcgggactttcctggaacgtgtcgaatccggttggatcagggacctgccaaaattaacctctctatacttacgcaaaatgcccagactcactacactggaaggggacatctttaagatgacccccaatctgcagcagctggactgtcaggacagccctgcgctcgcttctgtcgccacccatatatttcaggacacgcctcatctgcaagttctcctatttcagaattgcaatctctccagctttcccccatggacgctcgatagcagtcaagtgctgtccattaacctgttcggaaaccctctcacgtgtagctgcgatctatcctggctactcacagacgcgaaacgtaccgtgctatctcgagctgctgacacgatgtgcgccccagctgccggctctagcggcccttttagtgccagcctctcactgtctcaactgccaggcgtgtgtcagagcgaccagagtacaaccctcggggcctcccaccctccgtgcttcaatagatctacatatgcgcaggggaccaccgtcgctcctagcgccgcccccgcaacaagacccgccggggatcaacagagcgtatctaaggcccctaatgttgggagccggactatcgctgcctggccccattctgatgcgagagagggcacagccccatcaaccaccaattctgtcgcaggccacagtaactcatcggtcttccccagggctgccagtactacacgcactcaacatcggggtgaacatgctccagagctggtcctcgaacccgacatttccgccgccagtacgcctctggccagcaaattactcggcccttttcctacctcatgggatcggagcatcagcagcccccagccgggccagcggactcatgccacccctcaggcccccaacccctccttgtctgagggtgagatcccagtcctgttgctggatgattattccgaggaagaggagggacgcaaggaggaggtcgggacaccacaccaggatgtgccgtgcgattaccacccatgtaagcatctccaaaccccttgcgccgagttgcagagaagatggcgctgtcgttgcccaggcttatcaggagaggatactattcctgacccaccccggctacagggtgtcacagagacaaccgataccagcgctttggtccattggtgcgcccctaactcggttgtgcatgggtatcagatccgttattctgcagaaggatgggcagggaatcagagtgttgtgggcgtaatttacgccaccgccaggcagcatccattatatggactgagcccgggcacaacatacagggtatgtgttttggctgccaacagagccggtctgtcccaaccacgctcaagtggctggagatcaccctgcgctgcctttaccaccaaaccatcttttgctttgcttttgagtggactttgcgcagccagcgggcttctattggcaagcaccgttgttctttctgcctgtctttgtaggcggggacagaccctaggcctgcagcgttgcgatactcacttggtggcatacaaaaatccggccttcgacgactacccgctgggcctgcagaccgtaagctag

SEQ ID NO: 27088 - DNA, 1191 bp, Artificial Sequence
  Description of Artificial Sequence: Synthetic coding sequence
atgaagaattatgaatcaaagaaatatagcgaccccagccagccaggaaacacggtactgcatccaggcacacgcctaattcagaagctccacacgtcaacatgttggctccaggaagtgcctgggaagcctcagctcgagcaagccaccaagcacccacaagtcacgtctccccaggccacaaaggagactggcatggaaataaaggaaggaaagcagtcctacaggcagaagatcatggacgaactgaagtattattacaatggcttttacctcctgtggatagacgcaaaggtcgcggccaggatggtatggcggctccttcatggtcaggtgttaacgcgccgagaacggaggcgggaagagaaacagaagaaaaagatggccgtgaagctggagctggcaaagtttctgcaggagacgatgacggagatggctcgtaggaatagagccaagatgggggacgcctccacccaactcagtagctatgtaaagcaagtacagacagggcacaaacctagtacaaaagagattgtccgcttttctaaactgttcgaggatcaactagctttagagcatcttgatagaccccagctcgtggctttatgcaaactgctagaactgcagactttcggcacaaataacctgcttcgttttcagctgctcatgaaactcaagtccatcaaggcagacgatgagatcatcgccaaagagggggtgaccgcgctgagcgtaagcgaactccaggctgcctgtagggccagaggcatgagatcccttggcctgactgaagaacaactgcgccaacagttgactgagtggcaggatctccatctcaaagaaaatgttccgcctagtctgctcctgttgtcgaggaccttttatctgattgatgtcaagcccaagccaattgaaatccctctgagcggcgaggccccaaagactgatattctggtcgagctcccaacttttaccgaaagcaaagagaacatggtggatctcgcccctcaattaaagggcaccaaggatgaagatttcattcagccaccaccagttacctcctctcccatcacaccttctaccccaataagtcttcctaagggtcctatcaccagttccgaggagcctactctgcaggccaaatctcaaatgacagcgcagaattccaaggccagttccaagggcgcctag

SEQ ID NO: 27089 - DNA, 1476 bp, Artificial Sequence
  Description of Artificial Sequence: Synthetic coding sequence
atggccttttactcatacaattctgtcctagcaatcgcccggaccagatttcctagccatttcgtccaccccacttgttcaagttattcccccagttgcgccttcctccacctgcccgatagccatctaaacaaaacatgcatgaaaaactacgagagtaaaaaatacagcgatcctagtcaacccggcaacaccgtgcttcaccccgggactcgtttgattcaaaaactgcacacgtcgacctgctggctgcaggaagtgcctggaaagccacagctagagcaagccactaaacatccccaggtgacttcaccacaggcgactaaagagacagggatggaaatcaaggaaggaaaacagagctacaggcagaagataatggatgagctcaagtactattacaacggcttttatctgctttggatcgatgctaaggttgccgcccggatggtctggaggctactgcacgggcaagttcttacaaggcgtgaaagaaggcgcctcttgcgcacttgtgtagacttctttcgactggtacccttcatggtcttcctgatcgtccccttcatggaattcttactccccgtcttcctaaaacttttcccagagatgctcccatccacttttgaatcagaatcgaagaaagaggaaaaacagaagaaaaagatggccgtgaagctcgaactggctaagttcttacaggaaacaatgactgaaatggctaggagaaaccgggccaaaatgggagacgccagtacccagctttcttcgtacgtgaagcaagtgcaaacaggccacaagccttcgacaaaggaaattgttcgcttcagcaagttattcgaagaccagctcgctctggaacatctggaccggcctcagctggtggccctttgcaaactgttggaattacagacttttggaacaaataatctgctccgattccaactgctgatgaagttgaaatcaattaaggctgacgacgagattatcgcgaaagagggcgtgacagcactgtctgtgagtgagctgcaggcagcgtgtcgagcgcgtggcatgagaagcctggggctgactgaagagcagctccggcaacagctgaccgagtggcaagatctacacctcaaggaaaacgttccacctagccttctgctgctgtctcgcaccttctacttgattgacgtcaaaccaaagccaatcgaaatccccctgtctggagaagcccctaaaaccgacatcctggtcgagttacctaccttcacggaaagcaaagagaacatggttgatctggcccctcagcttaaagggacaaaggacgaagatttcattcaaccacctccagtgacaagtagccctatcaccccttcaacccctatttcattaccaaagggccctatcactagctctgaggagcccactctgcaagcgaagagccagatgaccgctcagaatagtaaagcctcttccaagggagcttag

SEQ ID NO: 27090 - DNA, 1332 bp, Artificial Sequence
  Description of Artificial Sequence: Synthetic coding sequence
atggccttttactcatacaacagcgttcttgctattgctcggacaaggtttccaagccacttcgtccaccctacatgcagctcatacagtccttcctgcgcctttcttcacctaccagattcacaccttaacaagacatgcatgaaaaactatgagtcaaagaagtactctgaccccagtcagccaggcaatactgtgcttcaccctggtacgcgcttgattcagaagctgcatactagcacctgctggctgcaggaggtgccaggcaaaccccaactggagcaggcgacaaagcatccgcaggttacgtccccacaagcgaccaaggagaccggcatggaaatcaaggaagggaagcaatcttatcgccagaaaatcatggatgagctgaaatactactataatgggttctatctcctttggattgacgcaaaggtggctgctaggatggtttggaggctgcttcacggtcaggttttgacccgccgcgagagaagacgcgaagaaaagcaaaaaaagaagatggcagtcaagcttgaattagccaagtttttgcaagagacaatgacagagatggcccggcgcaatagggccaagatgggagacgcctcaacgcaactgtcctcctatgtcaaacaagtgcagacagggcacaagccatcgaccaaggagatcgttcgcttcagcaaactgttcgaagaccagcttgcactggagcatcttgacaggccgcagttagtcgccctttgcaaattattggagttacaaacctttggtaccaacaatctactgagattccaactcttgatgaaactcaaaagcatcaaagctgacgatgagatcatcgccaaagaaggcgtaactgccctgtccgtttccgaactccaggccgcatgccgggcaagagggatgcgctccttaggactcacagaagaacaactccggcaacaactcactgaatggcaggatcttcacttgaaggaaaacgtacctccttcactgctattactgtccagaaccttctatctgattgatgtcaagccgaagcccattgagatacccctctcaggcgaggcgcccaagacggacattctggttgaactcccaacattcacagaaagcaaagagaatatggtggatctcgcccctcaattgaaaggcaccaaggacgaggactttattcagccccctcccgtaaccagtagccctattacaccaagtacgccaatctcactgccaaagggccctatcacatcctcagaagaacccactctgcaggcaaagtcccaaatgacagctcagaactcgaaggccagcagcaaaggcgcttag

SEQ ID NO: 27091 - DNA, 429 bp, Artificial Sequence
  Description of Artificial Sequence: Synthetic coding sequence
atggctttctattcttacaactctgtgcttgctattgcacggacccgattcccatcccactttgtccacccaacctgttccagctacagtccatcctgcgcgttcttacaccttcccgacagccacctaaataagacctgcatgaaaaattacgagagcaagaaatattccgaccccagccagccaggtaacacggtgctccatcctggtacccgcctgattcaaaaactgcacacgagcacctgttggctgcaggaagtcccaggtaagcctcagttagaacaggcaactaaacacccccaggtcacttcccctcaggccacaaaggaaaccggaatggaaatcaaagaaggtaaacagagctacaggcagaagattatggacgagctgaagtactactacaatggcttctacttactttggatatag

SEQ ID NO: 27092 - DNA, 351 bp, Artificial Sequence
  Description of Artificial Sequence: Synthetic coding sequence
atggccttttattcctataacagtgtactagcaatagctagaacacgctttcccagccactttgttcacccaacatgtagcagttacagccccagctgcgctttcctgcacttgccagacagtcatttgaacaaaacttgtatgaagaactacgagtcaaaaaagtatagtgacccatcacagccaggtaatacagtcctgcaccccggcactcggctgatacagaagttgcacacaagcacatgctggctccaggaagttcctggaaagcctcagctggaacaggccacgaaacatcctcaggtcacttcaccgcaggccaccaaagaaaccggcatggagataaagtag

SEQ ID NO: 27093 - DNA, 834 bp, Artificial Sequence
  Description of Artificial Sequence: Synthetic coding sequence
atggaggagaaacagaagaagaagatggccgtgaaactagagctggctaagttcctacaggaaacgatgaccgagatggccaggcgaaatagagctaagatgggcgatgcgtctacccaattaagctcatatgtgaaacaggtccagaccggacataaaccatcaaccaaggagatagtgagattttcgaagctgtttgaagaccaactggccctcgagcaccttgaccgtccacagctggtcgctttgtgcaagctactggagttgcaaactttcggcaccaataacttactgcggtttcagcttttgatgaagctgaagtcaattaaggcagacgacgagatcattgcgaaagagggagtgacagctttatcagttagcgagcttcaggccgcatgccgcgcccgcggcatgcgatctttaggcctgaccgaagaacagctcaggcagcagctgacggaatggcaggacctacatctcaaggagaacgtgccaccaagcctactgctgctttctcgtacattctacctgatagacgttaaacccaagccaattgaaattcccctgtctggagaggccccaaagaccgatatcctcgtcgaacttcctacatttaccgagtcaaaggagaatatggtggatctcgccccccaactcaagggcaccaaagacgaagattttatacagcctccacctgtgaccagctctccgatcaccccttccacccctattagtcttccaaagggccccatcacgtcaagtgaggaacccactttgcaggctaagagtcagatgactgctcagaacagcaaagcctcctctaagggggcatag

SEQ ID NO: 27094 - DNA, 369 bp, Artificial Sequence
  Description of Artificial Sequence: Synthetic coding sequence
atgaaaaactacgagtcgaaaaagtatagcgatccttctcagcccggtaatacagtcctgcaccccggaacaaggctgattcagaaactgcacacaagcacctgttggttacaggaagtcccaggaaagccccagctggagcaagctacaaagcatccacaggtgacaagcccgcaggcaacaaaggagacaggtatggagattaaagagggcaagcagagttaccggcagaaaatcatggatgaactaaagtattattataacggcttctatttgctttggatcgatgcaaaggtggccgccagaatggtgtggcggctgctgcatggacaggtgttgactagacgcgaaagaagaagatgcttctag

SEQ ID NO: 27095 - DNA, 1335 bp, Artificial Sequence
  Description of Artificial Sequence: Synthetic coding sequence
atgaagaattatgaatccaaaaagtactctgatccctctcagccgggaaacacggttctgcaccccggcacaagactgatccagaaactacatacgagcacctgctggttacaagaggtgcctggaaagcctcagcttgagcaggccaccaagcacccacaggtcacgagtcctcaagcaaccaaagaaaccggaatggaaataaaggaaggtaagcagtcctacaggcagaagatcatggatgaattaaagtattactataatggtttttatctcctctggattgatgcaaaagtggccgcaaggatggtgtggagactcctgcatggccaggtactgacccggcgagaaagacgcagacttctaagaacatgcgtggacttttttcgtctggtgccattcatggttttcctgatcgtccccttcatggagtttctgctgccggtttttctgaagctgtttcccgaaatgctgccaagcacctttgaatctgagtctaagaaggaggagaagcaaaaaaaaaagatggccgtcaaattggagcttgctaagtttctacaagagactatgactgaaatggcaaggaggaacagggcgaaaatgggggatgcctctacccagctgagcagctacgtgaagcaggtgcagactggacacaagccttccactaaagagatcgtccggttctccaagttattcgaggaccaattggccctggagcacttagataggccacaactggtggccctgtgtaaattgttggagttgcagactttcggaactaacaaccttctccgctttcaactgctaatgaagctgaaaagcatcaaggcggacgatgagattattgcaaaagagggcgtcacggccctttccgtttccgaattgcaagctgcctgccgggcgcgggggatgagaagtctgggcctgacagaggaacaactgagacaacagctgactgagtggcaggaccttcaccttaaggagaatgtcccacccagcctgctccttttgagtagaaccttctatttgatagacgtcaagccaaagccaatcgaaatcccactcagtggggaagccccgaagaccgatatcctggtggaactgccaaccttcaccgagagtaaggagaacatggtggacctggctccacagcttaaagggacaaaggatgaagacttcatacaaccaccacccgtcaccagcagcccaatcacccccagcaccccaatcagcctgccaaaggggcctattaccagctccgaagagcccaccctgcaggcaaagtcccagatgaccgcacagaattccaaagcaagttcaaaaggtgcttag

SEQ ID NO: 27096 - DNA, 1872 bp, Artificial Sequence
  Description of Artificial Sequence: Synthetic coding sequence
atgcgggtcgctctgggcatgctttggcttctggcactggcgtggcccccccaagcccggggcttctgtcccagccagtgctcctgttctctccacataatgggcgacggatctaaggcacgaacagtcgtttgtaacgatcctgacatgacactgccccccgcttctataccccctgacacttcccgtctaaggctcgagcgcaccgctatccgccgggttcccggagaggcgtttagacctctggggcgcttggagcagctgtggttgccttacaatgctctttctgagctgaacgccttaatgctgcgcggactgaggcgactgcgcgagttgcggcttccaggcaaccgcctcgccgctttcccatgggcagccttgcgagacgctcctaagctgcgcctgttggacctgcaggcaaatcggctgtctgcagtgccagctgaagcagctaggttcctggagaatctgaccttcctggacctcagctccaaccagctaatgagactaccacaagaactgattgtttcctgggctcacctggagactgggatctttccgcctggtcaccatcccagaagagtgctcggtcttcaggataacccatgggcttgcgactgccgactttatgatttggtgcacttactggacggctgggcccccaacttagccttcattgagacagaactacgatgcgcctccccacggtcattggcgggagtcgcctttagccaactggagctccgaaaatgtcagggcccagagctgcaccctggggtcgctagtataagatcgctcttgggaggaactgcactgttaagatgcggcgcaacaggagtcccaggccccgagatgagttggaggcgggccaacggacgacccctgaacggcactgtgcaccaggaggtgtccagtgatggcacatcctggacattgctagggctgcccgctgtctctcatctggacagcggcgactacatctgccaggccaagaatttcctgggagcgtccgaaactgtcatatctttaattgtaaccgagcctccaacttctacagaacactcaggctcacccggggcactgtgggctcggaccggtggaggtggtgaagccgccgcatacaacaacaagttggttgctagacacgttccacagatcccaaagcccgccgtcctcgccactgggccctctgtgcccagtacgaaggaggagctgacattagaacatttccagatggatgcccttggagaactgagtgatggccgggccggccccagtgaagctcgtatggttagaagcgtcaaagtggtaggagatacctatcactccgtctccctggtttggaaagctccccaggccaaaaacaccacggctttctcagtcctctatgcagtttttggccaacattctatgcgtagggtaattgtgcagcctgggaagaccagggtgaccattactggcctcctgcctaagaccaagtatgttgcttgtgtgtgtgtccagggcctcgtacctagaaaggaacagtgtgtgattttcagcacaaacgaggtggtggatgcggagaatacgcagcagcttattaatgtggtggtgatctcagttgctatcgtcatagctctgccactgacattgctggtatgctgctcagccctccagaagagatgcaggaagtgcttcaacaaggattcaacggaagccaccgtgacctatgtcaacctggagagactgggctacagcgaagatggcctggaggagctgtcgcggcatagcgtgtccgaggctgatagactactctcagcacgcagttctgtggatttccaggcattcggcgtcaagggggggcgcaggatcaatgaatacttctgttag

SEQ ID NO: 27097 - DNA, 1491 bp, Artificial Sequence
  Description of Artificial Sequence: Synthetic coding sequence
atggtggagcctcaccaggaacctcgtcactctaaagtcggcttgcaagataatccctggttttgcgattgtcacattagcaaaatgatcgagctcagtaaagtcgtcgaccctgccatcgtgctcctcgacccgttaatgacctgctccgaacctgagcggttaacggggattttgttccagagagctgagctggagcattgcttaaaaccatctgtaatgacgtctgccaccaagattatgtcagccctgggatcaaatgtgctcctacggtgcgatgccacagggttcccaacgccgcaaattacgtggactcggagcgactctagtcctgtcaattacacagtgattcaggaatctcccgaggagggggtgcgctggagcattatgtcattgactggaatttcttccaaggacgccggggattacaagtgcaaggcaaaaaatctggcaggaatgagcgaagcggttgtgactgtgactgtgttgggcatcacaaccaccccaataccccctgatacaagcgagagaacaggtgaccaccctgagtgggacgtgcagccagggtcgggcagatcaacttccgtgtcaagcgcatcctcttatctctggtccagttctttctctccgacctcctcattcagcgcaagtacactgtccccaccctctacagcaagtttctccctctctcctttttcctccagtacagtctcatctacaacaaccctgtcaacgagtattagcgccagtaccactatggccaataaaagatcgttccaactacaccaggggggaaagcgaaatttaaaggtagcaaaaaatggtagtaagcttccccccgccagtacctctaagaaggaagagctcgctctattagaccagacgatgctgaccgagactaatgccgctattgagaacttacgagtggtttcagagactaaagagagcgtgactctgacctggaatatgataaatacaacccacaatagcgctgtgaccgtcctgtatagcaagtacggagggaaggaccttctccttttaaatgctgacagttctaaaaatcaggtcactattgatggcttggagcctggaggccagtacatggcctgcgtgtgccctaagggtgtgcccccccaaaaggaccagtgcattacattcagtactgaacgggtggaaggcgatgattctcagtggtccctgctgctcgttgtgactagcacagcgtgcgtcgtgattctgcctcttatttgcttccttctgtataaggtgtgtaaattacagtgcaaatcagagcctttttgggaagacgatttagcaaaggaaacgtacatacagtttgaaaccctcttccctcgatctcaatcagttggagagctgtggactcgtagccacagagatgacagtgaaaaactgctgttgtgctcccgcagctctgtagaatctcaagtgaccttcaagtcagaggggtctagaccagaatattattgttag

SEQ ID NO: 27098 - DNA, 1905 bp, Artificial Sequence
  Description of Artificial Sequence: Synthetic coding sequence
atggacatgaatgaactcccaaccaatctcccggttgataccgttaagcttcgcatagagaagacagtcattagaaggatttccgctgaggctttttattatctggtggaattacagtacctatgggtcacatataatagcgtggcatccattgaccctagtagcttttacaatcttaaacagttgcatgagctgcgactggacggcaactctctggccgctttcccttgggcaagtctgcttgatatgcccctgttacgcacacttgacctccacaacaacaagatcacctccgtgcctaatgaggccctgagatatctaaagaaccttgcctacctagatctgtcgtcaaatcgcctcacaacactgccccctgactttctagaatcctggacccacctcgtctccacacccagcggtgtgctggatttatccccatctcgcatcatcttgggactccaggacaatccttggttttgtgattgtcacatatccaagatgatcgaattatcaaaggtggtggatcccgctattgtgctactggacccgttaatgacttgtagtgaaccggaacgcttgacgggaatcttattccagagggcagagttagaacattgtctgaagcctagcgtgatgacttcagccacaaagatcatgtctgctcttggaagtaacgttcttctgaggtgtgacgccaccggctttcccactccccagatcacatggactcgatccgacagctcccctgttaattacacagtcatccaagagagtcccgaggaaggagtgagatggtctataatgtccttaaccggtatttcgagtaaggacgccggagattataagtgtaaagcgaagaatctggctggtatgtctgaggcggttgtaacagtaacagtcctgggcatcaccacaacacccatcccccctgatacaagcgaacgtaccggggatcacccagagtgggacgttcagcccggctcaggccgctccacttcagtgtcctctgcatcaagctacctttggtcctcgtctttttcgcccacgagcagcttctccgccagcacactttcccctccctccacagctagcttctctttgtcaccattcagtagtagcaccgtctcaagtactactacactctccacgtctatcagcgcctccactacgatggcgaataagaggagctttcagttacatcaggggggcaagcgcaacttaaaggtggcaaagaacggtagtaagttgccacccgcgagtacctccaagaaggaggagcttgcgctgctcgaccagaccatgctcacagagaccaacgctgccatcgagaatctgcgcgtggtttcagaaactaaagagtccgtgaccctcacttggaacatgatcaatacaacgcataattctgctgtgaccgtcctgtactctaaatacggggggaaggaccttctgcttttaaatgccgattcatctaagaaccaggtcactatcgacggactcgagccaggggggcagtatatggcatgcgtgtgccccaagggggttcctccccaaaaggaccagtgtatcactttctcaacagaaagagtggagggagatgactcacagtggagtttactgctcgtggtcacctctacagcctgtgtagttatccttcctctgatctgctttctcctttataaagtctgtaagttgcagtgtaagagtgagccgttttgggaagatgacctggcgaaggagacttatatccaattcgaaacattattcccaagaagccagtctgtgggagaactatggacaagaagccaccgggacgactctgaaaagttacttctatgctccagatcttccgtggagtcccaagtaacgttcaagagtgaggggtcgagacctgagtactactgttag

SEQ ID NO: 27099 - DNA, 1491 bp, Artificial Sequence
  Description of Artificial Sequence: Synthetic coding sequence
atggtggaaccccatcaggaaccccggcactctaaagtcggcctgcaggataacccttggttctgtgactgtcatattagtaagatgattgaactgtccaaagtagtggacccggccattgttctactcgatccactcatgacatgctcagaacctgagagactgacaggcatcctcttccagcgtgctgagttagaacattgcctgaaaccttcagtgatgacgtccgccacaaagattatgagcgctctgggaagcaacgtgctgttacgctgtgacgccaccggtttccctaccccacaaattacgtggactcggtcagattcatcacccgtaaactatactgttattcaggagagccctgaagagggagtgagatggtctatcatgtctctgactggcatctctagcaaggatgccggggactataagtgtaaagccaaaaacctggctgggatgagtgaggcggtggtgaccgtgacagtgttgggtatcacaactacgccaatcccacccgatacaagcgaacgtactggcgaccaccctgagtgggacgtacaacctggcagtggccgctcgacgagcgtgtcatccgcttcctcatacttatggtccagctctttctcacctaccagctccttttccgcctcaacattgtccccacctagcaccgcttcattctcactttcacccttcagctcgagcacagtgtccagcactacaacattatcaacctccatttcagcaagcacaacaatggctaacaagcggtcctttcagctccatcagggcggcaagaggaatcttaaggtggccaaaaatggcagtaagctcccacccgccagcacttctaagaaagaggagttagccctcctggatcagaccatgttaactgaaactaatgcagcaatcgaaaacttgcgagtagtatctgaaaccaaagagtcagtcacccttacctggaatatgatcaacaccacacataacagtgcagttaccgtgttatactcaaagtacgggggaaaagacctcctgcttcttaacgccgattcatccaagaatcaggtgacgatagacgggctggaaccgggtggacagtacatggcatgcgtctgtcccaagggggtcccgccacagaaggaccaatgcatcacattctctactgagcgggttgagggagatgacagtcagtggagcttgctcctggtcgtgacatccactgcttgtgtcgtcatcctgcctctgatctgcttccttctgtataaagtttgcaagttgcagtgcaagtctgagcctttttgggaggatgacctcgcaaaggagacttatatccagttcgagactcttttccctaggtcccagtccgttggcgaattgtggactcggagtcatcgagatgatagcgagaagctactgttatgtagtcggtccagcgtggagtctcaggtgacctttaaatcagaaggatccagaccagaatactactgctag

SEQ ID NO: 27100 - DNA, 3360 bp, Artificial Sequence
  Description of Artificial Sequence: Synthetic coding sequence
atgagtgccccgagtttaagagcccgggccgctggcctcgggctgctcctttgtgcagtgctgggcagagccggcaggagtgactctggaggtagaggagagctgggacagccgtcaggggtggcggctgagcgtccatgcccaacaacctgtaggtgcttgggagatctgctggattgtagtagaaagcgattggcccgcctgccggaacctttaccgtcatgggttgcgcggctggacctatctcataacagactgagctttatcaaggcctcatcgatgagccatctgcaaagtctgcgggaggtgaaactcaacaacaatgagcttgaaacaattcccaaccttggtcctgtgagtgctaacattactcttttaagcttggccgggaatcgcatcgtggagatcttgcccgaacatttgaaagaattccagtcattggaaacgcttgatttgtcctcgaataacatctccgagttgcaaacagcgtttcctgctctgcagctgaagtacttgtacctgaatagtaaccgcgtcacttctatggagccaggatatttcgacaatctggccaatactctcctggtgcttaagttgaataggaaccggatatcagctatcccgcccaagatgttcaaacttccccaactgcagcatttggaactcaaccgaaataaaatcaaaaatgtagacggactcacattccagggtcttggcgcacttaaaagtctcaagatgcagagaaatggtgtgactaagttaatggatggtgcattctggggtttgtccaatatggaaatccttcagttagatcacaacaatctgaccgaaattactaaaggctggctctacggactgctaatgctgcaagagttacatctgtcccagaatgccatcaataggatatcccccgacgcatgggagttctgccagaagctgagcgagctcgatctcacttttaatcacctgagcaggctcgacgatagtagctttttggggttgtccctgttgaacacccttcatatcggtaacaaccgagtcagttacatagccgactgcgcttttagaggactgtctagtctgaaaaccctggatttgaagaacaacgagatatcctggaccatcgaagatatgaacggcgcgtttagcggactggataagctcaggagattgatcttgcagggcaacaggatccgctctatcacaaaaaaagctttcacagggctggacgctctagagcacctagacctgagtgacaacgctatcatgtctcttcaaggcaacgctttcagccagatgaagaaactccaacagctccatctgaacacaagttctctcctctgcgactgtcagcttaaatggttgccgcagtgggtcgcagagaacaacttccagagtttcgtgaatgctagctgtgcccacccccaattgctcaagggtaggtccatctttgccgtgtccccggacggcttcgtgtgtgatgatttccccaaacctcagattacagtgcagccggaaacccagagcgcgatcaagggatccaacttgtcttttatctgttccgctgcttcaagctccgattctcctatgaccttcgcctggaagaaagataatgagcttcttcatgatgctgagatggaaaactatgctcatctacgggctcaggggggggaagttatggaatatactaccattttgcggcttagggaggtggagttcgcctctgaggggaagtatcagtgtgtgatctcaaaccactttggtagcagctatagcgtcaaagctaaacttacagtaaatatgctgcctagttttacaaagacaccgatggatctgaccatcagggcaggtgcaatggctagattggaatgcgcagccgtggggcatcctgcgcctcaaattgcatggcaaaaggatggtgggactgactttccagctgctcgtgagcgaagaatgcacgtcatgcccgaagacgacgtcttctttatcgtagatgttaagattgaagacatcggtgtgtacagttgtactgcccagaactccgctggatctatttctgctaacgccacgctaacagtgctggagactccaagcttccttaggcccctgctcgaccgcactgtcacaaaaggggaaacagccgtccttcagtgcatcgctggaggtagtccgcctcccaagctcaactggaccaaggacgattcacccttggttgtcactgagagacatttcttcgccgctggaaaccagctgctgattattgtagacagcgatgtctcagatgctggcaagtacacttgcgagatgtcaaataccctcgggaccgaacgcggaaatgtgagacttagcgtgataccaacccctacatgcgactcgccccagatgacagcacccagtctagacgacgatggatgggcaaccgtcggcgtcgttattatagccgtggtgtgttgtgtcgttggaacgtctctggtgtgggtggtaattatctatcacaccaggcggcgaaacgaggactgtagcattacgaacaccgacgagacaaaccttcctgccgacataccatcctacctgagtagtcagggaacgctggccgatcgccaggacggctatgtgtcttccgagtctggaagtcatcaccagtttgtcacttccagtggggccggattctttttgccacagcacgactcttcagggacatgccatattgacaattcttccgaggcagatgtggaggccgccactgacctgtttctctgcccattcctggggagtaccggtcccatgtatttgaaagggaatgtttacggtagcgatccctttgaaacttaccatacgggctgctctcctgacccccgcacagtgcttatggaccactatgaaccatcttatataaagaaaaaggaatgctatccctgcagccacccctcagaagagtcatgcgagcggtcctttagcaatatatcatggccaagtcatgtgaggaaactgctgaatactagctacagccacaacgagggacccggtatgaagaacctgtgcctgaacaaaagctctctggacttcagcgccaatccggagcctgcttccgtagcttcctccaattcttttatgggcacctttgggaaagcattgcgacggccacatctggacgcatactctagcttcgggcaaccaagcgactgccaaccaagggcattctacttaaaggctcattcaagtccggatctggactctggtagtgaggaagacggaaaagaacgaaccgacttccaggaggagaatcatatctgtactttcaagcagacactcgagaattaccggactccaaattttcagagttacgacttggacacatag

SEQ ID NO: 27101 - DNA, 3180 bp, Artificial Sequence
  Description of Artificial Sequence: Synthetic coding sequence
atggtggatgtgttactgctgttttctttgtgcctgctctttcatataagcaggccagatctcagccacaatagactgagcttcattaaggcctcctctatgagtcatcttcagtcacttagagaggtgaaactcaataataacgagctggagaccatacccaacctgggacctgtctctgccaacattacacttctgagtctggccggcaatcgaatcgtggagatcctcccagaacacctcaaggagttccagagcctcgagacccttgacctgagctccaacaacataagtgagctccagacagcattcccagcacttcaacttaagtacctttatctgaattcaaatagggtcacatcgatggaacctggctatttcgacaaccttgctaatacgctgctggtgctcaagcttaatcggaatcgcataagcgcaattccgcccaaaatgtttaaactcccacagctccaacatttggaactaaatcgtaacaagataaagaatgtggatggtctcacattccaaggtcttggagctctgaagtcgcttaaaatgcaacgtaacggggtcacaaagcttatggacggggccttctggggcttgtctaacatggagatcttacagcttgaccacaataatttaacagagataacaaaaggctggttatatggcctccttatgctacaagaactgcacctgtcacagaacgcaattaacaggatttctcccgatgcctgggaattttgccaaaagctgagcgagctggatctgactttcaaccacctgtcccggcttgacgacagctccttcttgggacttagccttctgaatactttacatatcggcaacaaccgagtttcttacatcgccgactgcgctttccgtggcctgtcttctctgaaaaccctggatcttaaaaataatgagattagctggacaatcgaggacatgaacggcgcgttttctggactggacaaactccgaagactcattctacagggaaacagaatccgcagcattacaaagaaagcttttaccgggctcgatgccttggaacatctagacctcagcgacaacgccataatgtcgctccagggcaatgctttctcgcagatgaagaagttgcagcagctccaccttaacaccagcagcctcttgtgcgattgtcagttgaagtggctcccacaatgggtcgcagaaaataatttccagtctttcgtgaatgcaagctgcgcccaccctcagctgttaaaaggacgcagtatattcgccgtttccccagatggattcgtctgcgacgacttccctaagccacagatcacagtgcaacccgagacacagagtgcaatcaaagggagtaacctttcattcatttgcagtgcagcctcttcatctgacagccctatgacattcgcatggaaaaaggacaacgagctgctgcatgacgccgagatggagaattatgcgcacttgagggctcaaggaggcgaggtgatggagtacacaaccattcttagactgagggaggtcgagttcgcaagcgagggcaagtaccaatgcgtgattagtaaccacttcggtagcagctattcggtgaaagccaaattgaccgtcaacatgctgcccagttttacgaaaacacctatggatctgacaattcgagccggggcaatggcacgcctagagtgcgccgccgtggggcatcccgcgcctcagatagcctggcagaaagacgggggtacagatttccctgctgctagagagcgaagaatgcatgttatgcctgaggatgacgtgttcttcattgtggatgtgaaaattgaggatataggggtttattcttgcaccgctcagaattcggccggtagcatctccgctaacgcgaccctgaccgtgttagagacaccctccttcctgcggcctctgctcgatcgtacggtgaccaaaggagagaccgcggtgctccagtgcatcgcaggcgggtcaccacctcctaagctgaattggaccaaggacgactctcctctggtagtgacagaaagacatttctttgcagctgggaaccagcttttgatcattgtcgacagcgatgtgagcgacgctggaaagtacacttgcgaaatgtcaaatacactcggtacagaacgcgggaatgtgcgacttagtgtcatcccaacgccaacatgtgactccccccagatgacggctccatcattggacgacgatggatgggccactgttggtgtcgtgattatagccgtcgtctgttgcgtggtgggcacttctctggtgtgggtcgtcatcatataccacacacggcggagaaatgaagactgttccattacaaatactgacgagaccaacctgccagctgatatacctagctatctgagctctcaggggaccctggccgatcgccaggatggctatgtgtcatccgaaagtgggtctcaccatcagtttgtcacctccagtggggccgggttcttcctgcctcagcacgactccagcgggacatgtcacattgataatagctccgaggctgatgtagaggccgctacagacttgttcttgtgcccattcctgggctccaccggacccatgtatttgaagggcaatgtctacggctccgacccctttgaaacttaccataccgggtgttctcccgatcccaggacagtgctgatggaccactacgagccatcatacataaagaaaaaggagtgttacccatgttcccacccatcggaggagagttgcgagcgtagcttctccaacattagctggccctcacacgtgaggaagctgctcaatacttcttactcccacaatgaggggccggggatgaagaacctgtgtctcaacaagtccagcctggatttctctgccaacccagagccagcgagtgtggcatctagcaactcttttatgggaacttttggcaaggcactgcggaggccacatttagacgcctattcttccttcggacagccatcagattgccagcctagagctttttatcttaaggcccactcctcccctgaccttgactcagggtcggaagaggacggcaaggagagaacggatttccaggaggaaaatcacatatgcacattcaagcaaacgctggaaaattatcggacgcccaattttcagtcctacgatttggatacctag

SEQ ID NO: 27102 - DNA, 1038 bp, Artificial Sequence
  Description of Artificial Sequence: Synthetic coding sequence
atgaagggggagctgcttctattctcatccgtaattgtgctcctccaggtcgtgtgtagttgtcccgacaagtgctactgccagtcgagcacaaatttcgtggactgcagccagcagggcttggctgaaataccatcacacttgccacctcagacacgaactctgcacctgcaagacaatcaaattcaccacctgcccgctttcgcattcagatcagttccatggcttatgactcttaatttatccaataattcactgagcaacctagctcctggtgcatttcatggcctacagcatctacaggtgctgaatctgacccaaaacagcctgttaagcctggaaagtcgcctgttccatagtctgccccaactccgggaactggatctgtcttccaataacatcagccatctgcccacatctttgggcgagacgtgggagaatcttacaattctcgccgttcagcagaaccagctccagcagcttgatagagccttgctggagtctatgccatctgtgcggctgctccttcttaaggataacctctggaaatgtaattgccaccttttgggattgaaattgtggctggagaagtttgtgtacaagggcggactaactgacgggataatatgtgagagccctgatacctggaagggaaaggatctcctgcgcattccccacgaattataccaaccttgtcctcttccagctcccgaccctgtgtcatctcaggctcagtggccagggagtgctcacggcgtggtcctccgccctccagagaatcacaacgccggcgagcgagagttactcgaatgtgaattaaagccaaaacccaggccggccaacctgcgccatgcaatcgccaccgtcattataaccggtgtggtgtgcggaatcgtgtgcctgatgatgctggctgccgcgatctatgggtgcacatacgccgccattactgcacagtatcacggggggcccctggcacagaccaatgaccctgggaaagtggaagaaaaggagcgttttgacagcagccccgcttag

SEQ ID NO: 27103 - DNA, 810 bp, Artificial Sequence
  Description of Artificial Sequence: Synthetic coding sequence
atgacactgaacttatctaataatagcctaagcaatctagcacctggagcatttcacggactccagcaccttcaggttctcaacctcacgcaaaacagcctgctgtctctagagtctcgacttttccactctctcccccagctgagagaactggacctgagcagtaataacatttctcacttgcctacctctttgggggaaacctgggagaacttgaccatcctggcagtccagcaaaatcagttgcagcaattagatcgagcactgcttgaatcaatgccatccgtcagattgctgctgcttaaggataacctgtggaagtgcaactgccacttactcggcctcaagctgtggctggagaagttcgtgtataaaggcggcttaacagacggtatcatttgtgagtccccagatacatggaagggaaaggacctgttgcgcatccctcacgagctctaccagccttgcccgttgcctgcccctgaccccgttagcagtcaggcccagtggcccgggtccgcccacggggtcgtgttgcgtcctcccgagaatcataatgccggagagcgggaattgctcgaatgcgaattgaagcccaagccgcgccctgccaatttaagacacgccattgccaccgtgatcatcaccggtgtcgtgtgtggcatagtgtgcttaatgatgcttgccgcggctatctacggttgcacatacgctgccatcaccgcacagtatcacggaggaccactggcacagactaatgacccaggcaaggtagaggaaaaagagagatttgatagttctcccgcctag

SEQ ID NO: 27104 - DNA, 1113 bp, Artificial Sequence
  Description of Artificial Sequence: Synthetic coding sequence
atgctggcccctgggagtagccccgggcaaagaggccgcttggctctgcaatggagacaggtgagctggattacttgttggattgcattgtacgccgttgaagcacttcctacctgtcccttttcttgtaaatgtgactcacgttcgctggaggtcgattgctctgggctgggtcttacgaccgtgcctcctgatgttcctgccgcaacacggacattgttgctgctgaacaacaagctatctgccctccccagctgggcgttcgccaacctgtcttccctccaacggttagatttaagtaataacttcctggacagattaccccgttccatctttggggatctgaccaatctgacagaattgcagttaaggaacaattccatcagaacactggaccgggatttattacgccactcccccctgcttcgccatctagaccttagtataaatggactggctcagctacctcccggtctgtttgatggactactcgccctaagatctctttcgctgcgtagtaacagattacagaacctagacagactgacgttcgagcccctcgctaacttgcagctgctgcaggtgggggataatccctgggaatgtgactgcaacctgcgggaattcaaacactggatggagtggtttagctacaggggcggacgattagatcagctggcatgcactcttcccaaggagctaagaggcaaggacatgcggatggttccaatggagatgttcaactattgcagtcagcttgaagacgaaaactccagtgccggccttgacattccaggccctccatgtacgaaagctagtcccgaacctgctaagccgaaacctggcgcagagcccgaaccagaaccgtcaaccgcttgcccgcagaagcagagacacagacctgcaagcgtgagacgggccatgggcaccgtgatcatcgccggggtggtctgcggggtggtgtgcattatgatggtcgtggctgccgcttacggctgcatctacgcgtcactgatggctaaataccaccgtgagctaaagaaaaggcagccgctcatgggcgaccccgagggtgagcacgaagatcagaagcaaatctcatctgtcgcgtag

SEQ ID NO: 27105 - DNA, 408 bp, Artificial Sequence
  Description of Artificial Sequence: Synthetic coding sequence
atgagaatggtgcctatggagatgtttaactattgcagccagctggaggacgagaactcttctgcggggcttgatatccctggacctccctgcacaaaagcatcccccgaaccggccaagccaaagcctggcgcacaacactctctgccgactgaggctgaagcccccgccggagagcgagaggcatctcatgggcacggcgatcactgcaggggtagggtgagacgacggctccaccacgatggaggcggacgctgtctgtggctccaccttaggctgccccacggacaggtgcccccgggtgcccagaaagcccctgctccggatgggggaccacgggggagggcccgcgggcctgaggcagatcttttttgtggactgtcggcccacccccaccctgcgcgttag

SEQ ID NO: 27106 - DNA, 1113 bp, Artificial Sequence
  Description of Artificial Sequence: Synthetic coding sequence
atgcttgcccccggcagcagccctggccagagaggtagactcgccctacagtggcgtcaggtgtcttggatcacttgttggatagctctctatgcggtggaggctctcccaacatgtcccttttcctgcaaatgtgatagcaggagcctcgaggtcgactgtagtggacttggattaactaccgttcctccagacgtgcccgctgcaacaagaaccctgctgctgttaaacaataaactatctgcactgccatcttgggcattcgcaaacctgagttcactgcagcggctcgacttgtcaaataattttctggaccgactgccccggtcaattttcggcgatctgactaatcttaccgaattgcagttgagaaacaactctatacgaactctggatcgcgatctgctacgacacagcccattattgagacatctcgacttgtctattaatggtcttgcccagctcccaccgggcctgtttgacggactcctagctttgcggtccctcagtctgaggtcaaaccggctccagaatttggacagattgactttcgaaccattggcaaatctgcaactcttgcaagtcggcgacaacccatgggaatgtgactgcaacctgcgagagttcaagcactggatggaatggttctcctatagagggggccgcctcgatcagctagcctgtaccctcccaaaggaacttaggggaaaggatatgagaatggttccaatggaaatgtttaattactgtagccagctcgaggacgagaactctagtgccgggcttgatattccgggacccccctgtacaaaagcatcccccgagcccgctaagccaaagcctggggcagagcccgaaccagagccttctacagcctgtccgcaaaagcagcgacaccggccagcctcagtgcgacgagcaatgggaaccgtgatcattgccggagtggtttgcggagtggtttgcattatgatggttgtggcagccgcctatggatgtatttatgccagcctgatggccaagtaccatcgggagctgaagaaacgtcagcccctgatgggagacccagaaggagaacacgaagaccagaagcagatctcctccgttgcttag

SEQ ID NO: 27107 - DNA, 1113 bp, Artificial Sequence
  Description of Artificial Sequence: Synthetic coding sequence
atgctggcccccggcagttcaccagggcagcgagggcggctggccctgcagtggcgccaggtcagctggatcacctgctggatcgccctctacgcggtggaggcattacccacctgcccattctcatgcaaatgcgactcccggtctctggaggtagactgttctggtcttggtctgactaccgttccccccgacgtgccagccgccacaaggacactgttactcctgaataacaaactttcagctctaccatcctgggcctttgctaacctctctagcctccagagacttgacctaagcaacaatttcttggatagattgcccaggtcaattttcggggatttgacgaatctcaccgagttacagcttaggaacaattcaataagaacactggatagggaccttcttagacactcgcctctcctgcgacatttagacttgtctattaacgggttggcccagctgcctcctggtcttttcgacggcttgctggcccttcgttccctctcactgcgaagtaaccgcttgcagaacctggataggcttactttcgaacccttggccaacctgcagctcctgcaggtgggcgacaacccttgggaatgcgattgcaacctccgggagttcaaacactggatggagtggtttagctatcgaggaggacggctcgatcagctcgcctgcacgctgccaaaagagctccggggcaaagatatgagaatggtgcccatggagatgttcaactattgctctcagcttgaggacgagaactcaagcgccgggcttgacataccggggcctccctgtaccaaagccagccccgagccagcaaaacctaagcccggcgccgaaccggaaccagaaccgagcacagcctgcccccagaagcagagacaccggcccgcgagtgtgaggcgggcgatgggcacggtgataattgctggggttgtctgcggcgtggtctgcattatgatggtggtcgccgccgcctacggttgtatctatgcgtctcttatggctaagtaccatcgggaacttaagaaaaggcagccactcatgggcgatcctgaaggcgagcacgaagaccaaaaacaaatctcttctgtcgcttag

SEQ ID NO: 27108 - DNA, 1500 bp, Artificial Sequence
  Description of Artificial Sequence: Synthetic coding sequence
atgacacttattctcactagcctgctgttctttggcctcagtttgggcccaaggactcgggtccaggcggagaatttgcctaaacccattttgtgggcagagcctgggcctgtgatcacatggcataatccggtgaccatttggtgccagggaactctggaagctcagggttaccgtttggacaaggagggcaactcgatgtcaagacacatcctgaagaccttggagtctgagaacaaagtgaaactgtctattccttccatgatgtgggagcatgctggacgctaccactgctactaccagtccccggcgggatggtccgaacccagtgatcccctggaattagtggtgactgcctactccaggccaaccctttcagctctcccatccccggtggttacctctggggtgaatgtcaccttgagatgcgctagtcggttggggcttggacggtttaccctgattgaagaaggtgatcacagactgagctggaccctcaattcacaccagcataatcacggcaagtttcaagcattgtttcccatgggaccacttactttctcaaacaggggaaccttccgctgttacggatacgagaataacaccccttacgtttggtctgaaccgtccgatcccctgcagctgctggtcagtggtgtgtcccggaagcccagtcttctcacactccagggccccgtagtgacacctggtgagaatttaaccctgcaatgcggatcagatgtgggctacattcgatacaccctgtataaggaaggggcagatggcttaccccagcggcccgggcgtcaaccgcaggcgggcctgagtcaggcaaactttacactgtccccagtcagtcggagctacggaggtcaatacaggtgttacggtgcacataatgtgagctccgagtggagcgcgccgagcgacccgctggacatcttaatcgctggtcagattagcgatagaccaagcctttccgtccagcccggaccgactgttaccagcggagaaaaagttactctgctgtgccaaagctgggatccgatgttcacattcctgttgacgaaggagggagcagcccacccaccgctgaggctgcgctctatgtatggggcacataagtatcaggcagagtttcccatgtctcctgtgactagcgcacacgctggaacatatagatgttatggctccaggtcttcaaacccttaccttctcagccatccctcagagcccttggagctagtggtaagcggcgcaaccgagacactgaacccggcccagaaaaaatctgacagtaagactgcgccacatctgcaggattatacagtcgagaacctcatacggatgggcgtggctggcctcgttctgctctttcttggtatcctgttatttgaggctcagcattcccagcgtagccctcccagatgctcccaggaggctaactccaggaaggacaacgccccatttcgcgttgtggaaccatgggagcagatctag

SEQ ID NO: 27109 - DNA, 978 bp, Artificial Sequence
  Description of Artificial Sequence: Synthetic coding sequence
atggcgaatgcacttgcgagtgcgacctgtgagcggtgtaagggaggtttcgcccctgccgagaagattgtgaactcaaacggtgagctgtaccatgagcagtgctttgtctgtgctcaatgcttccagcagtttcccgagggccttttttacgagttcgaggggagaaaatactgcgagcacgacttccagatgctttttgccccgtgttgccatcagtgtggggaatttatcattggccgggtcatcaaggcaatgaacaactcatggcacccagagtgctttcggtgcgacctttgtcaggaagtattagcggacattggattcgtgaaaaacgctgggcgccacctgtgtagaccctgccataaccgggaaaaagcccgcgggctagggaagtatatctgccagaagtgtcacgccattatcgacgaacagccgctcatctttaagaatgacccttatcacccagaccacttcaactgcgctaactgcggcaaagagcttaccgctgatgcccgggagctgaagggggaattgtactgcctgccctgtcacgacaaaatgggggtcccaatctgtggggcatgtcggaggccaatcgagggtcgggtcgtcaatgcaatgggaaagcaatggcacgtggagcattttgtctgtgccaagtgcgagaagccatttcttggccatcggcactacgagcggaaaggcctcgcatactgtgagacacactataaccagctctttggagacgtttgctttcattgcaatagggtaatcgaaggagacgtagtttcagcacttaacaaggcttggtgtgttaattgcttcgcatgttctacctgtaacacaaagctcaccctgaagaataaatttgttgagttcgacatgaaaccagtatgtaagaagtgttatgagaaattccctctcgaattaaaaaaaagacttaagaagctggccgaaactctcggccgcaagtag

SEQ ID NO: 27110 - DNA, 978 bp, Artificial Sequence
  Description of Artificial Sequence: Synthetic coding sequence
atggctaatgctctggcttctgctacctgcgaaaggtgtaaaggtggatttgctcccgctgagaagatagtcaactcaaatggagagctgtaccacgagcagtgctttgtttgtgcacagtgtttccagcagtttccagaaggcctgttttacgaattcgagggcaggaaatattgcgagcatgacttccaaatgttgttcgctccttgctgtcatcagtgcggcgaatttatcattggccgggtaatcaaagctatgaacaactcctggcacccagaatgtttccgttgcgacctgtgccaggaagttcttgccgatatcggattcgtgaagaatgcaggccggcatttgtgtcggccttgccacaatagggagaaggcgcgtggtctgggaaagtatatttgccaaaaatgccatgcaatcattgatgaacagcctctgatctttaagaacgatccctaccatccagaccacttcaattgtgcaaactgtggcaaagagttgacagccgacgctcgcgagttgaaaggcgagctttactgtttaccatgccatgataaaatgggagtacccatttgcggcgcatgtcgacgcccaatcgagggacgggtggtgaatgccatgggtaaacagtggcatgtggagcactttgtatgcgccaagtgtgaaaagccgttccttggccatagacactacgaaagaaaggggctggcctattgtgagacccattataaccagctgttcggtgatgtctgttttcactgtaacagagtgatcgaaggggatgtggtgtcggccctcaataaagcatggtgcgtaaactgctttgcctgctcaacctgtaacactaaactgacccttaaaaacaagttcgtcgagttcgatatgaagccagtgtgtaaaaagtgctacgaaaagttcccgttagaattgaagaagcgactgaaaaaactggccgagacgctggggcggaagtag

SEQ ID NO: 27111 - DNA, 978 bp, Artificial Sequence
  Description of Artificial Sequence: Synthetic coding sequence
atggctaacgccctggcctccgcgacatgtgagcgctgcaaggggggttttgcccctgccgaaaaaatcgtgaattctaatggtgagctctaccatgagcagtgctttgtctgtgcccagtgctttcagcagttcccagagggcctgttctatgagttcgaggggcgcaagtactgtgaacatgactttcagatgcttttcgctccttgttgtcatcagtgcggcgaattcatcattggcagagtgataaaggctatgaataacagctggcatcccgagtgttttcggtgtgatttgtgccaggaggtgctggcagatatcggattcgtcaagaatgcaggccgacatttgtgtcgtccttgccacaatcgtgagaaagctcggggcctcggcaagtacatctgtcagaagtgccatgccatcattgatgaacaaccattgatcttcaagaatgatccctaccatccagatcacttcaactgtgcgaactgcgggaaagaacttaccgcagacgcccgcgaacttaaaggagagctgtactgcctgccctgtcatgacaaaatgggagttcctatatgcggcgcctgcagacggccaatcgagggtagggttgtgaatgctatgggaaagcagtggcatgtggagcactttgtgtgcgcgaagtgcgagaagccatttttgggacaccgccactatgagcggaaagggttagcttactgtgagacacattataatcagctttttggcgatgtgtgtttccactgtaaccgggttatcgagggcgatgttgtgtctgccttgaataaagcctggtgcgtaaactgcttcgcgtgctccacgtgtaacaccaagctcactctgaaaaataagttcgtagaattcgacatgaagcctgtatgcaaaaagtgttatgagaagtttcctctagagcttaaaaagcggctcaagaagctcgccgagaccttgggcagaaagtag

SEQ ID NO: 27112 - DNA, 354 bp, Artificial Sequence
  Description of Artificial Sequence: Synthetic coding sequence
atggccttttcgggtagggctcgtccatgtattattcctgagaacgaggaaattcctcgcgcggctctgaacactgtgcacgaggcaaacggtaccgaagacgagagggcagtgtccaaactccagaggagacacagtgatgtcaaggtctataaggagttttgcgacttttacgcgaagtttaatatggcaaatgcacttgccagtgccacctgcgagcgctgtaaggggggcttcgcccctgcagagaaaatagttaactctaacggcgaattataccacgagcaatgcttcgtctgtgctcaatgtttccagcagttccctgaaggacttttctacgaagagagaacatag

SEQ ID NO: 27113 - DNA, 1089 bp, Artificial Sequence
  Description of Artificial Sequence: Synthetic coding sequence
atgactgctttgcagctgaaagaattgtcacatagtggcctatatcgtaggaggcgggataggccagactccctccgggtgaacgggctgccagaggaggagctgtctaatatggctaacgccctggcgtctgcaacttgcgagcgttgcaaaggaggatttgcacctgcagagaagatagtcaatagcaacggagagttatatcatgagcagtgttttgtatgcgctcagtgcttccagcaatttcccgaggggctgttttacgagtttgaaggcaggaagtattgcgaacacgatttccagatgctgtttgctccatgctgtcaccagtgtggggagttcataatcgggagggtcatcaaggctatgaacaactcttggcatcccgagtgcttcaggtgtgatctctgtcaagaggtactagccgacatagggttcgtgaagaacgcaggacggcatttgtgtcgcccttgccacaatagagagaaggcccggggccttggaaaatacatctgccagaagtgccacgccatcattgatgagcaacccttgatcttcaaaaacgatccatatcacccagatcacttcaactgtgccaactgcgggaaagagttgactgcagatgcccgagagttaaaaggcgagctttactgtctgccatgtcacgacaagatgggtgttccaatatgcggggcgtgccgccgcccaattgaaggcagagtggtgaatgccatgggcaagcagtggcatgtggaacacttcgtgtgcgccaagtgcgagaagccgttcctcggccaccgccactacgagagaaaaggtctggcctattgcgagacccattacaatcaactgtttggggatgtctgcttccattgcaacagagtgatagagggcgacgtagtctcagccttgaataaggcctggtgcgtgaactgctttgcttgttccacctgtaacacaaagttgacgcttaagaacaaatttgtagaattcgacatgaagcccgtttgtaagaagtgttacgaaaaattcccgctggaactgaagaagagattgaagaaactggccgaaaccctgggaaggaaatag

SEQ ID NO: 27114 - DNA, 990 bp, Artificial Sequence
  Description of Artificial Sequence: Synthetic coding sequence
atgacctgcaatatggctaatgccttagcatctgccacatgcgagcgctgtaagggagggttcgcaccggctgagaaaattgtaaatagtaacggtgagctatatcatgagcagtgcttcgtgtgtgcgcagtgcttccagcagttccccgagggacttttttacgaatttgaaggaagaaaatactgcgagcacgattttcagatgcttttcgcgccatgttgccatcagtgtggggagttcatcatcgggcgagtcatcaaagcaatgaacaattcatggcatcccgagtgttttaggtgtgacctctgccaagaggtcttggccgatatcgggtttgtgaagaatgcaggcaggcacctatgtcgaccttgccacaatcgggagaaagccagaggtctagggaaatatatctgtcagaagtgtcatgccattatcgacgaacagccactgatctttaagaacgatccatatcatccagaccacttcaattgcgcaaactgcggtaaagagttgaccgctgatgccagagaactgaaaggcgaattatattgtttgccatgtcatgacaagatgggagtgccaatatgtggtgcctgtcgtcgacccatcgaggggagagtggtcaacgcaatgggaaaacaatggcatgtcgagcacttcgtgtgcgccaagtgtgaaaagccgtttctgggtcatcgccactacgaaaggaagggtttagcttactgtgagacacactacaaccaactctttggtgacgtgtgcttccattgcaatcgcgttatcgagggggacgttgtgagtgcactaaataaagcctggtgcgtgaattgcttcgcgtgcagtacttgtaatacaaaattgaccctgaagaataagtttgttgagttcgacatgaaacctgtttgtaagaaatgttacgaaaaattccccctggagctgaagaagcgactgaaaaaactggctgaaactcttggaagaaagtag

SEQ ID NO: 27115 - DNA, 1164 bp, Artificial Sequence
  Description of Artificial Sequence: Synthetic coding sequence
atggccttcagcggccgcgccaggccctgcattatcccagaaaatgaggagatccctcgcgccgctctgaacaccgtccacgaggcgaacggcactgaggacgaaagggcggtgtcaaagctacagcggagacattccgatgtcaaggtctataaagagttctgtgacttctatgcaaagtttaacatggcaaatgccctggccagcgctacgtgtgagagatgcaaggggggatttgctccggccgaaaaaattgtgaactcaaacggggagctttaccacgagcagtgcttcgtatgcgcccagtgtttccagcagtttcctgaagggctgttctatgaattcgaaggccggaagtattgcgagcatgattttcagatgctctttgccccatgttgtcatcagtgtggcgagtttattatcggacgggttattaaggctatgaataatagctggcatcctgaatgttttcggtgtgacctgtgccaggaggtgttagccgatattggctttgtgaagaacgccggacgacacctttgccgcccctgccataacagggaaaaagcgcgcggcctgggcaagtatatatgtcagaagtgccatgccattattgatgagcagcccctgatctttaagaatgacccatatcaccccgaccatttcaattgtgccaactgcggcaaggagctcacagcagacgcaagagagttaaagggcgagctgtactgtctcccctgtcatgacaagatgggcgtgcctatatgtggtgcctgtcgcagaccaattgaggggagggtggttaatgccatgggaaagcaatggcacgttgaacattttgtgtgtgcaaagtgtgaaaaacctttcctgggccacagacattacgaacgcaaggggctcgcctattgcgagacccattacaatcagctcttcggagacgtctgcttccactgtaaccgtgtaatagagggagacgtcgtgagcgccctcaacaaagcctggtgtgtcaattgtttcgcctgctctacatgcaataccaaacttacattgaagaacaagtttgtcgaattcgacatgaagccagtttgtaaaaaatgttacgaaaagttccccctcgagctgaagaagaggttaaaaaagttggcggaaaccttgggtaggaaatag

SEQ ID NO: 27116 - DNA, 1014 bp, Artificial Sequence
  Description of Artificial Sequence: Synthetic coding sequence
atgttgggtgtcgccgcgggcatgacccatagcaatatggccaatgcgctagcttccgcgacctgcgaacggtgtaaaggggggttcgctcctgcagaaaaaattgtgaattccaatggcgagctgtaccacgagcaatgctttgtgtgcgcccagtgttttcaacaatttccagagggtctgttttacgagtttgaaggccggaaatattgcgagcatgacttccagatgctgtttgcaccctgttgccaccagtgcggcgaatttattatcggtagggtgatcaaggctatgaataactcatggcatccagagtgtttccgctgcgatttgtgccaggaagtcctggctgatattggattcgtcaagaacgccgggcggcacctgtgtcggccatgccataacagagagaaggcacgaggactcggcaagtatatctgccagaagtgccacgcgatcatcgatgaacagcctcttatctttaagaatgatccttaccaccccgatcactttaattgcgctaactgtggaaaggagttgactgccgatgcccgcgagcttaaaggtgagctatactgcctgccttgtcacgacaagatgggggtgcctatctgtggggcctgccgaagaccaattgaagggcgggttgtgaatgctatgggtaagcagtggcatgtggagcattttgtctgcgcaaagtgtgagaaaccattcctggggcaccgtcactacgagcggaaagggctggcctactgcgagacacattacaaccaacttttcggggatgtctgctttcattgtaacagggtaattgagggcgacgtggtgtccgccctcaataaggcctggtgcgtaaactgctttgcctgcagcacctgtaataccaaattgacattgaaaaataagttcgttgagtttgatatgaagcctgtttgcaagaagtgttacgagaagtttcccctggagttgaagaagcgtctgaagaagttagccgagacactgggacggaaatag

SEQ ID NO: 27117 - DNA, 1098 bp, Artificial Sequence
  Description of Artificial Sequence: Synthetic coding sequence
atggcggctcgcttgggagctctggcagcaagcggcctgtatcgccggcggcagcatcggcaaagcccccctcctgctacaggcaacatgtccgacgccttagctaatgctgtctgtcagaggtgccaggcaaggttttcccccgccgagagaatcgttaattctaatggagaactgtatcatgaacattgctttgtgtgtgcacagtgctttagaccctttcctgaaggccttttttatgagttcgagggcaggaagtactgtgaacacgacttccagatgctcttcgctccctgctgcggcagctgcggtgagttcattatagggcgggtgatcaaggccatgaataacaactggcaccctgggtgctttcggtgtgaactgtgtgatgtcgaactggctgaccttggttttgtgaaaaacgccggccgacacctctgtaggccttgccataatcgtgagaaggccaagggactggggaaatatatctgccagaggtgccatctggtgattgatgagcagcccctgatgttccgttcagacgcgtaccatcctgatcatttcaactgcacccactgtggaaaggagctgaccgccgaagcacgcgagttgaagggtgagctttattgcctgccctgccacgataagatgggggtgcccatctgtggggcatgtcgaaggcctatagagggacgcgtggtgaacgctcttggcaaacagtggcatgtcgagcattttgtctgcgccaaatgcgagaagccttttctgggacatcggcactacgaaaagaaaggtctggcctattgcgagacccattacaatcagctgtttggagacgtgtgttacaactgttcacatgttatcgagggggatgttgtctcagctctcaacaaggcctggtgtgtgtcctgcttttcctgttcaacctgtaatagtaagctcacgcttaagaacaagttcgtcgagttcgacatgaagcctgtctgcaaacgctgttatgagaagttccctctcgagctgaagaagaggcttaagaaattgtccgaattaacctcccgaaaggcgcaacccaaggccacggatcttaactcagcttag

SEQ ID NO: 27118 - DNA, 750 bp, Artificial Sequence
  Description of Artificial Sequence: Synthetic coding sequence
atggagtcccggcaccccgcagtcgccgaaattgcatgcacttgctgggccctgctacacctggccaaccccgagggcagaggacacttatgtaggccctgccacaaccgggagaaagcaaaggggctaggaaaatatatctgccaacgctgccatctggtgatcgacgaacaaccacttatgttcagatctgatgcatatcatcccgatcacttcaactgtacccactgtggcaaagaactgacggcggaggcacgagaacttaagggagagctgtattgtttgccatgccatgacaagatgggagtccctatatgcggtgcttgcaggagacctatcgagggacgagtggtaaacgccctgggcaagcaatggcacgtagagcactttgtttgtgctaaatgcgaaaagccctttctggggcatagacattacgagaagaagggtctcgcctattgcgaaactcactataatcagctgtttggcgacgtgtgctacaactgttctcacgtcattgaaggggacgtggttagtgctttaaacaaagcgtggtgtgtgagctgtttttcttgcagtacgtgcaactccaaacttaccctcaaaaacaaatttgtggaattcgacatgaaacccgtgtgcaagaggtgctatgaaaaatttcctcttgagttgaagaaaagactgaaaaagctatcggagctaacaagcaggaaagcacagcctaaggctaccgacttaaactctgcctag

SEQ ID NO: 27119 - DNA, 1026 bp, Artificial Sequence
  Description of Artificial Sequence: Synthetic coding sequence
atgaccgggtccaatatgtcagacgccctcgccaacgccgtttgtcaacgctgccaggcacggttctcccccgcagagagaatcgtgaacagcaatggagagctgtatcacgagcactgctttgtatgtgcccagtgctttcggccgttccctgaagggttgttctatgaattcgaaggccgcaagtattgcgaacacgattttcaaatgctttttgcaccgtgctgcggcagctgcggcgagttcatcatcggtcgagtaatcaaggccatgaacaacaactggcacccgggttgtttcaggtgcgaactgtgtgatgtggagctggccgatcttggattcgttaagaacgctgggagacatctctgtcgtccgtgtcacaacagagaaaaggcaaagggcctgggcaagtacatctgccagaggtgccatctcgtgattgacgagcaacccctgatgtttcgctcagatgcataccatcctgatcacttcaactgcacgcactgtggaaaggagctcactgctgaagcacgggagttgaagggagagctgtactgcctgccctgccacgataaaatgggagtgcctatctgtggggcctgtcgccggcccatcgaggggcgggtcgtcaacgctctgggtaagcaatggcatgtagagcacttcgtgtgcgctaaatgcgagaaaccttttctgggacacagacattacgaaaaaaagggtttggcctactgtgagactcactacaaccagctgttcggagacgtgtgctacaattgttcgcatgttatcgaaggggatgtggtctctgctttgaataaggcttggtgtgtctcctgcttttcctgttcaacgtgcaacagcaaactgacgctgaaaaacaagtttgtggaattcgatatgaagcctgtttgcaaacgctgctacgagaagttccctctcgaactgaaaaaacgcctaaagaagctttccgagctgacatctagaaaagctcagcccaaagcgacggatctgaactcagcttag

SEQ ID NO: 27120 - DNA, 570 bp, Artificial Sequence
  Description of Artificial Sequence: Synthetic coding sequence
atgttccgaagtgatgcctatcaccccgatcactttaattgtacccattgcggaaaagaactgacagccgaggccagagaacttaagggggagctctattgtctaccttgtcacgacaagatgggagtgcccatctgcggagcgtgccgccgccctatcgagggccgggtcgttaatgccctaggcaaacagtggcacgtggaacactttgtttgcgctaaatgcgagaaaccattcctcggacaccgccattacgaaaaaaagggtctcgcttattgcgaaactcactataaccagctgtttggtgacgtttgctacaactgtagtcacgtaatagagggagacgttgttagtgccctgaataaggcatggtgtgtttcttgtttttcctgctctacatgtaacagtaagcttaccctgaaaaacaagtttgtagagtttgatatgaagcctgtgtgcaagcgctgctatgagaaattcccattggagttaaaaaaaagactcaagaaactcagtgagctgacatcacggaaagcccagccaaaagccacagatcttaactcagcctag

SEQ ID NO: 27121 - DNA, 570 bp, Artificial Sequence
  Description of Artificial Sequence: Synthetic coding sequence
atgtttaggtccgatgcttaccacccagaccacttcaactgtacacactgcggtaaggaactcacagcggaagcgcgggagctgaaaggcgagctgtactgcctgccatgtcatgacaaaatgggggtgcccatctgtggggcctgtagaagaccaatcgagggccgcgttgtgaatgcactgggcaaacagtggcacgttgaacactttgtttgcgccaagtgcgaaaaaccgtttcttggacacaggcattatgagaaaaagggcctggcttattgcgagacccattacaatcagctctttggcgacgtctgctataactgttctcatgtaatcgagggcgacgtggtttcggcactgaacaaggcctggtgtgtaagttgcttttcctgcagcacttgcaactctaaactcacactgaagaataagtttgtcgaattcgatatgaaacctgtgtgcaagagatgctatgaaaaatttccgctggagctgaaaaagcggctcaaaaaactgtcagagttgacatctcgtaaagcccagcctaaggccaccgacttgaactccgcttag

SEQ ID NO: 27122 - DNA, 1011 bp, Artificial Sequence
  Description of Artificial Sequence: Synthetic coding sequence
atgtctgacgcactggccaacgcggtctgccagcggtgccaggctcgcttttcccccgctgagcgaatcgttaattctaatggagagctttatcacgaacattgtttcgtctgcgctcagtgtttccgcccattcccagaaggtctcttttacgaattcgaagggcgaaagtattgtgaacatgacttccagatgctcttcgctccatgctgcggaagctgtggagagtttattatcggtcgagtgatcaaggctatgaacaataattggcaccccggctgctttcgctgcgaactgtgtgacgtggaactcgctgacctaggttttgtgaagaacgctggcaggcatctttgtagaccatgtcacaaccgcgagaaggccaaagggttgggcaagtatatctgccaaaggtgtcatttagtgatcgatgagcagcctcttatgtttagatcggatgcataccacccagatcactttaactgtacacactgcggcaaggagcttactgctgaggccagggagttaaagggggagctgtattgtttgccatgccatgataagatgggcgtgccaatctgcggagcctgtcggcgccctatcgagggccgtgtggtgaacgccctggggaagcagtggcacgtagagcattttgtgtgcgctaagtgtgagaagccattcctcgggcataggcattacgagaaaaagggactggcttactgcgagacccattacaatcagctgtttggcgatgtctgttataattgttcccatgtgattgagggggatgtagtgagtgccttgaacaaagcttggtgtgtgtcttgctttagttgctctacctgcaactctaaattaaccctcaaaaataagttcgtggaatttgatatgaagcccgtttgtaaacgctgctacgagaagttcccccttgaactgaagaagaggttgaaaaagctgagtgagctgacatctcgcaaagcacagcctaaagctactgacctcaacagcgcctag

SEQ ID NO: 27123 - DNA, 570 bp, Artificial Sequence
  Description of Artificial Sequence: Synthetic coding sequence
atgttcagaagtgacgcttatcatcctgatcactttaattgcactcattgcggtaaggaactcaccgcagaggctcgggagctcaaaggcgagctgtactgtctcccatgtcatgacaagatgggagttcctatctgcggcgcttgtcggaggcccatcgagggtcgcgttgttaatgccctcggcaaacagtggcacgtggagcactttgtttgtgcaaaatgcgagaagccattcttggggcatagacattacgaaaaaaagggactggcctactgcgagacgcattataaccagctattcggggatgtctgctacaactgttcccatgtcatcgaaggggacgttgtgtcagctctgaataaagcgtggtgcgtttcttgtttcagctgttccacatgcaattctaaattaactctgaagaataaatttgttgagttcgatatgaaacctgtttgcaaaaggtgttacgagaagtttccactggagctgaaaaagcgcttgaagaagttgtcagagttaaccagtagaaaggcacagcctaaagctacagatctcaacagtgcgtag

SEQ ID NO: 27124 - DNA, 1011 bp, Artificial Sequence
  Description of Artificial Sequence: Synthetic coding sequence
atgtccgatgcactggccaacgcagtgtgtcagaggtgccaggcccgattttcccccgccgagcgtatcgtcaacagcaatggggaactttaccacgaacattgtttcgtctgcgcccagtgtttcagaccattccctgagggactgttttatgagttcgaaggcagaaagtactgtgagcatgattttcagatgttattcgctccatgctgtggttcgtgtggagagttcatcataggcagagtgatcaaagccatgaacaacaactggcaccccggatgtttccgttgtgagctctgcgacgtagaacttgcagatctcggctttgtgaaaaacgccggccgacacctatgtaggccatgtcacaatcgtgagaaggcaaaaggcctgggcaaatatatctgccagcgctgccacctggtgatagacgagcagcccttaatgttccgtagcgacgcctaccatcccgaccacttcaactgcacccactgtggaaaggaactgaccgcagaggccagggagctcaaaggcgagttgtactgtctgccatgccatgataagatgggggtaccaatatgcggagcatgcaggcgaccaatcgaggggagagtcgttaacgcccttgggaagcagtggcacgtagagcacttcgtgtgtgcgaaatgcgaaaagcctttcctgggccatcgacattatgagaagaaaggtttagcttattgcgaaacacattacaatcagctgttcggagacgtatgttacaactgtagccatgttatcgaaggagacgttgtgtccgcattgaataaagcctggtgcgttagttgcttctcttgctcaacttgcaacagcaagttaactctaaagaacaagttcgtggagtttgatatgaagcccgtatgtaaacgatgttacgagaagtttccccttgagctcaaaaagcggctgaagaagctgtccgaactcactagtcgaaaggcccaacccaaagcaacagacttaaacagtgcctag

SEQ ID NO: 27125 - DNA, 1011 bp, Artificial Sequence
  Description of Artificial Sequence: Synthetic coding sequence
atgagtgacgcgctcgctaatgccgtttgtcaaagatgtcaggctcgtttctctcctgccgagaggatcgtcaatagcaatggggaattatatcacgagcattgtttcgtgtgtgctcaatgtttccgtccctttcccgaagggctgttttacgaatttgagggccggaagtattgcgagcatgattttcagatgctcttcgccccctgctgcggctcctgtggtgaatttatcatcggcagagttatcaaggccatgaacaataattggcatcctggctgcttcaggtgcgaactgtgtgacgtggaactggccgacctaggattcgtcaaaaacgccggccgccacctttgcagaccatgtcacaatcgagaaaaagccaagggcctggggaaatacatctgccagaggtgtcatctagtaattgatgagcagcctctcatgttccgatcagatgcttaccatccagaccactttaattgcactcattgcggaaaagagttgacagcggaagccagagaactgaaaggtgaattatattgtctgccctgccacgataaaatgggagttccaatttgcggggcctgtcgcagaccaattgaagggcgtgtggttaatgccctcggcaaacagtggcatgtggagcatttcgtgtgtgctaagtgtgagaagcccttcctcggccataggcactacgagaaaaagggccttgcttactgcgaaacccattacaaccagcttttcggcgacgtgtgttataattgtagccacgtcattgaaggcgacgtggtgtcagcgcttaataaggcttggtgcgtctcttgtttctcatgttcaacatgtaactcgaagttgaccctgaagaataaattcgtcgagtttgatatgaagcccgtgtgcaaaagatgctatgagaagttcccattggagcttaagaaacgcctgaagaaactctcggaactgaccagtcgcaaagcacaacccaaagccaccgacttgaatagcgcgtag

SEQ ID NO: 27126 - DNA, 570 bp, Artificial Sequence
  Description of Artificial Sequence: Synthetic coding sequence
atgtttaggtcggatgcgtaccacccagaccattttaattgtacacattgtggtaaggagctcactgctgaggctagggaactgaaaggtgaactgtactgtctgccgtgtcacgataagatgggtgtgcccatctgtggggcttgtaggaggcctatcgagggccgcgtcgttaacgccctgggaaagcagtggcatgtggagcattttgtttgcgctaagtgcgaaaagccgttcctgggacatcgccactatgagaagaaagggctcgcttactgcgagacacactacaatcagctctttggcgatgtatgctataactgctcacatgtcatcgagggcgatgtggtgtcagctttgaataaggcctggtgtgtgtcatgtttttcttgtagtacgtgcaatagcaaactaacgctgaagaataagtttgtcgagtttgacatgaaaccagtatgtaaacggtgctacgagaaattcccactggaactgaagaaacgtctgaagaagttatcagagttgacgtcacggaaggcccagcctaaggctactgatcttaactctgcctag

SEQ ID NO: 27127 - DNA, 1011 bp, Artificial Sequence
  Description of Artificial Sequence: Synthetic coding sequence
atgagtgacgcactagcgaatgccgtttgtcagagatgccaggccagattttcccccgccgaacggatcgtcaattccaatggagaactgtatcacgaacactgctttgtttgcgcccaatgctttcggcccttccccgaagggcttttctacgaattcgaaggacgtaaatactgtgaacacgattttcaaatgttatttgctccgtgctgcgggtcttgtggcgagtttatcattggacgagtcataaaagcgatgaataataactggcatccaggctgttttcgctgcgaactgtgtgacgtagaactagctgatctgggattcgtgaagaatgcgggtaggcacctgtgccgaccctgtcacaacagggagaaggcaaaaggtctgggaaagtatatatgtcagcgatgtcacctggtcatcgacgagcagcccttaatgtttaggtcagatgcttatcaccctgatcacttcaactgcactcactgtggcaaagagcttaccgctgaagcacgggaactgaagggcgagctatattgcttaccctgccacgataagatgggcgtacccatctgtggggcctgccgacggccgattgagggccgcgtggtaaacgccctgggtaaacagtggcatgtagagcactttgtgtgcgcaaagtgtgagaagccgtttctggggcaccgccactatgagaagaaggggctggcctattgtgagactcattacaaccagctatttggggacgtctgctataactgctcccacgtcattgagggggacgtggtgagtgcactcaacaaggcatggtgtgtgtcctgcttctcctgctctacatgtaattccaagctcaccctcaaaaacaaatttgtagagttcgacatgaaacccgtttgtaagcgctgctacgagaaatttccactggagttaaagaaaagattgaaaaagctgagtgagctgacatcgaggaaagcccagccaaaggcaactgatctcaactctgcctag

SEQ ID NO: 27128 - DNA, 441 bp, Artificial Sequence
  Description of Artificial Sequence: Synthetic coding sequence
atgagcgatgccttggctaatgctgtttgtcagaggtgccaggctagattttccccagctgaaaggattgtaaattcgaatggagagctgtatcacgagcactgcttcgtttgtgctcagtgttttcgtcctttccctgaagggctgttctacgagtttgaaggtaggaagtattgcgagcatgacttccagatgctatttgctccttgttgtggttcctgtggtgaatttatcatcggtcgggtgatcaaggctatgaacaataattggcatccaggatgttttcgatgtgaactgtgcgatgtagaactggctgaccttggattcgtcaagaacgcaggcaggcatctttgcagaccttgtcacaacagggagaaggccaaggggttaggtaagtatatctgccagagatgtcatctggtgattgatgagcagccctag

SEQ ID NO: 27129 - DNA, 570 bp, Artificial Sequence
  Description of Artificial Sequence: Synthetic coding sequence
atgttcagaagtgatgcataccatccggaccacttcaactgcactcattgtggtaaggaactgaccgccgaagccagggagctcaaaggggagttgtattgcctcccttgtcacgacaagatgggggtgcccatctgcggggcctgtaggaggcctatagagggccgggtggtcaatgccctgggaaagcaatggcacgtcgaacattttgtttgtgcgaaatgcgaaaagcccttcctcggccatcgccactatgagaagaaaggcctcgcttattgcgaaacccattataaccagttattcggcgacgtgtgctacaactgtagtcacgttatcgaaggggatgtggtgtctgcactgaacaaagcctggtgtgtctcctgcttcagctgctcaacgtgcaattctaaactaaccctgaagaacaagttcgtggagtttgacatgaagccggtgtgcaagagatgttacgagaaatttcctcttgaacttaaaaaaaggctgaaaaagttgagcgagctcactagccgcaaggcacagccgaaggcaacagatctgaattctgcttag

SEQ ID NO: 27130 - DNA, 1092 bp, Artificial Sequence
  Description of Artificial Sequence: Synthetic coding sequence
atgaccggcagaaagcgaaagtggggagagactgggaccgggagtggtgctgctcctgccgccgccctacggtggtccaacatgagtgacgctcttgccaatgccgtttgtcagcggtgccaggctaggttctccccagccgagaggatcgtgaatagcaatggcgagctctaccacgagcattgttttgtgtgtgcgcagtgcttcaggccattccccgaaggactcttctacgaatttgaaggtagaaagtactgcgaacatgatttccagatgttattcgcaccatgttgcggctcctgcggtgagtttatcattggcagggttatcaaagctatgaataataactggcatcccggatgtttccggtgtgaactctgtgacgtggaactggcagatctgggtttcgtgaaaaacgccgggcgacacctctgcagaccttgccacaatagagagaaggccaaaggcctcggaaaatatatatgccagaggtgtcaccttgtgattgacgaacagcctttgatgttccgaagcgacgcataccatcccgaccatttcaactgtactcactgcggtaaggaactgacagccgaggccagggaactgaaaggtgagctttattgcctgccatgccatgacaagatgggggttccgatttgtggcgcgtgccggcgtcccattgaggggagggtcgtaaacgctctcgggaagcagtggcatgtggaacactttgtgtgtgcaaagtgcgaaaaaccatttctagggcaccggcactatgaaaagaagggactggcttattgcgaaacacactacaaccagctatttggcgacgtttgttacaattgctcccacgtaatagagggggacgttgtctcagccctaaacaaagcatggtgcgtgtcctgctttagctgtagcacatgtaacagtaagctgactctgaaaaacaaatttgtggaatttgacatgaaaccagtatgcaaacggtgttatgagaaattcccccttgagttaaaaaagcggctgaagaagttgtctgaactcacaagtcggaaagcacagcctaaagctaccgatctgaactcagcttag

SEQ ID NO: 27131 - DNA, 1092 bp, Artificial Sequence
  Description of Artificial Sequence: Synthetic coding sequence
atgacaggaaggaaacgcaaatggggcgagaccggaaccggcagcggcgcggccccggctgccgctttacggtggtccaacatgtcagatgcccttgctaacgcagtgtgccagcggtgccaggctcggttcagcccagctgaacgaattgttaattccaatggcgagctgtaccatgagcattgtttcgtgtgtgcccaatgcttccgccctttccctgagggccttttctacgagtttgagggacgtaagtattgtgagcatgattttcaaatgctgttcgccccatgttgcggtagttgtggtgagttcataataggaagagtgattaaggctatgaacaataattggcaccctggctgctttcgctgtgagctttgtgatgtggagctggctgaccttgggtttgtgaagaacgcaggccgacatctgtgtagaccttgccacaatcgagagaaagccaagggactcggtaagtacatatgtcagcggtgtcatctcgtgattgacgaacagccattgatgttccgctccgatgcttaccaccccgaccactttaattgcacacattgtgggaaagaattgacggctgaggctcgagaattgaagggcgagctttattgcctgccttgtcatgacaagatgggagtccccatctgcggggcttgtaggcggccaatagaggggcgtgtggttaacgctctcggtaagcagtggcatgtcgagcactttgtttgcgccaaatgcgaaaaacctttcctaggccacagacattacgagaagaagggtcttgcatactgtgaaactcactataaccaattgttcggtgatgtgtgctataattgtagccatgttatcgagggggatgtggtgagcgccctgaataaggcctggtgcgtttcatgcttcagctgcagtacatgcaatagcaagctgactcttaagaacaagtttgtggaatttgacatgaaaccagtgtgtaagcgatgctacgagaagttcccactggagctgaaaaaacggttaaagaaactgtccgagctgacaagtaggaaggcccagccaaaagccaccgacctcaacagcgcctag

SEQ ID NO: 27132 - DNA, 702 bp, Artificial Sequence
  Description of Artificial Sequence: Synthetic coding sequence
atgctcaaaccaagcgtcacttccgcgcccacagctgacatggccacactcacagtcgtacagcccctcacacttgaccgggacgtggccagagccatcgagctcttggaaaagctccaggagtccggagaggtgcctgttcacaaactgcagtccctgaaaaaggtgttacagtctgaattttgtaccgcaatccgtgaagtgtatcaatatatgcatgagaccattacagtgaatggttgcccagaatttcgggctcgggcaactgccaaggccactgtagctgcatttgcagccagtgaggggcactcgcacccacgagtggtggagctgcctaagacagatgaggggctcggtttcaatgtgatgggcggtaaggaacaaaattctcctatatatatatctaggattatcccggggggcgtggccgagaggcatggcggtctgaagcggggtgaccagcttctgtccgtgaacggagtcagcgtggagggcgagcaccacgagaaggccgtggaattgctcaaggccgcgaaagatagcgtgaaactggtggtccggtacaccccaaaggtcctggaggaaatggaggctagatttgaaaaattgagaacagccagaagacgccagcagcaacagttgctgattcaacagcagcagcagcagcagcaacagcagactcagcaaaaccatatgtcctag

SEQ ID NO: 27133 - DNA, 858 bp, Artificial Sequence
  Description of Artificial Sequence: Synthetic coding sequence
atgaaggtgaccgtgggccctgatccgtcactcgtttacaggcccgatgtcgatcctgaggtggctaaggacaaggcatcctttcggaattacacaagcggtccactgcttgatcgggtgttcacaacttataagctgatgcatacacaccagacagtagactttgtgagatcgaaacacgcccagtttggtggtttttcatataagaagatgacggtaatggaagccgtagatctccttgatggtctggtcgacgagagcgatccagatgtggattttcctaattcgtttcacgctttccagaccgctgagggcattaggaaagctcatccagacaaagactggttccacctagtgggattgcttcatgacctcggaaaggtcctggccttatttggcgaaccgcagtgggccgtcgtgggtgatacctttccggtgggctgccggcctcaggccagcgtcgtattctgtgattcgacatttcaggacaaccctgatctccaggaccctcgctacagtaccgaattggggatgtatcagccacactgcgggctggaccgggtgttgatgtcatgggggcatgatgaatatatgtatcaggtgatgaagttcaataaattttccttaccccctgaggccttttatatgatcagattccattccttctatccctggcatacaggcagagactatcagcagttatgctcccaacaggacttagccatgctgccctgggtccgcgagtttaataagttcgatttatacactaagtgccctgatcttccagacgttgacaagctgaggccctactaccaggggttaattgacaagtactgccctggcatcctaagttggtag

SEQ ID NO: 27134 - DNA, 1785 bp, Artificial Sequence
  Description of Artificial Sequence: Synthetic coding sequence
atggcaggtagtagattaccgaggcagctcttcctgcagggcgtcgccgccgtgtttatgttcgcctttgccagcctgtacacacagatcccgggcctgtatgggccagaggggatcctgcccgcacggcgcaccctcagaccacaaggaaagggtcgctggcagcagctgtgggagacacccaccctgttgtgggaagctcccagactcgggttggataccgcccagggcctggaacttttgagtctactgggagctctggttgctctgggtgcgttgctgctgtctccactgcgccatcccgtcatatatctgcttctgtgggctgcttacctgagcgcctgtcaggtgggccaagtgttcctctattttcaatgggactctcttcttctagagactggctttctggccgttctagtagccccactgcggcccgccagtcatcggaaggaagcccctcagggaaggcaggcgggagcactgcctcatgaggacctgccgttttggttggttaggtggttgctgtttcgactcatgtttgcctcaggagttgttaagctgaccagccgatgtcccgcttggtggggcctgacagccttgacatatcattatgagactcagtgcctgcccacccccgctgcctggtttgcccaccacctgccagtctggttgcataagctgtcagtcgtcgccaccttcctcatcgaaattgccgttcctcccctgtttttcgctcccatcaggagattacggctggccgccttttatagtcaagttctgctacaggtgcttatcataataaccgggaactataatttcttcaatcttatgactctggttttaacgaccgcactgctggatgaccaacacctggctgcggaacctggacacggaagccggaaaaagactgctacatcttggcctaaagccctgctcgctactctttctctgctcctcgagttagcagtctacggcctccttgcatacggaaccgtccattactttggtctggaggtggattggcaacagcgaacaatacattctagaactaccttcacctttcatcagttctctcagtggctgaagactttaactttaccaacagtgtggctgggagtggctagtcttgtgtgggaactgcttagcgctctgtggaggtggacacaagtaagagattggcagatgtggttcgctgcactgggcccccacacccacagtccgtggttcacttctctggtgctccgccttctccaaggcaaagaaccagtgattcggctcgttcagagccaggttgcccgataccctttccacaagcaacccccgacatacgttcgggcccaacgctacaaatattggttctcacagcctggggaacagggacagtggtggaggcggcagtgggtcgaagagttctttcccagtgtgtctctgggggatccaactctcgaaactctgctgagacagtttgggctgcaagaaaagtcaccccctcggacaagatctgctaattctacgttggcacaggctctgcattggaccaggtctcagctgtcccctctcgaagcgccggcacttttatggggccttttaatggccgtgggagcagtaagattcgttcaggctctgttggcaccttgctccctgcgatcgagcccactcgcccctgtgtccggtgagaagcggcggcccgcctcccagaaggattcaggggccgcctcagagcaggccacagccgctcccaacccgtgcagcagttctagtcgtacgacccgaagaaaaaagtag

SEQ ID NO: 27135 - DNA, 2124 bp, Artificial Sequence
  Description of Artificial Sequence: Synthetic coding sequence
atggctggctctagattaccacgacagctgttcctgcagggagtcgcagccgtgtttatgtttgccttcgcttccttgtacactcagatccccggcctgtacgggcctgaaggaatccttccagcccggaggacactgcggccgcaggggaagggcaggtggcaacaactttgggaaacccctaccctcctgtgggaagctccacggctggggctggatacagcccaaggcttagagctcctcagccttttgggcgccttagtcgcactgggggccctgctactgagtccgctgcgtcaccctgtgatatatctcctgttgtgggccgcatatctgagcgcctgccaagtagggcaggtatttctttactttcagtgggactctctcttactggagactgggtttctggccgtcctcgttgctcccctcaggcctgcctcgcacaggaaggaggctccccaaggccgtcaggcaggggccctcccccacgaggatctgcccttctggctggtgcgctggctgctctttcggctgatgttcgcctcaggcgtggtgaaactcacaagtaggtgccctgcctggtggggccttacggccctgacataccactacgagacacaatgtctgccaaccccagccgcttggttcgcccatcacctgccggtgtggttgcacaagcttagcgtagtagcaactttcctgattgagatcgcagtgccacctctgtttttcgcccccatacggcggctgaggttagccgcattctatagccaagtccttctgcaggtgctgatcattatcactgggaattacaatttctttaatctgatgacgttagtgctgaccactgcactgctcgacgaccagcacctcgccgctgaacctggccatggctccagaaaaaagacagctacctcttggcccaaggctctgctggctactttgtcacttctgctggagctagctgtctacggcctcttggcctacggcaccgtgcattactttggcctggaggtggactggcagcaaagaactatccactccaggacaacattcacgttccatcagtttagtcagtggctgaaaactttgacattgcccaccgtctggctgggagtggccagcttagtatgggagctgttaagcgccctctggcggtggactcaggtgagggggtggctgcggaaattgagtgctgtggtacagctgtctctcgtagggaccgcgaccgtggcactttttctgattagcctggtgccttactcatacgtggagccaggcacgcacggcagactgtggacgggggctcataggttgttcggcgccgtcgaacatctgcaactggctaactcctacggactattcagaaggatgaccggactcggcggccgtcctgaagtcgtgctggaaggtagttacgatggacatcattggaccgagatcgagtttatgtacaagcctggcaacctcagtcggccacctccagtggttgttcctcaccagcctaggctggactggcagatgtggttcgccgccttaggacctcacacccattccccctggtttacctcattagtgctgaggctactgcaggggaaggagcccgtgatccgtctagttcagtcacaggtggctcggtaccccttccataaacaaccacccacttatgtgagggcacagagatataagtattggtttagccagcccggcgagcaaggtcagtggtggcggaggcaatgggtcgaggaattttttccaagcgtgagcctgggcgatcccaccctggagaccctcctgcgacagttcgggttgcaggaaaaatcacctcctcgcactaggagcgctaattctacgttggcccaggcattgcactggactcgttcccagctgtcacctttggaggccccggccttgctgtggggactattaatggctgtcggtgccgtgcggtttgttcaggctttgctggctccttgtagtcttcgctcatctcctcttgcccccgtatccggcgaaaagagacgaccagcgagccaaaaagacagtggcgcggcctccgaacaggcaaccgcagccccaaacccctgctcatctagctctcggaccactcgaaggaagaagtag

SEQ ID NO: 27136 - DNA, 978 bp, Artificial Sequence
  Description of Artificial Sequence: Synthetic coding sequence
atggccgtcggaaacaatacacagcggtcgtatagtattataccttgctttattttcgttgaattggtaattatggctggcactgtcttgcttgcatattattttgaatgtactgatacattccaagtgcatatacagggcttcttctgccaagacggggatttaatgaagccctatcctgggaccgaggaagaaagttttattacaccactcgtgctgtattgcgtcttagccgcaacccctacagcaattatctttatcggcgaaatttcaatgtacttcatcaaaagcacgcgcgagtcactaattgcccaggagaagacgattctcaccggagagtgttgctatttaaaccctctcctacggagaattataagattcactggcgtgtttgcttttggactgtttgccacagatatttttgtcaacgctgggcaggtcgtcaccgggcacctcactccctactttttgaccgtgtgcaagccaaactacacttcagccgactgccaagcacatcatcagttcattaacaacggaaacatttgtacaggtgatctcgaggtgatcgaaaaagcgaggcgttcctttcccagcaagcatgcagccctttccatctatagcgcgctgtacgcgactatgtatatcaccagtaccattaagactaagagtagtcggctggctaaaccagtcctgtgcctgggcacactatgcacagctttcctgactggcctgaacagggttagtgaatacagaaaccattgtagtgacgtcattgcgggctttattctcgggaccgccgtagctttattcctggggatgtgcgtggtgcataacttcaaggggactcaaggaagtcccagcaagcctaaacctgaggacccacggggagtcccgctaatggcattcccacgtattgaaagcccactcgaaactctgagcgcccagaatcacagcgcctccatgactgaagttacctag

SEQ ID NO: 27137 - DNA, 978 bp, Artificial Sequence
  Description of Artificial Sequence: Synthetic coding sequence
atggccgtggggaataatacccagagaagctattccattattccctgctttatcttcgtggagttggtgattatggctgggaccgtgttgctggcttattacttcgagtgcacagacactttccaagtgcacatacaaggtttcttctgccaagacggagatctgatgaaaccatatccagggacagaagaggaaagcttcatcacaccccttgtgctctactgcgtcctggcggctactcctaccgccattattttcattggagaaatctcaatgtatttcattaagtcaacgcgagagtcgctgatagcccaggagaagaccattctgacaggagagtgctgctatttgaaccccctgctgcgaaggatcatccgctttactggagtgttcgccttcgggctatttgcaacagatatcttcgtcaacgccgggcaggtggtaacagggcatctcacaccctacttcctgaccgtgtgtaaacctaactatacaagcgctgactgtcaagctcaccaccagttcatcaataatggcaacatatgcacaggtgatctggaagtgatcgagaaagcccggcgctccttcccctccaagcacgccgccctgagcatatacagtgccctgtatgccaccatgtacattaccagcacaatcaagacgaaatcttctcggctggccaagcccgtgctgtgcctcggcacactttgtaccgcctttctaaccggcttaaacagagtgagcgaataccgaaaccactgcagcgatgtgatcgctggcttcattctgggcactgccgtggccttgtttctcgggatgtgcgttgttcacaattttaagggtacccaggggtccccgtctaagccaaagcctgaagatcctcgcggcgttccactcatggctttccctcgaatcgaatcacctcttgagaccctgagcgcccagaaccactctgcgtcaatgaccgaagtgacgtag

SEQ ID NO: 27138 - DNA, 978 bp, Artificial Sequence
  Description of Artificial Sequence: Synthetic coding sequence
atggctgttgggaacaacacacaaagatcctactcaatcatcccttgcttcatctttgtcgaattggtcatcatggccgggactgtgctgttggcctactatttcgagtgcactgacacttttcaggttcacatacaggggttcttctgtcaggacggtgatctgatgaagccctatccgggaaccgaagaggaaagcttcattactccgctcgtgctttactgcgtcctggctgctacccccaccgccatcatcttcatcggggagatctcgatgtatttcatcaaaagtacccgtgaaagcctcattgcacaggaaaagacaatcctgaccggggaatgctgctatttaaatcccctgctaagacgcattatccgtttcacaggagtgtttgcctttggtctgtttgctactgatatctttgtgaatgctggacaggtcgtgactggtcatctgaccccatatttcctgacagtatgtaagccaaactacaccagtgctgactgccaagcccaccaccagtttatcaacaacgggaacatatgcaccggggacctggaagttattgaaaaggcgcgcagaagctttcccagcaaacacgccgctctttccatttactccgcactgtatgccacaatgtacattaccagtacaatcaagacaaaaagttcaagattagctaagcccgtcctgtgtttgggcactctatgtacggcttttctaaccggcctaaacagggtcagcgaatatcggaatcactgttccgacgtaattgctgggtttatcctgggcactgccgtagctctgtttcttggcatgtgtgtggtacacaactttaagggcacccagggatctccatcaaaacccaagcccgaggatcctcgaggagtgcccttgatggcattcccgaggattgaatctccactggagacactctccgcccagaatcactctgccagcatgacagaagtgacttag

SEQ ID NO: 27139 - DNA, 312 bp, Artificial Sequence
  Description of Artificial Sequence: Synthetic coding sequence
atggcagtgggaaataacacacagcggtcttactcaatcataccgtgtttcatctttgtggagctggtaattatggcagggacagtcttgttggcttactatttcgaatgtaccgacacctttcaggtccatatacaagggtttttctgccaagatggggatctgatgaaaccctaccctggcaccgaggaagaatctttcatcacaccactggtgctttactgcgtgttggcagcaacgccgaccgctattatctttatcggtgaaatctccatgtactttattaagtccactagagaaagtctgatttag

SEQ ID NO: 27140 - DNA, 1032 bp, Artificial Sequence
  Description of Artificial Sequence: Synthetic coding sequence
atggcaggtggccgaccacacctcaaacgatcattctccatcatcccttgcttcgtatttgtagagtcggttctattaggcattgtaattctgctcgcttacaggcttgagtttacggataccttcccagtgcacacccagggttttttctgctatgacagcacatatgctaagccatatcccgggcctgaagccgcctctagagtgcccccagcccttgtgtatgcgctagttaccgctggtccaactttgaccatattgctgggggagttggccagggcttttttccctgcaccgccaagcgccgtgcctgtcataggcgagtcgactatcgtgtctggagcgtgttgccggttttcaccccctgtccggcggctggtaaggttcctaggagtctactcatttgggctgtttacaactacaatctttgcgaacgccggtcaagttgtgaccggcaatcccaccccccacttcctttcggtatgccgcccaaactatactgcactgggttgcctgcctccaagtcccgatcggccagggcctgatcgatttgttacggaccagggggcatgtgctggcagccctagcctggttgccgccgcacgtcgggcatttccgtgcaaagacgcggccctgtgtgcttacgctgtcacatacaccgctatgtacgtgacactggtgtttagagttaaggggtcgagactcgtaaaaccttccctgtgcctagcacttctctgtccagcatttctggtgggcgttgtgcgcgtcgccgagtacagaaatcattggagcgacgtgttagcaggctttctcaccggcgcagctatagcaactttcctggtgacttgtgtcgtgcacaactttcaatctagacctccatccggtcggcgcttatccccctgggaggacctcggacaggcccccacaatggacagccctctggaaaagaacccccgcagcgcaggtcgtatcaggcatagacatggatctcctcatccttctaggaggactgccccagccgtagctacttag

SEQ ID NO: 27141 - DNA, 1284 bp, Artificial Sequence
  Description of Artificial Sequence: Synthetic coding sequence
atggccggcggtaggccgcatctgaaaagatcattcagtataattccatgttttgtcttcgtggaaggcttcttctgctatgatagcacctatgctaagccctatcctgggcctgaggccgcgtctcgggtgccccccgcgctggtatacgctttggttacagccggtccaaccctcactatcctcctgggcgaactagcaagagcattcttccccgcgcctccaagtgcggtgccggttatcggggagtctacaatcgtgtcaggcgcgtgctgtagattcagcccacctgttcggcgcttggtccggtttctgggggtatatagttttggccttttcaccacaaccatctttgcaaatgccgggcaagttgtaaccggaaaccctaccccccattttctcagcgtctgtcgccctaactacaccgccctgggctgtctgccgccaagccctgaccggcctgggccggaccgctttgttaccgatcaaggagcctgcgctggaagtccttccttggtggccgcagcacgccgagcatttccatgcaaagacgcagccctttgtgcctacgcagtgacctacacagcaatgtacgttacgctggtttttcgggttaaggggtccaggttagtgaaacctagcctgtgtttggcattgctgtgtcccgctttcctggtcggtgtcgttcgtgtggctgagtatcgcaatcattggagtgacgtgttggccgggtttctgacaggagctgctattgcaactttcctggtgacctgtgtggtgcacaacttccagtctcggccaccttccggccgtcgtctctcaccatgggaagatctggggcaggcccctacgatggattctcctctcgagaaactctccgtggcccaggagccagaggtgtgccgtccacactccacccccgcacgtcttactccctcaaaatctcagaactgcgccaggcggggacacctaataccttcgtgcgtgtcctccagagctccagcaatgtgtagctcacctagagtgcctagacctcgcttgcgtagcgaacccactcctttacctctccccctgccactgccagcaccaacaccctcccaggggccttctccctcatcgcctggccccggcggtccgggcggaggcggcgggcgaggacgaaagcttctcctgcctactcctctgcttcgagacttgtataccctgtccggactctacccaagcccgtttcaccgggataatttttccccttatctcttcgcatccagggatcatctgctgtag

SEQ ID NO: 27142 - DNA, 2160 bp, Artificial Sequence
  Description of Artificial Sequence: Synthetic coding sequence
atgattagcacgaaagagaaaaacaagatcccaaaagactctatgacattgctcccctgtttttatttcgtggagttgcccattgttgcctcctccatcgtgagtctgtactttctggagctaactgacctgttcaagccagctaaggtagggttccagtgctacgatcgcacattgtcaatgccttatgtggaaactaatgaagagctgattcccctcctcatgctgctctcgctggcctttgctgccccagccgcttctatcatggttgccgaggggatgctgtattgtcttcagtccaggctatggggaagagctgggggtcccgcaggcgccgaaggctcaattaacgccggaggttgcaattttaatagcttcctccgcaggacggtccggtttgtcgccggcgttcacgtattcggcctgtgtgcaaccgctctggtgacagacgtgatccagctcgcaactggatatcataccccatttttcctgacagtgtgcaagcccaactacacgctcctgggtacctcctgtgaagtcaacccgtacataacacaagacatctgctccggccacgacatacatgctattttaagcgcaagaaagacattccctagtcagcatgccaccctgtctgcattcgctgccgtttacgtgtccatgtactttaacagtgttattagtgatacaaccaagctcctgaaaccaattctcgtgttcgctttcgctatcgcagccggggtctgcgggcttacccagatcacgcagtatcgaagccatcctgtggacgtctacgcgggtttccttatcggggcggggatcgcagcatatctagcctgtcatgctgttgggaatttccaggcccctcctgctgagaaaccagccgctccagcacccgctaaagatgccctacgcgcattaactcagagggggcatgacagcgtctaccagcagaataagagcgtctctaccgacgaattgggcccaccaggcagactggaaggggctcccaggccagtggcgagagagaagacaagcttaggctccctaaagcgcgcatcagtagacgtcgacctcctggccccccggtctccgatggctaaggagaacatggtgacattcagtcacacgctaccacgtgcctccgcacctagcctcgacgaccctgcaagaaggcacatgaccatacacgtaccacttgatgcttcacggagtaagcagttaatcagcgagtggaaacaaaaatcactggaagggaggggactgggactgccggacgacgcctctcccgggcacctacgcgcacccgccgagccaatggcagaagaggaggaggaagaggaggatgaagaggaggaggaagaggaggaagaggaggaagatgagggaccagctccaccgtctctatatcccactgtgcaggcccgaccaggtttgggcccacgcgttatcttaccccctcgagccgggcctcccccgctggtgcacatcccagaggagggcgcacagactggtgccggtttgtcgcctaagtctggcgccggggtgagagccaagtggctgatgatggccgaaaagtccggcgctgcagtcgctaatcctcctaggctgctccaagtgatcgccatgtctaaggcccccggggcccccggcccaaaggctgctgaaactgctagttcttcttccgcctccagcgacagctcgcagtatcgctcgcctagcgatagagacagcgcctccatcgtgactatcgatgctcacgctccccatcacccagtcgtgcacttgagcgcgggaggagcaccttgggagtggaaggccgccggaggaggagctaaagcagaggccgatgggggatacgaactgggggatttggctcgcggattccgcggtggggccaaacctcctggagtgtcaccagggtccagtgtcagcgatgtggatcaggaggagcccagattcggagcagtggctaccgtgaatctcgccacaggtgaaggcttaccacctctgggagccgccgacggtgccttaggacccggctcccgggagtctacccttcggagacacgcaggcggtcttggcctggcagagagagaggctgaagctgaggccgaaggctactttcgcaagatgcaagccagacgctttcccgattag

SEQ ID NO: 27143 - DNA, 2241 bp, Artificial Sequence
  Description of Artificial Sequence: Synthetic coding sequence
atgatttccacaaaagaaaagaacaagattccaaaggattccatgaccctgttgccatgcttctattttgtggagctgcccatcgtggcgagctcaatcgtgtccctgtacttcctggagcttactgacctgtttaagcccgccaaagtcggatttcagtgttatgaccgaacactgagtatgccctacgtggaaaccaacgaggaactgattcctctgctaatgttactgtctctcgcattcgcagccccagcagccagcatcatggtggcggaagggatgctgtattgcttgcaaagtcgcctctggggcagggcaggaggacccgccggtgctgagggctccataaatgccgggggatgcaactttaactcattcttgagaagaacagtgcgtttcgtaggcgtacatgtcttcgggctttgcgctaccgccttggtaacagatgtaattcagttggctaccgggtaccacaccccttttttcctgaccgtgtgcaaacctaactacacactactgggcaccagttgtgaggttaacccttatatcacgcaagacatctgtagcggccatgatattcacgcaattcttagcgccagaaagacattcccttcccaacatgctactttgtcagccttcgcagccgtctatgtgagcgtgagccctgcccctcattgcccttcacaagcccttctacttactaggggggaaccctccctgacccctacaccaatgccccagatgtatttcaattccgtgatttccgatactacgaagctgttgaagcccatcctcgtgtttgctttcgctatcgccgctggcgtgtgcggcctgacacagatcacacagtataggtctcacccagttgacgtgtatgccggttttttgattggggccggaattgccgcttatctggcgtgtcatgccgtcgggaatttccaggctcctcccgctgagaaaccagcagcaccggcgccagccaaggatgctctgagggcccttacgcagcggggtcatgattccgtgtaccagcagaataaatcggtgagcacggacgagttaggaccaccagggagactggaaggggccccaagacccgtggcacgcgaaaagacctccctaggtagcttaaaaagggcctctgtagacgtggacctcttggctcccagatccccgatggccaaggaaaacatggttacattttcccacactttgccaagagcatccgccccttcactggacgatcccgctagacggcacatgactatccatgtgcctctggatgcgagcaggtccaaacaacttatttcagaatggaagcaaaaatccctggagggaagaggcctcggcctgccagatgatgccagcccaggacacttgagggctccagctgagcccatggctgaagaggaggaggaggaagaagatgaggaagaggaggaggaagaagaagaggaggaggacgaggggcctgcccctcctagcctctacccaacagtccaagcccgaccaggattaggcccccgggtaattctcccgccgcgggctgggccacccccattagtccatatccccgaagagggcgcacagacaggggctggacttagcccgaagtccggtgccggggttcgggccaagtggctgatgatggccgagaaaagcggagccgcagtggccaatccgcctaggctgcttcaggtgatagccatgtcaaaagcacctggagctccgggaccaaaagccgctgagaccgcctccagcagcagcgcttcctctgactcctctcagtaccggtcaccctccgatagggacagcgcttctatcgttactatcgatgcacatgccccacatcatcctgtggtacacttatctgcgggtggggccccttgggagtggaaagccgcagggggtggcgcgaaggcagaggctgatggcggatacgagttgggcgatctagctaggggcttccgggggggcgccaagccaccaggagtgtcacctggatcttcggtaagcgatgtggatcaggaagaaccacgtttcggggcagtagctacggtcaatctcgcaactggcgaaggactaccgcctctgggagctgccgacggcgccttaggccctggctcaagggagtcaaccttaagaaggcacgccggcggactcggcctcgccgaaagagaggcagaggctgaggccgaagggtatttccggaagatgcaggctcgacgcttccccgattag

SEQ ID NO: 27144 - DNA, 2157 bp, Artificial Sequence
  Description of Artificial Sequence: Synthetic coding sequence
atgatcagcacaaaggaaaagaacaagattcctaaggatagcatgactttattgccttgcttttacttcgttgagctgcccattgtcgcttcgagcatcgtgtcactttacttcctggagttgaccgatctcttcaagccagccaaagtgggattccagtgttacgaccgtactctcagtatgccttacgttgagacaaatgaggagctcatacctctgttgatgctgttgagcctggctttcgccgcacccgccgctagtataatggtagcagaggggatgctgtactgcctgcagtctaggctttgggggcgggcgggcgggcctgccggtgccgagggtagtataaatgctgggggttgcaacttcaattcctttctgaggcggacggtgcggtttgtgggagtgcacgtttttggcctgtgcgctaccgctctagtgactgatgtgatccagttagcgactgggtatcacacccctttttttcttactgtctgcaagccaaactatacgttattgggaacgagctgcgaggtgaacccatatattacgcaggacatctgcagtggacacgacatacatgctatcctttccgccaggaagaccttcccttcgcagcacgccacactctccgctttcgcagctgtgtatgtttccatgtacttcaacagtgtaatcagtgacactacaaaattgctaaaacccattttggtttttgcctttgccattgcagctggagtatgcggactgacgcaaataacccagtacaggtcccatcccgtggacgtctacgcagggttcttgattggtgcagggatcgctgcatatttggcctgtcacgcagtgggtaacttccaggctccacctgcagagaaaccggcagcccctgcccccgcaaaggatgcgctgagagcactgacccagcgcgggcatgactctgtttatcagcagaacaaatcagtgagcacagacgagctggggccacccggccgactcgaaggggcccccaggccagtagcacgcgaaaaaactagtctgggctctctgaaaagagcctctgtggacgtggatctgcttgcccctcgaagcccgatggccaaagaaaacatggtaacattctcccacacactcccaagggcctctgccccgagcttagacgacccagcacgtcgccatatgactatccatgtaccactggacgcatcgagaagtaagcagctcatttcagaatggaagcagaaaagtttggaaggtcgaggcctcggtctgcccgacgacgcctcgccgggccacctgagagccccagcggaacccatggcggaagaggaggaagaggaggaggacgaggaggaggaggaggaagaagaagaggaagaggacgagggacccgcaccacctagtttataccccacggtgcaagccaggccgggcctgggccctcgggtgatactccctccgcgtgccggccccccgcctctggtgcacattcccgaagagggagcccagactggcgctggcctctctccaaagtccggagccggagtacgcgcgaaatggctcatgatggctgagaagagcggtgctgccgtggccaacccaccccgtctgctccaggtaatcgctatgtctaaggctcctggtgcccctggccccaaagccgctgaaaccgcctcttcctcctccgcatcctctgactcttctcagtaccggtccccttctgaccgggatagtgcctcgatcgtcacgatcgacgcacacgcaccacaccatcccgtcgtgcacttatccgccggtggggcgccgtgggaatggaaggctgcaggcggcggagccaaagcagaggctgacggtgggtatgaacttggagacttggcacgagggtttcggggcggcgccaaaccacccggtgtctcccccggttcctcagtttccgatgtagatcaggaggaaccgagatttggagctgtagcaacagtgaatctagccaccggtgaagggttgccgccgttgggagctgctgatggcgccttgggccccggtagtagggaaagtacactgagaaggcacgcagggggcctgggcttagctgaacgcgaggccgaggctgaagcggaggggtattttagaaagatgcaagctaggaggttcccagactag

SEQ ID NO: 27145 - DNA, 1734 bp, Artificial Sequence
  Description of Artificial Sequence: Synthetic coding sequence
atgcagcgggcaggatcctcaggaggacgaggcgagtgcgacatctcaggagccggaagacttggcctggaggaagcagctaggttaagctgcgccgttcacacaagtcccgggggaggcagacggccgggacaggccgcgggtatgtcagctaaagaacgtcccaagggcaaggtaatcaaagactccgtcacactgctcccatgcttctattttgtggagctgcccattctggcgtcaagtgtggtgagtctgtacttcttagaactcaccgatgtgttcaaacccgtgcattcaggcttcagttgttacgataggtccctgtctatgccttacatcgaacctactcaggaggccataccatttctaatgctactgagcctcgcattcgcaggacccgctatcactataatggtcggtgaggggatcctgtactgctgcctgtcgaaaaggcggaacggcgtgggcctcgaacctaacattaatgctggtgggtgcaattttaatagttttttacgaagagcagttcggtttgtcggcgtccacgtcttcggtctgtgctctacagctcttatcaccgacatcattcagctcagcactgggtatcaggccccctacttcctgacagtatgtaaaccaaattacacgtccctgaatgtttcctgtaaagagaactcttatatcgtagaggatatttgctccggttcagatttaaccgtcataaattcgggacgcaaatcgtttcctagccagcatgctactttggcagcttttgctgctgtttatgtgtcaatgtattttaattccaccctcacagattctagtaagttacttaagcccttgctggtttttacatttataatttgcggaattatctgcggtttgaccagaattactcagtacaagaaccatcccgtcgacgtctattgcggatttctcattggcggcggtatcgcactgtacctgggcttgtatgccgtgggtaatttcctcccttccgacgagagcatgttccaacaccgggacgcccttaggagcttgactgatctgaaccaggaccctaacagactgctctctgcgaaaaacggctctagcagcgatggaatcgctcacaccgaggggattctcaaccggaaccaccgcgatgcgagttcgttgaccaacctgaagagggcgaacgccgatgtggaaatcatcacccctcggagcccaatgggcaaagaaaatatggtgacgttcagcaacactttgccacgcgccaacacgcccagtgtcgaggatcccgtgcgtaggaacgctagtattcacgctagcatggacagtgccaggagcaagcaactcttgacgcaatggaaaaacaaaaacgaaagtagaaaattatccctccaagtgattgagccggaacctggtcaaagtccccctcggagcattgagatgcgatcaagttctgagccttcacgggtcggggtgaatggagaccatcatggtcccggaaatcagtatctgaagatccagccgggcgctgtacctgggtgtaacaactccatgcccggagggcccagagtatcaatccagtcacgccccggctcatctcagctggtacatattcccgaggagactcaggaaaacattagcacctccccgaaatcctcccgcgtgtcctccaaagccgccccacggaccctaaaggccgcccgctcgcctgctttagccccttcagcgataaagccatag

SEQ ID NO: 27146 - DNA, 1818 bp, Artificial Sequence
  Description of Artificial Sequence: Synthetic coding sequence
atgaatatgttcgatgctgacaccaccacgaacctagtgacaatctcttttatattacctattggcgttcacgtgtttggattatgttcaactgccctcataacagatatcattcaactgtcaacggggtatcaagccccatacttcttgacagtatgtaagccaaattacacgagcttgaacgtcagttgtaaggagaactcatatatcgttgaagacatttgttccggctctgatttaaccgtcattaactcggggagaaaaagcttcccttcccaacacgccaccctcgccgcttttgctgccgtgtacgtgagtatgtatttcaacagtaccctcaccgacagcagcaagctgctgaaaccactcctggtttttacatttattatctgcggcatcatttgtggactgacccgcatcacccaatataaaaaccacccagtcgatgtttactgtggctttctgatcggcggtgggattgctctgtacctggggctgtacgcagttggcaattttctgcccagcgacgagagcatgtttcagcaccgagacgcactgaggagtctgaccgatttgaaccaggaccctaaccgactgctatccgcaaagaatggctcaagtagcgacgggatcgcacacaccgagggtattttgaaccggaatcatagagatgcctcctcattgactaatctgaaacgcgccaacgctgatgtcgaaatcattacgccccgatcccctatgggcaaggagaacatggtaacttttagtaacaccctgcctagagctaacacccccagcgtcgaagacccagtcaggcggaacgcttccatccacgcttccatggactccgcgcggagcaagcaactcctcacccaatggaagaataagaacgaatctcgcaagctctctttgcaggtaattgagcccgaacccggtcagagccctccccgaagcatcgaaatgaggagtagcagcgagccatcgagagtcggagtgaatggcgaccaccacggaccggggaatcaatatctcaaaatccaacccggcgccgtccccgggtgcaacaactccatgccaggtgggccccgcgtgagcatccagtcccgacctggctcttcccaactcgtgcatattcccgaggaaacacaagaaaacatttccactagccctaagtcttcatctgcccgtgccaagtggttaaaggccgccgagaaaacagttgcatgcaacaggagcaactcccaaccaaggatcatgcaagtgatcgccatgagcaagcagcagggggtgctccagagctcaccaaagaataccgagggctctacagtatcgtgtactgggagtattcggtacaaaacgctcactgaccatgagcccagtggaatagtgcgtgtggaggcgcacccagaaaataaccgcccaattatccagataccatcaactgaaggggaagggtctggttcatggaaatggaaggctccagagaaggggtccctaaggcagacatacgaactaaatgatttgaacagagactccgaaagctgtgaatcactcaaggattcctttgggagcggcgatagaaagagatctaatatcgatagcaacgagcaccaccaccatggcatcacaacaattcgtgtgacacctgttgaaggtagcgagattggctccgagaccctctccatttcaagttctagagactccacccttcgccgaaagggaaacataatattgatcccagagcgatccaattctcccgaaaacacccggaatatcttctacaaaggtacttcacctactcgggcctacaaagactag

SEQ ID NO: 27147 - DNA, 2292 bp, Artificial Sequence
  Description of Artificial Sequence: Synthetic coding sequence
atgcagcgcgcaggcagcagtggaggcaggggcgagtgtgatatttcaggcgccggtcggctggggcttgaagaggctgctaggttatcatgtgctgttcacacctcacctggcggtggtaggcgccccggtcaggccgcagggatgtccgcgaaggagcggcccaaggggaaagtgattaaggactcagtgacactgctgccctgcttctattttgtggagctaccaatccttgctagctcagtggtttcgttgtacttccttgagctgactgatgtcttcaaaccagtgcactcagggttctcttgttacgacaggagcctgtcaatgccttacatcgagcctacccaagaagccattccatttctgatgctcttgtcactggcatttgccggcccggccattactataatggttggagagggaatcctatactgttgtctgagcaagagaaggaacggggtggggctggaaccaaatattaatgccgggggatgtaattttaactcttttttacggagggccgttagattcgttggagtgcatgttttcggcctctgctcaacagcattaatcaccgatataattcagctttccaccggctaccaggctccatactttttgactgtgtgcaaacccaattacacgtcactgaacgtcagctgcaaggaaaactcgtacattgtagaggacatctgctcaggtagtgacctcactgtgatcaacagcggcaggaaaagcttcccttcccaacacgcaacacttgcagcttttgctgcagtttatgtgtctatgtattttaactctacccttacagactccagtaagctgttgaagcctctcctcgtgttcacattcatcatttgtggtatcatctgtggactcacaagaataactcagtacaaaaaccaccctgtggacgtatactgcggtttcctgatagggggcggaatagccctctacctggggctgtacgcggtcggtaacttccttccctccgatgaatccatgtttcagcacagagacgcacttcgttccctcaccgacttgaatcaggaccctaatcgcctgcttagcgcgaaaaatgggtcatctagtgacggtatagcgcacacggaaggtatcctgaataggaatcatagagatgcgtctagtttaactaacctcaagcgggcaaacgctgatgtcgaaattatcactccgcgtagcccaatgggcaaagagaacatggtgactttctccaatacactcccacgtgctaacaccccaagtgtggaggacccagtgcgtaggaatgcaagtattcacgcatccatggactccgcgagatccaagcagctgttaacgcagtggaagaacaaaaatgagagcagaaaactgagcctacaggtcatcgagcccgagcctggtcagagccccccccgctcaattgaaatgcgttcgtcctccgagccatccagggtgggagtgaatggcgatcatcacggccccggtaaccagtatttgaaaattcagccaggggccgtacccggctgcaataatagtatgcctggaggcccccgggtatcaattcagtctcgccctgggagttcacagcttgtccatatacccgaagagacgcaggaaaatatctccaccagcccaaagtcctcctccgctagggccaaatggttgaaagctgctgaaaagaccgtcgcttgcaaccggtccaatagccagccacggatcatgcaggtgatcgcgatgagcaaacaacagggcgtgttgcagagcagtccaaagaacactgagggatctactgtcagctgtaccgggtcgatccggtacaagacccttactgaccacgaaccttctgggatcgtaagagtggaagcacaccccgaaaacaacagacccatcatccagatcccaagtacagagggtgaaggaagcggttcttggaaatggaaagcgccggaaaaaggtagcctgcggcagacttacgagttaaatgatctgaaccgcgacagcgaatcatgtgagtcattgaaagactcctttggaagcggggaccgcaaaaggtcaaacatcgacagtaatgaacatcatcaccacggcatcacaacgatccgggtgacacccgtcgaggggagcgagattgggtcagagaccctgtcaataagttcatctcgagacagtacacttcgacgaaaaggaaatattattctaatcccagagcgtagtaattcccctgaaaataccagaaatatattctataaaggtacctcccccactcgcgcctataaggattag

SEQ ID NO: 27148 - DNA, 2118 bp, Artificial Sequence
  Description of Artificial Sequence: Synthetic coding sequence
atgcaacgtgcaggctcatcaggaggtcggggcgagtgcgacatctcaggcgctggcagactcggcctggaagaggccgcccggctgagctgtgcggtgcatacctcccccggcggaggtagacggcctgggcaggccgctggaatgtccgcaaaggagaggcctaaaggcaaggtcataaaagattctgtgactctcttaccttgtttttattttgtcgaactacctatacttgcctctagtgtggtgagcttgtattttctggagctgacagacgtgttcaagcctgtgcattctggcttttcatgttatgaccggagtctgagtatgccatacatcgagcctacccaagaagctattcccttcctgatgctcctaagcctggcctttgcgggaccagcaattactattatggttggcgaaggtatcctctactgctgtctgtctaaaaggagaaatggcgtgggactcgagccaaatatcaatgctggaggctgtaactttaacagtttcctgaggcgggctgtgcgcttcgtgggagtgcatgtgtttggcctctgctcgacagctctcattacagatattatccagctcagtacaggttatcaggccccatactttcttaccgtgtgcaagcctaattacaccagtctgaatgtctcatgcaaagagaattcctacattgtggaggacatttgtagcggtagcgacctgacggttattaacagcggcagaaaaagttttccctctcagcacgccacactcgccgcctttgccgcagtgtatgtgtctggcctgtacgccgtagggaactttttgccgtccgacgaaagtatgtttcagcacagggatgccctgcggtccctgactgacctgaatcaggaccccaatcggctgctttctgccaagaacggctcgtccagcgatggtatcgcacacactgaaggaattctgaatagaaatcacagggatgcttcgtctttgactaatctgaagagggcaaacgcagatgttgagataattaccccgaggagtccgatgggcaaggagaacatggtgactttttccaacactcttcctagagctaacaccccttcggtggaggaccctgtgcggcgcaacgcatctatccacgctagcatggattctgccaggtccaaacaactgctcacgcagtggaaaaataagaacgagtcaagaaaacttagcctacaagtcatagagcccgaacccggccagtcacccccacgcagcattgagatgaggagtagcagcgagccctcgcgggtcggagtgaacggagatcaccacgggccaggaaaccaatacttgaagatccagccgggggccgttcctgggtgtaataatagtatgcctggcggaccacgagtatccattcagtcaaggccgggctcgtctcagctggtgcacatccccgaggagactcaggagaacattagtacaagcccaaagagtagttccgcgcgcgccaaatggctgaaagctgcggagaaaacagtggcatgcaacaggtcaaattcacagcctcggattatgcaggtgatcgccatgagtaagcagcagggggtgctgcagtctagcccgaagaatactgagggcagtactgtgagctgcactggatctatacggtataagaccctgacagaccatgagcctagcggaatcgtgcgagtggaagcccaccccgaaaataaccggccaattatccaaataccttcgaccgagggggagggcagtggcagttggaaatggaaggcgcctgagaaaggttcactgaggcagacatatgaactgaacgatttaaacagggactcggagagttgtgagtccctcaaggactccttcgggtccggggatcggaaaagaagcaatattgattccaacgaacatcatcatcacgggattaccactatcagggttacacctgtggagggctcagagataggctccgagaccctgagtatttcctcttcccgtgattcgacactcagaaggaaagggaatatcattcttattcccgagagaagtaactcgcccgagaacacccgcaatatattttacaaagggacttcacccacacgagcctacaaggactag

SEQ ID NO: 27149 - DNA, 966 bp, Artificial Sequence
  Description of Artificial Sequence: Synthetic coding sequence
atgcccctactgccagcagccctcacaagctcgatgctttatttccaaatggttatcatggccgggacggtcatgctggcctactacttcgaatataccgacactttcacagtcaacgtacagggtttcttctgtcatgactcggcatacaggaagccctaccctggtccagaggactcatccgctgtgccccctgtcctcttgtactcactggccgcaggggttcctgtgcttgtcattattgttggcgaaacggccgtgttctgtctgcaactggccacccgtgactttgaaaaccaggagaagacaatcctgaccggagattgctgctacatcaatcctcttgtacgacggactgttcgttttcttggcatctacacttttggcctattcgctaccgacatttttgtcaatgccggtcaggtggtcaccggaaaccttgccccacacttcctagctctgtgcaaaccaaactatacggccttgggctgtcagcagtacacccagttcatttcaggagaggaagcttgcacgggtaatcctgacctgatcatgagagcccggaaaacatttccaagcaaagaggccgccttaagcgtgtacgccgcgatgtatctcacaatgtacattaccaacaccataaaggcaaagggcacaaggctggccaagcctgtgttgtgtctgggactaatgtgcctcgcatttctcacagggctcaatagggtagccgaatatcggaaccactggtccgacgttatcgctggtttccttgtgggaatcagcattgcagtctttttggtggtttgcgtggtgaataatttcaaaggtaggcaagccgaaaacgagcatatccatatggacaacctggctcagatgcccatgatcagcatccctagagtcgagtcccccttagaaaaggtgacctcagtgcagaatcatatcacggccttcgcagaggtgacctag

SEQ ID NO: 27150 - DNA, 951 bp, Artificial Sequence
  Description of Artificial Sequence: Synthetic coding sequence
atgccactgctccccgccgcccttacctcatctatgctctacttccagatggtgataatggcagggactgtaatgctcgcctactatttcgagtacaccgacacgttcacggtcaacgtacagggcttcttttgccacgatagcgcctatcgaaagccttacccaggtcccgaggacagttccgcggtgcctcccgttctcctctactccctggctgccggagtgcccgttctggtgattatcgtaggcgagaccgctgtgttttgcctacagctggctacaagggactttgaaaatcaggaaaagaccatactgaccggagattgttgctacataaatccattagttcggaggacagtgagattcctaggaatttacacatttggcctgtttgcaaccgacatattcgtgaatgcagggcaggtcgtgactggcaatcttgccccgcacttcctcgcattgtgcaaaccgaattacacggctctgggctgccagcagtacacgcagtttatttccggcgaggaggcctgcaccgggaatccagacctgatcatgcgcgcgcggaaaacttttcccagcaaagaggcggccctgagcgtgtacgctgccatgtatcttaccatgtacatcacaaatacaattaaggctaagggaaccaggttggctaagcccgtactatgcctcggcctgatgtgcttggcttttctcactgggcttaatagagtggctgagtaccgcaaccattggtcagatgtcatcgctggattccttgtcggcatttctatcgccgtgttcttagttgtgtgcgttgtgaacaattttaagggaaggcaggcggaaaacgaacacatccatatggacaatctcgcgcagatgcccatgatctctatccccagggtggaaagtcccctggagaagaaccacatcactgccttcgccgaggtgacttag

SEQ ID NO: 27151 - DNA, 744 bp, Artificial Sequence
  Description of Artificial Sequence: Synthetic coding sequence
atgttgccctcccaagaggcctccaaactgtaccacgagcactacatgcgcaatagcagggctatcggtgtgctgtgggctattttcaccatttgctttgcaatcatcaatgtcgtggtcttcatacagccttactgggtgggggacagcgtgagcaccccaaagcccggatatttcgggcttttccactactgcgtcggatcgggcctagcagggcgggagctgacgtgtaggggaagctttacggactttagtaccatcccatcctccgccttcaaagctgctgcattcttcgtcctgctgtccatggtcttaatcctaggttgcatcacatgcttctccctgttcttcttttgcaacaccgccacagtctataagatctgtgcatggatgcagcttcttgcggccctctgtctcgtgctcggatgtatgatattccccgacggctgggatgcggaaactatccgggacatgtgcggagccaaaaccggaaaatactcccttggcgactgttctgtgcgttgggcatacattctcgccataatagggattttaaacgccctcatcctttcttttctcgcatttgtgctgggaaaccgacaaacagacctgctgcaggaggagctcaagcccgaaaacaaagacttcgtgggcagtaccgtgtctagcgtgctgagacctggtggggacgttagcggatggggcgtactaccctgtccagttgcccacagtcagggaccttag

SEQ ID NO: 27152 - DNA, 2088 bp, Artificial Sequence
  Description of Artificial Sequence: Synthetic coding sequence
atgtccggcgcagcactgggactagagattgtttttgttttttttcttgcgctcttcttgctccatcgctatggcgactttaagaagcagcaccgccttgtaatcatcggtaccctgttagcatggtatctgtgtttcctgatagtattcattctgccactggatgtctccactaccatatacaatcggtgtaaacacgcagccgccaactcctctccaccagagaattctaatataaccggtctctacgccaccgcaaatcctgtcccatctcagcacccctgttttaagccatggagctacatccccgatgggattatgccgatcttttggcgtgtggtctactggacctctcagtttctcacctggatccttttaccttttatgcagagttacgcgcggtccggcggcttttccattactggaaaaatcaaaacagccctcatcgagaacgccatctactatgggacctatctacttatcttcggggcttttttgatttacgtggccgtgaacccccacttgcacctcgagtggaaccagctgcagacaattggaatagctgccgccaatacttgggggctcttcctgctggtgctgctcctcggatacgggctggtggagatcccacggtcatactggaatggagcaaagcggggttacctgctgatgaagacctactttaaggctgctaagctcatgacggaaaaggctgatgcggaagaaaacttggaggatgcaatggaggaagtgcgaaaggtcaacgagagcatcaagtacaatcatcccttacgtaaatgcgtagacacaattttaaaaaagtgcccaacagaataccaggagaagatgggccgaaatatggatgactatgaagacttcgatgagaagcattccatttacccatccgaaaagagcctggtgaaactgcataaacaagtgatttattctgttcaacgacaccgacggacccaggtgcagtggcagatccttctcgagcaagccttttatctggaggacgtggctaagaacgaaactagtgcaactcaccaattcgtccacacatttcagagtcccgaacccgagaacaggttcattcagtacttttataaccctactttcgagtggtattgggaatgtctgctgaggccctggttctataagatcctcgcagtggttttgtctatattctctgttatagtggtttggagtgagtgtacattcttttccaccacccccgtcctgtcacttttcgctgtgttcattcagttagctgagaaaacttataactacatctatatagagattgcctgctttttatctatattctttttatcgatctgtgtctatagcaccgtatttcggataagggtgtttaattattactatctcgcttctcatcaccagacagatgcttattctcttctgttctccgggatgttgttttgccgactgacaccacctctctgccttaatttcttagggctgactcacatggacagttcaattagccataaaaatacacagcccactgcgtacacctcgattatgggctctatgaaggtactttcttttatcgctgacggattctacatttattaccccatgttggtggtcatactctgtattgcaacttacttctccttgggaacaaggtgcctcaatctactcggatttcaacaattcatgggggatgatgatatgacatctgacctggttaatgagggaaaggagttgataagaaaagagaagcggaagcgtcaacgacaagaggagggggagaatcggagaagggagtggaaggagcgttacggtcataacagagaagactccacccgcaaccgcaacatccacaccgaccccaaggagtctaacttcagtgatgtcaacaccaataggagcgccttcaagtataccagagcaaataatcggacggagagagacaggattgaactcctacaggatgccgaacctctggacttcaacgccgagacctttactgacgatcccctggaaagcgaatctggacggtaccagccaggggggcgctatctgtctatgagtcgctctgatatcttcaatgatgtctag

SEQ ID NO: 27153 - DNA, 1770 bp, Artificial Sequence
  Description of Artificial Sequence: Synthetic coding sequence
atgccaatcttttggagagtggtctattggacctctcaatttctcacttggattctgctcccctttatgcaatcctacgctcgatctggaggtttttctattacgggcaaaattaaaaccgcgctcattgaaaacgcaatctactatggcacgtacctgctaattttcggcgcatttctcatttatgtagcagtcaatcctcatctgcacttggaatggaatcagctccagacaatcggtattgccgccgctaacacctgggggctgttcttgctggtgcttctgctgggatacggtctggtcgagatccctcgcagctactggaacggcgccaaaagggggtatttactcatgaaaacctattttaaagcagccaagctcatgactgagaaggctgatgctgaggaaaatttagaagatgcaatggaggaggtgaggaaggtcaatgagtctatcaaatacaatcatccactgagaaaatgtgtggacactatcctgaaaaaatgccctaccgaatatcaggagaaaatgggtcgcaatatggacgattacgaggacttcgatgaaaaacactctatatacccatccgaaaagagcctcgttaaattacacaagcaggttatctattctgtgcagcgccaccgtagaacgcaggtgcaatggcaaatcctgctcgagcaggcattctatctcgaagatgttgctaagaatgagacatccgccacccaccagtttgtgcataccttccaaagccccgaacctgaaaaccggtttattcagtatttctataaccccacctttgaatggtactgggagtgcctactaagaccgtggttctacaaaatactggctgtagtgcttagtatctttagcgtgatcgtggtttggagtgagtgcacatttttctccacaaccccggtgctctctttgttcgcagttttcattcaactggccgagaaaacttacaattacatttacatcgagattgcttgtttcctgtctattttctttttatctatctgtgtatactccactgtgtttcgcatacgggtgtttaattactactatctggcatctcatcatcagacggacgcatatagcctgctgttctctggtatgctgttctgccggctgacccctcccctgtgcctgaatttcctaggtcttacacatatggattcctccatttcacacaagaatacccagcctaccgcatacacttcaattatggggtcaatgaaggtcctctctttcattgccgatgggttttacatctactatccaatgctggtggtgattttatgcatcgccacctactttagcctcggcactaggtgcctcaacctgctgggtttccagcagttcatgggagatgatgatatgacttccgatctagtgaacgagggaaaagagctgatcaggaaggaaaaacgaaagaggcaaaggcaggaagagggagagaacagacgacgcgaatggaaggagcggtacgggcataatcgagaggactcaacacgaaacagaaatattcacaccgaccccaaggagagtaacttctcagacgtgaatactaaccggagcgcattcaagtatacaagggctaacaaccggacggagcgggaccggatagagcttcttcaggatgcagagccattagatttcaatgcggagactttcactgatgaccccctcgaatctgagtccggaagataccagcctggcgggaggtatctatcaatgtcgagatccgacatcttcaacgacgtatag

SEQ ID NO: 27154 - DNA, 618 bp, Artificial Sequence
  Description of Artificial Sequence: Synthetic coding sequence
atgaataaggtctttccgcagggagagaatggctacacagcagccgaatcaaaagcccaccccgggggcgaagcagggggcggccatctctgctgcagcagacgcggcgcctgtctgtcggcgtctcttcttttgctacttgcaacggtggccgccttaatagctctggtgacaatactggggctgccatcctgcacgcctggggctcaggcctgcattacccttaccaaccggacagggttcctctgccatgaccagagaagctgtatccctgcctctggcgtgtgcgacggcgtgagaacatgtacacatggcgaggacgaagatgaatccctgtgcagggatgtcccccagagtctgccccattttttagtcgcccattgcggcgatccagcctcatggatatacagcgatcaaaagtgtgatggcaccaacaactgtggtgattgttccgatgaattaagcccagtgaccgtttgtccaccatgtggaccaggctggtggaggtgtccttctaccttcttcaaatactgtgattgcattcctaggcatttgtgccgtgaccatgttcagcattgttccgattggtcagatgagtatgcttgcccaggcccatag

SEQ ID NO: 27155 - DNA, 351 bp, Artificial Sequence
  Description of Artificial Sequence: Synthetic coding sequence
atgaacaaagtgttccctcagggcgaaaatggatatacggcagctgagtcaaaggcccaccccgggggggagggggatgtgcctcaaagcctgcctcacttcctggttgcacactgtggggatccagccagttggatctacagtgatcagaaatgtgacggcactaacaattgcggggattgttctgacgagctgtccccagtcactgtatgccccccctgcgggcctggctggtggaggtgtccatcaacttttttcaaatattgtgactgtatcccgaggcatttatgtcgggaccacgttcaacattgttcagactggagcgatgaatacgcttgccctggtccatag

SEQ ID NO: 27156 - DNA, 819 bp, Artificial Sequence
  Description of Artificial Sequence: Synthetic coding sequence
atggaagcttgctgtcttttgcagctaccacaaagactgctgcttctgggcgctgcagccttaaccgccactgccctcgagacagccgatttggccgagctttgcggccagacatggcagggcgacggactgcttctgcgttcacatgcagcttctcgacgattctattttgtagcaccagatacagactgtggactgtgggttcaggcagcggcgccaggggaccggatcagattccagtttaggttctttctggtttacagtctgactcctgctcctccagccctgaatacgtcaagccccgccccagctgacccatgtgccccagggtcatatttgcagttctatgaaggaccaccaggcgcaccccgaccacttggatcacctctgtgtggtctcaacattcccgtgcctgttgcctcctcaggcccattcctgggtctgcgattggtgacccggggacgccaacctcgcgtggactttgtgggcgaggttacctctttccgtctgggcccatgcggagcttactttcgttgtcagaatgggcgctgtatcccatcaagcctggtttgtgacccttgggggatggataactgtggagacggcagcgatcagggaagttggtcgcccgccgattgccgcggtccaagcccagtcccgagccagacaggctcaactgacgcccatacatctcgctcccttactccgagtcccgcgctggggagtgctggctccctgtggattgctgcagagcggtcctctcccgccggcagggaccccactaggcaggacgccgccctggaggggtccactgaatag

SEQ ID NO: 27157 - DNA, 819 bp, Artificial Sequence
  Description of Artificial Sequence: Synthetic coding sequence
atggaggcttgttgtctgctccagctgccacaacggctcttactgttaggggcagccgccctgacagcgactgcattggaaaccgcggatttagcggaactttgtggtcagacctggcagggggatgggctcctgctccgatcacatgcggctagccgccgcttctactttgtggcccctgacaccgactgtggtctatgggttcaggccgcagcacccggagatagaatccgcttccagttccggttctttctagtgtattcactgaccccagcgccacccgctttgaataccagtagccctgcgcctgctgatccttgcgcacctggcagttacctgcagttctatgaaggcccacctggagcgcctcgccccttgggcagccccttgtgtggtttgaatattccggtacctgtggcctcgtcagggcctttcttgggattaaggttggtgacccgggggcgccagcctagggtcgacttcgttggggaagttacttccttcagactggggccatgcggagcgtatttcaggtgccaaaacggtagatgcatcccaagctcgttggtgtgcgacccatggggaatggacaattgcggcgatggctccgatcaaggaagttggtcccctgctgattgccgcggcccttcgccagtcccaagccaaactggctctaccgacgcacatactagccgttctcttacccccagcccggcgctgggctccgccggatccctgtggattgcagctgaaagatcctcacccgcaggacgcgacccaacacgccaggacgctgccctagaaggttccacagagtag

SEQ ID NO: 27158 - DNA, 1038 bp, Artificial Sequence
  Description of Artificial Sequence: Synthetic coding sequence
atgtggctgctgggacctctctgtctgcttttaagctccgccgcagagtcacaactgctcccgggaaataacttcacaaatgagtgtaacatcccagggaacttcatgtgttctaatggtcggtgcattcccggtgcctggcagtgtgacggtctgccggattgcttcgataaaagcgacgagaaagagtgtccaaaagccaagtccaagtgcggaccgacattttttccctgcgcaagcggaattcattgtattataggcagattccgatgcaacgggtttgaagactgcccggatggctccgatgaggagaattgcactgcgaacccactactgtgttcaaccgctcggtaccactgcaagaacggcctgtgtatagacaagtctttcatttgcgatggacagaataattgtcaagataattcagacgaggagagttgcgagtcgtctcaagagcctgggtccggccaggtgttcgtgacttcagaaaatcagttggtgtattatccctctattacatacgcaataatcggatcctctgtcatcttcgtgctagtggtggcgctgctggctctggtgctgcatcatcagcggaagcggaacaaccttatgactttacccgtccataggttgcagcaccctgtcctactttctcgcttagtggtcctcgaccatcctcaccactgtaacgtgacctataacgtgaacaatggcatccagtatgtggctagccaggcggaacaaaatgccagcgaggtgggaagccccccgagttacagcgaggctttgttggatcagagaccggcctggtacgacctgcctcctccaccttatagtagtgacacagaaagcctgaatcaggctgacctccctccatatagatctagatccggcagtgcaaacagtgcatcctctcaggccgcctctagcctgttgtcggtggaggatacaagccatagtcctggacagcctggtcctcaggagggtactgcggaacctagggacagcgagccgtctcaggggactgaagaagtttag

SEQ ID NO: 27159 - DNA, 468 bp, Artificial Sequence
  Description of Artificial Sequence: Synthetic coding sequence
atgtggctgctgggacctctctgcttactgttgtcctccgccgccgagagtcagttactgcctggtaacaacttcacaaacgagtgtaacatcccagggaatttcatgtgctcgaacggccgctgcattcctggggcctggcaatgtgatggtttgccagattgtttcgataagtctgatgaaaaggaatgcccaaaggcaaaatcaaaatgcggccctacatttttcccatgcgcaagcggcatccattgcatcatcgggcggtttcggtgtaacggatttgaagattgtccggatgggtctgatgaagaaaattgtaagaatggactgtgcattgataagagctttatatgtgatggacagaataactgtcaggacaactcagatgaagagtcttgcgagtcctcccagggcctccggggcatgactttcctccacaggccaacacttcttactcgcaacttatag

SEQ ID NO: 27160 - DNA, 1503 bp, Artificial Sequence
  Description of Artificial Sequence: Synthetic coding sequence
atggccagtgtggcgcaggaatctgccggatcacaacgcagactgccgcctcgccacggcgcacttagggggttgctgctcctctgcttatggctccctagcggacgtgccgcgctgccaccagctgcccccctgtccgaactgcacgcgcagctctcaggagtggaacagctgttggaagagtttcggagacagctgcaacaggaaagacctcaggaggagctcgagctggaactcagggccggcggtggtccacaagaagattgtcctggcccaggcagcggcggttacagcgcaatgcccgatgccataatccgcacaaaggacagcctggcagccggagcctcatttttaagggctcccgctgccgtccggggttggcggcagtgtgtcgccgcctgttgctctgagcccagatgttctgtcgccgtagtcgagctgcctcgccgtcccgctccgcccgcggccgtgcttgggtgttatctgtttaactgtacggctcggggacgcaatgtctgtaaattcgctctgcatagtggctactcaagctactctctgtctagagctccagatggggccgccctggctactgccagagccagtccacgccaggaaaaggatgctccccccctgtccaaggcaggccaggatgtcgtgttacacttgccaaccgacggcgtggtgctggatgggcgtgaaagcacagacgatcacgcaatagtccagtacgagtgggccctcctacagggcgacccgtctgtagacatgaaggtcccccaaagcgggaccctaaagttatcgcacctgcaggagggtacatatacatttcaactcaccgttacagatacagccggccagaggagcagcgataatgtgtccgtgactgtgctccgggcggcatactcaacggggggatgtctgcacacatgtagtagatatcactttttctgtgatgacggatgctgcattgacattacacttgcttgtgacggcgtacagcagtgccctgatggcagtgacgaggatttctgccagaatcttggactggaccggaagatggtgacacataccgctgccagccctgccctacctcgtaccacgggaccttctgaagacgccggaggcgactcgttggttgagaagagccagaaggctactgctcctaacaaaccccccgctctgagcaataccgagaagaggaaccattcagccttttgggggcccgagagccagattatccccgtcatgcctgactctagcagcagcggaaagaacaggaaggaagaatcttacatttttgagtcaaagggcgacggcgggggcggtgaacatccagccccggagactggggctgtgttgccactcgcactgggcctggccattaccgcacttctcctgctgatggtggcctgccggctgagactcgtaaagcagaaactgaaaaaggcacggccaattacctccgaagagagcgattatctcatcaacggtatgtacctgtag

SEQ ID NO: 27161 - DNA, 978 bp, Artificial Sequence
  Description of Artificial Sequence: Synthetic coding sequence
atggccagcgtagctcaagaaagtgctggctcgcaaagacgcttaccccccaggcatggagccctgcgtggtttattgctattgtgtctctggctgccctcaggccgagcagctttgccacccgcagctcctctttccgagctacatgctcaactgagtggcgtggagcagctcctggaggagttcagacggcagctccagcaagaaagaccacaggaggaactggagctggagttacgtgctgggggtggtcctcaagaggactgcccgggccccggctccggaggctattcagcaatgcccgacgcaatcattcgaacaaaggatagcctggctgctggcgcgtcattccttcgtgcacccgcagccgtgaggggctggcgacagtgtgtcgctgcctgctgctcagaacctagatgcagcgtagccgtagtcgaactgccacggaggccagctccaccggccgctgttctgggatgttacctctttaattgcaccgctcgcggcagaaacgtgtgcaagttcgcgcttcattctggctattcatcttactctctgtcccgcgcgcctgacggcgcagcccttgcaaccgcgcgcgcatcacccaggcaggagaaggacgccccccccctgagcaaggctggtcaggatgtggtgttacatctaccaaccgacggcgtggttctggacgggcgcgagtcaaccgacgatcacgctatagtgcagtatgaatgggctttgctccagggggatccttcagtggacatgaaggtgcctcagtccgggacgctgaagctgagtcacctgcaggaaggcacctacacatttcagctaactgtgaccgataccgcgggacaaagaagcagtgacaatgtaagcgtcactgtattaagggcagcctactcgacgggagatggctggagcatctgttgcatttgttctaaaagggaagcgaaggaattttccgaaacatcgtag

SEQ ID NO: 27162 - DNA, 738 bp, Artificial Sequence
  Description of Artificial Sequence: Synthetic coding sequence
atgaaagtccctcaatctggtaccctcaaactctctcacctccaggaaggcacctacacattccagttgacggtaaccgataccgccggacaacgctctagtgacaacgtgagcgttaccgtgctgcgggcggcttattccacgggagggtgtttgcacacctgcagtcgctaccactttttttgtgatgatggatgctgtatcgatatcacactcgcctgtgatggagtgcagcagtgtcccgatggatcagatgaggacttctgtcaaaacctggggctggaccggaagatggtgacacacacagctgcaagccctgccctccctcggacaaccgggccttcggaggacgcaggaggagatagcctggtagagaaatcgcagaaggccacagcccccaataaacccccagcattatcaaatacagagaagcggaatcacagtgccttctggggtccagagagtcagattattcccgtgatgccagacagttccagttccgggaagaaccggaaggaggagagctatattttcgaatctaaaggcgacgggggaggaggtgaacacccagcccctgaaaccggtgctgtcttgcccttggccctggggctagcgatcactgcactcctgcttctgatggttgcgtgcaggctgagattggtgaagcaaaagttgaagaaggcgaggccaattacaagtgaagaaagcgactacctgattaacggtatgtatctgtag

SEQ ID NO: 27163 - DNA, 2580 bp, Artificial Sequence
  Description of Artificial Sequence: Synthetic coding sequence
atggcctgtcgctggagcacaaaggagtccccacgctggcggtctgccttattactgcttttcttggccggagtttacggcaacggggcgcttgcagagcattcagagaatgtccatatctccggcgtgtctactgcttgcggcgagacaccagagcagattagggcgccttcaggaattataacgagccctggctggccaagtgagtatccagccaaaataaactgtagctggttcatacgcgccaacccaggagagattataactatttcttttcaggactttgacattcagggatctcggcggtgtaatctggattggttgaccatagagacttataagaacatagagagttaccgcgcctgcggctccactattcccccaccttacatctcttcacaggatcacatatggatcaggttccatagtgatgataatattagccgcaagggattccgattagcctacttctcagggaaatcagaggaacctaattgcgcctgcgaccagtttcggtgcggaaatgggaaatgcatccctgaagcttggaagtgtaacaatatggacgaatgtggggattcgtctgacgaagaaatctgtgccaaggaggctaacccacccactgctgccgcctttcaaccttgcgcttacaaccagttccagtgcctgtctcgattcacgaaggtgtacacttgtctgccagaatcccttaaatgcgatggaaacatagactgtctcgatctcggggatgaaatcgactgcgatgtgcctacatgtgggcagtggcttaagtatttttatggcacattcaattctcccaactatcctgatttctatcctccgggctctaattgcacatggctgatagacacgggtgaccaccgaaaggtcatcctgcgctttacagacttcaagcttgatgggacagggtatggcgattacgtcaaaatctacgacggactcgaagaaaacccacacaaactcctgcgcgttctgacagcatttgactcacatgcccctctgaccgtggttagctcttcaggccagatacgggtccacttttgcgctgacaaagttaatgcggcacgaggattcaatgctacttatcaagtggacgggttctgcttgccatgggagattccctgcgggggtaactgggggtgttataccgagcagcagaggtgtgatggttactggcattgcccaaacggccgggatgaaactaattgtaccatgtgccaaaaagaggaattcccatgcagtcggaatggggtgtgttacccacggagtgaccgatgcaactaccagaaccactgcccgaacggatctgacgaaaaaaactgcttcttttgtcagcccgggaatttccactgcaagaacaataggtgtgttttcgaatcttgggtttgcgacagtcaggacgactgtggcgatggatctgacgaagagaattgtccggtgattgtcccgactcgggtgattactgccgccgtgattggtagtcttatttgtgggcttcttctggtgatcgcactcgggtgtacatgcaagctttactctttgcgcatgttcgaaagacgctcattcgagacgcagttaagtcgtgtggaagctgaactgttgaggagggaagctccccctagctacggccagcttattgcgcagggcctgatccctccagtcgaagactttcctgtgtgcagccccaatcaggcttcagtgctggaaaatctgagactcgcggtccggtcccagctggggtttacaagcgttcggctgcctatggctggaagatctagcaacatttggaaccgtatcttcaattttgcccggtctcgccatagtggctctctggcgttagtcagtgcagacggtgacgaagtcgtgccatcacaaagcactagccgggaaccggagcgaaaccatacacatcgctcacttttttcagtagagagcgacgatacagacacggaaaacgagaggcgcgacatggccggcgccagtggaggtgttgctgctccacttccccaaaaggtcccaccaacgactgccgtggaggctaccgttggagcttgtgcaagttcatcgacacaatcaacacgtggcggccacgcagataatggcagagatgtcacatcggtggagcctcctagcgtgtctccagccaggcatcagctgaccagcgcactctctcgcatgacacaaggactgcgttgggttcggttcacactgggccgttcctccagcttaagtcagaaccagagtcctttgcgtcaactggataacggggtgagcgggcgtgaagatgatgatgacgtggaaatgttgatacccatttccgacgggagcagcgattttgatgtcaatgactgctcaaggcccctcctggacctggcgagcgatcaggggcaaggcctacgccagccttataacgccactaaccccggggtgaggccctctaacagagacgggccctgcgaacgctgtggcattgtgcatacagctcagataccggatacttgcctggaagtgaccctaaaaaatgagacctctgatgacgaagctctgctcttgtgctag

SEQ ID NO: 27164 - DNA, 2523 bp, Artificial Sequence
  Description of Artificial Sequence: Synthetic coding sequence
atggcctgccgctggagtaccaaggagtcaccacggtggcggtcagcccttctgctgctttttctggccggcgtgtacgcgtgtggggagacacctgagcagatcagggcccccagcggcatcattacctcccctggatggccaagcgaatatccagcaaagattaactgctcatggttcattagggcgaatccgggagaaattattaccatctcattccaagacttcgatatccaagggtccaggcgatgcaatctggactggcttactatagagacttataaaaacattgaatcgtaccgcgcctgtggctcaactattccccctccctatatatccagtcaggaccacatatggatcaggttccattccgacgacaatatttctagaaaaggcttccggcttgcttattttagcggaaaaagcgaagagccaaactgcgcgtgcgaccagtttcgatgcggcaatgggaagtgtatcccggaggcttggaaatgtaataatatggatgaatgtggggacagcagcgacgaagagatatgtgccaaggaggccaacccacccactgcggccgcttttcaaccttgcgcttataatcagtttcaatgtctttcaagatttacaaaggtgtacacatgcttgccagaaagtctgaagtgtgacggcaatatcgattgcctggatttgggcgatgagattgactgtgacgtgcctacctgcggacagtggcttaaatatttttacggcacctttaacagcccgaactatcctgatttttaccctcctggctctaattgtacatggctaatcgacaccggggaccatcggaaagtgatactccgcttcaccgatttcaagctggatggcaccggttatggagattatgttaagatatacgatggtttggaagaaaatccacacaagctgctccgcgtcctgactgcatttgactcgcacgcccccctcacagtggtatctagttcagggcagatcagagttcatttttgtgccgacaaagtaaatgccgcacgaggcttcaatgctacgtaccaggttgacggcttctgcctgccgtgggaaattccctgtggaggtaattgggggtgctacacagagcagcagagatgtgatggctattggcattgtccgaacggacgagatgaaacaaactgtaccatgtgtcagaaggaagaatttccctgtagccgcaacggcgtctgttaccctagatccgaccgatgtaattatcaaaaccactgtccaaacggttctgacgaaaagaattgcttcttctgccagcccggcaacttccactgcaagaacaacaggtgcgtttttgagtcgtgggtatgcgattctcaggacgattgtggagatggctctgatgaggaaaactgtcctgtgatcgttcccaccagggtgattactgccgccgtaattggcagcctcatctgtgggctgcttctggtgatcgcactgggctgcacctgcaaattgtactccctaagaatgttcgagcgacgcagctttgagacgcaattgtcccgagtggaggccgaattgctgagacgcgaagctcctcccagctatgggcagctgatcgcgcagggactgattccacctgtggaggatttcccggtctgctctcctaaccaggcaagcgtcctggaaaacctccgccttgccgtcagatctcaactggggttcacttctgttcggctaccaatggctggtaggagttccaacatctggaacaggatatttaactttgccaggtctcgtcattctggctcactggctctggttagcgcagatggcgatgaagtcgtcccttcacagtctacatctagagagccagagcgcaaccacacccacagatcattgttttcagtcgaatccgacgacacagacacagaaaacgagcgtcgcgatatggctggcgcttccgggggagtcgccgcgcccttgccccagaaagtgccgcctactaccgccgttgaagccaccgtgggagcatgtgcatcctccagcacacaaagcacgaggggggggcatgcagacaacggtagggacgtgactagtgtggagccgccttccgtgtcccctgcacggcaccaattgaccagcgccctttccagaatgacgcagggtctgaggtgggtccggtttaccctcggacgttcatccagcctcagccagaatcagtctcctctgaggcagctcgacaatggggtgtcaggaagagaggatgatgacgatgtggaaatgctcattccaatcagcgacggcagttccgacttcgacgtgaatgattgctcaaggccactgctggatctcgctagcgaccaggggcagggtctgagacagccctataatgcaaccaatccaggggttcgaccaagcaatagagacggaccctgtgagcgctgtggcatcgtccatacagcacagattcctgatacctgtttggaggtgacactgaagaatgaaaccagtgacgatgaggctctgctgttgtgttag

SEQ ID NO: 27165 - DNA, 8592 bp, Artificial Sequence
  Description of Artificial Sequence: Synthetic coding sequence
atggcttctgaagacaatcgggtcccgtctccaccgcctactggggacgacggcggcggcgggggacgggaagagacgcctactgagggcggggctttgagcctgaagcctgggctaccaatccggggcatccgaatgaaattcgcagttttgaccggcctagtggaggtaggcgaggtctctaatcgcgatatcgtggagactgtgttcaacctcttagtcgggggacagtttgatctcgaaatgaattttattatccaagaaggcgaatcaattaattgtatggttgatttgctagagaagtgcgatattacttgccaggccgaagtctggtcaatgtttacggccattcttaaaaagagtatacgcaatctgcaagtgtgcactgaagtgggactggtcgagaaagttcttgggaagattgaaaaagttgataatatgatcgccgatctcctggtagacatgctgggtgtgctcgcctcatacaatctgaccgtgagagagttgaagctttttttcagcaaattacagggcgacaagggacggtggcccccacacgccggaaagcttctgtccgtgctgaaacatatgcctcaaaaatacggcccagatgcttttttcaacttcccagggaagtcagcagcagcaatagccctgcctcccatagctaaatggccttatcagaatgggtttacttttcacacatggctgcggatggaccccgttaacaacattaatgtcgacaaggataaaccctacctgtattgcttccgaacgtcaaaagggttgggttatagcgcacatttcgttggtggatgcctcatcgtaacctccatcaaaagtaaagggaaaggtttccagcattgcgtgaagttcgactttaaaccccaaaagtggtatatggttacgatcgtacacatttataacaggtggaaaaattccgagctcagatgttacgtgaatggagagttagcaagctacggtgagattacctggttcgtcaacacatccgatacgtttgacaaatgcttccttggcagcagtgagactgcagacgcaaaccgcgtgttttgcggacagatgacagcagtctatttgttttccgaagcgctcaacgctgcacaaatcttcgctatctaccagctgggtttagggtataagggtacgttcaaattcaaagcggaaagtgatctctttctggcggaacaccacaagctactgctctatgacggcaagctgtcttccgctatagccttcacatacaacccccgggcaaccgatgcccaactttgtctggagtcaagtccgaaggacaatcctagcatcttcgtgcactcaccacacgcgctgatgctccaagatgtaaaggcggttttgactcacagcatccagtcagctatgcacagtatcgggggagtacaggtcctcttccccctgttcgctcagcttgactacaggcagtatttgtctgacgagatcgacctcaccatctgcagcaccttgttggcctttatcatggaactgttgaaaaattccatcgccatgcaggagcagatgttggcctgtaaagggttcctggtcatcggttacagcctggaaaaatcatccaaatcccacgtctcccgcgccgtactcgagctttgtcttgcgtttagtaaatacctgagtaatctgcaaaacggaatgccactgctcaaacagctctgcgatcacgttctactgaaccccgccatatggattcacacaccagcaaaagtgcaattgatgctgtacacctacttgtctactgagttcatcggcacagtgaacatttacaacacaattcggcgggtgggtaccgttctgctgatcatgcacacactcaaatactattattgggccgtgaaccctcaggatcggagtggaatcacgccaaagggcctggatggcccaaggcctaaccagaaggagatgctatccctgcgagcctttctcctcatgttcatcaaacagctggtgatgaaagacagcggcgtgaaagaggacgaactgcaggcaatactgaactacttgctgacaatgcacgaggatgacaatcttatggacgtccttcagttgcttgtcgcgctgatgagcgagcacccgaacagtatgatcccggccttcgatcaaagaaatgggctcagagtaatttacaaactcttggcctcaaagagcgagggtattagagtgcaggctctaaaggcaatgggatactttcttaaacacctcgcacccaagaggaaagctgaggtaatgctgggtcatggcttgttttccctgctagcagaacgcctgatgctccagaccaacctgattactatgacaacttataatgtgctgttcgaaatactcatcgagcaaatcggaacccaggttattcataaacagcaccccgatcctgactcatcggtgaagattcagaacccacagatcctcaaggtcatcgctacattgcttcgaaatagtccacaatgccctgagagtatggaggtccggagagcattcttgagtgacatgattaaactgttcaacaactccagagaaaatcgtaggtcactgctgcagtgtagcgtgtggcaagaatggatgctgtccctgtgctatttcaaccctaagaattccgacgaacagaaaattactgaaatggtatacgctatcttccgtatcctgctttatcatgcagtgaaatatgagtggggcggctggagagtttgggtagacaccctcagcatcacacactccaaagttacattcgaaatacacaaggagaatctggcaaacatttttagagagcagcagggaaaggtggacgaggagataggactctgttcaagcacatctgtgcaggccgcctctggcatccggagggacattaatgtgagtgttggttcccagcagccagacaccaaggattcacccgtctgccctcacttcaccactaatggcaacgagaactcctccatagagaagacaagttccctggagtctgcttctaatatagagctccaaaccaccaacacatcatatgaagaaatgaaggctgaacaggagaaccaggagttgcctgacgagggaacacttgaggagaccctgaccaatgaaactcgcaatgcagacgacctggaagtctcttctgacatcatagaggccgtggcaatctccagtaatagcttcattaccactggaaaggactcaatgacggtgagcgaggttacagctagtatttccagtccaagcgaagaggatgccagcgaaatgcccgaatttctggataaatccatcgtcgaggaagaggaagacgatgattatgtagagctgaaagtcgaggggtcacccaccgaagaggccaatctgccaaccgaactgcaagataactccctgtcccctgccgccagcgaagctggggaaaaactggacatgttcggcaatgatgacaagcttatcttccaagaaggcaagcccgtgaccgaaaagcagacggacacggaaactcaagacagtaaggactctggcattcagacaatgacagcctctggttccagcgccatgagcccagagaccacggtgtcacagattgcggtggaaagcgatctaggccagatgttagaagaggggaaaaaggctactaatctgacacgtgagacaaaattgattaacgattgccatggctcagttagcgaggccagttccgagcagaaaatcgcaaaactggatgtttcaaatgtcgccaccgataccgagagattggagctgaaggctagtcccaatgtggaggcccctcagccccatcggcacgtcctggaaattagccggcaacacgagcagcctggccaagggatcgcccccgacgccgtaaatggccagcgcagagacagtcgttctacggttttcagaataccggagttcaactggtctcagatgcatcagcgtctgcttacagatctcctgttctcaattgaaacagatattcagatgtggcgatcccactcgaccaagacagtcatggattttgtgaattcatctgacaatgtcatttttgtccacaataccatccacctcatttctcaagtgatggataatatggttatggcatgcggaggcatactccccctgctctccgctgcgacgtctgccacacacgaattggaaaacattgaaccaactcagggactgtctatcgaggcttctgtgacctttctccagcggctgatcagtcttgtcgacgtactgatttttgcttcttcattaggctttaccgaaatcgaggcagagaagtccatgagttccgggggcatccttaggcagtgcctgagactggtgtgcgcagttgcagtgagaaattgtctcgagtgccagcagcacagccaactgaagactagaggcgacaaggccctgaagccaatgcatagtcttatccctctcggtaaatccgcggcaaaatcccctgtcgatatcgtgactggtggaatttcccccgtgcgggacctcgacaggctgctgcaggatatggacattaacaggctgagggccgtagtgtttcgcgacattgaagatagtaagcaggcacagttcctggccctggctgtagtgtactttatttctgtgctgatggtctctaaataccgggatatcctggaacctcagaacgaaagacatagccagagctgtactgaaacgggctcagagaatgagaatgtctctctgagcgaaatcacaccggctgcgtttagcaccctgaccacagctagtgtggaggagtcagagtctacctcctccgctcgccgaagggacagcggcattggcgaagaaacagcaactggcctaggctctcatgtggaggtgacgccccatacggccccacctggtgtgagcgcagggcctgatgcgatcagcgaggtgttgtctacactttccctcgaggtaaataagtcacccgaaacaaaaaacgaccgtggtaatgatcttgacaccaaggctacacctagcgtcagcgtctccaaaaatgtgaatgttaaagatattctacggagtcttgtcaacataccagcagatggagtgactgtggaccctgcgctgctgccccccgcctgcttgggcgcattgggtgatctgtccgtggagcaaccagtgcagttccgaagcttcgataggtccgtcatcgtggccgcaaagaaatctgctgtctctccttctacttttaacacaagtatccctaccaacgctgtgtccgttgtctcctccgtggactccgctcaggctagcgacatgggaggggaatctcccggttcacgcagcagcaacgcgaagctcccctcagtgcctaccgttgacagcgtatctcaagaccccgtgtcaaatatgtcaataaccgagcgtttggaacacgcccttgaaaaggcggcacctctacttagagaaatttttgtggatttcgctccgttcctcagccggacgcttctcggatcccatggacaggagttgctgattgagggaacaagtctggtatgcatgaaaagtagctccagtgtcgtcgaacttgtgatgctgctgtgttcccaggaatggcagaactctatccagaaaaatgcaggcctggcttttattgagctcgtgaatgaaggcaggctgctgtctcagactatgaaggatcacctggtaagggtggccaacgaagcagaatttatactgtcccgccagagggctgaagacatacaccgacatgccgagtttgagtccctttgcgcccagtactctgcagacaagagggaggatgagaagatgtgtgatcacctgatacgcgcggccaaataccgggaccacgtaactgctacgcaacttatccagaaaatcattaatatcttaaccgataagcacggggcatggggtaactcagctgtgagcaggccgctcgaattttggcgactcgattactgggaagatgacctaagaaggcggaggaggttcgtcagaaatccactgggctcaacccatcccgaagccacccttaaaacggccgttgaacacgtctgtatctttaaactgagggagaactctaaggccacagacgaagatattttggccaaggggaaacagagcatcaggtctcaagccctcgggaatcaaaactcggaaaacgagattctgcttgaaggcgatgatgacacactgagcagcgtcgatgagaaggatttggagaacttggccgggcccgtttccttgagcactcctgcccaacttgtggctccttccgtggtcgtcaagggaactctttccgttacctcatccgaactttattttgaggtagacgaagaggaccccaatttcaagaaaatagatcccaaaatcctggcctatactgaaggattgcatggtaagtggctgtttaccgagatacggagcattttttctcggagatatcttctgcagaataccgctctggaaatctttatggcgaatcgcgttgctgtgatgtttaatttccccgaccccgcaacagttaaaaaggtggttaactatcttccccgagttggagtgggcacatctttcggccttccacagaccagacgtatcagcctagcctcccctcgccagctttttaaagcttctaacatgactcagcggtggcaacacagggagattagtaacttcgaatatctgatgttcctaaataccatcgccggacgcagttataacgacctgaatcagtaccccgtattcccttgggttatcacaaattacgaatccgaagagctggatcttaccctgcccactaactttagagacctgtcaaagcccattggggcactaaatcctaaaagggccgcattcttcgcggagagatacgagtcttgggaagatgatcaagtgccgaaattccattatggcacgcattactccaccgcatcattcgtgctcgcctggctgctgagaatcgagcccttcacaacctactttttgaacctccagggtggtaagttcgaccacgcagatcgaacattctcctcaatctctagagcatggcggaatagtcagcgggacacctcggacataaaggaactcatacccgagttttactacctgcctgagatgtttgtaaacttcaacaactataacctgggcgtgatggacgacggtaccgtcgtttcggatgtggagctgcctccttgggctaagactagcgaggaatttgtgcacatcaatcgcctggcactagagtccgagttcgtgagctgccagctacatcaatggatagatctgatttttgggtataagcagcagggcccagaggctgtgcgagccctcaatgtattttattacctgacctacgagggggcagttaatctcaattccatcacggatcccgtccttagagaggctgtggaagcacagattagatccttcggccagaccccctcgcagctgcttatcgaaccccaccccccccgaggcagcgccatgcaggtgtctccattaatgttcaccgataaggcccaacaggacgtgattatggtgctcaagttcccctctaacagtccagtgacgcatgtcgccgcaaacacccagccgggccttgcgacacctgcggttattaccgtgacagctaatagactcttcgctgtgaataaatggcataatctcccagcccaccagggcgccgtacaggaccaaccctatcagctccccgtcgaaattgatcctctgattgcttccaatactggaatgcacaggcgccaaatcacagacctgttggaccaaagtattcaagttcatagccagtgcttcgtgatcactagcgacaaccgctacattctggtctgcgggttttgggataaatcgttccgtgtgtattccacggatacgggcaggctaatccaagtggtgttcggccattgggacgtggtgacttgtttagccagaagcgagtcctacatcggcggcaattgctatattctatcaggttcgagggacgccaccctgttactgtggtactggaatggcaagtgctcggggatcggcgacaaccccggatctgagactgctgccccaagagccatcttgacagggcacgattatgaggtgacgtgcgccgccgtttgcgcagaactgggacttgtgctgtcaggctctcaggaaggcccgtgcctcatacattcaatgaacggcgacctcctacgaaccctcgagggccctgagaactgtctcaagcccaaattgatccaagccagccgcgagggccattgcgtgatcttttacgaaaatgggctgttttgtacattctccgtgaatgggaaattacaggccaccatggaaaccgatgataatattagagctatccaactgtccagagacggccagtacctgctaactggaggcgaccggggcgtggtggtggtccggcaggtatccgacttaaaacagctgtttgcttaccctggatgcgatgctgggatcagggcgatggcgctgtcatatgaccaacgctgtattatttccggaatggcatctggtagtatcgtgctgttttataacgatttcaacaggtggcaccacgaataccagaccagatactag

SEQ ID NO: 27166 - DNA, 8559 bp, Artificial Sequence
  Description of Artificial Sequence: Synthetic coding sequence
atggcctcagaggacaatagagtgccttccccgccaccgacaggagacgacggaggtgggggcgggcgcgaggaaacccccacggagggtggtgctctgagcctcaagccgggcctcccgattcggggaattcgcatgaaatttgctgtgctcaccgggctggtggaggtcggtgaagtctctaatcgggacatcgtggaaaccgtctttaatttgttggtcggcggtcagttcgatctggagatgaattttattattcaggagggcgaatctatcaattgcatggtggacctgttagaaaagtgcgatataacttgccaagcagaggtgtggagcatgtttactgcgattctgaaaaaaagtatccgcaatctgcaggtgtgcacagaagtgggactggtcgagaaggtcctcggaaaaattgagaaggtcgataacatgatagcagatctgcttgtggatatgctgggtgtgctggccagctacaacctgacagtacgggaactgaaactgttcttttcaaaactccagggggataaagggcgctggcctccccatgccgggaaattgctgtccgtcttgaaacatatgccccagaaatatggcccagacgctttcttcaattttcctggtaagtctgccgcggcaatcgccctgccccctattgcaaaatggccttaccagaacgggttcacgttccatacctggctgaggatggaccctgtaaataatattaatgttgataaagacaaaccttacctgtactgcttccggaccagtaagggattgggatactcagcccatttcgtgggcggatgcctcatcgtcacatctatcaaaagcaaggggaaaggtttccaacactgtgtgaagttcgactttaaacctcagaaatggtatatggttaccatcgtgcacatctataatcgctggaagaatagtgaacttcgatgctacgtcaatggtgaacttgcctcatatggagagatcacttggttcgtgaacactagcgatacattcgacaagtgttttcttggatcttcagagaccgcagacgctaaccgcgtgttttgcggacaaatgacagcagtctatttgttcagtgaggccctgaatgccgcacagatattcgcgatctaccaacttggcctcggctataaggggacattcaaattcaaggccgagtctgacctctttctggctgagcaccacaaactccttctttacgacggcaaactgtctagtgccatcgcctttacctataatcctagggctactgacgctcagctgtgcttagagtcctctccgaaagacaatcctagtatttttgtccactcaccacatgcccttatgctgcaggacgttaaagccgtgctgacccactccatccagtcagcgatgcacagcattggaggggtgcaagtacttttcccactgtttgcccagctggactataggcagtacctatcagatgaaatagatctgaccatctgcagtaccctccttgcgtttataatggaactgctaaaaaatagcatagcaatgcaggaacagatgttggcttgcaaaggttttcttgtgatcggctattcattggagaaatcctcaaaatcccacgtctcccgcgccgttcttgaactatgtctagcattctctaagtacctctctaatttgcaaaacggcatgcccctgctgaaacagctgtgcgaccacgtcctgctgaatccagcaatctggattcacaccccggccaaagtccagctgatgctatacacctatctgagcacggaatttattggcactgtgaacatttacaacactatccgcagagttggaacagtgctgttgattatgcacacactgaagtactactattgggcggtgaacccccaggatcgctctggaattacaccaaaaggtctcgatggcccacgacccaatcagaaagagatgctgtctctccgagcatttctgctgatgttcatcaagcagctggtgatgaaggattctggcgtaaaagaagatgaactgcaggcgattcttaattatctgctgaccatgcacgaggacgataatcttatggatgttctccaacttctggtggctttaatgagcgaacacccaaattctatgattccagcctttgaccaacgcaatggcttgagagtcatctacaagctgctcgctagtaagtcggaagggatccgtgtacaagcactgaaagccatggggtacttcctcaaacaccttgctcctaagaggaaagcagaagtgatgctcggtcacggactgttcagtctgctggctgaaaggctcatgcttcaaaccaatctaatcacaatgactacttataatgttcttttcgaaattctgattgagcagattggcacgcaagtcatacataaacaacaccctgacccagattcctctgtgaagatccagaacccccagatattaaaagtgatcgccacactgctgcggaatagcccacagtgcccagagtcaatggaggttcgtagggccttcttgtctgatatgataaagttgtttaataattctagagagaatcgcagatcccttttgcagtgttctgtgtggcaggagtggatgctgagcctttgttacttcaacccaaagaattctgatgagcaaaagatcacagaaatggtttatgccatatttaggatcctactgtatcatgctgtgaagtatgaatgggggggctggagggtgtgggtggacaccttatccattactcactccaaggttacctttgaaattcataaggaaaatctggcgaacatctttcgggagcagcaaggaaaggtcgacgaggaaataggcctgtgctcaagtacctctgtccaagccgctagcgggatcaggcgcgacatcaacgtgtctgtaggttcccagcagcccgacacaaaagacagccctgtgtgtcctcacttcactactaacggcaatgaaaactcatcgattgaaaagacttccagcctggagtctgcgagcaatatcgaactgcagaccacaaacaccagctacgaggagatgaaggccgaacaggagaaccaggagcttcctgatgaagggaccctggaagagactctgaccaacgagactagaaacgcagacgacctcgaagtgagcagtgatatcattgaggcagtggccattagcagtaactcctttataacgacgggaaaggatagcatgacagtgagcgaggtgaccgcatctatttcaagcccatctgaggaggatgcctctgaaatgccagagtttctggacaaatccatcgttgaggaagaagaggatgatgattatgtagagttaaaggtggaggggagcccaaccgaggaggccaaccttccaaccgagctacaggacaactctttatcacctgccgcctctgaggccggggagaaactggatatgttcgggaacgacgataaactcatcttccaggagggcaagccggttacagaaaagcaaactgacacagaaactcaggattctaaggactctggtatacaaaccatgactgcttccggaagcagtgcgatgtcccctgagacgacagtgtcacagatagcggtcgaatccgatctgggccagatgcttgaggaaggaaagaaggccactaatcttacgcgcgaaactaaattgataaatgattgtcatgggagcgtcagcgaagccagcagcgaacagaaaattgctaaattagatgtgtcaaacgtcgctactgacacagagcgactcgagctaaaggcgagccctaatgtggaggcccctcagccacatagacatgtgttagaaatttcccgccaacacgagcaaccaggacagggcatcgcaccagatgccgtcaatgggcagaggcgtgactcacggagcaccgtgtttaggattcccgagtttaattggagccagatgcatcaaaggctcctcacagatctcctgttttccatcgaaaccgatatccagatgtggaggtcccacagcactaagacagtgatggactttgtgaactcatccgataatgtcattttcgttcacaataccatccatcttatcagccaggtcatggataatatggttatggcatgtggaggaatcctcccattgctgtcagcagcaacatcagccacgcacgagcttgaaaatattgagccaactcaggggctgagcatcgaggcttccgtgaccttccttcaaagactgatcagcctggttgacgtgctgatctttgcttcctcattaggattcactgagatcgaagctgagaagtccatgagcagtggaggtattctccgtcaatgccttaggcttgtgtgcgcagtggcagtgaggaattgcttggagtgccagcaacactcccagctgaaaacgagaggcgataaagccttaaaacccatgcactccctcatccctttggggaaatcggctgcaaagtcgcctgtcgatatcgtgacaggtggaatttcccctgttagggacctggaccgcctgctgcaggacatggatataaatcggcttcgtgctgttgtgtttcgagacatcgaggactcaaaacaagctcagttcctggccctggctgtcgtgtactttatcagcgtgcttatggtctctaagtatagagatattctagagccccagaacgagcggcactcccaatcctgtaccgaaacaggctctgagaacgaaaatgtgtctctgtccgagattacccctgcagcttttagcacactcacaacagcatcagtggaggaatccgagagcacgagttctgcacggagacgggatagtggtatcggggaggagaccgccacaggactaggttcacacgtcgaggtgactccacatacagcacctccaggggtttctgctgggcctgatgcgatcagcgaagtgttgtccaccctgtcactcgaagtcaataaatcccccgagaccaagaatgatagaggtaacgatttggacactaaagcgacaccttccgtatcggtgagtaagaatgttaacgtgaaggatattttgcggagtctggtgaatatacctgccgatggcgtcacagtcgaccccgccctgcttccacccgcctgcctaggggcactcggggatctctcagtggaacaacctgtgcaattcaggtcctttgatcgaagcgtgatcgtcgctgcaaaaaaatccgccgtgtctccatctacattcaacacctctatccctacgaacgccgtgagcgtggtgtcctctgtcgactcagctcaggcctcagatatgggcggcgaatcccccggttcccgcagctccaatgccaagctgccaagtgtcccaaccgtggactctgtaagccaggacccagtgtctaatatgagcattacagaaagactggagcacgcgctcgaaaaggctgcacccctcctgcgggagatatttgtcgactttgcaccgtttcttagtagaaccctgctgggctctcacgggcaggaacttcttatcgaagggacctcactggtgtgcatgaagtctagctcctccgtggtcgagttagtgatgctcctatgctctcaggagtggcagaattccatacagaaaaacgccgggctggcattcatcgagctggtcaacgaaggtcggctcttgtctcaaacaatgaaggatcacttggtacgcgttgccaatgaagctgagttcatactgtctaggcagagagcagaggatattcaccgccatgctgagtttgaatccctgtgtgcccagtactctgccgacaagagagaagacgagaagatgtgcgatcacctcatccgggccgcgaagtatcgtgaccatgtcaccgcgactcagctcatacagaagatcatcaatatcctaaccgacaagcacggggcatgggggaactctgccgtctcacggccgctagagttctggcggcttgactactgggaggacgatttgcggcgaagacgaagattcgtcaggaaccctctgggctcaacccaccccgaagccaccctgaaaaccgccgtggagcacgccaccgacgaagacattctagccaaggggaaacagtccattcgttcccaagcgcttgggaatcaaaatagcgaaaatgagatcctactcgagggagacgatgacacattgagctcagtcgatgaaaaagacctggagaacttagctggtcccgttagcctgagcactcctgcccaacttgtagcaccatctgttgtggtgaagggaacactttccgtcacctcctccgagctgtatttcgaagttgacgaagaggatccgaacttcaagaaaatcgaccctaagatattagcttacaccgaagggttacacggaaaatggcttttcacagagatcagatcgatttttagccgtaggtacttactacagaatacggctctcgaaattttcatggcaaacagggtagcagttatgttcaatttcccggatccagcaaccgtgaaaaaagtggtgaactacctgccgagggtgggcgtcggaacaagcttcgggcttccgcagacccgaagaatttcattggcctcaccccgccagctgttcaaggcttccaacatgacacagcggtggcagcaccgggagattagcaactttgagtacctcatgttccttaataccatcgcaggcagaagctataatgacttaaaccaatatcccgtgttcccctgggtgatcacgaattacgaatctgaggagcttgacctaaccctgccaaccaactttcgcgacctctccaaaccgatcggggccttgaatcccaaacgggctgccttcttcgctgagaggtacgaaagctgggaggacgatcaggtgcccaaattccactatggcacacactactctactgcttcattcgtgctagcctggcttcttcgtatcgaaccattcacaacgtacttcttgaatctacaggggggaaagtttgaccacgctgaccgtaccttcagcagcatcagtcgtgcctggaggaactcccagagagacaccagtgatattaaggagctgattcccgaattctactatctacctgagatgtttgtcaatttcaacaactataacctgggcgttatggatgacggtaccgtcgtgtccgacgtggagctcccaccttgggctaaaacatccgaagagttcgtacacatcaatcgcttggccctcgaatcagagttcgtgtcctgtcaactccatcagtggatcgatttgatcttcggatacaagcaacagggacccgaagctgtccgggccctgaatgtcttctactatctcacctatgaaggtgccgtgaacctgaacagtataactgaccccgtgctcagagaggccgtggaggctcagattcggtcctttggtcaaaccccttctcagttgctcatagaaccgcatcctcccagagggtccgctatgcaggttagtcccctcatgtttaccgacaaagcccagcaggatgtcatcatggtcctgaagttccccagcaacagtccagttacgcatgtagcagccaatacacagcctggcctggctacgcctgctgtgattacggtgactgctaaccgcctgtttgccgtgaacaaatggcacaatctacccgcgcatcagggggcggttcaggaccagccgtaccagttgcccgtggaaatcgacccattgatcgcctcgaatacaggcatgcacagacgacagatcacagatttgttggatcagtccattcaggtgcatagtcagtgctttgttataactagcgacaatcggtacattcttgtgtgtggattctgggacaaatccttcagggtttactccacggacacagggaggcttattcaggtggtgttcgggcactgggatgtggtgacctgcctggcccggtctgaatcatacatcggggggaactgctatatacttagcggctctcgcgacgctacccttctgctctggtactggaacggcaagtgctccgggatcggcgataacccgggcagcgagaccgcggcgcccagagccattctaactgggcatgactacgaggtcacatgcgcagcggtgtgcgcagagctgggccttgtgctttctggtagtcaggagggtccttgtctgattcatagcatgaacggcgacctgctgcgaaccctggaaggtccagaaaattgtctgaaaccaaagctgatacaggcgagtcgtgaggggcactgcgttattttttatgagaatgggctgttctgtactttttcagtaaatggaaagctgcaagccacaatggagacagacgacaatatcagagcaatccagctctccagagacgggcagtatctactcacgggaggtgacaggggtgtcgtcgtggttcggcaggtgagtgacctaaaacagctgtttgcatacccgggatgtgatgctggtatacgcgctatggccctttcctacgatcagcgctgtattatctccggcatggcttccggtagcattgtgctgttctacaacgattttaaccggtggcaccacgagtaccagacaagatattag

SEQ ID NO: 27167 - DNA, 717 bp, Artificial Sequence
  Description of Artificial Sequence: Synthetic coding sequence
atgctgggctccccatgtctgctctggcttctggccgtgaccttcttggtaccacgagcacagccactagccccacaagatttcgaggaagaggaggccgacgaaacagaaacggcctggccccccctcccggctgtgccctgcgattatgatcattgccggcatttgcaggttccttgcaaggagctgcagagggtgggccctgctgcctgtctctgcccaggcctgtcatccccggcacagcctcccgatcctcctagaatgggagaggtgagaatcgcggcggaagagggacgggccgttgttcattggtgcgccccgtttagccctgttttacactactggttactgttatgggacggcagtgaggccgcacagaagggaccaccgttgaatgcaacagtccggcgcgccgagctcaaaggcctgaagcccggcggaatttacgtcgtatgcgtggttgccgcgaatgaggccggagcctcgagggtgccacaggcaggcggcgaggggcttgaaggcgctgacatccctgccttcggcccttgcagtcggctcgccgtcccccctaacccacgcacactggtgcatgccgcggtcggcgttggaactgccctggcccttttatcgtgtgcagctctggtgtggcacttttgcctgagggatcggtggggatgtccccggagagctgcagcaagagctgccggcgccctgtag

SEQ ID NO: 27168 - DNA, 270 bp, Artificial Sequence
  Description of Artificial Sequence: Synthetic coding sequence
atgtgtcagaaggaagtcatggaacaatccgctggaattatgtatcgaaagtcatgtgccagcagcgctgcctgtctaatcgctagcgcagggtatcagagcttttgtagtcctggcaaactcaactcagtgtgcatctcttgctgcaacactccactgtgtaatgggccacggcccaagaagcgcggcagcagcgcctctgccttgcgcccagggctgaggactaccatcctctttctgaaactggccctcttctccgctcactgttag

SEQ ID NO: 27169 - DNA, 426 bp, Artificial Sequence
  Description of Artificial Sequence: Synthetic coding sequence
atgtgggtactcggaattgctgctaccttttgcggcttgttcctgctgcccgggttcgccttgcagatccaatgttaccagtgtgaagagttccagctaaataacgactgctcctcacctgagtttatagtgaattgtacggtcaacgttcaggacatgtgtcagaaggaagtgatggaacagtccgccggcatcatgtacaggaagagctgtgcctcctccgctgcgtgtctcatcgcatctgccggctatcagagtttctgctctcctgggaaacttaattctgtgtgcatttcctgctgcaatacccccctctgcaacggacctaggcccaagaaacgggggagcagcgcttccgctttgagacccggcctcagaacgacaatcctgttcttgaagctagcactcttttctgctcactgttag

SEQ ID NO: 27170 - DNA, 495 bp, Artificial Sequence
  Description of Artificial Sequence: Synthetic coding sequence
atgcaggctcctcgggcggcacctgcagcacccctcagctacgaccgcaggcctcgggatagcgggagaatgtgggttctcgggatcgccgccacattttgtgggctgttccttctccccgggtttgccctgcagatccagtgctaccagtgtgaggaatttcagctgaataatgattgttcctcccctgagttcatcgtgaactgtaccgtgaacgtgcaggatatgtgtcagaaggaggttatggagcagtccgccggaattatgtataggaagagctgcgccagcagtgccgcctgtctgatcgcatccgccggatatcagtcattctgctcacctggtaagttaaatagcgtgtgtatcagctgctgtaacacccctctgtgcaacggtccaaggcccaagaaaaggggctctagcgccagtgccctacgccccggcctgcggacaaccatccttttcctgaaacttgccttattttcagcacactgttag

SEQ ID NO: 27171 - DNA, 378 bp, Artificial Sequence
  Description of Artificial Sequence: Synthetic coding sequence
atgaggggtacgcggctggccctcctcgccctggtgctcgctgcttgtggggaactggcccccgccctacggtgttacgtttgcccggaacccacaggcgtgagcgattgcgtcacgatcgcaacatgtaccaccaatgagaccatgtgtaagactacactgtacagtcgagagattgtgtatcccttccaaggagatagcaccgttacaaaatcctgtgcaagcaaatgtaagccttcagacgtcgacggaatcgggcagaccctgccggtctcatgctgcaacacagagctatgcaatgtggacggagccccagcactcaattcattacattgcggggcactaaccctcctgcctctactgtccctgcgcctgtag

SEQ ID NO: 27172 - DNA, 741 bp, Artificial Sequence
  Description of Artificial Sequence: Synthetic coding sequence
atgggcccgcagcatctacgtctcgtacagctattttgtctgttgggagccattagcaccttgcccagagccggggccctgctctgttacgaagctacggctagccgtttccgcgcggtggcatttcataattggaagtggctgttaatgcgcaacatggtatgcaaattgcaggaggggtgtgaagagacactcgtgttcatcgaaaccggcacagcacggggcgtggtgggatttaaaggctgcagtagctcgagctcctatcctgctcagatctcctacctcgtgagtcccccgggcgtgtcgatcgccagttatagccgcgtgtgccgtagctacctttgcaataacctgaccaacctggaaccatttgtcaaactgaaagccagtacacctaagtccatcacatcagctagctgctcctgcccaacctgtgtcggagagcatatgaaggactgtctgccaaactttgtgaccaccaattcttgccccctagctgcctccacttgctatagctcaacactcaagttccaggccggttttttgaacacaacgtttctgctgatgggctgcgcaagggagcataaccagctgctagctgatttccaccatattgggtctatcaaagttaccgaggtgttgaacatcttagagaaatctcagatagtgggagccgcatcgagccggcaggatcccgcgtggggagtcgttctgggcttactgttcgcttttagggactag

SEQ ID NO: 27173 - DNA, 636 bp, Artificial Sequence
  Description of Artificial Sequence: Synthetic coding sequence
atgggcccccaacatttgagactcgtccagcttttctgtttactgggcgctatatcaaccctgcctaggatgtcctgtggagcggggtgttacaagacgcaaaaaggcacagccagaggtgtggttgggttcaaaggctgttcttcctccagctcatatccggcccaaatctcctatctggtgtcccctccaggcgtctcaatagccagttactcgagagtatgtagatcctatttatgcaacaatcttacaaaccttgaaccattcgttaaacttaaggccagtacgccaaagagtataacttcagcctcctgcagttgccccacatgtgttggggagcatatgaaagattgcctacccaattttgtgaccaccaatagctgtcccttagccgcctccacatgctactcatctacgctcaagtttcaggcaggttttcttaatacgacattcttgctgatgggatgcgctcgggagcacaatcagctgctggctgatttccaccacatcggatcgattaaagtgacagaagtcctcaatattctcgagaagagtcaaatcgtaggggctgcatcatccaggcaagatcccgcatggggcgtagtgttaggtcttctcttcgcatttagagactag

SEQ ID NO: 27174 - DNA, 756 bp, Artificial Sequence
  Description of Artificial Sequence: Synthetic coding sequence
atggctatgggtgttcctcgcgtgattcttttatgcttgttcggcgcggctctttgtctgacggggtcccaggccctacagtgctacagtttcgagcacacatattttgggccttttgacctccgggccatgaagctcccaagtatatcatgtccgcatgagtgctttgaagccatattatctctggacactgggtaccgtgctcccgtcacactagtgagaaaaggctgctggaccggacctccggctggacagacccagtctaatgctgatgcgctaccgccggattacagcgttgtacggggttgcaccaccgataagtgtaacgcccacttaatgactcacgatgcccttccaaacctgtctcaggcaccagaccctccaacattatccggtgcagagtgttacgcgtgcataggcgtccatcaggacgattgtgccattgggcgctcccgccgcgtgcaatgccatcaagatcagactgcatgtttccagggaaacggacggatgacagtgggcaacttttctgtgccggtgtacatccgtacttgtcatcggccgtcttgcaccaccgaaggcaccacctctccatggactgcaatcgacctgcagggaagctgctgcgaagggtatttgtgtaatagaaaaagcatgacccaaccttttacctccgcaagtgctaccacccctccacgagctctccaggtactcgctctgctccttccagttttgcttcttgtggggctaagcgcatag

SEQ ID NO: 27175 - DNA, 627 bp, Artificial Sequence
  Description of Artificial Sequence: Synthetic coding sequence
atgaaactccccagtatttcgtgtccccatgaatgcttcgaggccatcctgagcctcgacacgggttatcgagcaccagtaacacttgttaggaaaggttgttggactggaccaccggcaggacagacgcagtccaatgcggacgcactccctcccgactatagtgtggtgcgcggatgcaccacagataaatgtaatgcacacttgatgacccatgacgctctgcccaatctgagccaggcgcctgatcctcctaccctcagcggagcagagtgctacgcgtgtattggagtgcatcaggatgattgtgctatcgggaggtctcggcgtgtacagtgtcatcaggatcagacagcgtgtttccagggaaatggtcggatgaccgttggtaatttttccgtgccagtgtatatcagaacttgtcataggccctcctgtacgaccgagggcactacttcgccttggactgcaattgacctccagggtagctgctgcgagggctacttgtgtaaccgcaagagtatgacccaacctttcacttccgccagcgcaacgaccccaccccgcgctctgcaggtgctcgcccttctgctgcccgtgctgctactagttggcttgagtgcatag

SEQ ID NO: 27176 - DNA, 624 bp, Artificial Sequence
  Description of Artificial Sequence: Synthetic coding sequence
atgcggctgattacactgagcgcaaacttgtttactgtgcctgagagaagcctgacaactactttttcttttagcaggtataagtccagtgacagacccgcgcacaaagtcagcatgctgctactctgtcatgctcttgcgatcgcagtggtgcagattgtaatcttttctgaaagctgggcatttgcgaaaaatatcaacttttacaatgtgcgtcccccactcgatcccaccccatttcctaatagcttcaagtgctttacatgtgaaaatgctggcgataactataattgtaacaggtgggctgaagataagtggtgccctcagaacacccagtactgtctcacagtgcatcactttacgagtcacgggagaagcactagtataacaaaaaagtgcgcaagcagatctgagtgccactttgtcggatgtcaccactcacgcgattccgaacataccgagtgtcgttcgtgttgtgaagggatgatttgcaatgtggaactgcccaccaatcataccaatgccgtcttcgctgtgatgcacgcacagcgaacttcagggtcttcggccccgactttatacctccccgtcttagcttgggtgtttgtactacctctgctctag

SEQ ID NO: 27177 - DNA, 552 bp, Artificial Sequence
  Description of Artificial Sequence: Synthetic coding sequence
atgctgtacaagtcctcggacaggccagcgcacaaagtttctatgttgctgctctgtcacgcgctggcaattgcagtggtgcagatcgtgatcttctcagagtcctgggcattcgctaaaaacattaacttctataacgtgcgacctccactcgatccaacaccattccctaatagttttaagtgcttcacatgtgagaacgctggagacaactacaactgcaacagatgggctgaggataagtggtgcccgcagaacactcagtactgcctcaccgtccaccacttcacctcccacgggcgatctacatctattacgaaaaagtgcgcatcgcgctctgagtgccactttgttggttgtcatcacagccgcgattctgaacacactgaatgccgctcctgttgtgaaggcatgatttgcaatgtggaactgccgactaaccataccaacgccgtgtttgctgttatgcacgcccagcgaacaagtggaagctcagccccaactctgtacttgcctgtgcttgcctgggtgttcgtactccctttgttgtag

SEQ ID NO: 27178 - DNA, 624 bp, Artificial Sequence
  Description of Artificial Sequence: Synthetic coding sequence
atgttgctcattactttgtcagccaatctgttcacagtacctgaacgcagcctcacaaccacctttagttttagccgctacaaatcttctgatagaccagcccacaaagtgtcaatgttgctgttatgtcacgccctggccattgcagtggtacagatagtgatcttttcagagtcgtgggccttcgctaaaaatataaacttttataacgtgcggccacccctggatcctacaccgttccctaattcttttaagtgttttacatgcgagaatgccggcgataactataactgcaaccgatgggctgaggataagtggtgtccacagaacacccagtattgcttaacagttcaccactttaccagccacggtcgctccacctccattactaagaagtgtgcctcccgcagcgaatgtcactttgtagggtgccatcactctcgcgattcagagcatacagagtgccggagttgttgcgaagggatgatctgcaacgtagagcttcctacaaaccacaccaatgccgttttcgctgtaatgcacgcccagaggacctcggggtcttccgcccctactctgtatttgccagtcttggcctgggtgttcgttcttccccttctatag

SEQ ID NO: 27179 - DNA, 552 bp, Artificial Sequence
  Description of Artificial Sequence: Synthetic coding sequence
atgctctacaagtcatccgatcggccagcccacaaagtgtccatgctgctactttgccatgccttagccattgctgtcgtgcagatcgtgatttttagtgagtcttgggccttcgcaaagaacatcaacttctataatgtccgccctccactggaccctaccccattccctaactcattcaaatgtttcacttgcgaaaacgctggagacaactacaattgcaatcgctgggcagaagacaagtggtgcccacagaacacccaatactgtttgaccgtgcatcattttacgagtcacggcaggagcacttcaatcacgaagaagtgcgcgtcccggagtgaatgccactttgttggctgtcatcattcccgcgattcagagcacaccgagtgtaggagctgctgcgagggcatgatatgcaatgtcgaactcccaactaatcacacaaacgcggtatttgccgttatgcacgcccagcggacttccggctcctctgcgccaaccctgtacctccccgtgcttgcctgggtgtttgtgctccctctgctatag

SEQ ID NO: 27180 - DNA, 378 bp, Artificial Sequence
  Description of Artificial Sequence: Synthetic coding sequence
atgaaagccctgatgctgctgaccctgagcgtgctgctgtgttgggtctctgctgacatccgctgccactcttgctacaaggtgcctgttcttggatgtgtggacagacagagctgccgcctggaaccaggccagcagtgcctgaccactcatgcatacctcgggaagatgtgggttttctcgaatctgagatgcggcacaccggaagagccttgtcaagaggccttcaaccagactaatcggaagctgggactgacatacaacactacgtgttgtaataaggataactgcaacagtgccggtccaaggcctacacccgcgctggggctggtatttctgacatcattagcaggtttgggattgtggcttctgcactag

SEQ ID NO: 27181 - DNA, 378 bp, Artificial Sequence
  Description of Artificial Sequence: Synthetic coding sequence
atgaaagcactgatgctcttaaccttgtctgtgctgctgtgctgggtctctgcagatatccgatgtcacagttgttataaggtaccagtccttggttgtgtagatcgccagtcctgtcggctagagcctgggcagcagtgcctgacaacccacgcctatctgggcaagatgtgggtcttttccaatctaaggtgcggcacccccgaagaaccttgccaggaagcatttaatcagaccaaccggaagctggggttgacttacaatacaacctgctgcaacaaggacaattgtaacagcgccggccccaggcccactcccgcactcggtctggtgttccttacatctctcgctgggttgggcctgtggctgctgcattag

SEQ ID NO: 27182 - DNA, 378 bp, Artificial Sequence
  Description of Artificial Sequence: Synthetic coding sequence
atgaaagccctcatgctgctgacactgagcgtgctgctctgttgggttagcgccgacatcagatgtcattcatgctacaaagtccccgtgctgggatgcgttgatcgacagtcttgccgcctggagcctgggcagcagtgtcttacgacccatgcctatttggggaagatgtgggtcttctcgaacttacggtgtggaacaccggaggagccttgccaggaggccttcaaccagaccaataggaagctcggtttaacctacaacaccacctgctgcaataaagataactgtaactccgctgggcctcggccaacaccggccctaggactcgtctttctgacctctttggccggcttgggactgtggttactgcattag

SEQ ID NO: 27183 - DNA, 378 bp, Artificial Sequence
  Description of Artificial Sequence: Synthetic coding sequence
atgaaggcactcatgctcctaacattgagtgtcctcttgtgttgggtcagtgccgatatacgttgccactcctgttacaaagtgccggtgcttggctgcgtcgaccgccagtcttgccgtctcgagcctgggcagcagtgtctaactacccatgcttatctggggaaaatgtgggtcttcagcaatctgcgatgtggcacaccggaggaaccgtgccaagaagcctttaaccaaactaatcgcaaattagggttgacctataatacgacttgctgtaacaaagataactgcaattctgcgggccctagaccaactccggccctcggcctggtgttcctgacatccctggcagggctcgggctatggttacttcactag

SEQ ID NO: 27184 - DNA, 378 bp, Artificial Sequence
  Description of Artificial Sequence: Synthetic coding sequence
atgaaggctcttatgctcctgactctcagcgtgctcttgtgctgggtgagcgctgatattcgctgccacagttgttataaagtgccagtgctcgggtgtgtggatcggcagtcgtgtagattggagccaggacagcaatgtttaactacccacgcgtacctggggaagatgtgggtgttttctaacctgcgatgtggcacaccagaagaaccttgccaggaggcgtttaatcagacaaatcggaagttaggcctcacatataatacgacttgttgtaacaaggacaactgtaactctgctggtccacgtccaacccctgcattgggcctcgtttttctcacaagcctcgccgggctcgggttatggctgctgcactag

SEQ ID NO: 27185 - DNA, 378 bp, Artificial Sequence
  Description of Artificial Sequence: Synthetic coding sequence
atgaaagccctgatgctgttgaccctatccgtgcttctttgctgggtttccgccgacataaggtgccattcttgttacaaggttcctgtccttggctgcgtagataggcagtcttgcagactcgagcccggacagcaatgtctaaccactcatgcttatctgggcaaaatgtgggtgttttccaatctgagatgcggcacccctgaagagccgtgccaggaggcatttaaccagaccaatagaaaactggggctgacgtacaacacaacttgttgtaacaaggataactgcaatagtgcagggcctcggcccacacccgctctgggtctggtgttcctgacctctttagccggacttgggctgtggctactccactag

SEQ ID NO: 27186 - DNA, 378 bp, Artificial Sequence
  Description of Artificial Sequence: Synthetic coding sequence
atgaaggcgctgatgctgctgactctttctgtcttattatgctgggtgtcagccgacattaggtgccattcctgctacaaggttcccgttttggggtgtgtcgaccgccagagctgccgtctcgagcctggacagcagtgcctgaccacacacgcttatttgggcaagatgtgggtgttcagtaacctccgatgcgggacacctgaggagccttgccaggaggctttcaatcagactaatcggaagctgggtctgacctataacaccacgtgctgcaacaaggataattgtaattctgctggcccaagacctactcctgccctgggtttggtgttcctgacatctttggcagggctgggcctgtggctgctgcattag

SEQ ID NO: 27187 - DNA, 210 bp, Artificial Sequence
  Description of Artificial Sequence: Synthetic coding sequence
atgtgggtgttttctaatctgcggtgtgggactccagaagagccatgtcaagaggccttcaatcagacaaataggaaacttggcctgacttacaataccacttgctgcaacaaggataactgtaacagcgcgggtccacggccaacccctgccctgggcttagtgttccttacctctctagctggattgggcctctggctgctgcattag

SEQ ID NO: 27188 - DNA, 210 bp, Artificial Sequence
  Description of Artificial Sequence: Synthetic coding sequence
atgtgggtgttttctaatctccgttgcggcacccccgaagagccttgccaagaggcgttcaaccagaccaaccgcaagctcgggctgacctacaatacaacttgttgtaataaagataactgtaactccgctggacctagacctaccccagcactgggcctcgttttcttgactagcctcgcaggcctagggctgtggttgctacactag

SEQ ID NO: 27189 - DNA, 894 bp, Artificial Sequence
  Description of Artificial Sequence: Synthetic coding sequence
atggcggtgctgtttcttctgttgtttctttgcggaacccctcaagccgctgataatatgcaggccatctacgtcgctctgggcgaagctgtggagctgccgtgcccaagcccacctactctgcacggcgacgagcatttgagctggttctgttcccctgctgccggttcatttacgacattggttgcccaggtacaggtgggcaggcccgctcccgatccaggaaaacctggtcgcgagagcagacttcggttactgggcaattacagcctgtggttggagggtagcaaggaggaggatgccggtagatactggtgcgccgtgttggggcagcatcacaattaccagaactggagggtatacgacgtgctcgtcttgaaggggtcccagttgagtgccagggccgccgatggaagcccctgtaatgtcctgctgtgctctgtcgtgcccagccgaaggatggacagtgtcacatggcaggagggaaagggaccggtcagaggcagagtccaatctttctggggcagcgaagccgccctgttattggtgtgccccggagagggtcttagcgagccacgaagtcgtaggcccaggattatccgttgcctcatgacccacaataaaggcgtctcattcagtcttgccgccagcattgacgcttctcctgccctctgtgcaccgagtactgggtgggatatgccctggatactgatgctgttgctcaccatgggacagggcgtcgttattttagccctctcaatcgttctgtggcgccagagagtcaggggagcacctggtcgggacgcttcaataccccaattcaagcccgaaatccaagtttacgagaacatacatctcgccaggctcgggccacccgcgcacaaacccaggtag

SEQ ID NO: 27190 - DNA, 894 bp, Artificial Sequence
  Description of Artificial Sequence: Synthetic coding sequence
atggccgtgcttttcctcttacttttcctgtgtgggacaccacaagcagcagacaacatgcaggccatctacgtcgccctcggcgaggccgtcgagttgccttgcccctcgcctcccaccttacacggagacgaacacctgtcctggttttgttcccccgccgcgggctccttcaccacccttgttgcacaggttcaagtagggcgccccgcaccagatcccggtaaaccgggaagggagtcaaggctccgtttactgggcaattacagtttgtggttagagggcagtaaggaggaggatgccggaagatattggtgtgcagtactgggtcagcatcataactaccagaactggagggtgtatgacgttctggtgctcaaggggagccagctctctgccagggcagccgatggatctccatgcaatgtcctcctttgcagcgttgtgccctcccgaaggatggattcagtgacatggcaggaaggcaaaggcccagtgagaggacgggtacagtcgttttggggaagcgaggcagctctcctgttggtgtgcccgggggaaggtctttctgagccccggtctcggaggccgagaatcattcgctgcctgatgactcataacaaaggagtgagttttagtctcgcggcatctatcgacgcatcaccagcgttgtgcgcaccctccactgggtgggatatgccatggatactgatgctccttctgactatggggcagggcgtggtcatcctggcactgtcaatagtattgtggaggcaacgggtaagaggagctccaggacgagatgcatctattccccagtttaagccagagatacaggtatatgagaatatccatcttgcccgacttggccccccagctcacaagccccggtag

SEQ ID NO: 27191 - DNA, 894 bp, Artificial Sequence
  Description of Artificial Sequence: Synthetic coding sequence
atggcggtactgtttctcctcctctttctgtgtggaaccccacaggccgctgacaatatgcaggcaatctacgtggccctgggggaggccgtggaactcccatgtccatcccctccgacattacatggggacgagcacctctcatggttctgcagccccgctgccggctcctttaccacactggtggcccaggtgcaggtgggcaggcctgctcccgacccagggaaaccaggaagggagtctcgattgcgtctcctggggaattactcgctctggctggaaggatctaaagaggaagatgcgggtaggtactggtgcgctgtactggggcaacatcacaattaccaaaattggagggtgtatgacgttctcgttctcaagggctctcagctcagtgcgagagctgctgatggtagcccatgcaatgttcttctgtgctctgtggtgccttcccggcgtatggattcagttacttggcaagagggcaagggaccagtgcgtgggcgcgttcagtcgttttggggatccgaggccgctctcttgttggtatgcccgggtgagggactctccgagccccgatctaggcgtccacggattatccgctgtctgatgacccacaacaagggagtctctttctctctggcggcatcaatcgatgcaagccccgccctgtgtgcacccagcaccggatgggacatgccgtggatcctgatgcttctgctgacgatggggcaaggggtcgtcattctggctctaagtattgtcctctggcggcagcgcgtgagaggcgctccggggcgggacgcaagtatcccgcagtttaaacccgagatccaggtgtatgaaaacatccatctcgcaagactgggacctccagcccacaaaccgcggtag

SEQ ID NO: 27192 - DNA, 894 bp, Artificial Sequence
  Description of Artificial Sequence: Synthetic coding sequence
atggcagtattgtttctgctgctgttcctgtgcggaacgccccaggccgccgataatatgcaggcaatctatgtggcattgggtgaggcggtggaacttccatgtccgtccccaccaaccctccacggtgacgagcacttgtcatggttctgcagtcctgccgccgggagcttcacgactctagtggcgcaggttcaggttggacgcccagcccccgatcctggtaaaccgggtagggagtcgcggctccggttgctgggcaactacagcctatggctggaagggagtaaggaggaggatgccgggcgctactggtgtgcggtgcttgggcaacaccataactaccagaattggagagtttacgatgtgctggtactaaaaggctctcagctctccgcacgtgcagcggatggcagcccctgcaacgtcttgctgtgttcagtggtgccttcccggagaatggattcagtcacgtggcaggaaggcaaaggccccgtgcggggtagagtccagtcattttggggaagcgaggcagccttactgctggtctgtcccggcgagggactgagtgaaccccgctcccgaagaccaaggataattcgttgcctaatgacccataataagggagtgtctttttcactggcagcctccatcgacgctagtccggcgttgtgtgctccttctaccggctgggatatgccatggatattgatgctgctgctgactatggggcagggagtggtaatcctggcgctgagtattgtgttgtggagacaacgcgttcggggtgcgcctggaagggatgcttccatccctcaatttaaacccgagatccaggtgtacgagaacattcaccttgcccggctaggtccccctgcacacaagccccgatag

SEQ ID NO: 27193 - DNA, 894 bp, Artificial Sequence
  Description of Artificial Sequence: Synthetic coding sequence
atggcagttctatttctgctcctgttcctgtgtggaactccacaagcagccgacaatatgcaggctatttacgtggccctcggagaggcagtggagttaccttgtccaagtccaccaacacttcacggagacgagcacctctcctggttctgtagcccagctgccggatcattcactactcttgtggcgcaggtgcaggtcggtagacctgcgcctgatcctggaaagcctggacgcgagtcgcggctcaggctgctaggtaactattccctgtggctcgagggcagcaaggaagaagacgctggaaggtattggtgcgcagtcctcgggcagcaccacaattaccaaaattggcgggtgtacgatgtcctcgttctcaagggatctcaactgtccgctcgcgcagctgatggctctccgtgcaacgttctgttgtgttccgttgtgccaagccgtcgcatggacagcgtcacctggcaagaagggaagggtccagttagggggagagtccagagtttttggggatcagaagccgcactgctcctggtttgccccggggaaggattgagcgagcccaggtctagaaggccaaggataattagatgcctgatgactcataacaaaggagtgagcttttctctggctgctagcattgacgcttcccccgctttatgcgccccatccaccggatgggacatgccatggatattaatgcttttgcttaccatggggcaaggagtggttatcttggccctgtccatagtcctctggcgtcagcgcgttaggggggcaccaggacgtgacgctagtattccccaatttaagcccgaaattcaggtctacgagaacattcacctggccaggctggggccgcccgcccacaaaccaagatag

SEQ ID NO: 27194 - DNA, 1149 bp, Artificial Sequence
  Description of Artificial Sequence: Synthetic coding sequence
atggccgtgctcttccttttattattcctgtgtggtacacctcaggccgccgacaacatgcaggccatctacgtggccctaggtgaggctgtggagttgccttgtccaagtccacccacacttcatggagacgagcacctcagttggttctgttcacctgcagcgggctcctttaccacattggttgctcaagtgcaagtggggcgcccagcgcctgatccagggaaacccggcagagagtcaagattgagactgctgggcaactactctctgtggctagaggggtcaaaggaagaagatgccgggaggtattggtgtgccgtcttgggacaacaccataactaccagaactggagggtctacgatgtcctcgttttgaaggggtcccagctgtccgcacgagccgcggacggctctccctgcaacgtcctgctgtgcagtgttgtcccctcaaggcgcatggactctgttacgtggcaggaaggcaaagggcctgtcaggggtagagttcagtccttttggggaagtgaagcagccctgttgctggtgtgccctggcgagggcctttccgagcccagaagcagacgtcccaggataatccggtgtcttatgacccacaacaaaggagtctcattctccctcgccgcttccattgacgcctcccccgctctctgcgccccttccaccggctgggacatgccatggatccttatgttgttgctcacaatgggacaaggagtcgtgatcctcgcactttcaatcgtgctctggaggcagcgcgtccgcggagcacccggtaggggcaacaggatgaggtgttataactgcggaggctctcctagcagctcctgcaaggaagctgtaaccacgtgcggcgaaggacgaccacagccaggactggagcagatcaagctgcctggcaatccgcccgttacactcatccaccagcatcccgcttgcgtagccgcacatcactgcaatcaagtggaaactgaatcggttggcgatgtgacttatcctgcacatcgggattgttaccttggagatctgtgtaactccgcagtggccagccatgtggccccagcaggaatcctcgccgccgccgcgaccgcgttgacctgtctcctccctgggttgtggtctgggtag

SEQ ID NO: 27195 - DNA, 1149 bp, Artificial Sequence
  Description of Artificial Sequence: Synthetic coding sequence
atggccgtcctgttcctcctgctattcttgtgtggaaccccgcaggctgctgacaatatgcaggccatctatgtcgctctcggcgaggccgtggagctgccatgcccctctccccccaccctgcatggtgatgagcacctgagctggttttgctcccctgccgcagggtccttcaccaccctagtagctcaggtgcaggttggtagacctgcaccagacccggggaaaccgggtagggagagtaggctcagactgctcggaaattattccttgtggctggaggggtcaaaagaagaggacgccggcagatactggtgtgccgtgctaggtcaacaccataattaccagaactggcgtgtgtatgacgtgcttgtgctgaaaggctcccagctctctgcaagggccgccgatgggagtccatgcaatgtcctactgtgctccgttgtacctagcagaagaatggattccgttacgtggcaagaagggaaagggccagtaagaggtcgggtacagtctttctggggctctgaagctgctttactgctagtgtgtcctggagagggtctgagcgagcctcggtcccgtcgtccaaggatcattaggtgcctgatgacacacaataagggagtttctttttcattggcagcttctatagacgcatcacccgcgctgtgtgccccgtcaacaggctgggatatgccgtggattttgatgctcctactgaccatggggcaaggtgtcgtgattctagccctgagtatagtcctttggcggcagagggttagaggggcccccggtcgcggcaatcggatgagatgctataactgcggagggtcgcccagctcctcatgtaaagaagctgtcaccacgtgcggggagggaaggccacaacctgggcttgagcaaataaagctgccaggaaatcctcccgtgacacttatccatcaacacccagcgtgcgttgcagctcatcattgtaatcaggtcgagactgaatctgtcggcgatgtgacataccccgcacacagggactgctatcttggggatttgtgtaactccgccgtcgccagtcacgtggcccctgcggggatcctggctgccgccgcaactgcgctgacctgcctgctgcctgggctttggtctgggtag

SEQ ID NO: 27196 - DNA, 1149 bp, Artificial Sequence
  Description of Artificial Sequence: Synthetic coding sequence
atggccgtattgtttctgcttctctttctctgtggaactcctcaggcagctgataatatgcaggcaatatacgtcgcactcggggaggcagtggagttgccttgcccctctccccccacgctgcacggagacgagcatctgagttggttctgctctcctgccgccggcagctttacaacattggttgctcaagtccaggttgggcgacctgcccctgaccccggcaaaccggggcgcgaatcccgactgaggcttctcggcaactatagcctgtggttggagggtagcaaggaggaagatgcaggacgatattggtgcgccgttctgggccagcaccacaattatcagaattggcgcgtctacgatgtgttagtgctgaagggttcccaactgagcgcccgagctgcagatggaagcccgtgtaacgtgctgctgtgttccgtggtacccagccggcgtatggactccgttacttggcaggaaggcaaggggcccgtgaggggccgggtgcagtctttttgggggtcagaagctgctctccttcttgtgtgtcccggcgagggcttgagcgagccacgctcccggagaccaagaataatcaggtgcctcatgacacataataagggggtgagtttttctttggcagctagtattgatgctagccctgccctatgcgctccgtccaccggctgggatatgccctggatactcatgctgttgcttactatgggacagggggtcgtaatccttgccctatcaatcgtgctctggcgtcaacgcgtacggggggcgcctggaagggggaatcgcatgcgatgttataactgtgggggctccccgagttcaagttgtaaggaggccgtgacgacatgtggcgagggccgtccacaacccggcctagagcagattaaattgccaggaaatcctcccgtgacgctgattcaccaacacccagcgtgtgtcgcagcacatcattgcaatcaggtggaaacggaatccgtgggggatgttacctatccggcccacagggactgttaccttggagacttgtgcaactcagcagttgcgtcccatgtggctcctgccggaatcctcgccgccgctgccacagccctgacttgtctactccctggactctggtctggttag

SEQ ID NO: 27197 - DNA, 5169 bp, Artificial Sequence
  Description of Artificial Sequence: Synthetic coding sequence
atgcggactggctgggcaacacctagaaggcccgccgggctccttatgctgctgttctggttcttcgatttggccgaaccaagtggtagagcagcaaatgatccttttaccatcgtccacggcaacacaggcaaatgcattaaacccgtctacggatggatcgtcgccgacgattgcgatgaaaccgaggacaagctttggaagtgggtttcccagcatagattgttccatctgcattcacagaagtgccttggtctggacattacgaaatctgtcaatgagctgaggatgttctcatgcgattcttctgccatgctatggtggaagtgtgagcaccactccctttacggtgccgcgaggtaccgcctggctcttaaagacggacatgggacggctattagtaatgctagtgatgtttggaagaaagggggcagcgaagaaagtttatgtgaccagccatatcatgagatctacactagagatgggaattcatatggacggccctgtgagtttccttttctgatcgatggtacatggcaccacgactgcatcctggatgaggatcactcaggaccctggtgcgccactactctcaattatgaatatgatagaaagtggggtatctgcttgaagccagagaacggatgcgaggataactgggagaagaacgagcagttcgggtcttgctatcagttcaacacacagacagcccttagctggaaagaggcctacgtgtcctgccaaaatcagggcgccgatttgttaagcatcaattccgcggcagagctcacatacctgaaagaaaaggagggtattgcaaagatcttctggatagggctgaatcagctttactctgcccggggctgggagtggtcagatcataagcctctcaatttcctcaattgggaccctgataggccctccgcccctaccatcggtggctcctcttgcgcgcggatggacgcggaatcaggcttatggcagtctttcagctgtgaggcacagttaccgtatgtgtgtcggaaacccctcaataacacagtagaactaaccgacgtgtggacgtattcagataccagatgcgacgctggctggcttcctaacaacggcttctgctacctgctggtgaacgagtccaacagttgggacaaggcacatgccaaatgcaaggccttctcctctgacttgattagcatccacagtctcgcagatgtggaagtggtagtgaccaagttgcacaatgaagacattaaagaagaggtgtggatcggccttaaaaatattaatattcccaccttatttcagtggtctgacggaaccgaggttacactgacatactgggatgagaacgagcctaatgttccatacaacaaaacaccaaattgtgtgtcatacctgggcgagcttgggcaatggaaggtccagtcctgtgaggagaaactgaagtatgtgtgtaaaaggaagggcgagaagctgaacgatgcgagttctgacaaaatgtgcccccctgacgaaggctggaaacgtcatggggagacctgctacaagatatatgaagatgaggtaccctttggcacaaattgcaacctaaccatcaccagtaggtttgagcaggaatatctcaatgacctcatgaaaaagtacgacaaaagtcttaggaaatatttttggacaggcttaagggatgtggactcttgcggcgagtacaactgggccaccgttgggggccggcgccgggccgtgaccttttccaactggaatttcttagaaccggcttccccagggggttgtgtggccatgtctacaggaaaaagtgtaggaaagtgggaagtaaaggactgtaggagcttcaaagccttaagcatctgcaaaaagatgtctggacctctcgggcccgaggaggcttcacctaagcccgacgatccatgcccagaaggatggcagagctttcccgcctcactgagttgttacaaggtctttcacgctgaacggatcgttcggaagagaaactgggaggaagcggagaggttctgtcaagccctcggggcccacttatcttccttctcccatgtggacgaaataaaagaattccttcactttttaacagaccagttctccggacaacactggctgtggatcgggctaaacaagaggagccccgacctccagggctcttggcagtggagcgacagaacccctgtcagcaccataatcatgccaaacgagttccaacaggattacgatattcgcgattgcgccgccgtgaaggtttttcacagaccttggcggaggggatggcatttttacgatgacagggaatttatttacctgaggccgtttgcttgcgatactaaattggaatgggtgtgtcagatcccaaaaggccgcactcccaaaactccagactggtataatcccgaccgcgcggggattcacggcccgcctttgatcattgaaggatcggagtactggttcgtggccgatctgcatttgaactacgaggaggccgtgctctactgtgccagcaatcattcctttctggccaccataaccagttttgttggcctaaaagccattaaaaacaagatcgcaaacattagcggagatggtcaaaagtggtggattcggatctccgagtggccaatcgatgaccatttcacttactcaagatacccctggcaccggtttcccgttacttttggggaagaatgtctgtacatgtcggcgaagacttggttaattgacctgggcaaacctaccgactgctctacaaagctgccattcatctgtgagaagtacaacgtgagctctcttgaaaaatactcacccgatagcgctgccaaggtgcagtgcagtgaacagtggatcccttttcagaataagtgctttctgaaaatcaagccagttagtcttaccttctcacaggcctccgacacttgccactcgtacgggggtacactaccaagtgtgttgtcccagatcgagcaggacttcatcacttcgctgctccccgacatggaggcaactctgtggattggtcttcgctggactgcctacgaaaaaatcaacaagtggacggacaacagagaactgacttacagcaatttccacccgctgcttgtttctgggaggctgcggatccccgagaacttctttgaagaagagagtcgttaccattgcgccctgatacttaatttgcaaaaaagcccttttacgggcacatggaactttacgtcttgtagcgaaagacacttcgtgtccttatgtcagaagtattctgaggtgaaaagccgccagacattacaaaatgcttcagaaacggtcaagtacctcaataatttgtacaaaattattcccaaaaccctgacctggcactccgccaaaagagagtgtctgaagagcaacatgcaactggtttctataacagatccataccagcaggcattcctgagtgttcaggcgctgttgcacaattcctctttgtggatcgggctcttttcgcaggacgacgagctcaacttcggatggagcgatggaaagcgactccatttttcaagatgggccgagaccaacggacagttggaagattgcgttgtgttggatacggatggtttctggaaaaccgttgattgcaacgataatcagccaggagcaatctgctactacagcggcaacgagactgagaaagaggtgaagccagtggattccgtaaagtgcccctccccggttttaaacaccccatggatcccctttcagaattgctgttacaatttcataattaccaagaaccgccacatggcaaccacacaggacgaggtccataccaaatgccaaaaactcaacccgaagagccatatcctctctatccgcgatgagaaggagaataatttcgtccttgaacagcttctgtactttaattatatggcatcgtgggtgatgctcggcattacgtaccggaataaaagtctaatgtggtttgataagacaccgctgagttatactcattggagagccggacggcctacaatcaagaatgagaagttcctagcaggactgtccaccgacggcttctgggacatccagacattcaaagtaatagaagaggcggtttattttcaccaacacagtatcttggcatgtaaaatcgagatggtcgattacaaagaggaatataacacgactctgccccagtttatgccttacgaggatggaatctactcagtgatacaaaagaaagtcacatggtacgaggccttaaacatgtgctctcagagcgggggacacttggcaagcgtgcataaccagaacggtcaactcttccttgaagacatcgtgaaaagagatggttttcctttgtgggtgggactaagcagccatgacggaagcgaaagctctttcgagtggtctgatggcagtacattcgattacatcccatggaaagggcaaacctcacccggcaattgcgtcctgttagatccgaagggaacctggaagcacgagaagtgtaacagtgtcaaggacggcgcgatctgttataaacccactaagagcaaaaaactctctcgcctgacctacagctctagatgcccggctgccaaagagaatggatctagatggatacagtacaaaggacattgctacaagtctgatcaggcactccactccttctcagaagccaaaaaattgtgctccaagcatgatcactccgccactatagttagcatcaaggacgaggatgagaacaagttcgtgtcgcgcctcatgcgggaaaataacaatattaccatgcgcgtttggctgggtctctcacagcattcagttgaccaaagttggtcatggctggatggcagtgaggtgacatttgtgaagtgggagaacaagtctaagagcggcgtggggagatgcagcatgcttattgcatcgaacgagacatggaagaaggttgagtgcgaacatggttttggtcgagtggtttgcaaggtgccactcggtccggactacaccgccattgcaataatagtagcgaccttgagtatcttggtcctcatgggcggactgatctggtttcttttccaacggcaccgcctacacctcgccggcttttctagcgtccgttatgcacagggcgtcaatgaagacgaaatcatgctgccttccttccacgattag

SEQ ID NO: 27198 - DNA, 5454 bp, Artificial Sequence
  Description of Artificial Sequence: Synthetic coding sequence
atgcgcaccggatgggccacccccagaaggcctgccggtctccttatgctccttttctggttcttcgatctggcagaaccttctggacgagcggctaacgatccttttactatagtgcacggtaacacgggcaagtgcataaaacctgtgtacggatggatagtggccgacgattgcgatgaaacggaggacaaactgtggaagtgggtttcccagcatagactgttccaccttcatagccaaaaatgtttgggcctggatataaccaaatcagtaaacgagctccgaatgtttagctgcgactccagtgccatgctatggtggaagtgcgagcaccactctttatacggggcggctcgttatagactggccttaaaagacggccacggcacagccatttctaacgcctccgacgtctggaagaaagggggaagcgaagaatctctctgcgaccagccctaccatgaaatatatacccgtgatgggaacagctatggcagaccctgcgagtttccattcctaattgacggtacatggcatcacgactgtatactcgatgaggaccactcaggtccttggtgcgcaacaacacttaattatgaatacgatcgcaagtggggtatttgcctgaaacccgagaacgggtgcgaagacaattgggaaaagaatgaacagttcggatcttgctaccagtttaacactcagacagccctgagctggaaagaggcatatgtgtcctgtcagaaccagggcgctgatctgctatcaatcaactctgccgctgagctcacgtacttgaaagagaaggagggtatcgctaagatattctggatcggcttgaaccaattgtactcggcaaggggatgggagtggagcgaccataaacctctcaacttcctgaattgggacccagataggccttccgccccaacaattggggggagtagttgcgctaggatggatgccgagagtggtttatggcagagcttttcctgcgaggcgcagctgccctacgtttgccgcaagccactcaacaacacggtcgagctcacggacgtatggacttactctgatacccgttgtgacgccggatggctgccaaacaatgggttctgctatctcttagtgaacgaatctaactcttgggataaagcccatgccaagtgtaaggcgttttcatcagacttaatttctatccacagcctggccgacgtggaggtagtcgtcacaaaactacataatgaggatataaaggaggaggtttggataggcttaaaaaatatcaacattcctaccctctttcagtggtctgatggcacggaagtgactctgacatattgggacgagaacgagcccaatgtgccatataacaaaaccccgaactgcgtgtcttacctaggagaactgggccagtggaaagtgcagtcctgcgaagagaagctcaagtacgtatgcaagcgtaagggtgagaaactcaatgatgctagttcagacaagatgtgtcctcccgatgagggttggaagcgccacggggagacttgctacaagatatacgaggacgaggtacctttcggtacgaattgcaacctgacaattacctcacggttcgaacaggagtatcttaacgacctgatgaagaagtatgataagtctttgcgaaagtacttttggacagggctgcgcgatgtggacagctgcggcgagtataattgggcaactgttggtggcaggagaagggcagtgacattttcaaactggaactttttggagccggctagccccgggggctgtgtggccatgtccaccggcaagtccgttggaaaatgggaagtgaaggattgccggtcctttaaagccctgtccatatgcaagaaaatgagcggcccactcggccccgaggaagcttcacccaagccagacgacccttgtccggaaggctggcaatcatttcccgccagtcttagctgttacaaggtcttccacgccgaaaggatcgtaaggaagcggaattgggaagaggcagaacgattttgtcaggccctgggagcccatttgagttctttctcacatgtcgacgagattaaagaattcctgcacttcctcaccgatcagttttcgggccagcactggttgtggatcggactgaacaagcgcagccccgatttacagggtagctggcaatggtctgaccggacgccagtgtcaaccattattatgcctaacgaattccagcaggattatgatataagggactgcgccgccgtgaaggtgttccaccggccatggaggcgtggctggcacttttatgatgatcgagaatttatctacctcagaccttttgcctgcgatacaaagctggagtgggtatgtcagattccgaaaggcaggacaccaaaaacccctgattggtacaatcctgatcgcgccggaattcacggcccccctctaattatcgaggggtcagaatactggttcgtggcggacctgcacctgaattacgaagaggccgtgctttattgcgcctctaatcactcattcctggccaccatcacctccttcgtgggactcaaggctattaagaacaaaattgcgaatatatccggagatggtcagaaatggtggattcgaatcagcgaatggcccattgacgatcactttacctacagtcgctatccctggcaccggtttccagtcacgttcggcgaggagtgcctctatatgtctgcaaagacctggttaatcgacctgggtaagccgactgattgttctacaaaactgcctttcatctgcgagaagtacaatgtgtctagcctggagaagtactccccggattctgcggccaaggtgcagtgctcagaacagtggatccccttccaaaacaagtgctttctaaaaattaagccagtgtctctcacgttcagtcaggcctccgacacttgccattcatacgggggtacgttacctagcgtgctgagccaaattgagcaagatttcatcacaagcttgcttcctgatatggaagccactttgtggatcgggcttaggtggacagcctacgagaagatcaataagtggacagacaatagggagctgacctacagcaattttcatccacttcttgtctctggccgattgcgaatccctgagaattttttcgaggaagagtctcgatatcactgtgctttaattctgaacctgcagaagtctcctttcaccggtacttggaacttcactagctgcagcgagaggcatttcgtgtcactgtgtcagaaatacagcgaggtcaagtctagacaaaccctgcaaaacgctagtgagacagttaaataccttaacaatctctataagattattcccaaaacactgacatggcatagtgcaaagcgtgaatgcctgaagagtaatatgcagctagtctctattacggacccctaccagcaggcctttttaagtgtgcaggctctcttacataattccagcctatggatcggcctcttctcacaagatgatgaactaaattttggctggtctgacggaaagcgactccatttctcaagatgggcggagaccaacggccagctggaagactgtgttgtgctagatactgacggcttctggaaaaccgtggactgcaatgacaatcagcccggcgccatctgctattactctggtaacgagaccgagaaggaggtcaaacccgttgattctgtaaaatgtccatcaccggtcctcaacacgccatggattccgttccagaattgctgctacaacttcattatcaccaagaatcgacacatggccactacacaggatgaagttcataccaaatgtcaaaaactgaacccgaaatcgcatattctcagcatcagagatgaaaaggaaaacaacttcgtgctcgagcaattgctgtatttcaactacatggccagctgggtcatgctcggcattacctacagaaacaaatccttgatgtggtttgataagacccctctgtcctacactcactggagagccggccggccgactatcaaaaacgagaaattcctcgcaggcctatctacagacggattttgggacatccagacttttaaagtgattgaagaagcagtttacttccatcaacatagtatcttagcctgcaaaattgagatggtcgactacaaggaagagtataacacaacattaccacaatttatgccatacgaggatggcatctactcagtcatccaaaaaaaggtaacttggtacgaggcactgaatatgtgttcacagtcgggggggcacctcgcctccgtccataaccaaaacggccaactgttcctggaggacatcgttaagcgagatggatttccactttgggtcgggttgagcagccatgacggcagtgagagcagctttgagtggtcagacgggagtactttcgactatatcccctggaaaggccaaactagcccagggaactgcgtcctgctggaccctaagggcacttggaaacacgagaaatgcaactccgtcaaggacggtgctatttgttacaagccaacgaaaagcaagaaactctctcggctcacttattcaagcagatgcccagccgccaaggaaaacggatcgcgctggatccagtacaagggccactgttacaagagcgaccaggcattgcattcctttagcgaggcaaagaaattatgcagtaagcacgaccatagtgcaacaattgtgagcattaaagacgaggacgaaaacaagttcgtcagccgcctgatgagagaaaataacaatatcacaatgagggtgtggctcggcctgagccagcattccgtggactgtccaagtagtacttggatacagttccaggatagctgctacatctttctgcaggaggctattaaggtggagtccatcgaggatgtgaggaaccagtgcactgaccacggggccgacatgattagtattcacaatgaagaagaaaatgctttcatcctcgacacactcaagaaacagtggaagggacctgacgatatactacttgggatgttctatgacacagatgacgcaagttttaagtggtttgataattccaacatgacctttgataaatggacggatcaggatgacgatgaggatttagtggacacctgcgcctttctgcatattaagactggcgaatggaaaaagggtaactgcgaagtatcatctgttgagggcactctgtgcaagacggctatcccttataagcgcaagtacctgagtgacaaccacattctgatcagtgccctggtgattgccagcacagttatcttgactgtcctgggcgccatcatttggttcctatataaaaagcattcagattctcgatttaccacagtgtttagcacagctccccagtccccctacaacgaggactgcgtgctggtcgttggggaggagaacgagtatcccgtacagttcgattag

SEQ ID NO: 27199 - DNA, 5622 bp, Artificial Sequence
  Description of Artificial Sequence: Synthetic coding sequence
atgagaactggctgggcgactcctaggcggcccgccggtttgctgatgctccttttttggttttttgacctcgcagaacccagcgggagagccgccaacgatccattcactatcgtccatggtaacactggtaaatgcattaagcctgtgtacggatggattgtggcggacgattgcgatgaaactgaagataagctttggaagtgggtaagtcaacatcggctctttcacttgcattcccagaagtgtttgggtctggatattaccaagagtgtgaatgagttgcgcatgttctcatgcgactcctcagccatgctctggtggaagtgcgagcatcactctctttatggggcagcgcgttacaggttggccttaaaggatggccatggaactgccatctccaacgcttccgacgtttggaagaaaggcgggagcgaggagtcgttgtgtgatcagccttatcacgaaatatatacacgcgatggtaatagttacggaaggccatgtgagtttccgtttctcatcgacggtacctggcatcatgattgcatcctagacgaggatcattcaggcccctggtgcgctaccacactgaactatgaatacgataggaagtggggtatctgtctgaaacccgaaaacggctgcgaggacaactgggaaaagaacgagcagttcggtagctgctatcagtttaacactcagaccgccctctcctggaaggaagcatacgtgagttgtcagaaccagggggccgatcttctgtctataaattctgcagcagagctgacctatttaaaggaaaaagaagggattgcgaaaattttttggattgggttgaatcagctttatagcgcccgggggtgggaatggtccgaccacaaaccattgaactttctcaactgggatcccgatcgcccgtccgctcccacgattggcgggagcagctgtgcccgcatggacgccgagtctggactgtggcaatcgttctcatgcgaagcccagttgccttacgtctgtcgcaaacctttgaacaacactgtggagctgactgatgtgtggacatattccgatacacgttgcgatgcaggatggctgcctaacaatgggttctgctatctactggtgaatgagtctaacagctgggacaaggcacacgccaagtgcaaggcattttcaagcgacctcatcagtattcatagccttgccgatgtcgaggtggtcgtcaccaaactgcacaacgaagatatcaaggaagaggtgtggatcggccttaaaaatattaatatccctacactctttcaatggtctgacggcaccgaggtaacattgacctattgggatgagaatgagcctaacgtaccttacaataaaactcccaactgcgtctcgtacttgggcgaactggggcagtggaaagtgcaatcctgcgaggagaagctcaagtatgtgtgtaagagaaaaggggaaaaattgaacgatgcatcgtccgataagatgtgcccaccagacgaaggctggaagagacacggagagacctgctataagatctatgaagatgaagtgccattcggaactaactgcaaccttaccatcaccagccgcttcgagcaagaataccttaacgatctgatgaagaagtacgacaagagtcttcgaaaatacttctggactggcctgcgcgatgtggattcatgcggggagtataattgggccactgtaggaggacggcgacgtgccgttacattctccaattggaatttcctcgaacccgcaagccctggtggatgcgtggccatgagcacaggtaagagcgtggggaagtgggaagttaaggattgccgctctttcaaggctctctccatatgtaaaaagatgtccggacctctgggccccgaggaagcttcccctaagcccgacgatccatgccctgagggctggcaatcatttcccgcatcactgagctgctataaggtgtttcatgccgaacgcatcgtgagaaagcgaaactgggaggaagcagagagattctgtcaggctttgggggcacatctgtcttcttttagtcacgtggatgagattaaggaatttctgcatttcttaaccgaccaattttcaggtcagcattggctatggattggattaaataagcgcagtcctgacctgcagggctcgtggcagtggtcagataggactccggtgagtacgatcatcatgcctaatgagttccagcaggactatgatatccgggactgcgccgcagttaaagtatttcacaggccttggagaagggggtggcacttctatgacgatagagagtttatctatctccggccctttgcatgtgataccaagctggaatgggtgtgccagattcctaagggccgaacacctaagaccccagattggtataatcctgacagagcgggcatacatggacccccattaatcatagaagggagtgaatattggtttgtggcagacttacatttgaattatgaagaggccgtcttgtattgtgcatccaaccacagctttcttgccaccattacatccttcgtaggactgaaagctatcaaaaacaaaatcgccaacataagcggcgatggccagaaatggtggatccggattagtgagtggcccattgatgatcactttacgtacagccgttacccatggcatcgctttcctgtgacctttggtgaggaatgcctttatatgtccgccaaaacatggctcattgatttaggcaaacctactgactgtagcacaaagcttccatttatctgcgagaagtataacgtcagcagtctcgagaagtattctccagatagcgctgcaaaggtgcaatgcagtgaacaatggattccatttcagaacaagtgttttctgaaaattaaacctgtgtcactcaccttttcccaggcctccgacacctgtcactcctatgggggaacgctcccatctgtgctttcccagatagaacaggattttatcacaagcctgctgcccgacatggaagccacactttggatcggactgcggtggactgcgtacgagaagatcaataagtggaccgacaatagggaactcacttacagtaattttcaccccctcctcgtctcagggcgcttgcgaatccctgagaatttcttcgaggaagagagcaggtatcattgcgccctcatcctaaacttacagaagagcccttttactggcacgtggaatttcacctcttgcagtgagcgccactttgttagcctgtgtcagaagtacagcgaagtgaaatcacggcagacactgcaaaatgctagtgagacagttaagtacctgaacaacctttataaaatcattcccaagactctgacctggcactctgctaagcgtgagtgcttgaaatccaatatgcagttagtgagcatcactgatccctaccagcaagcctttttgtcggtgcaagcactcctgcataactcctcactctggatcggtttatttagccaggacgatgaactgaattttggctggtccgacggtaagcgactgcattttagcaggtgggccgaaactaatggacaactggaagactgtgtggttttggacacagacggcttttggaagacggtggactgtaacgataatcaacccggagctatctgctactatagtggcaacgagactgaaaaggaggttaaacctgtggactcagtgaagtgcccatcacccgtccttaatacaccttggattccattccagaactgttgttacaatttcattattacaaagaataggcacatggcgacgacccaggacgaggttcatacaaagtgccagaaactcaaccccaaaagccacattctctctatccgggatgaaaaagagaacaatttcgtcttggagcagctgctctatttcaattacatggcatcctgggtgatgctgggcatcacctacaggaataagagcctgatgtggttcgacaaaactcctctctcttacacacactggagagcagggaggcctaccataaaaaacgagaaattcctggccgggctgtccacagatgggttctgggatatccaaaccttcaaggtgatcgaggaagctgtttattttcaccagcactcaatcctcgcctgcaagatagagatggtcgactataaagaggaatacaacacgactctcccacagttcatgccatacgaagacggaatctatagcgtgatccaaaagaaagtgacttggtacgaagcattaaatatgtgctctcagagcggcggacacctggcgtctgtgcataaccagaatgggcagctttttctggaggacattgtgaagagggacggcttccctctgtgggtaggcctgtcctctcacgatggttcggagtcctccttcgagtggtctgacggttccacctttgattacatcccatggaagggccagacatctcctgggaattgtgtacttcttgaccccaaaggtacgtggaaacacgaaaagtgtaatagtgttaaggatggcgccatatgctacaagcctacgaagagtaaaaagctcagccggttgacttactctagccgatgtcctgcggctaaagagaatggaagtcggtggatccagtataaaggacattgctataaatcagatcaggcccttcattcattctcagaggccaaaaaactctgctcaaagcacgaccatagcgctaccatagtgtctattaaggatgaggacgaaaacaagtttgtgagccggctcatgcgtgaaaacaacaacattactatgagagtgtggctcgggctgtcccagcatagcgttgatcaaagttggtcctggttggatgggtcggaagttaccttcgttaagtgggagaacaagtccaaaagtggtgtggggagatgtagcatgctgatcgccagcaacgaaacttggaagaaggtggaatgtgagcatggctttggccgcgtggtgtgtaaagtacctcttgactgcccctcgtctacgtggattcaattccaagatagttgctatattttcctgcaagaagctatcaaggtggaatcaatcgaggatgtgagaaatcaatgtactgaccatggcgcggatatgatatccatccacaacgaagaggagaatgcctttatactggacactctgaaaaaacagtggaagggccctgatgatatcctgctagggatgttttacgacaccgacgatgcttcgttcaagtggttcgacaattcaaatatgacatttgataagtggaccgaccaggacgatgacgaggaccttgtcgacacctgtgctttcctgcacattaagacaggggagtggaagaagggaaactgtgaggtgtccagcgtggagggcactctgtgtaagacagccattccatataagaggaagtatctaagcgacaaccacattttgatttcagcactggtaattgccagcaccgttattctcactgtactaggggccatcatttggttcttatacaaaaagcacagcgattctcgatttaccacagtgttttctactgctcctcaaagcccttataacgaggattgtgtgctggtggttggggaggagaacgaatatcccgtgcaatttgattag

SEQ ID NO: 27200 - DNA, 1149 bp, Artificial Sequence
  Description of Artificial Sequence: Synthetic coding sequence
atgaggtcccacttcctgcagtgggctctggctaccagccggaacaaggatcagataacaaatatttttagtgggttcgccggcttactcgcaatcctcttggtcgtagccgtattttgtatcctctggaactggaataagagaaagaagagacaggtgccgtacttacgagtaacggtcatgcctctgttgacccttccccagactcggcagcgcgccaagaatatctatgatattctgccatggcgccaggaggatctcgggcgccacgaatctaggtccatgcggattttctccaccgagagtcttctctctcgcaactcggagtctccagagcacgtgccctcccaggctggcaacgcctttcaggagcacacggctcatattcacgcgacagagtacgctgttggcatatatgataacgccatggtcccacagatgtgtgggaatttgacgccatctgcccactgcataaatgtgagagcttctcgggattgcgctagcatctcatctgaggattcccatgactacgtgaacgtgccgaccgcagaagagatcgcagaaaccctggcttctactaagtccccttccagaaacttatttgtactcccgtccacacagaagctggaattcacagaagagagagatgaggggtgcggtgacgccggcgattgcacctccctgtacagccccggggccgaagattctgactccctcagtaatggggagggatcctcccagatcagtaatgattacgtcaatatgactggtctggatctctcggctattcaagaaagacagctgtgggtggcgtttcagtgctgcagggattacgagaacgtgccggccgcggatccctcaggttcccagcaacaggctgagaaagacgtgcccagctcgaacatcggacacgttgaggacaaaaccgatgatcctggcacacatgttcaatgcgtgaagcgcactttcctggcgtcaggcgattacgctgactttcagccctttacacaatcggaggattctcagatgaagcacagagaggaaatgagcaacgaggatagctccgattacgagaatgtcctgaccgccaagttgggggggcgagactcagagcagggtcctgggactcaactgcttcctgacgagtag

SEQ ID NO: 27201 - DNA, 1197 bp, Artificial Sequence
  Description of Artificial Sequence: Synthetic coding sequence
atggacggcgtgaccccaaccctatccacaattcgcgggcgtacgttagaaagcagcaccttgcacgtgaccccgaggtctcttgaccgaaacaaagatcaaatcaccaatatcttctccggtttcgccggactactcgctatcctgctcgtggtcgccgttttttgcattctttggaattggaataaacgaaaaaagcgacaggtgccatatctgagggtcactgtcatgcctttactgaccctaccgcagacccggcagagagctaaaaacatctatgacatactcccctggcggcaggaagacttagggaggcatgaaagtcggtctatgagaatcttctctactgaatctctccttagccgaaattctgagtctcctgagcatgttccctcccaggctggtaatgcgttccaagagcacaccgcgcatatccacgctacggagtacgctgtgggcatttacgataatgctatggtgcctcagatgtgcggcaacctcacgccaagcgctcattgcatcaacgtccgtgcctctagagactgtgcctccatttctagtgaggattcacacgattacgtgaacgtgcccactgccgaagagatcgcagagaccctagctagcaccaagtccccatcccgcaatctcttcgttctgccatcaactcagaagctagagttcactgaagagagagacgagggatgtggggatgcaggcgactgtacatctctgtattcgcccggggctgaggactctgactctctgtcaaacggcgagggctcatcccaaatcagcaacgactacgtaaatatgacagggcttgacctctccgccatccaggaaagacagctttgggttgccttccaatgctgccgcgactatgagaatgttcctgcagccgacccttccggctcccaacagcaagctgagaaagatgtccccagctctaacatcggtcatgtcgaagataaaactgacgaccctggaacacacgtgcagtgtgtgaagcggacgtttttggccagtggtgactacgctgacttccagccgttcacacaaagcgaggactctcagatgaaacatagggaagagatgtccaatgaggattcaagcgactacgagaacgttctgacggctaagttaggtgggcgcgattcagaacaggggcccgggacacagctgctgccagacgaatag

SEQ ID NO: 27202 - DNA, 189 bp, Artificial Sequence
  Description of Artificial Sequence: Synthetic coding sequence
atggatccccgcgagtgcgtttgcatgagtggggggatctgtatgtgcggagacaattgcaagtgtactacctgcaactgcaagacatattggaagagctgctgcccatgttgccctccaggttgtgcaaagtgtgccagggggtgcatctgtaagggtgggagcgataagtgcagctgttgtccttag

SEQ ID NO: 27203 - DNA, 369 bp, Artificial Sequence
  Description of Artificial Sequence: Synthetic coding sequence
atgacgacagcaacccgacaggaggtgctcggcctgtaccgcagtatttttaggctagcccgcaagtggcaggctacctctgggcagatggaagacacaatcaaggagaaacagtacatccttaacgaggccaggacgctgtttaggaaaaataagaacctgaccgatactgacttgatcaagcaatgtattgacgagtgcaccgcaaggatagagatcgggctccattataaaattccttacccacgccctatccatcttcctccgatgggcctgacccctttgcgcggccgggggctcagaagccaggagaaactgaggaagctgtcaaagcctgtttatctgcgctcgcatgatgaagtgtcatag

SEQ ID NO: 27204 - DNA, 369 bp, Artificial Sequence
  Description of Artificial Sequence: Synthetic coding sequence
atgacgacagccactcgacaagaagtccttgggctgtaccggtctattttccgcctggctagaaaatggcaggccacatcaggccaaatggaggatacaataaaggagaagcagtatattctgaacgaggcacggactttgtttcgcaaaaataaaaatctgactgacacagatctcattaaacagtgtatcgacgagtgcacagcccgtattgaaataggactacactacaagataccataccccaggcctatccatcttcctcccatggggttgactccacttagaggtcggggactcagatcccaggaaaagctccggaaactatccaagccagtgtacctgcggtctcacgatgaggtgtcgtag

SEQ ID NO: 27205 - DNA, 369 bp, Artificial Sequence
  Description of Artificial Sequence: Synthetic coding sequence
atgactaccgccacgcggcaggaagttctgggcttgtacaggagcatcttccggctcgctcggaaatggcaggccacatcagggcagatggaggatacaattaaagagaaacagtacattcttaatgaagctagaactctttttcggaaaaataagaacctgaccgatacagacctaataaaacagtgcattgatgagtgtacagcgaggattgagattggcctgcattataaaatcccctatccccgtccgatccacctgcccccaatgggcctgactcctctgcgcgggcgcggactgagaagccaggaaaaattacgcaagttgtctaagccagtgtatctgagatcacacgacgaggtgtcctag

SEQ ID NO: 27206 - DNA, 267 bp, Artificial Sequence
  Description of Artificial Sequence: Synthetic coding sequence
atggccgcttccagattgccccccgccacactcaccctgaaacagttcgtcaggaggcagcaggtgctgctgctctatcggcgtatcctgcagacaatccggcaagtgcccaacgacagcgatcggaaatatctgaaggattgggccagagaggagttcagacgcaacaaatcagccactgaggaggatacaatccgaatgatgattactcaggggaatatgcagcttaaagagctggagaaaactcttgcgctcgcaaagtcatag

SEQ ID NO: 27207 - DNA, 273 bp, Artificial Sequence
  Description of Artificial Sequence: Synthetic coding sequence
atgaaaatggccaactccctgcgtggagaagtgttaaaactatacaagaatctgctgtatctagggcgggattatcccaaaggagctgactacttcaagaagcgtttaaagaacattttcctcaaaaacaaggacgtgaaaaaccccgaaaagattaaggaactcatcgcacagggggagttcgtcatgaaagaactggaagctttgtattttctgcggaagtaccgggcaatgaaacagcgttactacagcgacaccaataaaacgaattag

SEQ ID NO: 27208 - DNA, 105 bp, Artificial Sequence
  Description of Artificial Sequence: Synthetic coding sequence
atggccaactccctcagaggagaggtgctcaagctttacaagaatctcttgtatctcgggagagattaccccaaaggcgccgattattttaaaaagcgcctgtag

SEQ ID NO: 27209 - DNA, 267 bp, Artificial Sequence
  Description of Artificial Sequence: Synthetic coding sequence
atggccaattcattgcggggcgaagtcctgaaactgtacaaaaacctgctgtatctaggtcgtgattaccccaaaggcgcagattatttcaagaaacgcctcaagaacattttccttaagaataaggatgtgaaaaatcccgaaaagatcaaagaattgatcgcccagggagaattcgtgatgaaggagctggaggccctctatttcctccgtaagtatcgggcaatgaagcagaggtattactccgatacgaacaagacaaactag

SEQ ID NO: 27210 - DNA, 267 bp, Artificial Sequence
  Description of Artificial Sequence: Synthetic coding sequence
atggcaaactcccttcggggtgaggtgctgaagctctataaaaacctgctgtacctcggccgagactaccctaaaggcgctgactacttcaagaaaagactgaaaaacatcttccttaagaacaaggatgtgaaaaatccagaaaaaatcaaggagctcatcgcgcaaggggaattcgtcatgaaagagttagaagcactttacttcctgcgcaagtaccgggccatgaagcagagatattattcagataccaacaaaaccaattag

SEQ ID NO: 27211 - DNA, 267 bp, Artificial Sequence
  Description of Artificial Sequence: Synthetic coding sequence
atggccaattccctgcggggagaggtgcttaaactttacaaaaatttactgtatctgggtcgggattatcccaagggagccgattactttaagaaacgcctgaagaacatcttcctgaaaaacaaagacgtcaagaatcctgagaagatcaaggagctcattgcccagggcgagttcgtcatgaaagaactggaagccctgtattttctgcgtaagtatagggcaatgaaacagcggtattacagcgacaccaataagactaactag

SEQ ID NO: 27212 - DNA, 267 bp, Artificial Sequence
  Description of Artificial Sequence: Synthetic coding sequence
atggctaacagcctgagaggagaggtacttaagctgtacaagaacctcctctacctgggccgcgattatccaaagggcgccgactactttaagaaaaggttaaaaaatatcttccttaagaacaaagacgttaagaaccctgagaagataaaggaactgattgcgcagggagaatttgtaatgaaagaactggaggcattatatttccttcgaaaatacagggctatgaagcagagatattatagcgacaccaacaaaaccaactag

SEQ ID NO: 27213 - DNA, 315 bp, Artificial Sequence
  Description of Artificial Sequence: Synthetic coding sequence
atggggagggctgtgaaagtcttgcagcttttcaaaacgcttcatcggacgcgtcagcaggtgttcaaaaatgatgctagggctctcgaagccgcccgcataaagatcaatgaggagttcaagaataacaagtccgagacctcctcgaagaaaatcgaagaacttatgaaaatcggctccgatgtggagctgcttttaaggaccagtgtcattcaggggatccacacagatcataatactctgaagctagtaccccggaaggatctgctcgtggagaatgtaccctactgcgacgctccaacccagaaacagtag

SEQ ID NO: 27214 - DNA, 921 bp, Artificial Sequence
  Description of Artificial Sequence: Synthetic coding sequence
atggccggacggcatcagaatagaagttttccccttccaggtgtccagagcagtggacaagtgcacgcgttcggcaattgtagtgatagcgatatcctcgaggaggatgccgaggtttacgagttgcgttcacggggcaaggagaaggtgcggagatccaccagccgggacagactcgatgatatcatagtactgactaaagatattcaggaaggtgatactttgaacgcaattgcactccagtactgctgtaccgtggccgatatcaaaagagtgaataatcttatctccgaccaggactttttcgctctcagatcaattaaaattcctgtgaaaaaattctcaagcctgacagagaccctctgcccccccaaagggcgtcaaaccagccgccatagctccgtgcagtattcgtccgagcaacaagagatactccccgcaaatgattccttagcttactctgatagtgctggctcatttctgaaagaggtggatagggatattgagcagattgtcaagtgtaccgataataaacgcgaaaaccttaacgaagtggtgtctgctcttaccgcacaacagatgaggttcgagccagacaataagaacacccagagaaaagacccttactacggtgcagattggggcattggctggtggaccgcagtggtcatcatgttaatcgtgggaattattactccagttttttatctcctgtactacgaaatactggccaaagtggacgtgagccaccactccactgttgattcctcgcacctgcacagtaagataaccccccccagtcagcagagagaaatggaaaacggcatcgtacctaccaagggcattcacttttcccaacaggatgaccacaaactgtatagccaagatagccagagcccggctgcacagcaggagacatag

SEQ ID NO: 27215 - DNA, 921 bp, Artificial Sequence
  Description of Artificial Sequence: Synthetic coding sequence
atggccggacggcaccaaaatcgctccttcccgctacctggagtgcaaagcagcggacaagttcatgcgtttggaaattgctccgatagtgatattctggaggaggacgcagaggtgtacgaactgagatcaagggggaaggagaaagtccggagatccacgagcagggaccgcctcgatgacattattgtactgaccaaggatatacaggagggtgacaccctgaacgcgatcgccctgcaatattgctgtactgtggcggacataaagagggtcaacaacttgattagtgatcaggacttttttgctcttcggtccatcaagattccagtgaagaagtttagttccctgaccgagactttgtgtccccctaaagggcgtcaaacatctcgtcattcctccgtgcagtacagtagtgagcagcaggagatccttccagccaacgattccctggcctattctgactctgctggctctttcttgaaagaggtcgatcgcgacatagagcaaatagttaaatgcacagacaacaagcgagagaacctcaatgaagttgtgtcagccctgaccgctcagcagatgcgtttcgagcctgataacaaaaacacccaacggaaagacccttactacggcgccgattggggcatcggatggtggacagccgtggtgatcatgctgattgtcggcattattactccagtgttttatttgctgtattacgaaatcttggcaaaggttgacgtgtcacaccacagcaccgtggacagtagccacctccattccaaaattactcccccttctcagcagcgggagatggaaaacggaattgtgcctaccaaaggaatacacttttcacaacaggacgatcacaagctctactcacaggattcacagtcccccgctgctcaacaggagacatag

SEQ ID NO: 27216 - DNA, 384 bp, Artificial Sequence
  Description of Artificial Sequence: Synthetic coding sequence
atggcggggagacaccagaatcgctcttttcccctgcccggcgtccagtcttctggccaggttcacgcctttggaaactgtagtgatagtgatatcctggaagaggacgccgaggtatacgagttgcgcagccgggggaaggaaaaggtgagacgctccactagtagggacaggctcgatgatatcatagtgcttaccaaagacattcaggaaggggacactctgaatgccattgctctccaatactgctgcaccgtttatcagaactcttctaaaaaggtgcaatttctcgaccgaaacaccctgagctctaaacgtaaaacggattttacttcattcatttgctcaattctctttcgcaccactggtaatttcgcttcttag

SEQ ID NO: 27217 - DNA, 891 bp, Artificial Sequence
  Description of Artificial Sequence: Synthetic coding sequence
atgcggcacgaggaactcctgacaaaaaccttccagggacccgccgtcgtttgcgggaccccaacttcccacgtatatatgttcaagaatgggagcggagactccggagatagcagtgaggaggagtcccacagggtcgtactgcgcccaagaggaaaggagaggcacaagtctggagtgcatcagcctcctcaggccggcgctggagatgtggtgctcctgcaacgcgaactggcacaagaagactcgctgaataaactggctctgcagtatgggtgtaaggtggccgacattaaaaaagtgaacaactttattagggagcaggatctgtacgcgctgaagtcagtgaaaattcccgttcggaatcatgggatcctcatggagacgcacaaagaactcaagcctctgctcagcccctcctcggaaacaacagtgacagtggaattacccgaggccgatagggccggcgccggaaccggtgcccaggccggacagttgatgggatttttcaaaggcatcgaccaggacatcgaacgcgctgtccagagtgagatcttcctgcatgaatcatactgcatggataccagtcaccaacctcttctgccagctccccccaaaaccccgatggacggtgccgattgtgggattcaatggtggaacgcagtgttcataatgttgctgatcggcatagtgctcccggttttttacctcgtttacttcaaaatccaagcgtcgggcgagacccctaattcactcaacacaactgttatcccgaatggatccatggcaatgggaactgtacccggacaggctcctcggctggcagtcgctgtgccagctgttaccagtgccgattcacagttcagccagactactcaggcgggatcctag

SEQ ID NO: 27218 - DNA, 894 bp, Artificial Sequence
  Description of Artificial Sequence: Synthetic coding sequence
atggccgtcgggacaagaggaacattactgaagaaatctctcactgtgtggttttgcggtccgggagcaagatctgccaccagagccgtgtccacaagcttacctcgccgagaacaggttacgtggtgctgctgcagcggttcctggccccgacggactgcctcgacaagctggagatgttccatggctgccaacactttctacttccgaccaaacggggcaggggacactaggcagaacctgatccccgatttttatgcattcagggtcatcaacaacggcaaggtggcagacatcaaaaaggtcaacaatttcatccgggaacaggacctgtacgcactcaagtctgtgaagatccccgtccgtaaccacggaatcctcatggaaactcataaagagctgaaacccttactgagcccttcatctgagactaccgtcacagtggagcttcccgaagcagatcgtgcaggcgcaggcaccggcgctcaggcaggtcagctgatgggattttttaaaggaatcgaccaggatatcgagagagcagtccagtcggagattttcctgcacgagagctactgcatggacacatcgcaccagcctcttctgccggcccctccaaaaactccaatggacggggcagactgtggaattcagtggtggaacgcggtgttcattatgcttctgatcggcattgttctgcccgtattctatctcgtttacttcaagatccaagctagcggagagacacctaattcgctaaacacgacggtgattcccaacggtagcatggcgatggggaccgtgccaggccaggctccccgactggctgttgcagtccccgcggtgacatctgctgactcacagttctcacaaaccacacaggccggatcatag

SEQ ID NO: 27219 - DNA, 891 bp, Artificial Sequence
  Description of Artificial Sequence: Synthetic coding sequence
atgcgtcacgaggagttgctgaccaaaacttttcaaggacccgcagtggtgtgtggtacgcccacgagtcacgtatatatgttcaaaaacgggtcaggcgactctggggactctagcgaggaggagagccaccgcgttgttctccgtccgaggggtaaagagagacacaagagcggggtgcaccagccccctcaggctggcgccggtgacgtcgtgctgctacagcgggagctggcacaagaggacagtttgaacaagctggcgctccagtatggatgcaaggtagccgacattaagaaggtgaataactttatccgcgagcaagacctgtatgccttgaaaagtgtgaaaattcctgtccgcaaccatgggatcctcatggagacccacaaggaactgaaacccctcctatctccaagcagcgaaaccaccgtcaccgtagagctcccagaagcggaccgagcaggtgcagggaccggcgcccaggcaggacagctgatgggcttctttaaaggcattgatcaggacatcgagagggctgtccagtctgaaattttcctccatgaaagctattgcatggacacctcccaccagcctctcctgcctgcccctcccaagacacctatggatggggcggattgcggaatccagtggtggaacgccgtatttataatgctgctcatcgggatcgtgttgccggtgttctatctagtttacttcaagatccaggctagtggagagacaccaaattctttaaataccacagttattcccaacgggtctatggcaatggggaccgtacccggccaggcccccagactggcggtcgctgtgcccgcagtgacctctgccgattcacagttctcccaaacaacccaggccggatcgtag

SEQ ID NO: 27220 - DNA, 513 bp, Artificial Sequence
  Description of Artificial Sequence: Synthetic coding sequence
atggagactcacaaggagctcaaaccgctcctcagtcccagctcagagaccacagtcacagtcgaacttcctgaagccgatagagcaggcgcgggcacaggggcccaggccggccagctgatgggtttctttaaggggattgaccaagacatcgagagggccgtgcaaagcgagatattcctccacgaatcatattgtatggatacgtcacatcaaccgttgttacctgctccccctaaaacgccaatggacggcgcggattgtgggatacaatggtggaatgcagttttcattatgctgctcatcggtattgtgctaccagtattctatctggtttatttcaagatccaggcctcgggggaaaccccaaatagcctgaataccacggtgatccctaacgggagcatggccatgggcacagtgccgggccaggcaccaaggctcgccgttgccgttcctgctgtgaccagcgctgactctcagttctctcagaccacccaggccggctcctag

SEQ ID NO: 27221 - DNA, 1635 bp, Artificial Sequence
  Description of Artificial Sequence: Synthetic coding sequence
atgtcccgatgtgcccaggccgctgaagtcgctgcgaccgtgcctggcgcaggcgttgggaacgttggtcttaggccaccaatggtcccccgtcaagcctccttctttcctccacccgtgcccaacccgtttgttcagcagacccaaattggctcggcccggagggtccagatcgttttactggggattatcctgctgccaataagggtacttttggttgcattgattttgctactcgcttggccgtttgcagctatttcaacagtgtgctgtcccgagaaactcactcaccccattactggttggaggcggaaaattacccaaacagcactgaagttcctcgggagggcaatgttttttagcatgggctttattgtcgctgtcaagggcaagattgcgagtccactggaagctcccgtgttcgtggctgcacctcattcgaccttctttgacgggatcgcgtgcgtggttgccggcctcccaagcatggtatcaagaaatgagaacgcgcaggttcctctcattggacgcttgctgagggcggtgcagcccgtgctagttagtcgcgtcgaccccgactccagaaaaaacactatcaacgagattattaagaggactaccagtggaggcgaatggcctcagattctggtgttccccgaggggacatgcaccaaccgcagctgtctgataacctttaagcccggcgcttttattcctggagtgccggtgcagcctgtgctgctgcggtatccaaataaactcgacaccgtcacctggacttggcagggttacacattcatccagctgtgcatgctcaccttctgtcagctgtttacgaaagtggaggtcgaatttatgccagttcaggtgcctaacgatgaagagaaaaacgacccagtcctgtttgcgaataaagtgaggaatctcatggccgaggcactaggaatccctgtaacagaccatacatatgaagattgtcgtttgatgatctccgctggtcaactaacactccccatggaagccgggctggtggaattcaccaagatttcacgaaaactgaaactggattgggatggcgtgcgaaagcacctagatgagtacgcatcaatcgcgtccagcagtaaagggggtagaatcggaatagaagaattcgccaagtacttaaaactgcccgtgagcgacgtgcttcgacagctatttgcactgttcgaccggaaccatgacggcagtattgacttcagagagtatgtcatcgggttagcggtgctttgcaacccaagcaataccgaggagataatccaagtggcttttaagttgttcgacgtggacgaggatggatatattacagaagaagaattttctacaatactacaagcatcactgggagtacccgacttagatgtgagtggattattcaaggaaattgcccagggggactccatttcctatgaagagttcaaatcctttgcactgaaacacccagagtacgccaagatattcactacatatctggacctacaaacgtgccatgtgtttagcctgcccaaggaagttcagaccacaccgtccactgcctcaaacaaagttagccctgagaaacacgaagaatcgacttcagacaaaaaggatgactag

SEQ ID NO: 27222 - DNA, 1113 bp, Artificial Sequence
  Description of Artificial Sequence: Synthetic coding sequence
atggccatcactttagaagaggctccatggctgggctggcttctggttaaagctctcatgcgcttcgcctttatggttgtcaacaacctcgtagcgataccgtcctacatatgttatgtaatcattctccaaccgctgcgcgtgcttgacagcaagaggttttggtacattgaaggcataatgtacaaatggctgctagggatggttgcttcctggggatggtatgctgggtacacagtgatggagtggggagaggacatcaaggcggtatccaaagacgaagcggtcatgctcgtgaatcatcaggctactggggacgtttgcaccctgatgatgtgtctgcaagacaaagggttggtagtcgctcaaatgatgtggctgatggaccacatctttaaatacacaaattttggcatcgtgagtctcgtacatggggatttcttcatacgccagggacgctcataccgagaccaacaactgctcttgcttaaaaagcacctggaaaataactatcgaagcagggacaggaaatggatcgtcctgtttcccgagggcggattcttgagaaagcgccgggaaacatcacaagccttcgccaagaagaataacctaccttttttgaccaacgtgaccctgcccaggagcggggccacaaaaattatcctgaacgccctcgttgcccagcagaaaaatggatcccccgcaggcggagatgctaaggagctggactccaagagcaaagggctacagtggattattgacacaaccatagcttaccctaaagcagagcccatagacatccagacctggatcttggggtacaggaagcctacagtgacccatgttcactacaggattttccccatcaaggacgtgcctctggaaacagacgatctgacaacttggctgtatcagaggtttgttgaaaaggaggacctgctgtctcacttctacgaaaccggagcctttcccccctccaaaggacacaaggaggcagttagcagggagatgaccttgtccaatctttggattttcctgattcagagtttcgcctttctttccggctatatgtggtacaatataattcagtacttttatcattgtctgttctag

SEQ ID NO: 27223 - DNA, 1113 bp, Artificial Sequence
  Description of Artificial Sequence: Synthetic coding sequence
atggctatcaccctcgaggaggctccatggctggggtggcttctggtaaaagctctgatgcgcttcgctttcatggtggtcaacaacttggtggctatcccgtcttacatatgctacgtgatcatattgcaacccctgagagtcctggacagcaaaagattctggtacatcgaaggcattatgtataaatggctgttaggaatggtggcttcatggggttggtacgccggctataccgtgatggaatggggggaggatataaaggctgtgagtaaggatgaagctgtgatgttggtaaaccatcaggctaccggagatgtgtgtacactgatgatgtgtctgcaggacaagggcttagtggtagcccagatgatgtggctgatggaccacatctttaagtacactaacttcggtatcgtgagtttagtccacggagatttcttcattcggcaaggccggtcgtacagggatcagcaactattgctcttaaaaaagcacttggagaataactacagatccagggaccggaaatggattgtgctattccctgaaggcgggttcctacgaaaacgccgcgaaacctcccaagcatttgcaaagaaaaataatctgcccttcttgacaaacgtgacacttccaaggagcggcgcaactaaaattattctgaatgctcttgtagcccagcagaaaaatggaagcccggctgggggtgatgctaaagagctggattccaaaagcaagggacttcagtggattatcgacacaaccatcgcttacccgaaagctgaacctattgatatacagacatggatactggggtataggaaacccaccgtgacgcatgtacactatcgcatctttcccatcaaagacgtaccgttggagacagacgacttgacgacctggttgtatcagcgcttcgtcgaaaaggaagacttattgagccatttttacgagactggagcttttccaccctctaagggtcacaaagaggccgtttcccgcgagatgaccctcagcaatctgtggatctttttgatccagagttttgcctttctatccggttacatgtggtacaatatcatacagtacttttaccattgtctgttctag

SEQ ID NO: 27224 - DNA, 702 bp, Artificial Sequence
  Description of Artificial Sequence: Synthetic coding sequence
atggtgtcaatgagtttcaagagaaataggagtgaccggttctattccacccgctgctgtggctgctgccatgtccggacaggcacaataatcttgggaacatggtacatggtggtgaatctgctgatggccatccttctgaccgttgaagtgacccaccccaatagtatgcctgcagtcaacattcagtacgaagttataggcaactattactcttcagagcgcatggccgataacgcgtgcgtcctgttcgccgtgtctgtattgatgtttatcatttctagcatgctggtgtacggggccatcagttaccaggtcggatggctcatccccttcttctgttaccggttgttcgacttcgtgttgtcatgcctagtagctatcagctctcttacatacctaccgcgcattaaagagtatctagaccagcttcctgatttcccatacaaagatgacctgctggctctcgacagcagctgtctactcttcatcgtcctggtattctttgctttgtttatcatctttaaggcgtacctcattaattgcgtatggaattgctacaaatacatcaataacagaaacgtgcctgaaatagccgtgtacccggccttcgaagccccgcctcagtatgtgttgcctacatacgaaatggctgtcaaaatgcccgaaaaagagcctccaccaccatatctgccggcctag

SEQ ID NO: 27225 - DNA, 1251 bp, Artificial Sequence
  Description of Artificial Sequence: Synthetic coding sequence
atgcccagacagctcagcgccgcagccgcactgtttgcaagtcttgccgtgatcctccacgacggatcacagatgcgtgccaaagcattcccagaaacaagagactatagccaaccaaccgccgctgcaaccgttcaggatatcaagaagcctgtgcagcagccagcgaaacaggcccctcatcagactcttgctgctcgctttatggacggccacatcacttttcaaaccgctgcaaccgtcaaaattcctacaaccactcctgctaccaccaaaaacactgccaccacatcaccgattacctacaccctggttacaacccaggccaccccaaacaatagtcacaccgctccgcctgtgaccgaggtgacagtggggccctctctggccccttatagtctgcccccaaccatcacccccccagcacataccacgggcacctcgtctagtaccgtgtcccatactacaggcaacacaacccagccttcgaatcagaccaccctgcccgctacactgagcatcgcattgcacaaatctactactggacagaaacccgtgcaacctacacacgcaccaggcacaactgcagcagctcacaacacaacacgcactgcagctccagcatccacagtacctggaccaacactggcgcctcagccctcgagtgtgaagactggcatttatcaagtcctgaacggttctagactgtgcatcaaagcggaaatggggatacaactgattgtgcaggacaaggaatccgtttttagcccgcggcggtacttcaatatcgacccaaatgccacacaggctagcggcaattgcggaaccaggaaatctaatttgctgcttaattttcaggggggcttcgtgaatctgactttcaccaaagacgaagagagttattacatatccgaggtgggggcctatctgactgtatctgaccctgaaaccatttatcagggtatcaaacacgctgtggtgatgttccagaccgcagtaggacattcgttcaagtgcgtgagcgaacaaagtctgcaacttagcgctcatctgcaggtcaagacaacggatgtgcaactccaagccttcgatttcgaggatgaccatttcggcaacgtggacgaatgttcaagtgactacaccatcgttctccctgtcattggcgccatcgtagtgggcttgtgcctgatgggaatgggagtgtataaaatccgccttagatgtcagagcagcgggtatcaaagaatctag

SEQ ID NO: 27226 - DNA, 543 bp, Artificial Sequence
  Description of Artificial Sequence: Synthetic coding sequence
atgccaaggcaactgtcagctgctgcggcactgttcgcaagtctggccgttattctccatgacggctcacagatgagggcgaaggccttcccggaaaccagagactactcccagccaactgctgcagcaaccgtccaagacattaagaagcctgtgcaacagcccgcaaagcaggccccccatcagacactggccgccaggttcatggatggtcatatcaccttccaaaccgcagccaccgttaaaatccccactacaaccccggctactacaaagaataccgccactaccagtccaatcacatacacactggttaccacacaggctacacccaacaacagtcacaccgccccacccgtcaccgaggtcaccgtgggtcccagcctggcgccttacagcctgcccccaactatcacacctcctgcccataccaccggcaccagttcatctacggtctcccacactactgggaacacgacacagccttctaatcaaaccacactccctgccactctgagcatcgccctgcacaaatccacatag

SEQ ID NO: 27227 - DNA, 843 bp, Artificial Sequence
  Description of Artificial Sequence: Synthetic coding sequence
atggatctacagggtcgcggtgtgcccagtatcgaccggttgcgcgtgctcctcatgctattccacaccatggcgcagattatggcggagcaagaggtggagaacctgtctgggctctctacgaatcctgagaaagatatttttgtggtcagggagaacggtacaacctgtctcatggcagagttcgccgcgaagttcatcgttccttatgatgtgtgggcctctaactacgtggatctgattaccgagcaggcagatatagcgcttactcggggcgccgaggtgaagggccgatgtggccacagccagagtgaactgcaagttttctgggtggatcgagcctacgccttgaagatgctcttcgtgaaagagtcacataacatgagcaagggtcctgaggccacgtggaggctttccaaggtgcagttcgtatatgactcctctgaaaaaactcattttaaagatgctgtcagtgccggaaaacacaccgctaacagtcaccatctctccgctctagtgacaccagctggcaagtcgtatgagtgtcaagctcaacagacaattagtctggcttcctcagatccccagaagaccgtgacaatgattctgagcgctgtccacattcagcctttcgacattatctctgatttcgtgttctctgaagagcacaagtgcccggtggacgagcgcgaacagctggaggaaacgcttccccttatactggggctgatccttgggctcgtaatcatggtcaccctggctatttaccacgtgcaccataaaatgacagccaaccaggtgcagattcctcgcgataggtctcagtataagcacatgggttag

SEQ ID NO: 27228 - DNA, 711 bp, Artificial Sequence
  Description of Artificial Sequence: Synthetic coding sequence
atggacctgcagggccggggggttccttcgattgatcgcctgcgcgtgctgttaatgttgttccatactatggcccagattatggctgaacaggaggtggagaacctcagcggcctctcgactaacccagaaaaggatatctttgtcgtgcgggaaaatgggactacctgcctgatggcagaattcgccgccaaattcattgtgccctatgacgtttgggctagcaattacgtggacgaatcccataatatgtctaagggcccggaggccacctggaggctcagcaaggtccagttcgtttacgattcatccgaaaagactcattttaaggacgcagtgtctgccggcaagcacaccgcgaatagtcatcacctgtctgcgcttgtcacgccagccggcaagtcctatgaatgtcaagcccagcaaacaattagcttggccagtagcgacccacaaaaaacagtcacaatgatcctgtccgcggtacacatccaaccctttgacatcatctcagacttcgtgttcagtgaagagcacaaatgtcctgttgatgagcgggagcagctggaagaaacactccctctaatccttggcctgatccttggcctcgttatcatggtgaccctggccatctaccacgttcaccacaaaatgactgcaaatcaggtgcagattcctcgcgaccggagccaatataaacacatgggctag

SEQ ID NO: 27229 - DNA, 978 bp, Artificial Sequence
  Description of Artificial Sequence: Synthetic coding sequence
atgtcactgcagtctagattgtcaggccgcctcgcacagctgagagctgccggccagctcctggtccctccacggcccagacccggccatttggcgggagctacccgcacgaggagcagcacttgtgggcccccagctttccttggagtgtttgggaggcgcgcccgcacaagtgcaggtgtgggtgcatggggggcagccgccgtagggaggacggcaggggtaagaacgtgggctcccctggcgatggcagcaaaggtggatttatcaactagcacggactggaaggaagcaaagtcgtttcttaaaggcctttcggataaacagagagaagagcactatttttgtaaagatttcgtccggctaaagaagatacctacatggaaggaaatggctaaaggagtcgcggtaaaggtggaggagccccggtacaaaaaggataagcagctaaacgaaaagataagtctgctgagaagcgatatcacaaagctcgaagtggatgctatagtcaacgccgctaactcaagcttgcttggtggcggaggcgtggatggctgcatccacagggcagcgggccccttactcacagacgagtgcaggactttgcaatcatgtaagacgggcaaggctaagatcactggcggttatagactgccagcgaaatacgtcattcataccgtggggccaatcgcctatggggagccttccgccagccaggcagcagagttgaggtcatgttacctgagcagcttggatctgctgctcgaacatcgcctgagaagcgtggcttttccctgtatatctaccggggtgtttgggtatccatgcgaggcagctgccgaaattgtcctggcaactctgcgagagtggctggagcagcacaaggataaggtggaccgtctcattatctgcgttttcctcgaaaaagacgaagatatctaccggtcaaggttacctcactacttccccgtggcatag

SEQ ID NO: 27230 - DNA, 2151 bp, Artificial Sequence
  Description of Artificial Sequence: Synthetic coding sequence
atgaacaatttcagggctacaattttgttctgggccgccgccgcctgggctaagagcggaaagccaagcggagaaatggatgaggttggtgtccagaaatgcaaaaatgcactcaagctgcctgtccttgaggtgctgccagggggcggatgggacaatttgcggaacgtggacatgggaagggtaatggagctaacatattcaaactgccgcactactgaggacggccagtatattattccagatgagatctttactattccccagaagcaaagtaacctggaaatgaatagcgagattctagagagttgggctaactaccagagtagcacgagctatagcatcaatacagagctgtcactcttttccaaagtcaatgggaagttttcgactgaattccagcggatgaagactttgcaagttaaggatcaagctattaccacaagagtccaggtgcgtaacttggtctacacagtgaagataaatcctacactcgaactgagcagtggtttccgtaaagaactcctggatattagtgataggttggagaacaatcagacacggatggcaacttacctggccgagctgctggtcctgaactatgggactcacgtgacaacctcagtggatgcaggggcagctctgatccaagaggatcatctgcgggcatccttcctccaagatagtcagtcctcaagaagtgccgtgactgcttcagccggactggcctttcagaatacagtaaattttaagttcgaggaaaattatacctctcaaaacgtgctaactaaatcttacctgtctaacagaactaattctcgagtccagagcatcggcggggtgcccttctaccccggcattaccctgcaagcctggcagcagggaattacgaatcacctcgtggccattgacaggtctggactgccactgcatttcttcatcaatcccaatatgttacccgacttgccaggacctctcgttaagaaggtctctaagactgtggagacagctgtgaaaagatactacacctttaacacctacccaggttgcactgacttaaattcccctaattttaactttcaagcaaataccgacgacggatcctgcgaaggtaagatgactaatttttcctttggaggcgtttaccaggagtgtacccagctgtctggaaacagagacgtgctcttgtgtcagaaactggagcagaaaaacccactcacgggtgatttctcgtgtccttctggctatagtcccgtgcatcttttaagtcagatccacgaggaaggatataaccatctagaatgtcacaggaagtgtactcttttggtattttgtaagaccgtgtgcgaggatgtgtttcaggtagctaaggccgagttccgggccttctggtgtgtggcctccagccaagtgcccgagaatagcggacttctgtttggcggccttttctcttccaagtccatcaaccctatgactaatgcccagagctgccctgctgggtacttccccttacgcttgtttgagaacctcaaggtttgcgtaagccaggactacgagcttggctctaggtttgctgtgccgtttggtgggttcttttcatgcaccgtggggaaccctctggtcgatccagcaatctctcgagacctaggcgctcctagtctaaagaagtgcccaggcgggtttagtcaacacccagctttaatatccgacggttgtcaggtcagctattgtgtcaaaagcgggctgtttacaggaggaagcctcccacctgcccggcttccgccatttacccggcctcccttaatgtctcaagcagccaccaacactgtcatagtgaccaactccgaaaatgcacggtcgtggattaaggactctcagacacaccagtggagactcggagaaccaattgaactaaggagggccatgaacgtgattcacggggacggaggcggactcagtgggggcgcagccgcaggcgtgactgtgggggtgactacaatcctggcagttgtgatcactctagctatctacggcacaaggaaattcaaaaagaaggcctatcaggccatcgaggaaaggcagagtctggtgcctggcacagcagccaccggcgacacaacataccaggagcagggtcaatcccccgcttag

SEQ ID NO: 27231 - DNA, 495 bp, Artificial Sequence
  Description of Artificial Sequence: Synthetic coding sequence
atgaacaatttccgcgcgacaattctgttttgggccgcggcggcctgggcgaagagcgggaaaccatccggagagatggacgaggtaggcgtgcagaagtgcaagaacgccctgaaactcccagtcctggaggtgctccccggtgggggctgggacaatcttcgcaatgtggatatgggacgcgttatggagctgacttactctaattgccgcacgaccgaggatgggcagtatattattcctgacgagattttcaccattcctcaaaagcagagtaatctcgaaatgaattctgagatcctggaatcctgggccaactaccagtcctccacaagctatagcatcaacacagagctttcattgttctccaaagtcaacggaaagttttccaccgagtttcagagggtgcctgccccttgtcaggctcccacatttcatccagctacccctcacgagagcggctgccaccagtattgccactcggaccagttctag

SEQ ID NO: 27232 - DNA, 1398 bp, Artificial Sequence
  Description of Artificial Sequence: Synthetic coding sequence
atggaagaggaagatgaggaggcccgggccctcctagccggcgggcccgatgaagccgacagaggcgccccggcagcccctggcgctttacccgctctatgcgaccctagtcgactggcgcaccgcctcctcgtgctactacttatgtgtttcctgggctttggctcatacttttgctacgataaccctgctgctctgcagactcaagtaaagcgggatatgcaggttaacaccaccaaattcatgctgttgtacgcatggtacagttggcccaacgtggtcctgtgcttcttcggaggctttctcattgacagagtttttggcatcaggtggggcacaatcatctttagctgcttcgtgtgtatcggccaggttgtgttcgctctcggcggcattttcaacgctttctggctaatggagttcgggagatttgtgtttggcatcggcggagaatccttagcagttgctcaaaatacatacgcagtgtcttggttcaagggcaaagaactgaacctggtgttcggcctgcagctgtctatggcacggattggcagcacagtgaatatgaacctgatggggtggctttacagtaaaattgaggccctgttggggtcggccgggcataccaccttgggcattacgctcatgattggggggataacttgtatattgtccctgatttgcgcgttagccctcgcctacttggatcagagagctgagcggatcctgcacaaggaacaggggaagactggcgaggtcatcaagctgactgacgtcaaagacttttcgctcccactctggctcatatttattatctgtgtgtgttattacgtcgccgtctttccattcataggcttggggaaagtgttcttcactgaaaagttcggtttctcatctcaggccgcatcagccatcaacagcgtggtgtacgtgatttccgccccgatgagccccgtttttggacttctggtggacaagaccggaaagaatatcatttgggttctctgcgctgtggcagcgacactggtgtctcacatgatgctggcgtttaccatgtggaacccgtggatcgctatgtgtctcttggggttatcttactccctcctggcttgcgcgttatggcccatggtggcatttgtcgtgcctgaacaccagctcggaaccgcatatggattcatgcaaagcatacagaacctgggactggcaatcatatcaattattgctggaatgatactcgacagccggggatacctctttctggaagttttcttcatcgcatgcgtgtcgctgagcttattgagcgtcgttctgctctacttagtcaaccgcgcccagggaggcaatctgaactattcagctaggcagcgcgaagaaatcaaattctcgcacacagagtag

SEQ ID NO: 27233 - DNA, 762 bp, Artificial Sequence
  Description of Artificial Sequence: Synthetic coding sequence
atggaggaggaggacgaggaagcccgtgccctgttggctggcggccctgacgaggccgaccggggggcgcctgccgcgcccggcgcgctgcctgcgctttgtgaccctagccggctggcacatcggctgctggtccttttgctgatgtgttttttagggtttggatcttatttctgttacgataacccagctgccctccagacccaggtgaaaagggatatgcaggtgaacacaactaagtttatgctgctgtacgcttggtatagctggccaaatgtggttttgtgttttttcggaggcttcttaattgaccgagtgttcgggagcaccgtgaacatgaacctgatggggtggctctattctaaaatcgaagcactcctgggaagtgccggccatacaacactggggattacattgatgatcggcggcatcacgtgtatcctgtccctcatttgtgccttagcgctggcttatctggatcaacgagcagaacgcatactgcataaggagcagggaaaaacaggagaagtaatcaagctcacagatgtcaaggatttctctctgcctctgtggctgatattcatcatctgcgtgtgttattacgtggccgtatttccattcatcggcctgggcaaagtgttttttaccgaaaaattcggcttctctagtcaggcggcgagcgccattaactccgtagtgtacgtgatttccgcccccatgtcccctgtgttcggcctcctggttgataagacaggcaaatag

SEQ ID NO: 27234 - DNA, 1428 bp, Artificial Sequence
  Description of Artificial Sequence: Synthetic coding sequence
atgggtgtcgcgttgagagacctgcctggacgacacgtttcatcccggtcccacgtgaccgccgtgctaaccgtgttccatggacgttgcttcctcccaggctttggggtggtgaccactttcccttcgccctcgcccgccggagccatggaggaggaagatgaagaagcacgcgctcttttagccggaggacccgacgaagcggataggggcgcacctgccgccccgggggcactgcccgccctgtgtgacccatccagattagcccatcggttgctggtgctcttacttatgtgttttctcggttttgcgatttttgcgatgattatactgctccccttccgactaaaactcaacgaatggggtaccatcatattcagttgcttcgtttgtattggtcaagtggtcttcgccctgggtggcatttttaatgccttctggctgatggagttcggcagatttgtgttcggaatcgggggtgagagtctcgccgtggcacagaacacctacgcagtgagctggttcaaaggaaaggagctgaacctggtattcggtctccagttgtctatggcgcggattggcagcaccgtgaacatgaatttgatgggctggctgtatagcaaaatagaagccctgctggggagcgcagggcacaccacccttggtattactctgatgattggcggaatcacctgtatcctgtctttgatctgtgccttggcattagcatacctggatcagagagcagagcgcatcttgcataaagagcagggcaaaactggcgaagtaatcaaactgacggacgtcaaggatttcagcttacctctgtggctaatctttatcatttgtgtctgctattacgtggcagtatttcccttcatcggtttggggaaagtctttttcaccgaaaagttcggcttcagtagccaggcagcaagcgcaatcaactcagtcgtgtacgtgatttctgcccctatgagtcccgtgttcggcctgctcgtggataagacaggtaaaaatatcatttgggtcctttgcgccgtggcagccacattagtctcacatatgatgctcgctttcacaatgtggaacccctggattgctatgtgtctcctgggtctttcatactcactacttgcatgcgccctgtggcccatggtagcattcgtcgtccccgaacatcagcttggtacggcctatggctttatgcaaagcattcaaaacctggggctggcaataatctctatcatcgccggaatgatactggactccaggggctacttgtttctcgaagtatttttcattgcgtgcgtctcactatcacttctttcagtggtccttctgtatctcgtaaaccgggcccagggcggcaatctgaattacagcgcgcggcagagggaggaaattaaattcagccatacggagtag

SEQ ID NO: 27235 - DNA, 1545 bp, Artificial Sequence
  Description of Artificial Sequence: Synthetic coding sequence
atgggcgtggctctccgcgacctcccaggccggcatgtgagtagccgcagccacgtgactgcagtcctcaccgtcttccatggacgctgtttcctgcccggtttcggagtagtgacaaccttccccagcccatctcctgccggcgctatggaagaggaagacgaggaagcacgcgcactgctcgcaggcgggcccgacgaggcggaccgaggtgctccagccgcccctggcgctttacctgcgctatgcgatccctcaagactggctcaccggctcctggtgctccttctcatgtgcttcttgggttttggcagttatttttgctacgacaacccggcagcgctgcagacacaggtcaagcgtgacatgcaggtgaacacaaccaaattcatgctgctatacgcctggtactcctggcctaatgttgtactctgtttttttggagggttcctcatcgaccgtgtattcggtataaggtggggcaccattattttctcttgtttcgtttgtatcggacaggtggtatttgctctgggcggcattttcaatgccttctggctgatggaatttgggcggttcgtgtttgggattggcggcgaatcgttggctgttgcgcagaatacgtacgctgtgagctggtttaaaggtaaggaacttaatctggtgttcggactgcagttgagtatggcacggattgggtccaccgtgaatatgaacctgatgggctggctgtatagcaagatcgaggccctccttggcagcgcgggacatactactctcggcatcaccctgatgatcgggggcatcacctgtatcctttccctcatctgcgcccttgccctggcttatctcgatcagcgggcagaacggatactacacaaggaacaaggcaaaacaggtgaagtgattaagttgaccgatgtcaaagatttttcactgccactttggctgatctttatcatctgcgtgtgctactacgtagcggtttttcctttcattggccttggaaaggtattttttaccgagaagttcggcttttcctcccaggctgcatcggccatcaatagcgttgtttacgtgatcagcgcgccaatgtcccctgtgttcggactgctggtggacaagactggaaagaacattatttgggtcttatgtgcggtggcagccacacttgtgagtcacatgatgcttgcatttaccatgtggaatccgtggatcgcaatgtgtctcctgggcctgtcttacagccttcttgcctgtgcgctgtggccaatggtggcctttgtggtgccagaacaccagctaggtacagcttatggctttatgcaatctatccagaatctgggcctcgccataattagcatcatagccggtatgatcctggattccagggggtacttgtttctcgaggtgtttttcattgcgtgtgtgtccctcagcctactgagtgttgtgctgctttacttagtcaatcgcgcccagggtggcaatctcaattatagtgccagacaacgtgaggagataaagttcagccacacggaatag

SEQ ID NO: 27236 - DNA, 1368 bp, Artificial Sequence
  Description of Artificial Sequence: Synthetic coding sequence
atgggatggggggggggcggaggatgcacaccgcgccctcccattcatcaacagccacctgagaggcgtgtcgtgacagtcgtgtttttaggactactgctcgatctgctggcctttaccctgctgcttccattactaccaggactcctagaaagccatggtcgcgcccacgatcccctgtatggcagctggcaggggggggttgactggtttgccacagccattggcatgcctgttgaaaagcggtataatagcgttctctttggcggccttattgggtcggctttttccgtattgcagtttttgtgcgctccgctgaccggcgcgacttccgactgcctggggagaaggccagtgatgcttctgtgtctgatgggcgttgcaacgtcctatgctgtgtgggcgacttctaggagttttgccgcattcctggcttccaggctgataggaggcatatccaaggggaatgtctccctctcaacagccatagtcgctgatcttggatcccccctcgccagatcacagggaatggctgtaatcggcgttgcgttttccctcggctttacgctgggccccatgctgggcgccagtttgcccctggagatggcaccttggtttgctctccttttcgctgcatcagacttactcttcattttttgttttttacctgagacactacccttagagaagcgcgccccatcaatcgctctgggattccgtgacgccgctgacctgctctccccacttgcacttctgagattctctgccgtcgctcgcggccaggatcctccatcaggagaccgcctgtcctctctcagacggttgggcttggtctactttctgtacctgttcctgttttcaggcctggagtacaccctcagttttctcacccatcagcggtttcagtttagtagtctgcaacagggtaagatgttttttctcattggcttgacgatggccacaattcaaggcgcatacgcccgacgcatacaccctggtggcgaggttgccgccgtgaaacgcgccctgttgctcctcgtccctgcttttcttctgattggctgggggcgaagcttgccagtgctgggtctgggcctgctcctgtacagcttcgctgccgcagtcgtggtaccttgtctgtcttcggtggtcgccgggtacgggagccctggacaaaaaggtacagttatgggtacgcttcgtagccttggagcactagccagagcagctgggcctctcgttgcagcctctgtctattggctcgccggggcgcaggcctgcttcaccacatggtcaggtctttttttactcccattctttctgctacaaaagctctcttatcctgcccagacgttaaaagccgagtag

SEQ ID NO: 27237 - DNA, 1368 bp, Artificial Sequence
  Description of Artificial Sequence: Synthetic coding sequence
atgggatggggtggaggaggcggctgtacacccaggccacctatccaccaacaaccaccagagcgcagggtcgtgactgttgtcttcctaggacttcttctagacctgcttgccttcacccttctactgcccttgctacctggactgctcgaatctcacggccgggctcacgatcctctctatggctcctggcaagggggtgtcgattggtttgccactgccatcggcatgcccgtggagaagcgatacaacagcgtgctttttgggggcttaataggctctgccttctccgtactacagtttctgtgtgcaccgctgaccggcgcaacatccgattgcctgggtcgccggccagtgatgctgctgtgcctcatgggagttgctaccagttacgcggtgtgggccacaagtagaagctttgccgccttcttagcttctcgcctgatcggcggaatatctaaaggcaacgttagcctgagcacggcaatcgtagccgatctcgggagtccactcgcccgctctcagggaatggcagtaattggggttgctttttctctgggtttcactctgggacctatgttgggcgcatcactgcctctggagatggccccgtggtttgcactactgttcgctgcttccgacctgttgttcattttttgcttcctgccagaaaccctgccacttgagaaacgggcccctagtatcgccttgggctttagagatgcagctgatcttctctcacccttggctctgttaaggttctctgccgtcgcacgaggccaggaccctccaagtggcgacagactttcctctctgcgtcggttagggctggtgtacttcctttacctcttcctgttctctgggctggagtacacattgagcttcttgacccaccagagatttcagttctcttcgctccagcaggggaaaatgttcttcctgatcgggctcacaatggccactattcagggagcttacgctaggcggatccacccagggggggaggtcgcagccgtgaagagggccctgctgctgttggtgccagctttcctcctcatcggttgggggcgctctttgcccgttttaggacttggactgctgctatattcatttgctgcagccgtggtggtcccctgcctgtcatcggtggtggcagggtacggttccccagggcagaagggaacagtaatgggtacattacgctctttgggtgcccttgcacgtgccgccgggcctttggtcgccgcatccgtgtattggcttgccggggcacaggcctgctttacaacctggagtggcctttttctccttccttttttcttgctgcaaaaactgagttacccagctcagacccttaaggctgagtag

SEQ ID NO: 27238 - DNA, 1350 bp, Artificial Sequence
  Description of Artificial Sequence: Synthetic coding sequence
atgtcgccggaatctaaaaaacttttcaacatcattattctgggggtggcatttatgttcatgttcacagctttccaaacttgtggcaatgtcgcacaaacagttattagaagcttgaacaggaccgattttcacggaagtggttatacatctatggcaatcatctatggggttttttcagccagtaatcttattaccccttctgttgttgccatagtcgggccccaactgtccatgtttgcatctggccttttttactcaatgtacatcgctgtctttatccagccattcccgtggtcattctacaccgcctcagtctttattggtattgccgctgctgtgttatggacagcccagggtaactgtctgacaatcaattctgatgagcacagtattggcaggaacagtgggatcttttgggcactactgcaatccagcttattctttggcaatctgtacatctactttgcgtggcagggaaaaactcaaatatctgagagcgatcgaagaaccgtatttatagccctcaccgttatctctctcgtaggaactgtgctcttctttctgatcagaaaacctgatagcgaaaatgtcctcggagaggatgaatcatccgacgatcaggacatggaagtgaacgagtctgcgcagaataatcttacaaaggcggtggacgcgttcaagaaaagctttaagctgtgcgtcacaaaggagatgctgctgttaagcataaccaccgcctacactggactggagctcactttcttcagtggggtttacgggacctgcatcggcgcgactaataaatttggggctgaagaaaagagcctgataggattatccggcatattcataggcataggggaaatactcggggggtccctcttcggactcctgagtaagaacaaccggtttggacggaacccagttgtcctactgggcatattagtccatttcatcgcattttacctgatcttcctcaatatgcctggcgacgcccccatcgctcctgttaagggaaccgactcaagcgcatatataaaatccagtaaggaagtggctatattatgttcattccttctggggctaggtgattcctgcttcaacacacagctgctgtccattctgggatttctctactccgaagattccgcccccgcgttcgcaatttttaaattcgtgcaatccatttgcgccgccgtagcctttttttattccaactacctgctccttcattggcagcttctggtgatggtcatcttcggatttttcgggacaatcagcttcttcacagtggagtgggaggccgccgccttcgtcgcccgcggatctgattacagatctatctag

SEQ ID NO: 27239 - DNA, 1194 bp, Artificial Sequence
  Description of Artificial Sequence: Synthetic coding sequence
atgtctccagaatccaagaagctgttcaacattatcattctgggcgttgcgttcatgttcatgttcactgcatttcagacatgtggaaacgttgcccagactgtgataagaagtttaaataggactgactttcacgggtcaggatatacatctatggcaatcatctacggcgtgttctccgcttctaatctcattacgccctcagtggtagctatcgtcggccctcagctgagtatgttcgcgtcaggtctgttctacagcatgtatattgcagtgtttattcagccctttccctggtctttctacactgcttccgtctttattggcatagcagccgccgagtccgacagacgcaccgtcttcatcgccctaactgtgatatcattagtgggtaccgtgctcttcttcttaattcggaagcctgatagcgagaatgttctgggagaggatgaatccagcgatgaccaggatatggaagtcaatgaatccgcccagaacaacttgacgaaggcagtggatgcgtttaagaagagctttaaactgtgcgtgacgaaggagatgctgctgctgagtataacaaccgcatacacaggactggagcttacattcttctcgggcgtctatggaacctgtataggcgcgacaaataaattcggcgctgaggaaaagtctctcattggactcagcggcatcttcatcggaatcggcgagattctggggggaagtctgtttggcttgctgtctaaaaataacaggttcgggcggaatcccgtggtccttctgggaatccttgtccactttatcgccttctacctcattttcctgaatatgcctggggacgcaccaatagctccagtgaagggaactgattcttcagcttatataaaatcctcgaaggaagttgccatcctctgctcctttctcctgggcctgggagactcgtgttttaacacacagcttctctccatcctcgggtttctgtacagtgaggactcggctccggctttcgcaatcttcaagttcgtgcagagtatttgcgccgcagttgcctttttttactcaaattacctgcttctgcactggcagttgctggtcatggttatctttgggtttttcggcaccatcagtttcttcactgtagaatgggaagccgccgcatttgtggcccggggatccgactaccggtcaatttag

SEQ ID NO: 27240 - DNA, 1443 bp, Artificial Sequence
  Description of Artificial Sequence: Synthetic coding sequence
atgggacctggccctccggctgccggcgcagccccttcgcctagaccgctgagcctggtggcccggctgtcttacgcggtaggccatttcctgaatgacctgtgtgcaagtatgtggttcacatacctcctgctttacctgcactctgtgcgggcttacagcagccgaggagccgggctcctcctactgctcggccaagtggccgatgggctttgtacacccttggtgggatatgaggctgatagggctgcatcctgctgcgcccggtatgggccacggaaggcctggcacctggtgggcaccgtgtgcgtgctgctgagctttccattcatattctccccttgcctcggctgcggcgcagcgacacccgaatgggcagctctgctctattacggaccatttatcgtaatcttccagtttgggtgggcctcgactcagataagtcatctgtccctaattcctgagctggtcaccaacgatcacgaaaaggttgagctgaccgctctccgctacgcctttaccgtcgttgcgaatatcacggtatacggcgctgcttggttactgttgcatcttcaagggtcctcacgagtcgaaccgactcaagacatttcaattagcgatcaattggggggtcaagacgtaccagtgttccgaaatctgtctttgctcgtagttggggtgggggctgtgttcagcctgctgttccacttgggtaccagagagcggcgaagaccccacgctgaagagcccggggagcacacccccctgcttgcacctgcaactgcccaacccctgttactgtggaagcactggttgcgggagccggcattctaccaagtcggcatcctctatatgacaacccgcttgattgtgaatctgtcccagacctacatggccatgtatcttacttactcactacacctgccaaagaagtttatcgccactattcctcttgtaatgtacctttccggattcctcagctcttttctgatgaaacccattaacaagtgtattggacgcaatatgacttattttagcggcctgctggtgattttagcattcgctgcctgggttgcgctggccgaaggcctgggtgtcgcggtgtacgccgccgccgtgctcctaggcgcaggatgtgcaacaattctggtgacctcactcgccatgaccgccgaccttatcggaccacataccaattcaggggcgttcgtctacggctccatgagcttcctggacaaggtggccaacggcctggcagtaatggccatacaatctctgcacccctgcccttctgaattgtgttgcagggcttgcgtgtcgttctaccattgggctatggtggcggttaccggaggcgttggggtagcggcggctctctgtctctgtagtcttctcctgtggcctactcggctgcgccgctgggatcgcgatgcgcggccgtag

SEQ ID NO: 27241 - DNA, 1422 bp, Artificial Sequence
  Description of Artificial Sequence: Synthetic coding sequence
atgggccctggacccccagctgctggggcagccccgagcccaagaccgctcagtcttgtggctaggctctcttatgccgtgggtcacttcttaaacgatctttgcgcctccatgtggttcacttatttactcctctacttgcactctgtcagagcctactcaagtcgtggcgcaggacttctgcttctgctcggtcaggtcgctgacgggctctgcacacccctagtcggttacgaagccgaccgggccgcctcttgctgtgccaggtatggaccaagaaaggcctggcacctggtgggaactgtgtgtgtgcttctctctttccccttcattttctctccctgcctgggttgcggcgctgctaccccagagtgggccgctcttttgtactatggcccgtttattgtaatctttcagtttggctgggcctcaacgcagatctctcacctgtctctcattccagagctggtgaccaacgaccacgagaaggtagaactgacagcgttgcggtacgctttcactgtggtggccaacatcacagtgtatggggctgcctggctgttgctgcacctgcagggttcttcccgcgtggagcccacacaagatatctcgatttccgatcaattgggcggacaagacgttcctgtttttagaaatctctccttgctagttgtaggggtcggtgccgtattcagcctcctcttccatcttggaactagggagaggcggcgccctcacgccgaagagccgggggagcacacacctctgctagctcccgccacagcccagccactgctgctgtggaagcactggttgagggaacctgccttctatcaggttggaatcctttacatgactactcggctcattgtgaatctgagtcagacctacatggctatgtacctcacctatagtctgcatctaccaaagaaatttatcgctaccatccccctcgtgatgtatctgtctgggttcctgtccagctttttgatgaagcctatcaataagtgcattgggcggaacatgacatatttttccgggctgctcgttatcttagcatttgccgcttgggtggctttagctgagggcctgggagtcgccgtctacgccgctgctgtgcttctaggggctggttgtgcaactatcctcgtgacaagcttagctatgacagctgacctgatcggacctcacacaaatagcggggcctttgtctacgggtctatgagttttcttgacaaggtcgctaacggcttggcggttatggctatccagagcctgcacccttgcccaagtgaactgtgctgtagagcctgtgtgtccttctatcactgggctatggtagctgttactggaggggtcggagtcgctgccgcattgtgtctgtgctcccttttgctctggcccacccggttgcggcgttag

SEQ ID NO: 27242 - DNA, 1617 bp, Artificial Sequence
  Description of Artificial Sequence: Synthetic coding sequence
atgggccccgggccgcctgctgctggcgccgcaccttcacctaggcccttgagcctcgtcgcaaggttgagttatgccgtcggacactttcttaatgacctgtgcgcaagcatgtggtttacctacctgctgctgtacctccactccgtgcgggcatactctagccgaggtgccggcctgctcctgctgttagggcaagtggccgacggactatgtacgcctctcgttggctatgaagccgacagagctgcgtcatgttgtgccaggtacggcccccggaaagcttggcacctggttggtaccgtgtgcgtgctgctttcttttccatttattttcagcccgtgtctggggtgcggcgcagccacccctgaatgggctgccctgctttactatggcccttttatcgtgatttttcagttcggctgggcttccacccagatcagtcatctctccctgatccctgagctggtaactaacgatcatgagaaggttgaactcacagcccttcgatacgcctttactgtggtggctaatattacagtctacggagctgcctggttgctcctccacctccaggggagctcgcgcgtggaacctacccaggacatcagcataagtgatcagctgggaggccaggatgtccctgttttcagaaacctgtcacttctggtcgtcggggtgggagcagtgttcagcctcctcttccacttgggcacacgcgagagacggaggccacatgctgaggaacccggggaacacactccactgctagccccagctaccgcacagcccctgcttctctggaagcactggctccgcgagccagccttttatcaagtcggtattctttacatgaccactcgtctgatagtgaatctttctcagacttatatggctatgtacctaacctactctctccatctgccaaaaaagtttattgctactatccctttggtcatgtacttaagcgggttcctttctagctttcttatgaagcccattaacaagtgtatcggacgcaacatgacttacttctccggcctgctagtgatacttgcctttgccgcctgggtggccctcgcagagggacttggggtggccgtctacgccgcggctgtgcttcttggagccggctgcgccacgatactcgtaacctcgctagcgatgactgctgatttaatcgggccacatactaactccggcgccttcgtgtatggctccatgtccttccttgataaggttgcgaatggactagcagtgatggctattcagagcttgcacccttgcccttccgaactttgttgcagggcctgtgtaagcttttatcactgggccatggtcgccgtgacagggggggtcggagttgcagctgcgttatgcctgtgctccttgctgttatggcccactcgcttgaggagaagcttcctggcatggaggcgagggcgaggtgaagataaaggccccggttatagttggatccccactgtgctggtgcagccacccagaccaacaagcccattcctttgggaggcacccctggcctggagatgcacgagaaaaaaatggagcggcgcggggaccaagccgtggcctcgggaagactggggcacacactag

SEQ ID NO: 27243 - DNA, 1239 bp, Artificial Sequence
  Description of Artificial Sequence: Synthetic coding sequence
atgcggggtaaactgctccccctggccggcctctatctagtgcaggggctaccatatggactgcagtccggattgttgcctgtcctgctgagagcaggtggcttaagtttgacaagagtgggtcttgccaaggtgctgtacgctccatggctgttaaagctggcttgggcccctctcgtggacgcacaaggaagtgcaagggcatgggtcactcgctctactgccggccttggcctggtgtgtgggcttttggccgggctgccgcccccgggtgctggacaagctggactgcctgctgctgtcgctggattgctcttgctgcttaatctaggcgccgccatgcaggatgtcgcgctggatgcgttagccgttcagctcctggaacctgcggagcttggacccgggaatacggtgcaagtcgtagcgtacaaattgggggcggccctggcaggaggggccctcttggctcttttgcctaccttttcatggccgcagctttttctactcttggctgccacctactggctggcagctgcacttgcctgggctgctcccgccctgaggcggcttccgcaacaaccaccttcagagcagcggccgcacactgcacacctgctccgggacgtgctcgccgttcccggcaccgtgtggacagcaggcttcgtgttaacttacaaactgggggaacagggggctagttccctgttcccactgttgctgctggaccacggagtttctgcacccgagctgggcctttggaatggcgtcggtgcagtggtctgcagtattgccggtagctcacttggggggaccttactcgctaaacattggaagctcctcccgctgctgagaagtgtgttgaggttcagactgggagggctcgcatgtcagacagctctcgtgtttcaccttgacacccttggggcatcgatggatgcgggtaccatactccgcgggagtgccctacttagtctatgtctccaacattttctcggcggtctggtcacaactgtcacatttaccggcatgatgcgatgctcacaactcgcaccgagggcattacaggcaacccattattccctgctcgctactcttgaactactgggtaaactgctgctaggaacgctggccggggggttagctgatggcctcggcccccatccttgtttcttgctcctgctcattctgagtgcattcccagtcctctacttagacctggccccctctacatttctttag

SEQ ID NO: 27244 - DNA, 1545 bp, Artificial Sequence
  Description of Artificial Sequence: Synthetic coding sequence
atgggctgcgacgggcgtgtatcaggcctgctcaggcgaaacctccagccaacactgacttattggtcagtcttttttagtttcggactctgcatagcattccttgggcctacacttcttgatctccgatgccagacacactcctccctccctcagatcagttgggtcttcttttctcagcagttatgtctgcttctcgggtccgccctcggaggagttttcaagcgcacgctggcacagtctctctgggccctgtttacaagttctctggccattagccttgtcttcgccgtcataccgttctgccgcgacgtgaaggtgctggcgagcgttatggcccttgcaggcctggccatggggtgtatagacacagttgctaacatgcagctggtgagaatgtaccagaaagattcagccgtgttccttcaggtccttcatttcttcgtgggctttggggccctgctgagccctcttatcgcagacccatttctgtcagaagccaattgcctccccgccaacagcacagccaatactacaagccggggccacttatttcatgtgtccagggtgctgggacaacatcacgtggatgccaaaccttggtcaaaccaaactttccctggacttacacccaaagacggggcaggcaccagggtttcatacgcattctggattatggccctaatcaatctgccggtgcctatggcagtattaatgttattatcaaaggaaagattgttaacatgttgtccacagcgcagacccctacttctttcagcagatgagctggctctggagacacagccaccagaaaaagaagatgcctcttctctgccccctaagttccaaagtcacctcgggcatgaagatttgttcagttgctgccaaagaaagaatctgaggggcgctccttattcttttttcgccatccacatcaccggtgcactcgtcttgttcatgaccgacggtttgaccggtgcatatagtgcattcgtgtacagctatgccgtcgagaagcccttaagcgttgggcataaggttgctggatacctcccatctttgttctggggattcatcactctggggcgcttgctttcaatccccatcagcagccgaatgaaaccagcgactatggtgttcattaatgtcgtgggcgtcgtagtgacctttctggtacttctgatttttagctacaatgtggtattcttgtttgtcggcaccgcctctttaggattgttcctgtcctctactttcccctctatgctggcttacactgaagacagtctgcagtataaaggatgtgctaccacagtcctggttacgggggcgggcgtaggcgaaatggtattgcaaatgctggttggctctatttttcaggcacagggcagctactcattcttagtgtgtggagtgatctttggttgtctggcatttactttttacatcttactgctcttttttcaccggatgcacccaggactcccctctgtacctacacaagacagatccatcggaatggagaactccgagtgctaccaaaggtag

SEQ ID NO: 27245 - DNA, 1284 bp, Artificial Sequence
  Description of Artificial Sequence: Synthetic coding sequence
atgggctgtgatggcagggtcagcggtttacttagacgcaatctccagccgacactgacctattggtctgtgttctttagcttcggactgtgcatagctttcttggggccaaccctcctggatttacggtgccagactcattcatccctcccacagatctcttgggtgttctttagccaacagctctgtcttttgttgggctcagcattaggcggggtttttaagcggacgctcgctcagtcactctgggccttgtttactagcagtctggccatcagtctcgtgtttgcagtaatccccttctgccgggatgtcaaagtgctcgcgtccgtaatggcactagctggtctggccatggggtgtatagacaccgtggctaatatgcaactcgtgagaatgtaccaaaaagatagcgctgtgttcctgcagttacctgttccaatggccgtactgatgctgttatcgaaagagaggttgctcacatgttgtccgcaacgccggccacttctcctgagtgccgatgaactagctctcgagacacagcccccggagaaggaagatgctagctcattaccccctaagttccagagccacttaggccacgaggacctattttcatgctgtcaacgtaagaacctgcgtggcgctccttattcctttttcgccatccacattacaggggccctcgtactgttcatgaccgatggcctaacgggagcttacagcgcctttgtgtattcctacgctgttgaaaagcccctcagtgtcggccacaaagtggctggttatctgccctctttattctggggcttcattacactggggagacttctatccattcctatcagtagtagaatgaagcccgccacgatggtgttcatcaacgtggttggagtcgtggttacgttcctcgtgttacttattttctcttacaatgtagtgttcctctttgtgggaaccgcaagcctgggtctcttcctatccagtaccttcccatccatgctcgcttatacggaggatagtctccaatataaggggtgtgccactaccgtgctcgtcaccggtgccggagttggcgaaatggtgctgcagatgctggtaggatccatctttcaggctcaaggtagctactccttcctggtgtgtggtgtgatctttggatgtttggcctttaccttttacattctgcttctattcttccacagaatgcatcccgggctcccaagtgtgccgacccaggatcggtcgatcggcatggaaaacagtgagtgctaccagaggtag

SEQ ID NO: 27246 - DNA, 1323 bp, Artificial Sequence
  Description of Artificial Sequence: Synthetic coding sequence
atgggctgcgacggccgggtatcagggttattgaggcgtaacttacagcctacactcacttactggagtgttttcttctctttcgggctttgtatcgccttcctgggcccaactttactcgatctccgatgccagactcattcttctttgccacagatctcatgggtatttttcagccagcagctgtgtctgctcttagggagtgccttggggggtgtttttaagcgcactctggcccaatcactctgggcgcttttcaccagcagtctggccatctctctggttttcgccgttatcccattctgccgcgacgtgaaagtgttggcctccgtgatggcacttgccggtctggcaatgggttgcatcgataccgtcgccaatatgcagcttgtcagaatgtaccagaaggacagcgctgtcttcttgcaggtgttgcatttctttgtgggtttcggcgccttactatcccctttgatcgccgatcccttcctgagtgaagcaaactgtctccctgcaaactccacagccaacaccacatctcggggccacctattccacgtgtcccgcgtcctgggtcagcatcacgtcgacgcgaagccgtggtctaatcagacattcccaggacttactcctaaggacggggcaggcacaagggtaagttacgccttctggatcatggcactcattaacttgcctgtgccaatggccgtgctaatgcttctcagcaaagaaaggcttctgacatgctgcccgcagagacgcccccttctactgtccgccgacgaactcgccttagaaactcagcctccagaaaaggaagatgcaagttcgctaccacctaagtttcaatctcacctagggcatgaagacctgttctcgtgttgccagcgaaagaatctacgcggcgccccatactcctttttcgcgatccacatcacaggagccttggtgctatttatgaccgatggactgacaggcgcctattccgcttttgtctacagctacgcggtggaaaagccactctccgtgggacacaaagtcgcaggatatctcccctcgctgttctggggattcataacgcttggccgactcctgtccattccaatcagtagccgcatgaagcctgcgaccatggtgttcataaacgtagtgggggtagtcgtgacattcctcgtgttgttaattttctcctataacgttgtgtttctcttcgtgggaactgcaagtcttgggctgttcttgtcttccacatttcccagcatgctggcctataccgaggatagcttgcagtacaaggacatcccagggagcggccaactttag

SEQ ID NO: 27247 - DNA, 1299 bp, Artificial Sequence
  Description of Artificial Sequence: Synthetic coding sequence
atggaagtgactgcggtcggagaagaagcaaaccagggggatcttctcggttttggacaaagatgctgtagcttaggctccagcaacccttggctctaccggaccgccggtatcttcccggagcattgtaccgaggagaaaaaaattggcacttacttccgtgttgcaccacaggcctctaagtcccaaagatcccgctgccacggcatggcagcctccgaagcacggcctggtgaagcgactgccgccagctacgggaggccattcccaactcatccccggcgacaggaatttcgggcgagggtggtccgaggccctacaatgctggtaactgcttacctagcttttgtcggattattggcatcttgcctgggcctggagctcagccggtgtcgcgctaagccgccaggtagagcctgtagcaacccatcctttttgcgattccagcttgacttttatcaggtctatttcctggctctggccgccgattggttgcaagccccatacttgtacaaactttatcaacactattattttttggaggggcagatcgccatcctgtatgtgtgcggactcgcaagtaccgtgctttttggactagtcgcatcaagtctagtggactggctgggccgaaagaactcctgtgtgctcttctccttgacctacagcctttgctgtctgactaagctgtcacaagactatttcgttctgctggttggtcgcgccctaggcggcctctcaacagcactcctcttctctgccttcgaagcgtggtacatccatgaacacgtggagagacacgatttccccgccgagtggattcccgcaaccttcgccagggccgctttctggaatcatgtattagctgtggtcgcaggcgtagcagccgaggccgtggcatcctggatcggcctaggacccgttgcccccttcgtggcagctatccctctcctcgcgctcgccggcgccctggcactccggaattggggagagaattacgatcgccagagagctttctctcgtacatgtgctggcggattgcgatgccttctgtctgaccggagagtactgttgttgggtacgattcaggccctgtttgaatccgtgatctttattttcgtgtttttgtggacacctgtcctggatccacacggcgctccacttggaatcatcttcagctcatttatggctgcatctctactggggtcttccctatatcgcatcgccacctcaaagaggaccgtgatagaaaaacaggcccttgggatttgctccgcgttcgcccttctgtcttggtag

SEQ ID NO: 27248 - DNA, 1353 bp, Artificial Sequence
  Description of Artificial Sequence: Synthetic coding sequence
atgctcgtgaccgcctacctcgccttcgttgggctgctggccagttgcctcggcttggagctgtcccgttgtagggcgaagcccccaggaagagcatgttccaacccgtcctttctgagatttcagttggatttctaccaggtgtacttccttgctcttgcagcagattggctgcaggccccctacttatataagctgtaccagcactattacttcttagagggacaaatcgccatcctctacgtttgtgggctggcaagtaccgttctgtttggcttggtggcctcgtccttagtcgattggttgggccgaaagaattcttgcgtgctgttctcactcacatattccctctgctgtcttacgaaactgtctcaggattactttgtgctcctagtaggaagggctctaggcggcctcagcaccgcgctcctgttttctgcttttgaagcctggtatatccacgagcacgtggaaagacacgattttcctgctgagtggatcccagcaacttttgcgcgcgccgccttttggaaccatgtgctcgcggttgtcgctggggtggcagcagaagctgttgcgagctggattggactgggacctgtggccccattcgtggccgccattcctctcctggctctggctggcgctttggctctgcggaattggggggaaaattatgaccgccaaagggcattttcgcgcacatgtgcgggtgggctgagatgcctgctctctgaccgcagggtgctcttgctgggaactatccaagctctttttgagagcgttatcttcatatttgtgtttctttggacaccggtgctagacccgcacggcgcacccctgggcattatcttttccagtttcatggccgctagtctgctgggatcatctctctaccgaatcgcgacgagcaagaggtaccaccttcagcctatgcatctgctgagtctggccgtgctaattgtggtcttttcacttttcatgctgacttttagtacatctccaggccaagaatctccggtggaatccttcatcgccttcttactgatagagctagcctgcggtttatattttcctagcatgagcttcctgcgtagaaaggttattcctgaaaccgaacaggccggcgtgctcaattggtttagagtgcccctccacagtcttgcctgcctcgggctcctcgtcctacacgattcagatcgtaaaacgggtaccaggaacatgttctcgatctgcagtgctgtcatggtaatggcactgctcgccgttgttggcttattcaccgtggtgaggcacgacgcagagctgagagtaccatctccaacagaggaaccctacgctcccgagctttag

SEQ ID NO: 27249 - DNA, 1674 bp, Artificial Sequence
  Description of Artificial Sequence: Synthetic coding sequence
atggaagtcaccgcagtgggagaagaggctaaccagggagacctcctgggttttggccaaaggtgctgtagcctgggctcgtcgaatccatggttgtataggactgccggaattttcccagagcactgtaccgaggagaagaagatcggcacgtactttagagtggctcctcaggcgtcaaaatctcaaagatccaggtgtcatggcatggccgcctcggaggcacggccaggagaggccacagccgcctcatatggccgtccctttccaacccatccaaggagacaggagtttagagcgcgggtggtgagagggccaaccatgctggttaccgcatatttggccttcgtgggactgcttgccagctgtctgggcctggaattgtcacgctgtagagcaaagcccccagggagggcctgctcaaacccctccttccttaggtttcagttggacttttatcaagtttatttcctagctctggccgccgattggttgcaggccccatatctgtataagctgtaccagcactactatttcctagagggccagatcgccatattgtatgtatgcgggttggcctctacagtcctcttcggcctcgtggcttcctctctcgtagactggttaggccggaaaaatagctgcgtgctgttctcccttacctactctttatgctgtctgaccaaactctcccaagattacttcgtgctccttgtgggtagagctctgggagggctgtcaacagccttattgttcagcgccttcgaggcttggtatatacacgagcacgtcgagcgccacgactttcctgccgaatggatacccgctaccttcgctagagccgctttttggaatcacgtgcttgccgtagtggccggcgtagccgcggaggctgtggcctcatggatcggcttggggccagtcgcgccgtttgttgctgccatcccattgttagcgcttgcaggtgccttggcattgcgcaactggggtgagaactatgatcgccagcgggccttctcaagaacctgtgccggaggcctgcgttgcctgttaagcgataggcgtgttttactgcttgggaccatacaggccctatttgagtctgtgatatttatcttcgtgtttctgtggacaccagttctggaccctcatggtgcacccctgggcattatattctcctctttcatggcagcttctctattggggtccagtctgtacagaatcgcaacatcaaaacgctatcatttgcagccaatgcacctgttatccctagcagtgctcatagtggtcttcagcctgtttatgctcactttcagtactagcccgggacaggaatcacccgtcgaaagctttattgcatttttattgatcgaactagcatgcggcctttattttcccagcatgtcatttctgcgaagaaaggtgataccagagaccgagcaggcgggcgtgttgaattggttccgagtacccctgcactctctcgcctgcctcggcttgctggttctgcatgacagtgataggaaaaccgggacccgaaatatgttcagcatctgcagcgcagtcatggtgatggctctcctggccgtcgtgggcctttttacggtagtcaggcatgacgccgagctccgagtaccctcccccacggaggagccgtatgctccagaattgtag

SEQ ID NO: 27250 - DNA, 1395 bp, Artificial Sequence
  Description of Artificial Sequence: Synthetic coding sequence
atggaggtgaccgccgtcggcgaagaggcgaatcagggagacttactgggctttgggcagaggtgttgcagcctgggatcaagtaatccatggttataccggacagcaggaatttttccagaacactgcactgaagagaagaagataggtacctatttccgggtggccccacaagcatctaaatctcagcgctctcgatgccacgggatggcagccagcgaggcaaggcctggcgaagcaacagcagccagctacgggcgcccgttcccgacacacccccgaaggcaggaatttagggccagggttgtccgtgggcctacgatgctggttacagcgtacttggcctttgtgggccttctcgcgtcctgcctcggacttgaattgtccaggtgtcgggctaagcccccaggtagagcctgctctaacccctcttttctccgctttcagctggacttttatcaggtgtattttttggctcttgccgccgattggctgcaagccccatacctgtacaaattgtatcagcattactacttccttgaaggacagatcgccatcctgtacgtgtgtgggctggcgagcaccgtattgttcggcttggttgctagtagcctggtggactggctagggaggaaaaacagctgcgtgttgtttagcctgacatactcactgtgttgcctcacaaagttatcccaggactatttcgtgttgctggtcggcagagcattgggggggctgtcaaccgctctgttattctccgcctttgaagcttggtacattcacgaacacgtcgagaggcacgatttccctgctgaatggatcccggctaccttcgcccgggctgctttctggaaccacgttctggcagtggtggctggagtcgctgctgaggcggtggcctcctggattggactcggccctgtggccccttttgttgcggcgataccactcctcgccctggcaggggcattagcattgagaaactggggcgaaaactatgaccggcaacgtgctttctcaagaacttgcgccggcggccttcgctgcctgctgagtgacaggcgggtgcttctgctgggcacgattcaggcactatttgagtcagtcattttcatctttgtcttcctgtggacaccagtactcgatccgcacggcgctcccctcgggattatattctcatcctttatggcggcatccctgttaggcagcagcttataccgtatagccactagcaagtctgacagaaagacaggcacgaggaacatgtttagcatatgtagtgccgtaatggtgatggccctgctggccgtcgtgggcctgtttacagtggtcagacacgatgcagagctccgcgtgccaagcccaactgaagagccatatgctccagagctgtag

SEQ ID NO: 27251 - DNA, 1761 bp, Artificial Sequence
  Description of Artificial Sequence: Synthetic coding sequence
atgtcagccaacccaaggtgggacatcagtagggctctgggtgttgccaagttgttccacctggtatgcggcgtgagggaagcctgcgtcacaccatttctgacgttgtatctgcggcagctcggacttgccgctccttgggtcggcacccttatgggtacaaaacacctcattgctgctttctgggccccggtctgtgccttcttagctaagagttacaggaagcgacgagctcttctcatcggctcacttctgggaagtgtgggcgcaagtctacttatggtgctggtgccccccgtcgataagaaccgggtgcacttcccatgtaacggcagctccgggctgacctctaccgatgctctgcccggcgtgacattacccgttaatattacatctgcccaggagtccgcctcttcccacccagctaaaagaacggctgaggtggaaatgcctgggttccgaaatccccctggggagagcgaccgcgagaccttcagagatctccacgtatatctggctcctagcgtggagggagctaggactacatcgcaagcgcttctgcacccggtcacatctggtctgaaagatcatccctgggaagtgacattcgaagtcgtgaaaacagccttgccactgctgcctggcggcaagggcccaggcaaccctgctaatctctccggtaccaagggcaaagcttgggctttcgacctcagcctggaggccttacgtaggacattcatcttgtcactaggttctgtggcgttctgggagctcctcactgcacccttggaacaggtagccgacgacagcctttacgaatttttagactttgtggacgccaccgatcgctatcgctccctgtgggtatggcgtcttctgggcatgtctgccggagtgtgcggaattactgccttagttgggcagctggattgtttcctgatgaccagcggaccacgcggcgtggtgcatttttacggttattctgtggtttccacattggctctcttggtgagcattgcttttcccattcccatctgtcagcaatgggaaccgagctataagagagtaaaggcgctatccattgtgggtggtgacccccacttgattctgctcgcttctaccactgtgctcgtcggcgcgatcgtatccacagtccagaatttcctgttctggcatatgaaagaccacgggtcaggagagctggtgatgggtttttccgtggctctttctctcctgggggaaattctgttgcaccctttcaaggcgactctattgagaaagctgagcagaactggcctggtgggcctgggcctttcctgtctggccggccagctgctctattatagtttcctgtggagctggtggtcggttctgcctattcagatactctccgctatcagcaatagagctctttggtgggctgtgggcgcctctgtggaagatctcgcaactccccgtatggaaagagccctgtcagctctcttccgcgggcacttttatggtagcgggtgcagtcttgggagtttcgtcggagggttcgtcgttatgagattctccctggctgtactgtaccaggcctgctgcgtagcattgttgctgtggctcgctctgctgctttcaatccagcgaaggctgccccgggagcgtaagatcaagtactccaagctgctgtctatggaagtgtctgatactagtgacagcgagcagggtacagaacaggattggttagtgaaagcaatgcgagaggagcattccgattag

SEQ ID NO: 27252 - DNA, 1680 bp, Artificial Sequence
  Description of Artificial Sequence: Synthetic coding sequence
atggccggtcccactgaggcggaaacgggacttgctgagccccgggccctatgcgcccaaagaggacataggacctacgccagacgctgggtgtttctcctggccatcagtctactgaactgctcaaacgctaccctgtggttgtctttcgcacctgtcgcggatgtcattgccgaagatcttgtgctcagcatggaacagatcaactggctctccctcgtgtatctagtggtgtctacacccttcggagtggctgcgatctggattttagacagcgttggcctacgcgccgcgaccatcctgggagcatggctgaacttcgccggtagcgtactgagaatggttccgtgcatggtggtcggtacccaaaatccctttgcttttctgatggggggacagtccctgtgtgctctggcgcagtctctcgtcatattttcccccgccaagctcgccgccctttggttccccgagcatcagagagccacagctaatatgctggcaaccatgagcaatccactgggtgtgctcgttgccaatgtgctcagcccagtcttagtcaaaaaaggtgaagatattccccttatgctcggtgtctatactattcctgcgggtgtggtgtgcctgttgtcaaccatttgcttgtgggagtccgtcccacccacaccacccagcgcgggcgcggcatcctccaccagtgagaaatttctcgatgggctgaaacttctgatgtggaacaaagcttacgtgatactggcagtgtgtctgggcggcatgattggtatttctgctagttttagtgcgttattagagcaaatcctctgtgccagcggccattcaagtggttttagtggcctgtgtggcgccttgtttattaccttcggcatacttggagccttggcactaggcccctacgtggatcgcaccaagcattttaccgaggcaacaaagattggcctgtgcctcttcagtttggcttgtgtcccgtttgctttggtgtcccagcttcagggacagaccttggctcttgctgctacatgctccctgttaggcttgttcgggttttctgtgggtcccgtggccatggaactggcagtagagtgtagttttcccgttggtgagggagcggctacgggaatgatatttgtactcggtcaggctgagggtattctaattatgttggcaatgacagccctaacagtgaggagatcggagccatctctgtcgacgtgtcagcagggcgaggacccgctggactggactgtgtccttgttactcatggccggactatgtacattcttttcatgcatcctcgctgttttcttccatactccctatcgccgcctgcaggccgagtcgggggagcccccctccacacgaaacgcagtagggggggccgacagtgggcccggcgtggaccggggtggggctggaagggccggggtcctaggcccctcgactgcaacccccgagtgcactgctcgtggagcctcgttggaggaccctcgggggcccggatcccctcatcccgcctgtcaccgagcaacgccaagagcccagggcccagctgccacagacgccccttcgagacccggtcggcttgccggcagagtgcaggccagccgatttatcgatccagccggctcccactcctccttttcctcaccctgggtaattacctag

SEQ ID NO: 27253 - DNA, 1326 bp, Artificial Sequence
  Description of Artificial Sequence: Synthetic coding sequence
atggccggtcctaccgaagctgagactggcctggccgagccgcgcgctttgtgtgctcagcgcgggcacaggacctatgctcgccggtgggtttttctgctggcgatctctctgctaaactgctctaacgccaccatcaactggttgagcctcgtctatctagtggtttccacaccctttggagtggctgccatctggatcctagattccgtcggcctccgcgccgctctgggtgtgtacaccatccccgccggggtggtttgcctcctatccactatatgtctgtgggaatctgtgcctcctactcctccatccgccggcgcagcttcttccacatctgagaagttcctggacggcttgaagttgcaactcatgtggaacaaggcgtacgtcattctggctgtctgcctaggcggtatgattgggatttcggccagcttctcagctctgttggaacagattttgtgtgcatccggccactctagcggattttctggactctgtggcgctctttttatcacatttggaatcttaggcgcactggcgctggggccctacgtcgatcgcaccaaacacttcactgaggcaacgaagatcggcctgtgcctattcagcctggcatgcgttccatttgctttagtatctcagctgcagggtcagacactagctctcgctgccacttgtagtttgctcggactgtttggattttccgtggggccggtggctatggagctcgccgttgaatgcagttttcccgtgggggaaggtgccgctaccggcatgatcttcgtactggggcaggccgagggcatcctcatcatgctagcaatgaccgctttgactgtgagaagatctgagcctagcctcagtacatgccagcagggtgaggaccccctggattggactgtgtctctgctcctgatggccggtttgtgtaccttcttctcttgtatcctagccgtattcttccatactccctacagaagactacaggccgagagcggggagcctcctagtacccgaaatgctgtaggaggcgccgactcgggaccgggtgtggaccggggaggagcaggtcgtgcaggcgtgttggggccatcaaccgccacaccggagtgtaccgcccgcggagcatctctcgaagaccctagaggcccagggagtccacatccagcctgccaccgcgccactccaagagcacagggtccggccgccaccgacgctccgtccagacccggccgactcgccgggagggtgcaggcttcccgattcatcgacccggccggcagccactcttcattctctagcccctgggttatcacctag

SEQ ID NO: 27254 - DNA, 1683 bp, Artificial Sequence
  Description of Artificial Sequence: Synthetic coding sequence
atggctggaccaaccgaggctgagactggcctggccgagccacgagccctctgtgcacagcgcggccatcggacatatgctcgtaggtgggtattcctgctcgccatcagcctcctgaattgcagtaatgctactctgtggctgtctttcgccccagtagcagatgttatcgccgaagacttggtccttagcatggaacaaattaattggctctctttagtctacctggtcgtttccacacctttcggcgtggccgccatctggattctggacagcgtggggctccgagctgcaacaatcctgggcgcctggttgaatttcgcaggatctgtgctgcgaatggttccctgtatggtggtgggaactcagaaccctttcgctttcctgatgggaggacagtccctgtgcgctcttgcccagtccctagttatattttccccagctaagttggcagcgttgtggtttccagagcaccagcgcgcgacagcaaatatgctggcaaccatgtcaaacccactgggcgtcctagtggctaacgttctcagcccggtgttagtgaagaaaggggaggacatacctctcatgctcggcgtttacactatccccgcaggtgtggtgtgtcttctctctacgatctgcctctgggaaagcgttccccctacacctccatccgcaggtgcagcatcctccaccagtgaaaaattcctagacggcctgaaattgcaactgatgtggaataaggcatatgtaattcttgcagtatgtctcggcggaatgattggcatatctgcaagcttcagcgccctcttagaacaaatactatgtgcctccggccatagttccgggttttccggtctgtgcggtgcattgtttattacattcggcatcttaggggctctcgcgttggggccttacgtggacagaactaaacacttcacagaagcgaccaaaatcggcctttgtctcttcagcctcgcctgcgtgcccttcgcactggtatcacaacttcagggccagaccttggctctggccgccacctgtagcttgctgggcctcttcggattcagtgtgggacctgtggcgatggagctggcagtggaatgttcctttcctgtcggggagggagctgcaaccgggatgatatttgtgcttgggcaggccgaaggcattctaataatgctcgctatgaccgctttgactgttcgaaggtcggagccgtcgctttcaacttgtcagcagggggaagacccactcgactggacagtatccttgcttctgatggccggcctctgcacctttttcagctgtattctggcggtcttcttccacacgccataccggagactccaggccgagtccggcgagccaccttctactcgcaacgcagtggggggtgccgatagcggcccaggtgtggacagaggtggcgcaggcagagcaggagtcctgggtccctcaacagcaacacctgagtgcactgcccgaggagcttccctggaggacccaagagggccaggcagcccgcaccccgcctgtcaccgagctactcctcgcgcccagggacctgccgctaccgacgcaccttctcggccaggtcggctcgccggacgtgttcaggccagcagatttatcgatcccgccgggtcccattcctccttttcttcaccttgggtgattacgtag

SEQ ID NO: 27255 - DNA, 1425 bp, Artificial Sequence
  Description of Artificial Sequence: Synthetic coding sequence
atggagctcggagggcactgggacatgaattcagcccctagactggtttcagaaactgcggaacgcaaacaggaacagaaaacaggaaccgaggcagaggcagctgatagcggagcggtgggggctcgaagatttctcttatgcctttatctcgtggggttcctggacctctttggtgttagcatggtcgttcctttactgtcactgcacgtgaaatcactgggcgcctcgccgactgtggccggcatcgtgggatcttcatacggcatactacagttattttcgagcacacttgttggatgctggagcgacgtagtaggacgacgctctagcctcctggcatgcattctcctctccgcgttgggatatctgctgctaggtgccgctaccaacgtcttcctctttgtgctcgcacgggtgcctgccggaatattcaaacatactctcagtatatctagagccctcctctccgacgtggtgcccgagaaagaaagaccactcgttataggacactttaacacagcctccggagtggggttcatcctggggcccgtggttgggggctatcttacggagcttgaggatggattttacctcacagcattcatttgctttctggtgtttatcctgaatgctgggttggtgtggtttttcccttggagagaagccaagcccgggtcgactgaaaagggtctacccctgagaaaaactcacgtactactgggcaggtcgcacgatactgtgcaggaagccgccacaagcaggcgggccagggcctccaagaagaccgcccagccttgggtggaggtcgttctcgcattgagaaatatgaagaatctgctttttagtgagatgtgggacatattcctagtcaggctcctgatggccatggctgtcatgctgtattatagcaatttcgtactggccctggaagaacgctttggagtacggcccaaggtgacaggctatctcataagctacagtagtatgcttggagccgtggcgggtctcgcccttgggcccatcctcagactctataagcataactcacaagctctgctgcttcatagctctatcctcacatgtaccctcctgttgctgtacagccttgcccccactatgggcgcagtcgtattaagttctactctcctgtccttctccactgccatcgggcgtacctgcattaccgatctccaactgaccgtggggggagcgcaagctagcggcaccttaattggagtgggtcagtctgtgaccgcagtgggccgaatcatcgcccccctcctgagcggggtggctcaggaggtatctccctgtgggcccccctccctgggtgccgttctcgccctggttgccattttcattatgagtttgaacaagcgccacagctccggagatggaaattccaaactgaagtccgaatag

SEQ ID NO: 27256 - DNA, 465 bp, Artificial Sequence
  Description of Artificial Sequence: Synthetic coding sequence
atggccgttatggcccctcgcactctattgctcctcctttcaggggctctcgccctgactcaaacatgggccggaagccattcgatgcgttactttttcacctccgtctcccgcccaggacgtggggagccccggttcatagccgtggggtatgtggacgacactcagttcgttagatttgattctgatgccgcaagccaaagaatggagccccgcgcaccgtggatcgagcaggaaggaccagagtactgggaccaggagacaaggaatgtgaaagcccagtcccagacagaccgtgttgacctggggacactcaggggctattacaatcaatcagaggctggttcccacacgatccagattatgtacggatgtgatgttgggtccgacggtcgctttctgcgagggtatagactccggtccccatccgcaagtgggcgcagacctatgagaagatcttcatag

SEQ ID NO: 27257 - DNA, 900 bp, Artificial Sequence
  Description of Artificial Sequence: Synthetic coding sequence
atggccgtcatggccccccgcacactgctgttgcttctaagcggcgctctagcccttactcagacctgggccggttctcacagtatgaggtacttcttcacaagcgtgagccgcccagggaggggcgagcctagattcatcgccgttggatatgttgacgatactcagttcgtgaggttcgactctgatgccgcctcacagaggatggaaccaagggcaccttggattgagcaagaaggcccagaatactgggatcaggaaactaggaatgtaaaggcccagagccagaccgaccgggtagaccttggaacactccgtggctattataatcagtccgaggccgggtctcacacgatccagattatgtacgggtgtgacgtaggctcagacggcaggttcttgcgcggatatcgccaagatgcttacgacggcaaagactatatcgctctaaacgaagacctgagatcctggactgcagccgatatggctgcacagattacaaagcgaaagtgggaggccgcacacgaagcagaacaactcagagcctatctcgatggtacctgtgtcgagtggcttagacgataccttgaaaacggtaaggagacgttacagcgcacggaccctccgaagacccatatgacccatcacccaatctcagatcatgaggctacactgcgctgttgggccctaggcttttatccagctgaaatcaccctcacatggcagcgggacggagaggatcagacacaagacacagaactggtggagacaaggcctgctggtgatggaacattccagaagtgggccgcagttgtggtcccctcgggagaagagcagaggtacacttgccacgtgcagcacgaagggctgcccaagcccttgactctccgctgggtttag

SEQ ID NO: 27258 - DNA, 1116 bp, Artificial Sequence
  Description of Artificial Sequence: Synthetic coding sequence
atggcagtgatggcccctaggacattgctgctgctcctgtccggcgccctcgcgcttacccaaacttgggccggctcacatagtatgcgctatttctttacatcagtgtctcgccccgggaggggcgaaccaaggttcattgctgtgggatatgtggatgatactcagttcgttcggtttgactctgacgcggcgtctcaaagaatggagccccgcgcaccttggattgagcaggaaggtcccgagtactgggatcaggaaacacgcaacgttaaggcgcaatcccagaccgacagagtcgatctcgggactttgcgcggatactacaaccagtcagaagctggctcccacaccatccagattatgtacggctgcgacgttgggtcggacggcaggttccttaggggctaccggcaggatgcatatgacggtaaagactacattgcacttaacgaagacctgcgatcctggacagccgctgatatggcagcccagataaccaaacgtaagtgggaggcagctcatgaggccgaacaattgcgcgcctaccttgatggcacctgtgttgaatggctcagacgctacctggaaaacggaaaagagaccctccagcgaacggacccccccaaaacacatatgacacaccatcctatctccgaccatgaggcaaccctccgatgctgggcactcgggttttaccccgctgagataactcttacctggcagagagatggcgaggaccaaacgcaggataccgagcttgtggaaacccgccccgcaggcgacgggacattccagaagtgggccgccgtggtcgtgccttccggcgaagaacagaggtatacatgtcatgtacaacacgagggactgcctaagccactgacattacgctgggaactgtcatcccagccaacgattcctatcgttggaattattgcgggactggtcctgctgggagcggttatcaccggggctgttgtagcagctgtgatgtggcggcgtaaatcttctggtggagaaggggtaaaggatcggaaggggggctcatatacccaagccgcaagctctgatagcgcccaggggagcgacgtttccttgactgcctgcaaagtgtag

SEQ ID NO: 27259 - DNA, 1098 bp, Artificial Sequence
  Description of Artificial Sequence: Synthetic coding sequence
atggcggtgatggcacccaggactctgttgcttctcttgagtggcgctctggctctgacccagacatgggccgggtcacatagcatgcgatatttcttcaccagcgtcagcaggccggggcgaggggagcctcgattcatcgccgtggggtacgtagacgatacacagttcgtacggttcgattctgatgccgccagtcagcgcatggagccacgggccccttggatcgagcaagaagggcccgaatactgggatcaggaaacacgcaatgtcaaggcccagtcccagaccgaccgggttgatctcggaactctgcgaggttactataaccaatcagaggcaggctcgcacactatacagatcatgtacggctgcgacgtcggcagcgatggacgttttctgagaggctataggcaagacgcctacgacggaaaggattacattgccttgaacgaagacctacgttcatggacggcagccgacatggccgcccaaatcactaagcgaaaatgggaggctgctcatgaagcagaacagctgagagcatacctagacgggacttgcgttgaatggctgagacggtatcttgaaaatggtaaggaaaccttgcagaggaccgatccgccaaaaactcacatgacacaccaccctatttctgaccatgaggccacattgaggtgctgggctctcggattttatccggcagagataacactcacctggcagagagatggggaggaccaaacgcaggacaccgaacttgtcgaaacgcgccccgccggggatggaacatttcaaaaatgggcggctgtcgtcgtcccttcaggagaagagcagaggtatacctgccacgtgcagcatgaaggtctgcctaagccactgacactgaggtgggaactgagctcacaacctactattcctatcgtcggcattattgctggtttggtgctcctcggggccgtgattacaggtgccgttgtcgcggcggttatgtggagaaggaagtcatccgacagaaaggggggctcgtacactcaggcggcatcaagcgattcagcacaaggctccgatgtgtctctgacagcttgcaaggtatag

SEQ ID NO: 27260 - DNA, 900 bp, Artificial Sequence
  Description of Artificial Sequence: Synthetic coding sequence
atggccgtgatggcccctcgtacgctcgttttgctattgtctggagctcttgctctgacccaaacctgggctgggtctcactctatgcgctatttttatacatccgtctcccgcccaggtagaggggaaccccggtttatagccgttgggtacgttgatgacacccagttcgtccgatttgatagcgacgcggcttcccagcggatggagccacgcgcgccctggatagagcaggagggaccagagtactgggatcgcaatacccggaacgttaaggcccacagccaaacagacagagcaaatctgggcaccctgaggggctattacaaccagagtgaagacggaagtcacactatccagcgcatgtacgggtgtgacgtcggacccgatggacgattcctgcgaggataccagcaggacgcctatgatggtaaggactacatcgcactgaatgaggacctacggtcatggacggccgctgacatggctgcacaaattacccaacgaaagtgggagaccgcacacgaggccgaacagtggcgagcttatcttgagggccggtgcgtggaatggctgcggcgatatttggaaaatggaaaggagactctgcagcggacggacgcgcctaaaacacacatgacccaccacgccgtttctgatcacgaggctaccctccgatgttgggccctgagtttttacccagcggaaattaccctcacatggcagcgggatggagaagaccagactcaggacacggaacttgtcgagactcggcccgcaggtgatggaacattccaaaagtgggcctccgtggtggtccctagtggccaggagcaaaggtacacctgccatgtgcagcacgaagggcttcctaaaccactgacactccgttgggtttag

SEQ ID NO: 27261 - DNA, 1098 bp, Artificial Sequence
  Description of Artificial Sequence: Synthetic coding sequence
atggccgtcatggccccacgcacgctggttctcttgttgtctggcgctctagccctgactcaaacctgggccggctctcatagcatgaggtacttttacacatccgtatcacgacctggacgaggggagccgcgatttattgccgtcgggtacgttgatgatacacaatttgtgcggttcgacagcgacgccgcctcccagcggatggagcccagagcaccctggatcgaacaagagggcccagagtactgggatcggaacacccgcaacgtcaaggcccatagtcaaacagaccgcgcaaacctgggcacactccgcggatactacaaccagtccgaggacggcagtcacacgatccagcgtatgtacggctgtgacgtcgggccagacgggcgtttcctcaggggataccagcaagatgcctatgatggcaaagactatattgcactgaatgaggatttgcgaagctggactgccgctgacatggctgcccagattacccaaagaaagtgggagaccgcgcatgaggcagagcagtggcgggcttatcttgaaggacggtgtgtagagtggcttaggcgatatctggagaatggaaaggagacactgcagcggaccgacgcccctaaaacccatatgacacatcatgccgtaagtgatcacgaggctacgctgcgttgctgggccctgagcttctacccagccgaaataacccttacgtggcagagggatggcgaggatcaaacacaggacacagagttggtagagacacgtcccgccggcgatggtacgtttcagaaatgggcctcagtggtggtgccctccggtcaggaacagagatacacgtgccacgtccagcatgaaggcttacccaaacccctgaccctgcggtgggagccttcatcccagcctactattcctatcgtcggaatcatcgccggacttgtgctgtttggcgccgtgatcgccggtgctgtggtagcagccgttatgtggcgtaggaagagcagcgaccggaagggtggctcttactctcaggccgcctcatcggattcagctcagggttcagatatgtctctgactgcttgcaaggtgtag

SEQ ID NO: 27262 - DNA, 1116 bp, Artificial Sequence
  Description of Artificial Sequence: Synthetic coding sequence
atggcagtgatggccccgagaacattggttctgctgttatccggcgccctagcacttacacagacgtgggcaggctctcactccatgaggtacttttacacgtcagtctcccgccctggaaggggcgagcctcggtttattgccgtgggctacgtcgatgacacacagttcgtgagatttgacagcgatgctgcatcccagagaatggagcccagagcaccgtggatcgagcaggagggtcctgaatactgggaccggaacacacgcaatgttaaagcacactctcagacggaccgggcaaacctcgggacacttcgaggttattacaaccaatccgaggatggctcacacactatccagcgcatgtacggctgcgatgtgggtcccgacgggcgattcttgcgcgggtaccagcaggacgcatacgatggaaaggactatatcgcgctgaacgaagatctgagatcctggactgccgcagacatggccgcgcagatcactcagcggaaatgggaaaccgcccacgaagctgagcagtggagggcatacctggagggtcgttgcgtcgagtggcttcgacgatacctggagaacggcaaggagaccttgcagagaaccgacgcccctaaaactcatatgacacaccacgccgtttccgaccacgaggcaacactgagatgctgggccctcagcttctaccctgcggagatcacattaacctggcaaagagacggagaagatcaaacgcaggatacggaattagtcgaaaccaggcccgccggggacggcactttccaaaaatgggcaagcgtcgtggtgccttctggtcaggagcagcgttacacttgccacgtgcaacacgagggactgccaaagccccttacacttagatgggaaccctcctctcaaccaacaattcctattgtgggtatcatcgccggacttgtgctatttggcgccgttatcgccggtgcagtggtggcggctgtgatgtggcggcggaaaagtagcgggggggaaggtatgaaggatcgcaaggggggctcgtacagccaggccgcgtcatctgatagcgcgcagggctccgacatgtccctgactgcctgtaaggtgtag

SEQ ID NO: 27263 - DNA, 1098 bp, Artificial Sequence
  Description of Artificial Sequence: Synthetic coding sequence
atggccgtgatggcgccaaggaccctgctgctcctgttgtccggagcattagcactaacacagacttgggctggttctcattcaatgcgctactttttcacctccgtgtctagacctggccggggcgaaccacgctttatcgccgtagggtatgttgatgacacccaattcgtgcgcttcgatagtgacgcagctagccaacgaatggaacctcgcgccccatggatcgaacaggaaggacccgagtactgggaccaggaaacacggaatgtgaaggcccagagtcagacagaccgagtggatctgggtacgctaagaggctattataaccagtccgaggcagggagccacactatccagatcatgtatggttgcgacgtgggatccgatgggcggtttctacggggatatcgccaagacgcttacgatggtaaggactacattgcactaaatgaagatctgcgatcttggacagctgcagacatggccgcccagatcaccaagagaaagtgggaggccgcccatgaagcagagcagctccgagcatacctggatggcacatgtgtagagtggctacgcagatatttggagaatggtaaggaaacccttcagcgaactgacccacccaaaacacatatgacccatcatcccattagcgaccacgaagccacattacgctgttgggcgttagggttctacccggccgagattacactgacttggcagcgagacggggaggaccaaactcaggacaccgagctggttgagaccagaccagcaggagatggtacttttcaaaagtgggccgctgtcgttgtgccgagcggagaggagcaaaggtatacttgtcacgtacagcatgagggtctgccgaaaccattgaccctgcgttgggaacttagctcacaacccacaatcccaatagtggggattattgctggtctggttttactcggcgctgtgattacaggagccgtagttgccgcggtgatgtggaggagaaagtctagcgaccggaagggagggtcttatacacaagctgcatcttctgattccgcccaaggttccgatgtgtcgctcactgcctgtaaagtatag

SEQ ID NO: 27264 - DNA, 900 bp, Artificial Sequence
  Description of Artificial Sequence: Synthetic coding sequence
tgagccgtgatggctccccgcactctggtgctgttattaagcggcgcactggccctaactcaaacatgggcaggatcccatagtatgaggtatttcttcactagcgtctcaagacctgggcggggcgaaccccggtttatcgctgtgggttatgttgacgacacacagttcgtgcggttcgactcagacgcggcgtcccagcggatggagccgcgtgctccctggattgagcaggaggggcccgagtactgggatggggaaacacgcaaagtgaaggcgcatagtcagactcatcgggtggatttaggtacattaagaggctactacaaccagtctgaggccggatctcacaccgtgcagagaatgtacggatgcgacgtggggtccgactggaggtttctgcgtggctaccatcagtatgcgtatgatggcaaagactatatcgcattgaaagaggatctgcggagttggacagctgccgacatggctgcccagaccacgaaacacaagtgggaggccgcacacgtcgccgagcagctgagagcctacttggaaggaacctgcgtggaatggctcaggaggtatcttgagaacggcaaggaaacccttcaaagaaccgatgctcctaaaactcatatgacccaccatgccgtgtcagaccacgaggccaccctccgttgctgggccctaagcttctatcctgcggagatcacgttgacatggcagagggatggcgaggaccaaacccaggacacggagctcgtggaaacacgacctgcaggagatggaacatttcagaaatgggcagccgtggtcgtaccgtccggtcaagagcagcgctatacatgccatgtccagcacgagggacttcctaagcccctgactctgaggtgggtgtag

SEQ ID NO: 27265 - DNA, 900 bp, Artificial Sequence
  Description of Artificial Sequence: Synthetic coding sequence
atggcagttatggcgccaaggaccttgctgctcctgctgctgggcgccctggcgcttacacagacctgggctggaagccattcgatgcggtactttttcacatccgtgtcgcgtcccggaagaggggaacctcggttcatagccgtggggtatgtcgacgacacacagttcgttcggttcgattcagatgctgcctcgcaacggatggagcccagagccccttggattgagcaggaggggcccgagtattgggatcaagaaactcgaaacgtgaaagctcacagccagacagatagggaatctctccggattgcgctgcggtattacaaccagtcggaggcaggcagccacaccatacagatgatgtatggttgcgatgtgggccctgatggtcgactgctccgcggttaccagcaggatgcatatgacggtaaagactatattgccctgaatgaggatctgcggtcttggactgcggccgacatggccgctcagatcacacagagaaaatgggaggccgctagagtggccgagcagctaagagcttacctcgagggcacttgtgtcgagtggctgcgcagatacttggagaatggcaaggagacactgcagaggaccgatgctccaaagacgcacatgactcatcatgcggtaagtgatcatgaggccactttacgatgctgggcgttaagcttctatcctgcggaaatcaccctgacctggcagagggacggggaggaccagacacaagacacggaactggtagaaacgaggcccgccggcgatggcaccttccaaaaatgggcctccgtggtggttccatccggtcaggagcagcgttatacctgccatgttcagcacgagggcctcccaaagcctctcacactcaggtgggtatag

SEQ ID NO: 27266 - DNA, 900 bp, Artificial Sequence
  Description of Artificial Sequence: Synthetic coding sequence
atggccgtgatggccccccgaacactcctattgctcttaagcggcgccttagcactgactcaaacctgggcaggctctcactcaatgcggtatttctttacttccgtgtcacggcctggcaggggggagccccggttcattgctgttggctatgtcgacgacacacagttcgttagatttgatagtgatgccgcttctcagaaaatggaaccgcgcgccccttggatagagcaggaaggtccagaatattgggaccaggaaacgaggaacatgaaggcgcattcccaaacagatcgcgccaatctggggacactccggggatactacaatcagtccgaagacggatctcatacaatccagatcatgtacggttgcgacgtcggaccagacggccgcttcctgcgcggatatcgccaagatgcttacgacgggaaagactacatcgctttgaacgaggacctgcgttcatggaccgcagcagacatggctgcccagattactaagcgaaaatgggaggccgtgcacgcagctgaacaacgccgtgtttatcttgaggggagatgcgtcgatggcctcaggcgctatctggagaacggaaaagagaccctgcagcggaccgacccccccaagacgcatatgacacatcatccaatcagcgatcacgaagcgaccctgaggtgttgggctctggggttttaccccgcagagattactctcacttggcagagagatggcgaggaccagacgcaggatactgagctcgtggagaccaggccagccggagacggaactttccagaagtgggctgccgtggtggtccctagcggagaggaacagcggtacacgtgccatgtacaacacgaaggactacccaaacctctgaccctccggtgggtatag

SEQ ID NO: 27267 - DNA, 1116 bp, Artificial Sequence
  Description of Artificial Sequence: Synthetic coding sequence
atggccgtgatggccccccgcacactcctgctcctgctgtcaggggctcttgccctgactcagacgtgggcaggatctcattctatgcgctatttctttacatccgtgagccgaccaggccggggagagcctcggttcattgctgtggggtacgtggacgacacacagttcgtaaggttcgactccgacgctgcatcccaaaaaatggagccacgggcaccttggatcgaacaagagggaccggagtactgggatcaggagacccgaaacatgaaggcccatagtcagaccgaccgggctaacctgggtaccctacgaggctattacaaccagtccgaggatggaagtcacacaatccaaattatgtacggctgcgatgtgggacccgatgggcgcttcctgagaggttatcgccaagacgcttacgacggaaaggactacatcgctctcaatgaagacttgcgctcttggactgccgccgacatggcagcgcaaattaccaagcggaaatgggaggccgtgcatgctgccgaacagcgccgcgtgtatttggaggggagatgcgtggatggactgcggaggtacctcgagaatggcaaggagaccctgcagcgcactgaccccccaaagacacacatgacacaccacccgatttctgatcatgaagcaactctgagatgttgggccctgggtttttatcctgctgaaataactcttacttggcagagagatggagaagatcagacgcaggacacagagctggtggagacccgacctgcgggagacggcacgttccaaaagtgggccgcggttgtggttccttccggagaggagcagaggtacacttgtcacgtgcaacacgaaggccttcctaaacctctgaccctccgatgggaattaagctctcaacctacaatcccgatagtcggaatcatcgctgggttagtgttactgggtgctgtgatcaccggcgcagtggtggccgctgtcatgtggagaagaaaatctagcgggggcgagggagtcaaagacaggaagggggggtcatatacacaggccgcttctagcgactccgctcagggaagcgacgtttccctcaccgcctgcaaagtgtag

SEQ ID NO: 27268 - DNA, 1098 bp, Artificial Sequence
  Description of Artificial Sequence: Synthetic coding sequence
atggctgtgatggcccctcgaacactgctgctcctgctgagcggagcactggcactcacacagacatgggccgggagtcattccatgaggtactttttcacatctgtgtccagaccggggcggggggagcctaggtttattgccgtggggtatgtagacgacacccagtttgtgcggttcgatagtgacgccgcttcccaaaagatggagcctcgcgctccttggattgagcaggagggccccgagtactgggatcaggagacacgtaatatgaaagcccactcgcagacagatcgcgccaacttggggacactgcggggttattacaatcaaagcgaggacggctcacataccatacagatcatgtacggttgtgatgttggtcccgatggccgtttcctgcgcggatataggcaggatgcctatgacggaaaagattacatagccttgaatgaagacttaaggtcgtggaccgccgcggatatggctgctcagatcacaaaacggaagtgggaggccgtgcatgcggcagaacagcgacgggtgtacttggagggacgatgcgttgatggcctccgccggtacctagaaaacggcaaagaaactttgcagagaactgaccctcctaaaacccacatgacacatcaccccatctccgaccatgaggccaccctccgctgttgggcgttagggttctaccccgcggaaatcacactgacctggcagcgggacggtgaagaccagacccaggacacagaactggtggagacgcgacccgccggagatggtaccttccagaaatgggctgccgttgtcgtgcccagcggcgaagagcagcgatatacttgccacgtgcagcatgaggggctccctaagccactgaccctgaggtgggagctgagtagccagccaactatacccattgtgggcatcattgcaggactagtgctcctgggcgccgtgattaccggggcagttgtggccgcagtgatgtggaggcggaaatcaagcgaccgtaaaggtgggtcctatacccaagcagccagctctgattctgctcagggaagcgatgtgtctctgacagcttgcaaggtctag

SEQ ID NO: 27269 - DNA, 1116 bp, Artificial Sequence
  Description of Artificial Sequence: Synthetic coding sequence
atggctgttatggctccccggacactggtcctgctcctgagcggcgcccttgctctgactcagacatgggccggctcccactccatgcggtactttttcacctcggtgagccgccctggccgcggggagccacgcttcatcgccgtgggctacgtggatgatacccagttcgtgcggtttgacagcgatgccgcctcacagaggatggaaccccgcgccccctggatcgagcaagagggccccgagtattgggacggcgagactagaaaagtcaaagcccattctcagacacaccgcgtagacctaggcacattgcgcgggtactataaccagagcgaagccgggagccacaccgtgcaacgaatgtacggctgcgacgttggctccgactggcgttttttacggggatatcaccagtatgcctatgacggcaaggactacatagcactcaaagaggatctaagatcgtggaccgccgcggatatggctgcccagacaaccaagcataaatgggaagctgcccacgtcgcagagcaactcagagcgtacttggagggcacgtgcgttgagtggctgagacgatacctggaaaacggtaaagagaccctccagcgtactgatgcaccgaaaactcacatgacgcatcatgccgtcagcgaccacgaggctactcttcggtgttgggcattgtccttctacccggcagaaattacactgacttggcaacgtgacggcgaagaccagacccaagacaccgagttagtggagaccagaccagctggagatggcacatttcagaaatgggccgcggtggtggtgccatctgggcaggaacagcggtacacctgtcatgtgcagcatgaggggcttccaaaacccctcaccctacgctgggaacctagtagtcagccaacaatccctattgttggcataatcgccggcctggtcctgtttggagccgtgatcaccggtgctgtagtggctgcagtaatgtggaggcgtaagtcgtccggtggcgagggagtcaaggaccgcaaggggggctcatactcacaggccgcaagttcagactcagctcagggcagcgacgtgagtctgactgcctgcaaagtctag

SEQ ID NO: 27270 - DNA, 900 bp, Artificial Sequence
  Description of Artificial Sequence: Synthetic coding sequence
atggctgtcatggcaccccgtacattactgctgctccttagcggtgccctggccctgacgcagacttgggccggcagccatagcatgaggtacttctttactagcgtctccagaccggggagaggcgaacctcgttttattgccgtggggtacgtggatgatacacagttcgtgaggttcgactccgacgccgcttcccagaagatggagccccgggctccctggatagagcaagagggcccagagtactgggaccaagagacccgaaacatgaaggcacatagtcagacagatagggctaacctcggaaccctgagaggctattacaaccagtcagaagacggctcacacaccattcagatcatgtatgggtgtgatgttggtcctgacggtcgatttctcagggggtatcgccaggacgcttacgacggaaaagattacatagccctgaacgaggatttgagatcttggacagcagccgacatggccgcccagatcaccaaacggaaatgggaggctgtgcatgccgcggaacagcggcgggtgtatctggaaggaaggtgcgttgacggcctccgtcgttatttagagaatgggaaagagaccctgcagagaactgatccgcctaagactcacatgacccaccacccaatcagcgatcacgaggccaccctccgttgctgggcactgggcttctaccctgctgaaatcaccctcacctggcagagagacggtgaggatcagacccaggataccgagttggtcgagactcggcccgccggagacggtaccttccagaagtgggcagcggtggtagtgccctcaggggaagaacagaggtacacctgtcacgtgcagcacgagggccttcccaaaccattgactttgcgatgggtgtag

SEQ ID NO: 27271 - DNA, 1098 bp, Artificial Sequence
  Description of Artificial Sequence: Synthetic coding sequence
atggcggtaatggccccacgcaccctgttactcctgctctctggagctttggcacttacacagacgtgggcgggctctcactctatgaggtatttcttcacctcagtgtcacgccctggacgaggagagccccgctttatcgccgttggctacgtggatgacacccagtttgtgcgctttgacagcgacgccgctagtcaaaagatggagccaagagccccctggatcgagcaggagggacctgagtattgggatcaggaaacgcgcaatatgaaagcgcacagccaaacagaccgcgctaacctgggtactttgcgtgggtactacaaccagtcagaggacgggagtcatactattcagatcatgtatgggtgtgacgtgggacccgatggacggttccttcgcggataccgacaggacgcgtatgacggtaaggattacatcgccctgaacgaggacttacggtcttggaccgccgccgatatggcagcccagatcaccaagcgtaagtgggaggctgtgcacgcagccgagcagcgccgggtgtatctggagggacggtgcgtagatggtctgagaaggtatttggagaacggaaaggagacccttcagagaacagacccccctaaaacccatatgacccatcatccgattagcgaccacgaggccaccttacgctgctgggcgcttggcttctatcctgccgagattactctgacatggcaacgggatggcgaggatcagacccaagacaccgagttggttgaaacccggcccgccggtgacggtacattccagaaatgggctgcggtggttgtgcccagtggtgaggagcagagatatacatgtcatgtgcaacatgagggtttaccaaaacccctgacgctgcgatgggaactgtcctcccagcccaccattccgatcgttggtattatcgccggcctcgtgctcctgggcgcagtgatcacaggagctgtggtcgctgccgtgatgtggagaaggaagtccagcgatcggaaagggggcagctacacccaagctgcaagttccgattccgcccagggcagcgacgtctctttaaccgcatgcaaggtgtag

SEQ ID NO: 27272 - DNA, 1116 bp, Artificial Sequence
  Description of Artificial Sequence: Synthetic coding sequence
atggccgtaatggcaccacggacccttctcttgctgctgagtggggctctcgccctgacccaaacatgggcaggatcccactctatgcgctacttcttcacaagcgtatcgcgtcctgggaggggggagcccagatttatagccgtgggttacgttgatgacacacagttcgttaggttcgactcagacgctgcaagccagaagatggagccacgcgccccgtggatcgagcaagagggaccagagtattgggatcaagagacacggaatatgaaggcacattcccagacagaccgggccaacctcggcactcttaggggttattacaatcagtccgaggacgggtcccatactatccaaatcatgtatggttgcgacgtgggtcccgatggtcgtttcctccgcgggtacagacaggacgcatatgatggaaaagattatatcgccctgaatgaggacctgagatcttggactgccgccgacatggccgcccaaattacaaagcggaagtgggaggcagtccatgcagcggaacagagacgggtgtatttggagggccgctgtgtggacggcctgcggaggtacctcgagaatggcaaggagaccctccagagaactgacccaccgaaaacacacatgacgcatcatcccatctccgatcacgaagcaacccttcggtgctgggctcttggcttctaccccgcagagatcacactgacctggcagagagacggagaagaccagacgcaggacaccgagctggtcgagacgagacctgctggggatggtaccttccagaaatgggcagctgtggtcgtcccaagcggtgaggaacagcgttacacctgccacgtccagcacgagggacttcccaagcctctgactctgagatgggagctgagcagtcaaccgactattccaatcgtgggaattatagccggcttggtgctccttggcgctgtgatcacgggcgctgtggtggcagccgtgatgtggcgcagaaagagtagcggcggagagggtgtgaaggatcggaagggtggatcatatacccaggctgctagctcagatagtgctcagggatccgatgtgtcgctgaccgcatgtaaggtgtag

SEQ ID NO: 27273 - DNA, 900 bp, Artificial Sequence
  Description of Artificial Sequence: Synthetic coding sequence
atggctgtgatggccccccgcaccctgctcctgttgctgttaggcgcactggccctaactcaaacatgggctggctctcattcgatgaggtacttcactacctctgtctctcgtcctggcagaggtgaacccagatttatcgccgtggggtatgtcgacgatactcagtttgtgcgatttgactctgacgctgcatctcagaggatggaacccagggccccctggattgaacaggaaggtcccgagtattgggatttgcaaactaggaatgtgaaggctcagtcacagaccgaccgcgcgaacttaggaacgctgagaggctattataaccagtcagaggccggcagccacaccatccagatgatgtacggctgtgacgtgggctccgatggtagattcctgagagggtacagacaggatgcctacgacgggaaagactacatcgcactgaacgaagatctgcgatcatggactgctgccgacatggcagcgcagataacccaaaggaaatgggaggctgccagagtcgccgaacagttacgtgcgtatctggaaggcacttgcgtcgagtggttgcggcggtatctcgagaacgggaaggagaccctacagagaaccgacgctccaaagacccatatgacacaccatgccgtgtcagatcacgaggcaaccctgcggtgctgggcactgtccttctaccccgctgagatcactctcacatggcagcgagacggggaggatcagacacaagataccgagctggttgaaaccaggccagccggcgatggaacctttcagaagtgggcttcagtggtcgttccatccggccaggagcagcgttatacatgccacgtgcagcacgaaggcctccccaaaccactaaccctgcgctgggtctag

SEQ ID NO: 27274 - DNA, 1098 bp, Artificial Sequence
  Description of Artificial Sequence: Synthetic coding sequence
taggctgtcatggcgccgcggaccttagtacttttgttatctggagctctggccctcactcagacttgggctggctcacattcaatgcgctatttctttacctctgtgagtcggccagggagaggggagcctaggtttattgctgtaggctatgtggatgacactcagttcgtgagattcgattccgacgctgctagccaacggatggaacctagagcaccatggatagagcaggaggggccagaatattgggacggggagacccgaaaggtcaaagctcactcccagacgcatagagtggaccttggtacactccgtgggtattataaccagtctgaggctggcagccataccgttcagcgcatgtatgggtgtgacgttggcagtgattggagattcttgaggggataccaccagtacgcatatgacgggaaagactacatagctttaaaggaggacctacgatcttggacagctgctgatatggcagcccagaccaccaagcataagtgggaggccgcacacgtggctgagcagttgcgtgcctacctcgagggaacctgtgtggaatggctcagaagatacttggagaacggcaaggagacgctgcaaagaactgacgcccctaaaacccacatgacgcatcatgccgtgagcgaccacgaagctactctccgatgctgggccctgagcttctatcctgccgaaattaccctcacatggcagagagatggcgaagatcagacacaggacaccgagcttgtcgagaccaggccggctggggatggcactttccagaagtgggccgccgtcgtcgtaccaagtggacaggaacagaggtacacgtgtcacgtgcaacacgagggcctgccaaagcctctgactctgagatgggaacccagctcacagccaactattccgatcgtcggaattatcgcagggctcgtgttgttcggagccgtgatcactggagccgtagtggctgctgtaatgtggcggcgcaaatcgagtgacagaaagggggggagctactcccaggctgcttcttccgattccgcgcagggatcagacgtgtccctaactgcatgcaaagtttag

SEQ ID NO: 27275 - DNA, 900 bp, Artificial Sequence
  Description of Artificial Sequence: Synthetic coding sequence
atggctgtgatggcgccacgtacccttgtgctcttattaagtggggctctcgcccttactcaaacctgggcgggaagccactcaatgcgatatttttttacgtctgtgtcccgcccagggcgcggggagccccggttcattgcggttgggtatgtggacgacacccagttcgtccgattcgatagcgatgcagcttctcagaggatggaaccccgtgccccttggattgagcaggaggggcccgaatattgggacggcgagaccagaaaggttaaggctcattctcagactcatcgagtagacctcgggaccctcaggggatactacaatcagtcagaggccggcagccatactgtgcagagaatgtacggctgcgacgtgggttcggattggcggttcctgcgtgggtatcatcaatacgcctacgatggcaaagactatatcgcattgaaggaggatctaaggagctggaccgcggcagacatggcggcacagactacgaagcacaaatgggaggcggcccatgtagccgaacagctgagagcttatctggaggggacctgcgttgagtggctccgccggtatctcgaaaacggaaaagagacccttcaaagaacagacgccccaaagacacatatgacccaccacgcagtgagcgaccacgaagccactctgcgctgctgggcactgagcttttacccagcggagataacactgacctggcaaagggatggggaggaccaaacccaagacacagaactagtggaaacccgccccgccggggacggcactttccagaaatgggccgccgtggtggtgccgtctggacaggaacaacgctatacctgtcatgtacagcacgaaggattaccgaagcctctcacccttcgttgggtatag

SEQ ID NO: 27276 - DNA, 1098 bp, Artificial Sequence
  Description of Artificial Sequence: Synthetic coding sequence
atggcagtgatggctccaagaacactactactgctgctcttgggggcattagctctcacacagacttgggctggtagccactctatgaggtacttcttcaccagtgtctctcggcctggccgcggagaacctcgttttatcgctgttggctacgtggacgacacccagtttgtaagatttgacagcgacgctgcaagtcaacgaatggaaccccgggcgccgtggattgagcaggagggacccgagtactgggaccaggaaactaggaacgtgaaggcccatagccagactgaccgagaatctctccggattgctctgaggtattataaccagtcagaggcaggcagccataccattcagatgatgtacggatgcgacgtaggccccgacgggaggctgcttcgggggtatcaacaagacgcttatgacggaaaagactatatcgctctcaacgaggacctcagaagctggaccgcggcagacatggcagctcagattacacagaggaagtgggaggcagctagagtggccgaacagcttcgagcctacctggaggggacttgcgtagaatggctccgccggtacctggagaatgggaaggaaacactccaacgcacagatgctcctaaaacccacatgactcaccacgccgtgtccgatcacgaagcgaccctgcgttgttgggccttgagtttttatcccgcagaaattacgctgacatggcaacgcgatggcgaagaccagacgcaggataccgaattagtggaaacacgaccagctggagacgggacctttcagaaatgggccagcgtcgtggttccgtccggacaggaacagaggtacacgtgccacgttcagcacgaagggcttcccaagcccctaaccctccgatgggagccttcgtctcaacccacaatcccaatcgtgggtattattgcaggactggtcttgttcggggccatgttcgctggggcagtggtggccgccgtcagatggaggcgcaagagttctgaccggaagggcggaagttattcccaggcagcctcctcagattcagcacaggggagtgacatgtctctcaccgcatgcaaggtgtag

SEQ ID NO: 27277 - DNA, 1116 bp, Artificial Sequence
  Description of Artificial Sequence: Synthetic coding sequence
tgagcagtcatggcaccccgcactctggtcttgctgctgtcaggagcactggccctcacccagacctgggctggaagtcattctatgaggtacttcttcacctcagtgagtcgacctggaaggggggaaccaagatttatcgcggtcggctacgtcgacgacactcagttcgtcagattcgacagtgatgcagcctcccagaggatggaaccaagggcaccctggatcgagcaggaaggacccgaatattgggatggagagacacggaaggtgaaggcacactctcaaacgcaccgcgtcgatttaggaactcttcgtggctattataaccagtccgaggctggtagtcacaccgtacagaggatgtacggatgcgacgtaggaagtgattggcgctttctaagaggctatcatcagtatgcatacgacggcaaggactatattgccctgaaagaggatctgcgttcctggactgccgccgatatggccgctcagaccaccaaacataaatgggaggctgcccacgtggccgagcaacttagagcctatctagagggaacatgtgtggagtggctacggcgctaccttgagaatggcaaagagacacttcaacgcaccgacgcccctaagacccatatgactcaccatgccgtgagcgatcatgaagccacacttcggtgttgggccctgtcgttctatcccgccgaaataaccctcacctggcagagggacggagaggaccagacccaggatactgagcttgtggaaacaagaccagcgggggacggcacattccagaaatgggccgctgtggtggttccatccggacaggagcagaggtacacctgccacgttcagcatgagggactgccaaaaccgctaaccctgcgctgggagccatcgtctcagcctacaatccccatagtgggcataatcgctggtctggttctatttggcgcagtgataaccggtgcggttgtggccgcagttatgtggcggcggaaaagctctggtggcgagggtgtgaaggataggaaaggggggtcttacagccaggcggcctcaagcgactcagcacaaggctccgacgtttcacttaccgcttgtaaggtgtag

SEQ ID NO: 27278 - DNA, 1098 bp, Artificial Sequence
  Description of Artificial Sequence: Synthetic coding sequence
atggctgtgatggccccgaggactttgttgcttctactgttgggcgcactagccctgactcagacctgggccgggtcccactcaatgcgatattttaccacttccgtgtctaggcccggtcgcggtgaacctcggttcatcgcagttgggtatgtcgatgacactcaattcgtccgctttgacagcgatgccgccagccagaggatggaacccagggctccatggatcgagcaagagggcccagagtattgggacctgcagacccgcaatgtgaaggcacagtcccaaacagacagggctaatctgggcacgctgagagggtactacaatcaaagcgaagcgggatcacatacaatacagatgatgtatgggtgcgacgtgggatccgacgggcgattcctcaggggataccgccaagatgcctatgatggcaaagattacatagcactcaacgaggacctgcggtcatggactgcagctgacatggcagcgcagatcacgcagagaaagtgggaagccgcccgcgtagcagaacagctgagggcctatcttgaggggacatgcgtggagtggctccgcagatatctggaaaacggaaaggaaacgcttcagagaacagatgctcccaagacgcatatgacacatcacgctgtgagcgaccacgaggccactcttcggtgctgggcattaagcttctacccagctgagatcactctgacttggcaacgagacggggaagaccagacccaggacactgaactggttgaaactcgccccgccggagatggcaccttccagaagtgggcttccgtggtggttcctagtgggcaggaacagcgctacacatgccacgtacagcatgagggtctcccgaaacccctgactctgcggtgggagccaagtagtcaaccgactatcccgattgtcgggattattgccgggttggtgctctttggagctgtgtttgctggcgcagtagtggcggccgtgcgatggcggcgaaagtcttccgacaggaaggggggatcttactctcaagcagcctctagtgattcagcccaggggagtgacatgtccctcacagcctgtaaggtgtag

SEQ ID NO: 27279 - DNA, 1098 bp, Artificial Sequence
  Description of Artificial Sequence: Synthetic coding sequence
atggccgtcatggctccacggactctggtgcttctgctgtcaggcgctttggctttgacacaaacatgggcgggctctcattctatgagatatttcttcacgtctgtgtctagaccaggccgcggggagccacgcttcatcgccgtgggatatgtggacgatacacagttcgtgcgcttcgactcggacgccgcgagccagagaatggaaccccgagctccttggatcgagcaagaaggaccggagtattgggacggggaaacccgcaaagtgaaggcccactctcagacccacagagttgaccttggcactcttcggggctactataatcagtctgaggcgggtagccataccgttcagagaatgtacggttgtgatgtggggtcagattggcggtttctcaggggttaccaccagtatgcctatgatggcaaagactacatcgcattaaaggaggacctgagatcctggaccgcagcagatatggccgctcagacaactaagcacaaatgggaggccgcccacgtagctgaacagctgagagcttacttggagggaacgtgcgtggagtggctccgccgatatctggaaaatggaaaggagacccttcagcgcacggatgctccaaagactcacatgactcatcacgctgtcagcgaccacgaggccacactacgatgttgggctctatccttttacccagccgaaattaccctcacctggcagcgggatggcgaggatcagacccaagataccgagctggttgagactagacctgccggcgatggcacttttcagaagtgggctgcggtggtcgtgccttccggccaagagcagcgctatacttgtcacgtccagcacgagggcctaccgaaacctttgactttacgctgggaaccctcctcccagccaacaatacctatcgtcggcatcatcgcaggcttggtcctattcggtgctgttattaccggcgccgtggtcgctgctgtgatgtggcgacggaagagtagcgatagaaagggcggatcctatagccaggcagcatcctctgacagtgcccaggggtcggatgtgtcattaaccgcgtgcaaggtctag

SEQ ID NO: 27280 - DNA, 1029 bp, Artificial Sequence
  Description of Artificial Sequence: Synthetic coding sequence
atggcagtcatggcccccaggacactgctattactgctcctgggagcactcgccctgacgcagacctgggccggctctcattctatgcgctattttactacgagcgtgtctcggccaggcaggggggaacccagattcatagccgtcgggtacgtagacgatacccaattcgtgcgattcgactccgacgccgcatcccagcggatggagcctcgtgcaccatggatcgagcaggagggccccgagtactgggacttacagacacgaaatgtgaaggcccagtcccagacggacagggccaacctgggtaccctgcgcggatactacaaccaatccgaggctggatcccatacaattcagatgatgtatggttgtgacgtcgggtcagacgggcgctttctgcgcggctatagacaagacgcatacgatggaaaagactatattgccctgaatgaggacttgcgatcctggaccgcggctgacatggccgcgcagatcacgcaacgaaaatgggaggccgctcgcgtcgccgagcagctacgggcctatttggagggaacatgtgtcgagtggctcaggcgctatctggaaaatgggaaagagaccctccaacggacagacgccccgaaaactcatatgacgcaccatgctgtgagtgaccacgaagctactctgcgctgctgggcactgagtttttatccagccgagatcacgctgacttggcagagagacggggaagatcagacgcaggacaccgaattggtggaaacaagacctgccggagatggaacatttcagaagtgggccagcgttgtggttccgtccgggcaggaacaacgatatacatgccatgttcaacacgagggccttcccaagccactcacactacgctgggaaccgagctctcagcctactatacccatagtgggcattatcgctggactggtcctgttcggagcagtgttcgccggagcggtcgtggctgccgtgcgttggaggcggaaaagttccggcggagttaaaggttag

SEQ ID NO: 27281 - DNA, 345 bp, Artificial Sequence
  Description of Artificial Sequence: Synthetic coding sequence
atgacccaccatcctatttccgaccatgaagcgaccctccggtgctgggccctgggcttctatcccgctgagattacgttgacatggcagcgcgacggagaagatcagactcaggacactgaactagtggagacgcgcccagctggagatggcacattccagaagtgggcggccgttgttgtgccgagcggggaggagcaacggtacacttgtcatgtgcagcacgagggtctgcctaagccactgacactgagatgggatcgcaaggggggcagttacactcaggccgcaagctctgactctgctcagggttctgatgtcagcctgacagcctgtaaagtctag

SEQ ID NO: 27282 - DNA, 465 bp, Artificial Sequence
  Description of Artificial Sequence: Synthetic coding sequence
atggcggtcatggctccacgcaccctgctgcttttactgtcaggcgctctggccttaacccagacttgggccggctctcatagcatgagatacttcttcacttctgtgagccgtcctggaagaggcgaacctcgcttcatcgccgttggatacgtggatgacactcagttcgtccggtttgatagcgatgccgctagccagaagatggaacccagagcaccctggatcgagcaggagggccctgaatactgggatcaggaaacgaggaatatgaaggcacactctcagaccgatagagctaatctaggtaccttgcgtggttactacaatcaatctgaggacggttcccacacaattcaaattatgtatggctgcgacgtcggccctgatggtcgatttctgcggggataccgattgcgctcaccttccgcctccggccgacggagcatgcgccggtccagctag

SEQ ID NO: 27283 - DNA, 1098 bp, Artificial Sequence
  Description of Artificial Sequence: Synthetic coding sequence
atggcagttatggcccctcgcaccctagtcttactgctctccggcgctttggccctgacacagacctgggccggcagccactcaatgcgctactttttcacctccgtgtcccggcctggacgcggtgaaccaaggtttatcgccgtggggtatgtggacgatacccaatttgtgagatttgacagcgacgcagcatctcagcgtatggagcctcgtgccccctggatcgaacaagagggacccgaatattgggatggcgagactcggaaggtaaaagcccattcacagacccaccgggtggacctggggacacttcgcgggtactacaaccagtcagaggcgggatctcataccgtgcaacgaatgtacggctgtgacgtgggaagtgattggcgtttcctgaggggttatcaccagtacgcctatgacggaaaagattatatagctctgaaggaggacttgaggtcatggacagctgcagacatggccgctcagactaccaaacataagtgggaggccgcccatgtggcagagcagttgcgcgcctacctggaaggtacctgcgtggagtggttgcggcgttaccttgagaacggcaaagagacgctccagcgcaccgacgcacccaaaacacatatgacacaccacgccgtgagcgatcatgaggccacgctgaggtgttgggcgctgagtttttatccagccgaaatcacattgacatggcagagagatggggaagaccagacacaagacaccgagctggtggagacacgccctgccggagatggcaccttccagaaatgggcagcagtggtggtcccctccgggcaggaacagagatacacttgtcatgtgcaacacgaaggtttgccaaagccgctgacactgaggtgggagcccagctctcaacccaccatccctatcgttgggatcattgcaggcttggtgctttttggagcggtgataactggagcagtggtggcagcagtgatgtggcgtcgaaagagctctgacaggaaaggcggctcttattcgcaggcggcctcttctgattccgctcaggggtccgacgtttccttgaccgcttgtaaggtctag

SEQ ID NO: 27284 - DNA, 1089 bp, Artificial Sequence
  Description of Artificial Sequence: Synthetic coding sequence
atggcccctagaacgctcctgctgttgctatccggagcacttgccctgacacagacctgggccgggagccatagcatgaggtatttcttcacaagcgtgagtagacctggacgaggagagcccaggtttattgctgtggggtatgtggatgacacacagtttgttcggtttgacagcgacgctgcctcacagcggatggaaccaagagctccgtggattgagcaggagggtcctgagtactgggacggcgaaactcgcaaagtgaaagcacatagccagactcacagggtcgacctgggcacactccggggttattacaatcaatctgaggccggaagccatactgtgcagaggatgtacggatgcgacgtgggcagcgactggcgatttcttcggggctatcaccagtatgcctacgacgggaaagattacatagccctgaaagaggatttgcgctcctggaccgccgccgatatggcagcccaaactacgaaacacaagtgggaggcggcacatgtggcggaacagttgcgggcttacctggagggaacttgcgttgagtggctgcggcgctatctggagaacggaaaagagacattgcagaggacggacgctccaaaaacccacatgactcatcatgcagtgagcgaccatgaagctaccctgcgctgttgggccctgtcattttatcctgccgagatcacacttacatggcagagggacggcgaggatcagactcaggacacagaactggttgagacacgcccagcgggtgatggaaccttccagaaatgggccgccgttgtggttccatccggacaggaacagagatacacctgtcacgtgcagcatgaaggactgcctaagccactcactcttcggtgggagcccagctcacagccaacaatccccatagtgggtatcatagctggactagtgctgtttggagcagtcataactggggccgttgtcgcagctgttatgtggcgacgcaagagctcagacagaaaaggcgggtcctactctcaggctgcctcttccgattctgcccagggtagcgatgtttctcttacagcctgcaaagtgtag

SEQ ID NO: 27285 - DNA, 1098 bp, Artificial Sequence
  Description of Artificial Sequence: Synthetic coding sequence
atggccgtgatggcaccacggacactggtactgcttttaagtggagcactcgccctgacccagacttgggccgggtcccattctatgaggtacttctacaccagtgtgtccaggccaggcagaggcgaacctcgattcattgcagtgggttatgtcgacgacacacaattcgttcgatttgacagcgatgctgcttcccagagaatggagccacgggcaccgtggattgagcaggaagggccggagtactgggaccgcaacacaaggaatgtgaaggcccattcccagaccgacagagcaaatcttggaacactgcgtggctactacaatcagtcggaggacgggtcccacaccattcagcgaatgtatggctgtgacgtgggacccgatgggaggtttcttaggggctaccagcaagacgcgtacgatggcaaagactatatcgctctgaatgaggacctgagaagttggaccgccgccgatatggcggcccagatcacccagcgaaagtgggaaaccgctcacgaggcagagcagtggcgcgcttatttggaaggacggtgtgtggaatggcttagacgttacctcgagaacggcaaagaaaccttgcagagaacagacgcaccaaagacccatatgacacaccatgcggtgtcagaccacgaggccaccctcagatgctgggcactgtctttttaccccgccgagataaccttaacttggcagcgtgacggggaagatcaaactcaagatacagaactggtggagacccggcctgctggcgacggtaccttccagaaatgggcttccgttgtggtgccctctggccaggaacaacgctacacctgtcacgtgcagcatgaggggctgcctaagcccctaaccctccgctgggagccatcctcgcagcccaccatccccatcgtgggaattatagcaggactggtgctgtttggcgccgtcattgcaggcgcggtagtggctgctgtgatgtggagacgcaaatcctccgaccgaaagggaggatcatactcccaggcagcatccagcgactcagcacagggtagtgatatgtctttgactgcgtgcaaggtttag

SEQ ID NO: 27286 - DNA, 888 bp, Artificial Sequence
  Description of Artificial Sequence: Synthetic coding sequence
atggctgttatggccccaagaaccttgttgctactcctgttaggggcgctggcactcacccagacatgggccggtagccacagcatgagatattttacgactagtgtttcacggccgggtcggggagaacccaggtttattgcagtgggctatgtggacgatacacagttcgtcagattcgactctgatgccgcgtcacagcggatggaaccccgagctccatggattgaacaagagggacccgaatactgggatcttcagacgcgcaatgtgaaggctcagagccaaaccgatagagcctatttggaaaacggaaaggagaccctgcagcgcaccgatgcccctaaaacccacatgactcatcatgccgtctccgatcacgaggctactttacggtgctgggcactgtccttctatcccgcagagatcaccctgacttggcaacgggatggtgaagaccagacacaggacacagaactcgtcgagactaggcccgccggagatggcactttccagaaatgggccagcgtagtcgtgcctagtggccaagagcagcggtatacctgccacgtgcaacacgaggggttgccaaaaccgctgacacttcgctgggagccctcttctcagccaactataccgatcgtgggcatcatagctggcctggtgctctttggtgccgtttttgcaggagccgtggtagccgcagtgcggtggcgacgaaagagtagtggtggggagggaatgaagggcggttctgagatttcatgcttaacggaaggttccaaaacgcaggtggaagtgtgccccgcctccttgctgggatccacaatccacaattatggtcccacccaacctggcccatgtgttccagctttgaccttattatag

SEQ ID NO: 27287 - DNA, 1098 bp, Artificial Sequence
  Description of Artificial Sequence: Synthetic coding sequence
atggccgttatggcgcctcgcactctgctactgttgttgtccggggccttagctctgacccagacctgggcgggctcccactcgatgaggtactttttcactagtgtgtctcgcccgggtaggggtgaaccccggtttatcgctgtgggttatgttgacgacacacagttcgttcggtttgattccgacgccgctagccagaaaatggaacctagagcaccctggatcgaacaggaaggccccgaatactgggaccaggagacacgaaacatgaaggcgcactcccagacagaccgcgccaacctcggcacactgaggggctattacaaccaatctgaggatggctcccatactatccaaattatgtacggctgtgatgtggggcctgacgggaggttcttgcgcgggtaccggcaggacgcatatgatggtaaggactacatcgccctgaacgaagatcttaggagctggacagctgccgatatggccgcccagattaccaagcgaaaatgggaggctgttcacgccgctgagcagagaagagtctacctggagggaaggtgcgtagatggactgcggcggtacctggaaaacggcaaagagacacttcagaggaccgatccacctaagacacacatgacgcaccaccccatctcggatcacgaagctactttgcgctgctgggccctcggattttatcctgccgagattaccctaacatggcagcgggacggggaggaccaaacccaggacacggagctggttgaaaccagacccgctggtgatggaacatttcaaaagtgggccgctgtggtggttccttcgggcgaagaacaaagatatacttgtcatgtccagcacgagggcctgcctaagcccctgacactaagatgggagctgtccagccaacctactatccctattgtgggaataatcgcaggactcgtgttgctcggtgccgtgatcaccggcgcagtggttgcggcagtcatgtggcgtaggaagtcgtcggatagaaaagggggcagctacactcaggctgcctcttcagactccgctcagggatctgacgtttctttaaccgcttgcaaagtgtag

SEQ ID NO: 27288 - DNA, 888 bp, Artificial Sequence
  Description of Artificial Sequence: Synthetic coding sequence
atggcagtaatggctccaaggaccctgctactgctgctcctaggagcacttgcccttacacagacatgggcaggtagtcactcaatgagatacttctttaccagcgtgtctaggccagggcgaggggaaccccgctttatcgcagtgggatacgtggacgacacgcaattcgtgagatttgattcagacgcggcatcccagcggatggagccacgagccccctggatcgaacaggaaggaccagaatattgggatcaggaaaccagaaatgtgaaggctcactcccagacggatagaaggtatttggagaacggtaaggagacactgcagcgtaccgacgcacctaaaacacatatgacacaccatgcggtctcagatcacgaggccacactacgttgttgggcgttgtccttttacccggccgagatcaccctgacatggcagcgtgacggggaggatcaaacacaggacaccgagttagtagagacgcggcctgccggtgatggcaccttccaaaagtgggcctctgttgttgtccccagcggccaagagcagcgctacacctgccacgtgcagcacgaggggttgcccaagccactgaccctgcggtgggaacccagcagccaacctaccatccccatagtgggcattattgccggcctggtgttgttcggagccatgttcgcaggggcagtggttgccgcggtacggtggcggaggaaatccagcgggggagaaggtatgaaaggtggcagcgagatcagctgtctgacagaaggaagcaaaacgcaggtggaggtgtgccctgcctctcttctgggctcgaccattcacaactacgggcccacacagcccgggccctgcgtgcccgcgctgactctcttgtag

SEQ ID NO: 27289 - DNA, 1098 bp, Artificial Sequence
  Description of Artificial Sequence: Synthetic coding sequence
atggctgttatggcacccagaactttgctgttactgctgctcggagccctggcccttacacaaacttgggctggctctcatagcatgcgatacttcaccacgagtgtatcccgacccggccggggtgaacctcgcttcattgcagtaggctacgtggacgacactcagtttgtccgctttgattctgacgcggcatctcagcgcatggaaccacgagccccttggatagaacaagagggccctgaatactgggatctacagacgaggaatgttaaggctcagagccaaacggaccgggccaacctggggacactgagagggtattataaccagagtgaggctggctctcacacaatccaaatgatgtacggttgcgacgtgggttcggacggaagattcctgagggggtacagacaggacgcatacgatggcaaggactacatcgcactgaatgaagatctgagaagttggacagccgccgatatggccgcgcagattacccagcggaagtgggaggccgcgcgggttgcggagcagctacgggcctacctggagggtacttgtgttgagtggctgcgccgctacctggagaatggaaaagagacgctgcagcgcaccgatgcccctaagacccacatgacgcatcatgctgtctccgaccatgaagccactctgcgctgctgggctttgtctttttaccctgccgagattacactgacatggcagcgcgacggcgaagatcaaacgcaggacactgaacttgttgagacgcggcctgcaggggacggcacattccagaaatgggcttccgtggtcgttccttccggacaggagcaacgctatacctgccacgtgcagcatgagggcctgccaaagcctctcacgcttcgttgggagccttcgtcccaacccaccataccaatcgttggcattattgctgggctggtgctgtttggagccgtgttcgccggcgccgtcgtcgccgcggttaggtggcgaagaaagtccagcgatcgaaagggtgggtcatacagccaggctgcttcgtccgactcggcgcagggatctgacatgagcctgaccgcctgtaaagtgtag

SEQ ID NO: 27290 - DNA, 345 bp, Artificial Sequence
  Description of Artificial Sequence: Synthetic coding sequence
atgacccaccaccctatatcggaccacgaggcaactctcagatgttgggccctaggcttctatccagccgagatcaccttgacctggcagagggacggggaagatcagacacaggacaccgagctggtagagacaagacccgccggcgatggaacattccagaaatgggcagcagtcgtggtgccgtctggagaagagcagagatatacctgtcacgtccaacatgaaggtctgcccaagcccttaaccctccggtgggatcgaaaaggggggtcctacactcaggcagcgtcaagcgactcggctcagggatctgacgtgtctctgacagcttgcaaagtgtag

SEQ ID NO: 27291 - DNA, 888 bp, Artificial Sequence
  Description of Artificial Sequence: Synthetic coding sequence
atggcggtgatggccccccgaacacttgtgttgctcctgagtggagctctggcacttacccagacttgggctggtagtcactccatgcgttatttctacacatccgtctctaggcctggacggggcgaaccccgcttcattgccgttggttacgttgacgacacgcagttcgttcggtttgacagcgatgccgcgagtcaaaggatggaaccgcgagccccatggattgagcaggagggtcctgagtattgggatcgcaacacaaggaatgtcaaagctcactctcagacggatcgcgcctacttggagaatggcaaagagactttgcagcgcaccgacgctcccaagacacacatgacccatcacgccgtgtctgatcatgaagctactctacggtgctgggcactgtccttctaccccgcagaaatcacactgacctggcagcgagacggtgaagaccaaacccaggatacagagctggtggaaactcgtcccgcaggagatgggaccttccaaaagtgggcatctgttgtcgtgccgtcgggtcaagaacagcgttatacctgtcatgtccagcacgagggtctgcctaaacctctgactctgcgctgggagcctagctcccaacccacgataccaatcgttggtattattgctggcctggtcctgtttggggctgtcatcgcaggcgccgtggtcgccgctgtcatgtggcggcggaagagctccggtggcgagggtatgaaaggaggaagcgagatctcgtgtttaacggagggcagcaagacacaggtggaggtatgccccgcttctttgctgggttccactattcacaattatgagcccacacagccggggccctgtgtgcccgctctgacgttgttgtag

SEQ ID NO: 27292 - DNA, 465 bp, Artificial Sequence
  Description of Artificial Sequence: Synthetic coding sequence
atggcagtgatggccccaaggacccttttgctgcttttgtccggcgctttagctctcacacagacttgggcagggagccattccatgcggtatttttttacctctgtgtccagacctggtcgcggggagcctagatttatcgcagtcggttacgtagatgacacccagttcgtaagattcgatagcgatgccgcctcccagaagatggagccaagggccccatggatcgagcaggaggggcccgaatactgggaccaggaaacccgtaacatgaaagcgcactctcagacagatagggcaaacctgggtactctacgcggctattataatcaatccgaggatggatctcataccattcagatcatgtacggctgtgacgtcggcccagatgggaggttcctccgcggctatcggctgcggagcccttctgctagcggccgtagaagcatgcgcagatccagctag

SEQ ID NO: 27293 - DNA, 1098 bp, Artificial Sequence
  Description of Artificial Sequence: Synthetic coding sequence
atggccgtcatggcacctagaacattgctcctgctactgtctggggctctggctctgactcaaacatgggccgggtctcacagcatgcgctacttttttacctccgtatcccgtcctgggcgcggtgagccacgcttcatcgctgtgggttacgtggacgacacacaatttgtcagatttgactccgatgcagcaagtcagaagatggagccccgggccccctggattgagcaggagggtcctgagtattgggaccaggagactcggaacatgaaggctcattcccagactgaccgggccaatcttggcacactaagagggtattacaatcagtctgaggatggctcccatacgatccagatcatgtatggttgcgacgttggccctgacggccgtttcctgaggggttatcggcaggatgcttatgatggcaaagactatattgccctgaatgaggatctcagatcctggacagccgctgacatggccgcccagatcacgaagcgtaagtgggaggcggtgcacgccgcagagcagaggcgtgtttaccttgaaggacgctgcgtggacgggctgcggcgctacctcgagaatgggaaagagactctccagcgaacagatcctccgaagactcatatgacccatcatccaatctccgatcatgaggccacgttgcgctgttgggcccttggtttctacccagctgagattaccctgacttggcagagggatggagaggatcagacccaggacacagagcttgtagagaccagaccggctggtgacgggacctttcagaagtgggctgctgtcgtcgtaccaagcggagaagagcaaaggtacacatgccacgttcaacatgagggattgccaaagccgctgaccctccggtgggagctcagctcacagcccacaatccctatcgtgggcatcattgccggtctcgtcttactaggtgctgtcataacaggcgccgtcgtggcagcagtgatgtggcgcagaaagtctagcgaccgcaaagggggcagttacacccaagccgccagctccgattccgctcagggcagtgacgtgtctttgaccgcctgcaaagtctag

SEQ ID NO: 27294 - DNA, 1098 bp, Artificial Sequence
  Description of Artificial Sequence: Synthetic coding sequence
atggctgttatggcacctcgtacactattgctgctgctgctgggggccttagccctgactcagacatgggccggctctcattccatgcggtactttttcaccagtgtgagcagaccagggcggggcgaacctcgttttatcgctgtgggatatgttgacgacacacagttcgtcaggtttgacagcgatgccgcttcgcaaagaatggagccacgggctccatggatcgagcaagaaggtccggaatattgggaccaggaaacgaggaacgtcaaggctcactctcagacagaccgggagagcctccgtatcgctctgagatattacaatcagtccgaggccggctcacacaccattcagatgatgtatgggtgtgacgtggggccagacggtcgattattacgtgggtaccaacaggacgcctacgatggcaaggattacattgcactgaacgaagaccttaggagttggaccgccgcagacatggcggcccagatcacccagcggaaatgggaggcggcccgggtcgcagaacagcttcgcgcctacctggaggggacctgcgtggaatggctgagaaggtatctggagaatggcaaagagacattgcagagaactgacgcacctaagacacacatgacacatcacgcagtttctgaccacgaggcgaccttacggtgctgggcattgtccttttatccagcggaaatcaccttgacatggcagcgtgacggggaagatcagacccaggataccgagctggttgaaacaagacctgcaggcgacggaacattccaaaaatgggctagcgtagtagtaccctctggacaggagcagcgatacacatgtcacgtgcagcacgagggactgcccaaaccgctgaccctccgctgggaaccttcaagtcagcccaccatccccattgtaggaatcatcgctggactggttctcttcggggcaatgtttgcaggggcagtcgtcgcagccgtgcgatggcgcaggaaaagctctgatagaaagggcggctcgtactcacaggccgcttcctctgactctgctcaaggaagtgacatgtcactgacggcatgcaaagtctag

SEQ ID NO: 27295 - DNA, 345 bp, Artificial Sequence
  Description of Artificial Sequence: Synthetic coding sequence
atgactcaccaccctatctctgaccatgaggccaccctccggtgctgggccttaggcttttaccctgctgagatcactctcacatggcagagagacggggaagaccaaacccaagatactgaactcgtagaaactaggcccgccggtgacggcaccttccaaaaatgggccgccgtggtggttccgagcggcgaggaacagcgatatacatgtcatgtgcagcacgaggggttgcccaaacctcttaccttacgctgggaccgcaaaggcgggtcttacacccaggctgcttcaagtgacagcgctcaggggtccgatgtgtcccttactgcctgcaaagtgtag

SEQ ID NO: 27296 - DNA, 1089 bp, Artificial Sequence
  Description of Artificial Sequence: Synthetic coding sequence
atgcgcgtaacagcgcctagaaccctccttctcttgttatggggggccgtggcattgacagagacatgggcgggatcccatagcatgcgatacttccacacgtcggtgtcaaggccaggtagaggtgagccacgttttatctctgtcggctacgtggacggcacccaatttgtgcggtttgattcggacgctgcctcgccacgcaccgagccacgcgcaccttggattgagcaggaaggtccagagtattgggatcggaacacccagatcagcaagaccaacacccaaacttatagggagtctctcagaaatctgaggggctattacaatcaatccgaagccggctcccacaccctgcagcgtatgtacgggtgtgacgtgggcccagacggtcgtttactgcgcggccacgatcaaagtgcgtacgacgggaaggactatatcgctcttaatgaagacctctcatcatggaccgcagctgataccgctgcccagataacccagcggaaatgggaggccgccagagtagctgaacagcttcgcgcatatttagaagggacttgcgtggaatggttgcgcaggcatctagagaacggaaaggaaaccctgcagcgcgcagatccccccaagacgcacgtgactcatcaccccatttcagatcatgaggcgaccttaaggtgctgggcattaggtttttatcctgctgaaattaccctcacctggcagagggatggtgaagaccagacccaggatacggaactagtcgaaaccagaccagcaggagaccggacatttcaaaagtgggccgcagtggtcgtaccctcgggcgaggagcagcgctatacttgccatgtgcagcacgaaggactgcccaaaccacttacattgcggtgggagccaagctctcagtcaactattcccatcgtggggatcgtcgcggggctagcagtattggccgtggtagtcatcggcgcagtggtggccactgtgatgtgtaggcggaagagcagtggcgggaaggggggatcttactcccaggccgcttcaagcgacagtgcacagggcagtgatgtgagccttacggcgtag

SEQ ID NO: 27297 - DNA, 1089 bp, Artificial Sequence
  Description of Artificial Sequence: Synthetic coding sequence
atgctggtcatggctccacgtactgtgttactactgctctccgccgcgcttgctctgaccgagacctgggccgggagccacagtatgcggtacttttatacgtcggtcagcaggcccggtagaggtgaaccccgcttcattagcgtcgggtacgtggacgatacacagttcgtccggttcgactcagatgccgcctccccccgcgaagagccacgggcaccctggatagagcaagaaggacccgagtattgggacaggaatactcaaatttacaaggcccaggcgcagactgacagagaaagccttcgcaacttgagaggttactacaatcaatccgaggcaggttcccataccttgcagagcatgtatggctgcgacgtcggacccgacggtaggttgcttcgcggacacgatcaatacgcctatgatggaaaggattatattgccttgaatgaggatctgcggtcatggacagcggctgacacggcagcacagatcacacagcgcaagtgggaggcagcaagagaagctgaacaaagaagagcttatctcgaaggggaatgcgtggagtggctgcggaggtaccttgagaacgggaaagacaagcttgagagggccgatccacctaaaactcacgtgactcatcacccaatttcagaccacgaggcaacactgagatgctgggctctggggttttaccccgccgaaattaccctcacatggcagagggatggcgaggaccagacccaggatacagagctggtggaaactcgtccggcaggtgacagaaccttccagaaatgggcggccgtggtggtgcctagcggagaggaacagcggtacacttgccacgtccagcatgaaggtctgcctaagcctttaacactgcggtgggagcccagcagccagagtaccgtcccaattgtgggtatcgtggctggcttagctgtgctggccgttgttgtgattggtgctgtggtggcagcagttatgtgtagaaggaaatctagcggaggaaagggggggtcttactcacaggctgcttgcagcgactcagcccagggaagtgatgtatccttaacggcctag

SEQ ID NO: 27298 - DNA, 726 bp, Artificial Sequence
  Description of Artificial Sequence: Synthetic coding sequence
taacccgacggcagactacttcgtggccataaccagtacgcttacgacggaaaggattatatagcgttaaacgaagatctccggtcgtggacggcagccgataccgccgcccagatcacacagaggaaatgggaggcagccagagttgcagagcaggatcgcgcgtatctggaggggacttgcgtggagtggcttcgtcgctacttagagaacggcaaagacaccctcgagcgggctgatcctcctaagacccacgtgacgcaccacccaatttccgatcacgaagcaacacttcggtgctgggctctcgggttctatcccgctgaaataacccttacatggcagagagacggcgaggaccaaacacaggatactgagctggtggagactcggcccgcgggcgatcgaacctttcagaaatgggcagctgtagttgttcccagtggcgaagagcagcgatatacttgtcacgtccagcatgaggggttacccaagcccctgactctgcgctgggagccatcctcccagtccaccgttcctattgtcgggattgtggctggcctcgccgtgctcgcagttgttgtgatcggtgccgtggtcgccgcggttatgtgcaggcggaagtccagcggccattttctccccaccggggggaagggaggctcttatagtcaggcagcctgtagtgatagcgcacagggctcggatgtctctctcaccgcgtag

SEQ ID NO: 27299 - DNA, 726 bp, Artificial Sequence
  Description of Artificial Sequence: Synthetic coding sequence
tgaccggacggaagattgctgcggggccacgatcagtctgcatacgatgggaaggattacattgcgttaaatgaggacctgagcagttggactgctgccgatactgcggcacagattacccagagaaagtgggaagccgcaagagtagccgaacagttgagagcatacctggagggaacatgtgtagagtggctcaggcgccaccttgaaaacggcaaggagaccctccaaagggccgatcccccaaagacgcacgtcacccaccaccccatttcagatcacgaagccacactcagatgctgggccctgggattttaccctgccgaaattactctgacctggcagcgggacggggaggatcagacgcaggataccgaactggtggaaacaaggcccgcgggcgatcgaacattccagaagtgggccgcggtagtggtgccatcgggcgaagagcagaggtacacatgtcacgtgcagcatgagggtctgcctaagcctttgacactgaggtgggagccttcttcacagtcaaccatcccaatcgttgggattgtcgctggcctggccgtgcttgccgtcgtggtgattggcgccgttgtagccacagtgatgtgccgtagaaaatcttccggccatttcctgcctacaggaggaaagggcggttcatactcacaggctgcttcaagcgattctgcccaaggtagtgatgtgtctttgaccgcctag

SEQ ID NO: 27300 - DNA, 1089 bp, Artificial Sequence
  Description of Artificial Sequence: Synthetic coding sequence
atgcgagtaactgcccccaggaccttgttactgctcctctggggagcagtggctttaacggagacatgggccgggtctcatagcatgcgatatttctacaccgccatgagtcgaccggggagaggagaacctcggtttatcacagtaggatacgttgacgataccctattcgtgaggtttgatagcgacgccacaagcccacgtaaggaaccccgagctccctggatcgagcaagaggggcctgagtattgggacagggagactcagattagtaaaacgaatactcagacataccgtgagaaccttaggactgcccttaggtactataaccaaagcgaggccggatcccatatcattcagcggatgtatggctgcgacgtgggccctgatggacgacttctgcgcggctacgatcaggacgcttatgacgggaaagactatatcgctttaaacgaggacttatctagctggacggctgccgacacagcagctcagatcacacaaaggaaatgggaggccgcccgagtcgctgagcaggatcgtgcttaccttgaaggcctgtgcgtggagtctctcaggcgttacctcgagaacggcaaggagaccctccagcgcgccgaccccccgaagactcacgtgacgcaccatcctatctctgaccatgaagtcaccctccgttgctgggcactgggcttctatccggcagaaattacgctgacatggcagagagacggggaagaccagacgcaggacacagagctggtggagactagacctgccggagatcggacatttcagaaatgggccgccgtggtggtaccctcgggcgaagaacagcggtatacttgtcacgtgcagcatgagggattgcccaagcccctgacattgcgatgggaaccttcatcacagtctactgtacccatcgtcggaatagtggccggcctggctgtgctcgcagtagtggtcattggggccgtcgtagcggcggtgatgtgcaggcgcaaaagttccggtggcaaggggggctcttacagccaggctgcatgctcagatagcgctcagggcagtgacgtctctttgacagcctag

SEQ ID NO: 27301 - DNA, 726 bp, Artificial Sequence
  Description of Artificial Sequence: Synthetic coding sequence
tgaccagatggtagattactgaggggccacgatcagtcggcttacgacgggaaggattatatagcgttgaatgaggacctgtcctcctggacagctgcagacacggccgctcaaataacacagcgtaagtgggaggccgccagagaggccgagcagtggagggcatacctggagggtctgtgcgtggagtggttacgccggtacctcgaaaatggaaaagaaacccttcagagggctgatccaccaaaaactcacgttacccatcatccaatcagcgatcacgaggccacactgaggtgctgggccctgggcttctatccggcagagataacactaacctggcagcgcgacggggaggaccagacgcaagacaccgagctggttgaaacgcggcccgccggcgatcgcacgtttcagaagtgggctgctgttgtggtgcccagcggggaagagcagcgatatacctgtcacgtgcaacacgaaggactaccaaagcccctgacccttcgttgggaaccaagtagtcagagtactatacccatcgtaggaatcgtggccggccttgcggttttggcggtagtggttatcggggcggttgttgcgacagttatgtgcaggcggaagagctcaggccactttctgcccactggtggcaagggaggaagttactcccaggccgctagctcagactcagcacaaggttccgatgtgagcttgaccgcatag

SEQ ID NO: 27302 - DNA, 1089 bp, Artificial Sequence
  Description of Artificial Sequence: Synthetic coding sequence
atgttagtgatggctcccagaaccgtcttactactactaagcgccgctctcgccctgactgaaacgtgggctggatcccacagtatgaggtatttcgatacagcgatgagtagacctggtaggggcgagccacggtttatctctgtgggctatgtcgacgacacccagttcgtgagattcgacagcgacgccgctagcccgcgggaagagccaagagcgccttggatcgaacaggagggccctgagtactgggataggaatactcagattttcaaaacaaatactcagacggaccgtgagtcgcttcgaaacctgagagggtactacaaccagtctgaagctggaagccacacattgcagtccatgtatggctgtgatgtcggccccgatggacggctgctgaggggtcacaatcaatatgcctacgatgggaaggattacatcgcgctcaacgaggatctccggtcttggactgcagccgacactgccgcacagattacccagcgaaagtgggaagctgccagggtcgccgagcaggacagagcatacctcgagggcacctgtgtggagtggttgcggaggtatctggagaatggtaaggacacccttgaacgcgccgacccccctaagacccatgtcacacaccacccaatcagcgatcacgaggctacacttcggtgttgggctctgggtttttatcctgccgaaatcactctgacgtggcagcgagacggcgaagaccaaactcaggacaccgagcttgtggagactagacctgctggcgacagaacctttcagaagtgggccgccgtcgtcgtgcctagtggagaagagcagagatacacttgccacgtgcaacatgagggactgcccaagcctctgactctgcgatgggaacccagcagccagagcaccgtgccaattgtggggatcgttgccggcttggctgttttagccgttgttgtgattggtgccgtcgtcgccgccgtcatgtgtcgccggaagtcttcaggcggaaaagggggatcgtactcccaggcagcttgttcagacagcgctcagggaagcgacgtttcgctaactgcatag

SEQ ID NO: 27303 - DNA, 678 bp, Artificial Sequence
  Description of Artificial Sequence: Synthetic coding sequence
tgaatgctcgtaatggcacctcgtactgttctgctgcttttgtcagcggctctcgctcttaccgaaacatgggccgggagtcacagtatgaggtacttctataccagcgtgagtcgccccggaagaggggagcctcggtttatctcagtagggtatgttgatgacacccaattcgtgagattcgattccgacgctgcttctcctagggaggaacctcgcgcaccctggatagaacaggaaggccctgagtactgggatcggaatacacagatctacaaggctcaggcgcagaccgacagagaaagcctacgcaatctaagaggttattataatcaatcagaagccggcagccacaccctccaatctatgtatgggtgcgacgtgggacccgacggacggttactgagggggcacgatcagtatgcttacgacgggaaggactacatcgccctgaacgaagatctgcggtcttggaccgcggcggatactgcagcgcaaattacccagcgaaaatgggaggcagcacgggaggccgagcaaaggagagcctacctcgaaggggaatgtgtcgagtggctgaggcgatacctcgaaaatggcaaggacaagctcgagagggctgaccaggagcagaagtccctgttccctgcgcagcggctggaactgagcaatgagtag

SEQ ID NO: 27304 - DNA, 726 bp, Artificial Sequence
  Description of Artificial Sequence: Synthetic coding sequence
atgtacggatgcgacgtcggccctgatggaagactcctcagagggcatgaccaatatgcctatgacggcaaagactatattgctctgaatgaggacttgcgcagctggaccgctgcggacacggccgctcagataacccagcggaagtgggaggccgccagagaggccgagcaaagacgggcatacctggagggcgagtgcgtcgagtggttgagacgttacctggaaaatggcaaagataaacttgaacgggccgacccccccaaaacacacgtgacccaccatccaatctcagaccacgaagcgacgctgagatgttgggccctgggcttctatcctgcagagatcacccttacgtggcagcgtgatggcgaagaccagactcaggacactgagctggtggaaaccaggccggctggcgaccggacttttcagaaatgggccgccgtggtcgtgccctcgggagaagagcagaggtacacctgtcatgtgcaacatgagggacttcccaaaccacttacattacgttgggaacctagctctcagtctacagtcccaattgttggtatcgtggctggcctggccgtcctggcagtggtcgtgataggggctgtcgttgcagccgttatgtgtcgtcgaaagagctctggaggaaagggtggctcctactcccaagctgcatgcagcgactcagcccagggctctgacgtcagcttaaccgcttag

SEQ ID NO: 27305 - DNA, 741 bp, Artificial Sequence
  Description of Artificial Sequence: Synthetic coding sequence
atggccagcgtgggtcgccgggaaggcaccgccgggggtggagccggcccaggggagccacgtcgggaagaggggagggcaggattatcaccatcctctccacccgggtctcactccatgaggtatttctacactgccatgtctagaccagggcgcggagaacctaggttcatcactgtagggtatgttgacgataccctatttgtaagattcgactctgatgccacttcccctagaaaagaaccgagagctccatggatcgaacaggaggggcctgaatactgggacagagagactcagatttctaagacaaatactcaaacctatagggagaacctgcgcacggcactgcggtattataatcagtccgaagccggctcccacattatccagcggatgtacggatgcgatgtgggccctgatgggaggcttttgaggggttatgaccaggacgcttacgacgggaaagactatatagcgcttaatgaagatctttccagctggaccgccgccgatacagccgcccagatcacgcaacggaagtgggaggccgcgcgagttgccgaacagctgagagcctatctggagggcctgtgtgttgaatccctgagacgttacctcgagaatggtaaagagacattacagagggccgatccgccgaaaacccacgtcacacatcaccccatcagcgaccacgaggtgacattgcgatgctgggccttggggttttatcctgcatag

SEQ ID NO: 27306 - DNA, 741 bp, Artificial Sequence
  Description of Artificial Sequence: Synthetic coding sequence
atggccagcgctggcaggtcggaagggactgctgggggcggggcaggtcctgaggagccgaggcgggaagaaggcagggccggcttatcccccagctcaccccctggaagccactcaatgagatacttttatacatcggtcagccgccctggccgcggggagcctcggttcatctccgttgggtacgtcgatgatactcagtttgtgcggtttgattcagacgccgccagccctcgggaggaacccagggccccctggatagagcaggagggccccgaatactgggaccgcaatacgcagatatacaaggctcaggcccaaacagacagggagagcctccggaacttaagaggctattacaaccagagcgaggctgggtctcataccctccagtcaatgtacggctgcgatgtcggcccggacggccggctgctgaggggacacgatcaatacgcgtatgatggcaaggattacatagccctgaatgaggaccttaggtcgtggaccgccgcagacactgccgcacagatcactcagaggaagtgggaagcagcgcgagaggctgaacagcgtagagcctacttggagggagagtgtgttgagtggctcaggcgctatctcgaaaacgggaaagataagctggagagggcggatcctccaaagacacatgtaacgcaccaccctattagcgaccacgaagccacattaagatgctgggccttaggattctaccccgcttag

SEQ ID NO: 27307 - DNA, 1089 bp, Artificial Sequence
  Description of Artificial Sequence: Synthetic coding sequence
atgagggtgacggcaccaagaactctcctgctactgctgtggggcgccgtggcacttacagagacatgggccggttcacacagtatgcgatatttctatactgccatgtctcggccggggagaggggagccccggttcatcaccgttggctatgtagacgatacactcttcgtcagattcgactccgatgcgacatcccctagaaaggaaccccgagcgccttggatagaacaagagggaccagagtactgggacagagagacacaaatatctaagactaatacacaaacttatagggagaacctcaggacagcactaaggtattataaccagagcgaggccggaagccacatcattcagcgcatgtatgggtgcgacgtcgggcctgacggtaggctgttacgggggtatgaccaagatgcatatgacgggaaggactacatcgctcttaacgaggacctgtcaagttggaccgctgctgataccgcagctcagattacacagcggaaatgggaagccgcccgggtcgcagagcagctcagggcgtatttggagggcttgtgcgtagaaagcctcaggcgatatctggagaatgggaaggaaactctgcagcgggctgatcctcctaagactcatgtcactcatcatccaataagcgaccatgaagtgactctacgctgttgggccctggggttttatccagcagagatcacactgacgtggcagagggacggagaagaccagactcaggacaccgaactggtcgagacccggcccgcaggagatcgcacgttccagaaatgggcagccgttgtagtgccctccggcgaggaacaaagatatacttgtcacgtgcagcacgaggggctgcccaagcccctgaccttgcggtgggagccttcatctcagtctaccgtcccaatagtcggcattgtcgccggcctcgcggtgctagccgtggtcgttatcggcgctgttgtcgcagccgtcatgtgtcgcagaaagtccagcggcggcaaagggggcagctattctcaggcagcctgcagtgattcggcacaggggagcgatgtctctctaactgcgtag

SEQ ID NO: 27308 - DNA, 726 bp, Artificial Sequence
  Description of Artificial Sequence: Synthetic coding sequence
tgacctgacgggcggctactgagaggatatgaccaggacgcttacgatggtaaggactacatcgcactgaacgaggacctgtccagttggacagcagctgataccgctgcccagatcactcagcgcaaatgggaagcggcccgcgtggctgaacagcttcgggcttatctcgaagggctgtgcgtggaatcgcttcggagatatttggaaaacgggaaagagaccttgcaacgggctgatccccccaaaactcatgtgacccaccatccgatatccgatcacgaggtaaccctgcggtgttgggctttaggattctaccccgcggagatcaccctcacctggcaaagagatggagaggatcaaacgcaggatacagaacttgtcgagacaaggccagccggggaccgcaccttccagaagtgggccgccgtggtggtgcctagtggtgaagagcagcgatacacctgtcacgttcagcatgaaggattgcctaaacccctgaccctgagatgggagccaagtagccagtccacggtccccatcgtgggaattgttgccggtttggcagtcctcgctgtggtggtgattggcgcagtagtcgctgcagtcatgtgtaggcggaaatcatcaggccatttccttcctactggcggaaaaggagggagttatagccaagccgcctgcagtgacagtgcccagggctcagatgtgtcccttaccgcttag

SEQ ID NO: 27309 - DNA, 726 bp, Artificial Sequence
  Description of Artificial Sequence: Synthetic coding sequence
tgaccggacggccgattgctccgtgggtacgaccaagatgcgtatgacggcaaggactacatcgccctcaacgaagaccttagcagttggacagcggccgacactgcggctcaaatcacacagcgaaaatgggaagcggctcgagtggctgagcaggaccgggcctaccttgagggactatgtgtcgaaagcttgagacgatatttagaaaacggcaaagagacacttcagcgcgccgatcctccaaaaacccacgtgacacaccaccccatcagcgaccacgaagtgaccctgagatgttgggccctgggattttaccccgccgagattacgttgacttggcaaagagacggcgaggaccagactcaggacacggagctggtcgagactagacccgcaggtgatcgcacctttcaaaagtgggctgcggttgtcgtgccatcgggcgaggaacagcgctatacttgtcacgtccagcacgaagggctgcccaaacctctaactctgcgttgggaaccatcatcgcagtcaactgttcctattgtcggcattgtggcaggtctggcagttctggccgtagtcgtgataggagcagttgttgccgcagttatgtgccgcagaaaatccagtggccacttcctcccgaccggagggaagggcggaagttattctcaagcagcctgctcagattcggctcagggatccgatgtgtccctcacagcatag

SEQ ID NO: 27310 - DNA, 741 bp, Artificial Sequence
  Description of Artificial Sequence: Synthetic coding sequence
atggcatctgtcggcagatccgaaggtactgcaggagggggtgcaggtccaggagagcctaggcgggaggaggggcgcgctggtctttcgccctccagtccaccaggttcccatagcatgaggtatttttacaccgcaatgagtcgccctgggaggggcgagccacgatttattgccgtggggtatgtcgatgacactcagtttgtaaggttcgatagcgatgctgcctcaccccggatggccccaagagccccttggattgagcaggagggtcccgaatattgggacagagaaacacagatcagtaaaacgaacacacagacgtatcgggaatcgctccgcaatcttcggggctactacaatcagtcggaagccggttcccataccctccagaggatgtatggatgcgacgtcggccctgacgggaggttactgcgcgggcacgatcagagcgcttacgacggtaaagactatatagcactgaatgaggatctgtcctcatggactgctgctgatactgcggcccagattactcagcggaagtgggaagcagcccgagaggccgagcaatggagggcttacctcgagggtctctgcgttgagtggttacgtcgatatctcgagaatggcaaggagacactgcagcgcgcagatcctcctaaaacgcatgtaactcaccatccaatctctgaccacgaagctacactgcggtgctgggcactgggcttctacccagcctag

SEQ ID NO: 27311 - DNA, 741 bp, Artificial Sequence
  Description of Artificial Sequence: Synthetic coding sequence
atggccagcgctgggcgctccgagggaacggctggcggaggcgcaggtcccgaggagccccgtcgcgaggagggccgagcaggtctgtctccgtcctctcctccaggaagccattctatgcgatacttcgacaccgccatgtcaagaccagggcgcggggaacctaggtttatctccgtggggtatgtagacgatactcaatttgtaagattcgatagcgatgctgctagtcctagggaggagccgagggccccctggatcgagcaggaaggtcccgagtactgggacagaaacacacaaatttttaagacaaacacccagaccgatagggagagtttacggaacctgagaggatactacaatcaaagtgaggcgggctcacacactctgcaaagcatgtatgggtgcgatgttggccctgacgggagattgttgagaggccacaaccagtacgcatatgacgggaaagattacatcgcccttaacgaggatttgagaagctggaccgccgccgacacagctgctcaaatcacccagaggaagtgggaggccgcacgcgtggccgagcaagatcgtgcatacctcgagggaacctgtgtggagtggctccggcgctacctagagaacggtaaggacactctggagcgggcggatcctcctaaaacacatgtgacccaccaccccatcagcgaccacgaggccactttgcgatgttgggctctgggattttatcccgcttag

SEQ ID NO: 27312 - DNA, 741 bp, Artificial Sequence
  Description of Artificial Sequence: Synthetic coding sequence
atggcctccgtgggacgcagggaaggtacggctggtggcggagctggccctggcgagccacggcgcgaggaaggcagagcaggtttgagtccatcgagtccgccgggttcccactctatgcgctacttttacactgccatgtccaggcccggtagaggggagcccaggttcatcactgtgggttacgtggatgacacactgtttgtgaggttcgacagcgacgcgaccagcccaaggaaagaacctagagccccttggatcgagcaggagggacctgagtattgggatcgggagacacagatatccaagacaaacacccaaacctacagagagaacctaagaaccgccctgagatattataatcaatcggaagctggatcacacataattcagaggatgtatggatgcgatgtggggcctgatggacgccttctgcgaggttacgaccaggacgcgtatgacggcaaggactacattgcactcaatgaagatctctctagctggacagccgcagacacggcggcccagataacccaacgtaaatgggaggccgcaagagttgccgagcaggacagagcatacttggaaggcttgtgtgtggagtccctccgacgatacttggagaacggtaaagaaactttgcagcgagccgatcccccgaagactcatgttactcaccaccccatttccgaccacgaagtcacactgcgctgctgggcgctcggcttttaccctgcctag

SEQ ID NO: 27313 - DNA, 1089 bp, Artificial Sequence
  Description of Artificial Sequence: Synthetic coding sequence
atgagagtcacagcccctaggaccgttctattgttactgtcaggcgccctggctctaacagagacctgggcaggttcccactcgatgcggtacttttatactgccatgagccgaccaggacgtggagaaccgcggtttattgcggtcggatacgtggatgacacacagtttgtgcgattcgacagtgacgcagcttcaccccgcatggccccgcgagctccgtggatagagcaggagggaccggaatactgggatagagaaactcagatttcgaagaccaacactcagacataccgggagagtctcaggaacttaaggggttactataaccagagcgaggcgggctcacataccctgcagaggatgtatggatgcgatgttggccccgatggccgtctgctgcggggtcatgatcagagtgcctacgatggcaaggattacatcgccctgaacgaagacctgtcttcgtggaccgcagccgacaccgccgcccaaattacccagcggaagtgggaggctgcccgtgaggccgaacagtggcgtgcttacctggagggcctgtgtgtagaatggctgcgccgataccttgaaaatggaaaggaaactctccaaagggccgaccctccaaaaacccatgtgacacatcaccccattagcgatcatgaggccactctgaggtgttgggccctgggtttctacccagctgaaattactctgacatggcagagggacggagaggatcagacacaggataccgagctggtagaaacccggcctgcaggggacagaacatttcagaagtgggccgctgtcgtggttcctagcggggaagagcaacgctacacctgccacgtgcagcacgaagggctccctaagcctctcactctgcggtgggagccaagctcccagtctacaattcccatcgtagggatcgtggcaggactggcggttctggccgtggtcgtgatcggcgcggtggttgctaccgttatgtgcagacgtaaatctagcgggggtaaagggggcagttatagtcaggcggcttcttccgactctgcgcaaggctcggatgtctcgctgacagcatag

SEQ ID NO: 27314 - DNA, 609 bp, Artificial Sequence
  Description of Artificial Sequence: Synthetic coding sequence
atgtacggatgtgatgtaggccccgatggacgcctccttcgtggtcacgaccaatacgcctatgacgggaaggactacattgcccttaacgaggacctgaggtcttggacggccgctgacacagccgcccaaatcactcaacgaaagtgggaagctgcccgggaagctgagcagcggcgcgcatatctcgagggtgagtgtgtcgaatggttaaggcgctatcttgagaatggcaaggacaaactggaacgagccgacccccccaagacccacgtcacccaccacccaatatctgaccacgaggccaccctgagatgctgggcactcggcttctaccccgccgagatcactctgacgtggcagagggacggggaggaccagactcaggacacagagctggtagagactcgtcctgccggcgataggactttccagaagtgggccgccgtggtagtgccttccggagaagagcagcgatacacgtgtcatgttcaacacgaaggactgcctaagcctctgacactgaggtgggggggcaagggcgggagctactcacaagccgcatgcagcgacagcgcacagggctctgacgtttcactgacagcttag

SEQ ID NO: 27315 - DNA, 675 bp, Artificial Sequence
  Description of Artificial Sequence: Synthetic coding sequence
atgctcgtgatggctccacgaaccgtattactgctgctgtctgcggcgctcgctctgaccgaaacttgggcaggaagtcactccatgagatattttgatactgcgatgtcacgaccaggtaggggcgaaccacgctttatatcagtgggttacgtggacgatactcagtttgtgcgctttgacagtgatgccgccagcccacgggaagagcccagagcaccatggatcgagcaggaaggccccgaatattgggacagaaacacccaaatctttaaaactaatacacagaccgaccgcgagtctcttaggaacttacgcggatattacaatcagagtgaggctggctctcataccctgcaatccatgtacggatgcgacgtgggccctgacggccgcctcttgagaggacacaatcaatacgcttatgacggcaaggactatattgcattgaatgaggaccttaggtcctggactgccgctgatacagctgcccagatcactcaacgcaagtgggaggcagccagagtcgcagaacaggatagggcttatttagaaggcacttgtgtggaatggttacggcgttatttggaaaacgggaaggacacactagagcgtgcagaccaagaacagaaaagtctgttcccagcccagcggctggagctcagtaacgagtag

SEQ ID NO: 27316 - DNA, 675 bp, Artificial Sequence
  Description of Artificial Sequence: Synthetic coding sequence
atgcgcgtcacagctccccgaacagtgcttctgcttctgtctggagctcttgcgttgacagagacctgggctgggtcccacagcatgagatatttttatactgccatgtccagaccggggcgcggagagccacgtttcattgccgtgggatatgtggacgacacccaattcgtcaggttcgactctgacgcggcctcaccaaggatggcaccccgagccccatggatcgagcaggagggtccagaatattgggatcgggagacccaaatcagtaaaaccaacacacagacctatagggagtcactccggaatctgcgaggctactacaatcagtccgaggctggtagccataccctgcagcgcatgtacgggtgtgatgtcgggccagacggacgtctgctgcgcggtcacgaccagtctgcatacgatggtaaggattatatcgctctgaatgaagacttaagctcctggacggccgcggatacagccgcccagattacacagaggaaatgggaggccgcccgcgaggccgaacagtggagggcttacctggagggtttatgtgttgaatggctgcgccgttatctggagaatggcaaagaaaccctccaaagagctgatcaagagcagaagagcttatttcccgcgcaacggctggagttaagcaatgagtag

SEQ ID NO: 27317 - DNA, 675 bp, Artificial Sequence
  Description of Artificial Sequence: Synthetic coding sequence
atgcgtgtcaccgcaccacgcacactgcttctgctactttggggcgccgtcgccctgacagagacttgggccggatcacactctatgcgctattttcatacttcagtgtctaggcccggaagaggagaaccacgatttatctcagttgggtatgtggatggaactcagttcgtgcgcttcgactcagatgccgccagtcctcggactgaaccccgggcgccctggattgagcaggagggaccagagtactgggacagaaatacacaaatctctaagactaacacccaaacgtatagggaatcccttcgaaacctccgggggtactacaaccagagcgaagccgggagccacacccttcagcgaatgtacggatgcgacgtaggacccgacgggagactgcttagggggcacgaccaatcagcgtatgacggcaaggactatatcgcattgaatgaggacttgtcttcttggactgccgctgataccgctgcccagattacacagcggaaatgggaggcagccagagttgcggaacagctgagagcttatctggaggggacttgcgtggagtggctgcgcagacacttagaaaacggtaaggagacactgcagagagccgatcaggagcagaaaagtctattccccgcccagaggctggaattatctaatgagtag

SEQ ID NO: 27318 - DNA, 675 bp, Artificial Sequence
  Description of Artificial Sequence: Synthetic coding sequence
atgcgggtgacggctccacgcacacttcttctccttctctggggggcggtggcacttactgaaacctgggccggctcacattccatgagatacttctatacagcgatgtcgcgaccgggcagaggcgagccaaggttcatcacagtcggatatgtagacgacaccctatttgtccgttttgactccgatgccaccagcccacgcaaagaacctagggccccctggatcgaacaggagggcccggagtattgggaccgggaaacccaaatttccaaaactaacacccaaacctatcgggagaaccttcggacggccttgagatactataaccagtctgaagctgggagccatatcatccagcgaatgtatggctgtgatgtgggccctgacggccggctgctgcggggatatgatcaggacgcttacgacgggaaggactatatcgctctcaatgaggatctgtcaagctggacagcagctgacaccgctgcgcagatcacgcaaaggaaatgggaggcagcccgggttgccgaacaactgagggcctatttggagggtctgtgcgtggaaagcctccgccgctacctggagaacgggaaggagacactgcaaagagctgatcaggaacaaaagtcgctcttccccgctcagcgtctggaactgtccaacgagtag

SEQ ID NO: 27319 - DNA, 675 bp, Artificial Sequence
  Description of Artificial Sequence: Synthetic coding sequence
atgagagtcacagccccccgcaccctgctgcttctgctttggggagccgtggccttaaccgagacatgggcaggctcccactcaatgagatacttttacaccgccatgtcccgtcccggtcgcggcgaaccgcgcttcattaccgttggctacgtagatgatactcttttcgtgaggtttgactcagacgcaacaagtccccgaaaggagccacgcgctccctggatcgaacaggagggacccgagtactgggatagggaaacccaaattagtaaaacgaacacacagacttaccgcgagaatctaagaacagcattaagatactacaaccagtctgaggccggcagtcacattattcaacggatgtatgggtgcgatgtgggcccagacggacggctgctgaggggttacgatcaagatgcttatgacggcaaagattatattgccttaaatgaggacctttcttcatggacagcagcagatactgctgcccagatcacccagcggaagtgggaagctgccagggttgcggagcaggaccgtgcatacctcgagggtctttgcgttgaatctctgaggaggtacctagagaatgggaaggaaaccttacagagagccgatcaagagcagaagtctctgttcccagcccagagactggagctgtctaatgagtag

SEQ ID NO: 27320 - DNA, 1302 bp, Artificial Sequence
  Description of Artificial Sequence: Synthetic coding sequence
atgagggtgactgctccaagaactctgttgcttcttttgtggggagccgttgctcttactgaaacctgggccgggtcccattccatgcgatatttttacacagctatgagtagacccggcagaggcgagccacgattcatcaccgtcggatacgtcgatgacacgctgtttgttaggtttgactccgacgccaccagtccgcgtaaagaacctagggcaccctggattgaacaggaggggcctgagtactgggatagagagacgcagatatctaagacaaacacacagacttaccgcgaaaatctgaggactgctttgcgttattataatccagggcggcgctcccgtctacctataccacatgtaagaccaggatcaccccgtgtgagtggatccgaaatcaggccgcgcggacggggtaccaggccagacccgcgacctgcccgggcccctggagccttcactcggtttcacttccagctccgccctaaatcacctagagtgggccgtgggggggcgggactcggcacaggccttaccgccggaccaggtcctgggagtcacatcattcagcgcatgtatggctgtgatgtgggacccgatgggcgccttcttcggggctatgaccaagatgcttacgacggcaaagattacatcgcacttaatgaggacctgagcagttggacggctgcagacaccgcagctcagattacccagagaaagtgggaggcagcccgtgtggccgaacagctgcgtgcatacttggaaggactctgcgtcgagtccttgaggagatatcttgagaatgggaaggagaccctccagagggccgacccccccaagacgcatgttacccaccatccaatatccgatcacgaggtgacactgagatgttgggccctgggattctaccccgcagagataaccctgacgtggcaacgagacggtgaggaccagacacaggacactgaactcgtggaaaccaggcctgccggcgatagaacttttcagaagtgggcagctgtggtggtgccttccggggaggagcagcgatacacgtgccacgtgcagcatgaagggttaccaaaaccattgacacttagatgggaaccgagttcccaatccaccgttcccatcgtgggcatcgttgcgggcctggctgtcctggctgtggtagtcatcggtgctgtggtcgccgctgtcatgtgtcgccgcaagtcgagcggggggaaaggaggttcctactctcaggctgcctgttcagattccgctcaggggagcgacgtgagcctcacagcttag

SEQ ID NO: 27321 - DNA, 726 bp, Artificial Sequence
  Description of Artificial Sequence: Synthetic coding sequence
atgtatggctgcgatgtcggtccagatggaagacttctgcgaggacacaatcaatatgcatatgacggaaaagactacatcgcgcttaacgaggacttgcgatcatggaccgccgccgacactgccgctcagattacccagaggaaatgggaggctgcccgggtagcggaacaagatcgcgcctacctggagggcacatgcgtagaatggctgcggcggtacctggagaacggaaaagatactttggagcgtgcagaccctcctaagacacatgtgacacaccacccaatatccgaccacgaagccacgttaagatgctgggccctgggcttttacccggctgagataacactgacctggcagcgtgatggcgaggaccagacacaagacaccgagctcgtagagacaagaccggcgggcgaccggactttccagaaatgggctgccgtggttgtccctagcggcgaggagcagcgctacacttgccacgtgcagcacgagggcctgcccaaacccctgactctgagatgggagccatcaagtcagagcacggttcccatcgtaggaattgtcgccgggctcgctgtgctcgccgtggtcgtaattggcgccgtagtcgctgcagtaatgtgcaggcgcaagtcctccggggggaagggaggttcttactctcaggcagcctgttccgacagcgcccaaggcagcgacgtgtccttaacagcatag

SEQ ID NO: 27322 - DNA, 1302 bp, Artificial Sequence
  Description of Artificial Sequence: Synthetic coding sequence
atgagagtgactgcaccgagaaccctgcttctgctgctgtggggagccgtggccttgacggaaacatgggccggctcccatagtatgagatatttttataccgcaatgtcaaggcctggacggggagagcccagattcattactgttggttacgtggacgacaccctgttcgttagattcgactcagacgcaacttcgccaaggaaagaaccccgagccccttggattgagcaggaaggcccggaatattgggatagggagacccagatctccaagacaaatacccagacttatcgggagaatctgaggactgcattaagatactacaatcctggacggcgaagccgtcttccgataccccacgtcaggccaggttccccacgggtctcaggctcggagatacgccctagaggaaggggaacccgcccggatccccggccagctagggcacccggtgcctttacccgattccatttccagttgcgccccaagagtcctcgcgtgggcagggggggtgctggcctggggacggggctgactgccggcccgggtcctgggagccacattatccagcgtatgtatggttgcgatgttgggcccgatggcaggctgctgaggggatacgatcaggacgcgtacgacggcaaagactatattgcccttaatgaagacctttccagttggaccgctgccgatacagcagctcagattacccagaggaaatgggaagccgccagagtggctgagcaggatcgcgcgtatctagaggggttatgtgtcgagagcttgcggaggtacctggagaatgggaaggaaaccctgcagcgtgcagacccaccgaagactcatgtgacccaccaccctataagtgatcacgaggtaacgctgcgatgctgggccctagggttttacccagcggaaataacactcacctggcagcgggatggggaggaccagacccaagatactgagttagtggaaactagacctgccggcgatcgcacgtttcaaaaatgggccgccgtggtcgtgccctccggtgaggaacagcgctacacatgccatgtgcagcatgagggcttacccaaacctcttaccctgcggtgggaaccatcatctcagtcaactgtgcctattgtggggattgttgccggactagcggtcctggccgtggtcgtgataggcgcagtggtggcagccgtaatgtgcaggagaaagtcaagtggcggcaaggggggctcttactcacaggctgcctgctcggactccgcgcagggttctgatgtctcattgaccgcttag

SEQ ID NO: 27323 - DNA, 1077 bp, Artificial Sequence
  Description of Artificial Sequence: Synthetic coding sequence
atggtcgatggcaccttgctcctgcttctcagcgaggctctggctctgacccagacttgggctggaagtcatagtctgaaatattttcacacttctgtcagtcggccaggacgtggagaacccaggttcattagcgttggatacgtcgatgacacacaatttgttcgatttgataacgatgccgcgtccccacggatggttccaagggctccttggatggagcaggagggttccgaatactgggacagagaaacccgaagcgctcgcgatactgcacagatattccgggtgaatctgcgcacactcagaggatattacaatcaaagcgaggctggttctcacacacttcaatggatgcatggctgcgaactgggccctgacgggaggtttctcagaggctacgagcaattcgcctacgatggaaaagactatctcactctgaatgaagacctgaggtcatggacagcggttgacacagctgctcagattagcgagcagaaaagcaacgatgctagtgaagcagagcatcagagggcgtatctggaagatacctgcgtggagtggctgcacaagtatctggagaaaggtaaggaaacactgctgcatcttgaacctccaaagactcacgtgacccaccacccgattagcgaccacgaggcaacacttagatgttgggcgcttgggttctatcctgctgagatcaccctcacatggcagcaggacggagaagggcatacacaagacaccgagcttgtagaaaccaggcccgccggtgacggtacattccagaaatgggctgcggtggtagttccctcaggagaagagcagagatatacgtgccatgttcagcacgagggactgcctgagcccgttacgctgcggtggaaaccagcatctcaacctacaatcccaatcgtgggcatcatagcaggactcgtcctgctcggatccgttgtgtcaggagccgttgtggcagccgttatctggagaaagaagagcagcggtggaaaaggtggatcatacagcaaagctgagtggagtgattctgcccagggtagcgaatcacatagtctgtag

SEQ ID NO: 27324 - DNA, 1077 bp, Artificial Sequence
  Description of Artificial Sequence: Synthetic coding sequence
atggtggacggcaccctgttactgctgctgtcggaagcactcgctttgactcagacctgggcaggctctcatagcctcaaatacttccataccagtgtgtccagaccaggtagaggagagcctagatttataagcgtcgggtatgtggatgacacacagttcgttcggttcgacaacgatgctgccagccctaggatggtgcccagagccccctggatggaacaggaaggttcagagtattgggacagagagacccgcagcgccagagacacagcgcagattttccgggtcaacctgaggactctgaggggttattacaatcagagtgaagccggaagccacacccttcaatggatgcacgggtgtgagctgggccccgaccggcggtttctgcgcgggtacgagcaatttgcgtacgatgggaaagattacctgacactcaatgaagatctgaggtcctggaccgccgtcgacacggcagcccaaatatctgagcagaaatccaacgacgcttccgaggcagagcatcagcgggcatacttagaggacacatgcgtggaatggttgcataaataccttgaaaaagggaaggaaacattgctgcacctggagccacctaaaacacacgtcacccaccaccctatctcggatcacgaggccacgctacggtgttgggccctcggattctatccagctgagattacacttacttggcagcaggatggcgaagggcacacacaggacacggagctggtggagaccaggcctgcaggagatgggacattccagaaatgggctgccgtcgtcgtcccctccggggaggagcagagatacacctgtcatgtccagcacgaaggccttccagaaccggttacgcttagatggaaacccgcttcccagcctaccattcccatcgtggggataatcgctggacttgtgctgttggggtcggtggtgtccggcgccgttgtcgccgccgtgatttggcggaagaagtcttccggcggtaagggaggcagttactctaaagcagagtggtccgacagcgcccaggggagcgagtctcatagtctgtag

SEQ ID NO: 27325 - DNA, 1077 bp, Artificial Sequence
  Description of Artificial Sequence: Synthetic coding sequence
atggtggacgggacattgctcctgttgctctccgaggccctggcccttacccagacatgggctggctcgcacagcctcaaatatttccacacatctgtgtcccgacctggccgaggagagcccaggtttatctccgtggggtatgtggatgacacacagtttgttcgattcgacaacgacgccgctagccctcgcatggtgcccagggccccttggatggagcaggaggggagcgaatactgggatagggagacacgcagcgcccgggacacagcccagattttcagagtgaatcttcgaaccctgcggggctattacaatcaatcagaagctggttctcatactttgcagtggatgcacggatgtgagctggggccagatcggcgattcttacggggctatgaacagttcgcatatgatggtaaagactacctgacactcaacgaggatctgagaagctggacggcagttgacaccgctgcacagatttcagaacagaagagcaacgatgcttctgaggccgagcatcagcgggcctatttggaagatacttgtgttgagtggttgcacaagtatctggagaaggggaaggaaaccctgctccacctggagccaccaaagacacacgtgacccaccaccccatctctgatcacgaggccactttaagatgttgggccttgggattttaccctgccgagataacgttgacttggcagcaggatggagagggtcacactcaggataccgaattggtggagactcgcccggccggcgatggcactttccaaaagtgggctgccgttgtggtgcccagtggtgaggaacaacgttatacctgccatgtgcaacacgaggggcttccagagcctgtgactttacgatggaaacccgcatcacagccgacaatccctattgttgggatcatcgcgggacttgtgcttcttggctccgtggtctctggggccgtggtcgctgcagtgatttggcgtaagaagtcatccggaggcaaaggaggttcctatagtaaagcagagtggtccgattccgcacaggggtctgagagtcattccctttag

SEQ ID NO: 27326 - DNA, 1077 bp, Artificial Sequence
  Description of Artificial Sequence: Synthetic coding sequence
atggtggacggcactctgttactcctgctttccgaggcattagctctcactcagacttgggctggctctcacagcctgaagtactttcacacttctgtgagtcgtcccgggcgcggtgagcccaggtttatttcggttggctatgtggatgatacgcaattcgtgcggttcgacaatgacgcagcatctccccggatggtgccaagggcaccatggatggagcaggagggtagcgaatactgggatcgggaaacccgctctgcgagagacaccgctcagattttcagagtcaacctgcggactctgcgtggttattacaatcagtcagaggccggctctcatactctccagtggatgcacggatgcgaattgggcccggatcgccggttcctgcggggatacgaacaattcgcttacgatggcaaggattatctgacccttaatgaggaccttcggtcatggactgccgtagatactgcagctcaaatctctgagcagaaaagcaatgatgcctcagaagctgaacaccagagagcctatctcgaggatacatgtgtggagtggctccacaagtacctcgaaaaagggaaagagaccctgctgcatctcgaaccccccaagacccatgttactcaccaccccatttcagaccatgaggccactctgagatgttgggcgttgggattttatccagctgaaatcactctaacttggcaacaggacggagagggccatacccaagacacagagctagtggagaccaggcctgccggggacggcacttttcagaaatgggcagctgtggtcgtgcctagtggagaggagcagaggtacacctgccacgtgcaacacgaaggccttcccgaacctgtgactttgagatggaaacctgcgagtcaaccaaccattcctatcgtcgggattattgccggtctggtcctcttggggagtgtggtgtccggtgctgtggtggccgctgtaatttggaggaaaaaatcctctggaggcaaggggggcagctactcaaaagctgagtggtctgattctgcccaagggtcagagtcccatagcctgtag

SEQ ID NO: 27327 - DNA, 1077 bp, Artificial Sequence
  Description of Artificial Sequence: Synthetic coding sequence
atggtagacggcactctcctcctcctgcttagcgaggcattagcccttactcaaacctgggccggaagtcactccttgaagtatttccacacctcggtgtcacgtcctggcagaggcgagcccagattcataagtgtgggttacgtggacgacacccagtttgtgaggttcgacaatgacgctgcatcacctaggatggtgcctcgagctccatggatggagcaagaaggaagcgaatactgggatagggagacaagaagcgcacgggacactgcacagattttccgagttaacttgcggactctgaggggctattataatcaatccgaagctggatcgcacaccttgcagtggatgcacggatgtgagctagggcctgatggtcgatttttgcgtggatatgagcagtttgcctatgacggaaaggattacctaacactgaacgaggatctgcggagctggaccgccgtcgacaccgccgcccagatttcagaacagaagagtaatgatgcctccgaggcggaacatcagcgggcctatttagaggatacgtgtgtagagtggcttcacaaatatctggagaaaggcaaggagaccttactgcacctggaacctcccaagacacatgtgacccaccacccaataagcgatcatgaggccaccctcagatgttgggccctgggtttctatcccgccgaaattacactgacgtggcagcaggacggtgagggccacacccaggatactgaattggttgagacacggcccgccggagacggtaccttccaaaaatgggcagccgtagttgtgccttcaggtgaagagcagcgatacacctgtcacgtgcagcacgaaggattgccagaacccgtgacgctgcggtggaaacctgcctcacagcctaccattccaattgtcggaattatcgccggtctcgtcctgttaggatctgtggtatccggggccgtcgtagcagcggtgatttggcggaagaagtccagtggtggcaagggcggctcctattctaaggctgagtggagcgattctgcgcagggctctgaaagtcattccctctag

SEQ ID NO: 27328 - DNA, 1077 bp, Artificial Sequence
  Description of Artificial Sequence: Synthetic coding sequence
atggttgatggtaccctgttattgttgctatccgaagcacttgcgctgacacaaacgtgggcgggtagccattccctgaagtactttcacaccagcgtaagcagacccggccgtggggagcccagattcataagcgttggttatgttgacgatacacagttcgtccgcttcgataatgatgctgcgtcgcctcggatggttccacgagccccctggatggaacaggagggttctgagtactgggatcgcgagaccagatccgcccgggatacagcgcagatctttagagtaaatctgagaaccctgcgcggatactacaaccagtccgaggccggttcccacacgttacagtggatgcatgggtgtgagctggggcctgaccggaggtttttgagaggctatgaacaattcgcatatgatggcaaggactacctcacactgaacgaagacttaaggtcgtggacagcagttgacaccgctgctcagatctcggagcagaagagcaacgatgcctcagaagccgagcaccagcgcgcttaccttgaagatacatgcgtggagtggctacacaagtacctcgagaaagggaaagagacgctgctgcatctagaaccccccaaaacacacgtgacacaccatcctatctccgaccacgaggctaccctccgctgttgggcactgggcttttaccccgcggaaatcacactcacttggcagcaggacggggaagggcatacacaggatactgagctcgtcgaaactaggcccgctggggatggcaccttccaaaaatgggccgccgtggtggtgccttccggggaagaacaaaggtatacctgtcatgtccagcacgagggcctgccagagcctgtgacattgcgttggaagcctgcctcacagccaaccattcccatcgtcggaataatcgccggcctcgttcttctggggtccgtggtctctggcgccgtagtggccgccgttatctggcgcaagaaatcctcaggtgggaagggtgggtcatattccaaggctgagtggagtgatagtgcacagggaagtgaaagccactctctttag

SEQ ID NO: 27329 - DNA, 1077 bp, Artificial Sequence
  Description of Artificial Sequence: Synthetic coding sequence
atggtcgatggcacgttacttctgctattatccgaggctttggccctgacccagacctgggccggctcccactcgttaaagtacttccacactagcgtgtcccggccgggaaggggcgagcccagatttatctccgtcgggtacgttgacgatacccagttcgtaaggtttgataacgatgcagccagtccccggatggtgccacgggccccatggatggagcaagagggatctgaatactgggatcgtgaaacccggagcgctagagacacagcccagatctttagagtaaacctgcgcacccttcgaggttattacaatcaaagcgaagcgggctctcacactctccagtggatgcatggctgcgagttaggacccgatggaaggttcctcaggggctacgagcaatttgcttacgatggaaaggactatttaactctcaacgaggacctccgctcatggactgccgtcgatactgcggctcagatttcagaacagaagtctaacgatgcctcggaggctgagcaccagagagcttatctggaggacacatgcgtggagtggctgcacaaatatttggagaaaggtaaggaaacactcctgcaccttgagccaccaaagacacatgtgactcatcaccctatctccgatcatgaggcgactcttcgctgttgggccttggggttctacccagccgagattactctgacatggcagcaggacggcgaaggacatacccaagacaccgagttggtggagacacgtcctgccggagacggcactttccagaagtgggccgcagtagtggtcccatcgggcgaagagcaaagatatacctgccacgttcaacacgaggggttgcctgagcccgtcactcttcggtggaaacctgccagccagcctaccatcccaattgtgggcatcatcgctgggctggtgttactggggagtgtcgtgtctggcgctgtggtggctgcagtgatctggaggaaaaagagttctgggggcaaaggtgggagttattcaaaggcagaatggagcgattctgctcagggcagtgagtcacacagcctctag

SEQ ID NO: 27330 - DNA, 1200 bp, Artificial Sequence
  Description of Artificial Sequence: Synthetic coding sequence
atggagcccagtttttacagctctcgcagaccctggccgttgcctcgacccggcagagtgagcgctggttccggttggaaacgcccactccctggcgtagaacggggccgcccaggcggtggggaaggtctgggcgagccacgcagagaggaaggtcgagcagacctgtctcccagctctcccccgggcagccatagccttaaatatttccacactagtgtttctcggcctggaagaggagaaccccgatttatatccgttggctacgtggacgacacccagttcgtgaggttcgataatgacgccgcaagcccaaggatggtgccaagagcaccttggatggaacaggaaggatccgagtactgggacagagagacccgttccgcccgggacactgcccagatctttagggtgaatcttcgaactcttaggggctattacaaccaaagtgaagctggatctcacacactgcaatggatgcacggctgcgagctcggtccagaccggcggtttcttcgcggctatgagcagtttgcctatgatggcaaagactatttgactttgaatgaggacctgcgcagctggactgccgtggacactgctgcccagatctcagagcagaagagcaatgatgcatctgaggcagagcatcagagggcgtacctagaagatacctgtgtggaatggctccataaatacctggaaaaaggaaaggagacgctcttacatctagagccacccaagacacatgttacacaccacccaatttccgatcacgaagcaacactgagatgttgggctctcgggttctatcccgcagagatcactctgacttggcaacaagatggggaaggccatacccaggacactgaactggtggagacccgtcccgctggtgatggcactttccagaagtgggcagccgtggtcgtgccatctggcgaagagcagcgatacacatgccatgtacagcacgagggcttacccgaacccgtgaccctgcgatggaagccagcgtctcagcccactattccgattgtggggattatagccggtctggtacttctagggagcgtggtcagcggtgcagtggttgcagcggtcatttggcggaagaagtcctccgggggcaagggaggctcttattctaaggctgagtggtcggacagcgcccaaggctccgaatcgcactctctttag

SEQ ID NO: 27331 - DNA, 1329 bp, Artificial Sequence
  Description of Artificial Sequence: Synthetic coding sequence
atggctccccgcagcttactgctcctgctgtcaggagcgctggctttgactgatacttgggcggggtcccacagccttaggtatttcagcactgcagtgtccaggccaggtagaggtgagccaagatatatagccgtcgagtacgtcgacgatactcagttcctgagattcgacagcgacgccgccattccgagaatggagccaagagaaccttgggtcgagcaagagggcccgcagtactgggagtggaccaccggatacgcgaaggcaaatgcccaaactgaccgagtggctctcaggaacctccttagacgctacaatcagagcgaggccgggtctcataccttgcaggggatgaatgggtgcgacatgggacctgacggtaggctattacgcgggtatcaccagcacgcctacgacggcaaggactatatcagcctcaacgaggacctccggagctggactgcagcggatactgtagctcagatcactcaacgtttttacgaagctgaagaatatgctgaagagtttcggacatacctcgagggtgaatgtctagagctcctccgccggtacctggaaaacgggaaggaaaccttacagagggccgatcctcccaaggcccatgtggcccaccaccccataagcgaccacgaagcgacccttagatgttgggctctggggttttacccagcggaaatcaccctaacatggcagcgtgatggcgaagagcaaactcaggacaccgagctggtcgaaacacgacccgccggggacggtacgtttcagaagtgggcggccgtagtggtcccccccggcgaagaacagcgatacacttgccacgttcagcatgaaggcctaccccagcccctcatactgcgatgggaacagtcgccccagccaactattccgattgtcggcattgtagcagggctggtggtgctgggggctgtagttaccggggccgtggtggcagctgttatgtggcgaaaaaaaagtagtgacaggaaccgtgggagctactcccaggccgccgcttattctgtggtctctggaaatctaatgatcacatggtggtcgagcctcttcctgttgggtgtactcttccaggggtacctgggttgtttgcgctcacattcagtactgggccggcgtaaggttggcgatatgtggattctgttcttcctgtggctttggacgtccttcaatacggccttcttagccctgcagagcctgcgattcggatttggcttcaggcgcggtcggtctttcctgctcagaagctggcatcacctgatgaagagagtgcaaatcaaaatcttcgactag

SEQ ID NO: 27332 - DNA, 1041 bp, Artificial Sequence
  Description of Artificial Sequence: Synthetic coding sequence
atggccccgcggtcactgctcctactgctcagcggtgcactggcgcttactgacacgtgggccggaagtcacagtttgcggtacttctccaccgcagtcagtcgccctggccgaggtgagccaagatacatcgcagtggagtacgtcgatgatactcaatttctgaggtttgacagcgatgccgccataccccgaatggaaccacgagaaccgtgggtagaacaggagggaccccaatattgggaatggacaaccggctatgccaaggcgaacgcacagactgatcgcgtagctctacgaaacttactccggcggtacaatcagtcggaggcaggtagccatacgctgcagggcatgaacggatgcgacatggggccagacgggagattactgcgcggctatcaccaacatgcttacgacggtaaggattatatatctcttaatgaagacctgcgatcctggacagctgcagatactgtagcacagattacccagaggttctatgaggcagaggagtatgcagaagagttccggacgtatcttgaaggtgagtgccttgagctgttacgcaggtacctcgaaaacggcaaagaaaccctccaacgagcagacccgcctaaggcccacgtggcacatcaccctatctccgatcatgaggccacgctgaggtgttgggccctcggcttttatcctgcagaaataaccctaacctggcagcgtgatggcgaggaacagactcaagatactgagttagtcgaaactcgtcctgccggggacggaaccttccagaagtgggcagctgttgtggtgcctcccggcgaagagcagagatatacatgtcacgtgcagcacgaaggactgccccaaccgctgatcctccgttgggaacagtccccacagcctaccatccccatagtaggaatcgttgccggacttgtcgtactaggtgctgtggtgacaggagcagtggtggctgctgttatgtggcgcaagaagtctagcgatagaaacaggggttcctacagccaggccgcagtttag

SEQ ID NO: 27333 - DNA, 1041 bp, Artificial Sequence
  Description of Artificial Sequence: Synthetic coding sequence
atggcaccaagaagtttactgcttctactgtctggtgctctggccctgacagatacctgggccggttcacacagcctccgatatttcagtactgctgtgagtcgacccgggcgaggcgaaccacggtatatcgcagtcgaatacgtcgacgacacgcaatttctgcgcttcgattcagatgcagccatcccacgcatggaaccccgagagccatgggtggagcaggaaggcccacagtactgggagtggacaactgggtacgctaaagccaacgcacaaacagacagggtggcactaagaaacctgctgcggcgatataaccaaagtgaggctggatcccacactctccaggggatgaatggctgcgatatgggacctgacggcaggctcctaaggggataccaccagcacgcttatgacggcaaagactacatctctctcaacgaagatctgaggtcttggactgccgccgatacagttgctcagattacccaaagattttatgaagcggaggagtacgccgaagagttccggacctacctggagggcgaatgcttagaattgttgagaagatacttggagaatgggaaagagaccctacagagggccgaccctcccaaagcacacgtggcccaccatcccatttccgaccatgaggctaccttgcgatgctgggcccttggcttttaccccgccgagatcactttgacctggcagcgcgacggggaggagcagactcaggacacagagctggtggagactcgcccagccggcgacggtacttttcagaagtgggccgccgtggtcgttccttccggagaagagcagagatacacctgccatgtgcagcatgagggacttcctcagcctctgatcctccggtgggaacaaagccctcagccaaccatacccatcgtcgggatcgtcgccggactggtcgtcctgggtgccgtcgtgactggggcggtggtggcagccgttatgtggcggaagaagagttctgaccgtaatcgaggctcctactctcaggccgcggtgtag

SEQ ID NO: 27334 - DNA, 765 bp, Artificial Sequence
  Description of Artificial Sequence: Synthetic coding sequence
atggccccacgaagtctgttattgttgctatccggggccctcgctctgacagacacatgggccggaagccactctctgaggtacttttcgacggctgtgtctcgaccgggcaggggtgagccacgctatattgctgtcgagtacgtagatgatacccagtttttaaggttcgacagcgatgccgcgattccccggatggagccaagagagccttgggtggagcaggagggcccccagtactgggagtggaccaccggttatgctaaagccaacgcccagaccgaccgagtggccctgaggaacttgcttagaagatacaaccaatctgaggctggcagtcatactctgcaggggatgaacggctgtgatatgggcccagatggaagactgttacgcggctatcatcagcacgcttatgacggcaaagattatataagcctcaatgaagacctcaggtcgtggacagcagctgacacggtggcgcaaatcacccagaggttttacgaggcggaggagtacgccgaggagttccggacgtacttggagggggagtgcctggaactgctcaggcgttatttggaaaatggtaaagaaactcttcagcgggctgagcagtcaccgcagcccactatcccgatagtgggaatcgtagctggactcgtcgtgctcggtgctgtggtgaccggcgccgtggtggctgctgtgatgtggcgcaagaagtcaagcgaccgcaatcgcggttcttactcccaagcagcggtctag

SEQ ID NO: 27335 - DNA, 1005 bp, Artificial Sequence
  Description of Artificial Sequence: Synthetic coding sequence
atggctccacggagtctgctcctcttgctgtctggagcgctggctctcaccgatacctgggcaggatcccactctctgaggtacttctctaccgcagtgagcaggccaggaagaggagaacctcgctatatagctgtcgagtatgtggatgatacccagtttttgcggttcgattccgatgcagccatcccaaggatggagcctagagaaccttgggtcgaacaggagggacctcagtattgggagtggacaacaggttatgccaaagcaaatgcccagacggatcgtgtggccctccgaaacctgcttcgacggtacaatcagtcagaggcaggcagtcacaccctgcagggcatgaatggctgtgacatgggtcccgacggccgactcctccggggctatcaccaacatgcttacgacggaaaggattacatctcgttgaacgaggatctgcggtcctggactgccgccgatactgttgcgcagatcacccaaaggttctatgaagccgaagaatatgctgaggaattcaggacttaccttgaaggtgaatgcctggagctgctccgtcggtatctggaaaatgggaaggagacactgcagagggccgacccccccaaggcccacgtggcgcaccaccctatcagtgaccacgaggccacactgaggtgctgggccctcggcttttaccctgctgagattaccctcacttggcagcgagacggcgaagagcaaacgcaggacactgagcttgttgagacccgtcctgcgggagacggcacctttcagaagtgggcagccgtggtcgttccaagtggtgaggagcagaggtacacctgccacgtgcagcatgaaggactaccccagcccttaattctgagatgggagcaatccccccagccgacaatcccaatcgtcggaatcgtggcagggctcgttgttctgggagcagttgtgactggagccgttgtggccgcggtgatgtggaggaaaaagagtagctag

SEQ ID NO: 27336 - DNA, 765 bp, Artificial Sequence
  Description of Artificial Sequence: Synthetic coding sequence
atggcccctaggagtctcttactgctgctgtccggtgccctcgcactcaccgatacttgggcaggatctcacagtctccggtacttttctaccgcagtgtctcgaccaggccgcggggagccacgctacatagccgtagagtacgtagacgatacccagttcttgcgttttgactccgatgctgccatacctcggatggaaccaagagaaccctgggtagaacaggaaggtcctcagtactgggaatggaccactgggtatgcaaaggccaacgcccagacagaccgcgtcgcgctgagaaatctgttgcgcaggtacaatcagagcgaagccggcagtcatactctgcagggcatgaacggctgtgatatgggccctgacggcaggttactgcgggggtatcatcagcatgcatacgacgggaaagactatatatctcttaatgaagacttgcgctcctggacggcggctgataccgtggcccagataacccagaggttctacgaagccgaagagtacgctgaagaattccggacctacctggaaggggaatgtctggagctgctcaggcgctacctggagaatggtaaggagacactccagagggccgagcaaagccctcagcctacaataccaatagtcggcattgttgctggtctggtggtgctgggtgccgtggtcacgggcgcagtcgtggcagcggtcatgtggcggaagaaatcttcggacagaaatcggggctcgtactcacaggctgccgtttag

SEQ ID NO: 27337 - DNA, 1041 bp, Artificial Sequence
  Description of Artificial Sequence: Synthetic coding sequence
atggcacctagaagcctgttgttgctgttgtctggagctctcgctctgaccgacacctgggctggatctcattctcttcggtatttctctaccgctgtctcccggcctggacgcggggagccccgttatatcgccgtagaatatgtggatgatacgcaatttctgcgcttcgactccgacgcagccattcccaggatggagcccagggaaccctgggtggagcaggagggcccgcaatattgggagtggacgacaggttacgccaaggctaatgcgcagacggatcgggtcgctctgagaaacctgctgagaagatacaaccagagcgaagcaggctctcatactttacaaggcatgaatgggtgcgatatggggcccgacggcaggctcctgagaggctaccaccaacatgcttatgacggtaaggactacatctctctgaacgaggaccttcggtcttggacagcagcagataccgtggcccaaatcacccaacgcttctacgaggccgaagagtatgccgaagaatttaggacctatctcgagggcgagtgtctcgaactactgcgccggtatcttgagaacggcaaggaaacgctgcagcgcgcagaccccccaaaggcccatgtcgctcatcatcccattagtgaccatgaggcaactctacgttgctgggcactgggcttctaccccgccgagatcaccctgacctggcaacgagatggcgaggaacagacccaagataccgaactggtagagacaaggcctgctggtgacgggactttccagaaatgggccgctgtagttgtccctccaggagaggaacagcggtacacttgtcatgtccagcacgaaggcctcccccaaccactgattctaaggtgggagcagagcccacagcccacaatcccaatcgtggggatcgtcgccggtttagtggttctgggcgctgtggtcacaggggcggttgtcgctgctgtgatgtggaggaagaaatcctcggatagaaatagaggtagctatagccaggcagctgtctag

SEQ ID NO: 27338 - DNA, 765 bp, Artificial Sequence
  Description of Artificial Sequence: Synthetic coding sequence
atggcacctcgcagcctgctgttgttgttgagcggggctctggccctgactgatacatgggccgggagccatagcctgagatatttcagcacagctgtgagtaggccaggccgaggagagccacggtacatcgccgtggagtatgtcgatgacacacaattcctgcggttcgactcagatgcagcaattccaagaatggagccccgggaaccgtgggtggagcaggaaggcccacaatattgggagtggaccaccggctacgcaaaggccaacgctcaaactgacagagttgctttaagaaacttgctcaggcgctacaatcagtccgaagccggatcccataccttacaggggatgaatggctgtgacatgggtccagatgggcgcctcttacgcgggtaccatcaacatgcgtacgacggcaaggattatatctctctgaacgaagatctccgctcctggactgcagctgatacagtggctcagataacccagcggttttatgaagctgaggagtatgccgaggagttcaggacttacctagagggcgagtgtcttgaactgctccgccggtatctcgagaacggcaaagagaccctacagagagccgagcaatctccacagcccacaattccaattgtgggcatcgttgccggcctggttgtcttaggagctgtcgttactggggccgtggtagctgctgttatgtggcgcaaaaaatcaagtgataggaatagaggctcatattcacaggcagcggtgtag

SEQ ID NO: 27339 - DNA, 1329 bp, Artificial Sequence
  Description of Artificial Sequence: Synthetic coding sequence
atggccccacggagcctccttctccttctgtcaggcgccctggcactgactgacacttgggccgggtctcactcattgaggtacttttcgacagctgtgagccgtcccgggcgaggggaacctagatacatcgcggtcgaatacgtggatgatacacagttccttagatttgactccgacgccgccataccccgtatggagccccgcgaaccgtgggtggaacaggaggggccacagtactgggagtggacaacaggctatgccaaagctaacgcgcagacggatcgcgtcgcactgcggaatttattgcggcggtataaccagagcgaagcagggtcgcatacactgcaggggatgaatggttgcgacatgggacccgacgggaggctcctgcgggggtaccatcagcatgcatacgatggcaaagattacatatcattgaatgaggatcttagatcctggaccgccgcggatactgtggcccagataacccaacggttttatgaagccgaggagtatgctgaggaattcaggacttatctggagggtgagtgtctggaacttcttagacgctacctagaaaatggcaaggaaactttacagcgagccgacccgccaaaggcccacgtagcccatcacccaatttccgatcatgaagctacattgcgctgctgggcgctgggcttttaccctgccgagataacactcacgtggcagcgtgacggcgaagagcagacacaggacactgagctggtcgaaacacgaccagcgggcgacggcaccttccagaaatgggcagcagtggttgttccaagcggtgaggagcaaaggtatacgtgccatgtgcagcacgaaggacttccacaacctctcatccttcgctgggagcagagtcctcagcctaccatcccaatcgtgggcatagtggccggcttagtggttctgggcgctgtggtcaccggcgcagtagtagcagcggtcatgtggcgcaaaaagtcctctgaccgcaaccgtgggtcttattcacaggccgcagcttattccgtggtatcgggtaatctgatgatcacatggtggtctagtctcttcctgcttggagttctgtttcaaggatatctgggatgccttagaagtcactcagttttgggccgccggaaagtgggagacatgtggatccttttttttctctggttgtggactagcttcaatacagcttttctggccctgcagtcactgcggttcggttttggattccgtagaggtcgatcctttcttctacgctcctggcaccatctgatgaagcgcgttcagatcaaaatcttcgactag

SEQ ID NO: 27340 - DNA, 1041 bp, Artificial Sequence
  Description of Artificial Sequence: Synthetic coding sequence
atggcgccccgcagccttctcttactgctgagtggagctctagcgctaactgatacatgggccggatctcacagcctgagatatttttcgaccgctgtgagcaggcccggccggggcgagccccgctacatagctgtcgagtatgtggatgacacacagtttctcaggttcgacagtgatgccgctataccaaggatggaaccacgagagccctgggtggaacaggaaggccctcaatactgggagtggaccactggttacgccaaagcgaatgcccagactgatcgtgtggctttgcggaacctgctcaggagatacaaccaatccgaagccgggtcacacacactgcagggcatgaatggctgtgatatgggacccgacggcaggctcctgcgcgggtatcatcagcacgcttacgatgggaaagactacattagtctcaacgaggatcttcgatcatggactgcagccgatactgttgcccagatcactcagcggttctatgaagccgaggagtatgccgaagaattcaggacatatcttgaaggagaatgtctcgagctgctgcgtagatacctggaaaacgggaaggagaccctgcagcgtgccgatccccctaaagcccatgtagcgcaccaccctatatctgatcatgaagctactcttagatgttgggctttgggcttctacccagctgaaatcaccctcacttggcagcgagatggtgaggagcaaacccaggatactgaactggttgagacacgaccagcaggagacgggaccttccagaaatgggccgcggttgtggttcccagcggtgaggaacagaggtacacttgtcacgtccagcatgagggccttcctcagccgttaattctcagatgggagcagtcccctcagccgacaattcccatcgtcggcattgtagccggacttgtggtcctgggggctgtcgtaaccggcgcggttgtggcagccgtgatgtggaggaaaaaatccagcgaccgaaatcggggctcctattctcaggccgccgtatag

SEQ ID NO: 27341 - DNA, 1329 bp, Artificial Sequence
  Description of Artificial Sequence: Synthetic coding sequence
atggctcctcggagcttgcttctcttgctaagtggggccctggccctcaccgacacttgggcgggatcacacagccttcgctacttctcaactgctgtaagtcgaccaggtaggggagaaccacggtacatcgctgttgagtacgtggacgatacacagttcctgaggttcgactcagacgccgctatcccccggatggagccgagagagccatgggtcgaacaggaggggccccagtactgggagtggacgactggctacgccaaggctaatgctcaaaccgatcgggtcgcactgagaaatctcctgcgccgatataatcagagcgaagccggttctcataccctgcaggggatgaacggttgtgacatggggcctgacggacgcctgcttcggggctaccaccagcacgcctatgatggcaaagactacatctcactgaacgaagaccttaggagctggacggctgccgataccgtggctcagatcactcaacgattttatgaagccgaagaatacgccgaggagttcagaacgtacctggagggtgagtgcctcgagctgttacggcgctacttggagaacggaaaggagaccttacagagagcagacccccccaaggcccacgttgcccatcatcccatctcagatcatgaagctaccctccggtgttgggccctggggttttatcctgctgagataactctcacctggcagagagacggggaagagcaaacacaagacactgagttagttgagacccgccctgctggggacggcacgttccagaagtgggctgccgtggtcgtgccctccggggaggagcagcggtacacctgccatgtacaacatgagggcctcccgcaacctctgatcctgcgttgggaacagtctcctcagcccaccattcccatcgttggcatagtggcagggttggtggtcctgggcgcagtggttactggcgccgtggtggccgccgtaatgtggcgtaaaaaaagtagtgacaggaacagaggttcatactcgcaagccgcggcctattccgtcgtgtcggggaatcttatgatcacttggtggagtagcctgttcttgttaggcgtactctttcagggctacctcggatgtcttcgtagccactccgtactggggcgcagaaaggtgggtgacatgtggatcctcttctttctctggctctggacatcgttcaataccgcttttcttgcgctccagagcctacggttcggtttcggtttcagaagaggacgatcatttttactgcggtcgtggcatcacctgatgaaaagagtccagatcaagattttcgattag

SEQ ID NO: 27342 - DNA, 1050 bp, Artificial Sequence
  Description of Artificial Sequence: Synthetic coding sequence
atggcaccacgctccctgttgttgttgctgtctggtgctctggccctcacagacacttgggctggttctcattctctgcgatatttctccaccgcggtaagccgacctgggcggggcgagccgcgatacatcgccgtggaatatgtcgatgatacccagttcctgcgattcgactctgacgccgcaatcccacgaatggagcctcgtgagccatgggtcgagcaagagggcccccagtactgggaatggactaccggatacgcaaaagctaatgcccaaactgatcgcgtggctctgagaaacctgcttagaaggtaccttgaaaacggaaaagagacccttcagagggccgaccccccgaaagcccacgtcgcccaccaccccatctccgatcatgaagccactctgcgatgttgggcacttgggttctatccggcagagatcacattgacatggcagagagatggggaagagcagactcaggacactgagttggttgaaaccaggcctgcaggtgacgggacttttcaaaagtgggcagcggtagtggtgccccccggggaggagcagaggtacacgtgtcatgtccagcacgagggcctgcctcagcccctcatcctgagatgggagcagtcgcctcagcctaccattcctatagtgggaatcgtcgcagggcttgtggtcctaggagctgtcgtcacaggcgctgtggtcgcagccgtaatgtggagaaaaaagagctctgaccgcaaccgcggtagctattcacaggcagccgcctattcagtcgtgtctggtaacttgatgattacttggtggtcaagcctttttctgcttggggtcttgttccaggggtatctcggctgtttaaggtctcattctgtacttggtcggcggaaggctcaactgctgtcagtctccacaagccagaccagcatcttaatacaggaacagttttcccatcagcggactttggcaatgagtgggaaaatgttttgctgtcatgactggagtgaagaagaggtgctaccggcctcatgcggagaatag

SEQ ID NO: 27343 - DNA, 396 bp, Artificial Sequence
  Description of Artificial Sequence: Synthetic coding sequence
atggcaccccgcagcctcttgctcttgctgtccggggcgctggccctgactgacacatgggctggcagtcactcgctccgatacttttcaacagctgtgtctagacccggccggggggagccacgatacattgccgttgaatacgtcgacgacactcagtttctccgcttcgacagcgatgcagctatccctcggatggagccccgagaaccttgggtggaacaggagggacctcagtattgggaatggaccacagggtacgctaaggccaatgcgcagaccgaccgggtggcactgaggaatttgctgcgcaggtataatcagagtgaggccggctcccatactctgcagggaatgaatggttgcgacatgggacctgatggcaggctcttgtag

SEQ ID NO: 27344 - DNA, 396 bp, Artificial Sequence
  Description of Artificial Sequence: Synthetic coding sequence
atggctccacggtctctgctgctgctcctgtctggcgccctcgctctgaccgacacttgggccggatcccactccctccggtacttctcaactgcagtgagccggccaggacggggtgagccacggtatatagccgttgaatacgtagacgacactcagttcttgcgctttgattccgatgcggccatcccaagaatggagccccgggagccatgggtggagcaggaggggccccagtactgggaatggaccactgggtatgcaaaagccaatgcccaaaccgatagagtggccctgcggaacctcctgagaagatacaaccagagcgaggccggatcccacacactacaaggcatgaacggttgtgacatgggacctgatggaagacttctgtag

SEQ ID NO: 27345 - DNA, 396 bp, Artificial Sequence
  Description of Artificial Sequence: Synthetic coding sequence
atggcccccagaagcttgctgttgctgttaagcggggccttagctttgaccgatacctgggccggatcccactcgttacgctacttctccaccgccgtgagtaggcccggtcgtggcgaaccacgctatattgccgtggagtatgtggacgatacccagttcctgaggtttgattctgacgcagccatacccagaatggaacctagagaaccgtgggttgagcaggaaggcccccagtattgggaatggacgactggctacgctaaagcaaatgcccaaactgacagagtcgctctgaggaacttactgcggcggtacaatcagtccgaggccggcagccataccctccaggggatgaacggctgcgacatgggtccagacggaaggcttctgtag

SEQ ID NO: 27346 - DNA, 642 bp, Artificial Sequence
  Description of Artificial Sequence: Synthetic coding sequence
tagccggatccccccccgggaagggttccgggggccttcacagagcatgcctatgacggtaaggactacatcagtctgaacgaggatttgcgcagctggactgccgctgacacggtcgcccagatcacccagcgattctatgaagcagaagaatatgctgaggaattcaggacctacctcgagggggaatgcctcgagctcttacgcaggtacctggagaacggaaaagaaacacttcagagggccgatcccccaaaagcacacgtggcccatcatcccatctctgatcacgaggctactttgagatgttgggcgctggggttctacccagcagagatcactttaacctggcagcgtgatggtgaagagcagacccaagacaccgagttggtggaaacacgccctgcaggcgatggcactttccagaaatgggccgctgtcgtggtaccctctggtgaagagcagcgctatacctgtcatgtgcagcacgaggggctgccacagcctttaatcctgcggtgggaacagtcaccgcaacctaccataccaatcgtgggcatcgtagcaggcctagtagtactcggagccgtggttaccggggccgtcgttgcggcggtcatgtggcggaaaaaatcgagctag

SEQ ID NO: 27347 - DNA, 765 bp, Artificial Sequence
  Description of Artificial Sequence: Synthetic coding sequence
atggccccccggtcgctgctcttactgctgagcggagccctagcactcaccgacacctgggcgggcagccactccctgagatatttctccacggccgtcagtagacccggacgcggggagcctcggtatatagctgttgagtacgtggacgacacacaattcttgaggtttgattctgatgctgcgatcccgcgtatggaacctagggaaccatgggtagagcaggagggaccgcagtattgggagtggacaaccgggtacgcgaaagccaacgcgcaaaccgatcgcgtcgccctgagaaatctgttacggaggtataatcaaagtgaagcagggtcccatacactccagggcatgaacggctgtgacatgggaccggatggcaggctgctcaggggttatcaccagcacgcttacgatgggaaggactacattagtttgaacgaggacctaagaagttggacagccgcagatactgttgcccagatcacgcaacggttctatgaggcagaggagtacgcggaggagttcaggacatacctggaaggcgagtgccttgagcttttgagacgttacttggagaacggcaaagagacactgcagcgtgccgaacagtccccgcaaccgacaattcctattgtaggcattgtggcaggtctagtggtgttaggagctgtagtcacaggtgcggttgtcgctgccgtgatgtggcgcaagaagagcagcgataggaaccgaggatcatattcccaggccgcagtctag

SEQ ID NO: 27348 - DNA, 396 bp, Artificial Sequence
  Description of Artificial Sequence: Synthetic coding sequence
atggctccaagatcattgctgctcctgctgagtggggcccttgcgcttaccgacacttgggcaggctcgcattcgctgagatattttagcacggcagtgtcacggcccggaagaggagagcccaggtacatagcggtggagtacgtggacgacacccaattcttgcgttttgatagcgacgccgccatcccccggatggaacctagagaaccctgggtagaacaggaggggccccagtactgggaatggacaacagggtacgctaaagctaatgcccaaacagaccgggtggcccttcgaaacttgttgcggcgttacaaccaaagtgaagcggggagtcacaccctgcaagggatgaacgggtgcgatatgggccctgacggtcgcttattatag

SEQ ID NO: 27349 - DNA, 678 bp, Artificial Sequence
  Description of Artificial Sequence: Synthetic coding sequence
tgacctgatccacctccaggccgagttcctggcgccttcacagagcacgcttacgatggcaaggactacatctcactgaacgaggacctacggtcctggactgcggcagacaccgtcgcccagatcacccagcggttttatgaggccgaggagtacgccgaggagttccgaacctacctagagggagaatgcctcgaattactcagaaggtacttggagaatggtaaagaaaccctgcagagggccgacccgccgaaagctcatgtggcccaccatcccataagcgatcacgaggccacccttcgatgctgggcacttggcttctaccctgccgaaataaccttgacctggcaacgagatggagaggagcagactcaggatacagaactcgtagagactcgccctgcaggggatggcactttccagaaatgggccgcagtggtggtgcccagtggtgaggagcagagatatacttgtcacgtgcaacatgagggactccctcagccgctgatcctgcgctgggagcagtcccctcagccgactattcccatcgttggcatcgtcgcgggtctcgtcgtacttggtgccgtggtgactggggcggtggttgcggccgtgatgtggaggaagaagtcttccgatcgcaatcgcgggtcatactcccaggccgcggtctag

SEQ ID NO: 27350 - DNA, 1005 bp, Artificial Sequence
  Description of Artificial Sequence: Synthetic coding sequence
atggctccacgcagtctgctccttctgctcagcggggccctggccctcaccgacacatgggccggcagtcatagtttgcgctatttttccactgctgtctcacggcctgggcgtggagaacctaggtacatagctgtggagtacgtcgatgacacacagtttctaaggtttgactccgatgccgccataccgagaatggagcctcgcgagccctgggtggaacaggagggcccccagtactgggagtggaccacagggtacgccaaagccaacgctcagaccgaccgggtcgccctgcggaatcttctgcgccggtataatcagtctgaagccggatcgcatacactacagggaatgaatgggtgtgacatggggccagacggcagactgcttagggggtatcaccagcacgcttatgacggcaaggattacatatctttgaatgaggacctgagaagctggacagctgccgacactgtggcccaaataacacaaagattttacgaggcggaagaatacgctgaggaatttcgcacatacctggaaggggagtgcctcgaactgctgaggagatacctcgaaaacggcaaggagaccttgcagagggccgacccccccaaggcccacgtggcgcatcacccgattagcgaccatgaagcgaccctccggtgttgggcccttgggttctaccccgccgaaataacactcacgtggcagcgcgacggggaggagcagactcaggatacagagctggttgaaaccaggccggccggggacggtacttttcaaaaatgggccgccgtcgtcgtcccatccggagaagaacaacggtacacctgccacgtgcagcacgaggggctgccccagcccctaattcttcgatgggagcagtcgccacagccgactatccctattgtcggcattgtggccggattggtggtcctgggagccgtagtgacaggggcggtggtcgccgcagttatgtggcgaaaaaagagttcttag

SEQ ID NO: 27351 - DNA, 1041 bp, Artificial Sequence
  Description of Artificial Sequence: Synthetic coding sequence
atggcgcctagaagtctgttattgctgctttctggggctctggcactgaccgatacttgggcgggaagccattcactcaggtacttcagtactgctgttagccgtccaggtcggggcgaacccagatacatagccgtggagtacgtcgacgacacccagttcttacgttttgatagcgacgctgcaatccctcggatggaaccaagagagccttgggtcgagcaggagggacctcagtattgggaatggacaaccgggtacgctaaggccaatgcccagaccgatagggtcgcccttagaaatctgctccgccgttacaatcagtcagaagccggcagccacacactccagggcatgaatggatgcgatatgggcccagacggcagactgctgcgggggtaccatcagcatgcttatgatggtaaagattatatttcactgaatgaagatctgcggtcttggaccgccgctgacacggtagcccagattacccagagattttacgaagccgaggagtatgctgaggagtttcgtacctatctggaaggcgagtgtctagagttgcttcgcagatatttggagaacggcaaggaaactttgcaaagagccgacccgccaaaggcgcacgtggctcatcatccaatcagcgatcacgaggcgacgctgaggtgttgggccttgggattttaccctgcagagatcacccttacctggcaacgtgatggggaagagcagacacaagatacagaactggtggagactcgtcctgcaggcgatgggaccttccagaagtgggccgccgtcgtcgtgcccagcggagaagagcagaggtacacgtgtcatgttcagcacgagggactaccacaacctctgatccttcggtgggaacaatcacctcaaccgactatacctattgtgggaatcgttgccggcctggtggttttaggcgcagtggtgaccggcgctgtcgtggcggcagttatgtggcggaaaaaaagctcagacaggaacagaggcagttattcccaggcagccgtgtag

SEQ ID NO: 27352 - DNA, 375 bp, Artificial Sequence
  Description of Artificial Sequence: Synthetic coding sequence
tgagccgtgatgtggcggaagaaatccagtggacacttcctacccattgacagaaatcgaggttcttactcacaggccgccgcttacagcgtcgtcagcgggaatcttatgatcacctggtggtctagcctattcctattaggcgtattatttcagggatacctgggatgtttgaggtcacactcggttctggggagacgcaaagtgggcgacatgtggatcctgttctttctttggctctggactagttttaataccgcgttcctggctctccaatccctgagatttgggttcggctttcgtagaggtcgatcatttttgctcaggagttggcatcatctgatgaagagggtccagatcaaaattttcgactag

SEQ ID NO: 27353 - DNA, 375 bp, Artificial Sequence
  Description of Artificial Sequence: Synthetic coding sequence
tgagctgtaatgtggcgaaagaagagttctggccacttcctcccaattgaccgcaatcggggatcctattcccaagctgccgcgtatagcgtcgtgtcgggaaatctgatgattacctggtggtcaagtttattcctccttggtgtgctgttccaagggtaccttggctgccttaggagtcattccgtcctgggtcgtagaaaagtgggagatatgtggatcttgttctttctctggctctggacctcttttaatactgccttcttggccctccagagtctccgcttcgggttcggatttcgaagaggacgaagcttcctcctgagaagctggcaccatctgatgaagagagtgcaaatcaagatttttgactag

SEQ ID NO: 27354 - DNA, 678 bp, Artificial Sequence
  Description of Artificial Sequence: Synthetic coding sequence
tgaccagaccctccacccgggcgggttccaggcgcctttactgaacacgcatacgatggaaaagactacataagtttgaacgaggacctccggtcgtggactgctgcggacacagttgcccagattacgcaaaggttctacgaagccgaggaatatgccgaggaattcagaacctacctcgaaggagaatgtctggagttgctgcgtcgttatctggaaaacgggaaagagacactgcagcgcgcggatcctcctaaggcccacgtagcccatcacccaattagcgaccacgaggctaccctcagatgctgggccctcggcttttatccagccgaaattacgctgacctggcagcgggatggcgaagaacagacccaggacacagaactggtggagacccgaccggcgggcgacggaaccttccaaaaatgggctgccgtggtggtccctagtggagaagagcagagatatacctgtcacgtacagcacgaaggtcttccccagccattaatactgcgatgggaacagagcccgcagcccaccatcccaatcgtggggattgtggcaggcctggttgtgcttggcgccgtagtaactggcgccgtagtcgcagccgtgatgtggagaaagaagtccagtgacagaaacaggggctcctactcccaggctgcggtgtag

SEQ ID NO: 27355 - DNA, 1329 bp, Artificial Sequence
  Description of Artificial Sequence: Synthetic coding sequence
atggccccacggtcactgctgttattgttgtccggcgcactggcgttgaccgacacttgggctggcagtcattcactccggtactttagtaccgccgttagtcgccccgggaggggtgaaccccggtatatcgcagtggaatatgtggacgacacccagtttctgcgttttgacagtgacgccgcgatccctcgcatggagccgcgggaaccctgggtggaacaagaaggaccccagtattgggaatggacaaccggctacgcgaaagccaatgcacagactgacagagtagcattgaggaacctgctccggcgatataatcaaagtgaagccggctcccacaccctgcagggaatgaacggatgcgatatggggccagacggccggctgttgaggggttaccatcagcacgcctacgacgggaaagattatatatccctgaatgaggatcttaggagttggacagctgcggatacagttgcccagattactcagcggttttacgaagcagaggaatacgctgaggaattccgcacttatctggaaggagaatgtctggaattgttaaggagatatctcgaaaacggaaaagaaacacttcagagggccgacccccctaaagcacatgttgcccaccaccccatcagcgatcacgaggccacattacggtgctgggccctcggcttttatccagccgagattacactgacatggcaacgggatggagaggagcagactcaggatacagagctggtagagacccgacccgccggagacgggacttttcaaaaatgggcagcagtggtggtccccagcggggaggaacaacggtatacttgccacgtgcagcatgagggccttccacagcctttgatccttcggtgggagcagtcccctcagcctaccatacctatcgttggcattgtggctggcctggtggtgctgggcgccgtagtgactggcgctgttgtggccgctgtgatgtggcggaagaaatcctccgatagaaataggggtagctatagccaggccgcggcctactcggttgttagtggcaacctcatgattacatggtggtcatcactttttctcctgggcgtgcttttccaggggtatttaggatgccttcggtcacatagcgtccttggtagacggaaagtgggtgacatgtggattttgttctttttgtggttatggacctctttcaacacggcctttctagccctgcagagcctgcgcttcggatttggcttccgccgcggacggagtttcctgctgagatcctggcaccatctgatgaagcgggtgcagattaaaatatttgactag

SEQ ID NO: 27356 - DNA, 678 bp, Artificial Sequence
  Description of Artificial Sequence: Synthetic coding sequence
tgacctgatccacctccaggtcgcgtgcccggtgcgttcactcaacatgcctacgacggcaaggactatattagcctgaatgaggacctacgttcttggactgcggccgacaccgtcgctcaaattacccaacgcttctacgaagcagaggaatacgccgaggagttccgtacgtacttggagggggaatgcctggaattgctgcgaagatacttagagaacggtaaggagaccctgcagagagcagacccaccgaaggcccatgtagctcatcatccgatttccgatcacgaagctacactaagatgttgggctctgggcttctatccggccgaaataacactgacttggcaacgcgacggcgaggagcagacacaggacacagagctcgtcgaaactcggcccgcaggagatgggacctttcagaaatgggcagccgtggttgttcctccgggtgaagaacaacggtatacctgccacgtacagcacgaaggtctgccacagccactaatccttagatgggagcagagcccccagcctaccatacccatcgttgggattgtggccggactcgtagtcctgggcgcagtggtgaccggtgcggtggtggccgcagtgatgtggagaaagaagtcctccgatcggaatcgcggatcatatagccaggctgctgtgtag

SEQ ID NO: 27357 - DNA, 1329 bp, Artificial Sequence
  Description of Artificial Sequence: Synthetic coding sequence
atggcacctcgaagtctcctgctgctgctgagtggtgctctggcactgacggatacctgggcaggctcccactctttaaggtatttcagtaccgccgtaagcaggccaggccggggtgagccccggtatattgccgtggaatacgtggatgatacccagttccttagatttgatagcgatgctgcgattccacgaatggaaccacgagaaccctgggtcgagcaggagggcccacagtattgggaatggaccacaggctacgctaaggccaacgctcagactgatagggtggccctgagaaatctgctgaggcggtacaatcaatccgaagccggatcccatacgttgcaggggatgaatggttgtgacatggggcccgatggtaggctgctgcgcggttaccatcaacatgcttatgatggaaaagattatataagcctgaatgaggacctccgtagttggaccgctgccgacaccgtcgcccagattacccagaggttttacgaggcagaagaatacgccgaagaattcagaacatatcttgaaggcgagtgccttgagttgctgaggaggtatctagaaaatggcaaggagacccttcagcgcgccgacccacctaaggcccacgtggcccatcatccaatatccgaccatgaagccacactgagatgctgggcattaggtttctacccagcagagattacactgacgtggcaaagagacggggaggagcagacccaggacactgagctggtagagactcggcccgccggtgatggtacgttccagaagtgggctgccgtagtcgttccttcaggcgaggaacaacggtatacttgtcatgtgcagcacgaagggctgccccagccactcattctacggtgggagcagtctccacaaccgacgatcccaatagtggggatcgtggccgggctcgtggtgttaggggccgtggtcacaggtgccgtcgttgcagctgtgatgtggcggaaaaaatcctcggatcgtaatcgcggctcttactcccaggcagccgcgtattccgtcgtgagcggactgctgatgatcacttggtggagctcgcttttcctgctcggcgtgctgttccagggatacctgggctgtttgcggtcccactcagtgctgggtagaaggaaagtcggtgacatgtggatcttgttctttctgtggctgtggacatccttcaacacggcttttttagccctgcagtcactccggtttggttttggcttcagacgaggccgtagtttcttactgcgctcttggcatcacctgatgaaacgcgtgcagatcaaaatcttcgattag

SEQ ID NO: 27358 - DNA, 678 bp, Artificial Sequence
  Description of Artificial Sequence: Synthetic coding sequence
tgacccgatccacctccgggcagggtgcctggggctttcactgaacacgcttacgatggaaaagactatattagcctgaacgaggatttgcgctcctggacagctgctgatacggtcgctcagattacccagcgattctacgaggctgaagaatacgccgaggaattcaggacttacctcgagggtgagtgtctcgagctgctcaggcgctacctggagaacgggaaagaaacactgcagcgggccgatcctccaaaggcccatgtggcccaccatcctatctctgatcacgaggcaacattaaggtgttgggctctgggattttacccagcagagataactctgacgtggcaacgcgatggtgaggagcagacgcaggatacagagttggttgaaactaggcccgccggagatgggactttccaaaaatgggctgccgttgtagtacctagcggtgaggagcaaagatacacatgccacgtgcagcacgagggcctgccccagcccctaatcctccgatgggaacagtctccgcagcctaccattcccatcgtcggcatcgttgccggattagtcgtgttgggcgcggtggtcacaggagccgttgttgccgctgtcatgtggcgtaagaagagctcagaccgcaatcgcgggtcatactcacaagctgccgtgtag

SEQ ID NO: 27359 - DNA, 765 bp, Artificial Sequence
  Description of Artificial Sequence: Synthetic coding sequence
atggcccctcggagcctcctgctgctcctttctggcgccctggctctcactgatacttgggcaggcagccacagtttgcggtactttagcaccgcagtctctcgccctgggagaggtgagcctaggtacatcgccgttgaatacgtggatgacacccagttccttcgatttgatagcgatgccgctatcccaagaatggaaccaagggagccatgggttgagcaggagggcccccagtattgggaatggactactgggtatgccaaagccaacgcgcagaccgatagggttgcactgagaaaccttcttcgaaggtacaatcagtcagaggcaggctcgcataccctccagggtatgaacggttgcgacatggggcctgatggaaggttactccggggataccatcagcatgcatacgatggaaaggattatatctctctgaacgaggatcttcggtcctggacagctgcagataccgtagcccagatcactcagcggttctatgaggcagaagaatatgccgaagagttccgtacctacttagagggcgaatgcctcgagctgttgagacgctatctggaaaatggaaaagaaacactgcagagagccgaacagagccctcaacctactatacctatcgtgggcatcgtggctgggctagtggtcttgggtgccgtggtgactggggctgtggtcgctgcagtgatgtggagaaaaaaaagcagcgatcgtaatcgtggttcatactcacaggccgccgtctag

SEQ ID NO: 27360 - DNA, 1041 bp, Artificial Sequence
  Description of Artificial Sequence: Synthetic coding sequence
atggcaccacgctctctcttgttattgctcagcggcgccctggctcttactgacacctgggccggttcccatagcctcagatactttagcaccgcggttagccgtccaggccggggtgaaccacggtatatagcagttgaatacgttgatgatactcagttcctccggttcgactcagatgcagcgatcccccgcatggagccgcgggaaccttgggtagagcaggaggggccgcaatattgggagtggactaccggttacgccaaagcaaatgcacagaccgaccgtgtcgctctgaggaacctgctcagacggtacaaccagagtgaggcaggttctcacaccctccaggggatgaatggatgtgacatggggcccgacggccgcctcttgcggggataccaccagcacgcatacgatggcaaagactatattagcctcaacgaggacttgcggagctggactgccgcagacactgtagcacagatcacccagcgattttatgaagccgaagaatatgctgaggaatttagaacctacttggagggagagtgcctggaattgctgcggaggtacctcgaaaacgggaaggagacgctccagcgggctgatcctcccaaagcgcatgtggcgcaccaccccatctccgaccacgaagctacactgcggtgctgggcactcggcttttatccggcagaaattaccttgacatggcagagagacggggaggaacaaactcaggatactgagcttgtcgagactcggcccgctggcgatgggacatttcagaagtgggctgccgtagttgtgcccagcggcgaggagcaaaggtacacatgtcatgtgcagcatgagggactcccccagcctctcatactccgctgggagcagagtccacaacctaccatcccaattgttggaattgtcgcaggactggtcgtgttaggcgcagtcgttaccggagctgtggtggcagctgtgatgtggcgaaagaaaagcagtgaccggaatagagggtcctactcccaggctgctgtctag

SEQ ID NO: 27361 - DNA, 396 bp, Artificial Sequence
  Description of Artificial Sequence: Synthetic coding sequence
atggcgccgcgctctctgctgctgttactctctggcgccttagcgctgactgatacttgggccgggtcgcactcccttcgttactttagtacagccgtgtctaggccagggcggggcgagcctcggtatattgcagtagagtatgtcgacgacacccagttcctccggtttgatagcgacgctgctataccaaggatggagccaagagagccttgggttgaacaggagggtccccaatattgggaatggaccaccggttacgctaaggcgaatgcacagacagatagggtagccctccggaatcttttgagaaggtataaccaatctgaagccggttcccatactctacagggaatgaacgggtgcgatatggggcccgacgggagactgctgtag

SEQ ID NO: 27362 - DNA, 33 bp, Artificial Sequence
  Description of Artificial Sequence: Synthetic coding sequence
tgagccgtgatgtggaggaagaaaagtagttag

SEQ ID NO: 27363 - DNA, 780 bp, Artificial Sequence
  Description of Artificial Sequence: Synthetic coding sequence
atgaatggctgtgatatgggacccgatggtaggcttctcagggggtaccaccaacacgcgtatgacgggaaagattatatctcattgaacgaggatctgagatcctggaccgcagctgacacagttgctcagatcacgcaaaggttttatgaggctgaagagtatgctgaagagtttcgcacctatctggaaggcgaatgtcttgagctgctcagacggtacctggagaacgggaaggaaaccttacagcgtgccgatccaccaaaagcacacgtggcccaccatccaatctctgaccatgaggctacattacgttgttgggcactggggttttaccctgctgagatcactctcacatggcagagagatggggaagaacagactcaggacactgagctcgtggagacaaggcctgccggcgacggaacctttcagaagtgggcagccgtggtcgtgccgcccggagaagaacagcggtatacttgtcacgtccagcatgagggcttacctcagccattgatcctgcgatgggagcagtcccctcagcctactattccgatcgttggcattgtcgccggactggttgtgttaggcgctgtggtgacgggtgccgtggttgccgctgtgatgtggagaaaaaagtcatctgcctactcagtcgttagtggaaatcttatgataacatggtggtccagtttgttcctgctcggggtcctattccagggctacttgggatgtctcagatcacactcagtgctgggacgcagaaagcacttttag

SEQ ID NO: 27364 - DNA, 765 bp, Artificial Sequence
  Description of Artificial Sequence: Synthetic coding sequence
atggcaccgagaagtctcctgctgctattatctggcgcacttgccctgacggacacctgggcaggctcacacagcttgcgctatttcagcaccgcagtctcacgcccaggtcggggtgaacccagatatatcgcagttgagtacgtcgacgacacacagttccttcgattcgattccgacgcagctatcccccggatggagcccagagagccgtgggtcgagcaagagggaccccaatattgggaatggacaaccggctacgctaaagcaaacgctcagaccgacagggtggcgctgcggaacctgctgagaagatataatcagtccgaggccggctcacataccttacagggcatgaatggctgcgatatgggcccagacggtcggttactgagggggtatcaccaacatgcttatgacggtaaagactacattagtctcaacgaagacctgagaagttggactgcagccgatacagtggcacagattactcagcggttttacgaggctgaagagtacgccgaagagtttagaacatatctggagggagagtgtctggaactgcttaggagatacctcgagaatggtaaggaaacactccagcgagctgagcagtcccctcagcccaccatccccatagtagggatcgtagctgggcttgtcgtgttgggcgccgtcgtgactggagcagtggtggctgctgtaatgtggcgaaaaaagtccagcgacagaaaccgaggaagctacagccaggctgcagtgtag

SEQ ID NO: 27365 - DNA, 729 bp, Artificial Sequence
  Description of Artificial Sequence: Synthetic coding sequence
atggctccacggagtctcctgctgcttttgagcggtgccctagccctgaccgacacctgggccggtagtcacagcctgagatacttttcaaccgccgtgtcaaggcctggtcggggcgaacccaggtacatcgccgtggagtatgtggatgatacacagtttctgaggttcgactctgacgctgcgattccacggatggagcctagagagccttgggtggagcaggagggaccacagtactgggagtggaccaccggatacgctaaagcaaatgcacaaaccgaccgtgtggcactgcgcaacctcctaaggcgatacaaccaatcagaggcgggttcacatacgctccaggggatgaatggctgcgacatggggcccgacgggcgcctcctgcgaggctaccatcagcatgcgtatgatggcaaagattacataagcctgaacgaagatctacgttcctggaccgcggcagacactgtggcccaaataactcagcggttctacgaagctgaggaatacgcagaggaatttcgaacctatcttgagggcgagtgcctcgaactgctaaggagatatctcgaaaacggaaaagagaccctgcagagagccgaacagagccctcagcccaccattccaatcgttggaatagtcgccggactggtggtgctgggcgccgtggttacgggggcggtcgtagccgccgttatgtggcgaaagaaatcatcatag

SEQ ID NO: 27366 - DNA, 396 bp, Artificial Sequence
  Description of Artificial Sequence: Synthetic coding sequence
atggcccctagatcacttcttcttctgctttctggggcattggctctgacagacacatgggccggttcccactcactccgatacttctccaccgctgtttctcgcccgggacgcggcgagcctagatatattgcagtcgagtacgtcgatgatactcagttcttgcgttttgatagtgacgctgccatccctaggatggaacccagggaaccatgggttgaacaggagggacctcaatactgggaatggaccacaggatacgctaaggccaacgcccagaccgaccgggttgccctgcgtaatctcttacggcggtacaaccagagcgaggcagggtctcacaccttacaaggcatgaacggctgtgacatgggacccgatgggaggctcctctag

SEQ ID NO: 27367 - DNA, 375 bp, Artificial Sequence
  Description of Artificial Sequence: Synthetic coding sequence
tgagcggtgatgtggagaaagaagtcatcaggacattttctccccatcgatagaaacagagggtcttactcacaagcggcagcctacagcgttgtgagtggcaacctgatgatcacgtggtggagttctcttttcctattgggggttctgttccagggctacctcgggtgcctacgctctcattccgtgttggggagaaggaaagtcggcgacatgtggatacttttttttctgtggctttggaccagctttaatactgctttccttgccctgcagtcactgcgcttcgggttcgggtttcgacggggacgcagtttccttcttagatcctggcatcacttgatgaagagggtgcagatcaagatcttcgactag

SEQ ID NO: 27368 - DNA, 1041 bp, Artificial Sequence
  Description of Artificial Sequence: Synthetic coding sequence
atggcgcccagaagtctgctgttgttgctgagcggcgctctcgccctaactgacacctgggcaggatctcattctctccggtatttcagcacagccgtgagtcggcctggccgaggtgaaccacgatacattgccgtcgagtacgtggacgatactcagttcttgcgctttgactctgacgcagcaatccctaggatggagcccagggagccctgggttgaacaggaaggaccacaatattgggaatggacgaccggatatgctaaagctaatgcgcagactgatcgcgtggccctgcgtaatctcttgagacggtataatcaatccgaggcgggaagccacacattgcagggcatgaatggctgcgatatgggccccgatggccggcttctccgagggtaccaccagcacgcatacgacggaaaagattacatttcactcaatgaggatctgcggtcatggacagccgccgacacagtggctcagatcactcaacgtttctatgaagccgaagagtacgctgaggagtttaggacgtacctggagggcgaatgcctggagctgctccgaaggtatctggagaatggaaaagagaccttgcagcgcgcagacccgcctaaggcccacgttgctcatcaccctatctcagatcatgaggctacgctgcgatgctgggctctgggcttttatcccgccgagatcactctgacttggcagcgcgatggggaggaacagacccaagacaccgaactcgtggagactcggcccgcaggtgatggaacctttcagaagtgggcagccgtagtcgtgccttcaggggaggaacagcggtacacctgtcacgttcagcacgagggactgccacagcctctcatcttgcgctgggaacagtcacctcagcccacaattcctattgtgggcattgtggcagggttggttgttttgggggccgtcgtgacaggagccgtagtagccgccgtaatgtggcgaaagaagtctagtgaccggaatcgcggttcttactcccaggctgctgtctag

SEQ ID NO: 27369 - DNA, 1329 bp, Artificial Sequence
  Description of Artificial Sequence: Synthetic coding sequence
atggcacctcgcagcttgctcttgctgctgagcggtgcgctcgcactgactgacacatgggccggcagtcactcattaagatactttagcacagccgtgtcccgccctgggcgcggtgagcctaggtatatcgcagtggaatatgtcgacgatacccaattcctgcgattcgatagcgacgctgccatacctcgtatggagccgcgagagccatgggtcgagcaggaaggtccgcagtactgggagtggacaacagggtacgctaaagccaatgcacagacagacagagtggcactgcgcaacttgctccgccggtataaccagagtgaagcaggttcgcataccctgcagggaatgaacggctgcgatatggggcctgatgggaggctcttgcgagggtaccaccagcatgcctacgatgggaaggattatatctcactgaatgaggatctgcgctcctggacagctgctgacactgtagctcagatcacacagcgattctatgaggcggaagagtatgctgaggagtttagaacttacctcgaaggggaatgcttagagctactgcgaaggtatctcgagaacggaaaagagacgctgcagcgtgccgaccctccgaaggctcacgtggcacaccatcctatctctgaccacgaggccaccctgagatgctgggcactggggttctacccagcggaaatcacattgacatggcagcgcgacggtgaggaacagacacaagataccgagctggtggaaactcggcccgccggggacggaaccttccagaagtgggccgccgtggtggtcccttctggggaagagcaacggtacacctgccacgtgcagcatgaggggctgcctcagcccctcatcctgcggtgggagcagtctccccagcccaccattccaatcgtggggatcgtagctggattggtagtgctgggcgccgtcgtgacaggagctgtggtagcagccgtcatgtggagaaaaaagtccagtgataggaatcgcggctcctatagccaagctgcagcatactcagtcgtgagcggaaacctcatgattacttggtggagctcccttttcttgctgggcgtgttattccaggggtaccttggctgcctaagaagtcatagcgtgctgggtagaaggaaggttggtgacatgtggatcctgttcttcctgtggctctggaccagcttcaacacagcattcctcgctcttcagagcctgcgttttgggttcggctttaggcgagggcgcagtttcttgttgcgtagttggcatcatcttatgaaacgtgttcagatcaagattttcgactag

SEQ ID NO: 27370 - DNA, 396 bp, Artificial Sequence
  Description of Artificial Sequence: Synthetic coding sequence
atggcaccaaggtcactgctgctgctactgagtggcgcactggcattaaccgacacatgggcaggcagtcactcactgcgctattttagcacagccgtctctagacccggccggggagagccccgctacattgccgtagagtatgtggatgacacacaatttctccgtttcgactcagatgctgctatcccccggatggaaccgagggagccttgggtggaacaagaggggcctcaatactgggagtggacgacaggctacgcaaaagcgaacgcccagaccgatcgtgtcgcattgagaaatctccttcgacggtacaaccagtcagaagccgggtcccacacactccagggaatgaatggttgcgacatggggcccgatgggcggctgctgtag

SEQ ID NO: 27371 - DNA, 375 bp, Artificial Sequence
  Description of Artificial Sequence: Synthetic coding sequence
tgagccgtgatgtggaggaagaagtcctccggacattttttgcctattgatcgcaaccgcggtagctatagtcaggcagccgcctactcagtggtaagcggactgctaatgatcacttggtggagctcattatttctgctcggggtgcttttccaagggtacttaggatgcttgcgctcccactcagtgctaggcagaaggaaagtaggtgacatgtggatactgtttttcctctggttgtggacttcttttaataccgctttcttggccctccagtccctgcggttcggattcggattccgcaggggcaggtcttttctcctgcgcagttggcatcatctcatgaaacgcgtgcagattaagatttttgactag

SEQ ID NO: 27372 - DNA, 1260 bp, Artificial Sequence
  Description of Artificial Sequence: Synthetic coding sequence
atggccccaagatctcttctgttactgctctccggcgcactcgccttgactgacacctgggctggatcccatagccttcggtatttttccacagccgtttccaggcccggtaggggagaaccacggtatattgcggtagaaccgtgggtggagcaggaaggtccccaatactgggagtggactacgggttatgctaaggcaaatgcccaaaccgatcgtgtggccttgagaaaccttttgcgacggtacaatcagtcggaagccggttcccacacgctgcaaggaatgaacggttgtgatatggggcctgatgggaggcttctccgagggtaccatcagcacgcgtatgatggcaaagattacattagtctgaatgaggacctccggtcttggaccgcggctgataccgtggcacaaataacacagcgcttttacgaggcggaggagtacgcagaagagttccggacttacctggaaggggagtgcctcgagcttctgcgaaggtatctcgagaacggcaaggaaacgctccaaagagccgaccctcctaaggctcacgttgcccatcaccctatctccgatcacgaagctacccttcgttgttgggccttgggcttttacccagccgagatcaccctgacctggcaacgtgacggcgaggaacagacacaggacacagagcttgtcgagacacggcctgctggcgatggaacttttcaaaaatgggccgcggtggtggttcctcccggagaagagcagcgatacacttgccacgtgcagcacgaaggtcttccacagcctctgatcttgcgctgggaacagtctccccaacccacaatccccatcgtggggattgtggcgggcctggtagtgctcggagcagtcgtgacaggggccgtggtggctgcagttatgtggagaaagaagagttcagatcgtaaccgcggatcatattcacaggccgccgcatactctgtcgtatcggggaacctgatgattacatggtggtcctccctttttcttcttggcgttctgttccaaggatatctgggttgcctgcggtcccattctgtacttggccggagaaaagtgggcgacatgtggatcctcttcttcctttggctctggactagctttaataccgcctttctcgcactgcaatcccttagatttggattcggcttccgacggggtcggtcttttctgttgaggtcatggcaccatctgatgaagcgggtgcagattaagatctttgactag

SEQ ID NO: 27373 - DNA, 375 bp, Artificial Sequence
  Description of Artificial Sequence: Synthetic coding sequence
tgagcggtgatgtggcggaagaagagttctggacactttctgcctatcgatcgtaaccggggctcgtattcacaagcagccgcgtacagtgttgtgtcgggaaacctgatgataacctggtggtccagcctgttcctgttaggcgtgttattccaaggctatctgggttgtcttagatcccattcagttctcggaagacggaaggtaggcgacatgtggatcctattctttttatggctctggacatccttcaacacggctttcctggcgctgcaaagtctgcgcttcggctttggcttcagacgcgggagaagcttcctgctgaggtcctggcatcatctgatgaagcgcgtgcagatcaagattttcgactag

SEQ ID NO: 27374 - DNA, 678 bp, Artificial Sequence
  Description of Artificial Sequence: Synthetic coding sequence
taaccagacccccccccgggacgagtacccggagcctttactcagcacgcatacgacggaaaggactatatcagcttgaatgaagacctgcggtcgtggactgccgccgacaccgtagcgcaaatcactcagcgtttctatgaggccgaggagtacgcagaagaatttagaacttaccttgagggagaatgtctggagctccttaggcgctatctggagaacggcaaagaaacactgcagcgggctgaccctcctaaagcgcacgtggcccaccaccctataagtgaccatgaggccaccttgagatgctgggctctcggcttttaccctgccgagatcaccctgacgtggcagcgggacggtgaagagcagacacaggatacggagcttgtggagactaggcccgcgggcgacggtacatttcagaaatgggctgcggtcgtagtcccaagtggcgaggagcagcggtacacctgccatgtgcagcacgagggtcttcctcagcccctgatcctaagatgggagcagtccccccaaccaactatcccaatcgtgggcatagtggctggactggtcgtgctgggcgcagtcgtcaccggcgccgtggtggccgcggtcatgtggaggaagaagtcttctgaccggaacagaggcagttattctcaggcggcagtttag

SEQ ID NO: 27375 - DNA, 678 bp, Artificial Sequence
  Description of Artificial Sequence: Synthetic coding sequence
tgaccagaccccccacccggacgggtccccggggcatttactcagcacgcttacgatgggaaggactatattagcctgaacgaggatttgcgctcatggacagctgctgatactgtagcccagattacacagaggttctacgaggccgaagagtacgcggaggagttccggacatatttggagggagaatgtcttgaattactccggagatatctcgagaacggcaaagaaaccctccagcgggcggacccacctaaagcacatgttgctcaccaccctattagcgatcatgaagctactctgcggtgctgggctcttggcttctaccccgcagagataaccctgacatggcagagagatggcgaagagcaaacacaggacaccgagcttgttgagaccagaccggcaggagacgggacttttcagaaatgggcagccgtggtagtgccttctggagaggagcagagatacacgtgtcacgtccagcacgaaggcttaccacagcctctgatcttaagatgggagcagtctccacagcctacaatcccgatagtcgggattgtcgctgggttagtggtgctcggcgcggttgttactggagccgtagtggctgcggtgatgtggcgcaagaagtcttccgatcggaatcgaggcagctatagtcaggctgctgtttag

SEQ ID NO: 27376 - DNA, 375 bp, Artificial Sequence
  Description of Artificial Sequence: Synthetic coding sequence
taagccgtcatgtggaggaaaaaaagcagtggccactttctgcccatcgaccggaatcgggggagttactcccaggccgctgcctactctgtcgtttctgggaatctgatgatcacttggtggagttctctgtttctgctgggagtgctgttccagggatacctgggctgtctcaggagccattccgtgctggggcggaggaaggtgggcgacatgtggattctgtttttcctgtggttgtggacatcattcaatacagcttttctggccctccagtccctgcgcttcggttttgggttccggaggggccgcagctttctgcttaggtcctggcatcatctgatgaagcgggtgcaaattaagattttcgattag

SEQ ID NO: 27377 - DNA, 780 bp, Artificial Sequence
  Description of Artificial Sequence: Synthetic coding sequence
atgaatggttgtgatatgggccctgacgggcgattgctccgtggctatcatcagcacgcttacgatggcaaggactatatttccttgaacgaggatctgagaagttggaccgcagccgataccgtcgcccagataacccagcgtttctacgaagccgaagagtacgctgaagagttccgtacttatctagagggcgagtgtcttgagctgctgagacgctatcttgaaaacgggaaggagactctccagcgggcagacccacctaaggctcatgtggcacaccatcccatttctgatcacgaggccactctgagatgttgggcgctcgggttctaccctgccgaaatcactttaacgtggcagcgagatggagaggagcagacccaggacacagagttggttgagactagacccgcaggagacggaacttttcaaaagtgggctgccgtggtggttccaagcggcgaggagcagcggtatacttgtcacgttcagcacgaaggactgcctcagcccctgattcttaggtgggagcagtcacctcagccgacaatacccattgtgggaattgtggccgggctagtcgtgctgggagcggtggttaccggagccgtcgtggccgccgtgatgtggcgtaaaaagtcaagcgcctattcagtggttagtggtttgctgatgataacctggtggtctagtttatttctgctaggcgttctgttccagggatatcttggctgtcttagatcacattccgtgctggggagacgcaagcacttctag

SEQ ID NO: 27378 - DNA, 1050 bp, Artificial Sequence
  Description of Artificial Sequence: Synthetic coding sequence
atggccccccggtcccttcttcttctcctgtccggggctctggccctcactgatacttgggcaggcagccattctctccggtacttttctaccgcggttagtcgcccaggacgcggagagccacggtatattgctgtggaatatgtggatgacacacagttcttacggtttgacagcgacgcagcgattccacgtatggaaccccgtgaaccctgggtggagcaagagggaccccaatattgggagtggacaactggatacgccaaagctaacgcccagacggaccgggtcgctttacggaatttgcttaggcgatacctcgaaaatggcaaagaaaccctccagagggctgaccctccgaaagcgcatgtggcccatcacccaatctctgaccatgaagctaccctgagatgttgggccctgggtttctatcctgccgagataaccctgacctggcagcgcgacggggaggagcagacccaggataccgagctcgtcgagaccagaccagccggtgatgggacctttcagaaatgggcggctgtcgtggtgccctccggtgaggagcagcgctacacctgccacgtccagcacgaaggactcccccagcctctgattttgagatgggagcagtctccacagccgaccattcccatcgtcggtatcgtcgctggccttgtggttctgggagccgtcgttaccggagcagttgtggctgccgtgatgtggagaaagaaaagcagcgaccggaatcgggggagctactcgcaggcagccgcctatagtgtagtctcagggaacttgatgattacgtggtggtcaagtttattccttcttggtgtactctttcaaggatacctaggctgtctgagaagccacagcgtacttgggaggagaaaggcccagctgttgtccgtcagtacgtcacagacaagcatccttatccaggaacagttcagccatcaacggacactcgctatgtccggcaagatgttttgctgccacgattggtctgaagagaaggtgctaccagcctcttgtggcgagtag

SEQ ID NO: 27379 - DNA, 1260 bp, Artificial Sequence
  Description of Artificial Sequence: Synthetic coding sequence
atggctccgagaagcctgctgctgctcctgagcggtgcgctggctctcacggatacctgggcagggtctcactctctccggtatttcagcaccgcagtgtccagaccgggccggggtgagcctcgctatatcgcagtggagccatgggtggagcaggaggggccccagtattgggagtggactacggggtacgcaaaggcaaacgctcaaaccgatcgggtggccctgaggaaccttctcagacgatacaatcagtccgaggcagggtcacacactcttcagggaatgaatgggtgcgatatgggccctgatggcaggcttcttcggggttatcaccagcacgcttacgacggaaaagactatatctcattgaatgaggaccttcgaagttggacagcggcagacaccgtagcgcagatcactcaacgcttctacgaagcagaggaatacgccgaagagttccggacatacctcgagggcgaatgtttagaactccttcgccgttatctggagaatgggaaagaaactctgcaacgtgccgatccacccaaagcccacgtcgctcatcaccctatctccgatcacgaagctacactgcgctgctgggctctgggattttaccctgcagagatcacattgacatggcagcgagacggcgaggaacaaacccaggacacggagctggtcgaaaccagacctgctggcgacggcactttccagaagtgggccgccgtcgtggtgccttctggcgaagaacaaaggtacacttgccacgtgcagcatgaaggcctcccacagcctctgattctgcgctgggagcaaagtccccagccaacaataccaatcgtcgggatagtagctggtttggtggttctgggggcagtcgtgacaggtgcagttgtggctgctgtgatgtggcgcaagaaatcctccgaccggaacagaggcagctattcacaggctgccgcatactctgtggtatctgggaatctcatgatcacctggtggagtagtttgtttctcttaggcgtgctgttccagggctatctgggatgtctgcggagccattcggtgctagggcgtcgaaaggttggggatatgtggatactgttctttctgtggctttggacatctttcaacactgcctttctcgccctgcagagcctgaggtttggattcgggttccgacgcgggcgaagcttcctgttacggtcctggcatcacttaatgaagcgcgtgcagatcaaaatttttgattag

SEQ ID NO: 27380 - DNA, 1050 bp, Artificial Sequence
  Description of Artificial Sequence: Synthetic coding sequence
atggctccccgatcgctgctcttactgctgtctggtgccttggcgctgactgatacctgggccggatctcacagtctgaggtatttctctacagccgtgagccgacccggccggggcgaaccaaggtacattgccgtggaatatgtggacgatacacagtttctgcgctttgacagcgatgcagccattcctagaatggagccgagagagccctgggtggagcaagaggggccgcagtactgggaatggacaaccggctacgccaaagcaaatgcacagactgatagagtggcactaaggaatctccttcggcgctatctggagaacggaaaagaaacgctgcaacgggccgaccctcccaaggcccatgtggcccatcaccccattagcgatcatgaagctactctgcggtgctgggcactgggtttttaccccgcagagattacactaacatggcagcgggacggagaggagcagacacaggatactgaactagtagagacccggccagccggggatggcacattccagaagtgggctgccgtggtagtaccctctggggaagaacaaagatacacctgccatgtgcaacacgagggtctgccccagcccctcattcttcggtgggaacagtcaccccagcccacaattccaattgtgggaatcgttgctggcctcgtcgtccttggagcggtggtgactggagcggtcgtggcagctgtgatgtggcggaaaaagtcctcagacaggaacaggggctcttattcacaagccgccgcctactccgtggtctccggtaatctgatgatcacttggtggagctccctcttcctcctcggtgtcctgttccaaggttaccttgggtgcttgcgttcacattccgtccttggacggcgaaaggcacagctgctcagcgtgagcacatcacagactagcatcctgatccaggaacagttttcgcatcaacgaacactggctatgtcgggaaagatgttctgctgccacgactggagcgaggagaaagtgttgcccgcttcgtgtggagaatag

SEQ ID NO: 27381 - DNA, 780 bp, Artificial Sequence
  Description of Artificial Sequence: Synthetic coding sequence
atgaacggatgtgacatgggaccagacggtagactgctccgaggataccaccagcacgcttacgatgggaaggactatatttccttaaatgaagacttgcggagttggacagccgcggacacggtcgcccaaataacccagcgcttttacgaggcggaggagtatgcggaagaatttaggacctacctcgaaggggagtgccttgaactcctcagaaggtatcttgagaacggaaaggaaactctccagagggctgatccccccaaggcacacgtggcacaccaccctatctctgaccacgaagcaacactgagatgctgggctttgggtttctatcccgccgagatcactctgacatggcagagagacggggaagagcaaactcaggacaccgaactggtcgaaactaggccagccggagatgggacctttcagaagtgggccgctgtggtcgttccttcaggggaggagcagaggtatacctgccatgtgcagcacgagggcttgccgcagcccctaattctccgctgggagcaatctccccagcctaccatcccaattgtgggtatcgtagccggactcgtggtgctgggggccgttgtaaccggcgccgtcgtcgccgcagtgatgtggcgaaaaaagtcgagtgcctacagtgtcgtctccgggaatttaatgattacatggtggtcatcactgtttctgctcggagtgctgtttcaggggtacctgggatgtctcaggtcgcatagtgtgcttggcaggcgcaagcatttttag

SEQ ID NO: 27382 - DNA, 780 bp, Artificial Sequence
  Description of Artificial Sequence: Synthetic coding sequence
atgaatggttgcgatatgggacctgatggaagattgctcaggggctaccaccagcacgcttacgatgggaaggattatatatccctgaatgaggatctcaggtcttggacagctgctgataccgtggcgcaaataacacagaggttttacgaggctgaggagtatgcggaagagtttaggacctacctggagggtgagtgcctggagctgctcagaagatacctagagaatgggaaggagaccttacagcgggccgatccacctaaggcacacgtggcgcatcaccctatcagtgatcatgaggcaaccctacggtgctgggcacttggtttctacccagccgagatcactctaacgtggcagcgagatggagaggagcagacacaagacaccgagcttgtggaaactcggccggctggagatggaacattccaaaagtgggctgctgttgtggtgccgagcggagaggagcaaaggtatacctgtcatgtccagcatgaggggctacctcagcccttgatactgagatgggagcagagccctcagcccactattccaatcgtgggaatagtcgcagggttggtagtcttgggagccgtggtgaccggggccgttgtggctgccgtgatgtggcggaaaaagagctctgcatacagcgtggtgagcgggaacttgatgattacttggtggtcctctttattcttgttaggcgtactgttccagggctacctgggttgcctgcggtcccattcagtgctaggtcgtcgcaagcacttttag

SEQ ID NO: 27383 - DNA, 1260 bp, Artificial Sequence
  Description of Artificial Sequence: Synthetic coding sequence
atggcccctagatcccttctgttgctcctgagcggggccctggcactcaccgatacctgggccggctctcacagcttacgctacttttctaccgctgtgtcccgtcctgggcgaggagaacctcggtacatcgccgtggagccatgggtggagcaggaaggcccgcagtattgggagtggacaacagggtacgccaaagccaatgcccagaccgatagagtcgcattgcgcaatttgttaagacggtataatcagagtgaagccggtagccacactttgcaaggcatgaatggatgcgacatgggaccagacgggcgactcctgagaggttatcatcagcacgcttatgatgggaaggactatatcagcctgaatgaagatcttcgctcttggacggctgccgataccgtggcccaaattacacaaaggttttatgaggccgaggagtatgccgaagagtttcgcacctaccttgagggggagtgtctcgagctgttgaggaggtacctagagaatggtaaggagactcttcagagggcagatccaccaaaggcacacgtcgctcaccacccgatctcagaccacgaagcaactctgcgctgctgggctctcggtttttaccccgcagagataacacttacttggcaaagagacggcgaggagcagacccaggacactgagcttgttgagacacgtcctgcgggcgacgggacgttccaaaaatgggctgccgttgtcgtgccatctggagaggagcaaagatacacatgtcatgtccagcatgaagggctaccacagcccctcattctccgctgggagcaatccccccagcctaccattcctatcgttgggattgtggctggccttgttgtcctcggcgctgtcgtcacaggcgctgtcgttgccgccgtgatgtggcgcaaaaaatcatccgaccggaacagggggtcatacagtcaggccgctgcatatagtgtggtctctggtaatttaatgataacatggtggagctcgttgttcctgctgggtgtgctttttcaggggtacctggggtgtctgaggtctcatagcgtcctgggaagaagaaaggtgggggatatgtggatcctgttttttctgtggttgtggacaagtttcaacacagcctttctggccctccagtctctacggtttggattcggctttcggcgggggcgaagttttctgttgcgatcgtggcaccatctgatgaagcgggtgcagatcaagatatttgattag

SEQ ID NO: 27384 - DNA, 1050 bp, Artificial Sequence
  Description of Artificial Sequence: Synthetic coding sequence
atggcccctcggagtcttctgctgctcctttccggcgcactggccctgacggatacatgggcagggagtcactcactgaggtatttctcaacggccgtgtcacgacccggtcgcggggagcccagatacatcgccgtagagtacgtggatgacactcagttcctaagattcgatagcgatgctgcaatccccaggatggagcctcgagaaccctgggtcgaacaggaaggaccccagtattgggagtggaccaccggctatgcaaaggccaacgcgcaaacagatcgggtcgcccttcggaaccttctcagaaggtacctggagaacggaaaggaaactctccagcgcgctgaccctccaaaggcgcacgtggctcaccatccaattagcgaccacgaggcgactttgcggtgctgggcgctggggttctacccagccgaaatcaccctgacctggcagcgtgacggagaggagcaaacacaggataccgagctggttgaaacccggcccgccggtgatggcacctttcagaaatgggccgccgtcgttgtgccgagtggggaagaacagcgctatacttgtcacgtacaacacgaaggtttgcctcaaccccttatcttgaggtgggagcaaagcccacagccaactatccccatcgtcggtatagtggctgggctggttgtcctcggggctgtcgtaaccggcgccgtcgtggctgcggtcatgtggaggaaaaaaagttccgatcggaatagaggaagctatagtcaggcagctgcatacagtgtggtctctggaaatctgatgatcacctggtggtcaagtctttttctgttgggtgtactttttcaagggtatctggggtgcctccgttcacattccgttttaggacgaagaaaagcccaattgctttcagtctccacttcacagaccagcatcctgatacaggaacagttttctcaccagaggactcttgctatgtccggtaagatgttttgttgccacgactggagcgaagaaaaggtgctcccggcgagctgcggcgagtag

SEQ ID NO: 27385 - DNA, 1308 bp, Artificial Sequence
  Description of Artificial Sequence: Synthetic coding sequence
atggccccacggagcctgcttctcttgctgtcaggcgcgctggcactcaccgatacatgggcagggtctcattccctgaggtacttcagcactgccgtgtcgaggccaggcaggggggagccacgatacattgcagtggagtatgtggacgatacccagttcctgcggtttgattcagacgctgccattcccagaatggaaccccgtgaaccttgggtggagcaagaagggccccagtattgggagtggaccactggatacgctaaggctaacgcacagactgacagggtggccctgcggaacctgcttagacggtacaatcagtctgaagctggtagccatactttgcaagggatgaatggatgtgacatgggaccggatggacgcctgttgcggggttaccaccagcacgcctacgacggtaaggattatattagtcttaacgaggatctgcgcagctggacagctgcagacactgtcgctcaaattacgcagcgtttctacgaagccgaggagtatgccgaggaatttcgcacatatcttgagggtgaatgccttgagctgctgaggagatacctggagaatggtaaggaaaccctgcaacgtgctgacccccctaaggctcatgtcgcccaccatcctatttcagaccacgaggcaactctacgatgttgggcactaggcttctatcccgccgagataacattgacctggcaaagggacggcgaggaacagacgcaagacacggagctcgtcgaaacacgtcccgcaggggatggaactttccagaaatgggccgcagtggtcgtcccttcaggcgaggaacagcggtatacatgtcacgtgcagcatgaaggattgccccagcctttaattctgcgctgggagcagtctccccagcccacaattccgattgtgggtatcgtcgcggggctggtcgttcttggggcagtcgtcaccggcgccgtggtggctgcagtgatgtggcggaagaagagttccgaccgcaatcgcgggtcatattcccaagccgctgcctacagcgtggtgagcggactgcttatgatcacctggtggtcttctttgtttctactgggtgtgctctttcagggctatctgggctgtcttcgatcacactctgtcctgggaaggcggaaggcccagctcctcagcgttagtactagccagacatctattctgattcaggagcagttcagccaccagaggaccttggcaatgtcaggtaagatgttctgctgccacgactggtcagaggaggaggtactacccgcctcatgcggcgagtag

SEQ ID NO: 27386 - DNA, 1041 bp, Artificial Sequence
  Description of Artificial Sequence: Synthetic coding sequence
atggccccacggagcctgctgctgttgctgagcggcgcacttgccctaactgatacttgggccgggagccacagcctgagatatttttccactgctgtttcaaggcccggacgtggggaaccacgctacatagccgtcgagtacgtagacgacacccaatttctccgctttgacagtgatgcagcgatcccccggatggaaccccgggagccctgggtggagcaggagggtccccaatactgggaatggaccaccggttacgcaaaggcaaacgctcagacagacagggtggccttacgaaaccttctgaggcgctataaccagtctgaggctggcagccacacactacaaggcatgaatggctgcgacatgggtcccgatggcagactgctccgcggctaccatcagcacgcatatgacggtaaggattacatttcgcttaatgaagacctgaggtcctggacggctgcggacacagtggctcagataacccagagattctatgaagctgaggagtacgctgaggagttccggacctacctggaaggtgaatgtctggagctactgcggagatacctggagaacggcaaagaaactttgcagagagcagatccacccaaggctcatgtcgctcatcatcccattagcgatcatgaggcaacccttcggtgctgggccctggggttctaccccgcagaaatcactttaacttggcagcgagacggggaggaacagacccaggacactgagctcgttgagacgaggccagccggagatggcacttttcagaagtgggcagcagtcgttgtcccctcaggggaggagcagcgttatacttgccatgtgcagcatgaaggcttacctcagcccctgatccttcgatgggaacagtctccacaacccacaattccaattgttggcattgtcgctggtctggtagtgctgggggccgttgtgacaggagctgtggtggccgcagtgatgtggaggaagaaatcatccgaccggaaccgaggttcatactctcaggctgccgtctag

SEQ ID NO: 27387 - DNA, 780 bp, Artificial Sequence
  Description of Artificial Sequence: Synthetic coding sequence
atgaatggctgcgatatgggccccgatggacgcctccttcgcgggtatcaccagcacgcttatgatgggaaagattacatttcccttaacgaagacctcaggagctggactgccgccgacactgtagctcagattacccagcggttctacgaagccgaagagtacgctgaggagttccgtacatatttagaaggtgagtgcctggaactcttgcgtagatatttggagaacgggaaagagactttgcagcgcgcagatcctcccaaagcccatgtggctcaccatccaatctccgatcatgaggctacccttaggtgctgggcactcggtttctaccccgccgaaattacacttacctggcaaagggatggggaagagcagacacaagacacagagctggttgagaccagacctgcaggcgacggtactttccagaagtgggccgccgtggtggtgcccagcggggaggagcagcggtatacctgccacgttcagcacgaaggtctccctcagccccttatactgcgctgggaacagtctccccaacccaccattcctattgtcggaattgtggcgggcttggtcgtgctgggggccgtggttaccggcgcggtagtcgctgccgtcatgtggcgtaaaaaatccagcgcgtacagtgtggttagcggcaacttaatgataacgtggtggtcttccctttttttgcttggggtgctgttccaaggctatctagggtgtctgcgtagccactccgtactgggtagaagaaaacatttctag

SEQ ID NO: 27388 - DNA, 1041 bp, Artificial Sequence
  Description of Artificial Sequence: Synthetic coding sequence
atggccccacggagcctgctcctgttgctgtcaggcgccttggcactgacagatacctgggcgggcagccatagtctgcggtatttctctacggcagtgagtcgcccagggaggggcgaaccaagatacatcgccgttgaatacgtggatgacactcagtttctccgatttgatagcgatgctgcaatcccacggatggagccccgcgaaccttgggtggagcaggagggacctcagtactgggagtggaccacaggctatgcaaaggccaacgcccagaccgatcgtgtcgccctcaggaatctacttaggcgatacaaccagtcagaggccgggagccatacactgcaaggaatgaacggctgcgatatggggcccgacggaaggttattacgggggtaccatcagcacgcgtacgacggtaaggattacatttctctgaatgaggatctgaggagctggactgctgccgacactgtggcccaaatcacacaaagattttacgaggcagaggagtacgctgaggaatttcgaacctatctggaaggggaatgcctcgaactactgcgacgatacttggaaaatgggaaggagaccctacagcgggccgatccaccaaaggctcatgtggcacaccacccgatatctgaccacgaagccactctgcgttgctgggcgcttggattctacccggctgaaatcactttgacttggcagcgcgatggcgaggaacagacacaggacaccgaattagtggagacccggcccgcaggcgatgggacctttcagaagtgggctgccgtcgtcgtgccctccggagaagaacagaggtacacctgccacgtccaacacgaaggtctcccacagccactgatcctgagatgggagcagagtccccaacctaccataccaatagtgggaattgttgccgggctggtcgttctcggcgcagtcgtcactggagccgtggtagccgcagttatgtggcggaagaagtcgtccgaccgaaaccgaggctcctactcccaagccgcagtgtag

SEQ ID NO: 27389 - DNA, 1050 bp, Artificial Sequence
  Description of Artificial Sequence: Synthetic coding sequence
atggcacctcgaagcctgcttctgctcctctccggcgctctggcccttacagacacctgggccggctcccactcactgagatatttcagtaccgccgttagcaggccaggacggggagagcctagatacattgcagtcgaatacgttgacgacacacagtttctgcggttcgactctgatgcagcgatcccgagaatggagcccagggagccctgggtggaacaggaggggcctcagtattgggaatggacaactggttacgcaaaggctaacgcacagaccgatcgggtggcgctgcgtaacctgctacgccgttacctggaaaacggaaaggagaccctgcagcgggctgacccacccaaggcccatgtggcacaccatcctatatctgatcacgaggcaaccctgcgttgctgggccctaggtttctatccagccgagataaccctgacttggcagagggatggcgaagagcaaacccaggacacagagttggttgaaaccagaccggccggagatggcacgttccagaagtgggccgccgtggtggtgccgagtggcgaagagcagcgatacacttgccatgtccagcatgagggcctgccccagccactaatattgagatgggaacaatcaccacagcctaccatccctattgtaggtattgtggccgggcttgtagtactcggggctgtcgtcacgggagccgtggtggctgctgtgatgtggaggaaaaaaagcagtgacaggaatcgcggatcttactcacaggcggctgcctatagcgtagtttctggaaaccttatgataacctggtggagtagcctgttcctgctaggcgtgctgtttcagggctacttggggtgtctacgatcccacagtgtgctgggaaggaggaaggctcaactgctttctgtttccacaagccagacctccatcttgatccaggaacagttctcacatcagcgcaccctggcaatgtcagggaaaatgttctgttgccatgattggtccgaggaggaagttctgccagcaagctgcggcgagtag

SEQ ID NO: 27390 - DNA, 1260 bp, Artificial Sequence
  Description of Artificial Sequence: Synthetic coding sequence
atggcgccgaggagcctgcttctgctgctgtcaggagccctcgcactgaccgacacatgggcaggaagccacagtttacggtatttctcaacagctgtcagtagacctgggcgcggggagccaaggtatattgccgttgagccatgggtagaacaggaaggaccccagtactgggagtggactactgggtatgcgaaagctaatgctcagaccgacagagttgcccttaggaaccttctgcgccgctataatcagtccgaagctggatcccatactctccagggaatgaacggttgtgatatgggacccgacggacgtctgcttagaggctaccaccagcacgcatacgacggcaaggattacatcagcctcaacgaggacctgagatcttggacagccgccgacacagtggcccagatcacacagaggttctatgaggcggaagagtacgctgaggagtttcggacttatctcgaaggcgaatgcttagagttgctgcgccggtacctggagaatggaaaagaaaccctgcagcgcgctgatcctccaaaagctcatgtcgctcaccacccaatttcggaccatgaagcaacactaagatgctgggctctgggattctaccctgccgaaattaccttgacttggcagagagatggggaggagcagactcaggacacagagctggtggaaacccggccggcgggagacggcactttccaaaagtgggccgctgtcgttgtgccctcgggggaggaacagaggtacacatgtcacgttcagcacgagggcctgccgcagccgctcattcttcgctgggagcagtcaccccagccaaccatcccaatcgtggggatcgtggcagggttggtggtgcttggcgccgtggtgactggagctgtggtcgctgccgttatgtggaggaaaaagagttcagatcggaaccgggggtcttattcccaggcggcagcatatagcgtcgtttccgggaacctgatgattacttggtggtcctcactttttcttctgggggtgttgttccaggggtacctgggctgcctcagaagccactcggtgcttgggaggcgtaaagtcggggacatgtggattctgttcttcttgtggctctggacgtcattcaacacggccttcctggccttacagagcttacgatttggattcgggttccgccgaggtaggtctttcctcctgaggagctggcaccacctaatgaagcgagttcaaattaagatatttgattag

SEQ ID NO: 27391 - DNA, 780 bp, Artificial Sequence
  Description of Artificial Sequence: Synthetic coding sequence
atgaacggctgcgatatgggacctgacgggcgcctcttgcgaggataccaccagcacgcctacgacggcaaagattatatatccctaaacgaagacctccgaagctggaccgctgctgacacagtcgcccagatcactcaaaggttctatgaggctgaagaatacgccgaggagttcaggacctatttggagggtgaatgtctggaactgctgcggcgatacctagaaaatgggaaggaaacactgcagcgggccgatcccccaaaggctcacgtggctcatcaccccatctccgatcatgaagcgacactgagatgctgggcccttggtttctatcccgccgaaattaccctgacctggcaaagggatggggaggagcagactcaagacactgaactcgtagagaccagacctgcgggcgacggtacatttcagaagtgggccgcggtggtggtgccttccggggaggaacagaggtacacttgccatgtgcagcacgaggggctgcctcagcccctaattctgcgctgggaacaaagtccccagcctacaatccccattgtgggtattgttgcagggttggtggtgctgggggcagtggttacgggcgctgtggttgccgcggtgatgtggagaaaaaagtcttctgcgtacagcgttgtgtctggaaatttaatgatcacatggtggtccagcctattcttgctcggcgtgttattccagggatacctcggatgtctccgtagtcattctgttctcgggcgacgaaagcatttttag

SEQ ID NO: 27392 - DNA, 1260 bp, Artificial Sequence
  Description of Artificial Sequence: Synthetic coding sequence
atggcaccccgatctctcctgttgctgttaagcggcgccctagctctgaccgatacctgggctggcagccattcgctgaggtatttcagcaccgccgtgagtagaccgggacgtggtgagcccaggtatatcgccgtggaaccatgggtagaacaagaaggtccacagtattgggagtggactaccgggtacgcgaaggcgaatgcccagacggatagagttgctctccgcaatctactccgaaggtacaaccagagcgaggccggtagccacacgctccagggcatgaacgggtgcgatatgggccctgatgggagacttttacgcggttatcatcaacacgcctatgatgggaaagattacatctccctcaacgaagacttgcgttcctggacagccgccgacacagtggctcagatcacacagaggttttacgaggcggaggagtatgccgaagaattccggacctaccttgagggagagtgcttggaactgctcagacggtatcttgaaaacggaaaagaaacactgcaacgcgccgacccacctaaagcacacgttgctcaccaccctatctctgatcacgaggcaacactcaggtgttgggctctgggcttctaccctgcagaaatcacgctgacatggcagagggacggggaggaacaaacccaggacacggagcttgtggaaacccggcccgccggagacggcaccttccaaaaatgggcggccgtggtcgtgccgtcaggtgaggagcagagatacacctgccatgtgcagcacgaaggcctgcctcagccgctgatcctgcgttgggagcagagcccacaaccaactattccaatcgtgggcatcgtagctggcctcgttgtacttggagctgtggtgacaggcgctgtcgtcgcagccgtgatgtggcggaaaaaaagcagcgatcgtaatcgagggtcttattcccaggccgccgcatattcagttgtcagcggtaatcttatgattacatggtggtcatccctctttttattaggcgtgctgtttcagggctatctgggctgtctgaggtctcatagtgtccttggaaggcgtaaggtgggagacatgtggatcctgtttttcctctggttatggacaagttttaacaccgcttttctggccctgcagtctctgcgcttcggatttggcttccgtaggggaagatccttcttgctccgttcatggcaccatctgatgaaaagagttcagattaaaatctttgactag

SEQ ID NO: 27393 - DNA, 1041 bp, Artificial Sequence
  Description of Artificial Sequence: Synthetic coding sequence
atggccccaaggtcactcctgttattgctctccggagcgctggcactaacagatacatgggccgggagtcactcactaaggtactttagtacggccgttagtcgtcccgggcgtggggaaccccggtatattgccgttgagtatgtcgacgatactcaattcctgaggtttgattccgacgcagccattcccagaatggaaccccgggagccctgggtcgaacaggagggtccccaatattgggagtggaccactgggtacgccaaagcgaacgcccagacagaccgcgttgctttgcggaacctgctacgcaggtataatcaaagcgaagccggaagccacacactacaaggcatgaacggttgcgatatgggccccgacggccgactcctgcgtggctaccaccagcacgcttacgatggcaaagactacatatctctcaacgaggatttgcgaagttggacggctgcagatactgtggcacaaatcactcagagattctatgaggctgaagagtacgccgaggaattccggacctacctcgaaggtgagtgtctcgaattattgagacgctatttggaaaatgggaaagagaccctccagagagcggaccccccgaaggctcatgtcgctcaccatccaatttctgaccatgaggccaccctgcgatgctgggctctgggtttctatccagccgaaattactctgacctggcagcgcgacggagaagagcagacacaggataccgagttggtggaaaccaggcctgccggggacggaacgtttcaaaaatgggccgccgtagtcgtgcctagtggtgaggagcagcgatatacctgtcacgtacagcatgagggcttaccccagccactcatcctgcgttgggaacagtccccacagccaaccattccgattgtgggcatagtagcagggctcgtcgtgctgggggcagtagtcaccggggccgtggtggcagccgtcatgtggcggaaaaaatcatctgatagaaacaggggctcctactcgcaggcggcagtctag

SEQ ID NO: 27394 - DNA, 1041 bp, Artificial Sequence
  Description of Artificial Sequence: Synthetic coding sequence
atggccccacgttctctgctgcttctgctcagtggagccctggctcttacagatacttgggctgggtcccattctctcagatactttagtaccgcagtgtctcgcccaggcagaggcgaaccgaggtacatcgcagtagagtatgtggatgacactcagtttttaagattcgacagcgacgcagcaatcccacgcatggagccgagagagccatgggtggaacaggagggaccccagtactgggagtggactactgggtatgccaaggcaaacgcacagactgatagagtagctctgaggaatctcctccgaagatataatcaatcagaggccgggagccacacactccaagggatgaacgggtgtgatatgggaccagacggcagactgctcagagggtatcaccaacacgcctacgatggcaaagactatatatctttgaatgaggaccttcgatcctggacagccgcggacacggtagcacagatcacgcagcgcttttatgaagccgaagagtatgcagaggagttccgcacgtacctcgagggggagtgtctagagctactccgcaggtatcttgagaatgggaaggagaccctacagagggccgacccccctaaggctcacgtggctcaccaccccatctccgaccacgaggctacccttaggtgctgggcacttggattttacccagccgagattacacttacttggcagcgagacggtgaagagcagacgcaggacaccgagctcgtcgaaacccggccagccggtgacggaactttccaaaaatgggcagctgtggtagtgccaagtggggaagagcagagatatacctgccacgtgcaacacgagggcctcccccaaccactaatactcagatgggaacagagcccccagcctaccatccctatcgttggtattgtggcaggcctggtggtccttggcgctgtggttaccggagctgtggtagctgcggtgatgtggcggaagaagtcttctgatcgtaacaggggcagctattcccaggctgccgtgtag

SEQ ID NO: 27395 - DNA, 1017 bp, Artificial Sequence
  Description of Artificial Sequence: Synthetic coding sequence
atggcaccccgcagcttgctgctgctcctgtccggagctttagccttaaccgacacttgggccggctcccacagcctccgatactttagtacggccgtttcaagacccgggcgcggggagccccgctatatagcagtggagtatgtggatgacacgcagttcctcagattcgactctgacgccgcaatacccaggatggaacctagagagccctgggtggagcaggagggtcctcagtattgggaatggacgaccggatacgccaaagccaacgcccagaccgatcgagtggctctccggaatttgctaagacggtacaatcagagtgaggcagggagccacaccttgcagggtatgaacgggtgcgacatgggtcctgacggacgacttcttagagggtatcatcagcacgcctatgatgggaaggactacatatccttgaacgaggatctgcgtagctggacagccgcagataccgtggcacagattacccagcggttttacgaagccgaggagtatgccgaagaattcaggacttatctggagggggaatgcctcgagctgctgcgccggtacctcgagaacggcaaggagacccttcagagagctgacccacctaaggcgcacgtggcgcaccaccccattagcgatcacgaagcaacccttcgctgctgggccctgggattctacccggcggagattacactgacgtggcagcgggacggcgaggagcaaacacaggataccgaacttgtggaaaccaggccagccggggacggcaccttccagaagtgggcggccgtggtggttccttctggcgaggaacagagatacacatgccatgtgcagcatgagggtctcccacagcccttaattttacggtgggaacagagcccgcaacccactattcccattgtcggcatcgtggcggggttagtggtattgggagcggtggtcactggagctgtggtggccgcagtgatgtggcggaagaaatccagcggtcgaaagggctag

SEQ ID NO: 27396 - DNA, 1260 bp, Artificial Sequence
  Description of Artificial Sequence: Synthetic coding sequence
atggccccccgttctttgctgctcctcctcagtggggctcttgctctgacagatacttgggcgggtagccattcacttagatatttttccactgcggtgagtcggccggggagaggagagccaagatatattgccgtggaaccatgggtggagcaggagggtccccagtattgggaatggacgactggctacgctaaagctaatgcccagactgacagagtggccttacggaacctgctgcggagatacaaccaaagtgaggctggatcccacacacttcaaggaatgaatgggtgtgatatgggcccagatggtcggttgctgagaggttaccatcagcacgcctatgacggaaaagactatattagcctcaatgaggacctccgtagttggactgccgctgataccgtggctcagatcacacaacgtttttacgaggccgaggagtatgccgaggagtttcgtacatatttggagggagagtgtctggagctcctgcggaggtatttggagaatgggaaggagaccttacagcgtgcagacccacctaaagcacatgtggcccaccatcccatttccgatcatgaggccaccttgagatgctgggccttgggcttctatccagcggagatcactctgacttggcagcgcgacggagaggagcagacgcaagacaccgagctagtggagaccagaccagctggcgacggaacgttccagaaatgggccgcagtggtcgtgcctagtggcgaggagcaaaggtatacctgtcacgtccagcatgagggtctgccgcagcctctgatcttgaggtgggaacagtccccccagcccactattcccatcgtggggatcgttgcagggttggtggtcctgggggctgtcgtaaccggtgccgtggttgctgctgtaatgtggcgcaagaaatcctcagaccggaatcgggggtcatactcccaggctgccgcgtatagcgtagttagcgggctgttgatgatcacctggtggagttccttgtttttgctcggggtgctgtttcagggatatctgggctgcctgcggtcccactctgtcctggggaggagaaaagtgggcgatatgtggatcctgttctttctgtggctgtggacttcattcaacacagcgttcttggccctacagtccttaaggtttggcttcggctttagaaggggacggagcttcctgcttagatcatggcaccacttgatgaagcgagtgcaaataaaaatttttgattag

SEQ ID NO: 27397 - DNA, 1017 bp, Artificial Sequence
  Description of Artificial Sequence: Synthetic coding sequence
atggtcgttatggcccctaggactctttttctccttctttctggggccctgacattgactgaaacttgggctggaagtcatagcatgcggtacttctccgcagctgtctcccgccccggccgaggggagcctagattcattgccatggggtatgttgatgacacacagttcgtccgcttcgacagcgactctgcttgccctcgtatggaaccccgggctccctgggtggagcaggaggggcccgagtattgggaggaagaaacacgcaacaccaaggcccacgcgcaaacggaccgcatgaatctgcagaccctccgtgggtactataaccagtctgaagcaagctcgcacaccctccagtggatgatcggatgtgaccttggctcggatggtcggctgctacgaggctacgaacaatacgcttacgacggtaaggattacctggccctgaatgaagacctacgaagttggaccgccgccgataccgctgcgcagatctcaaagaggaagtgcgaggctgccaacgtcgcagagcaaaggcgggcctatctggaggggacttgcgtcgagtggctgcatagatacctcgagaacggcaaggaaatgctccagcgggccgaccccccgaagacgcatgtcactcaccacccagtcttcgattatgaggcgacgctgcgctgttgggctctgggattttaccctgctgagatcattctgacgtggcaaagggatggagaggaccagactcaggatgtggaactcgttgaaaccaggccggcaggagatggcacctttcagaaatgggctgccgtcgtcgtaccaagtggtgaggaacagcgttacacatgccacgtacaacatgagggacttcccgaaccccttatgctgcggtggaaacaatcctccctgccgaccattcccatcatgggaattgtggctggattagttgtgctcgcagccgtggttaccggtgccgcggtggctgccgttctctggagaaaaaagagcagtgattag

SEQ ID NO: 27398 - DNA, 465 bp, Artificial Sequence
  Description of Artificial Sequence: Synthetic coding sequence
atggtcgttatggcgccacggaccctctttctgctcctttccggagccctaactttaactgagacatgggctggatcccatagcatgagatacttctctgccgctgtgagcaggcccgggaggggggagccaagatttatcgcaatgggatatgtggatgatacccagttcgtacgctttgacagcgacagtgcctgtcctaggatggaaccccgagccccgtgggtggaacaggaagggccagagtattgggaggaagaaaccaggaatactaaagcccatgctcaaaccgatagaatgaacctgcagaccctcagaggctactataaccaatcagaagcaaaacagtcatctcttcccacaatccctattatgggcattgtagctggtttggttgtcctggccgctgttgtcacaggggccgctgtggccgcggtcctatggaggaagaagtctagcgattag

SEQ ID NO: 27399 - DNA, 741 bp, Artificial Sequence
  Description of Artificial Sequence: Synthetic coding sequence
atggtggttatggccccacgcacccttttcctgctgctgagtggggccttaacattgaccgaaacctgggccggttcgcatagcatgagatacttttccgccgccgtcagtaggcctggcagaggtgagccacgctttatcgcaatggggtatgttgacgacacacaatttgttcgattcgatagcgattctgcgtgtcctcgaatggagccacgcgcaccttgggttgagcaagagggcccagagtattgggaggaggaaacccgcaataccaaggcccacgcacaaacagacagaatgaacctgcaaactttacgaggatattacaatcaatctgaagccaatccccccaagacccatgtgacccaccacccggtgttcgattacgaggctacactccgttgttgggcactgggcttttaccctgctgaaatcatcttgacatggcaacgggacggcgaggaccagacccaggatgttgaactcgtggaaacacggcctgcgggtgacggaacttttcaaaagtgggctgccgtcgtggtcccttctggcgaggaacagagatacacgtgccacgtacagcacgaaggccttcccgaaccactcatgctgaggtggaaacagtcttccctgcccaccatcccaatcatgggaatcgtggcagggctggtagtcctggctgccgtcgttaccggcgcggctgtggccgcggtgctgtggcgaaaaaaaagctcggattag

SEQ ID NO: 27400 - DNA, 1032 bp, Artificial Sequence
  Description of Artificial Sequence: Synthetic coding sequence
atgaaaactcctcgcatggtcgttatggcgccccggaccttattcctgctgctgagtggagcactgacactgaccgaaacctgggcagggtcccacagcatgcgctatttcagcgctgccgtcagtcggcctgggcggggagagcctagatttattgccatgggctacgtcgacgacacccagttcgtacggtttgactcggattccgcctgccctagaatggaacccagagcaccttgggtcgaacaggagggtcctgagtattgggaagaggaaaccaggaatacaaaagcacacgcccaaacagatcgaatgaacctccagactctccgcggctattataaccagagtgaggcaagctcccacacactacagtggatgatcggctgtgatctggggagcgatggacgcctgctccgcgggtatgagcagtatgcctatgatgggaaggattacctcgcactcaatgaggacctcaggtcttggacagctgcggacacggccgcccagatctccaagcgtaagtgcgaagccgcaaatgtggccgagcagaggagggcttacctcgagggcacctgcgtggaatggctgcatcgttatctggagaacggcaaagagatgctgcagcgtgcagatccacccaagacgcacgtgactcaccaccccgtcttcgactacgaggcaacgctgcgctgctgggccctcgggttttacccggctgagattattttaacgtggcagcgggatggggaagaccaaacgcaagatgtcgaactggtcgaaacgcgcccggctggcgacggcacctttcagaaatgggctgcagtcgtagtaccctccggagaggagcaacggtacacatgccacgtgcagcacgaggggttaccagagcccttgatgctgagatggaaacaatcaagtcttcctacaatcccgattatgggcatcgtcgctggattggtcgtccttgccgcggtggttaccggagccgcagtggccgccgtgctgtggaggaagaagagctctgattag

SEQ ID NO: 27401 - DNA, 1017 bp, Artificial Sequence
  Description of Artificial Sequence: Synthetic coding sequence
atggtcgttatggcccctcgaacactcttcctcctactctccggggccctgactctgaccgaaacttgggccggctctcacagcatgagatatttctccgcagctgtgtccagacctgggcggggggaacctcgtttcattgccatgggctatgtagacgatactcagttcgtacgatttgacagcgattctgcttgtcctcgcatggagccccgggctccttgggtggaacaagagggaccggaatactgggaggaagagacaaggaataccaaggcgcacgctcagaccgataggatgaatcttcagacactgagaggctattataaccagtcggaagccagctcccacactctccagtggatgatcgggtgtgatctcggtagtgacggcaggctactgcggggctatgagcagtacgcctacgacggcaaagactacctggcattgaacgaagacctcaggagctggaccgcagccgacactgccgcgcaaatttccaaacggaagtgtgaagccgctaatgtcgccgagcagcgtagggcatatctcgaggggacatgtgtggagtggctgcatcgctacttggaaaatggaaaggaaatgcttcagagagctgatccacccaaaactcacgtgacccaccatccagtgttcgactatgaagccaccctgcggtgctgggccttgggtttctatccagccgagattatcctgacatggcagcgtgacggtgaggaccagactcaggacgttgagctggttgaaacacggcccgcaggcgacgggacattccagaagtgggcagcagtcgtcgttcctagtggtgaagaacaacgttatacttgtcatgtgcagcatgagggcttgcccgagcccctgatgctccggtggaagcagagctccttgcccactatacctattatgggaatcgtggctggactcgtggtactggcagccgtggtcaccggcgcagctgtggccgccgtcctgtggcggaagaagtcctcagattag

SEQ ID NO: 27402 - DNA, 465 bp, Artificial Sequence
  Description of Artificial Sequence: Synthetic coding sequence
atggtggtgatggcccctagaaccctgtttctgctgctctcaggagccctgactctgacagagacatgggccggatcccatagcatgaggtacttctccgccgctgtgagcaggcctggacgcggtgagcctcgatttatcgccatgggctacgtggatgacacccagttcgtgaggttcgactcagattctgcttgcccgagaatggaacctcgggctccatgggtcgagcaggaaggccctgaatattgggaggaggaaacacgaaacacaaaggcccacgctcaaactgaccgcatgaacttgcagacactgcgaggatattataaccaaagtgaggcaaagcaatctagccttccgacaatccccattatggggattgtcgcaggattggtagtgttggccgctgtggtcacgggtgcagccgttgcggccgtgctgtggagaaaaaaaagtagcgactag

SEQ ID NO: 27403 - DNA, 741 bp, Artificial Sequence
  Description of Artificial Sequence: Synthetic coding sequence
atggttgttatggccccgaggaccctgttccttctgctgagcggtgcacttactctcaccgaaacatgggccggtagtcattccatgcgatacttcagcgcggctgtctcacggccagggagaggggagccacggtttatagcaatgggatatgtggatgacacccagttcgtacgattcgactcagactccgcatgtcctcgtatggaacctcgcgctccttgggtggagcaggaaggccccgagtattgggaagaggagacccgtaacaccaaagctcacgcccagacagatcggatgaatttgcaaacgctgcgaggctactataatcagagtgaagccaacccgcccaagacccacgtaactcatcatccagtgtttgactacgaggctactctgcgctgctgggcactgggattttatccagccgaaataatcctaacatggcagcgagatggcgaagatcagacccaggatgtcgagttagtagagacgcgaccagccggggatgggacgtttcaaaagtgggccgccgtagtcgtgccatctggggaggagcaacgatatacctgccatgtgcagcacgaaggactgcccgaaccgttgatgctccgctggaaacaatccagcctgccaaccatcccaataatggggatcgttgctggattggtcgtcctggcagcagttgtgactggggctgcggtggctgctgtgctgtggcgaaagaaatcctcagattag

SEQ ID NO: 27404 - DNA, 1032 bp, Artificial Sequence
  Description of Artificial Sequence: Synthetic coding sequence
atgaagacgccacgcatggtggttatggccccgcgtaccctatttctattactgtcaggtgcccttacgttgacggaaacttgggccggatcccatagcatgagatacttctctgctgcagtgagcagacctgggagaggcgaacccagatttatcgccatgggttatgtggacgacacgcagtttgtgagattcgatagtgatagtgcttgccctcggatggaacctcgcgctccgtgggtggaacaggagggacccgagtactgggaggaagaaaccagaaatacaaaggctcatgctcagacggacagaatgaacctgcagactctgcggggttactacaaccagtcagaggcgtcgagtcacacactgcagtggatgattggctgtgacctgggcagtgatggcagactcctgcgcggctatgagcagtatgcatacgacggcaaggattacctggccctgaacgaggatcttcggtcatggacagccgcagacaccgcggcccagatctctaagcggaaatgcgaagccgctaacgtggcggaacagaggcgcgcatatctggaaggaacctgtgtggagtggttgcatcggtatttggagaatggcaaagagatgttgcaaagagccgatcccccgaagactcatgtgactcaccacccggtgtttgactacgaggctaccctgcggtgttgggcactcggcttctaccccgctgaaatcatactgacttggcagagagacggagaagaccagacccaggatgtggagctcgtggagaccagacccgctggcgatggtacatttcagaaatgggcggctgtcgttgtgcctagcggtgaggagcagagatatacatgccatgtgcagcacgagggattgcctgagcctctgatgctgaggtggaagcagtcgtctctacctaccatcccgattatgggcatcgtagctggccttgtcgtcttagctgcagtagtcactggggcagccgtcgccgcagtactgtggaggaaaaagtcttcggactag

SEQ ID NO: 27405 - DNA, 1032 bp, Artificial Sequence
  Description of Artificial Sequence: Synthetic coding sequence
atgaaaacaccgaggatggttgtgatggccccgaggaccctgttcttgctgttgtcaggagcactgacattgacagagacatgggctggatctcatagtatgcggtacttttctgctgctgtcagccgtccaggacgaggggagccccggttcatcgccatggggtacgttgacgatacacagtttgtgcgattcgactctgacagtgcatgcccccgaatggagccgcgcgcgccttgggtggagcaggaggggcccgaatactgggaagaggagaccaggaataccaaggcccacgcccagactgaccgcatgaacttacagactttgcggggctactacaaccaaagtgaggcctctagtcatacacttcagtggatgatcggatgtgacctgggatccgacggaaggctgttgagaggctatgaacaatacgcatacgacggcaaggattatttagctctgaatgaagacctcagatcatggaccgccgccgatacggccgctcagatcagcaagcgtaagtgcgaagccgcgaatgtcgctgaacagcggagggcctatctggaggggacttgcgtagagtggctccatcgctacctggagaatgggaaagaaatgctgcagcgggccgatccaccaaagactcatgtgacacatcacccagtctttgattacgaggccacactgcgttgctgggccctgggattttacccagccgagatcatattgacatggcagcgcgatggcgaagaccagacacaagatgtcgagttggttgagacgagacccgccggcgacggcactttccagaaatgggccgcagtggtagtgccttctggagaggaacagaggtacacctgccacgtgcagcacgaggggctgccggaaccactcatgctccgctggaagcaaagtagcctccctacaatacctatcatgggcatcgtcgcaggtctggtcgtgctggccgcagtggtaactggagccgcagtggcggctgtgctgtggaggaaaaaatctagcgattag

SEQ ID NO: 27406 - DNA, 741 bp, Artificial Sequence
  Description of Artificial Sequence: Synthetic coding sequence
atggtagttatggctccaagaactttgtttctgctgctcagcggagcactgaccctgacagagacctgggccggcagtcattctatgcgctacttctctgctgccgtgagtagacctggccgtggagagccaaggttcatcgccatgggctatgtggacgacacacagttcgtgcggttcgatagcgactcagcctgccctaggatggaaccgagagcaccctgggttgagcaggaggggccggaatactgggaagaggagacccggaatacaaaggcccacgcccaaaccgacaggatgaacttgcaaacgctcagaggctactacaatcagagcgaggccaaccccccaaaaacgcatgttacgcatcaccctgtgtttgactatgaggccacgttgagatgctgggcactcggtttctatccagcagagattatattgacctggcagagggacggggaagaccagacgcaggatgtggaattggtcgagaccaggcctgcaggcgacggtacctttcagaagtgggccgccgtcgtggtcccctcaggcgaagagcagcggtacacgtgtcacgtgcaacatgaagggctgcccgaacctttgatgctaaggtggaaacagtcatctctacctacgatcccaattatgggcatcgtggccgggctggtcgtgctggccgctgtcgtgaccggcgctgccgtagcggcagtgctctggcgcaagaaatcctcagattag

SEQ ID NO: 27407 - DNA, 465 bp, Artificial Sequence
  Description of Artificial Sequence: Synthetic coding sequence
atggtggttatggctccccgaacgctctttttgctactctcaggagccctgactctcaccgagacctgggctgggtcccatagcatgcgttacttcagcgcagccgtctcccgccctggcagaggggaacccagatttattgctatgggatatgtcgacgacacacagttcgttcggttcgattccgacagcgcgtgccccaggatggaaccgagggccccctgggttgagcaggagggtccagaatattgggaagaagagacacgcaatacaaaagcccacgcacagaccgacaggatgaacctgcagactctccgcggatactacaatcaaagtgaggccaagcagtcctcacttcccaccataccaattatgggcattgtggctgggctggtggtgctcgcggccgtcgtgaccggagccgccgtcgccgccgtcctgtggcgtaagaagtcgtctgattag

SEQ ID NO: 27408 - DNA, 1032 bp, Artificial Sequence
  Description of Artificial Sequence: Synthetic coding sequence
atgaagacaccgcgaatggtggttatggctccaagaaccttgttcctgttgttatccggcgccctgacgttaaccgagacctgggctggcagtcacagcatgaggtacttctccgccgccgtgtcccgacccggcaggggagaacctagatttatcgcgatgggttatgtggatgacactcaatttgttcgatttgacagcgattcagcatgtccccggatggaaccaagagccccgtgggtggagcaggaaggccccgaatactgggaggaagagactcgaaataccaaggctcacgcacaaacagacagaatgaatctgcaaacgctccgtggctactacaatcagtccgaggcatcatctcacacgttgcaatggatgatcgggtgtgacctggggagcgatggtaggcttcttaggggctatgagcagtatgcctacgacgggaaggattacctagcattgaacgaggacttgcgctcctggaccgctgcagacaccgccgcccagattagcaagaggaaatgtgaagccgccaatgtggccgagcagcggagagcttatttggaaggaacctgtgtggagtggctgcacaggtacctcgagaacggcaaggaaatgctgcagcgggcggaccccccgaagacacacgtcacacaccaccctgtgtttgactatgaagctaccctgcggtgttgggccttaggtttctatcctgcagagatcatcctgacctggcagcgtgatggcgaagaccagacccaggacgtcgagcttgtcgagaccaggcccgcgggggacgggacttttcagaaatgggccgctgtagtcgtaccgagtggtgaggaacagcgctatacatgccatgtgcagcacgaagggttgcctgaacccctgatgctgcgttggaaacagagcagcctgcccacgatccctatcatgggcatagttgcagggctcgtggtgctcgctgcagtcgtgacaggcgccgccgtcgcagccgtgctttggcggaagaaatcttccgattag

SEQ ID NO: 27409 - DNA, 1032 bp, Artificial Sequence
  Description of Artificial Sequence: Synthetic coding sequence
atgaaaacccctcgcatggtggtaatggcacccagaaccttattcttactgctgtccggagccctaacactgaccgaaacatgggccggaagccacagtatgcgttatttctcggcagctgtctcaaggcccggacgtggtgaaccacggtttatagccatgggatacgtggacgatactcagttcgtgaggtttgacagcgattccgcttgccctagaatggaaccgagggctccttgggtagagcaggagggacccgaatactgggaagaagaaactcggaacacaaaggcacatgcacagactgacagaatgaacctacaaacactcaggggttattacaaccagagcgaagcatccagccatacgctgcagtggatgattggctgcgatctagggtctgacggcaggctactccggggctacgagcagtacgcatacgacggaaaagactatttagctctgaatgaagatctccggtcttggactgccgccgatacagccgcgcaaatcagcaagcgcaagtgcgaggccgccaacgtagctgagcagagacgcgcctatctcgaaggcacctgcgtggagtggctgcaccggtatttagaaaacggcaaggagatgctgcagcgagccgatccgccgaagactcatgtgacacaccatccagtgtttgattatgaagccacgctccggtgctgggccctaggattctacccggctgaaatcatcctaacctggcagcgcgacggggaagatcagacccaagacgtggagttggttgagactagacctgcaggagatgggacctttcaaaaatgggccgccgtggtggtgcccagtggggaggagcagagatacacatgtcacgtccagcacgaagggctgcctgagccattgatgttgcgttggaagcagtcaagtctgcctaccatccctattatgggtattgtcgccgggttggtcgtcctggccgccgtggtgacaggtgccgcagtggcggccgtcctctggcgtaagaagtcttcggattag

SEQ ID NO: 27410 - DNA, 1017 bp, Artificial Sequence
  Description of Artificial Sequence: Synthetic coding sequence
atggtggtgatggcccctcggaccttattcctccttctctccggggccctgactctcaccgagacatgggctgggtcacactcaatgcggtactttagcgcagcagtgtctcgcccaggcaggggagagccccggttcatcgctatggggtacgttgatgacacacagttcgtgaggtttgattctgattctgcatgcccacgcatggaacctagagccccctgggtggaacaggaagggcctgagtactgggaagaggagactcgcaataccaaagcacacgcccaaaccgataggatgaatctgcagacgctaaggggctactacaaccagagcgaggcttccagtcacactctacagtggatgatcggctgcgacctgggctccgacgggcggctcctccgcgggtacgagcaatatgcctatgacggaaaggactacctggctctcaatgaggatctccggtcttggaccgctgctgatactgccgcacaaatttccaaaaggaagtgcgaagctgcgaatgtagccgagcagcggcgcgcatacctcgagggaacctgcgtggaatggttgcaccggtaccttgaaaacggaaaagaaatgctgcaacgggccgatccgcctaagactcacgtgacgcaccatccagtattcgactatgaggcaactctacgctgctgggcactgggcttctacccagccgagataatcttgacatggcagcgcgatggtgaggaccagacacaggacgttgagctcgttgagaccagaccagccggcgatgggactttccagaagtgggcagccgttgtggtaccgtctggtgaagagcagaggtacacatgtcacgtgcagcatgaaggactaccggagccgctgatgttaaggtggaaacaaagcagcctacctactattcccatcatgggcattgtggccggtttggtggtcttggccgcagtagtcaccggtgcagccgtagcggctgttctgtggaggaagaaatccagtgattag

SEQ ID NO: 27411 - DNA, 1017 bp, Artificial Sequence
  Description of Artificial Sequence: Synthetic coding sequence
atggtcgtaatggcccctagaacgctgttcctgctgctcagtggggcactgacacttaccgaaacgtgggccggatcccactctatgagatattttagtgcagccgtttccagacccgggcgcggcgaaccacggtttattgccatgggatatgtggacgacacccagtttgtgagattcgattctgactctgcatgcccacgcatggagccccgtgcaccatgggtggagcaggaaggtcccgaatactgggaggaagagaccaggaatacaaaagcccacgctcagactgatcgaatgaatctccagaccctccggggatactataaccaatctgaagccagctctcatacacttcagtggatgattggttgcgatctcggctctgacgggaggctccttagaggttatgagcaatacgcctatgatggtaaagattacttagcattgaatgaggatttgaggtcatggactgccgccgacactgcggcccagatttcaaaacgaaagtgcgaagccgcaaatgtggctgagcagaggcgggcatatctcgagggtacctgcgtcgagtggctgcatcgatacctggagaatggaaaagagatgctccaacgagccgacccaccgaaaacacatgtgacacaccatcctgttttcgactatgaggccaccctacgctgttgggcactgggcttttatccagcggaaatcattctcacgtggcagagggacggcgaggatcagacccaagatgtagagctcgtcgaaactcgccctgcaggcgacggaacattccagaagtgggccgctgtcgtcgtgccttcaggagaagaacagcgttacacatgtcacgtgcagcacgaaggcctacccgagccactgatgcttcgctggaaacagagtagccttccgacaatccccatcatggggatcgtggcaggtttggtggtactcgcggccgtggtgaccggtgccgcggtggcggcagtgctctggcggaaaaaatcttctgactag

SEQ ID NO: 27412 - DNA, 741 bp, Artificial Sequence
  Description of Artificial Sequence: Synthetic coding sequence
atggtggttatggcaccccgtacacttttcctcctactttccggcgcccttacactgacagagacatgggccggcagtcactcaatgcggtacttcagcgctgccgtgtctaggcctggccgaggtgaaccgaggtttatagcaatggggtacgtggacgacacccagttcgtgcgttttgattcagactccgcctgtcctaggatggagccgagagctccttgggtcgagcaagaaggtccagaatactgggaggaagaaactcgcaatactaaagcccacgctcaaacagatagaatgaacctccagaccctgagaggctactacaaccagtccgaagccaaccctcctaaaacacacgtcacacatcaccccgtttttgactacgaagccaccctgagatgctgggctctgggcttctacccggctgaaattattctgacctggcagcgcgacggggaagatcaaacacaggacgttgaacttgttgagactaggccggccggcgacggaactttccagaagtgggcagcagtggtggtgccttccggagaggagcagagatatacttgccacgtgcagcacgaagggcttcccgaacccctgatgctccggtggaaacagagcagcctgccaacaatccccataatgggaattgtcgcaggacttgtggtcctcgcagccgtcgtgactggcgcagccgtggctgccgtgctgtggagaaagaagagctccgattag

SEQ ID NO: 27413 - DNA, 1017 bp, Artificial Sequence
  Description of Artificial Sequence: Synthetic coding sequence
atggtggtaatggccccaagaacactgttcctgctgctatcaggagcgctgaccctaacagagacttgggcaggctcgcactcaatgcgatacttttcggcagctgtcagccggccgggtcggggagagcccaggttcattgccatgggatacgtggatgacacgcagttcgtgcgctttgacagcgacagcgcctgtccgcggatggagccacgtgcaccgtgggttgagcaagaaggccccgagtactgggaggaggaaactaggaacacgaaggcgcacgcccagacagacaggatgaatctgcaaacactgaggggttactacaaccaatcagaagcatcaagtcacacactgcagtggatgatcgggtgcgatctgggtagtgacggccgcctcctgagggggtatgaacagtacgcatatgatggcaaggactacctggcattgaacgaggacctgagatcatggactgcagcggacaccgccgcacagatcagtaaacgaaaatgcgaagccgctaatgtcgctgaacagcgcagagcctacctggaaggaacctgcgtagagtggctgcacaggtacttggagaatggaaaggagatgctccagagagcagatcctcccaaaactcacgtgacccaccatccagtttttgattatgaggccaccttaagatgctgggctctggggttctaccctgctgaaatcatcctcacgtggcagcgagacggtgaagaccagacacaggatgtggaactggtagagacacggccagctggcgacggaacgttccagaagtgggctgccgttgtcgtgccatctggcgaggagcagcgatatacctgtcatgtccagcacgagggcctccctgagcctctgatgttgcgttggaagcagagcagcctgcctactatcccaattatgggtatcgtagctggcctagtcgtgctggcggcagtcgtcaccggcgcggccgtagctgctgtgctctggaggaagaagagcagcgactag

SEQ ID NO: 27414 - DNA, 1017 bp, Artificial Sequence
  Description of Artificial Sequence: Synthetic coding sequence
atggtggtgatggctcccaggaccctcttcctgctgcttagtggggccctgaccctgacggagacctgggccgggtcccatagtatgcgatatttttccgcggcagtgagtcgcccgggaagaggcgaaccccgtttcatcgctatgggatatgtggatgatacccagtttgttcgctttgactctgactctgcatgtccccgaatggagccacgagctccttgggtggagcaggaaggccccgaatactgggaggaggagacacggaacacgaaggcccatgcacagaccgatagaatgaatctccagaccttgcgagggtactataatcagagcgaggcctcaagtcatactctacagtggatgattggctgtgaccttggcagcgacgggagattgctgcgcggctacgagcagtacgcctacgacggcaaagactacctcgccctcaacgaagaccttcgcagttggaccgccgccgataccgcagcacaaatctccaaacgcaagtgtgaagccgccaacgtagcggagcagaggagagcatacctggagggaacctgcgtcgagtggctccaccgctatcttgagaacgggaaggagatgctgcagagggccgatccccccaagacacatgtgacgcatcacccagttttcgactatgaggccaccctgcgctgctgggctcttggtttttaccctgccgaaattatactcacttggcagcgtgatggtgaagaccagacgcaggacgttgagttggtggaaacccgaccggctggagatgggacatttcagaaatgggccgccgtggtggtcccgtcaggcgaggagcagcgatatacctgtcacgtccagcatgagggcttgcccgaacccctgatgctccggtggaagcagagttccctgcccaccatcccaattatgggtatcgtggctgggctggtggtactcgctgcagtggttacgggggccgccgtcgcagcggtgctgtggagaaagaagtctagcgactag

SEQ ID NO: 27415 - DNA, 465 bp, Artificial Sequence
  Description of Artificial Sequence: Synthetic coding sequence
atggtggtgatggcgccacgaactctgttcttgctgcttagtggtgctctgactctgactgagacctgggccggatcccattctatgagatacttctcggccgcagtgtcacgccccggcagaggagagcctcgcttcattgcgatgggttacgttgatgatacacagtttgtgcgattcgactccgacagtgcctgtcctcgtatggagcctcgcgccccgtgggtcgagcaggaggggcctgaatactgggaagaagagacacgaaacacgaaggcgcatgcgcagaccgacagaatgaaccttcagactctcagaggctactataaccagtcagaggctaagcagagcagcctgccgaccatcccgatcatgggtatagtggccgggctggtcgttctggctgcggttgtgactggtgctgcagtggccgcagttctctggaggaagaagtcttctgactag

SEQ ID NO: 27416 - DNA, 741 bp, Artificial Sequence
  Description of Artificial Sequence: Synthetic coding sequence
atggtagtgatggctcctagaaccctcttcttactgctgagcggagccctgactctcacggagacgtgggcaggcagccactccatgcgatattttagtgctgccgtatcacgacctggacgcggagagccacgattcatcgcaatgggttacgttgatgacacccagttcgtgcgcttcgacagtgatagcgcctgtccccggatggaacctcgcgccccatgggtcgaacaagagggccccgaatactgggaagaggaaacacgcaatactaaagctcacgcacaaaccgatcgcatgaacttacagacacttcgcggctactacaaccagagtgaggccaaccccccaaagacacatgtgacccaccacccagtttttgattatgaagcaacactgcggtgctgggccttgggtttctaccccgcagagatcatactgacctggcagagggacggagaagaccagacacaggatgttgagctggtagagactaggcctgccggggacggaaccttccagaaatgggccgctgttgtcgtcccgagcggtgaggagcagcgttatacatgccacgtgcagcacgagggccttcccgaacccctcatgttacgctggaaacagtcctccctccccaccataccaattatggggatagtggctggtctcgttgtccttgcagcagtcgtcaccggggccgcggtagccgccgtcttgtggaggaaaaaaagttctgattag

SEQ ID NO: 27417 - DNA, 1032 bp, Artificial Sequence
  Description of Artificial Sequence: Synthetic coding sequence
atgaaaaccccgcgaatggttgtcatggctccccggactctcttcctcctcctgtcaggtgctcttaccctgaccgaaacctgggcgggaagccactccatgcgttacttcagtgccgccgtttccaggcccggtagaggcgaacctcgtttcatcgccatggggtacgtggacgatacccaatttgtcaggtttgactcagattccgcctgccctaggatggaacctagggctccatgggtagagcaggaaggacctgagtactgggaagaagaaacccgcaacaccaaggctcatgcccagaccgatcgtatgaatcttcagactctgcggggttactacaaccagagtgaagcgtccagtcacacactgcagtggatgatcggatgtgacctggggagcgatggcaggctgctccgaggatacgagcagtacgcctatgacgggaaagactacctagccctcaacgaagatctgagaagttggacggcagccgatacagccgcccagatatccaagcggaaatgtgaggcagctaacgtagcggaacagcgccgagcttacctcgaaggcacctgtgtggagtggcttcaccgctatctcgaaaatgggaaggaaatgcttcagagagccgaccctccaaagacccacgttacacaccaccccgtttttgattacgaggctactctccgctgctgggctctgggcttttatcccgcagaaataatcctgacctggcagagggacggcgaggatcagacccaggatgttgagctggtggagacaagaccagctggagatgggacatttcagaagtgggcagccgttgtcgtgccgagcggggaagaacaacgctacacatgccatgtgcagcacgaagggctccctgagcctttaatgctccgatggaaacagagtagcctgccgacgatcccaatcatgggtattgtcgcaggcctagtggtgttggcagcagtcgtgacaggcgcggccgtggccgctgtgctttggcggaaaaagtcatccgactag

SEQ ID NO: 27418 - DNA, 741 bp, Artificial Sequence
  Description of Artificial Sequence: Synthetic coding sequence
atggtggtcatggcccccaggactttattcttgctgctctccggagctctgacactcaccgagacgtgggccggctctcactctatgcggtacttctcagcagccgtgtccaggccggggcggggcgaaccccgttttattgccatgggctacgtggacgacacccagtttgtgagattcgattctgactctgcctgtcccagaatggaaccaagagctccttgggtggagcaagagggaccggagtattgggaagaggaaactcggaacacaaaggctcatgcacagacagaccgtatgaatctgcagacgttacgaggctattacaaccagtcagaggcgaacccacctaaaacacatgtgacacaccaccctgtgtttgattacgaagcaactctgcggtgttgggctctcgggttctatccagctgaaatcatcctgacgtggcagagagatggcgaggaccagactcaggatgtggagctggtcgaaacccggccagcgggcgatggcaccttccagaaatgggctgccgtagttgtgccctcaggggaggaacagagatacacgtgtcacgtccaacatgaagggttacccgagccgctgatgctacgctggaagcagtcttccctgcctaccatcccgattatgggcatagtggccggcctcgtggtgctggctgctgtggtgacgggcgcagccgtggcggcagtgctgtggagaaagaagtcctctgattag

SEQ ID NO: 27419 - DNA, 1017 bp, Artificial Sequence
  Description of Artificial Sequence: Synthetic coding sequence
atggtagttatggctccgagaaccttgttcctcctgctgagtggggcgttgacgctgaccgagacatgggccggatcacactccatgagatacttctccgccgccgtttctcgccctggaaggggcgaacctagatttatcgctatgggatacgtggacgatacgcaattcgtgagatttgactctgactcagcatgtccccgcatggagcccagagctccctgggtagagcaggaggggcccgagtattgggaagaagagactagaaacacgaaagcccatgcacaaacagatcgcatgaatcttcagaccttgcggggctattataatcagtccgaggcctcctcccacaccttacaatggatgattggatgtgatctgggatcagacggaaggctactgaggggttacgagcaatacgcatacgacggaaaggactatctggccctcaacgaggatctgcggtcctggacagcagctgatacagccgcacagatctcgaaaaggaagtgtgaggcagcgaatgtggctgagcagaggcgtgcctacctcgaaggaacatgcgtagaatggcttcaccgctacctcgaaaacggtaaagagatgctccagcgtgcagatcccccaaaaacccacgtgactcatcaccccgtgtttgattacgaagcgacactaaggtgctgggccttaggcttctaccccgccgagattatcctcacatggcagcgcgatggagaagatcagacacaagacgttgagttggtggaaactaggccggccggagacggcacgttccagaagtgggccgccgtggtggttccttcgggcgaggagcagcggtacacctgccacgtgcagcatgaggggctgcccgaacctttgatgttgcggtggaagcagtcatccctccctacaattcccattatgggtatcgttgcaggattagtggtgctagctgccgtggtcacaggagctgccgtggccgctgtcctctggagaaagaagtcgtccgattag

SEQ ID NO: 27420 - DNA, 465 bp, Artificial Sequence
  Description of Artificial Sequence: Synthetic coding sequence
atggtagttatggcaccccgcactttatttctactcctaagtggtgctcttacactaaccgagacgtgggcaggcagccacagcatgagatactttagcgctgcagtcagtcgccccggacggggcgagcccagattcatagcaatgggctatgtggatgacacccaatttgtgcgcttcgatagtgattccgcttgccctagaatggagccccgagcgccatgggttgagcaagagggcccagagtactgggaagaggagactagaaacactaaggctcacgcacagacagaccgcatgaacttgcaaactctacgcgggtactacaaccagagtgaggccaagcaaagctctctgcccacgatacctatcatggggatcgtggcaggacttgtggtgttggccgcagtggtcacaggtgccgctgtggctgcggtgttatggaggaagaagagcagcgactag

SEQ ID NO: 27421 - DNA, 465 bp, Artificial Sequence
  Description of Artificial Sequence: Synthetic coding sequence
atggtggttatggctcctagaacactgttccttctcctgtctggggctctgacactgaccgagacctgggccggctcccactccatgagatactttagcgccgccgtttcgaggcccgggcgtggtgaaccacggttcattgcaatgggatacgtggacgacactcagtttgttcgttttgacagcgatagcgcttgcccgagaatggagcctcgggctccgtgggtggaacaggaggggcctgagtactgggaagaggagacccgtaacactaaggcccatgcacaaactgatcgcatgaatctgcaaacacttagaggctattataatcagagcgaggccaaacagtcgtctctgcctacaattccaataatggggatcgtggccgggttggtggttctggccgctgttgttaccggggccgcggtcgcagccgtactgtggcgaaaaaagagttctgactag

SEQ ID NO: 27422 - DNA, 1017 bp, Artificial Sequence
  Description of Artificial Sequence: Synthetic coding sequence
atggtcgtcatggcgcctcgaacgctcttcctactactaagcggcgctctcaccttaactgagacctgggctggaagccacagcatgcggtacttctctgcagccgtgagccgccccggcaggggcgagcccagatttatcgctatggggtacgtggacgacactcagttcgtgcgtttcgattccgattccgcatgtccccgtatggaacctcgagcaccatgggtagaacaggagggaccagagtattgggaggaggagacgcggaacaccaaagcacacgctcaaaccgaccgaatgaacttgcagacactgcggggatattacaatcaatccgaagcctccagtcatacactgcagtggatgatcggttgtgacttgggaagtgatgggcgactgctccgcggctatgagcagtatgcctatgatggcaaagattacctagctcttaacgaggacttgcgatcttggactgctgccgatacagctgcacagatcagtaagagaaagtgtgaagcagcaaacgtcgcagagcagcggagggcctacctcgagggtacatgtgttgaatggctccacaggtaccttgagaatggaaaagaaatgttgcagcgagctgatcctcccaagacccatgtgacacatcatcctgtgttcgactatgaggctacactgcgttgctgggccctcggcttttatcccgccgaaatcatcctgacatggcaaagagatggagaggaccagactcaggacgttgagctcgttgaaacccggcccgccggcgacggcacatttcaaaaatgggccgcagtcgtggtcccatcaggcgaggagcagagatacacatgccacgtccaacatgaggggctcccagagcctctcatgctccgatggaagcagagttctctgcccactattccgattatgggaattgttgcgggactcgtagtgctggccgctgtggtaaccggcgctgcagtggcggctgtgctgtggcggaagaagtccagcgactag

SEQ ID NO: 27423 - DNA, 1032 bp, Artificial Sequence
  Description of Artificial Sequence: Synthetic coding sequence
atgaagactccgcgtatggtggtcatggcacccaggaccttgttcctcctgttgagcggcgcattaacactgaccgagacctgggccgggtcccactctatgagatattttagtgcggccgtcagtaggccaggccggggcgaaccacgatttatagccatggggtatgtggatgatacgcagttcgtccggtttgattccgactctgcttgcccgcgcatggaacccagggctccctgggtcgaacaggagggaccagaatactgggaagaagagacacgaaacacaaaggctcacgcacaaacagaccgcatgaaccttcagacgctgagaggctactacaaccagagcgaggccagttcccacactcttcagtggatgatcgggtgtgatctcggtagcgatggtaggctgttacgtgggtatgagcaatatgcttatgacggtaaggactatctggccctcaacgaagatctccgaagctggacggccgccgatacggccgctcaaataagtaagcggaagtgtgaggctgcaaatgtcgccgagcaacggcgagcctatcttgaagggacatgtgtggagtggctgcacagataccttgagaacggcaaggagatgctccagagggccgaccccccgaagactcatgtgacccatcaccccgttttcgactatgaagcgaccctgcgctgctgggccttaggtttttaccccgcggaaatcatactcacgtggcagcgggatggggaagaccagactcaggatgtagagttagtggaaactcgccccgcaggagacggaacttttcagaaatgggctgccgttgtcgtaccaagtggtgaggaacaacgatatacatgccatgtgcagcacgagggtttgcccgagcctttgatgctgcgctggaaacagtcctcgctgcctactatacctataatgggtattgttgccgggttggtcgtgcttgcagctgtggttactggtgcagccgttgctgctgtcctctggcgaaagaagtccagtgactag

SEQ ID NO: 27424 - DNA, 741 bp, Artificial Sequence
  Description of Artificial Sequence: Synthetic coding sequence
atggtggtcatggcgcctagaacgctgttcttgttgctcagcggggccttgacattgaccgaaacctgggcaggcagccattccatgcggtattttagcgcagcagtgagccgccccgggcgtggagaaccacgattcattgcgatgggctatgtcgacgatacacagttcgtccggttcgattccgattctgcttgcccacgaatggagccccgcgcaccctgggtggagcaggaggggcccgagtactgggaggaggagaccagaaatacgaaggcacacgcacagaccgatcggatgaatttacagaccctcagaggctattataatcaatcagaagccaatccaccgaagacccacgtaacgcaccaccctgtgttcgactatgaagctacgttaaggtgttgggcgcttggcttctaccccgctgagattatcttaacctggcagcgagatggcgaagaccagacgcaggacgttgaactcgtagagacgaggccagcaggggatggcacattccagaaatgggcggccgtcgtggtcccctcaggggaagagcagcgttacacatgtcacgtgcagcatgaagggctgccggagcccttaatgctccggtggaagcagtctagtcttcctacaatccctataatgggcattgtcgccggattggtggttctcgctgcagtggtgactggcgccgccgtggccgctgtgctgtggcgtaaaaaatccagcgattag

SEQ ID NO: 27425 - DNA, 741 bp, Artificial Sequence
  Description of Artificial Sequence: Synthetic coding sequence
atggttgtgatggccccaaggaccctttttcttctcctctccggcgcccttaccctaactgaaacatgggccgggagtcactccatgcgatatttctcagcagccgtctccagaccggggagaggcgagccccgattcattgccatgggatatgtggatgacacccagtttgttcggttcgattcagactctgcatgcccaagaatggaaccacgagcgccatgggttgaacaggagggacctgaatattgggaggaggaaacccgaaatacaaaggctcatgcacagactgacagaatgaacctgcagaccctccggggatattacaatcagagcgaggctaatccccctaaaacccatgtaacacaccaccccgtcttcgactacgaggctactctgcggtgttgggctttggggttctaccccgcagaaataatcctgacgtggcagagagacggggaagatcagactcaggatgtcgaactcgtcgagacgcgtccggccggcgatgggacatttcagaaatgggccgctgtcgtcgtgccttctggtgaggaacaaagatatacatgccacgtgcagcatgaggggctacctgagcccctaatgcttcgttggaagcaatcctcactgccaacaatcccaattatgggcatcgtcgccggcctcgttgtactagccgcagtggtgacaggcgctgccgtggccgcagtgctctggcggaagaagagttccgattag

SEQ ID NO: 27426 - DNA, 465 bp, Artificial Sequence
  Description of Artificial Sequence: Synthetic coding sequence
atggtggtgatggcacctaggacgctgttcctcctcctgagtggtgctctgacactgacagaaacttgggcaggctctcatagtatgcggtacttttcagcggctgtctcccggcctggccggggtgaacctcgattcattgctatgggctacgtcgacgatacccagtttgtcagattcgactccgactctgcttgcccacgtatggagccccgagcaccttgggtggaacaagagggtcccgaatattgggaggaggagactcgcaacaccaaagcacacgcacagacagatagaatgaaccttcagaccctccgcggatactacaaccaaagcgaggcgaaacagtcgagcttacccaccatcccaataatgggcatcgtggcagggctggtggtgttggccgcagttgtcaccggcgccgcggtcgccgccgtgctgtggcgcaagaagagttctgactag

SEQ ID NO: 27427 - DNA, 741 bp, Artificial Sequence
  Description of Artificial Sequence: Synthetic coding sequence
atggtagtcatggccccacggaccttattcctgctactttcaggcgccctcacattgaccgaaacatgggctggatcacatagtatgcgttacttcagcgccgctgttagtaggcctggtcgaggggaacccaggttcatcgccatgggctacgtagatgatacccagttcgttcgatttgattcggattccgcctgtccgcgcatggaacctcgagccccctgggtcgagcaagagggtcccgaatattgggaagaggagacaagaaacactaaagcgcacgcccagacagaccggatgaacctgcagacccttcgggggtattacaaccagtctgaggcgaacccccctaaaactcacgttacccaccaccccgtattcgactacgaggccactctgcgttgctgggcactgggcttttacccagccgagattattctcacctggcaaagggacggtgaggaccagactcaggacgttgagcttgtggagacccggcccgcaggagatggaactttccagaaatgggccgccgtagttgtgcctagtggcgaggagcagaggtatacgtgccacgttcagcacgaaggcctacccgagccactgatgcttcggtggaagcagagctccctgccaaccattcctattatggggatagttgcaggactcgtggttctggcagcagtagtaacaggtgctgctgtggcggctgtgttatggaggaagaagtctagcgactag

SEQ ID NO: 27428 - DNA, 741 bp, Artificial Sequence
  Description of Artificial Sequence: Synthetic coding sequence
atggtcgtaatggcgccgcggacactgtttctgctgttgagcggcgctttgaccctgaccgaaacttgggccggttctcactctatgcggtatttttctgccgcagtctctcggcccggcaggggtgaaccaagattcattgccatgggttacgttgatgatactcagtttgtacgtttcgattccgactcagcctgtccccggatggaaccaagagcaccatgggtggaacaggaaggcccggagtattgggaggaggagacgaggaataccaaggcccacgctcagaccgatcgcatgaacttgcagacgctgagagggtactataatcagtccgaggccaacccaccaaagacccacgtgacccatcatcccgtgttcgactatgaggcaactctccgatgttgggctctgggattttaccctgccgaaattatccttacctggcaaagggatggtgaggaccagactcaggacgtcgaattggtggaaaccagacctgccggggacggcacattccagaagtgggccgccgtggtagtaccatcaggcgaagaacagcgctacacgtgccatgtgcagcacgagggcctgcctgaacctttaatgttgagatggaaacagtcgtccctccctactattcctattatgggcattgtcgcaggattggtggtgcttgctgcagttgtcacaggggctgctgtcgctgcagtgttatggagaaagaagtcttccgattag

SEQ ID NO: 27429 - DNA, 741 bp, Artificial Sequence
  Description of Artificial Sequence: Synthetic coding sequence
atggtagttatggcacctaggacactctttctgctcctttcaggtgcacttactctcaccgaaacatgggccggcagtcactcaatgagatactttagcgcagccgtttcaagacctggtcggggcgagccgagattcattgcaatgggttacgtagacgatacccaatttgtgaggttcgacagcgactcagcttgtccaaggatggagcctagggctccctgggtggagcaagaaggtccggaatattgggaagaagaaacaagaaatactaaggcccatgcccagaccgatagaatgaaccttcagactctcaggggttactacaatcaatcagaggccaacccacctaaaactcatgtaacacaccatcccgttttcgactatgaagccacgctgcgatgttgggccctgggcttttatcccgccgagattattctgacctggcagcgggacggcgaagaccagacccaagatgtggaactcgtggagactcgcccggctggggacggaaccttccaaaaatgggcggcagtagtggtgccgtctggggaggagcagagatacacatgccacgtgcaacacgagggcctaccagagcccctgatgctccggtggaaacaaagttccctgcccaccatccctatcatgggcatagttgctgggctggtagttctggctgcagtcgttacaggcgctgcagtggcggcggtgctttggaggaagaaaagctctgattag

SEQ ID NO: 27430 - DNA, 741 bp, Artificial Sequence
  Description of Artificial Sequence: Synthetic coding sequence
atggtggtcatggcccctcgtacactatttttacttctgtctggcgctctgaccctgaccgaaacttgggcaggaagtcatagtatgcgatacttcagcgccgctgtgtcacgccccgggagaggcgagccaaggttcatagccatggggtacgtggatgatacacaatttgttagattcgactctgattctgcctgtcctcggatggagcctcgggcaccctgggtggaacaggaaggaccagagtactgggaggaagagacacgaaacaccaaggcccacgctcagactgaccggatgaacctccagacccttcgggggtattacaaccagtccgaggctaatcctcctaagacgcacgtgactcaccaccctgtgttcgactacgaggccaccctccgttgttgggcgcttggcttttaccccgctgaaatcattctgacgtggcagagggacggagaagaccagacccaagacgtggaactagtggaaactaggcccgccggcgacggaacatttcagaaatgggcggcggtggttgtaccgagcggcgaggaacagcgctatacttgccatgtccagcacgagggcctgcccgaaccattaatgcttaggtggaaacaaagttcattgcccaccattcccatcatggggatcgttgctggtctagtggtgcttgccgcagtggtaaccggcgctgccgtggcagccgtcttatggaggaagaaatcctcagactag

SEQ ID NO: 27431 - DNA, 741 bp, Artificial Sequence
  Description of Artificial Sequence: Synthetic coding sequence
atggttgtgatggcccccagaactctgtttctgctgttaagcggcgccctgacgttgactgagacttgggcaggatcccacagtatgcgttacttctcagcggcagtctcccggccggggcggggtgagcctcggtttatcgccatgggatacgttgacgatacacaatttgtccgattcgactccgattcagcctgtccccggatggagccccgagcaccctgggtggagcaagagggacccgaatactgggaggaagaaactaggaacacaaaggcacatgctcagactgacaggatgaacctgcaaaccctgagaggttattacaaccagtctgaagccaatccccctaaaacccacgtgactcatcaccctgtcttcgactacgaggccacattgagatgctgggccctcggcttttacccagcggaaattattctaacatggcagcgggacggggaagatcagacccaagatgtggagctggttgaaactagaccagccggcgatggaacttttcagaaatgggctgccgtggtcgtgcctagcggtgaggaacagcggtacacatgtcatgttcaacacgaaggccttcccgagccactgatgcttaggtggaagcagagtagcctgcccacgataccaataatgggaatagtggccggtctggtggtgttagctgccgtcgtgacgggcgcagctgtggccgccgtcctatggaggaagaaatcgtccgactag

SEQ ID NO: 27432 - DNA, 741 bp, Artificial Sequence
  Description of Artificial Sequence: Synthetic coding sequence
atggtggtgatggcccctcgtactctctttcttctgctgtcgggagcattgactcttaccgagacctgggcaggaagtcattctatgcgctacttctccgccgccgtgagtaggccaggccgcggcgagccacgtttcatcgccatgggctacgttgatgatacacaattcgtgcgatttgattcagactcagcctgccctagaatggagccccgagctccttgggtagaacaggaaggtcccgagtattgggaagaggagacaaggaatacaaaagctcatgctcagacggatagaatgaatctccagaccctgagggggtattataaccaatccgaagccaatcccccaaagactcacgtaactcaccacccagtgtttgattatgaagccaccttgcggtgctgggcactcggcttttacccggccgagattatccttacctggcagagagatggagaagatcagacccaggatgtagagctggtcgaaacccgcccagcgggcgacgggactttccagaaatgggcagcagtggtggtgccttccggcgaggaacagaggtatacatgccatgtgcagcacgaggggctgccagaacctctgatgttgaggtggaagcagtctagcctgcctacaatccctattatgggaatcgtggcaggcctggtggtcctggccgcagtggtcacaggagccgcggttgccgccgtattatggcgcaagaagagctctgattag

SEQ ID NO: 27433 - DNA, 1017 bp, Artificial Sequence
  Description of Artificial Sequence: Synthetic coding sequence
atggtggtcatggcacctcgaacgttattccttctcttatccggggctctgaccctgaccgaaacctgggcaggttctcactctatgaggtacttcagtgctgccgtttcgcgtccaggtcgcggcgagcctcggttcatagcgatgggttatgtcgatgatacacagtttgtgcggttcgattccgactccgcatgccctcggatggagccccgcgctccctgggtggagcaggaggggcctgaatactgggaggaggagacacggaacaccaaagcacatgcccagactgataggatgaatcttcaaacgcttcgaggatactacaaccaatcagaggctagttcgcatacactacagtggatgattggttgcgatctgggttctgatggacgcctgcttaggggatatgaacagtacgcgtatgatggcaaggactatctggccctgaacgaggatctgaggagctggactgccgctgatacagcggcacagattagtaaaaggaaatgcgaagctgcgaacgtggccgagcaaaggcgagcttatcttgaagggacatgcgtggagtggttgcaccggtacctggagaatggtaaggagatgctgcagagggccgaccctcctaaaactcacgtgactcaccatcctgtcttcgattacgaggctacactgagatgctgggccttggggttttacccagctgagattatcctgacatggcaacgagatggggaggatcagacgcaagacgtcgaattggttgagacccggcccgccggtgacgggacgtttcagaagtgggccgcggtggtggttccatccggcgaggagcagagatatacgtgccatgtacagcatgaagggctgccggagccactaatgctgcgatggaaacagtcatcgctccctaccattcccattatggggattgtggccggtcttgtggtcctggctgctgtcgtgacaggcgccgcagtggccgccgtgctgtggcgtaagaagtcctccgattag

SEQ ID NO: 27434 - DNA, 1017 bp, Artificial Sequence
  Description of Artificial Sequence: Synthetic coding sequence
atggtggtaatggccccaagaactctgttcctgcttttatccggcgccctgacactcaccgaaacttgggccggcagtcactccatgcgctatttttccgcggccgtgagccggcctggacggggagagccaagattcatcgctatggggtacgtcgacgatactcaattcgtgcggttcgactccgactcggcttgtccgcgcatggagcccagggccccttgggttgaacaggaagggcccgagtattgggaagaggaaactaggaacactaaggctcatgcccagacagaccgaatgaacttgcagacactgcgcggctactacaatcagtccgaagcctcatctcacactcttcagtggatgataggctgtgacttgggttctgacggtagactcctcagaggctacgagcaatacgcctatgatggcaaagattatctggcgctcaacgaagatttgcgctcttggactgccgctgacacagcggctcagataagcaaaaggaagtgtgaggccgcgaatgtggcggagcaacgccgtgcttaccttgaaggcacgtgcgtggaatggctccacaggtacttagaaaatggaaaagaaatgcttcagcgtgcggaccctccaaagacacatgttacacatcaccccgtttttgattacgaggccacgcttcggtgttgggctctggggttttatcccgccgagattatcctgacgtggcagagagacggggaggaccagacccaggacgtggaattagtcgagacaagacctgcaggcgacggaactttccagaagtgggcagctgtcgtggtcccttccggcgaagaacagaggtatacctgccacgtgcagcatgaaggtcttccggagcctctgatgttgcggtggaagcagagcagtttacccactattccaatcatgggtatcgtcgcaggtctcgttgtgctggctgctgtggtgacaggagccgcggtggcggcagtgctgtggcggaaaaagtcttctgactag

SEQ ID NO: 27435 - DNA, 1017 bp, Artificial Sequence
  Description of Artificial Sequence: Synthetic coding sequence
atggtagtcatggcaccgagaactcttttcctgctcttgtcgggtgcgctgactcttaccgaaacgtgggccgggtcccattccatgagatattttagcgcagcggtgtcacgccctggccgaggagaaccgaggttcattgctatggggtacgtcgatgatacgcagtttgttcgatttgacagcgactccgcgtgccctaggatggagcccagggccccctgggtggagcaagagggaccagagtattgggaggaggagactcgcaacactaaagctcacgcacaaacagaccgaatgaaccttcagaccctccgcgggtattataatcagtccgaggcttcctcccacaccttacagtggatgataggatgtgacctgggctcagatggcaggctcctacgcgggtacgagcagtacgcatatgatggtaaagactaccttgcactcaatgaggacttgaggtcctggaccgcagccgatacagcagctcagatttccaagaggaaatgtgaggcagccaacgtcgccgagcagaggcgcgcatacctggagggcacttgcgtggaatggctccatcgatacctggaaaacgggaaagagatgctccagagagcagatcccccaaagacacacgttacacatcatcccgtatttgactatgaagccacactcaggtgctgggcgcttggcttctatcccgccgaaatcatactcacctggcagcgggacggggaagaccagactcaggatgtcgaactggtggaaacacggccagctggagatggcacgttccagaagtgggcagccgtcgttgtgccatccggagaggagcagagatatacatgtcatgtgcagcacgaaggcttgcctgaaccgcttatgctcagatggaaacagtcttctcttcctacaataccaataatgggaatagtcgctggtctggtggtcttagcggccgtggtcaccggagctgcggtggctgcagttttgtggcgcaagaagtcctccgactag

SEQ ID NO: 27436 - DNA, 1017 bp, Artificial Sequence
  Description of Artificial Sequence: Synthetic coding sequence
atggtcgtgatggcccccagaaccctctttctgctgctgtccggcgctctgacactaactgagacctgggccggatcccactcgatgcggtacttcagcgccgcagtctcacgccctggacggggagaaccacgctttatcgccatgggctacgtcgacgatacacagttcgtccggttcgacagcgatagcgcctgcccgcgcatggagcctagagccccctgggtcgagcaggaaggaccggaatattgggaagaggaaacacgcaatacgaaggcccatgcccagacagataggatgaacctacagaccctgcgggggtattataatcaatccgaggcttcttcacatactcttcagtggatgattgggtgcgatctgggctcagacggaaggctacttcgaggatatgagcagtatgcctatgatggcaaggattacttggcgctgaatgaagacctccgatcgtggacggcagcagacacggccgcccagattagcaaacgcaagtgcgaagccgcaaatgtggcagagcagcgtcgtgcatatttggaaggaacctgtgttgagtggttgcatcgctatctggaaaacggtaaagaaatgctgcaacgggcagatccccccaagacccacgtcactcaccatccagtgtttgattatgaggccaccctgcgatgttgggcattgggtttctacccagctgaaatcattcttacatggcaacgggacggagaagaccagactcaagatgtggagctggtcgagacccgcccagcaggggatgggacgtttcagaagtgggccgccgttgtggttccctctggagaagagcagcgatacacgtgccacgtgcagcatgaaggcctgccagagccgctcatgctccggtggaaacagtcatctctgcctaccattcccattatgggcatcgtagcagggctggtggtgctggccgctgttgtgaccggcgccgcggtggccgctgtgctgtggaggaagaaatcatccgactag

SEQ ID NO: 27437 - DNA, 1017 bp, Artificial Sequence
  Description of Artificial Sequence: Synthetic coding sequence
atggtggtgatggccccacgaacactgtttctcttgctttccggcgcgttgactttaaccgaaacttgggcaggatcccactctatgagatatttctccgccgcagtgtcacgacctggaagaggagaacctaggtttattgccatgggctacgtggatgacactcagttcgtgaggtttgactcggattctgcttgcccaaggatggaacccagagcaccatgggttgagcaagagggcccagaatactgggaggaggagacccgcaacaccaaagcccacgcccagacagacagaatgaatctgcaaacactgagaggctactacaatcagagtgaggctagctcacacacgcttcaatggatgatcggctgcgacctcggttccgacggacgcctgttacgtggatatgagcagtacgcctatgatggaaaagattatctagcccttaatgaggacctgaggagttggacagctgctgatactgccgcccagatttctaagagaaaatgtgaggccgccaatgtggcagagcagcggcgcgcttacttggagggcacctgcgtagagtggttgcaccggtatctggagaacggtaaagagatgctgcaacgggcagacccccctaaaacgcatgtgacacaccatcccgtgtttgactatgaggccactctgcgatgctgggccctgggcttctaccccgcagagatcattctgacatggcagagagatggcgaagatcagactcaggatgttgagctcgtagagactaggcctgcaggcgacgggacattccagaaatgggccgccgtcgtggtcccctccggggaggagcaaaggtatacttgtcacgtgcagcacgagggactccctgaacccttgatgctccgatggaagcagtcatcactccctactatccctattatggggattgtggcaggattggttgtgctggccgctgtggtgactggcgctgccgtggcggctgtcctgtggcgaaaaaagagttctgactag

SEQ ID NO: 27438 - DNA, 1017 bp, Artificial Sequence
  Description of Artificial Sequence: Synthetic coding sequence
atggtagtgatggccccgcggacactgttcctgctgctatcaggcgcgctgacgcttactgagacttgggcaggaagccactcgatgcgttatttttccgctgccgtgtcacgacccggaaggggggagcctaggtttatagcaatggggtatgtggatgacacccagttcgtgaggtttgactccgattccgcctgtccccggatggagcctagagcgccttgggtggagcaagaaggacccgagtactgggaggaagaaaccaggaacacaaaggcccacgctcagaccgatcggatgaacctccagactctgcgcggttactacaaccaatcagaggccagtagtcacacgttacagtggatgatcggatgcgacctaggatccgacgggcgactgctgcgcggttatgagcagtacgcctacgatggaaaggactatctggcgctcaatgaagacctccgtagttggaccgcggcggataccgcggcccagatttctaagaggaaatgtgaagctgcgaacgtggctgaacagcggcgcgcttacctggagggtacatgcgtggaatggctgcatagatacctggaaaatgggaaagagatgttgcagcgggccgaccctccaaaaacgcacgtcacccaccatcctgtgttcgactacgaggctaccctccgctgttgggctttgggtttttatcctgcggagattatcctaacttggcagagagacggggaggaccaaacccaggatgtggaattggttgagacccgacctgctggcgacgggacatttcaaaaatgggcagctgtggtggttccgagcggagaagagcagcggtatacctgccatgttcagcacgagggcctgccagagcccctcatgttgagatggaaacagtcatctctacctaccattcccattatgggcatagtggctggacttgtggtgctggcagccgttgtgaccggcgccgccgtggccgccgtgctgtggcgtaagaagagtagtgactag

SEQ ID NO: 27439 - DNA, 372 bp, Artificial Sequence
  Description of Artificial Sequence: Synthetic coding sequence
atgggccatgaacaaatgctgccattgctgtggctgttacctcacagctgggctgtcccggaggcacctacgcctatgtggcccgacgatttgcagaaccataccttccttcataccgtgtactgtcaggatgggtcccctagcgtggggctatccgaagcgtatgatgaagatcagctgttttttttcgatttctcccagaacacaagagtccctcgtctaccagaatttgctgattgggcacaggagcagggcgatgctcccgcgatactctttgataaggagttctgcgagtggatgatccagcagattggtccgaagctggacggaaagatccccgtctcacggggacaagagttctctggcgaatag

SEQ ID NO: 27440 - DNA, 786 bp, Artificial Sequence
  Description of Artificial Sequence: Synthetic coding sequence
atgggtcacgaacaaaatcaaggagcggccctgttacaaatgctccccctcctgtggctgcttcctcactcctgggcggtccctgaggctcccacgcccatgtggcccgatgatctacaaaatcatacctttttgcataccgtgtactgtcaagacggtagccccagcgtcgggctgagtgaagcctatgatgaggaccaactgttctttttcgattttagccagaataccagagtgccacggctccccgagttcgcagattgggcccaggaacagggggatgccccagccatcctcttcgacaaggaattctgcgagtggatgattcagcaaatagggcccaaactcgacgggaagatccctgtgtctcggggattcccgatagcagaggtgtttactttgaaacccctcgagttcggcaagccaaacacgctggtctgctttgtctcaaacctgttcccacctatgctaactgtcaactggcaacaccactctgtgcctgtcgaaggtttcggtcccacattcgtgtcagccgtagatggcctctcattccaggccttcagctacctaaacttcacaccggagccctctgacattttttcatgcattgtcacacatgagatcgatagatacaccgccatagcgtactgggtgccacgcaatgcactgccttcagatctgctcgaaaacgtcctgtgtggtgtcgctttcgggttaggcgtgctgggcattattgtgggcattgttcttatcatttattttcgaaagccctgctctggggactag

SEQ ID NO: 27441 - DNA, 684 bp, Artificial Sequence
  Description of Artificial Sequence: Synthetic coding sequence
atgggtcatgagcagaatcaaggagctgctttactgcaaatgctgccactgctctggctactgcctcatagctgggccgtaccagaggcccctacacctatgtggccggacgacctccagaaccataccttcttacacacagtgtactgtcaagacggtagcccaagcgttggacttagcgaggcgtacgacgaggaccagctcttcttctttgactttagtcagaatacacgcgtgccccggctgccggaattcgcggattgggctcaggagcagggcgacgccccggcaatcctcttcgataaagaattctgcgagtggatgatacaacaaataggaccgaagctcgatggcaagatccctgtctcccgggtgaattggcagcatcacagtgtcccagtggagggatttgggccaacttttgtgtcagccgttgacggactgtcattccaggctttttcttatctcaatttcacacctgagccatcagacatcttttcttgtattgtgactcatgaaattgaccgctatactgcgatagcctactgggtgcctagaaatgctcttcctagtgatcttcttgaaaatgtgctgtgcggtgttgccttcggcctgggagtcctgggaattattgttggaatcgtgctaatcatttatttccgcaaaccgtgcagcggtgactag

SEQ ID NO: 27442 - DNA, 501 bp, Artificial Sequence
  Description of Artificial Sequence: Synthetic coding sequence
atggggcacgagcaaaaccagggcgctgctttactgcagatgcttccattactgtggctcctgccccactcgtgggcagttccagagggatttccaattgcggaggtcttcacactgaagcccctagagttcgggaagcccaacactctggtgtgttttgtgtcaaacctgtttcctccaatgctgacggtgaattggcagcaccatagcgtgcctgttgaaggtttcggcccgacgttcgttagcgccgtggacggcttgtccttccaggccttttcctatctaaactttacgcccgaaccgtccgatatatttagctgtatagtgacccatgagattgaccgctataccgcaatcgcttattgggttcctcgcaatgccttaccctcagatttgttggaaaatgtgctgtgtggagttgcttttggccttggcgtcttgggcattatagtgggaatcgtgctgattatctacttccggaaaccatgtagcggtgactag

SEQ ID NO: 27443 - DNA, 786 bp, Artificial Sequence
  Description of Artificial Sequence: Synthetic coding sequence
atggggcatgagcaaaaccagggggccgctctgctccaaatgctaccgttgttatggctgctgccccacagctgggcagtgccagaggctccaacccctatgtggccagacgacctccagaatcacacctttcttcacaccgtgtattgccaagatggctccccatctgtaggactgtctgaggcctacgacgaggaccaactcttttttttcgacttcagccagaacacacgcgttccgcgtctgcctgaatttgccgactgggctcaagagcagggggacgctcccgccatcttattcgataaggaattctgcgagtggatgatccaacaaataggccctaaattagacggcaagatccctgtgagtcgcgggtttccaatcgccgaagtatttaccctcaagccactggaattcggtaagccaaacactctagtttgcttcgtgagcaatctgttcccccctatgctaactgtgaattggcaacaccattcggtgcctgtggagggatttggtccgaccttcgtatccgcagttgatggtctgagcttccaggccttttcttatctcaacttcactccagaacctagcgatattttcagctgtatcgtgacacacgaaattgatcgctataccgccattgcgtactgggtccccagaaatgctttacccagtgacctgctggagaacgttctgtgcggcgtcgccttcgggctcggcgtgctgggtatcattgtgggcatcgttttgattatctacttcagaaaaccttgctccggtgactag

SEQ ID NO: 27444 - DNA, 684 bp, Artificial Sequence
  Description of Artificial Sequence: Synthetic coding sequence
atggggcacgaacagaaccagggagcggcgctgctccagatgctgcctctcctctggctgttacctcactcatgggccgtgcccgaggctcccactcccatgtggcctgatgatctgcaaaatcacacgttccttcacacagtctactgccaggacgggagcccgagtgtaggcctgtctgaagcctatgacgaagatcagctgtttttcttcgacttctcccagaatactagagtcccacggctccccgaatttgccgactgggcccaagagcagggcgacgcccccgccatcctctttgacaaggaattttgtgaatggatgatccagcagatcggtcccaagctggacggaaaaattccagttagccgcgtcaattggcagcatcacagcgtcccggtggaagggtttggcccgacattcgtctcagcagttgatggtctgtctttccaggccttttcttatctcaactttactcccgagccaagcgatatcttttcctgcatcgtcacccacgaaattgatagatacaccgctatagcctattgggtgccaagaaatgctctgccctccgatctcctagagaacgtactgtgtggcgtggcctttggccttggcgtcctcggaattattgtcggaattgtgctcattatctatttccgcaaaccttgctccggggactag

SEQ ID NO: 27445 - DNA, 501 bp, Artificial Sequence
  Description of Artificial Sequence: Synthetic coding sequence
atggggcacgagcagaaccagggagcggcccttcttcagatgcttccccttctgtggctcctgccgcactcatgggcagtgcctgaagggttccccatcgcggaggttttcacattgaaacctctggaatttgggaaacctaacaccttagtctgctttgtttcgaatctgtttcctcccatgctgaccgtcaattggcagcaccactctgtaccggtggaaggattcgggccaacctttgtctccgcagtggacggactttcttttcaggcgttcagctacttgaacttcacaccagaaccctctgatatcttcagctgtattgtcacacacgaaatcgaccggtacactgcaatcgcctattgggttccacggaatgcactccctagcgacctgcttgaaaatgtcctgtgcggggtggctttcggcttgggagtgttagggataattgtaggcatcgtactgattatttatttcagaaaaccttgttccggagactag

SEQ ID NO: 27446 - DNA, 726 bp, Artificial Sequence
  Description of Artificial Sequence: Synthetic coding sequence
atgaagtggctgaagaaatgcctggacacagctcctactcctatgtggccggatgatctgcagaaccatacatttttgcataccgtgtattgtcaggacggctctccatcggtcggcctgtccgaggcctacgatgaagatcaattattctttttcgacttttcccagaacacaagagtacctaggctgccggaattcgccgattgggcccaggagcaaggcgacgctcctgccatcctgtttgacaaggagttctgtgaatggatgatccagcagatcggacctaaattggacgggaaaattccggtctcacgtgggttcccgattgcagaagtgttcactctaaagcctcttgaatttggcaaacctaatacccttgtctgttttgtatcaaacctgttcccccctatgttgaccgtaaattggcagcatcactctgtgcccgtggagggctttggtccaacgtttgtatcagcagttgacggcctttccttccaggcatttagctatttgaatttcacccctgaaccctcagatatcttctcatgcattgtgacccacgagattgatcgttataccgccatcgcttattgggttccccggaatgctctcccgtcagatttacttgaaaacgttctgtgtggcgtggcctttggtctcggcgtccttgggattattgtcggcatcgtcctaatcatctactttcgcaagccatgttctggatag

SEQ ID NO: 27447 - DNA, 510 bp, Artificial Sequence
  Description of Artificial Sequence: Synthetic coding sequence
atgtggccggatgatttacagaatcatacttttctgcatacagtctattgccaagatggctctccctcagtcggcctctctgaggcatatgacgaggatcagcttttctttttcgatttcagtcagaatacacgtgtgcccaggctcccagagttcgctgattgggctcaggagcagggggacgcaccagccatactgttcgataaagaattctgtgagtggatgattcaacagatcggcccaaagctcgacggcaaaataccagtgagtaggggtttcccaattgccgaggttttcactcttaagccactggagtttggaaaacccaacaccctggtctgttttgtgtcaaatctgttcccccccatgttaacggtgaactggcaacaccactcggtccctgtcgagggatttgggcccacctttgtctctgcggtcgatggcctctccttccaggcattctcttatctgaattttactcccgaacctagtgacatattttcttgttag

SEQ ID NO: 27448 - DNA, 873 bp, Artificial Sequence
  Description of Artificial Sequence: Synthetic coding sequence
gtctcatgctggttgtccgatagctgccaggagctccagcgaaggggaattatactgtgcagctatggcgttaccagcccaatcgctgtgtttggtcgacctggaaggctgagaaataggcggcatttcgaaaggagattggtgccaatgaagtggttgaagaagtgtctggatacagcccccacccccatgtggcccgacgatttgcagaaccacacgtttctgcacactgtttactgccaggacggcagcccatctgtgggcctctcggaagcctatgacgaagatcagctttttttttttgatttttctcaaaataccagagtcccgcggctgccagagtttgccgattgggcccaagagcagggtgacgcacctgccatcctatttgacaaggagttttgcgaatggatgattcagcagattggccccaagcttgatggcaagattcctgtgtccaggggctttcccattgcagaagtatttaccttgaagcctctcgagtttggaaagcctaacacactggtgtgctttgtctcaaacctgtttcctccaatgctgaccgtgaactggcagcaccactcagtgccagtcgaaggctttgggcccactttcgtgagtgcggtcgacggattgagctttcaggctttcagctatcttaatttcacaccagagccatctgatatattctcctgtatagtcacccacgagattgatcggtacactgctatcgcctattgggttcctagaaacgctctgcctagcgatcttctggagaacgtgctatgtggcgtcgcattcggtctgggagtgctagggatcattgtaggcattgtgctcattatctattttcggaagccatgctccggctag

SEQ ID NO: 27449 - DNA, 510 bp, Artificial Sequence
  Description of Artificial Sequence: Synthetic coding sequence
atgtggccggatgacctccagaatcacacattcctgcacacagtttattgccaggatggctctccaagtgttgggctgtcagaagcctacgatgaagaccagttatttttctttgattttagccagaatactcgggtgcccaggctgccggagttcgccgactgggctcaagaacagggggatgcacccgcaatcctgtttgacaaagaattctgcgaatggatgatccagcaaataggcccgaagctggacggcaagatacccgtgtctcgaggctttccaatcgctgaggtatttacactgaagcccctcgaattcggcaagcccaacacactggtgtgtttcgtgtccaacctctttccccccatgctgacagtcaactggcagcaccattctgttcctgtcgagggcttcggtcctacgtttgttagtgccgtggacggacttagcttccaggcattttcctatctgaatttcacccccgaaccctctgatatcttcagttgctag

SEQ ID NO: 27450 - DNA, 684 bp, Artificial Sequence
  Description of Artificial Sequence: Synthetic coding sequence
atggggcacgaacagaaccagggtgctgccctgctgcagatgctgcccctcctgtggttgctaccacacagctgggccgtccctgaagcacctacaccaatgtggcctgacgacctgcaaaaccacacttttctacacacagtgtactgccaggacggttccccttccgttggcctgagcgaagcctatgacgaggaccagctctttttctttgatttctctcaaaacacgcgtgtcccccgacttccagaattcgccgattgggcccaggaacaaggggacgctcctgccattctgttcgacaaagagttttgtgagtggatgatccagcaaattgggccaaagctcgacggcaagatcccagtctctagagtcaactggcagcaccactccgtcccagtcgaaggttttggccccacctttgtctccgccgttgatggcctgtcgtttcaggcattctcctatcttaatttcactcctgaaccatcagacatattttcatgcattgtgacccatgagatagaccggtacacagccatcgcttactgggtgccacgcaacgcgctgccttcagacctgctggaaaacgtgctgtgtggcgtggcttttggcctaggcgtgctaggaattatcgtggggattgtgctgattatatacttccggaagccatgttcaggtgattag

SEQ ID NO: 27451 - DNA, 510 bp, Artificial Sequence
  Description of Artificial Sequence: Synthetic coding sequence
atgtggccagatgacctgcagaaccacacttttctccacacagtctactgccaagacggaagtccttccgtggggctcagtgaggcttatgatgaggatcagctattcttttttgacttcagccagaatacacgagtgccgagattgcccgaattcgccgactgggcccaagagcagggggacgctcccgcaattctcttcgacaaggaattttgcgagtggatgattcagcagatcggacccaaattggatggaaagatcccggtaagtcggggatttcctatcgccgaggtgttcaccctcaagccactcgaatttgggaaacctaataccctggtgtgtttcgtctctaatctgttcccgcctatgttgaccgtgaattggcagcaccactctgtccctgtggagggattcggacccactttcgtttctgctgtcgatggtctctcattccaggccttctcatacctgaatttcacacctgaaccttccgatattttctcctgttag

SEQ ID NO: 27452 - DNA, 501 bp, Artificial Sequence
  Description of Artificial Sequence: Synthetic coding sequence
atgggacacgagcaaaaccagggagccgcccttttgcagatgctgccactcctctggctactgcctcacagttgggccgtcccagagggttttcctatcgctgaagtattcactttgaagccactggagtttggtaagcccaacacgctggtatgtttcgtgtccaacctgttccctccgatgctaaccgtcaattggcagcatcactcagttccggtggagggttttgggccaaccttcgtgtccgccgtagacggactgtccttccaggcgttttcctacctaaactttacacctgagcctagcgatatcttctcatgtattgtcactcacgagattgaccggtacacggcaattgcctattgggtgcctcgcaacgcgctaccctcagacctgctggagaacgttctctgtggagtggccttcgggctgggtgtgcttggtatcatagtcggcatcgtgctcatcatctacttccgaaagccatgcagcggcgactag

SEQ ID NO: 27453 - DNA, 684 bp, Artificial Sequence
  Description of Artificial Sequence: Synthetic coding sequence
atgggtcacgagcagaaccagggtgccgctctgctgcagatgctccccctactgtggttattgcctcactcatgggctgtgcccgaagcccctactcctatgtggcccgacgacctgcaaaatcacaccttccttcacacggtctattgccaggacggctctccttccgtcggcctttcagaagcttatgatgaggaccaactttttttttttgatttctcccaaaacacgcgtgtgcctagactcccagaattcgccgactgggcacaggagcagggggatgctcctgccatactgtttgataaagagttttgcgaatggatgatccagcaaatcggacccaaactggacgggaagatccccgtgtcacgagttaactggcaacaccactccatcccagttgagggattcggtccaacgtttgtgtctgctgttgatggactctcctttcaggccttctcttacctgaactttacccctgagccaagcgacattttctcttgcatcgtcacgcacgaaattgatcggtatactgcaatcgcctactgggtgccccggaatgccctgcctagcgacctgctcgagaacgtactgtgtggcgtggcttttggcctgggcgtcctgggaattatcgtgggtatcgtgctgatcatttactttcgtaagccttgcagcggcgattag

SEQ ID NO: 27454 - DNA, 873 bp, Artificial Sequence
  Description of Artificial Sequence: Synthetic coding sequence
gtcagctgctggctgagcgacagctgtcaagagctgcaaagaagaggaatcatcctgtgtagctatggagtgacctcaccgatcgctgttttcggccgccctggccggctgcgtaacaggagacattttgagagacgtctcgttccaatgaagtggctcaagaagtgtctcgatactgcccctaccccaatgtggccagatgacctccaaaaccatactttcttgcacaccgtatactgccaggatggctctccttccgtgggtctcagcgaggcttatgacgaggaccagctgttcttttttgacttctcccagaacacaagggttcctagacttccagaatttgccgactgggcacaagaacagggagatgcaccagccatcctgttcgacaaggagttctgtgagtggatgattcaacagatcgggcccaaactggatggtaaaattccagtctctcgaggctttccaatcgcagaagtgtttactctcaaaccacttgagtttggcaagcctaacacactggtgtgttttgtgtccaacttattcccacccatgctcaccgtgaactggcaacaccatagcgtacctgtcgagggatttggcccaacctttgtgagtgctgtcgatggactctcctttcaggccttcagttatctgaacttcaccccagagccaagcgatatctttagctgtatcgtgacccacgagatcgatcgttataccgccattgcttattgggtgccccgcaatgccttgcccagcgatctgctggagaacgttctttgtggtgttgctttcggcctgggtgtgctcggcattatcgtcgggatagtcctgattatatacttccgcaaaccttgctcaggatag

SEQ ID NO: 27455 - DNA, 510 bp, Artificial Sequence
  Description of Artificial Sequence: Synthetic coding sequence
atgtggccagatgacttacagaaccataccttcttacataccgtgtactgccaggatggttccccaagcgtgggtctctccgaggcgtacgatgaagaccagctgtttttctttgatttttcacagaacacacgcgtacctagactccccgagtttgcggactgggctcaggagcagggcgacgcacccgctatcctgttcgacaaagaattttgcgaatggatgatccagcagattggtcccaaactagacggaaagattccggtcagcagaggcttcccaattgccgaggtcttcacgttgaagcctctggaatttggtaaacccaacacgttggtgtgtttcgtttccaacctcttccctccaatgctcaccgttaattggcagcatcatagtgtccctgtggagggtttcggaccaactttcgtgtcagcagtggatggccttagttttcaggctttctcatatcttaatttcacgcctgaaccctctgacatctttagttgttag

SEQ ID NO: 27456 - DNA, 510 bp, Artificial Sequence
  Description of Artificial Sequence: Synthetic coding sequence
atgtggcctgatgatctccaaaaccacacgttccttcacaccgtgtactgtcaggacggaagcccctcagtcggactgagtgaggcttacgatgaggaccagctctttttttttgacttctcccaaaacactcgagttccccgcctccccgagtttgccgattgggcccaggaacagggagacgctcccgccatactgtttgacaaggagttttgcgaatggatgatacaacagattgggcccaaactggatgggaagattcccgtatctaggggattccccatcgccgaggtgtttactctgaaaccgctggagtttggcaagcctaacacactcgtgtgtttcgttagcaaccttttcccacctatgcttacagttaactggcaacaccacagcgtgccagtggaaggatttgggccgacgttcgtgagcgcggtcgatggactgtccttccaggccttctcctacttgaattttactccggaacccagcgatatcttttcttgctag

SEQ ID NO: 27457 - DNA, 684 bp, Artificial Sequence
  Description of Artificial Sequence: Synthetic coding sequence
atgggccacgaacagaaccagggggcagcactgctccagatgttgcctcttctctggctcctgccgcactcgtgggctgttcctgaggctccaactcctatgtggcccgacgacctgcagaaccatacctttcttcacaccgtttattgtcaggatgggagccccagcgtcgggctgtccgaggcgtacgatgaggatcagctttttttttttgacttcagtcagaatacacgtgtgccacgattgcctgagttcgctgattgggcccaggagcagggtgatgctccagcaatcctgtttgataaagaattctgtgaatggatgatccagcagatcggcccgaaactggatggaaagataccagtatcacgcgtaaactggcagcatcatagtgtccccgtcgagggctttggaccgacattcgtgtcagccgtggacgggcttagctttcaggcctttagttacttgaactttactccagagcctagtgatattttcagttgcatcgtgacccatgaaattgataggtataccgcaatagcatactgggttcctcggaatgccctaccttcagatctgctggagaacgtgctttgcggggttgccttcggactgggtgtgctgggcattattgtgggcattgtgctcattatttatttccgaaagccctgttcgggtgattag

SEQ ID NO: 27458 - DNA, 873 bp, Artificial Sequence
  Description of Artificial Sequence: Synthetic coding sequence
gtgagttgctggctatccgacagctgtcaggagcttcaaagaaggggaataatactgtgcagctacggcgttacctcccccattgctgtattcgggaggccagggagactgcgcaaccggcgtcacttcgagcggcggctcgttcccatgaaatggctgaagaaatgtctcgacaccgccccaacacccatgtggcctgacgatctccagaaccatacatttctacacactgtgtactgccaggatggttcaccgtctgtcgggctctccgaggcatatgatgaggatcagctgtttttctttgacttctctcagaacactagagtcccccgactgccagaatttgctgattgggctcaagagcaaggcgatgcccctgccattttgtttgacaaggagttctgtgagtggatgatccagcagatcggtcccaagctggacggtaagataccagtatcccgcgggttcccgattgcagaagtgttcacgctcaagcctcttgagtttggtaagcccaacactctggtctgctttgtctccaatctcttcccacccatgctgacagtgaactggcagcaccattctgtccctgtggagggctttggccctacctttgtgagcgctgtagatgggttgagctttcaggcttttagttaccttaactttacacctgagcctagcgacattttcagttgtatcgtgacacacgaaatcgaccgctacacagctatcgcatattgggtacctaggaacgccctgccttctgacctacttgagaacgtactttgcggtgtcgccttcggcctcggggtactgggaattattgtggggatcgtcctgatcatttattttcgtaagccttgttcgggttag

SEQ ID NO: 27459 - DNA, 786 bp, Artificial Sequence
  Description of Artificial Sequence: Synthetic coding sequence
atgggacacgaacagaatcagggagcagcactcttgcagatgctcccccttctgtggttgctgcctcattcttgggctgtgcctgaggctcctactcctatgtggcctgacgacttacaaaaccacacctttctacacacggtttactgtcaagacggaagtccatccgtgggcctatccgaagcatatgacgaagatcagctgttcttctttgattttagccagaatactagagtgcctcgtttgcccgaattcgcagattgggcacaagaacagggggacgcacctgcgatcctcttcgacaaagagttctgtgagtggatgattcagcagataggccccaaactggacggaaagatcccagtgagccggggctttcccattgcagaagtgttcaccctgaagcccttagagtttggtaagcccaatacccttgtctgctttgtgtctaacctctttccccctatgctgacggttaattggcagcaccactcggtgccagtcgaaggtttcggacccacctttgtatctgccgtcgatggcctcagctttcaggcttttagttaccttaacttcacaccagaaccttccgatatttttagctgtattgtcacccacgagatcgatcggtatacagcaattgcttactgggtgcctagaaacgccctcccctcagacctgctggagaatgtcttgtgcggagttgcatttggtctcggcgtcttgggaattattgtggggattgttctaattatctacttccgaaagccatgcagcggcgattag

SEQ ID NO: 27460 - DNA, 501 bp, Artificial Sequence
  Description of Artificial Sequence: Synthetic coding sequence
atgggccatgaacagaaccagggcgcggcgctgctgcagatgcttccgctgctgtggttgctgccgcacagctgggctgtgccggaggggtttcccatcgcggaagtcttcacactgaaaccactcgagtttggaaagccgaacacccttgtctgttttgtctccaatttgtttcctcccatgctgacagtcaattggcagcatcatagcgtaccagtggaaggttttggaccaacatttgtcagcgcagtcgatggcctgtcatttcaagcttttagctacctgaacttcacccccgagccatcagacattttctcctgtattgttacccatgaaattgaccgttacactgccatagcatattgggtccctcgcaacgccttgccatccgacctcttagagaacgtcttgtgcggggtggctttcggattaggtgttctaggtatcatcgttgggattgtcttgatcatatacttccggaaaccttgctccggcgactag

SEQ ID NO: 27461 - DNA, 510 bp, Artificial Sequence
  Description of Artificial Sequence: Synthetic coding sequence
atgtggcccgacgacctgcagaatcatacatttctgcacaccgtttactgccaggacggatccccatcagtgggtctctccgaggcttatgacgaagaccaactcttcttctttgactttagccagaatactcgagttccacgtctccctgagtttgccgactgggcccaagagcagggagacgcgccggccatcctcttcgataaggaattttgcgagtggatgatacagcagattggaccaaagctcgacggcaagatcccagtgtctagaggctttccaatcgctgaagtatttactctcaagccccttgaatttggaaagccaaacacgctagtgtgctttgtttcgaacttgttcccaccaatgctgaccgtgaactggcaacatcactctgtgcccgtggagggatttggaccaacattcgtgagcgcagtggacggtctgtcatttcaggctttctcttatctaaacttcacccccgaaccttctgatatattcagttgctag

SEQ ID NO: 27462 - DNA, 786 bp, Artificial Sequence
  Description of Artificial Sequence: Synthetic coding sequence
atggggcatgaacagaatcagggtgcagcactgctgcagatgttgcctttgctttggctgctaccacactcctgggcagtgccagaggctccaactcccatgtggcccgacgatctccaaaaccatacattcctccacacagtttactgccaggacgggtcccccagcgtcgggctctccgaggcttacgacgaggatcagctgttttttttcgattttagtcagaacactcgggtcccaaggctacctgagtttgcggattgggcacaggaacagggggacgcgcctgctatcctttttgataaggagttctgtgagtggatgatccagcagatcggacccaagctcgacggcaagataccggtctctaggggtttccccattgccgaggtgttcaccctcaaacctctcgagtttggcaagccgaatacgctcgtctgcttcgtaagcaacctgtttccgcccatgcttaccgtcaattggcaacaccactctataccagttgaggggttcggtcccacatttgtttccgccgtggacggactaagctttcaggccttttcatacttgaacttcactccagagcccagcgatatctttagctgcatcgttacccatgagattgatagatatacagcgatcgcgtattgggttccccgcaatgctcttcctagcgatttactggaaaacgtgctgtgcggagtggcatttgggttgggagttcttggcattatagtgggcatcgtgctgattatctatttcagaaaaccctgcagtggagactag

SEQ ID NO: 27463 - DNA, 873 bp, Artificial Sequence
  Description of Artificial Sequence: Synthetic coding sequence
gtatcctgttggctttccgatagttgtcaggagttacagcgaagggggatcatcctatgcagctatggtgtcacttctccgattgcagtctttgggcgtcccggaaggctcaggaataggagacatttcgaacgaagattggttccaatgaaatggctaaaaaagtgcctcgataccgcaccaactcccatgtggcctgacgacttacagaatcacacctttctccacaccgtctactgccaggacggatctccatcggtggggctgtcagaggcctacgacgaagaccaactattcttctttgacttctcccagaacaccagagtgcctaggttgcctgagtttgctgactgggcgcaggagcagggagatgctcctgccatcctatttgacaaggagttctgtgaatggatgatccagcaaattggacctaaattggatgggaagattcccgtgagtagaggatttccaattgctgaagtgtttacactgaaaccactggaattcggtaaaccaaacacacttgtctgctttgtatcaaacctctttcccccaatgttgaccgtgaactggcagcaccactccgtgcccgtcgaaggtttcggccctacattcgtctcagctgtggatgggctcagctttcaggctttcagctatctgaatttcacacccgagccatcagatatattttcatgcattgtgacgcatgagatcgataggtacacagctattgcctactgggtaccgcgtaatgccctaccctcagacctcctcgaaaacgtcctttgcggagtggctttcggcctgggagttttgggaattattgtagggatcgtcttgattatatattttcgaaagccatgctcaggctag

SEQ ID NO: 27464 - DNA, 510 bp, Artificial Sequence
  Description of Artificial Sequence: Synthetic coding sequence
atgtggcctgacgacctgcagaaccacactttcttacacaccgtgtactgccaggatgggagcccttccgtcgggttgtctgaagcctacgacgaggaccagttgtttttcttcgatttttcccaaaatacccgcgtcccccggttgccagagtttgccgactgggcccaggagcaaggcgacgccccagctattttgtttgataaagagttttgcgaatggatgatccaacagattggccccaaactcgacggtaagatcccggtgagccgagggttcccgattgccgaagtgttcaccttgaaacctttagaatttgggaagcccaacactcttgtgtgctttgtgagtaacttgttccctcccatgctcactgtgaactggcagcatcatagtatcccggttgaaggctttggaccgacctttgtaagcgctgtcgatggactgtctttccaggccttcagttacctgaacttcaccccggagccatcagatatcttttcctgctag

SEQ ID NO: 27465 - DNA, 786 bp, Artificial Sequence
  Description of Artificial Sequence: Synthetic coding sequence
atggggcacgaacagaaccagggagcagcactcctgcagatgctccctctcctgtggctactgccccactcctgggcagtgcctgaagctcccacgcccatgtggccggacgacctacaaaaccataccttcctacataccgtctactgccaggatggttccccttctgtgggcctcagcgaggcgtacgatgaggatcaattattcttcttcgatttctcccagaatacacgtgtgccacgattaccagaatttgctgactgggcccaagagcagggggacgctcccgccatactctttgataaggagttttgcgagtggatgatccagcagatcggcccaaaactcgacggcaaaatccccgtgtctcgcggcttcccgatcgctgaggtgtttaccctgaaacccctagagtttgggaaacccaacacattggtgtgctttgtgagcaacctgttcccaccaatgctcactgtgaattggcagcatcactccgtacccgtagagggatttggtcccactttcgtttcggccgttgacggtttgagctttcaggcattttcttatcttaacttcacgcctgagccatctgatattttttcgtgcatcgtcacccacgagatcgatcggtacaccgcaatagcttactgggtgccacggaatgccctcccaagcgacttgctggaaaacgtcttatgcggtgtcgccttcggtctcggggtgctagggatcattgtgggtattgtactcatcatctacttccgaaagccatgctccggggattag

SEQ ID NO: 27466 - DNA, 501 bp, Artificial Sequence
  Description of Artificial Sequence: Synthetic coding sequence
atgggacatgaacagaaccaaggcgccgccctgctgcagatgctaccactgctttggctgttgcctcactcttgggccgtccctgagggctttcccatcgcagaagtgtttacactgaaacccttagaatttggtaaaccgaacacgttggtgtgctttgtgagtaacctctttccgcctatgctaaccgtgaactggcagcaccacagcatcccagtggagggcttcggacccacatttgtatccgcggtggatggtctgagctttcaggccttcagttacctcaatttcacccctgagccaagcgacattttttcatgtattgtgactcatgagattgatcgatacaccgctattgcgtactgggtaccacgaaatgccttaccctccgatctgctcgaaaatgttctgtgcggcgttgctttcggccttggcgtgctgggtattattgtgggcatcgtgctcatcatctacttcaggaaaccctgtagcggggactag

SEQ ID NO: 27467 - DNA, 786 bp, Artificial Sequence
  Description of Artificial Sequence: Synthetic coding sequence
atggggcacgagcagaaccagggtgccgcactcttacagatgctccctttgctgtggctgttgccacactcgtgggccgtaccagaggcgcccactccaatgtggccagacgacctacagaaccacacatttttgcacacagtgtattgccaggacggctctcccagtgtgggactgtccgaagcctatgacgaagaccagcttttcttcttcgacttctcccagaacacaagagtgcctaggctgcccgaatttgctgactgggcgcaggagcagggcgatgcacctgcgatcctgtttgataaggaattttgcgagtggatgattcagcagattggccctaagttggatggaaagatacctgtatcacgggggttccccattgccgaggtctttacactgaaaccgttggagttcggcaagcccaacacactggtctgtttcgtatcgaacctgtttcctcccatgcttacagtcaactggcagcaccacagcgtacccgtcgagggctttggacccacattcgtcagtgccgtggacggactctcttttcaagccttctcttatctaaacttcaccccagagccctcggatatctttagctgtattgtgacgcatgagatcgatcgctacaccgctatcgcctattgggttccccgcaatgccctccctagcgatctgctagagaatgtgctctgcggcgtggcctttggtctcggagtcctgggtattatcgtgggtatcgtactgatcatctacttcagaaagccatgctcgggggactag

SEQ ID NO: 27468 - DNA, 684 bp, Artificial Sequence
  Description of Artificial Sequence: Synthetic coding sequence
atggggcatgagcaaaaccagggggccgctctccttcagatgctccccttactgtggcttcttccccacagttgggccgtgcccgaagccccaactcccatgtggccggatgaccttcaaaatcacacattccttcataccgtgtattgtcaggatggcagtccatcagtgggcctttcagaggcatacgatgaggatcagctgtttttcttcgattttagccagaacacaagagttccacggctgcccgagttcgctgattgggcccaggaacagggagacgctcccgcaatcctcttcgacaaggaattttgtgagtggatgatacagcaaatagggcccaaactagacgggaagattccagtgtctcgcgtcaactggcagcatcactctgtcccagttgagggtttcgggcccacattcgtgtcagctgtggacggattatcttttcaggctttttcatatcttaattttacaccagagccgtcagatattttctcctgcattgtaacacatgagatcgataggtataccgccatagcatactgggtcccacggaacgctctgccaagcgatctgttagagaacgtcctttgtggcgtggccttcggattgggtgttcttggaattatcgtgggcatcgtcttaattatatatttcaggaaaccttgctctggagactag

SEQ ID NO: 27469 - DNA, 501 bp, Artificial Sequence
  Description of Artificial Sequence: Synthetic coding sequence
atgggtcacgaacagaatcagggggctgcccttctccagatgttgcccctgctctggctacttccgcacagttgggccgtccccgagggtttccctattgccgaggtgtttacactcaaacccctggaattcggcaagcctaacaccctggtgtgttttgtatctaatttgttcccgccaatgctcacagtcaattggcagcaccatagtgtccccgttgaaggctttggtccaaccttcgtctccgcggtcgacggcttgagtttccaggctttttcctacctgaacttcacacccgagcccagcgacatcttctcctgtatcgtgacacatgagattgataggtacactgcaatcgcctattgggtccccaggaacgcgctgccctccgaccttttagaaaacgtgctttgcggcgtggctttcggcttgggtgttctggggataatcgtgggcatcgtgctgatcatttactttcgtaagccgtgctcaggagattag

SEQ ID NO: 27470 - DNA, 684 bp, Artificial Sequence
  Description of Artificial Sequence: Synthetic coding sequence
atggggcatgaacaaaatcagggggctgcactgttacaaatgctcccattgctctggctcctcccacactcttgggctgtgccagaagcccccactccaatgtggcccgatgaccttcagaaccatactttcctgcatacagtttactgccaagatggtagcccttccgtgggtctgtcagaggcttacgatgaggaccagctgtttttcttcgatttttctcagaatactcgggtgcccaggctcccggagttcgctgactgggcccaggagcagggagatgcgcccgctatcctgttcgataaagagttctgcgagtggatgattcagcagataggccccaagctagacggtaaaatccccgttagccgcgtgaactggcagcaccacagtgtcccagtggaggggtttggaccaacattcgtgtccgctgtggacggcctcagttttcaggccttttcctaccttaactttacgccggagccttccgacatattcagttgcatagtcactcatgagattgatcgttatacagccattgcatactgggttccacgcaacgcgctcccgagtgatctacttgaaaacgttctttgcggcgtggcgtttgggctgggggtcctgggtatcatagttggcatcgtgctaatcatttacttccgcaagccctgttcaggagactag

SEQ ID NO: 27471 - DNA, 684 bp, Artificial Sequence
  Description of Artificial Sequence: Synthetic coding sequence
atgggccacgagcagaaccagggggcagcactgcttcagatgcttcctctgctgtggctgctgcctcattcatgggcagttcccgaagctccaacgccgatgtggcctgatgatctacagaaccacacctttctacacaccgtctattgccaggacggcagtccaagcgttggactctcagaagcgtacgacgaggatcagctcttcttcttcgatttctcacagaatacccgcgtcccgagacttcccgagtttgcggactgggcccaggaacagggggacgcccctgctattctctttgacaaggagttctgtgagtggatgattcagcagatcgggcctaagctcgatggaaagattccggtctctcgggtgaactggcagcaccatagcgtccctgtagagggattcggccctactttcgtgtccgccgtcgatggcctgagcttccaagctttttcatatttgaatttcactcctgaacccagcgatatcttttcctgtatagtcacacatgagattgatcgttacaccgcgattgcgtactgggttcccaggaatgctctgccatccgatctcctcgaaaatgtgctttgcggggttgcttttgggctgggggtgctgggcattattgtggggattgtgctcataatctattttcgcaagccatgttccggcgactag

SEQ ID NO: 27472 - DNA, 786 bp, Artificial Sequence
  Description of Artificial Sequence: Synthetic coding sequence
atgggccacgagcagaaccagggcgctgcgctcctgcaaatgctacccctcctttggctcctgccccattcatgggctgtgcctgaggcacccacaccgatgtggccagacgatctccagaatcacaccttcctgcacacagtttactgccaggatggctccccatcagtcggtctctcagaagcctacgatgaggaccagctgtttttcttcgatttctcgcagaacactcgggtgcccagactcccagagttcgccgactgggcccaggagcagggggatgccccagctatactgtttgacaaggaattttgcgagtggatgatccagcagattggccctaagctggacggtaagatacccgtgtcacgcggattccctatcgccgaggtatttactctgaaaccgctggaatttggcaaacccaacacactagtgtgtttcgtgagcaatctctttccccccatgttgaccgttaactggcagcaccactctgtgcccgtggagggctttgggcctacctttgtatctgctgtcgatgggctaagcttccaggctttcagctaccttaacttcacacctgagccgtcagatatattctcctgcatcgtgacacatgagatcgaccgctacaccgcaatcgcatattgggtcccccgcaacgctctcccaagcgacctgctggaaaacgtgttatgtggagtggccttcggtctgggggttcttggaatcatcgtaggaatcgttctaattatctactttcggaaaccttgttctggggactag

SEQ ID NO: 27473 - DNA, 501 bp, Artificial Sequence
  Description of Artificial Sequence: Synthetic coding sequence
atgggacatgagcaaaatcaaggggccgccctcctgcaaatgcttcccctgctgtggctactcccccatagctgggcagtccccgaaggtttccccatcgcagaggtttttacattaaaaccgttggaatttggcaagccaaatacactggtatgtttcgtctccaatctgttccctccgatgttaaccgttaactggcagcatcactctgtgcccgtggaggggttcggtccaacattcgtcagtgcagttgacgggctatctttccaagccttctcatatctgaacttcacccccgagccttctgatatcttctcatgtattgtgacacatgaaatcgatcggtacacagctatcgcatactgggtgccacgcaacgccctgccaagtgatttattagagaatgtcttgtgcggagtggcattcgggctgggggtgcttggcatcatcgttgggattgtcctcatcatatacttcaggaaaccctgctcaggagattag

SEQ ID NO: 27474 - DNA, 786 bp, Artificial Sequence
  Description of Artificial Sequence: Synthetic coding sequence
atgggacacgaacagaatcagggtgccgccctgctacagatgctcccactgttgtggctgctcccccattcctgggccgtccccgaggcgcctacccccatgtggcctgatgatctgcaaaatcacactttcctccataccgtatactgccaggatggaagtccgagcgtcgggcttagtgaggcctacgacgaggatcagttattcttctttgacttcagccaaaacacccgcgtcccaaggctgccagaatttgccgattgggcacaggaacagggagatgcccccgccatactgtttgacaaggaattctgtgagtggatgattcagcagatcgggcccaaactagatggcaaaatacccgtttcccgggggtttccaatcgccgaggtgtttacattgaaacccctcgagttcggcaagcctaatacactggtgtgcttcgttagcaatttgtttccccccatgctgacggtgaactggcagcatcactcggtccctgtcgagggattcggtcctacctttgtgtcagccgtcgacggcttaagctttcaggcattttcatacctcaattttacgccagagccctccgacatcttttcctgcatcgtcacacatgagatcgatagatacactgctatcgcttactgggtcccacggaacgcactgccgtcggacctgctcgagaatgtgctttgcggtgtggccttcggcttaggcgtgttgggcattatagtggggattgtcctgatcatctacttccgaaagccttgctccggagattag

SEQ ID NO: 27475 - DNA, 873 bp, Artificial Sequence
  Description of Artificial Sequence: Synthetic coding sequence
gtgagctgctggttgtcagattcctgtcaggagttacagcgcagaggaattatactgtgttcttatggtgtgactagccccattgcagtgtttggcaggcctggtcgcctgcggaacaggcgccactttgagagacgcttggtgcccatgaagtggctcaaaaaatgtctggacactgcccccacaccaatgtggcccgacgatctgcagaatcacacctttttacacaccgtctattgccaagatggatctccgtctgtcgggcttagcgaggcatacgacgaggatcagctgttcttttttgatttttctcagaacacacgcgtgccccgtctacctgaattcgccgattgggctcaggagcagggtgatgctccggcgattttgtttgacaaagaattctgtgagtggatgatccaacagatcggccccaagctcgatgggaaaattccagtgtcaaggggctttccaattgctgaagtgtttactctgaaacctctggagttcggcaaaccgaatacactggtctgctttgtcagcaatctttttccaccaatgctgaccgtaaactggcagcatcactcggtccccgtagagggctttggtcctactttcgtgtctgccgtagacggactatcctttcaagcatttagctatctaaatttcacccccgagccatcagacatctttagctgcatcgtgacacacgagattgaccgctacaccgccatcgcctactgggtccccaggaatgctctacccagtgatctcttagaaaacgttctgtgtggcgtagcgtttgggctcggtgtgcttggtattatagtgggaatcgtgctgatcatatactttcgaaagccttgttcgggctag

SEQ ID NO: 27476 - DNA, 873 bp, Artificial Sequence
  Description of Artificial Sequence: Synthetic coding sequence
gtgagttgctggctaagcgactcctgccaggaactgcagaggcgcggcattattttgtgttcctacggcgtaacatctcccatcgcggtttttggccgccccggaaggctgcggaataggcggcacttcgaacggcggttggtcccaatgaaatggttaaaaaaatgccttgatactgctcccacgccaatgtggcctgacgaccttcaaaatcatacctttctgcataccgtgtactgtcaagatggatccccttcagtgggactttctgaagcgtacgacgaggatcagctctttttttttgacttctcgcaaaatacccgcgtgccacgattgccagagttcgcggattgggcccaggaacaaggcgatgcaccggccatcttattcgacaaggagttttgcgagtggatgatccagcagattggtcccaagctggacggcaaaattcccgtgtccaggggattccccatcgctgaggtgttcactctgaaaccacttgaattcggcaagccaaacacattagtctgctttgtctctaacttgttcccgcctatgcttacggttaactggcagcatcactccatcccagttgagggattcggcccaactttcgttagcgcagtggacggtctcagcttccaggccttttcctacttgaacttcacccctgaacccagcgatatcttctcatgtatcgtgacccacgaaatagatagatataccgccatcgcatattgggtgccacgaaatgctttacctagtgatctgcttgaaaatgtgctctgcggcgtcgcattcggtctgggtgtgttgggcattattgtaggtatcgtgttgatcatctatttcagaaaaccatgctcggggtag

SEQ ID NO: 27477 - DNA, 873 bp, Artificial Sequence
  Description of Artificial Sequence: Synthetic coding sequence
gtgtcatgctggctcagcgacagctgtcaagaactacagcggcgcgggatcatcctgtgttcgtatggagtcacctcccctattgcagtctttggaaggcccgggagactacgtaatagaaggcattttgagcgacggctggtaccaatgaaatggcttaagaagtgcttagatacagcacccacccctatgtggcctgatgacctgcagaaccatacttttcttcataccgtctactgccaggatgggagccccagcgtgggcctctcagaagcctacgatgaagaccagctgtttttctttgactttagtcagaatacaagggtccctcgcttaccagaattcgccgattgggctcaggaacagggagatgctccggcgatcctgtttgataaggaattttgcgagtggatgattcagcagattgggcctaagcttgatgggaagatccccgtgagtcggggctttcccatcgcagaggttttcacactgaaacctctggagtttggcaaaccaaatacactcgtatgtttcgtgtccaacctgttccctccgatgttgacagtcaactggcaacaccacagcgtccctgtcgaggggttcggtcccacgttcgtgagcgccgtggatggactctccttccaagccttcagctatcttaatttcacacctgaaccttctgacatcttctcgtgtatcgtgacccatgaaatcgataggtatactgccattgcctactgggtgccgaggaatgccctgccatcagatttgttagagaatgtcctctgcggtgttgcgttcggactgggggtcctgggtatcatagtaggaatcgttctgattatctactttagaaaaccctgctccggctag

SEQ ID NO: 27478 - DNA, 501 bp, Artificial Sequence
  Description of Artificial Sequence: Synthetic coding sequence
atggggcacgagcaaaatcagggcgcggcccttcttcagatgctccctctgctgtggctacttccccacagttgggcggtacctgaggggtttcctatagctgaagttttcacattgaaacctctggagtttggcaaaccaaacactcttgtctgttttgtctccaatctatttccacctatgctgactgtaaattggcagcatcattccgtcccggtggagggcttcgggccaacctttgtgtccgccgttgatggtctgtcctttcaggcatttagctatttgaattttaccccggaaccctccgatatcttctcgtgcattgtcacccacgagattgatcggtataccgcaattgcctactgggtgccaaggaacgctctacccagtgacttgctggagaatgtgctctgcggcgtggcattcggacttggagtgctggggatcatcgtgggaatcgtcctgataatatacttcagaaagccatgctcaggggattag

SEQ ID NO: 27479 - DNA, 510 bp, Artificial Sequence
  Description of Artificial Sequence: Synthetic coding sequence
atgtggcctgacgaccttcagaaccacacattcctgcacacagtatactgccaagatggctctccctccgtgggactgtctgaagcttacgacgaggatcagctgtttttcttcgacttcagccagaataccagagtcccacggctgccagagttcgcagattgggcccaagagcaaggagatgcgcccgcaattctgtttgacaaagagttttgcgaatggatgatccaacagattgggcccaaattggacggcaaaatccccgttagcaggggcttcccaatcgctgaagtctttactcttaaacccttagagtttggcaagcctaacactctggtctgcttcgtgtcaaacctgttcccacctatgttgacggtgaactggcagcaccacagcgtgcctgtagagggtttcggcccaacttttgtttcggctgttgacggcctgtcattccaggctttcagctatctaaactttaccccagaaccgtcggacattttcagttgttag

SEQ ID NO: 27480 - DNA, 792 bp, Artificial Sequence
  Description of Artificial Sequence: Synthetic coding sequence
atgattaccttcctgcctctcttgctgggactgtctctgggatgtacaggcgcggggggctttgtagcacacgttgaatccacatgtctgctggatgatgcaggaaccccaaaggacttcacatattgtattagctttaacaaagatcttctgacttgttgggatcccgaggaaaataagatggcaccttgcgagttcggtgttctgaattccctggccaacgtgctttcccagcacctgaatcagaaagacacattgatgcagcggctgcggaacggattgcagaactgcgccacccacacacaacccttctggggctcactgaccaaccgcaccagacctcccagcgttcaggttgcaaagactacaccattcaatacgagggaacccgtgatgcttgcctgctacgtatgggggttttatccggctgaagtaacaataacctggcggaaaaacggcaagttggtgatgcctcattcctccgcgcataagacagcacaaccgaacggagattggacatatcagaccctctcccatctggcccttaccccgagctacggcgacacttatacctgcgtggtcgagcatattggcgcaccagagcctatccttcgggactggactcccggtctcagccccatgcaaaccctgaaggtctccgtatccgcagtgactttaggattggggctaataatattctccctcggagtgatcagctggcgtcgagccggccactcttcgtatacccccctgccggggtccaactatagcgaggggtggcatatttcttag

SEQ ID NO: 27481 - DNA, 792 bp, Artificial Sequence
  Description of Artificial Sequence: Synthetic coding sequence
atgataacatttctcccactgctgctggggttgtccctgggctgcactggggccgggggattcgtggctcacgtcgagtctacatgtctgcttgacgatgccggcacacccaaggatttcacatactgtatctccttcaataaagacctcttgacatgttgggatccagaagagaataaaatggcgccttgtgaattcggcgtgctgaactccctcgctaatgtcctgagccagcacctgaatcaaaaggacactttgatgcaaagacttcgcaacggattgcaaaattgcgccacccatacccagcctttttgggggagtttaacaaacagaactcgccctccgtccgttcaggtggccaaaacgacaccttttaatactcgagagccagtgatgttggcatgctacgtgtggggtttttatcccgctgaagttaccattacttggaggaagaacgggaagctggtgatgccacacagcagcgcccacaaaacggcacagcctaatggtgactggacctaccagacattaagtcatctcgctttgactcccagctacggggatacttatacttgtgtcgtggagcatataggagcacccgaacctattctgcgagactggacccccggtctgagccctatgcaaactctgaaggtgtccgtctcggccgttacactgggcttgggcttgatcattttttctctcggggtcatctcctggcgccgtgcaggacactcatcttacacacccctcccaggcagcaattatagtgagggctggcacatcagttag

SEQ ID NO: 27482 - DNA, 792 bp, Artificial Sequence
  Description of Artificial Sequence: Synthetic coding sequence
atgattacctttctgccgctcctgttaggcctgagtttggggtgcactggagctggaggatttgtcgcacatgtggagagtacttgcctcttggatgatgcaggcacacctaaggacttcacatactgcatcagtttcaataaggatcttctgacctgctgggatccagaggagaacaagatggccccgtgcgagttcggcgttcttaacagtttggctaatgttttgtcacaacatcttaatcagaaggatactcttatgcagcgcctgaggaatggcttacaaaattgtgctacacatacccagcctttttggggcagcctcacaaaccggactaggccacctagcgtgcaagtggctaaaaccaccccgtttaacacacgggagccagtgatgctcgcttgctacgtctggggattttacccggccgaagtgaccattacatggcggaagaatgggaagctcgtcatgccacacagctctgcccataaaacagcacaacctaacggggactggacctatcagactctgtctcacttggctctgacaccttcttacggggatacttacacttgcgtggtcgagcataccggggctcctgaaccgatcttgcgagattggacgccggggcttagtcccatgcaaacattaaaggtgtctgttagcgcagtgacactgggccttggactcatcattttctcattgggtgtcatttcttggagacgggccggtcactccagttatacacccttgcccggatctaattactccgagggatggcatatctcatag

SEQ ID NO: 27483 - DNA, 426 bp, Artificial Sequence
  Description of Artificial Sequence: Synthetic coding sequence
tgaacccgccccccctcagtgcaagtggcaaagactactccgttcaatacacgggagccagtaatgctggcttgctacgtttgggggttttatccagccgaggtgacaatcacctggaggaaaaacgggaagctagtgatgccgcattcctcagcgcacaagaccgcgcaaccaaacggcgactggacctaccagactctgtcccacctcgcgttaacccccagttacggggacacctacacctgtgtcgtcgagcatataggggctcctgagcccattctgcgtgactggacccccggccttagtccaatgcaaactcttaaggtgtcagtcagtgctgtgacgctcggactcggactgataattttttccctaggcgtcatcagctggagacgggccggccatagcaggtggcacatttcctag

SEQ ID NO: 27484 - DNA, 774 bp, Artificial Sequence
  Description of Artificial Sequence: Synthetic coding sequence
atgatcacctttttgccactcctgctcggtctgtccctcggttgtactggcgcgggaggattcgtcgcacatgtggaaagtacctgcctcctcgatgacgcaggcacgccaaaggacttcacatattgtatcagctttaacaaagacctgcttacctgctgggatccagaagagaacaagatggccccctgcgaattcggtgtactgaattccttagcaaacgtactttcccagcatctaaatcagaaggacacgttgatgcagcgattgcggaacggccttcagaattgtgctacccatactcagcccttttggggctcgctgacgaaccgaacccggcctccctcagttcaggtcgccaagactacaccctttaacacccgcgaacctgttatgcttgcttgctacgtttgggggttttaccccgcagaggtgacaatcacctggcgcaaaaatgggaaactcgtgatgccgcatagttctgcacacaagaccgcgcagcccaacggcgactggacttatcagacattgtcgcacctcgcactgaccccatcatatggggacacatatacctgcgtcgtcgaacacatcggtgctcccgaaccaatacttcgagactggaccccaggcctgtccccaatgcagacgctgaaggtgagtgtatcagccgtcaccctggggctgggcctcattattttttccttgggagtaatctcatggcgacgtgcaggacattctagcgatctgattatttctctgctgttcatcctttag

SEQ ID NO: 27485 - DNA, 321 bp, Artificial Sequence
  Description of Artificial Sequence: Synthetic coding sequence
gttgctaagaccacgccctttaatacccgtgagcccgtgatgttagcctgttacgtgtggggcttctaccccgcagaggttacgatcacctggcggaagaatggcaagcttgttatgccacacagctccgcccataaaaccgctcagcctaacggtgattggacctaccagaccctgtcgcacctggcactgaccccgagttatggcgatacctacacatgtgtcgttgagcacactggagcccccgaaccaattcttcgcgactggtcttacacaccacttccggggtcgaactactccgagggatggcatattagctag

SEQ ID NO: 27486 - DNA, 426 bp, Artificial Sequence
  Description of Artificial Sequence: Synthetic coding sequence
tgaactaggccacccagtgtgcaagtcgctaagacaaccccctttaacacccgtgagccagtcatgctcgcgtgctacgtctgggggttctaccctgccgaggtcaccattacgtggcggaaaaatggcaaattagtcatgccacattcctctgcccataagacggcccaacctaacggtgattggacttatcagactctatcccatcttgccctcaccccgagctacggagatacttacacatgtgtggtcgaacacacaggggctcccgagcctattctgcgggattggacccccggtctctccccaatgcaaacactcaaggtgtctgtttccgccgttactctgggtctcgggttgatcatctttagtctgggagtaatctcatggaggcgcgcagggcatagtcgctggcatatctcatag

SEQ ID NO: 27487 - DNA, 528 bp, Artificial Sequence
  Description of Artificial Sequence: Synthetic coding sequence
atgggccacgaacaaaaccagggtgctgccctcctccaaatgcttccgctgctatggctgcttccccactcttgggctgttccagaggaacagtctatgatcacattcctccccctgctcctgggccttagtttaggatgcaccggcgccgggggcttcgtagcccatgtggaatctacatgtctgttagatgatgcaggtactccaaaggacttcacttattgtatctccttcaataaagaccttttgacatgctgggatcctgaagaaaataaaatggctccctgtgaattcggtgtcctcaacagtctggccaatgtgctgtctcagcatctcaaccagaaggacactttaatgcaaagacttaggaacgggcttcagaattgcgcaacacatacacaacccttctggggctcgcttaccaaccgcaccagacccccaagcgtgcaggtggcaaagactactcctttcaacaccagagaacctgtgatgctggcatgttatgtgtggggcttctacccagcatag

SEQ ID NO: 27488 - DNA, 528 bp, Artificial Sequence
  Description of Artificial Sequence: Synthetic coding sequence
atgggtcatgaacaaaatcagggagcagcgctactgcaaatgctccctttgctctggctgctccctcactcctgggcagtaccagaggagcaatccatgataacttttcttccactgctactggggctgagtctcggatgcaccggcgcgggtgggttcgtggcccatgtggagagtacctgcctgctggacgatgcaggcacccccaaagacttcacctattgtattagctttaataaagatctattaacttgttgggatcccgaggagaataaaatggctccatgcgaattcggtgtgctgaattctctagccaatgtgttatctcagcacctcaatcagaaggacactttaatgcagagactgcggaacggactccagaactgtgcaacccatacccagcccttttggggtagccttacaaatcggactcgccctccctccgtacaggttgccaaaacaaccccatttaacacccgcgaaccagttatgctcgcatgttatgtctggggattttaccccgcatag

SEQ ID NO: 27489 - DNA, 651 bp, Artificial Sequence
  Description of Artificial Sequence: Synthetic coding sequence
atgataacattcctgccgctcttactgggcttgtctttgggttgcaccggcgccggtggattcgtggcacacgtagaaagtacgtgccttcttgacgacgccggtacccctaaggactttacttactgtattagtttcaataaagacctcttgacctgctgggacccggaggaaaataagatggccccatgtgagtttggcgtgcttaattccctggccaacgtgctgtcccagcatctcaaccagaaggatactctgatgcaaaggctgagaaatgggctccagaactgcgcaacccacacccaacccttctggggaagcctgactaaccgcactagaccgccctctgtgcaggtcgctaagactacaccgttcaacacccgggagccagtcatgctggcttgttacgtctggggcttctatcctgccgaggtgacaattacgtggcgcaaaaacgggaaactagtgatgcctcacagttccgcgcacaagaccgctcagccaaatggcgattggacataccagacgctctctcacttggcactgacaccctcttatggtgatacatacacatgcgtggtggagcataccggagctcctgaacccattcttcgggattggtctaagtgtatggctgatggatggaactag

SEQ ID NO: 27490 - DNA, 792 bp, Artificial Sequence
  Description of Artificial Sequence: Synthetic coding sequence
atgattacctttctgccactgctcctaggactaagccttggctgcacaggcgctggaggcttcgtggcccatgtcgaatcaacatgtctgctggatgatgccggtactcccaaagacttcacttactgcatctcatttaacaaagacctcctcacatgttgggatccagaggagaataagatggcgccctgcgaatttggcgtgctgaattcactggccaatgtcttgtctcagcacctcaatcaaaaagatacattgatgcagaggcttagaaacggtcttcagaattgtgccacccacacccagcctttttgggggtccctgacaaatagaacccgccctccatctgtgcaggtggcgaagactactccctttaacactcgtgagccagtgatgctggcctgctacgtgtgggggttttaccctgccgaagtaacaatcacctggcggaaaaatggaaagctggttatgccccatagcagcgctcataaaactgcgcaacctaatggagactggacttaccagaccctgtcgcatctcgccctgactccaagctacggggacacctacacttgtgtcgtcgaacacactggcgcccctgaaccaattttgcgtgattggacgcctgggttatcccccatgcagacactgaaggtctctgtgtcagccgttaccttgggtctgggactcatcatcttctctctgggtgtcatttcatggagacgagctggccacagtagctacactcccctacccggatcgaattactccgagggttggcatatcagctag

SEQ ID NO: 27491 - DNA, 774 bp, Artificial Sequence
  Description of Artificial Sequence: Synthetic coding sequence
atgattactttcctgccgctgctactgggtttgtcactgggatgtacaggcgcaggcggcttcgtcgcgcacgttgaaagcacttgcttgctggacgatgcaggaaccccaaaagacttcacttattgtattagttttaacaaggacctgctgacatgctgggatcctgaggaaaataagatggctccatgcgaattcggcgtgttaaatagcctcgcgaacgtgctgtctcagcaccttaaccagaaggataccctgatgcagagattaaggaacgggttacagaattgtgctactcacacgcagccattctgggggagtttgacaaataggacgagaccccctagcgtacaagtcgccaaaacgaccccattcaacactcgggagcctgtgatgctggcctgctatgtgtggggattttatccggccgaggttacgattacctggcggaagaatgggaagctggtgatgccccacagctctgcacacaagacagctcagcccaatggggactggacataccagactctaagccacctggctcttaccccatcttatggagacacttacacctgtgtcgttgagcacacaggtgcaccagagcccatcttgcgtgattggactcccggccttagtcccatgcagactcttaaggtgtctgtttccgctgtgacactgggactcggacttattatcttcagcctgggtgtgatcagttggcggagagcaggtcactccagtgatcttattatatccctcctcttcattctgtag

SEQ ID NO: 27492 - DNA, 321 bp, Artificial Sequence
  Description of Artificial Sequence: Synthetic coding sequence
gtggctaaaacaacaccatttaacacacgggaaccagtcatgctggcatgttatgtctggggattctatcccgctgaggtaaccatcacatggaggaagaacggtaagcttgtgatgccccactccagcgcgcataagaccgctcagcctaatggagactggacataccagaccctctcacatttagcactcacaccatcttacggagatacttatacctgtgtcgtggagcatattggtgcccccgagccaatcctacgagattggagctatactcctctccctggtagcaattacagcgagggctggcatataagttag

SEQ ID NO: 27493 - DNA, 792 bp, Artificial Sequence
  Description of Artificial Sequence: Synthetic coding sequence
atgatcacgtttttgccacttctcttaggactgagtctgggatgcacaggggcgggggggttcgtcgcacacgtggagagcacttgcctgttagatgacgccggaacccccaaggactttacttactgtatatctttcaacaaagatctactgacttgctgggacccagaggagaataaaatggccccctgcgaatttggcgtgctgaactctctcgcaaacgtgttatcccagcacctgaaccagaaggatacgctgatgcaaagactccgtaatggcctgcagaattgtgctacacatacacagccattctggggatccttaaccaaccggacccgccctccgagtgtccaagtggccaagacgacccctttcaacacgcgggagcctgtgatgttggcttgctacgtgtgggggttttatccggccgaggtgacaatcacatggcgaaaaaacggcaagctcgtaatgccacactcaagtgcacacaagaccgcacagcctaatggtgactggacttatcagacactctctcacttggccctgactccttcatacggggatacctatacgtgtgttgtagagcacacaggcgctccagagccaatattgcgcgactggactcctggtctgtcccccatgcagactctgaaggtgtcagtgagcgcagtgaccctgggactcggactcatcattttctccctgggtgtgatctcatggcgccgggccggccactcatcatatactccgctcccgggatccaattattccgagggctggcatatttcctag

SEQ ID NO: 27494 - DNA, 426 bp, Artificial Sequence
  Description of Artificial Sequence: Synthetic coding sequence
tgaactcgtccccctagcgtccaagtcgctaaaactacccccttcaatacacgggagccggtgatgctcgcctgctacgtttggggcttttatccagccgaggtaacaattacctggaggaaaaatggcaaactcgtgatgccccactccagtgctcataagacggcccaacccaacggcgactggacataccaaaccctgtctcaccttgcccttaccccttcctacggcgatacatacacttgtgttgtggaacacacaggcgcgcccgagcccattctacgtgattggacccccggtctcagtcctatgcagactctcaaggtctctgtgagcgccgttacactgggtctcggtctgataatatttagcttgggcgtgatctcctggaggcgcgcaggccacagccgctggcatatctcttag

SEQ ID NO: 27495 - DNA, 792 bp, Artificial Sequence
  Description of Artificial Sequence: Synthetic coding sequence
atgataacttttctcccgctgctgctgggcctctccctgggttgcaccggcgcgggtgggtttgtcgcccacgtagagagcacctgcctgctcgatgacgcaggcactcctaaagatttcacctattgcatatctttcaacaaggacctgctgacgtgttgggatccagaagagaataaaatggcaccctgtgagtttggcgtactgaattctcttgccaatgtacttagccaacacctcaaccagaaggatactctgatgcaacggctgcgcaacggactacagaactgcgcaactcatacacagcccttttggggtagccttaccaaccggacacggccccccagcgtgcaggtggcaaaaacaactcccttcaatacccgcgaacctgtgatgttggcttgctatgtttggggtttttatccggcggaggttactattacttggaggaaaaatggcaagttggtcatgcctcactcctctgcccacaagaccgcacagccaaatggggactggacctaccaaactttaagccatctagcgctgacaccatcttatggagacacctacacatgcgtggtagagcatatcggagcaccagagcctatcctcagggattggaccccaggccttagtcctatgcagacgctgaaagtttccgtgtcagccgttacccttggcttgggcctgattatcttctccctgggtgtcatttcctggaggcgcgccggacattccagctatactcccctccccggcagcaattatagcgagggctggcatatttcttag

SEQ ID NO: 27496 - DNA, 774 bp, Artificial Sequence
  Description of Artificial Sequence: Synthetic coding sequence
atgatcacgttcctgccattgctattgggactgagcctgggttgcaccggagcaggtggcttcgtcgctcacgttgaatctacatgtctactcgacgacgcagggacacctaaggacttcacctattgcatttcctttaataaagatcttctgacgtgctgggatcctgaagaaaataaaatggcaccctgtgagtttggggtgctaaatagcttggctaacgtgctcagccagcacctaaaccagaaggacactcttatgcagagactgcgtaacggcctacaaaattgtgccacacacacgcaacccttttggggttccctgaccaacaggacccgcccgccaagcgtccaggtggccaagacaacaccttttaacacgagagagccagtcatgctcgcatgttacgtctgggggttttatccagccgaggtgactattacatggcggaaaaatgggaagctggtcatgcctcactcaagtgcccacaagaccgcacagcccaacggcgactggacttaccagacccttagtcacctggctctcacaccatcatacggtgacacttacacttgtgtggtggagcacatcggtgctcccgagcccattttgcgcgactggaccccagggcttagccccatgcagacactcaaggtttcagttagcgctgtcaccctgggcttggggctgataatcttttcacttggggtgatctcttggcgcagagccgggcactcatctgatctaatcattagcctgctgttcatcttatag

SEQ ID NO: 27497 - DNA, 528 bp, Artificial Sequence
  Description of Artificial Sequence: Synthetic coding sequence
atggggcacgagcaaaaccaaggagccgccttgctgcaaatgctgccactgctgtggcttctgccacacagctgggccgtgcctgaagaacagagcatgatcacgttcttgcccctgctgctcggactgagtctgggctgcactggtgctggggggttcgtggcacacgtagagagtacatgcctccttgacgacgcagggacgccaaaggactttacctactgcatctcatttaataaagatctgttgacatgctgggaccccgaagagaacaagatggctccttgtgaatttggggttttgaattcgctggctaacgttctgagccagcacttgaaccagaaggatacattgatgcagagactacgtaatggacttcagaactgtgcaacacacacacagcctttttggggaagtttaaccaaccgaactaggccccctagcgttcaggtggccaagaccacccctttcaacactagggagcccgtgatgctcgcttgttacgtgtggggtttttacccagcatag

SEQ ID NO: 27498 - DNA, 528 bp, Artificial Sequence
  Description of Artificial Sequence: Synthetic coding sequence
atgggccatgagcaaaaccagggcgcagctcttcttcagatgctgcccctcttgtggcttctcccgcattcctgggcagttcctgaggaacaatcaatgatcaccttcctccccttactgcttgggctcagcttgggctgcacgggagcaggaggcttcgtggctcacgtcgagtccacctgcttattagacgacgctggcacccccaaagattttacctattgtatcagcttcaataaagatttattaacctgctgggacccagaagagaataagatggccccttgtgaatttggcgtgctcaattctctggccaatgtgctttctcaacaccttaaccaaaaggatactctcatgcagaggttgcgcaatgggctgcagaactgcgcaactcatacccagccattttggggctccctcacgaacaggacccggcctcccagtgtgcaggttgctaagactacaccttttaacacccgagagcctgtgatgctcgcctgctatgtctggggcttctaccccgcgtag

SEQ ID NO: 27499 - DNA, 321 bp, Artificial Sequence
  Description of Artificial Sequence: Synthetic coding sequence
gtcgccaagactaccccttttaatactcgagaaccagttatgcttgcctgctacgtctgggggttctatcctgcggaggtgaccattacttggcggaagaacggcaagctagtgatgcctcattcctctgcacataagaccgcacagcctaacggagactggacctatcagaccctgagtcacctcgctttgactccgagctacggcgatacatatacgtgcgtggtagagcatattggggcccccgagccaatcctacgcgattggtcgtacactccgctgcctgggtccaactacagcgagggctggcacataagctag

SEQ ID NO: 27500 - DNA, 426 bp, Artificial Sequence
  Description of Artificial Sequence: Synthetic coding sequence
tagacgaggcctccttcagttcaggtagctaaaacaacaccgttcaatacgcgggagcccgttatgcttgcttgctatgtttgggggttctatcccgccgaggtgacaattacttggcggaagaatgggaagcttgtaatgcctcacagctccgctcacaagacggcccagcccaacggagattggacatatcaaacattaagccatttggctctgacgccttcatacggggatacatatacatgcgttgttgagcatactggagccccggagcccatcctgagagactggacacccggtctctccccgatgcaaacgctcaaagtgtctgtcagcgctgtcaccctgggactgggcctcatcatcttttctctgggggtcattagctggcgcagagcaggccactctagatggcacatctcctag

SEQ ID NO: 27501 - DNA, 528 bp, Artificial Sequence
  Description of Artificial Sequence: Synthetic coding sequence
atggggcacgagcagaatcagggagctgccctgctgcagatgctgcccctcctctggttacttccgcactcttgggccgtgccagaagagcagtcgatgattacgtttttacccctcttgctgggtctgagcctcggctgcaccggagctggagggtttgtggcccacgtcgagagcacctgcctgcttgatgatgctggcacacccaaagacttcacatattgcatttcctttaacaaggatctgctgacctgttgggacccagaagagaacaagatggccccctgtgaattcggcgtgctaaattcactggcaaatgtcctgagccagcatcttaaccagaaagatacgctgatgcagagacttcgcaacgggctgcaaaactgcgctacccacactcagccattctggggctcactgaccaacagaacaagacccccatccgtccaggttgccaagacaactcccttcaacacaagagagcccgtaatgctagcttgctatgtgtggggcttctatcccgcttag

SEQ ID NO: 27502 - DNA, 321 bp, Artificial Sequence
  Description of Artificial Sequence: Synthetic coding sequence
gtcgccaaaaccactccttttaatacccgcgaacctgtgatgttggcatgctacgtttggggcttttaccctgcagaagtgactatcacatggcgaaaaaatggtaaacttgttatgccccacagcagtgcgcacaagacggctcagccaaatggtgactggacataccagacactcagccatctggcgctaactccatcatacggcgatacttatacatgcgtagtagagcacaccggggcccccgagccgatcctacgggactggagctacacaccactcccgggatctaattactctgaaggatggcatataagttag

SEQ ID NO: 27503 - DNA, 321 bp, Artificial Sequence
  Description of Artificial Sequence: Synthetic coding sequence
gtggctaaaaccactcccttcaataccagggaacccgttatgttggcctgttatgtctggggattttaccccgcagaggtgaccatcacttggcggaagaatgggaaactggtgatgcctcactcttcggcccacaagaccgcacagccaaacggggattggacgtatcagacgctctctcaccttgccctgacccccagttacggggatacttatacatgcgtcgttgaacatattggggcccctgagcctatcttgagggactggtcgtatacacctcttcctggttctaattactcagaaggttggcatatatcatag

SEQ ID NO: 27504 - DNA, 321 bp, Artificial Sequence
  Description of Artificial Sequence: Synthetic coding sequence
gtagctaagaccaccccgttcaacactcgggaacccgtgatgttggcttgctatgtatggggattctaccccgctgaggtgaccattacctggagaaaaaatggaaaactcgtgatgccccactcaagtgcacacaagaccgcacagcccaacggagattggacataccagactctgagccacctggcgcttacaccctcgtatggtgacacttacacttgtgtcgtcgagcacatcggcgcacccgaaccgatcctgcgcgattggagctatacgcctctaccaggctctaactactccgaagggtggcatatctcctag

SEQ ID NO: 27505 - DNA, 426 bp, Artificial Sequence
  Description of Artificial Sequence: Synthetic coding sequence
tagacacgccccccctctgttcaggtcgctaaaactacacctttcaatacgagggaaccagttatgctcgcctgttacgtgtggggcttttaccccgccgaggtgacgattacctggcgcaaaaatggaaaactggttatgccgcacagcagcgcccataaaacagctcagccaaacggggattggacataccagaccctgtctcacctggctctgactccatcatatggtgatacttatacgtgcgttgtggagcatatcggggcaccagagccaattctgagggactggactcctggcctgagtccaatgcagactctgaaggtaagcgtttctgccgtgactctgggactggggctgataatcttttccctgggtgtgatttcctggagaagggcgggtcatagccggtggcatatctcatag

SEQ ID NO: 27506 - DNA, 321 bp, Artificial Sequence
  Description of Artificial Sequence: Synthetic coding sequence
gtcgccaagaccactccatttaacacaagggagcccgtgatgttggcatgctacgtgtggggattttacccggccgaggtgacaattacatggaggaagaacggtaaactggtgatgccacattccagcgcacataaaaccgctcagcctaacggcgactggacataccagaccctgtctcacttggctctgacacctagctacggggacacctacacctgtgtggtggaacacaccggggcccccgaaccaatactgcgcgactggtcgtacacgccactgccgggatccaattattcggagggctggcatatcagctag

SEQ ID NO: 27507 - DNA, 774 bp, Artificial Sequence
  Description of Artificial Sequence: Synthetic coding sequence
atgatcacctttttacccctgctgttgggcttaagcctgggctgcactggcgccggggggttcgtcgcacacgtggaatccacctgtctcctcgacgatgccggcacccctaaggattttacgtactgtatatcctttaacaaggatttgctgacttgttgggaccccgaggaaaacaagatggctccctgcgaatttggagtgcttaactccctggcaaacgtgctgagccaacacctgaatcagaaggataccctgatgcagcgcctgcgaaatggcctgcaaaactgtgccacacacacccaacctttctggggatccttgaccaacagaactcgtcctccctcggtccaggtggcgaagactaccccattcaacactagagagccagtgatgctggcttgctatgtctggggtttctaccctgccgaggtcaccatcacgtggagaaagaacggtaagctggttatgccacacagttcagctcataaaacagcccaacccaatggagactggacctatcagaccctgtcccatctggcgctgacacctagctatggtgatacttatacatgtgtagtcgagcacaccggcgctccagaaccaatcctgcgggactggacccctggtttatcacccatgcagacactgaaagtgagtgtgagtgccgtgaccctcggactgggattaataatattcagtctgggggttatcagttggcggcgtgccggtcactccagtgacttgatcatctcattactgtttatattatag

SEQ ID NO: 27508 - DNA, 792 bp, Artificial Sequence
  Description of Artificial Sequence: Synthetic coding sequence
atgatcacatttctgcctcttctgctggggctatctctgggatgcacaggtgctggaggatttgtggcccacgttgaatccacatgtcttcttgatgacgctgggacccccaaagatttcacatattgcattagctttaataaagacctgctgacctgttgggaccccgaagagaacaagatggcgccgtgtgagttcggggtcttgaattcacttgcaaatgtgctctcgcagcatctaaatcaaaaggacacccttatgcagcggcttaggaatggcctgcagaactgcgcaactcacactcagcccttttggggcagtttgaccaaccgtaccaggcccccttcggtacaggtggcgaagaccacaccctttaatacgcgcgagcctgtcatgctcgcctgttacgtctggggtttctatcctgctgaagtgacaataacctggaggaagaacggcaaattagttatgccgcactcgtctgcccacaagacagctcagccgaatggcgattggacttaccaaactctgtctcacttggcactgaccccaagttacggggacacctatacatgtgtggtcgagcatatcggcgctccagagcccattctgagagactggacgcctggactgtcccctatgcagacacttaaagtgtctgtgagcgccgtgaccctcggtctgggcctgattattttttcactcggcgtcatatcttggaggagagctggacacagcagctacacccccttaccagggagcaactactctgaaggatggcatatatcgtag

SEQ ID NO: 27509 - DNA, 321 bp, Artificial Sequence
  Description of Artificial Sequence: Synthetic coding sequence
gtggcaaagacaacccccttcaatacccgggagcccgtgatgctagcctgttatgtctggggattttatccagcagaagttaccatcacctggcgtaagaacgggaagctggttatgcctcactctagtgcacataaaaccgcccagccaaacggtgactggacttatcagaccttaagccaccttgcactgactcccagctacggcgatacctacacatgcgtggtcgaacacaccggggccccagagccgatccttcgggactggtcatataccccactgcccggatcaaactacagtgaaggttggcatatcagttag

SEQ ID NO: 27510 - DNA, 426 bp, Artificial Sequence
  Description of Artificial Sequence: Synthetic coding sequence
tgaacccggccacccagcgttcaggtggccaaaacaactcccttcaatacccgagagccagtcatgctggcttgctatgtgtggggattttatccagccgaagtaaccatcacttggaggaaaaatggcaaattggtgatgccacactcgtctgcccacaagaccgcacaaccgaatggcgattggacgtatcaaaccctgtcacacctagccctgacaccttcttatggcgacacatacacatgtgtggtggagcataccggcgcccccgagccaattcttcgtgactggacaccgggtctgtctccaatgcagactctgaaagtttccgttagtgcagtcactctgggcctgggactgatcatcttcagtctgggggtgatttcttggcgcagagcgggacattctagatggcacatcagctag

SEQ ID NO: 27511 - DNA, 774 bp, Artificial Sequence
  Description of Artificial Sequence: Synthetic coding sequence
atgattacctttttacccttgctcctcgggctgtccttaggctgcaccggcgctggcgggttcgttgcacatgtggaatctacctgcctgttagatgatgccggtacccctaaggactttacctattgcatctcatttaataaggacctgctcacctgctgggacccagaggagaataaaatggccccatgtgaattcggcgtccttaattccctggcaaacgtcctcagccagcatttgaaccaaaaagatacactgatgcagcggctaaggaacggactccaaaattgtgctactcatacacagcccttttggggcagccttacaaatcgcactcgtcccccgtcagtccaggtggctaaaaccactcctttcaacacaagagagcctgttatgttagcttgttacgtctggggcttctaccctgctgaggttactattacgtggcgcaagaatggaaagttggttatgccacatagtagcgcacataagacagcccaaccaaacggggactggacttatcagactttgtcccacctcgccctgactccatcttacggcgacacgtacacctgtgtggtggagcacaccggcgccccagagccaatactgagggattggacacccggtctgtcaccaatgcaaacacttaaggtgagtgtatcagctgtgacactggggctcggattgataattttcagcctaggagtgatctcttggcgacgggctggacattctagcgatctcataataagccttctatttatcctttag

SEQ ID NO: 27512 - DNA, 774 bp, Artificial Sequence
  Description of Artificial Sequence: Synthetic coding sequence
atgattacttttctccctctgctgctgggcttgtctttgggatgtacgggagccggcgggttcgtggcgcatgtggagagcacctgcttattggatgacgcaggcacaccaaaggactttacctactgtatctcctttaacaaggatttactgacatgctgggaccctgaagaaaacaaaatggccccctgcgagttcggtgtcctgaatagtcttgcaaacgtgctcagccagcatctgaatcagaaagatacccttatgcagcggttgcgaaacgggcttcaaaactgtgcgactcacacccagccattttgggggagccttaccaatcgcactaggccgcccagtgtccaagtcgctaaaacaacgcccttcaacacgagagagcccgtgatgctcgcttgttatgtctgggggttctaccccgctgaagtgactattacctggaggaagaacggcaagctggtgatgcctcactcatccgcgcataagaccgcacagcccaatggagactggacctatcagaccctgtcccacctggcattgacgccgtcttacggagatacctacacttgtgtggtggaacacatcggagctcctgagccgatccttcgagactggacgccagggctgagtccaatgcaaacccttaaggtgtctgtctccgctgtgacactcggtttaggactcatcattttttcgttaggagttatctcctggagacgtgccggccatagcagcgatttgatcatctcactcctgttcatcttatag

SEQ ID NO: 27513 - DNA, 528 bp, Artificial Sequence
  Description of Artificial Sequence: Synthetic coding sequence
atgggacatgagcagaaccagggagcagcattacttcagatgctccctctactttggttgctcccacactcttgggccgttccagaggaacagagcatgattactttcctacccctgctcttagggctgtcccttgggtgcactggcgcaggcggcttcgttgcccacgttgagtcaacctgtctgttggacgatgcgggcacacccaaagatttcacttactgcatttcgtttaacaaggacctcctcacctgctgggatccggaggagaacaagatggccccgtgcgagtttggtgtcctaaactctctggccaatgtattgtcccaacacctcaatcagaaggacaccctcatgcagaggcttagaaacgggctgcaaaactgcgccacccatacccagccattttgggggtcgctaaccaatcgaacccggcctcccagcgtgcaggtggccaagacaacccccttcaatacccgggaaccagttatgctggcttgttatgtgtgggggttttacccagcttag

SEQ ID NO: 27514 - DNA, 426 bp, Artificial Sequence
  Description of Artificial Sequence: Synthetic coding sequence
tgaacaagacccccaagcgtgcaggtggccaagactactccatttaacactcgtgaaccagtcatgctggcctgctatgtgtggggcttttatccagcggaggtgactatcacgtggcggaagaacggaaagctcgtgatgccccattcctctgcacacaaaacagcccaacccaacggcgactggacataccaaacactctcgcacctcgccctcacaccttcctatggggacacatatacctgtgtggtggaacacattggagctccagagccaatactcagagactggacacctgggctgagccctatgcagaccctgaaggtcagcgtgtctgcagtcaccctggggttaggcttgatcatctttagtctgggcgtgatctcctggcgcagggcaggtcatagccgatggcatatcagttag

SEQ ID NO: 27515 - DNA, 528 bp, Artificial Sequence
  Description of Artificial Sequence: Synthetic coding sequence
atgggccacgaacagaaccagggcgctgctctgttacagatgttgcccctgctttggctgctgccccactcctgggcagtccccgaggaacagtcgatgattacttttctccctctgctgctcggactaagcttaggttgtactggcgccgggggctttgtagcccatgttgaatctacgtgtctgctggatgatgcggggacgcctaaagattttacttactgcatctcttttaataaggatcttctcacgtgttgggaccccgaagaaaataaaatggctccttgtgaattcggcgtgttaaactccctggccaacgtgctgtcccagcacctgaaccagaaagatacgcttatgcagaggctacgcaacggactgcagaactgcgctactcatacacagcccttctgggggtctttgaccaatcgcaccagacctccatccgtccaagttgcaaaaaccactccttttaacactcgggaacctgtcatgttagcttgttatgtgtggggattttaccccgcgtag

SEQ ID NO: 27516 - DNA, 528 bp, Artificial Sequence
  Description of Artificial Sequence: Synthetic coding sequence
atgggccacgagcagaatcagggcgcggctctcctccaaatgcttccactcctgtggctgctgcctcactcttgggccgttccagaggaacaatcgatgatcacctttttgcctctgctgctcggcctgtccctgggatgtaccggagctggtgggttcgtggctcatgttgagagcacctgtcttctcgacgatgcaggcaccccaaaggacttcacctattgcatcagtttcaacaaggatctgctcacttgttgggaccccgaggagaacaaaatggctccatgtgagtttggggtcttaaatagcctggcaaatgttttgagccagcacctaaaccagaaagacactttgatgcagaggcttcgcaatggcctacagaattgtgccactcacacacaacctttctggggcagcctaacgaataggactaggcccccttcagtgcaagtggccaaaaccactccctttaacacgcgggagcctgtcatgttggcatgctacgtatggggattctacccagcttag

SEQ ID NO: 27517 - DNA, 792 bp, Artificial Sequence
  Description of Artificial Sequence: Synthetic coding sequence
atgatcacgttcttacccctgttgttaggcctcagcctgggatgcacaggcgccggcggtttcgtggcccacgtcgagtccacctgccttttggacgacgcagggactcctaaggatttcacttattgtatcagcttcaataaggatctgctgacttgctgggaccctgaagagaataagatggccccctgcgagttcggggtactaaactctcttgcgaatgtactctcccagcacctgaaccaaaaggacacactcatgcagagactccggaatggattacagaactgcgccacgcatacccagcctttctggggcagccttacgaacagaactagaccaccctctgttcaggtcgccaagaccacacctttcaataccagggaacctgtgatgctggcatgctacgtgtggggcttttatccggccgaggtaacaattacgtggaggaagaatggtaaactggtcatgccccatagtagtgcgcacaaaacagcacaacctaatggcgactggacataccagactctgtcccatttggctcttaccccttcctatggcgatacctacacatgcgtagtggagcacaccggggcgccagagcctatcctccgtgattggactcctggcctgagtcccatgcaaactctcaaggtgagtgtgtcagctgtgactttaggcctgggcctaatcatcttctctctgggcgtaatctcctggaggcgcgcagggcacagctcatatacccctctgcccggctccaactactccgaaggctggcacattagctag

SEQ ID NO: 27518 - DNA, 426 bp, Artificial Sequence
  Description of Artificial Sequence: Synthetic coding sequence
tgaacccgcccaccctctgtgcaggtcgccaaaactacgcccttcaatacacgcgagcccgtgatgctggcctgttatgtgtggggattctacccagctgaggtgacgatcacatggaggaagaacgggaagttggttatgccccattccagtgctcacaagaccgcccagcccaacggagactggacttatcagacactgagtcatctggctttaacccccagttatggtgacacttacacttgcgtagtggagcacatcggagcacccgaaccgattttgagagattggactcccggcctgtccccaatgcagacgctgaaggtatccgtttctgcagttactctggggctggggctgattattttttccctcggcgtgatttcctggagaagggctggacactccagatggcatatctcttag

SEQ ID NO: 27519 - DNA, 774 bp, Artificial Sequence
  Description of Artificial Sequence: Synthetic coding sequence
atgattaccttccttccactgctgctgggcctgtcattgggatgtactggggctggtgggttcgtcgcacatgtggaaagcacgtgtcttctcgatgacgccggaaccccaaaagacttcacatattgcatctcttttaataaagacttgttgacatgctgggatcctgaggaaaacaaaatggcaccctgtgagttcggtgtgctgaattctctggcaaatgtactaagtcagcatctgaaccagaaggacacactgatgcaaagactgaggaatgggctgcaaaactgcgcgacgcacacccagcctttttgggggtctctgaccaacagaactaggcccccttctgtgcaggtcgccaaaaccacacccttcaacaccagggagcctgtcatgcttgcctgctatgtgtggggattctatcccgcagaggtcacgatcacttggcgtaaaaacggcaagctggtcatgccccattcatctgcacacaaaactgcccagcctaatggcgattggacataccagaccctttctcacctcgcccttaccccatcttatggcgatacctatacttgtgttgtagaacatatcggcgctccagagcctattcttagagactggacccccggcctgagtccgatgcagacactgaaagtcagtgtctccgcagtaacactcgggctgggcctgattatcttcagcctcggcgtgatttcttggcgacgggcgggacatagctcagacttaattatctctctcctgtttattctctag

SEQ ID NO: 27520 - DNA, 774 bp, Artificial Sequence
  Description of Artificial Sequence: Synthetic coding sequence
atgatcacattcctgccactgctactgggactgagtcttggctgcaccggagcgggtggctttgtggcgcatgtggagtctacctgcctacttgacgatgctggtaccccgaaggattttacatactgcatatcatttaacaaggatctcctgacttgctgggatccagaggaaaataagatggctccttgcgagtttggggttttaaatagcctcgctaatgtgttgtctcaacacctgaatcaaaaagatacgctaatgcagcggctgcgcaatggtctccagaattgcgctactcatacccaaccattttgggggagcctcaccaaccggacccggcccccctccgtgcaggtggcaaagaccacaccttttaatactcgagagccagtcatgctcgcttgctacgtgtgggggttctatccggccgaggtgaccataacctggaggaagaatggaaaactcgtgatgccccactcaagcgcgcataagacagcacaaccaaatggagactggacttatcagacgctctcacacctagcgcttaccccttcctacggtgacacgtacacatgtgtagtcgaacatactggcgctcctgaaccaatcctgagagactggacacccggcttgtcacccatgcagacactaaaggtgagtgtgtctgcagttaccctcgggctgggcctgatcatcttttccctcggagtcattagctggaggagggccgggcactcatcagatctgatcatcagcctgttgttcatcctttag

SEQ ID NO: 27521 - DNA, 651 bp, Artificial Sequence
  Description of Artificial Sequence: Synthetic coding sequence
atgatcaccttcttgccgctgctgctggggctgtcactggggtgtactggtgcaggtggatttgtggcacacgtggagtcgacgtgccttctagacgacgcaggtacccctaaggatttcacatactgcatctcctttaacaaggacctgctgacctgctgggatcctgaggagaataagatggctccttgcgagttcggcgtcctgaactctttggccaacgttctgtcacaacacctcaaccaaaaagacacactgatgcagcgattgcggaacggcctgcaaaactgcgcgacccacacccagccgttttggggttcactgacaaacagaacccgccccccaagtgttcaggtagcaaagaccactcctttcaatactcgcgaaccagtgatgctcgcgtgttacgtttggggattctaccccgctgaggtgaccattacttggcgtaagaacggaaagttggtaatgccccatagctctgcacacaagactgcccagccgaatggggattggacctatcagactctgagccacctcgccctcacaccctcctacggagatacatatacctgcgttgtcgaacacattggggcacctgaacccatcctgcgcgactggtctaaatgcatggcggatggttggaactag

SEQ ID NO: 27522 - DNA, 171 bp, Artificial Sequence
  Description of Artificial Sequence: Synthetic coding sequence
atgcctcacagcagcgcacataagaccgctcaacccaacggagattggacatatcagactctatcccacctggcgttgaccccatcttacggggacacttatacgtgtgtggtggagcatatcggtgccccagagcccattctgcgcgattggcggtggcacatcagctag

SEQ ID NO: 27523 - DNA, 171 bp, Artificial Sequence
  Description of Artificial Sequence: Synthetic coding sequence
atgccacacagttccgcgcacaagacagctcaaccaaacggcgactggacgtaccagacactctcacatctcgccctgaccccttcttatggagacacatacacctgcgtggtggagcatattggagcccccgagccaatcttaagggactggcggtggcacatctcatag

SEQ ID NO: 27524 - DNA, 651 bp, Artificial Sequence
  Description of Artificial Sequence: Synthetic coding sequence
atgatcacattcctacctctgctcctgggacttagcttgggctgtaccggggctgggggcttcgtggcacatgtggagagcacgtgcctgctcgatgatgctggcacccctaaggactttacttattgtatatcattcaacaaagatctgcttacatgctgggacccggaggagaataagatggccccctgcgagtttggcgtcctgaactccctcgccaacgtgctatctcagcaccttaatcagaaggacactttgatgcagagactccggaatggccttcagaattgcgccactcacacccagccattttgggggtcgctcactaatcgcacaagacctccttccgtgcaggtcgctaaaaccaccccatttaatacccgagaacctgtcatgctggcatgttacgtctggggcttctacccagccgaggtcacaatcacctggcgtaaaaatggaaagttggtgatgcctcatagctctgcgcacaaaacagcccagccgaatggagactggacttaccagacactcagccacttagctctgaccccttcctacggcgatacatacacctgtgtggttgagcacaccggcgcaccagagcctattctccgggactggagcaagtgtatggctgatggatggaattag

SEQ ID NO: 27525 - DNA, 207 bp, Artificial Sequence
  Description of Artificial Sequence: Synthetic coding sequence
atgccacacagcagcgctcacaagactgcccagcctaacggcgactggacgtaccagaccttgagtcacctggcactcacacctagctatggagacacctatacctgcgtggtcgaacacattggggctccagaaccaatactgcgagactggagctatactcccctgcccgggagcaattactctgaaggctggcacatctcctag

SEQ ID NO: 27526 - DNA, 171 bp, Artificial Sequence
  Description of Artificial Sequence: Synthetic coding sequence
atgccccattcaagtgcccataaaaccgcccaacctaatggcgactggacataccagacactgagccacctggctttaaccccctcgtacggcgatacctatacctgcgtcgtagagcatattggcgctcccgaacctattctaagggattggcggtggcacatcagctag

SEQ ID NO: 27527 - DNA, 288 bp, Artificial Sequence
  Description of Artificial Sequence: Synthetic coding sequence
atgccccattctagcgctcacaaaacagctcaacctaacggggactggacctaccagactctgtcccatctagccttaacgccctcatatggagacacctacacctgcgtagtagagcacatcggggcacctgaacccattctcagggattggacgcccggactctcccccatgcagacactcaaagtgagcgtgtccgcagtgactctcggactcggcctgatcattttctccctgggagtgatctcttggcggcgtgctggccactcgaggtggcacatctcctag

SEQ ID NO: 27528 - DNA, 207 bp, Artificial Sequence
  Description of Artificial Sequence: Synthetic coding sequence
atgccacactcctccgcccataagactgcccagcctaacggcgattggacataccaaacactcagccatctggcgcttacaccttcatatggagatacttacacttgtgttgttgaacacatcggcgcccccgagcctattcttcgcgactggtcttatacccctctgcccgggagtaattacagcgaaggatggcatatctcttag

SEQ ID NO: 27529 - DNA, 207 bp, Artificial Sequence
  Description of Artificial Sequence: Synthetic coding sequence
atgcctcacagttcagctcacaagacggcccagcctaacggtgactggacttaccagacacttagccacctggccttgactccctcctacggagacacttacacgtgtgtggtggagcatatcggcgcgcccgagcccatccttagagattggtcttacacccccctgcccggttctaactactccgaaggttggcacatttcctag

SEQ ID NO: 27530 - DNA, 288 bp, Artificial Sequence
  Description of Artificial Sequence: Synthetic coding sequence
atgcctcactccagcgcacacaagactgcgcagccgaatggggattggacctaccagactctttcacacctggctctgacgcccagctacggggacacgtatacatgcgttgtggagcacatcggcgcccccgagccaatactacgcgactggacccctggcctgtcacctatgcaaaccttaaaagtatcggtctctgcagtcaccctggggcttggcctgatcatcttctcccttggcgtcattagctggcgacgtgccgggcattcgaggtggcacatatcatag

SEQ ID NO: 27531 - DNA, 651 bp, Artificial Sequence
  Description of Artificial Sequence: Synthetic coding sequence
atgatcacctttctgccactgctgctgggacttagcctaggctgtaccggagccggagggtttgtcgcccacgtcgaaagcacctgcctgcttgatgatgctggaacccccaaagattttacttattgtatcagctttaataaggatctactcacatgttgggaccctgaggaaaacaaaatggccccttgtgaattcggcgtgctcaatagcctcgccaatgttctctcccagcacctgaaccaaaaagacacccttatgcagcggttgaggaacgggctgcagaactgcgcaacacatacccaaccattttggggatctctaacgaatagaacgcgtcccccctccgtgcaagtggctaagacgaccccgtttaacaccagagaacctgttatgcttgcctgctatgtgtggggtttctatccagcagaggtgacgatcacatggcgtaagaatgggaaactggtcatgcctcacagctctgctcacaagactgcccagccaaacggtgactggacttaccaaacattgagccacctggcgctgacacctagttacggggatacctatacatgcgtagtggagcacattggcgctccagagcccatcctccgcgactggagtaagtgcatggctgacggctggaattag

SEQ ID NO: 27532 - DNA, 207 bp, Artificial Sequence
  Description of Artificial Sequence: Synthetic coding sequence
atgcctcacagctcggctcacaaaacagcgcagccaaacggggattggacataccagaccctgtcccacctggccctgactccttcctacggcgatacatacacctgcgtcgtggagcatatcggggccccggagcctatcttacgggattggagctatacaccgctgcccggatctaattacagtgaaggctggcacataagctag

SEQ ID NO: 27533 - DNA, 651 bp, Artificial Sequence
  Description of Artificial Sequence: Synthetic coding sequence
atgattacatttttgccgctcctgttgggattatcgttaggatgtacgggtgcagggggatttgttgcccatgttgagagcacctgcctcctagatgatgccggcacccctaaagatttcacttactgcattagcttcaataaagatctcttgacatgttgggatcccgaggaaaataaaatggccccttgtgagttcggcgtcctcaattccctggccaacgtcctctcacagcacctgaatcagaaggacaccctgatgcagagactgaggaacggcttgcagaactgtgctacacatactcagcccttttgggggtcattgacaaatcggaccagaccgcctagtgttcaggtcgctaaaaccaccccgttcaacaccagggaaccagttatgcttgcttgttacgtatggggattctaccctgcagaagttactattacatggagaaagaatggaaaactggtgatgccacacagttctgcccacaagacggcgcaaccaaacggagactggacctatcagaccctgagtcacttagccttgactccttcttacggggacacttatacatgtgtagtcgaacatactggcgctccggaacccatcctgcgcgactggtcaaaatgtatggcagacgggtggaactag

SEQ ID NO: 27534 - DNA, 651 bp, Artificial Sequence
  Description of Artificial Sequence: Synthetic coding sequence
atgattacattccttcctctgttgctgggtctgtccctgggctgtacgggcgctggagggtttgtggctcacgtcgaaagcacatgcctcctcgatgatgctgggacccccaaggacttcacgtattgcattagtttcaataaggacttgttaacctgttgggatcccgaagagaacaaaatggccccttgcgagtttggcgttctgaacagcttggccaacgttctctcacagcatctgaatcagaaggacacactaatgcagcggttgaggaatggcctgcaaaactgcgccactcacacccagcccttctggggctccctgactaaccgtacaagaccgccatccgtgcaggtggctaagacaacaccattcaacacccgagagcccgtgatgctggcctgttacgtgtgggggttctatcccgccgaggtgaccattacatggcggaagaatgggaagttagttatgcctcattcctcagctcacaaaaccgcccagcccaatggggattggacctaccagactttgtcccacctggccttgactccctcatatggtgacacctatacctgcgtggttgaacacacaggtgcccctgagccaattttacgggactggagcaagtgtatggcggacgggtggaactag

SEQ ID NO: 27535 - DNA, 171 bp, Artificial Sequence
  Description of Artificial Sequence: Synthetic coding sequence
atgcctcatagctctgcgcacaaaacagctcagccaaatggcgattggacataccagactctttcccacctggcactgacacccagttacggcgatacttacacgtgcgtggtggaacacattggcgctcccgaacccatcttaagagattggagatggcacatttcttag

SEQ ID NO: 27536 - DNA, 651 bp, Artificial Sequence
  Description of Artificial Sequence: Synthetic coding sequence
atgattacttttctacccctgctactcggattatccctgggttgtactggagccggtggtttcgttgctcacgtcgagtcaacatgtctactggacgacgcaggtacccctaaggacttcacttactgtatttctttcaacaaagatcttctgacatgctgggacccagaggaaaataaaatggccccctgcgagttcggcgtactgaactccctggctaatgtattgtctcagcatctgaaccagaaggacacattaatgcagagactgcggaacggcttgcaaaactgtgctacacacacacagcccttctggggctcattgacaaaccggacacgccccccaagtgtgcaggtagccaaaaccacaccctttaacaccagggaaccagtgatgctggcatgttatgtatggggtttttaccctgcagaagtcaccataacatggagaaaaaatggcaagctcgtgatgcctcatagcagcgcccataagaccgcccagcccaacggggactggacctatcaaaccctcagccacttggcccttactccctcgtacggggacacctacacttgcgtggtggaacatataggagcccctgagccgatcttaagggactggtcgaagtgtatggccgacgggtggaactag

SEQ ID NO: 27537 - DNA, 288 bp, Artificial Sequence
  Description of Artificial Sequence: Synthetic coding sequence
atgccacacagttccgcacacaaaactgcgcaacccaacggggactggacgtatcagaccctatctcaccttgccctcacaccatcctatggcgacacatatacatgtgtcgttgagcatattggtgcacctgagcctatcctgcgggactggacacccgggctctcccccatgcagactttgaaggtgagcgtgagcgccgtgacccttggacttggcttgattattttcagtttgggcgtcatctcttggcgacgggcgggacactctcgttggcatatcagctag

SEQ ID NO: 27538 - DNA, 288 bp, Artificial Sequence
  Description of Artificial Sequence: Synthetic coding sequence
atgccccattcgagtgctcacaagactgcacaacctaatggagactggacatatcaaacgttgtcacacctagcactcactccctcatacggagatacttatacttgcgtcgtggagcacatcggggcgccagaacctatcctgagagattggacaccgggtctctctccaatgcagaccctgaaagtgtcagtgagcgcagttacactcggactcggccttatcattttctcacttggtgtgatttcgtggcgccgcgctggccacagcaggtggcacatctcctag

SEQ ID NO: 27539 - DNA, 651 bp, Artificial Sequence
  Description of Artificial Sequence: Synthetic coding sequence
atgataaccttcctaccgctcctgctcggcctgagtctcggatgcaccggtgccggcggatttgtggcgcatgtcgagtccacctgcttgcttgatgacgctggaacaccaaaggattttacttattgtatctccttcaacaaagatcttctcacctgctgggaccctgaagaaaacaagatggccccatgcgagtttggagtcttgaactcccttgccaatgttcttagccagcatctgaaccagaaagacacactgatgcaacggcttcgcaatgggttacagaattgtgccacacacacccagcccttttggggtagtctaactaatcgcacgcgaccccctagcgtccaggtggctaaaaccacccctttcaatacacgggagcctgtgatgcttgcctgctatgtgtggggattttacccagccgaagtgacaatcacctggagaaagaacggaaagctcgtgatgccacactcctccgctcacaagacggcccagcctaatggcgattggacatatcagactttgtcacacttagcacttactccatcatacggggacacgtacacctgcgtcgtggagcatatcggtgccccagaacccattctgcgggattggtctaaatgcatggccgatggatggaactag

SEQ ID NO: 27540 - DNA, 465 bp, Artificial Sequence
  Description of Artificial Sequence: Synthetic coding sequence
atggctggagggggaccacaggctaatcctgactacctgtttcacgtgatctttctcggagattcaaatgtgggcaaaacaagttttttgcatcttctgcaccaaaattccttcgctaccggactgacggctacagtcttacacccttccttatgtgtcctcggagtggacttcagggtgaaaaccctgcttgtagataacaaatgtttcgtgctgcagctttgggatacagccggacaggaacgctatcatagcatgactcgccagctccttaggaaggccgacggggtggtgttgatgtatgatatcacctcacaggagtccttcgctcacgtcagatactggttggactgtctgcaagatgcagggagtgatggagtggtcattctgttgctcggcaataaaatggactgcgaggaagagaggcaggtgtcagtggaagccgggcagcaacttgctcagtag

SEQ ID NO: 27541 - DNA, 261 bp, Artificial Sequence
  Description of Artificial Sequence: Synthetic coding sequence
atggctttgagagctggactcgttttggggtttcataccctaatgacccttctttcccctcaagaagccggagccaccaaaggacgcgccggtcggcatagacgaaatcaatccccgtctggccatccgggaggagctctgcagcctcagcagtcccaccagcgcgcctccaccggagaccgggctccacaagtgagcggaggagcaggccccgcccagcacccgcatctccaccggggtcagcatttgcccccgtgttag

SEQ ID NO: 27542 - DNA, 261 bp, Artificial Sequence
  Description of Artificial Sequence: Synthetic coding sequence
atggcactacgggcaggcttagtgctgggattccacactctcatgaccctgctgtcgccccaggaggctggtgccactaaaggcagggccggacgccatagaaggaaccagagtccctctggacatcccggaggagctttgcagccacagcagagccaccagcgggcaagcaccggcgatagggcccctcaggtgtcagggggagcgggaccagctcagcatccacacctacatcgaggacaacacttgcccccctgttag

SEQ ID NO: 27543 - DNA, 753 bp, Artificial Sequence
  Description of Artificial Sequence: Synthetic coding sequence
atggcactccgagctggtctggtcctggggttccacaccctcatgacattattgtcaccgcaggaggcaggcgccaccaaagctgatcacatgggctcttatggtccagcattctaccagagttacggggcctcaggtcagtttacacacgagttcgacgaggagcagctttttagtgttgacctcaagaagagcgaggcagtctggaggctcccagagttcggggattttgcccgctttgacccacagggcgggttggccggaatagctgcaattaaagcccatctggatatcctcgtggagcgctcaaatcgctcgcgcgcgattaacgtgccgccgcgagtaacagtgctgccaaagagcagagtggagctgggacagcccaacattctgatctgcatcgtcgataacatattcccccctgttatcaacattacttggcttcgaaacggacagaccgttaccgagggagttgcccagacctctttttactctcagccagatcacctgttcaggaaattccactacctaccattcgtgccctccgccgaggacgtgtacgactgtcaggtggagcactggggactggatgcaccactgctgaggcattgggagctacaggtgccaatcccacctcccgacgctatggagactcttgtgtgcgccctcggcttggcaatcggtctcgtcgggtttctagtgggaacagtgctgatcatcatgggcacatacgtgtcctcggtcccaaggtag

SEQ ID NO: 27544 - DNA, 261 bp, Artificial Sequence
  Description of Artificial Sequence: Synthetic coding sequence
atggctctacgtgctggcctcgtcctcggctttcacacgctgatgacgttgctttcacctcaagaagccggtgctaccaagggatgggctggacggcaccgacgcaaccagagcccctcaggccatcccggtggcgctctgcagccccagcagtctcatcagcgcgcgagtacaggagaccgcgctcctcaggtgagcgggggggcaggtcccgcccaacatcctcacctgcaccgtggacagcacctcccaccatgctag

SEQ ID NO: 27545 - DNA, 261 bp, Artificial Sequence
  Description of Artificial Sequence: Synthetic coding sequence
atggctcttagagcaggactcgtccttgggtttcacactctgatgaccctccttagtccccaggaggccggcgcaacgaagggtcgcgcaggccgccatagacgcaatcagagtccgtccggacacccagggggcgccctgcagccacagcagagtcaccagcgggcatctaccggtgaccgggcacctcaggttagtggcggcgcaggccccgcacaacatccccacctgcatcggggacagcatctgcctccatgttag

SEQ ID NO: 27546 - DNA, 753 bp, Artificial Sequence
  Description of Artificial Sequence: Synthetic coding sequence
atggcattaagggcaggtctggtcttgggatttcatactctgatgaccctgttgagcccccaggaagccggtgctacgaaggccgatcacatgggcagctacggtcccgctttttatcagtcctatggcgcaagtggacagtttacccacgagttcgacgaagagcaattattctcagtcgacttaaagaagtctgaagctgtgtggaggttgcctgagtttggcgacttcgcccggtttgatccccagggcggcctggccgggattgcagcaatcaaggcacacttggacatattagttgagagaagcaaccgcagcagggcaatcaacgtgccgcctagggtcactgtgcttccgaagtctcgtgtggagttaggccaaccaaatattctgatatgcattgtcgacaatattttcccacctgtcattaatattacatggctgcgcaacggtcagacagtgaccgagggggtggctcagacctctttttattcacagccggaccacctgttccgtaaattccattacctcccattcgtgccaagcgctgaggacgtctatgactgtcaggtggagcattggggccttgatgcaccgctcttgcgccattgggaactgcaggttcccatcccaccccctgatgccatggagacgctggtgtgtgccctgggtctcgccatcggtcttgttggcttcctggttgggaccgtcctcatcattatgggaacatatgtgtcgtctgtcccccgctag

SEQ ID NO: 27547 - DNA, 753 bp, Artificial Sequence
  Description of Artificial Sequence: Synthetic coding sequence
atggcactccgggccggacttgtgcttgggtttcacaccctgatgaccctgttgtccccacaggaggcaggagctaccaaggccgaccacatgggctcttatgggccagccttctatcagtcttatggcgcttccggccagtttacccacgaattcgatgaagagcagctgttctcagtggatcttaaaaagtccgaagcagtttggaggctcccagaattcggagatttcgcccggtttgacccccagggcggccttgccggaattgccgccatcaaagcacacctggacattttagtggaaaggagcaacaggagtagggcaattaatgttcctccaagggtgacagtcctgcctaagagccgggtggaattgggacagccgaacattctcatctgtatcgtggataatattttcccgccagtcattaatatcacatggctacgcaatggccaaacggtgacggagggtgtcgcgcagacttcgttctactcacaaccagaccatctatttcgaaaattccactatctacctttcgtgccctccgcagaggatgtttacgattgccaggtggaacattggggactggatgccccacttcttagacattgggaactgcaggtgcctatccctccacctgacgctatggagactctggtttgtgccttgggcctcgcaatcggactggtgggcttcctggtggggaccgttcttatcattatgggtacgtacgtcagtagcgttcccagatag

SEQ ID NO: 27548 - DNA, 186 bp, Artificial Sequence
  Description of Artificial Sequence: Synthetic coding sequence
atggcccttcgagcgggtctggtactcggattccatacccttatgactcttttgtctcctcaggaggccggagctaccaaggccgaccacatgggaagctacggcccaccgagtacctctctcactgcaccaagggcctcgtcccccatgaaccttatgagaaatagttgctctctctggacatag

SEQ ID NO: 27549 - DNA, 753 bp, Artificial Sequence
  Description of Artificial Sequence: Synthetic coding sequence
atggccctgagagctggcctggtgcttggcttccacactctaatgacactgctgtctccccaggaagcaggtgccaccaaggccgatcacatgggcagttacggtccagcattttatcagtcatatggagctagtggccagtttacgcacgagtttgatgaggagcagcttttcagtgtggatctgaaaaaatccgaagccgtgtggaggctgccagagtttggtgatttcgccagatttgatccacagggggggcttgccggtatagcagccatcaaggcacacttggacattctggtggaacgttctaaccgcagtcgggctatcaacgtccctccgcgcgtgactgtcctgcctaaatctagagtggaactgggacaacccaacatacttatctgcattgttgacaacattttccccccagtgattaacattacttggctccggaatggacaaaccgtcaccgaaggagtggctcagacctcattttacagtcagcccgaccacctgtttaggaagtttcactacctccccttcgtcccgtccgctgaggacgtttacgattgtcaggtcgagcactggggcctcgacgcccctctgctgagacattgggagctgcaggtgccaattccaccgcccgacgcgatggagacgctggtctgtgctctgggcctggccattgggttggtgggcttcctggttggcaccgttttaattattatggggacatacgtgtcatcagtgccccggtag

SEQ ID NO: 27550 - DNA, 753 bp, Artificial Sequence
  Description of Artificial Sequence: Synthetic coding sequence
atggccttgagagccggcctagtccttggatttcacacactgatgactctgctttcaccacaagaggctggggccacgaaggccgaccacatggggagttacggacccgccttctatcagtcatatggggcaagtggccagttcactcacgagtttgatgaagaacagctctttagcgtcgatctcaaaaaaagcgaagccgtctggcgcctgccggagttcggagattttgccaggttcgacccccagggcggactcgcagggattgctgccatcaaagcccacttagatatcctggtggaacgtagcaaccggtcccgtgccattaatgtgcccccgagggttacagtcctcccaaagagtcgcgtggaactggggcagccaaacattctgatttgcattgtggacaacatctttccacctgtgattaatatcacatggctgcgaaacggacagactgtgactgaaggggtcgctcagacatcgttctactctcaacctgaccacctgtttcgtaaatttcactatttacctttcgttccttcagcagaggatgtgtacgactgccaggtcgagcactggggactggacgcacctctcctgcgccactgggagctccaggtgcctatcccccccccagacgccatggagacactagtttgcgcgttgggccttgcgataggcctggtggggtttcttgtcggaaccgtgctcataatcatgggtacttacgtgtcatcagtgccgagatag

SEQ ID NO: 27551 - DNA, 261 bp, Artificial Sequence
  Description of Artificial Sequence: Synthetic coding sequence
atggccctccgcgccgggcttgtgctgggcttccacacgttaatgactctgctcagcccccaggaggccggggcaacgaaaggccgcgcggggcgtcaccggagaaatcagtccccatccggtcaccccggaggagcgctgcagccccagcagagccaccaacgcgcctccaccggagatcgcgccccacaggtatcgggtggtgctggacctgcccagcatccacatctgcaccggggacagcaccttcccccctgctag

SEQ ID NO: 27552 - DNA, 615 bp, Artificial Sequence
  Description of Artificial Sequence: Synthetic coding sequence
atgggcagctacggccctgccttctatcagagttacggagcatctggacaattcacccacgagtttgacgaggaacagctcttttccgtcgatctcaagaaaagcgaggccgtctggcggttacccgaatttggggacttcgctaggttcgacccacagggcggccttgctgggatagcagcaattaaagcccatctggatattctggtcgaaagaagtaaccggtcaagggcaatcaacgtgccacccagagtcacagtgctccctaaatctagagtggagctaggacaaccgaacattctcatttgtatcgtggataatatctttccacctgttataaatatcacttggctgagaaacggacagactgttactgaaggggtggcccaaacttcgttctacagccagcccgaccatctgttccgaaaatttcattacctgccgtttgtgccctcagccgaagatgtgtacgactgtcaggtcgaacactgggggctggatgcacctctgttaaggcactggggaaatgatccttcagaacgcaacgatctttgggaaacaccttgtcgaagttcctgggtttgcgattctccctgcgtcctcagtgctctttag

SEQ ID NO: 27553 - DNA, 753 bp, Artificial Sequence
  Description of Artificial Sequence: Synthetic coding sequence
atggcccttagggccggccttgttctcggcttccacaccctgatgacgctcctcagtccacaggaagccggagctacaaaagcagaccacatgggctcttatggacccgccttctaccaatcatacggagcatccggccagtttactcacgaattcgacgaggaacagctgttcagtgtggacctgaagaaatcagaggctgtatggaggttaccagaatttggcgacttcgcccggttcgacccacagggggggctggctggtatcgctgctataaaggcccacctggatatcttagtggaacggtccaacaggtcaagggcaatcaatgtacccccacgagtaacagtcctgcccaaaagtagggtcgagttgggacagcccaatatcctcatctgcatcgtggataacatatttcctccggtcattaacatcacctggttacgcaatgggcaaaccgttactgagggagtggctcagacgagtttctattcccagcccgatcacttgttccgcaagttccattacctgccgtttgtaccatcggcggaggatgtatacgattgtcaggtggaacactggggcctggacgcaccgttgctacgacactgggagctgcaagtacccatccctccccccgatgccatggagaccctcgtgtgcgcgctggggcttgcaataggcctagtcgggtttttggtgggtaccgtactgataattatgggcacctatgtaagctccgttccacggtag

SEQ ID NO: 27554 - DNA, 261 bp, Artificial Sequence
  Description of Artificial Sequence: Synthetic coding sequence
atggctctcagggctggccttgtattaggatttcatacattgatgacgctactgagtccccaggaagcaggcgcaactaagggatgggccggaaggcatcggcggaaccaaagcccttcaggccatcccggcggggccttgcagccacagcagtcacatcagcgtgcatctaccggagatagagctcctcaagtttctggcggtgcaggccctgctcagcacccacacctccaccgggggcaacaccttcctccctgttag

SEQ ID NO: 27555 - DNA, 261 bp, Artificial Sequence
  Description of Artificial Sequence: Synthetic coding sequence
atggcccttcgcgccggactcgtcctgggctttcatactcttatgacgctgctatcgccacaggaggccggcgcaaccaagggacgcgcaggccgacaccggaggaatcaatccccaagtggtcacccaggaggagctttacaaccccagcagagtcaccaacgagcatcaacaggtgatagagcgccacaagtctcaggaggcgctggacctgcgcagcaccctcatctgcacagagggcagcacctccccccttgctag

SEQ ID NO: 27556 - DNA, 186 bp, Artificial Sequence
  Description of Artificial Sequence: Synthetic coding sequence
atggcactgagagctggactggtgctgggcttccatacactcatgacgttactgagtcctcaggaggccggggcaacgaaagcagatcacatggggagctacggccctccgtctacatctcttaccgctccaagagcatcttccccaatgaacttaatgcgcaattcatgtagcctctggacctag

SEQ ID NO: 27557 - DNA, 186 bp, Artificial Sequence
  Description of Artificial Sequence: Synthetic coding sequence
atggctctccgagcaggactggtgcttgggtttcacacccttatgactttgctatcaccacaggaagccggagccactaaggccgatcatatgggctcctacggccccccaagcacctcgctgacagcaccccgcgccagttccccgatgaacttaatgcgcaacagctgctccctctggacatag

SEQ ID NO: 27558 - DNA, 615 bp, Artificial Sequence
  Description of Artificial Sequence: Synthetic coding sequence
atgggatcatatggccccgcattttatcagagctacggcgcctctggccagtttactcacgaattcgacgaggaacagctattttctgtggatttgaaaaaaagcgaagccgtgtggagactcccagaatttggggattttgcccgattcgacccacagggcgggttagccggcattgcagccatcaaggctcatctggatattttggtggagcgttccaaccgtagccgggccatcaacgtgccaccgcgcgttacagtgctgcctaagtctagggtcgaattaggacagccgaatattctgatatgtattgtggataacattttcccaccggtgattaacatcacttggctccggaatgggcagaccgtcaccgagggagtcgcccagaccagtttctattcccaacccgaccacctgttccgcaaattccactacttgccgttcgtgccctctgcggaggatgtgtacgattgtcaggtggagcattgggggcttgatgctccactactgaggcactggggcaacgatcccagcgagcgtaatgacctgtgggaaactccatgtaggtccagctgggtctgtgacagcccttgtgtgctgtcagccttatag

SEQ ID NO: 27559 - DNA, 615 bp, Artificial Sequence
  Description of Artificial Sequence: Synthetic coding sequence
atgggaagttatggcccagccttttaccagtcctacggggccagcggccagttcactcatgaattcgacgaggagcagttgttcagcgttgacttgaagaagagtgaagcagtgtggcggctgcctgagttcggggatttcgccaggtttgatccccagggcggtctggcgggtatcgccgcgataaaagctcacctggatattctggttgaaagaagcaataggtcgcgtgccatcaatgtgcccccccgagtgacagttcttccgaagtcaagggtcgagctcgggcagcccaatatcctgatttgtatcgttgataatatctttccacctgtcatcaacatcacctggctccggaatggtcagacggttacagagggagtcgcccaaacttctttttactcccaaccagatcacttgtttcgaaagtttcactacctcccattcgttcccagcgctgaggatgtgtacgattgtcaagtggaacactggggactagatgcacctctcctgagacactggggcaatgacccaagcgaacggaacgatctgtgggaaaccccatgtaggtctagttgggtgtgtgacagtccatgcgtgctttctgccctgtag

SEQ ID NO: 27560 - DNA, 615 bp, Artificial Sequence
  Description of Artificial Sequence: Synthetic coding sequence
atgggcagctacgggccagcattctatcagtcctacggtgctagcggccagtttactcatgaatttgatgaggagcagctgttttcagttgatttgaagaagagcgaggccgtgtggaggcttcctgagttcggggactttgccagattcgatccccagggcggcctggccggcatcgcagcaatcaaggcccacctggacatattggttgaaagatcgaaccggagccgcgcaatcaatgtgcctcctagagtcacagtgcttcccaaaagccgcgtggaattaggccagcctaatattcttatttgtatcgtagataatatctttccacccgtgattaatatcacatggctgcgaaacggacagaccgtgactgagggagtagctcagacctcattctacagtcaaccagaccacttattcagaaaatttcactacctgccttttgttccaagcgccgaagatgtctatgattgtcaggtagagcactggggattagacgcccccctcctgcggcactggggcaacgacccctccgagaggaatgatctgtgggagaccccctgtagatcaagttgggtctgcgactctccatgcgtgctctccgctctgtag

SEQ ID NO: 27561 - DNA, 186 bp, Artificial Sequence
  Description of Artificial Sequence: Synthetic coding sequence
atggccctgcgggccggactcgtactcggcttccatactttgatgactctgctgtcaccacaagaagccggagctaccaaagctgatcacatggggtcgtatggcccaccctcaacaagcttgacagctcctcgggctagtagccctatgaacttgatgagaaatagctgtagcctttggacatag

SEQ ID NO: 27562 - DNA, 615 bp, Artificial Sequence
  Description of Artificial Sequence: Synthetic coding sequence
atgggctcatatggccctgccttctaccagagttatggcgcctcaggacagtttacacacgaatttgatgaggagcaactgttcagtgtggacctgaaaaagtccgaggccgtctggcgtttacctgaattcggggactttgctcgctttgacccgcaagggggactggcaggcatcgctgcgatcaaggcgcaccttgacattctggtcgaaaggagtaatcgaagcagggctatcaatgttccacctcgggttacagttttgcccaagagtcgggttgaactcgggcaaccgaacatacttatatgtatagtggacaacatattcccccccgtcattaacattacctggctcagaaatggccagacagttaccgagggtgttgcccaaacttccttctacagccaacccgaccacttgttccggaaattccactatttgccttttgttccctctgctgaggatgtttatgactgtcaagtggaacattgggggcttgatgcaccactcctcaggcactgggggaatgacccctccgagcggaatgatttgtgggagacaccatgtaggagctcgtgggtttgtgactccccctgtgtgctgtcggccctgtag

SEQ ID NO: 27563 - DNA, 615 bp, Artificial Sequence
  Description of Artificial Sequence: Synthetic coding sequence
atgggctcttatggacccgcgttttaccagtcctacggagcttccggccagttcacacacgagtttgatgaagagcagctgttttccgtagatctgaagaagagtgaagcagtttggcgactgccagagttcggtgacttcgctagatttgatccccaaggtggattggcaggaatcgccgccattaaggcccatctagatattttggttgaaagatcaaaccgctcccgtgccataaacgtcccaccacgagttaccgtcttaccaaaaagtcgggtcgaactgggtcagcctaatatcctgatctgcatcgtggataatatttttcctcccgtgattaatatcacctggctgagaaatggccagacagtgacagaaggcgtggcccagacctccttttacagtcagcccgatcacctattccgaaaatttcattatttgccattcgtgccaagcgcagaggatgtttacgattgccaggttgagcattgggggctggatgcaccgctgctgagacactggggcaatgacccctccgaaagaaacgacctctgggaaaccccatgtcggtcttcatgggtctgcgacagcccgtgtgtgctgtccgcactatag

SEQ ID NO: 27564 - DNA, 186 bp, Artificial Sequence
  Description of Artificial Sequence: Synthetic coding sequence
atggcgctcagagccggcctggtgctgggtttccatacgttgatgaccctcctgtcgccacaggaagccggcgcaacaaaagctgatcatatgggttcatacggtcctcctagcaccagtctgacagcgcccagagcaagctctcccatgaatcttatgcggaattcatgttctctctggacctag

SEQ ID NO: 27565 - DNA, 186 bp, Artificial Sequence
  Description of Artificial Sequence: Synthetic coding sequence
atggcactgcgagctggcttagtgttggggtttcatacactgatgactttgctctccccacaggaggctggtgccaccaaggcggatcatatgggttcctacgggccgccaagcacatctttgacagcccctcgggcttcatcgcccatgaaccttatgcgtaactcctgtagcctatggacttag

SEQ ID NO: 27566 - DNA, 186 bp, Artificial Sequence
  Description of Artificial Sequence: Synthetic coding sequence
atggccttgcgcgctggactagttctgggatttcacactctgatgaccctcctgtctcctcaagaagcaggggctaccaaagccgaccatatggggagctacggcccaccttcgacttcactgacagcgcctcgagccagcagtccgatgaacctcatgaggaatagctgttcactctggacctag

SEQ ID NO: 27567 - DNA, 615 bp, Artificial Sequence
  Description of Artificial Sequence: Synthetic coding sequence
atgggctcttatggccccgccttttatcaaagctacggtgctagcggtcagtttactcacgagtttgacgaagaacagcttttttctgtagacctcaagaagtcagaggccgtgtggcgtctgccggaatttggagatttcgccaggttcgacccccagggaggactcgcaggcatcgcagcaatcaaggcccacctggatatcttggtggagcgtagcaaccgctcccgggccattaacgttcccccgagagtgaccgtacttcccaaatcacgggtggagttggggcagccaaacatcttaatatgcatcgtcgacaatatcttccccccggtgattaatatcacttggctccgcaacggccagacagtcacagagggtgtggctcaaacttcattttactctcagcccgatcatctgtttaggaagtttcactacctgccatttgttccttctgccgaggacgtgtatgactgccaggtggaacattggggccttgatgcccctctgctgcggcactgggggaatgatcctagtgagaggaatgacctgtgggaaacaccctgccgcagttcttgggtttgcgacagcccgtgcgtgctgagcgccctgtag

SEQ ID NO: 27568 - DNA, 549 bp, Artificial Sequence
  Description of Artificial Sequence: Synthetic coding sequence
taaaaccttacacggctggacagcagcatgacccaggggaccgattccccagaggactttgtcattcaggctaaagcagattgctactttacaaacggcacagaaaaggtacagtttgtggtacgtttcatcttcaacttggaggaatacgtgcggtttgactccgacgtgggaatgttcgtcgcccttacaaagctgggccagcctgacgcagaacagtggaactcgcgccttgacctgctggaacggtcgcggcaggcagtcgacggcgtgtgccgacacaactatcgcctgggagcgccatttaccgtgggccgaaaggaagtgacagtgtacccagaacgtacaccactgctacaccagcataatttgctgcactgttccgtaactgggttttacccgggcgacataaagataaaatggttcttaaacgggcaagaggagcgagcaggggttatgtccacgggccccatccgcaacggggactggactttccagacggttgtgatgctcgagatgacgcctgagctgggtcacgtttacacttag

SEQ ID NO: 27569 - DNA, 822 bp, Artificial Sequence
  Description of Artificial Sequence: Synthetic coding sequence
atgggctctgggtgggtcccttgggttgtggccctgctggtgaacctcactcgactggactcctctatgactcaggggaccgactctcccgaagacttcgtgatacaagccaaagcagattgctactttaccaacgggacagagaaagtccaattcgtggtgaggtttattttcaatctggaggagtacgttcgttttgacagcgacgtaggtatgtttgtggctcttaccaagctgggccagccggacgccgagcagtggaactcaaggctggatctactcgagagaagcagacaagccgttgatggcgtgtgcaggcataactatcgtctgggagccccctttaccgtgggtcggaaagtgcagcctgaggtgacagtgtatccagagcgtacaccccttctccatcagcacaatttacttcactgctccgttactggcttctacccgggggatatcaaaataaagtggtttttaaacggacaagaggaaagagcaggggtgatgagtacagggcccattcgcaatggcgactggacttttcagacagttgtaatgctcgaaatgaccccggaactggggcatgtgtatacctgcctggtcgaccacagtagcttgctctcacctgtcagtgtcgagtggagggctcagagcgagtactcttggcgtaaaatgttgtccggaattgctgccttcttactggggttgatctttcttctggtaggtatagtgatccaattaagagcacagaagggctatgtgagaacccagatgagcggcaacgaggtcagccgagccgtcttgttgccacagagctgctag

SEQ ID NO: 27570 - DNA, 822 bp, Artificial Sequence
  Description of Artificial Sequence: Synthetic coding sequence
atgggctccggatgggtaccatgggtggttgcactacttgtgaacttaacgaggctcgactctagtatgacacaaggcacagactcccctgaggactttgtaattcaggctaaggccgactgttattttacaaatggcacagaaaaagtgcagtttgtggttcggtttatcttcaatctggaggagtatgttagattcgacagtgacgtagggatgttcgtagctctaacaaagctcgggcagccagacgcggagcagtggaacagcaggttagatctcctagagagaagcaggcaggcggtggacggagtgtgtcgccataactacaggctgggcgctccattcaccgtgggcagaaaagtccagcctgaggtcaccgtgtacccagaacggacacctctgctgcaccagcataacctgctgcattgtagcgtgaccggcttctatcctggggatattaaaatcaagtggtttctcaacggccaagaagaacgggccggcgtgatgtcaaccggaccgatccggaatggcgactggacatttcaaaccgtggtcatgctcgagatgactccggaactggggcatgtgtacacctgtctggtcgatcacagctcactgttgtcaccggtttccgtcgagtggagagcacagtctgagtactcttggcgaaagatgctgagcggcatcgctgcattcctactgggtctcattttcctcctcgtaggaattgttatccagcttcgggcacagaagggctacgttcgaacacagatgagtgggaatgaagtttcccgggctgtgttactgccccagtcatgctag

SEQ ID NO: 27571 - DNA, 549 bp, Artificial Sequence
  Description of Artificial Sequence: Synthetic coding sequence
tgaaacttgaccagactggatagctcaatgacacagggtacagatagtcctgaggactttgtgatccaggcaaaggcggattgctattttacaaatgggacggagaaggtgcagtttgtggtcaggtttatttttaatctggaggaatacgtgcgcttcgacagcgacgtgggaatgtttgtcgcacttacaaagcttgggcagcctgacgctgagcagtggaactccagactcgatcttctggagcgctccaggcaggcagtagatggagtatgtagacacaattacagacttggagcccctttcaccgttgggcggaaagaagtcacagtttatcctgagcggacacctctgcttcatcaacataacctgcttcactgcagcgtgactggcttctatcctggcgatatcaaaatcaaatggtttctcaacggccaagaagagagggccggagtgatgtcaactgggcccatccgaaacggtgactggacatttcagacggtggtgatgctggagatgacacccgagctgggacacgtatatacttag

SEQ ID NO: 27572 - DNA, 822 bp, Artificial Sequence
  Description of Artificial Sequence: Synthetic coding sequence
atggggagtggctgggtgccgtgggtggtcgccctgcttgtaaacttaactagactggactcctcgatgacccagggtaccgattctcctgaggactttgtgattcaagctaaggccgattgctactttacaaatgggactgagaaggtccagtttgtggtccggttcatcttcaatttagaagagtatgtgcgctttgattctgatgtgggcatgttcgtcgcccttacaaaattgggtcagcccgacgccgagcagtggaattcccggttggatctactggaacggagccggcaggctgtggatggggtgtgtcggcataattaccggttgggggcgccattcaccgtcggtcgaaaagttcaaccggaagtgacagtgtacccggaacgcacacctctgctacaccaacataatttgctccattgcagtgtaacgggcttctatcccggcgatatcaagatcaaatggtttcttaacggtcaggaagaaagagccggggtcatgagcactggccctattaggaatggggattggacattccagaccgtggtaatgctggaaatgaccccggagctcggccatgtatacacatgcctggtggaccactcctccctgttaagccctgtctccgtcgaatggcgggcacagtcagaatatagctggcgcaagatgctttctggtattgccgctttcctcctgggcctgatctttctgttggtcggaatagtgattcaacttagagcacagaaggggtacgtgcgaacgcaaatgtccgggaatgaggtgtcccgggctgtcttgttgccgcagagctgctag

SEQ ID NO: 27573 - DNA, 549 bp, Artificial Sequence
  Description of Artificial Sequence: Synthetic coding sequence
tgaaacctgacacggttggactcctctatgacgcaggggacagactccccggaagactttgtgatccaagctaaagcggattgctattttactaatggaaccgagaaggtgcagtttgtggtccggttcatcttcaacctggaggagtatgtccgcttcgactcagatgtggggatgttcgtcgcattgacgaaactaggccaacccgacgcggagcagtggaatagccgcctcgatttattggagcgaagtagacaggccgtagatggggtgtgcagacacaactacaggttaggggcgccctttaccgtaggacgcaaagaggttacagtatatcccgagaggacacccctcctacaccagcacaatttgctccactgctcagtgacagggttctatcctggtgatattaagattaagtggttcctgaatggacaggaagagagggccggcgtgatgagcaccgggcctatccggaatggagactggaccttccagaccgtcgtaatgctggagatgacaccagaactggggcatgtgtatacttag

SEQ ID NO: 27574 - DNA, 549 bp, Artificial Sequence
  Description of Artificial Sequence: Synthetic coding sequence
tgaaatctcacccggctggatagctctatgacgcaggggactgactcccccgaagactttgtgatccaggcaaaggccgactgctatttcaccaatggcactgagaaggtgcagttcgttgtgcggtttatcttcaacctggaggagtatgttcgcttcgattccgacgtggggatgttcgttgccctaacaaagctgggacaacctgacgccgagcagtggaactccaggcttgatcttctcgagcgttctcggcaagccgtcgacggcgtgtgcagacataattaccggctcggtgccccatttaccgtaggccgaaaggaggtgaccgtctaccctgaacgcacacccttgcttcaccaacataacctgttacattgttctgtcactggattctatcctggggatataaagatcaaatggtttctgaatggccaagaggaaagggccggggtgatgtccactgggcccattaggaacggagattggacatttcagacagtcgtgatgctcgagatgacaccagaactggggcatgtgtacacatag

SEQ ID NO: 27575 - DNA, 549 bp, Artificial Sequence
  Description of Artificial Sequence: Synthetic coding sequence
tgaaacttaactaggctagattcttctatgacccagggcactgattctccggaagactttgtgattcaggcgaaggccgactgttacttcaccaatgggactgagaaagttcagtttgtggtgagatttatctttaatctggaggagtatgtgcgattcgattcagacgtgggcatgttcgtggccttgacaaagcttggccagccggacgctgaacagtggaattctaggcttgacctcctcgagcgcagccggcaggccgtagacggggtgtgcagacataattacaggctcggagcgccattcaccgttgggcgcaaggaggtcaccgtgtaccccgagcggacacctttgcttcatcagcacaacttgctgcattgcagcgtcacaggcttttatccaggcgatataaaaatcaagtggtttctgaatgggcaggaggagcgggccggcgtcatgagtacgggacctatcagaaacggagactggaccttccagaccgtagtcatgctggaaatgactcctgaactgggtcacgtgtatacttag
